United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 17

SEQ ID NO: 722221 - RNA, 22 nt, Human
agauaacauuuauugaauguaa

SEQ ID NO: 722222 - RNA, 22 nt, Human
caaguccaacaguuuuucagac

SEQ ID NO: 722223 - RNA, 22 nt, Human
aggaggcaggaagucuauggga

SEQ ID NO: 722224 - RNA, 22 nt, Human
agcugccuccuggugccccauc

SEQ ID NO: 722225 - RNA, 22 nt, Human
ggcugaagaacugggagucuca

SEQ ID NO: 722226 - RNA, 21 nt, Human
uucacagaugggaaaacugag

SEQ ID NO: 722227 - RNA, 22 nt, Human
cugugggagcacaugacagaua

SEQ ID NO: 722228 - RNA, 22 nt, Human
augacauaaagcuaugcuaggu

SEQ ID NO: 722229 - RNA, 21 nt, Human
ucugacaaucucauuucaaac

SEQ ID NO: 722230 - RNA, 20 nt, Human
agccagccacuuccugcucc

SEQ ID NO: 722231 - RNA, 20 nt, Human
ggcuucuuuacaucuguguu

SEQ ID NO: 722232 - RNA, 22 nt, Human
augugcaauuauuaagaagaga

SEQ ID NO: 722233 - RNA, 22 nt, Human
gagguggccaagcgaggaaggg

SEQ ID NO: 722234 - RNA, 22 nt, Human
uauuucuauuccccaggcaagu

SEQ ID NO: 722235 - RNA, 22 nt, Human
gaggagaaugcgcaccacauau

SEQ ID NO: 722236 - RNA, 22 nt, Human
uuucugugaauuauaaaauuug

SEQ ID NO: 722237 - RNA, 22 nt, Human
ugcaggagacauaauagggacu

SEQ ID NO: 722238 - RNA, 22 nt, Human
cuuauuugaauguaugaguuuu

SEQ ID NO: 722239 - RNA, 18 nt, Human
aagccagagaccacugcc

SEQ ID NO: 722240 - RNA, 22 nt, Human
augcuaaacuaugaucauuuuc

SEQ ID NO: 722241 - RNA, 22 nt, Human
auggguggccccgugugcaguc

SEQ ID NO: 722242 - RNA, 22 nt, Human
ugggucagagcugugcugccca

SEQ ID NO: 722243 - RNA, 22 nt, Human
uauggaaaaauguaucuuguca

SEQ ID NO: 722244 - RNA, 22 nt, Human
ggcccagaagccagaagccucc

SEQ ID NO: 722245 - RNA, 22 nt, Human
augcacuuuguaaucuguucaa

SEQ ID NO: 722246 - RNA, 22 nt, Human
uuucagagaacugaguccuugc

SEQ ID NO: 722247 - RNA, 22 nt, Human
acccaggagccgugagagguua

SEQ ID NO: 722248 - RNA, 22 nt, Human
uagaacaugcucauguauaaau

SEQ ID NO: 722249 - RNA, 22 nt, Human
gcaaagacugcaauuacuuuug

SEQ ID NO: 722250 - RNA, 22 nt, Human
uggauuaguuucaaggcagcaa

SEQ ID NO: 722251 - RNA, 22 nt, Human
uagguaguuuccuguuguuggg

SEQ ID NO: 722252 - RNA, 22 nt, Human
augugagaauaacucaaaacaa

SEQ ID NO: 722253 - RNA, 21 nt, Human
auuggcacaccuuuuauugga

SEQ ID NO: 722254 - RNA, 22 nt, Human
aacaugcucuuccuggcuaguc

SEQ ID NO: 722255 - RNA, 22 nt, Human
aaagcauggcaugaagaacaug

SEQ ID NO: 722256 - RNA, 22 nt, Human
acaggaguggagaggugccucu

SEQ ID NO: 722257 - RNA, 22 nt, Human
aaggaucuuucuuuuuaccauu

SEQ ID NO: 722258 - RNA, 22 nt, Human
ugugagcuuaggacagggcuau

SEQ ID NO: 722259 - RNA, 22 nt, Human
caguacuuugaagauauuuuag

SEQ ID NO: 722260 - RNA, 22 nt, Human
agaucugaguaugauuugccug

SEQ ID NO: 722261 - RNA, 22 nt, Human
ugagcaguaggucugaauagug

SEQ ID NO: 722262 - RNA, 22 nt, Human
ucuguuuucucuguauuuugac

SEQ ID NO: 722263 - RNA, 22 nt, Human
uccucaggaugugggguagaau

SEQ ID NO: 722264 - RNA, 22 nt, Human
cagcaggaagguuuccccugca

SEQ ID NO: 722265 - RNA, 22 nt, Human
acagacagacagagaacuauuc

SEQ ID NO: 722266 - RNA, 22 nt, Human
auggccaguuagaaaucaaaaa

SEQ ID NO: 722267 - RNA, 20 nt, Human
ugggagcuggugaggucuca

SEQ ID NO: 722268 - RNA, 22 nt, Human
agcucuguguucacagcacuaa

SEQ ID NO: 722269 - RNA, 22 nt, Human
auuacuguuggcaaagucuuau

SEQ ID NO: 722270 - RNA, 22 nt, Human
gggccagugggaccugggucuc

SEQ ID NO: 722271 - RNA, 22 nt, Human
aaacuugacagugagacaguuu

SEQ ID NO: 722272 - RNA, 22 nt, Human
guuucucacaaggcugcaaucc

SEQ ID NO: 722273 - RNA, 22 nt, Human
ccuuuaauuuacaauguuaauu

SEQ ID NO: 722274 - RNA, 22 nt, Human
uaaauuuuuguuaacagccucu

SEQ ID NO: 722275 - RNA, 22 nt, Human
uuacagcacagugcuuuuacug

SEQ ID NO: 722276 - RNA, 20 nt, Human
ccugcugggaacccucugaa

SEQ ID NO: 722277 - RNA, 22 nt, Human
cagggaugagagauggcacaga

SEQ ID NO: 722278 - RNA, 22 nt, Human
gcacccaugcucuugucucagg

SEQ ID NO: 722279 - RNA, 22 nt, Human
cucaguuuccucaacugcaaaa

SEQ ID NO: 722280 - RNA, 22 nt, Human
gcagcccugcagcuccacaccg

SEQ ID NO: 722281 - RNA, 22 nt, Human
ucagcccaccugguguggggcu

SEQ ID NO: 722282 - RNA, 22 nt, Human
ggucugaggugggacccaggaa

SEQ ID NO: 722283 - RNA, 19 nt, Human
agaaaaacugguacugcug

SEQ ID NO: 722284 - RNA, 22 nt, Human
accccaggaaguggaggucaug

SEQ ID NO: 722285 - RNA, 22 nt, Human
ggugggagccaacacccuucug

SEQ ID NO: 722286 - RNA, 22 nt, Human
uuucucucugacugggagcuga

SEQ ID NO: 722287 - RNA, 22 nt, Human
uacucucuggaaauuauaguga

SEQ ID NO: 722288 - RNA, 22 nt, Human
agcaggagcugugggaagaugg

SEQ ID NO: 722289 - RNA, 22 nt, Human
uggcugugccucuuuccaggcc

SEQ ID NO: 722290 - RNA, 22 nt, Human
ccaggagacaaagaugacugcu

SEQ ID NO: 722291 - RNA, 23 nt, Human
uccaggagcaugcuggcuggcga

SEQ ID NO: 722292 - RNA, 22 nt, Human
gcuccuggauguucaagucggc

SEQ ID NO: 722293 - RNA, 22 nt, Human
gaagcagcgaaguggaagggac

SEQ ID NO: 722294 - RNA, 22 nt, Human
agggagagaaguuauacaagau

SEQ ID NO: 722295 - RNA, 22 nt, Human
cagggccuucguaaguguccgg

SEQ ID NO: 722296 - RNA, 22 nt, Human
caaaguuaugaaugauaagauu

SEQ ID NO: 722297 - RNA, 22 nt, Human
cugcugucaaaggaaauauuug

SEQ ID NO: 722298 - RNA, 22 nt, Human
ugggacuuaauaugcccuugau

SEQ ID NO: 722299 - RNA, 22 nt, Human
gccauucauauuuuagcauuaa

SEQ ID NO: 722300 - RNA, 22 nt, Human
ugaugaaaauaugauucugagg

SEQ ID NO: 722301 - RNA, 22 nt, Human
aagcacagggugucugcauuca

SEQ ID NO: 722302 - RNA, 22 nt, Human
aagccaguauucaauggggcua

SEQ ID NO: 722303 - RNA, 22 nt, Human
aguauguggcacagaauuucuu

SEQ ID NO: 722304 - RNA, 22 nt, Human
gaagggcugcaggucugggccc

SEQ ID NO: 722305 - RNA, 22 nt, Human
ucagaggugagcuucuugcuaa

SEQ ID NO: 722306 - RNA, 22 nt, Human
uuuuauucucagcuccagagag

SEQ ID NO: 722307 - RNA, 22 nt, Human
caaguccucaaagggcucugcu

SEQ ID NO: 722308 - RNA, 22 nt, Human
gcugaggguaacacuucgggau

SEQ ID NO: 722309 - RNA, 22 nt, Human
uaucauucuucucaccuuugaa

SEQ ID NO: 722310 - RNA, 22 nt, Human
auucuguaauugaacuguguug

SEQ ID NO: 722311 - RNA, 22 nt, Human
uccaggggagacuagacccaca

SEQ ID NO: 722312 - RNA, 22 nt, Human
agaaucaauuagauucuaugag

SEQ ID NO: 722313 - RNA, 22 nt, Human
aaagccagaguguguuagagac

SEQ ID NO: 722314 - RNA, 22 nt, Human
aaauccaguggguccucaugag

SEQ ID NO: 722315 - RNA, 22 nt, Human
gaaguucuuagucucauuugca

SEQ ID NO: 722316 - RNA, 22 nt, Human
gcacagccacugagugagaacc

SEQ ID NO: 722317 - RNA, 23 nt, Human
cucaccaagcgccgccgcugugu

SEQ ID NO: 722318 - RNA, 22 nt, Human
acuuucucaggaauucacagac

SEQ ID NO: 722319 - RNA, 22 nt, Human
cuccaaggguugugggugguca

SEQ ID NO: 722320 - RNA, 22 nt, Human
uuccuuccauagcaaaacaugc

SEQ ID NO: 722321 - RNA, 22 nt, Human
uuccuggucccguucuucacug

SEQ ID NO: 722322 - RNA, 22 nt, Human
auccuugagccaaugacugauu

SEQ ID NO: 722323 - RNA, 22 nt, Human
uuaaugcagcucuaccacacag

SEQ ID NO: 722324 - RNA, 22 nt, Human
gaagaacugaaaguugaugcac

SEQ ID NO: 722325 - RNA, 22 nt, Human
agccaggaagaaggucacacca

SEQ ID NO: 722326 - RNA, 22 nt, Human
gaugaaggggcuggugcccucu

SEQ ID NO: 722327 - RNA, 22 nt, Human
acuggccuaucagcaugagucu

SEQ ID NO: 722328 - RNA, 22 nt, Human
auuggagacagaugggcuccag

SEQ ID NO: 722329 - RNA, 22 nt, Human
auucaaaguacuagcuauuuuu

SEQ ID NO: 722330 - RNA, 22 nt, Human
uccacagugguggaauuguuca

SEQ ID NO: 722331 - RNA, 22 nt, Human
uaagaacagauaaaguuucccc

SEQ ID NO: 722332 - RNA, 22 nt, Human
gaggagcuguucccucaccucu

SEQ ID NO: 722333 - RNA, 22 nt, Human
cugucagagauggggagucaga

SEQ ID NO: 722334 - RNA, 22 nt, Human
ucccuacuguuagggacucagc

SEQ ID NO: 722335 - RNA, 22 nt, Human
guuugccugccgacgcucucau

SEQ ID NO: 722336 - RNA, 22 nt, Human
ugaguccacuuuaaaaugucag

SEQ ID NO: 722337 - RNA, 22 nt, Human
auuguagcccaugcauaaaccg

SEQ ID NO: 722338 - RNA, 18 nt, Human
uggccccuuaucaguccu

SEQ ID NO: 722339 - RNA, 22 nt, Human
agcccaggaaucugcaucuuga

SEQ ID NO: 722340 - RNA, 22 nt, Human
ccaagaggggcagagggcugca

SEQ ID NO: 722341 - RNA, 22 nt, Human
gcagcaaucuucacagugucau

SEQ ID NO: 722342 - RNA, 22 nt, Human
ucaaacuguuuacagugagaua

SEQ ID NO: 722343 - RNA, 22 nt, Human
acauugaauucaaaauuacuga

SEQ ID NO: 722344 - RNA, 23 nt, Human
ccuucuguuaaccaucugggggg

SEQ ID NO: 722345 - RNA, 22 nt, Human
ucaggcugguccccacagugga

SEQ ID NO: 722346 - RNA, 22 nt, Human
gguggacaguguuagcucuggg

SEQ ID NO: 722347 - RNA, 22 nt, Human
caggaggagcauuagcgucuca

SEQ ID NO: 722348 - RNA, 22 nt, Human
aacagaauuguacaccagggag

SEQ ID NO: 722349 - RNA, 22 nt, Human
auuucuugugggaaaugcagca

SEQ ID NO: 722350 - RNA, 22 nt, Human
acacaugcucauaaauaaauag

SEQ ID NO: 722351 - RNA, 22 nt, Human
gcugucugggaggccuccacuu

SEQ ID NO: 722352 - RNA, 20 nt, Human
augggcugguuaggaagugu

SEQ ID NO: 722353 - RNA, 22 nt, Human
ucaggaagcauccugagguguc

SEQ ID NO: 722354 - RNA, 22 nt, Human
aacaggcagcagacugaaucug

SEQ ID NO: 722355 - RNA, 22 nt, Human
cugucccuucccaagcccagcc

SEQ ID NO: 722356 - RNA, 22 nt, Human
gcaaagcagaacccucucuauc

SEQ ID NO: 722357 - RNA, 22 nt, Human
aggguagggccguagggccaug

SEQ ID NO: 722358 - RNA, 22 nt, Human
ucugucaccccuguuucuggcu

SEQ ID NO: 722359 - RNA, 22 nt, Human
aucuguuauuuacccaucucug

SEQ ID NO: 722360 - RNA, 22 nt, Human
guuaagugaaugucaugucagg

SEQ ID NO: 722361 - RNA, 22 nt, Human
guguguggcaaacugggccugc

SEQ ID NO: 722362 - RNA, 22 nt, Human
uuucaacaggaugauaauaggc

SEQ ID NO: 722363 - RNA, 22 nt, Human
gugcaggaucucagaacaagug

SEQ ID NO: 722364 - RNA, 22 nt, Human
ucuucaauuuagaauggauuua

SEQ ID NO: 722365 - RNA, 21 nt, Human
cagugggcugcugcgcuccag

SEQ ID NO: 722366 - RNA, 17 nt, Human
cagaggagcuuuggggg

SEQ ID NO: 722367 - RNA, 22 nt, Human
aaugcacaugccacauguggua

SEQ ID NO: 722368 - RNA, 22 nt, Human
augugaaaaauuucuuauuaca

SEQ ID NO: 722369 - RNA, 22 nt, Human
agcauguguggagaaauauuuu

SEQ ID NO: 722370 - RNA, 22 nt, Human
aagaggugccagggguuuugua

SEQ ID NO: 722371 - RNA, 22 nt, Human
aagccaggagcgaggccucggc

SEQ ID NO: 722372 - RNA, 22 nt, Human
uguuuacaaggagaauuugagg

SEQ ID NO: 722373 - RNA, 22 nt, Human
uaacaacucaguuuguuccuug

SEQ ID NO: 722374 - RNA, 22 nt, Human
agccacaaaggcuugccucgga

SEQ ID NO: 722375 - RNA, 22 nt, Human
acauacuugaagcaagugauca

SEQ ID NO: 722376 - RNA, 22 nt, Human
cucucuggaagggggagcugau

SEQ ID NO: 722377 - RNA, 22 nt, Human
acaagauagcuuagaagauuca

SEQ ID NO: 722378 - RNA, 22 nt, Human
cacugccugugagcugugugcc

SEQ ID NO: 722379 - RNA, 22 nt, Human
aaguccuuuccaguccugugau

SEQ ID NO: 722380 - RNA, 22 nt, Human
cauuaucugagaguguccuaca

SEQ ID NO: 722381 - RNA, 22 nt, Human
agguuccagggauuaggaugug

SEQ ID NO: 722382 - RNA, 23 nt, Human
cagaaauaaacugguuuguagau

SEQ ID NO: 722383 - RNA, 22 nt, Human
aauacuuaugugaccucauuuu

SEQ ID NO: 722384 - RNA, 22 nt, Human
uuucauugacaguugggggaaa

SEQ ID NO: 722385 - RNA, 22 nt, Human
ucaaagguuaacucuguuguuc

SEQ ID NO: 722386 - RNA, 22 nt, Human
aagauucuuaaauuuguuucuc

SEQ ID NO: 722387 - RNA, 22 nt, Human
ccaaaauguuugaaugcaugug

SEQ ID NO: 722388 - RNA, 23 nt, Human
aaaugcacaguauugauuuuuaa

SEQ ID NO: 722389 - RNA, 22 nt, Human
uuacacaaacacauuccagaua

SEQ ID NO: 722390 - RNA, 22 nt, Human
uuuaaugaauaauucaaaucug

SEQ ID NO: 722391 - RNA, 22 nt, Human
auacagcugccuucuaacuaug

SEQ ID NO: 722392 - RNA, 22 nt, Human
uguguuguuuuaagcugcugca

SEQ ID NO: 722393 - RNA, 22 nt, Human
ggcagugaaaaaguauguuucc

SEQ ID NO: 722394 - RNA, 22 nt, Human
cagcaggguuaagugacucacc

SEQ ID NO: 722395 - RNA, 22 nt, Human
ggccagaguugauggcaucuug

SEQ ID NO: 722396 - RNA, 19 nt, Human
ucuuggcuuugucuacugu

SEQ ID NO: 722397 - RNA, 23 nt, Human
ggccaggugcaccuuagagagcc

SEQ ID NO: 722398 - RNA, 22 nt, Human
cauugacaucaggcuuggccaa

SEQ ID NO: 722399 - RNA, 22 nt, Human
auggucacagagcuuaauuaau

SEQ ID NO: 722400 - RNA, 19 nt, Human
augggaagcggccagcgga

SEQ ID NO: 722401 - RNA, 22 nt, Human
aaaguccuuuuugccaugcaag

SEQ ID NO: 722402 - RNA, 22 nt, Human
aaagguuuugguaaggcuuuaa

SEQ ID NO: 722403 - RNA, 22 nt, Human
acaggcagagaacucagccaga

SEQ ID NO: 722404 - RNA, 22 nt, Human
uauuuaucaagguaggagaaua

SEQ ID NO: 722405 - RNA, 22 nt, Human
uucacccugagccccaccucug

SEQ ID NO: 722406 - RNA, 22 nt, Human
guccagagggucaaguuucuug

SEQ ID NO: 722407 - RNA, 22 nt, Human
ugaugaggaccuggucucugcu

SEQ ID NO: 722408 - RNA, 22 nt, Human
acauggggcccaaagagagguc

SEQ ID NO: 722409 - RNA, 21 nt, Human
ugauuucugccaaguucacua

SEQ ID NO: 722410 - RNA, 22 nt, Human
auuacaaucgagagaaacaaau

SEQ ID NO: 722411 - RNA, 22 nt, Human
aaagccauaagccuaauacuaa

SEQ ID NO: 722412 - RNA, 22 nt, Human
gcugacagagugccuggccuca

SEQ ID NO: 722413 - RNA, 22 nt, Human
gcagacagccagacugcacugg

SEQ ID NO: 722414 - RNA, 22 nt, Human
gucuacuuuugucaucauugca

SEQ ID NO: 722415 - RNA, 22 nt, Human
cacaugguggugcuugauaagc

SEQ ID NO: 722416 - RNA, 22 nt, Human
gucacacaauaguaaguggucc

SEQ ID NO: 722417 - RNA, 22 nt, Human
caguuugugcuaggcacuauuu

SEQ ID NO: 722418 - RNA, 22 nt, Human
ggcagugcaaggcagccuggau

SEQ ID NO: 722419 - RNA, 22 nt, Human
cacaguuuaugaucucagugaa

SEQ ID NO: 722420 - RNA, 22 nt, Human
uugcaucaaauauguaccacag

SEQ ID NO: 722421 - RNA, 22 nt, Human
agaagccaacagggcaggagag

SEQ ID NO: 722422 - RNA, 19 nt, Human
uuucaauggcuuagagaaa

SEQ ID NO: 722423 - RNA, 22 nt, Human
cauccugaagaagccgcacugu

SEQ ID NO: 722424 - RNA, 22 nt, Human
aguuagugugauggagguacga

SEQ ID NO: 722425 - RNA, 22 nt, Human
cuccugggcuucgaaggcuccc

SEQ ID NO: 722426 - RNA, 20 nt, Human
accugaggucccuauggucu

SEQ ID NO: 722427 - RNA, 22 nt, Human
ugccuuuucuguagcucuggaa

SEQ ID NO: 722428 - RNA, 22 nt, Human
gggaguguugagcgcccugcca

SEQ ID NO: 722429 - RNA, 22 nt, Human
ccugccagggccagaggccagc

SEQ ID NO: 722430 - RNA, 20 nt, Human
uuaucugucaaucugucuca

SEQ ID NO: 722431 - RNA, 22 nt, Human
gcucucuuucacagagguagga

SEQ ID NO: 722432 - RNA, 22 nt, Human
acccaggagagagcuauaaaau

SEQ ID NO: 722433 - RNA, 22 nt, Human
uuccgagggcucggcggccgcc

SEQ ID NO: 722434 - RNA, 22 nt, Human
ggaugggcagacaggacggcac

SEQ ID NO: 722435 - RNA, 22 nt, Human
cacacacaguuuuguauucugu

SEQ ID NO: 722436 - RNA, 22 nt, Human
aggagacccaaugccagaaaga

SEQ ID NO: 722437 - RNA, 22 nt, Human
uagagagccaguugucauaguu

SEQ ID NO: 722438 - RNA, 22 nt, Human
uuucaugaggcugcauaaggag

SEQ ID NO: 722439 - RNA, 18 nt, Human
cuugcaguguguggagaa

SEQ ID NO: 722440 - RNA, 22 nt, Human
ucaggagcagccuuggagagcg

SEQ ID NO: 722441 - RNA, 22 nt, Human
ugcaauacauacuuagacccag

SEQ ID NO: 722442 - RNA, 22 nt, Human
uggcuggaaacaggagauucag

SEQ ID NO: 722443 - RNA, 22 nt, Human
auugcaccuuggguuuugaaag

SEQ ID NO: 722444 - RNA, 22 nt, Human
caguucuggaguuucauucuuu

SEQ ID NO: 722445 - RNA, 22 nt, Human
aaagaaggaugggagaaauccu

SEQ ID NO: 722446 - RNA, 22 nt, Human
aguaaacaguaucuuuaguguc

SEQ ID NO: 722447 - RNA, 20 nt, Human
cacaggcuuacaguuuagau

SEQ ID NO: 722448 - RNA, 22 nt, Human
uacauggguagguuaagucaua

SEQ ID NO: 722449 - RNA, 22 nt, Human
aaugguuucaaacacacuaagu

SEQ ID NO: 722450 - RNA, 22 nt, Human
cugaaaauguuagugauacgaa

SEQ ID NO: 722451 - RNA, 22 nt, Human
agcaggaaucuguucuguauaa

SEQ ID NO: 722452 - RNA, 22 nt, Human
uccucggcugggccccaggcuu

SEQ ID NO: 722453 - RNA, 22 nt, Human
uuuauguacauauccacaagga

SEQ ID NO: 722454 - RNA, 22 nt, Human
ugauuacaaaagauuguuugaa

SEQ ID NO: 722455 - RNA, 22 nt, Human
ucugaagcacagcaggaagggu

SEQ ID NO: 722456 - RNA, 19 nt, Human
cucuggagaacaauagugc

SEQ ID NO: 722457 - RNA, 22 nt, Human
gaggguggguuucuugcacguc

SEQ ID NO: 722458 - RNA, 22 nt, Human
uagcucugaggccaucuccggu

SEQ ID NO: 722459 - RNA, 22 nt, Human
uucuuacauuacuuuacaugug

SEQ ID NO: 722460 - RNA, 22 nt, Human
agcagacaacccagaugaccca

SEQ ID NO: 722461 - RNA, 22 nt, Human
aucacaaucccucucucugaua

SEQ ID NO: 722462 - RNA, 22 nt, Human
gaggccagaaugagucucuggg

SEQ ID NO: 722463 - RNA, 22 nt, Human
auuuggucuccauacugguuag

SEQ ID NO: 722464 - RNA, 22 nt, Human
cugagggagaagugaucucuac

SEQ ID NO: 722465 - RNA, 22 nt, Human
aggguggaagauggcacuaucu

SEQ ID NO: 722466 - RNA, 22 nt, Human
acauuugguaacacuugagcau

SEQ ID NO: 722467 - RNA, 22 nt, Human
acagggucauuuuaugaucugu

SEQ ID NO: 722468 - RNA, 19 nt, Human
caggaaugagguaauggcu

SEQ ID NO: 722469 - RNA, 22 nt, Human
ucuaccacucaugcuacuuacu

SEQ ID NO: 722470 - RNA, 22 nt, Human
uggcaguggcgggacucagggc

SEQ ID NO: 722471 - RNA, 22 nt, Human
gaggaccacagaugagccugca

SEQ ID NO: 722472 - RNA, 22 nt, Human
ccugucucccuggcauggcuca

SEQ ID NO: 722473 - RNA, 22 nt, Human
uguccugugccaccuuccugag

SEQ ID NO: 722474 - RNA, 22 nt, Human
aggauucgggcauaaagccauu

SEQ ID NO: 722475 - RNA, 22 nt, Human
aggcauggcacugagcagcuuc

SEQ ID NO: 722476 - RNA, 22 nt, Human
cuuacauugucuuaguuuucaa

SEQ ID NO: 722477 - RNA, 22 nt, Human
ccacugcccaccccgacgucua

SEQ ID NO: 722478 - RNA, 23 nt, Human
gauacacucccugcugggcacug

SEQ ID NO: 722479 - RNA, 22 nt, Human
aggccacaggauugcacagcau

SEQ ID NO: 722480 - RNA, 17 nt, Human
ggcugcaguccaggagg

SEQ ID NO: 722481 - RNA, 22 nt, Human
ugguggaaauaaacauccaauu

SEQ ID NO: 722482 - RNA, 22 nt, Human
uuuaaacuguugauuuuaugaa

SEQ ID NO: 722483 - RNA, 22 nt, Human
uucuguucugauacuuguuucu

SEQ ID NO: 722484 - RNA, 22 nt, Human
aucuggagcaagauuaagagau

SEQ ID NO: 722485 - RNA, 22 nt, Human
auucugucagaucuuacuggau

SEQ ID NO: 722486 - RNA, 22 nt, Human
ggaagcagccugaagccaaggg

SEQ ID NO: 722487 - RNA, 22 nt, Human
gauggguggucucagacuugcc

SEQ ID NO: 722488 - RNA, 22 nt, Human
gcuguguccaggugggggugac

SEQ ID NO: 722489 - RNA, 22 nt, Human
agugggaggaaguggugauauu

SEQ ID NO: 722490 - RNA, 22 nt, Human
caguggcugguuagggacagga

SEQ ID NO: 722491 - RNA, 22 nt, Human
aauguaaaauaucuuguacuug

SEQ ID NO: 722492 - RNA, 22 nt, Human
augcacacugggauucaacugg

SEQ ID NO: 722493 - RNA, 22 nt, Human
aguauacauauauuagccuucg

SEQ ID NO: 722494 - RNA, 22 nt, Human
uuugcucuuaugaacaaggugg

SEQ ID NO: 722495 - RNA, 22 nt, Human
aaacuguuauagcagaaaggac

SEQ ID NO: 722496 - RNA, 21 nt, Human
uggagcugccacuugagcugc

SEQ ID NO: 722497 - RNA, 22 nt, Human
aaaucagaggucagcuguacca

SEQ ID NO: 722498 - RNA, 22 nt, Human
uagcagcucacagccucccauu

SEQ ID NO: 722499 - RNA, 22 nt, Human
agaguggggaagguguugagaa

SEQ ID NO: 722500 - RNA, 22 nt, Human
aagcaucuccucaucauuuggg

SEQ ID NO: 722501 - RNA, 22 nt, Human
guauuacauuuaguaauuaggc

SEQ ID NO: 722502 - RNA, 22 nt, Human
caggcccagugaucagggcucu

SEQ ID NO: 722503 - RNA, 22 nt, Human
acagucuucccuuauuccacuc

SEQ ID NO: 722504 - RNA, 22 nt, Human
aggcaguggcugagaccagggg

SEQ ID NO: 722505 - RNA, 22 nt, Human
accaggagggacccugguggcc

SEQ ID NO: 722506 - RNA, 22 nt, Human
uccugagggcauuuuggugacu

SEQ ID NO: 722507 - RNA, 22 nt, Human
uggcuaauggcauuuccugggu

SEQ ID NO: 722508 - RNA, 22 nt, Human
accugcuagaagcaaaugucug

SEQ ID NO: 722509 - RNA, 21 nt, Human
ugggaccuauuucaacuggau

SEQ ID NO: 722510 - RNA, 22 nt, Human
cuuggggcugucacucuggcau

SEQ ID NO: 722511 - RNA, 22 nt, Human
aucagaaaauacccaguguuua

SEQ ID NO: 722512 - RNA, 22 nt, Human
ugccuugcagguuuuaaauaca

SEQ ID NO: 722513 - RNA, 22 nt, Human
uaagaaacaugauuaauggcag

SEQ ID NO: 722514 - RNA, 21 nt, Human
uagcaaagccagauguauauu

SEQ ID NO: 722515 - RNA, 22 nt, Human
ucacacagguuugcaaugauuu

SEQ ID NO: 722516 - RNA, 20 nt, Human
acugggcauaccuguccugu

SEQ ID NO: 722517 - RNA, 22 nt, Human
ugucugaauucaagaaauucaa

SEQ ID NO: 722518 - RNA, 22 nt, Human
augaggccaccuucuacauuuc

SEQ ID NO: 722519 - RNA, 22 nt, Human
cuuuuguuaggagaaaacauca

SEQ ID NO: 722520 - RNA, 22 nt, Human
cacagcagccagaacauuuuug

SEQ ID NO: 722521 - RNA, 22 nt, Human
gaggcugaggguuagagaguca

SEQ ID NO: 722522 - RNA, 22 nt, Human
gcagccacccucaaggcugaau

SEQ ID NO: 722523 - RNA, 22 nt, Human
agccuggagcuugaguuaugag

SEQ ID NO: 722524 - RNA, 21 nt, Human
agaggucauugggcugguucu

SEQ ID NO: 722525 - RNA, 22 nt, Human
uggcuucuagcaguguugauuu

SEQ ID NO: 722526 - RNA, 22 nt, Human
cacuauuuccuggauuuugacg

SEQ ID NO: 722527 - RNA, 22 nt, Human
gggagucugggcuagacuccuu

SEQ ID NO: 722528 - RNA, 20 nt, Human
ccagauggucccugugaaaa

SEQ ID NO: 722529 - RNA, 22 nt, Human
agggcuuuaaugauuauuuucu

SEQ ID NO: 722530 - RNA, 22 nt, Human
caggauggucucgaucuccuga

SEQ ID NO: 722531 - RNA, 22 nt, Human
cagggagcagccccuagaagua

SEQ ID NO: 722532 - RNA, 22 nt, Human
cugggaggauacacaagaucag

SEQ ID NO: 722533 - RNA, 22 nt, Human
aauucauccaugaacaauucca

SEQ ID NO: 722534 - RNA, 22 nt, Human
ugcauuaagugucugcauaugg

SEQ ID NO: 722535 - RNA, 22 nt, Human
ccugggaagucagccaaggacg

SEQ ID NO: 722536 - RNA, 22 nt, Human
ccaggcagcaaauuuucugaau

SEQ ID NO: 722537 - RNA, 22 nt, Human
cuuggaggaaaggcagggagac

SEQ ID NO: 722538 - RNA, 22 nt, Human
ggcugugcgggcagccguggga

SEQ ID NO: 722539 - RNA, 22 nt, Human
gagacacaauuuccccauccua

SEQ ID NO: 722540 - RNA, 22 nt, Human
agcauuuccgcccucuucugcc

SEQ ID NO: 722541 - RNA, 22 nt, Human
uggacccccucaaggcagagcu

SEQ ID NO: 722542 - RNA, 22 nt, Human
aggucuggagugggaucugaga

SEQ ID NO: 722543 - RNA, 19 nt, Human
aggcuucuacccuguccag

SEQ ID NO: 722544 - RNA, 22 nt, Human
uuauuuccucucuaauagggua

SEQ ID NO: 722545 - RNA, 22 nt, Human
accaugcaucaaagcuaauaua

SEQ ID NO: 722546 - RNA, 22 nt, Human
agcagccacacgccuccuucuc

SEQ ID NO: 722547 - RNA, 22 nt, Human
guaaacaccuguuaaauucaga

SEQ ID NO: 722548 - RNA, 22 nt, Human
cgcaccacugaauuccagccug

SEQ ID NO: 722549 - RNA, 22 nt, Human
ucccauguuagguguuucuguu

SEQ ID NO: 722550 - RNA, 22 nt, Human
agccagugcagcuggaaauuca

SEQ ID NO: 722551 - RNA, 22 nt, Human
cagaccaucuugaagcaaacug

SEQ ID NO: 722552 - RNA, 22 nt, Human
gguaggggaagacaagugaaaa

SEQ ID NO: 722553 - RNA, 22 nt, Human
gaggccugggagccuguccucc

SEQ ID NO: 722554 - RNA, 22 nt, Human
gaaauguuguccugucucuuga

SEQ ID NO: 722555 - RNA, 22 nt, Human
ugugucagagguagagauggca

SEQ ID NO: 722556 - RNA, 16 nt, Human
agacucagugcacuuu

SEQ ID NO: 722557 - RNA, 14 nt, Human
gcaggcggaucacu

SEQ ID NO: 722558 - RNA, 22 nt, Human
ugaaguuuuacauccucuccaa

SEQ ID NO: 722559 - RNA, 22 nt, Human
ucuucccccgugcuccagugca

SEQ ID NO: 722560 - RNA, 22 nt, Human
acuggcuguggccacggcugcu

SEQ ID NO: 722561 - RNA, 22 nt, Human
augcuucccucacauauccugg

SEQ ID NO: 722562 - RNA, 22 nt, Human
guuauucuauuaaugugauugu

SEQ ID NO: 722563 - RNA, 22 nt, Human
uguuuuaaagccauugccuuuc

SEQ ID NO: 722564 - RNA, 22 nt, Human
cugagacacggagaggcugugu

SEQ ID NO: 722565 - RNA, 22 nt, Human
ugcuuucagccagugucuggau

SEQ ID NO: 722566 - RNA, 22 nt, Human
agcuccagguagugccuuaucg

SEQ ID NO: 722567 - RNA, 22 nt, Human
uacugaaaaagaauccagaccu

SEQ ID NO: 722568 - RNA, 22 nt, Human
uaacacugugguguucuuuguc

SEQ ID NO: 722569 - RNA, 22 nt, Human
aaagugcauuguuuguguuccu

SEQ ID NO: 722570 - RNA, 22 nt, Human
auguagcagaagauguuuuccu

SEQ ID NO: 722571 - RNA, 23 nt, Human
cugaggucugcaauucuaguagu

SEQ ID NO: 722572 - RNA, 22 nt, Human
aaagcucacaguaauacaaggc

SEQ ID NO: 722573 - RNA, 22 nt, Human
cuagagggauguuaggauagca

SEQ ID NO: 722574 - RNA, 22 nt, Human
cuuguccccagcagguugguuu

SEQ ID NO: 722575 - RNA, 22 nt, Human
caccuguuguuuauucaucucu

SEQ ID NO: 722576 - RNA, 22 nt, Human
ucugcagacacuggggucugga

SEQ ID NO: 722577 - RNA, 22 nt, Human
agcuccaggugcaagucauggu

SEQ ID NO: 722578 - RNA, 23 nt, Human
uaguuauuuucucuguaauuugc

SEQ ID NO: 722579 - RNA, 22 nt, Human
aaacuucaguaggagccaaccu

SEQ ID NO: 722580 - RNA, 22 nt, Human
gcugcagagaugggugcccuuu

SEQ ID NO: 722581 - RNA, 22 nt, Human
uuuaauuaggaaaugggcaggg

SEQ ID NO: 722582 - RNA, 22 nt, Human
uuauuugguugcugacuuggaa

SEQ ID NO: 722583 - RNA, 22 nt, Human
gcuauguuagacauucucauuu

SEQ ID NO: 722584 - RNA, 22 nt, Human
guauuugucuuguuggucucca

SEQ ID NO: 722585 - RNA, 22 nt, Human
agagaccaagggaauagucuca

SEQ ID NO: 722586 - RNA, 22 nt, Human
ggaggggaggauuaaugacaaa

SEQ ID NO: 722587 - RNA, 22 nt, Human
aauguuuuauagcucaagcaau

SEQ ID NO: 722588 - RNA, 22 nt, Human
gggcugagacgauggggucuuc

SEQ ID NO: 722589 - RNA, 22 nt, Human
cgcugauaaacgucacguuccc

SEQ ID NO: 722590 - RNA, 22 nt, Human
uagcuucccugcuggaucauaa

SEQ ID NO: 722591 - RNA, 22 nt, Human
ggucagguggcuucuguccucu

SEQ ID NO: 722592 - RNA, 22 nt, Human
uagccaggcugcagcugauccg

SEQ ID NO: 722593 - RNA, 22 nt, Human
caaaguaugaaccaguuucucu

SEQ ID NO: 722594 - RNA, 22 nt, Human
agcugaugccauguggaacagu

SEQ ID NO: 722595 - RNA, 22 nt, Human
acuggacuccccaagggccagg

SEQ ID NO: 722596 - RNA, 22 nt, Human
uuuccaaaguugccauaagcuu

SEQ ID NO: 722597 - RNA, 22 nt, Human
gaggagaggggcucccaagagc

SEQ ID NO: 722598 - RNA, 20 nt, Human
uucucuggauagccagaugu

SEQ ID NO: 722599 - RNA, 22 nt, Human
acugcugaccucaggucauccu

SEQ ID NO: 722600 - RNA, 22 nt, Human
cuggaguuagaguagacacuga

SEQ ID NO: 722601 - RNA, 22 nt, Human
ucucaguuuccucauauguaaa

SEQ ID NO: 722602 - RNA, 22 nt, Human
uaaagcacauaucuuacaauaa

SEQ ID NO: 722603 - RNA, 22 nt, Human
augaggccuaucuuggcagagg

SEQ ID NO: 722604 - RNA, 22 nt, Human
ucuuuaaaguuggagcuugcaa

SEQ ID NO: 722605 - RNA, 22 nt, Human
uaaagugaaggucauaaugauu

SEQ ID NO: 722606 - RNA, 22 nt, Human
uugccuauuguucuuacauguu

SEQ ID NO: 722607 - RNA, 22 nt, Human
gcagggacgcagcacucuccgu

SEQ ID NO: 722608 - RNA, 22 nt, Human
uauggcaauauguaucaagauc

SEQ ID NO: 722609 - RNA, 22 nt, Human
ucuauuacuuaccacuaauuca

SEQ ID NO: 722610 - RNA, 22 nt, Human
ccugagaggcccucucacuguc

SEQ ID NO: 722611 - RNA, 22 nt, Human
uacacagugaguccucucugcc

SEQ ID NO: 722612 - RNA, 21 nt, Human
acacugcuguagcauauuggg

SEQ ID NO: 722613 - RNA, 22 nt, Human
ugggcaagcaggagggccucag

SEQ ID NO: 722614 - RNA, 22 nt, Human
gauggugcaauuaucgugcaug

SEQ ID NO: 722615 - RNA, 22 nt, Human
ccagcccuguuuaugugucacu

SEQ ID NO: 722616 - RNA, 22 nt, Human
aaguucaaggcucuagaguucc

SEQ ID NO: 722617 - RNA, 22 nt, Human
uggaaggcgcagugaugaugcu

SEQ ID NO: 722618 - RNA, 22 nt, Human
acaggagugaaucuggcacuua

SEQ ID NO: 722619 - RNA, 22 nt, Human
auaauuuaaauuaguaugugau

SEQ ID NO: 722620 - RNA, 22 nt, Human
uuguacauuuguucaguucuga

SEQ ID NO: 722621 - RNA, 22 nt, Human
ucaccuguauuaauacagaacu

SEQ ID NO: 722622 - RNA, 22 nt, Human
uucacagccucugccccaggca

SEQ ID NO: 722623 - RNA, 22 nt, Human
augcaacaccccuauggaugga

SEQ ID NO: 722624 - RNA, 22 nt, Human
auggagugggccaauuuuagug

SEQ ID NO: 722625 - RNA, 22 nt, Human
aagagagaccaugggggacagg

SEQ ID NO: 722626 - RNA, 21 nt, Human
auucugagucuuggggucuca

SEQ ID NO: 722627 - RNA, 22 nt, Human
aguguccucaggcuuuguuccu

SEQ ID NO: 722628 - RNA, 22 nt, Human
guuuccugggccccaacccaga

SEQ ID NO: 722629 - RNA, 22 nt, Human
uugcugaagugaagguauguuu

SEQ ID NO: 722630 - RNA, 22 nt, Human
acuuagcagaguugaauguacu

SEQ ID NO: 722631 - RNA, 22 nt, Human
ugucugccauuagcccagucca

SEQ ID NO: 722632 - RNA, 22 nt, Human
cucuccacuguccuuugcuggu

SEQ ID NO: 722633 - RNA, 22 nt, Human
cuugcaggauuuugcugcugua

SEQ ID NO: 722634 - RNA, 22 nt, Human
uaacugauauugaaaaacauca

SEQ ID NO: 722635 - RNA, 22 nt, Human
gauguacaaugucacuaugacc

SEQ ID NO: 722636 - RNA, 22 nt, Human
auagugucagaaaaucauaaga

SEQ ID NO: 722637 - RNA, 22 nt, Human
acuguggcgucaggaagaaauu

SEQ ID NO: 722638 - RNA, 22 nt, Human
caggcaggagccagggauucca

SEQ ID NO: 722639 - RNA, 20 nt, Human
uccuccaaccagcugcuaau

SEQ ID NO: 722640 - RNA, 18 nt, Human
uucagagucuggugagga

SEQ ID NO: 722641 - RNA, 22 nt, Human
gugugcguuccuaguaaacgug

SEQ ID NO: 722642 - RNA, 20 nt, Human
gcaacuagggagacacagcu

SEQ ID NO: 722643 - RNA, 17 nt, Human
uggcuucaggcugagca

SEQ ID NO: 722644 - RNA, 22 nt, Human
uagucucuggagacucuagggg

SEQ ID NO: 722645 - RNA, 23 nt, Human
aaagacucuccagagggaaguag

SEQ ID NO: 722646 - RNA, 15 nt, Human
ucccugggagauggu

SEQ ID NO: 722647 - RNA, 22 nt, Human
aaccaacauaggaaugcagaga

SEQ ID NO: 722648 - RNA, 22 nt, Human
aguucuuuucuagauucuggau

SEQ ID NO: 722649 - RNA, 22 nt, Human
gcagagcagggauuuugccaua

SEQ ID NO: 722650 - RNA, 22 nt, Human
agccuggcacugccccauccau

SEQ ID NO: 722651 - RNA, 22 nt, Human
cuugccugccacuacagcugaa

SEQ ID NO: 722652 - RNA, 22 nt, Human
ucugaaagcauuacaguuuauu

SEQ ID NO: 722653 - RNA, 22 nt, Human
ucuggguggcugccaaucugcc

SEQ ID NO: 722654 - RNA, 15 nt, Human
ggaggccaggcugug

SEQ ID NO: 722655 - RNA, 22 nt, Human
gcucucugccauaugaggauac

SEQ ID NO: 722656 - RNA, 22 nt, Human
ucaccaaggcauuuucacagca

SEQ ID NO: 722657 - RNA, 22 nt, Human
ggcccuguccuggcugucuccg

SEQ ID NO: 722658 - RNA, 22 nt, Human
ccaugcucuggggaggucaagc

SEQ ID NO: 722659 - RNA, 22 nt, Human
auucacacuguauacacaggau

SEQ ID NO: 722660 - RNA, 22 nt, Human
caauucaauggcaaaguauugu

SEQ ID NO: 722661 - RNA, 22 nt, Human
gcacuuuguggauuguauuucc

SEQ ID NO: 722662 - RNA, 23 nt, Human
ugaaugauggugcuccucaucuu

SEQ ID NO: 722663 - RNA, 22 nt, Human
ucacagcuguuuuguccauuaa

SEQ ID NO: 722664 - RNA, 22 nt, Human
auucagaagcuauucuuaguuc

SEQ ID NO: 722665 - RNA, 22 nt, Human
cuugccuucagugucccuuugc

SEQ ID NO: 722666 - RNA, 22 nt, Human
ucagcuguagguauggaugucc

SEQ ID NO: 722667 - RNA, 22 nt, Human
gucccuggggguuuaggacuca

SEQ ID NO: 722668 - RNA, 22 nt, Human
caugaaauugcuccuuuggugc

SEQ ID NO: 722669 - RNA, 22 nt, Human
aacacaaagaagcugcaggauc

SEQ ID NO: 722670 - RNA, 22 nt, Human
aaugcauuagcuacauaugucu

SEQ ID NO: 722671 - RNA, 22 nt, Human
ggagaccuuaaggugcuuccua

SEQ ID NO: 722672 - RNA, 22 nt, Human
auuguaauuuuagagaaagugg

SEQ ID NO: 722673 - RNA, 22 nt, Human
aucuggaguagaaaaaucgcuu

SEQ ID NO: 722674 - RNA, 22 nt, Human
uagaacaugugaaaauauagcc

SEQ ID NO: 722675 - RNA, 22 nt, Human
gggaaggcaggccucuguugga

SEQ ID NO: 722676 - RNA, 22 nt, Human
ggggcagagucuggacuguugu

SEQ ID NO: 722677 - RNA, 22 nt, Human
gcccugggauuggguggaggcu

SEQ ID NO: 722678 - RNA, 22 nt, Human
gacaguuuagguucaaaucuca

SEQ ID NO: 722679 - RNA, 22 nt, Human
ucugguaauaggcaauagcuug

SEQ ID NO: 722680 - RNA, 22 nt, Human
uuuguacaggugcaggcauuug

SEQ ID NO: 722681 - RNA, 22 nt, Human
ucagaaccagcccagcagauga

SEQ ID NO: 722682 - RNA, 22 nt, Human
uggaaaaucaggggacauugau

SEQ ID NO: 722683 - RNA, 22 nt, Human
uagacagugagcuaugaguggu

SEQ ID NO: 722684 - RNA, 22 nt, Human
cucugcuucugagauggaagcu

SEQ ID NO: 722685 - RNA, 21 nt, Human
uguaacaaguucccuagguga

SEQ ID NO: 722686 - RNA, 19 nt, Human
cuuccuggaggagagccuc

SEQ ID NO: 722687 - RNA, 22 nt, Human
aagucaauuaguaaacuuggaa

SEQ ID NO: 722688 - RNA, 22 nt, Human
ucagggaagagagaucuccuag

SEQ ID NO: 722689 - RNA, 22 nt, Human
caggaaaaggagacuuuagcac

SEQ ID NO: 722690 - RNA, 19 nt, Human
ucccaggaaccuuuuauuu

SEQ ID NO: 722691 - RNA, 22 nt, Human
aaguccagugcuuuagauucca

SEQ ID NO: 722692 - RNA, 22 nt, Human
ccugggugaugugcugcccucg

SEQ ID NO: 722693 - RNA, 22 nt, Human
uuagaaaucaccucugaagauc

SEQ ID NO: 722694 - RNA, 22 nt, Human
caggccacacggcggcucccug

SEQ ID NO: 722695 - RNA, 22 nt, Human
cagcugcaggagaaacagaggc

SEQ ID NO: 722696 - RNA, 22 nt, Human
uccagccuuucuacucacugag

SEQ ID NO: 722697 - RNA, 23 nt, Human
cagggccaggcagcagcugucac

SEQ ID NO: 722698 - RNA, 21 nt, Human
caguuauucuugaugugugug

SEQ ID NO: 722699 - RNA, 22 nt, Human
cugagccauaagggaggcuggg

SEQ ID NO: 722700 - RNA, 21 nt, Human
cuggccuucaacugauuggau

SEQ ID NO: 722701 - RNA, 22 nt, Human
uuggggaguuaaugccaaagau

SEQ ID NO: 722702 - RNA, 20 nt, Human
aggggccuggaacaggccuu

SEQ ID NO: 722703 - RNA, 22 nt, Human
aaaauagccucacauaauugcu

SEQ ID NO: 722704 - RNA, 22 nt, Human
agauaucaccucuaggcuggug

SEQ ID NO: 722705 - RNA, 22 nt, Human
uuacaucaugcuuaucccuuuc

SEQ ID NO: 722706 - RNA, 16 nt, Human
ugggcagaugagaaga

SEQ ID NO: 722707 - RNA, 23 nt, Human
ugugacagggucauugaaaaggg

SEQ ID NO: 722708 - RNA, 22 nt, Human
gcaccuggcugcccagguggag

SEQ ID NO: 722709 - RNA, 22 nt, Human
auggaaaucagguucauccaag

SEQ ID NO: 722710 - RNA, 22 nt, Human
ugacagagcugggauuugaagc

SEQ ID NO: 722711 - RNA, 22 nt, Human
cauggcccucuucuggagcaau

SEQ ID NO: 722712 - RNA, 22 nt, Human
ggaggcggggaaggcaucccau

SEQ ID NO: 722713 - RNA, 22 nt, Human
uguguauuucuggaacagacua

SEQ ID NO: 722714 - RNA, 22 nt, Human
auucuucauguugaagcuguca

SEQ ID NO: 722715 - RNA, 20 nt, Human
uguacacaguacuuuacaau

SEQ ID NO: 722716 - RNA, 22 nt, Human
aggagcugucagagugccagag

SEQ ID NO: 722717 - RNA, 22 nt, Human
caggcuuuuucugcuguccucu

SEQ ID NO: 722718 - RNA, 22 nt, Human
uacaguaaccuuauuugucauu

SEQ ID NO: 722719 - RNA, 22 nt, Human
auccuuggcagcucagaccuac

SEQ ID NO: 722720 - RNA, 22 nt, Human
auucaguuaguagauuugguca

SEQ ID NO: 722721 - RNA, 22 nt, Human
aggcuguguccucauuuuauau

SEQ ID NO: 722722 - RNA, 21 nt, Human
ucucguuguauggucuugggg

SEQ ID NO: 722723 - RNA, 22 nt, Human
gagcuucagagaccacuuaacu

SEQ ID NO: 722724 - RNA, 19 nt, Human
gcccucaggcagcuccauc

SEQ ID NO: 722725 - RNA, 22 nt, Human
cugaggccagagugggccucuu

SEQ ID NO: 722726 - RNA, 22 nt, Human
ugggcuccagcaccugugcucu

SEQ ID NO: 722727 - RNA, 19 nt, Human
aggcacaauucugagaagc

SEQ ID NO: 722728 - RNA, 22 nt, Human
gcguguuugcccagugaguggc

SEQ ID NO: 722729 - RNA, 22 nt, Human
aguacauauaguaauuuagcca

SEQ ID NO: 722730 - RNA, 22 nt, Human
cugacucccugauucuggguuu

SEQ ID NO: 722731 - RNA, 22 nt, Human
auagugugacugaggaguugaa

SEQ ID NO: 722732 - RNA, 22 nt, Human
aaauaauuauagcgagucuauc

SEQ ID NO: 722733 - RNA, 22 nt, Human
uucuggcaugagagaugggggu

SEQ ID NO: 722734 - RNA, 22 nt, Human
uuagacuagaagcuuccacuuu

SEQ ID NO: 722735 - RNA, 17 nt, Human
ccuguuguugccuuugc

SEQ ID NO: 722736 - RNA, 22 nt, Human
gugcaaauuccacuggaaagcu

SEQ ID NO: 722737 - RNA, 22 nt, Human
ugagacgaagucuugcucuguu

SEQ ID NO: 722738 - RNA, 22 nt, Human
auugucuucuggucuuaucuuu

SEQ ID NO: 722739 - RNA, 22 nt, Human
cuucacauugggcuugauauga

SEQ ID NO: 722740 - RNA, 22 nt, Human
caaauagaacucacagacaaga

SEQ ID NO: 722741 - RNA, 22 nt, Human
accugcagccacuucucuccuu

SEQ ID NO: 722742 - RNA, 22 nt, Human
uugucuaaugagcuccacuuca

SEQ ID NO: 722743 - RNA, 22 nt, Human
ggaagaugagaaguggggcucc

SEQ ID NO: 722744 - RNA, 22 nt, Human
agucagcagccuggccaggaga

SEQ ID NO: 722745 - RNA, 22 nt, Human
agguaucaacagcagagucuga

SEQ ID NO: 722746 - RNA, 22 nt, Human
ugaaccuuguuccugcccuccu

SEQ ID NO: 722747 - RNA, 22 nt, Human
aaucagaaauugagggucuggu

SEQ ID NO: 722748 - RNA, 22 nt, Human
aucagaaaggugggcaagcaga

SEQ ID NO: 722749 - RNA, 17 nt, Human
agcugaaauugcugaag

SEQ ID NO: 722750 - RNA, 22 nt, Human
uggcuccaaaucaacugcuguu

SEQ ID NO: 722751 - RNA, 22 nt, Human
ccugggcaggccggacgcuggg

SEQ ID NO: 722752 - RNA, 22 nt, Human
aggcucaggucucaggucuggc

SEQ ID NO: 722753 - RNA, 22 nt, Human
gaagccaagccagcugauggag

SEQ ID NO: 722754 - RNA, 22 nt, Human
ugacagaacuuuuucacaucuc

SEQ ID NO: 722755 - RNA, 22 nt, Human
gcauccagguagagcuugcggg

SEQ ID NO: 722756 - RNA, 22 nt, Human
augcaguuuuaaaucauuucag

SEQ ID NO: 722757 - RNA, 22 nt, Human
acuccagacacagacacuauga

SEQ ID NO: 722758 - RNA, 21 nt, Human
caggccccaggccuggggugc

SEQ ID NO: 722759 - RNA, 22 nt, Human
agguuggccucagggaggcucu

SEQ ID NO: 722760 - RNA, 22 nt, Human
agggccucugacgcccccagcc

SEQ ID NO: 722761 - RNA, 22 nt, Human
agaggguugaaccuauaaacua

SEQ ID NO: 722762 - RNA, 22 nt, Human
agagggcuucccuaggagugag

SEQ ID NO: 722763 - RNA, 23 nt, Human
ggacccuguggagggugagaguc

SEQ ID NO: 722764 - RNA, 22 nt, Human
cagcccagcagggucuggcccu

SEQ ID NO: 722765 - RNA, 22 nt, Human
uuauuaagugcguacuguaugc

SEQ ID NO: 722766 - RNA, 22 nt, Human
agaggcucuuugagcugggaga

SEQ ID NO: 722767 - RNA, 22 nt, Human
acagucuggcagguguugaaag

SEQ ID NO: 722768 - RNA, 17 nt, Human
gggcuggauggccaugg

SEQ ID NO: 722769 - RNA, 22 nt, Human
uuucagacauuaagugauggga

SEQ ID NO: 722770 - RNA, 21 nt, Human
cugauaauuguuaaauuauuu

SEQ ID NO: 722771 - RNA, 22 nt, Human
cugaggccugggggcguggacg

SEQ ID NO: 722772 - RNA, 22 nt, Human
uagcaaauacaugauguaauuu

SEQ ID NO: 722773 - RNA, 22 nt, Human
uggcucagauaauucaaggggc

SEQ ID NO: 722774 - RNA, 22 nt, Human
gcaacaggcaguuugcucaugu

SEQ ID NO: 722775 - RNA, 17 nt, Human
cgagggcuugcuggcuc

SEQ ID NO: 722776 - RNA, 22 nt, Human
gagagcccuacaaggcguuuug

SEQ ID NO: 722777 - RNA, 22 nt, Human
ccccagagaaagucagcagcau

SEQ ID NO: 722778 - RNA, 22 nt, Human
ggcccugggaugcucagcagug

SEQ ID NO: 722779 - RNA, 22 nt, Human
uuugacaaaggaaaaaugcaca

SEQ ID NO: 722780 - RNA, 22 nt, Human
gaggcucccuuuagguccagau

SEQ ID NO: 722781 - RNA, 22 nt, Human
augaagaaacuguucugggugg

SEQ ID NO: 722782 - RNA, 22 nt, Human
ucaauaacuuuguuuagcauug

SEQ ID NO: 722783 - RNA, 22 nt, Human
agcugggcuuggccaggucgcu

SEQ ID NO: 722784 - RNA, 22 nt, Human
cagcugcaggagcugagcacuu

SEQ ID NO: 722785 - RNA, 22 nt, Human
ucuggcuccacaccucacugca

SEQ ID NO: 722786 - RNA, 22 nt, Human
uaauugcuauuuaaugugguga

SEQ ID NO: 722787 - RNA, 22 nt, Human
cauucucuacacuccugcccug

SEQ ID NO: 722788 - RNA, 22 nt, Human
caugaaaaauuuacuguuaaca

SEQ ID NO: 722789 - RNA, 22 nt, Human
ucagagaaaauggaaacuuuua

SEQ ID NO: 722790 - RNA, 19 nt, Human
ucccugaguuccagcccag

SEQ ID NO: 722791 - RNA, 22 nt, Human
uucucucaguuaaacuuuguga

SEQ ID NO: 722792 - RNA, 22 nt, Human
aaccucuuugugaaugucauga

SEQ ID NO: 722793 - RNA, 22 nt, Human
ggaaggucgagcugcaucuggc

SEQ ID NO: 722794 - RNA, 22 nt, Human
cccaggagagaggggauaaagc

SEQ ID NO: 722795 - RNA, 22 nt, Human
cccaggaagggaugccaaggaa

SEQ ID NO: 722796 - RNA, 22 nt, Human
ucacuggauucucuuuuguucc

SEQ ID NO: 722797 - RNA, 18 nt, Human
aggccugggaagcugagg

SEQ ID NO: 722798 - RNA, 22 nt, Human
ugggagcagccaacauggccuu

SEQ ID NO: 722799 - RNA, 22 nt, Human
gaguaaaaguuggauuacaaag

SEQ ID NO: 722800 - RNA, 22 nt, Human
acagcagaggaaaagucugaua

SEQ ID NO: 722801 - RNA, 22 nt, Human
gccuggcugccggccuuggcaa

SEQ ID NO: 722802 - RNA, 22 nt, Human
ugcuggguguuccgcacuugac

SEQ ID NO: 722803 - RNA, 22 nt, Human
gacacuuugggacucagcccua

SEQ ID NO: 722804 - RNA, 22 nt, Human
ugaggcagggagaguggauaug

SEQ ID NO: 722805 - RNA, 22 nt, Human
cagcagguuaacagaggcuggu

SEQ ID NO: 722806 - RNA, 22 nt, Human
uaauugcuuguaaagcccugaa

SEQ ID NO: 722807 - RNA, 22 nt, Human
aaucagaaucaguugacacagc

SEQ ID NO: 722808 - RNA, 22 nt, Human
ccugccugcuuucugcuuugca

SEQ ID NO: 722809 - RNA, 22 nt, Human
aaagaugucacaagaugugaug

SEQ ID NO: 722810 - RNA, 22 nt, Human
uggguccaguguccuggcuaug

SEQ ID NO: 722811 - RNA, 22 nt, Human
uuauuccagguacuugguuucu

SEQ ID NO: 722812 - RNA, 22 nt, Human
ucuucugugaucuauguguuuu

SEQ ID NO: 722813 - RNA, 22 nt, Human
aagagggagggcaaaggcacug

SEQ ID NO: 722814 - RNA, 23 nt, Human
cagaccuggcagucauccucaac

SEQ ID NO: 722815 - RNA, 17 nt, Human
acacaucuuggcuuugc

SEQ ID NO: 722816 - RNA, 22 nt, Human
auggcaguagaaugggggaaaa

SEQ ID NO: 722817 - RNA, 22 nt, Human
uccagcugcaaggggcacagcu

SEQ ID NO: 722818 - RNA, 22 nt, Human
gccugcucugacauccauccca

SEQ ID NO: 722819 - RNA, 22 nt, Human
uacaauguacuuccuugcacag

SEQ ID NO: 722820 - RNA, 22 nt, Human
ucuggcugaaaggggcugugcc

SEQ ID NO: 722821 - RNA, 22 nt, Human
cugaggugaugucaaauggguu

SEQ ID NO: 722822 - RNA, 22 nt, Human
aaggcaauuggcuuguauaaga

SEQ ID NO: 722823 - RNA, 22 nt, Human
ugccuccauguuucagcaucua

SEQ ID NO: 722824 - RNA, 22 nt, Human
cuauucaacuugacuguuucac

SEQ ID NO: 722825 - RNA, 22 nt, Human
cucagccccaauucuccccauu

SEQ ID NO: 722826 - RNA, 22 nt, Human
caguccuguuccuggaguaguu

SEQ ID NO: 722827 - RNA, 22 nt, Human
cuggccucaccucagacuuacu

SEQ ID NO: 722828 - RNA, 22 nt, Human
cuaguccagucucaaaaugcua

SEQ ID NO: 722829 - RNA, 21 nt, Human
gaauaguucuguggcagcagu

SEQ ID NO: 722830 - RNA, 22 nt, Human
aggcugguaguauuuagucaca

SEQ ID NO: 722831 - RNA, 23 nt, Human
ugggccacuauagaaaucucuca

SEQ ID NO: 722832 - RNA, 22 nt, Human
cagcuguuccuggaaggagacc

SEQ ID NO: 722833 - RNA, 22 nt, Human
aagcugggagggagcccagagu

SEQ ID NO: 722834 - RNA, 22 nt, Human
aauauuuguuaguguuuuaaug

SEQ ID NO: 722835 - RNA, 21 nt, Human
uagggcucuauuuuuauuuca

SEQ ID NO: 722836 - RNA, 22 nt, Human
gaaugugggcugugaagaggag

SEQ ID NO: 722837 - RNA, 22 nt, Human
uguucuaaguguuuuguucaug

SEQ ID NO: 722838 - RNA, 22 nt, Human
aagacaggaacauagcaaaucc

SEQ ID NO: 722839 - RNA, 22 nt, Human
aaacagcucaagaaguuacucu

SEQ ID NO: 722840 - RNA, 22 nt, Human
uuuaugacccaagaagauacca

SEQ ID NO: 722841 - RNA, 22 nt, Human
caugcaguuucucuaugcguag

SEQ ID NO: 722842 - RNA, 23 nt, Human
uccucccugacuucuacagcaca

SEQ ID NO: 722843 - RNA, 22 nt, Human
ggcuccaugcuccgcuucuugu

SEQ ID NO: 722844 - RNA, 23 nt, Human
cagaaagcccuuuccccacagua

SEQ ID NO: 722845 - RNA, 22 nt, Human
aaggcuuugauuccauugcccu

SEQ ID NO: 722846 - RNA, 22 nt, Human
cuggcuguuucuccuuugucua

SEQ ID NO: 722847 - RNA, 22 nt, Human
cauuucuagggaucauaaagua

SEQ ID NO: 722848 - RNA, 22 nt, Human
gugcagaggucacaaaagugaa

SEQ ID NO: 722849 - RNA, 22 nt, Human
augaggucauccuggaguaagg

SEQ ID NO: 722850 - RNA, 22 nt, Human
aaggaauucccuuucugacaga

SEQ ID NO: 722851 - RNA, 22 nt, Human
aggcagucuaguccccaggcaa

SEQ ID NO: 722852 - RNA, 22 nt, Human
ggcugccagcacugguguagag

SEQ ID NO: 722853 - RNA, 18 nt, Human
cacaauuuacagaugaca

SEQ ID NO: 722854 - RNA, 22 nt, Human
agccggccauguggucuugugc

SEQ ID NO: 722855 - RNA, 22 nt, Human
auguguuggauauuagugggga

SEQ ID NO: 722856 - RNA, 22 nt, Human
uacaaccauagacauauacuag

SEQ ID NO: 722857 - RNA, 22 nt, Human
uaaugccgucucuacaagacuc

SEQ ID NO: 722858 - RNA, 22 nt, Human
cagaagacugcagggaagggac

SEQ ID NO: 722859 - RNA, 22 nt, Human
gaaagaaugcugggagccaucu

SEQ ID NO: 722860 - RNA, 22 nt, Human
auguacauuuuccuaauguuuu

SEQ ID NO: 722861 - RNA, 22 nt, Human
agcucugacauugauucucagc

SEQ ID NO: 722862 - RNA, 22 nt, Human
aaaugaucauguaauuucagaa

SEQ ID NO: 722863 - RNA, 22 nt, Human
cagcuggcguggagugauugca

SEQ ID NO: 722864 - RNA, 22 nt, Human
uuaggaguccagaugucuuggg

SEQ ID NO: 722865 - RNA, 22 nt, Human
accucuggacacugcauccuuc

SEQ ID NO: 722866 - RNA, 22 nt, Human
ccagagccuaagaucugauccu

SEQ ID NO: 722867 - RNA, 22 nt, Human
cacauauaccucuucuugaguu

SEQ ID NO: 722868 - RNA, 22 nt, Human
aucaggaaugaauacuuuugga

SEQ ID NO: 722869 - RNA, 22 nt, Human
aguccuggcauggaauuguccc

SEQ ID NO: 722870 - RNA, 21 nt, Human
ugcucaguaaaugcugaguga

SEQ ID NO: 722871 - RNA, 20 nt, Human
ugagaaaguagagacucagg

SEQ ID NO: 722872 - RNA, 22 nt, Human
uuggaagggauauuggcauaug

SEQ ID NO: 722873 - RNA, 23 nt, Human
caugugugacaguaucacuguuu

SEQ ID NO: 722874 - RNA, 22 nt, Human
ggcagugccacuaagcucugcu

SEQ ID NO: 722875 - RNA, 22 nt, Human
ggugucugugauggcauauaac

SEQ ID NO: 722876 - RNA, 22 nt, Human
cucugaagggagggccaagccc

SEQ ID NO: 722877 - RNA, 22 nt, Human
uuccuagggcagagccgcuggg

SEQ ID NO: 722878 - RNA, 22 nt, Human
cagugguucucaaucaggaaug

SEQ ID NO: 722879 - RNA, 22 nt, Human
uugaaaguuuauggagucugca

SEQ ID NO: 722880 - RNA, 22 nt, Human
aaggaguggggcauaucacaga

SEQ ID NO: 722881 - RNA, 22 nt, Human
caguguuugcuuaaguuauaug

SEQ ID NO: 722882 - RNA, 22 nt, Human
gcaugucaugucauguaggaau

SEQ ID NO: 722883 - RNA, 22 nt, Human
ugucuuuaagcaaacaguguuu

SEQ ID NO: 722884 - RNA, 22 nt, Human
uauacaaugaguacauucuggg

SEQ ID NO: 722885 - RNA, 22 nt, Human
guggcagggguauuccagcuga

SEQ ID NO: 722886 - RNA, 22 nt, Human
caaauacuuacugaaccugugc

SEQ ID NO: 722887 - RNA, 22 nt, Human
auuggcauacuuucuauauuca

SEQ ID NO: 722888 - RNA, 21 nt, Human
auuaacuuguuaaccuaaagu

SEQ ID NO: 722889 - RNA, 22 nt, Human
cuucuuugaaaaaggcagucag

SEQ ID NO: 722890 - RNA, 22 nt, Human
agcuuucagucucugaaggaac

SEQ ID NO: 722891 - RNA, 22 nt, Human
cccaaguuaauuuguagcugaa

SEQ ID NO: 722892 - RNA, 22 nt, Human
ccaaagucagugcucagucguc

SEQ ID NO: 722893 - RNA, 22 nt, Human
ugcuucugaacucagcaugugg

SEQ ID NO: 722894 - RNA, 22 nt, Human
acgaaggaaugugcuugagcau

SEQ ID NO: 722895 - RNA, 22 nt, Human
ggcugguggggaaagaggacca

SEQ ID NO: 722896 - RNA, 22 nt, Human
caggauagaaaggccauggagu

SEQ ID NO: 722897 - RNA, 22 nt, Human
gugagacucgccuuuguguagc

SEQ ID NO: 722898 - RNA, 19 nt, Human
ggaacucacuuagagaaac

SEQ ID NO: 722899 - RNA, 22 nt, Human
uagaaauguuagauguauugag

SEQ ID NO: 722900 - RNA, 22 nt, Human
cuuauuucagcccugggcaccc

SEQ ID NO: 722901 - RNA, 23 nt, Human
ggcugagacuacaggcgcuugcc

SEQ ID NO: 722902 - RNA, 22 nt, Human
ggagaccagaaggaagcuucga

SEQ ID NO: 722903 - RNA, 18 nt, Human
agcugcccugggcuggag

SEQ ID NO: 722904 - RNA, 22 nt, Human
gagagucuaggaaccucauaua

SEQ ID NO: 722905 - RNA, 22 nt, Human
aacacugacgacgugaacuaaa

SEQ ID NO: 722906 - RNA, 22 nt, Human
agccuucucugauucuccuagu

SEQ ID NO: 722907 - RNA, 22 nt, Human
gccuucugugcuccuggccuuu

SEQ ID NO: 722908 - RNA, 22 nt, Human
uauuucaggggguacaagaaga

SEQ ID NO: 722909 - RNA, 22 nt, Human
cuucaguuuaucccaucaucca

SEQ ID NO: 722910 - RNA, 22 nt, Human
cucuucagguuucugcucugga

SEQ ID NO: 722911 - RNA, 22 nt, Human
ucaggaaagccuagaagagaac

SEQ ID NO: 722912 - RNA, 22 nt, Human
uucuuugggcaauugcuggccc

SEQ ID NO: 722913 - RNA, 22 nt, Human
uccucugggcucccugcaacag

SEQ ID NO: 722914 - RNA, 22 nt, Human
ccuggccaaucuagggcuguua

SEQ ID NO: 722915 - RNA, 22 nt, Human
gcaaaacagucgaugccuccca

SEQ ID NO: 722916 - RNA, 22 nt, Human
cugcacagaggucggucugcca

SEQ ID NO: 722917 - RNA, 22 nt, Human
uaauacacugcuuuuuguaacu

SEQ ID NO: 722918 - RNA, 22 nt, Human
cggagggguuugaacagaggag

SEQ ID NO: 722919 - RNA, 22 nt, Human
acucugcuaucuuagcaaaagg

SEQ ID NO: 722920 - RNA, 22 nt, Human
gccuguguggaugcgccggugc

SEQ ID NO: 722921 - RNA, 22 nt, Human
gccagcuguaggugguggguug

SEQ ID NO: 722922 - RNA, 22 nt, Human
cuggcucuucuggguucugugu

SEQ ID NO: 722923 - RNA, 22 nt, Human
ccugagugcuuccagagucaug

SEQ ID NO: 722924 - RNA, 22 nt, Human
gagagggcugccuggugugagg

SEQ ID NO: 722925 - RNA, 19 nt, Human
guagggacagugguucuga

SEQ ID NO: 722926 - RNA, 22 nt, Human
agcaccaugaccuugccauuga

SEQ ID NO: 722927 - RNA, 22 nt, Human
cugggacuggguccucaggaca

SEQ ID NO: 722928 - RNA, 22 nt, Human
ucucuggaauuggcugaggcaa

SEQ ID NO: 722929 - RNA, 22 nt, Human
aaggaacacuacaaggcuggga

SEQ ID NO: 722930 - RNA, 22 nt, Human
ccagaggcuggcagccagcuga

SEQ ID NO: 722931 - RNA, 22 nt, Human
agugucugcuagguucaucaac

SEQ ID NO: 722932 - RNA, 22 nt, Human
aaacacugaaaauuuuggucau

SEQ ID NO: 722933 - RNA, 21 nt, Human
ccuucucuugcuucagcuuca

SEQ ID NO: 722934 - RNA, 22 nt, Human
gucacccugcuguuuguccauu

SEQ ID NO: 722935 - RNA, 22 nt, Human
ucccuccccacuucugagcuuu

SEQ ID NO: 722936 - RNA, 22 nt, Human
ucuaaacauuaugauaguagag

SEQ ID NO: 722937 - RNA, 22 nt, Human
cuggcugcuuguagacucgacu

SEQ ID NO: 722938 - RNA, 22 nt, Human
guuggccauuaauuggaggaca

SEQ ID NO: 722939 - RNA, 22 nt, Human
ugguccaggguguaguacagag

SEQ ID NO: 722940 - RNA, 22 nt, Human
acacucuacagagcaaucuacc

SEQ ID NO: 722941 - RNA, 19 nt, Human
agucuuucccacucgucuu

SEQ ID NO: 722942 - RNA, 22 nt, Human
ucacagaaucucugauaagucu

SEQ ID NO: 722943 - RNA, 22 nt, Human
ugaguaauaaacugucuugcuc

SEQ ID NO: 722944 - RNA, 23 nt, Human
cugaccugacccauaagcaagga

SEQ ID NO: 722945 - RNA, 22 nt, Human
agugucugagccagaauuagaa

SEQ ID NO: 722946 - RNA, 22 nt, Human
caauaaguaauaggcaucuaau

SEQ ID NO: 722947 - RNA, 22 nt, Human
uggcucaguuugggggauugaa

SEQ ID NO: 722948 - RNA, 22 nt, Human
acaacuuucuggguuaucugau

SEQ ID NO: 722949 - RNA, 22 nt, Human
gcacaccuuagaggggagcugc

SEQ ID NO: 722950 - RNA, 17 nt, Human
gaagguuucucuuaggu

SEQ ID NO: 722951 - RNA, 22 nt, Human
uuucuguuuagcauaaaguggc

SEQ ID NO: 722952 - RNA, 22 nt, Human
uuuaucuguuguacauuuaugc

SEQ ID NO: 722953 - RNA, 17 nt, Human
cacaacuggcugauuga

SEQ ID NO: 722954 - RNA, 22 nt, Human
cagagguacagccauugaagau

SEQ ID NO: 722955 - RNA, 22 nt, Human
ggauggguuccgugggcaaaug

SEQ ID NO: 722956 - RNA, 22 nt, Human
ggcuugcacacagccucaguuu

SEQ ID NO: 722957 - RNA, 22 nt, Human
caaaggcuuugcuaugaugcau

SEQ ID NO: 722958 - RNA, 22 nt, Human
aggcacaaaagcagggugacca

SEQ ID NO: 722959 - RNA, 22 nt, Human
aagcuuuaugaucucucagcua

SEQ ID NO: 722960 - RNA, 22 nt, Human
aaguuguuguugagguggguaa

SEQ ID NO: 722961 - RNA, 22 nt, Human
uguuuacauauuuggucucaga

SEQ ID NO: 722962 - RNA, 22 nt, Human
ugugagacguguuagaacagug

SEQ ID NO: 722963 - RNA, 22 nt, Human
uaaccauauuuuccauuaaguu

SEQ ID NO: 722964 - RNA, 22 nt, Human
uagauaaaagggcaaagggcau

SEQ ID NO: 722965 - RNA, 22 nt, Human
cuuugcaauagaggcacacaug

SEQ ID NO: 722966 - RNA, 18 nt, Human
gcuccugguuggaaagaa

SEQ ID NO: 722967 - RNA, 22 nt, Human
gaaacaugucugacaauuuacc

SEQ ID NO: 722968 - RNA, 22 nt, Human
accagaguaauguguggaaauu

SEQ ID NO: 722969 - RNA, 22 nt, Human
ggccacagcagaugcuucagau

SEQ ID NO: 722970 - RNA, 22 nt, Human
gcacagaagagcuuuggaauga

SEQ ID NO: 722971 - RNA, 22 nt, Human
gaucacaucuuuaugaguauuu

SEQ ID NO: 722972 - RNA, 22 nt, Human
augggcagaguggggacaggaa

SEQ ID NO: 722973 - RNA, 22 nt, Human
ugaaggcaaccucugugguccu

SEQ ID NO: 722974 - RNA, 22 nt, Human
ugcuccaucucucgugguucca

SEQ ID NO: 722975 - RNA, 22 nt, Human
ugugcagcuaguccuggacuug

SEQ ID NO: 722976 - RNA, 22 nt, Human
ucucaacaccacuugcugaaga

SEQ ID NO: 722977 - RNA, 22 nt, Human
acagucuacuaaacaucaucag

SEQ ID NO: 722978 - RNA, 22 nt, Human
acagucuuaugcauacacuauu

SEQ ID NO: 722979 - RNA, 22 nt, Human
agaggccacaccagccucccgu

SEQ ID NO: 722980 - RNA, 22 nt, Human
aaugaacauggacaaguuaaua

SEQ ID NO: 722981 - RNA, 22 nt, Human
auugguaagcaagauggcaaua

SEQ ID NO: 722982 - RNA, 22 nt, Human
auaccauaggaaaggaucagcc

SEQ ID NO: 722983 - RNA, 22 nt, Human
cccuagaacacgcagacacuga

SEQ ID NO: 722984 - RNA, 22 nt, Human
cacaguguaguuaaugugacau

SEQ ID NO: 722985 - RNA, 22 nt, Human
ugcuuuauucagucucugccau

SEQ ID NO: 722986 - RNA, 22 nt, Human
ucuuggcugucuuugaaguuag

SEQ ID NO: 722987 - RNA, 22 nt, Human
ugccugccucuggagcccaucc

SEQ ID NO: 722988 - RNA, 22 nt, Human
acagaauauugguuacuguugc

SEQ ID NO: 722989 - RNA, 22 nt, Human
gaaggaaaacagaucugccuga

SEQ ID NO: 722990 - RNA, 22 nt, Human
cuucuuaaugacagauuaaaau

SEQ ID NO: 722991 - RNA, 22 nt, Human
uguuuuuuuauauaccugaagu

SEQ ID NO: 722992 - RNA, 22 nt, Human
auaaauuuucuugcuguacuua

SEQ ID NO: 722993 - RNA, 20 nt, Human
cugggucuccuucugcuuaa

SEQ ID NO: 722994 - RNA, 22 nt, Human
cugagacaugguuugacuggca

SEQ ID NO: 722995 - RNA, 22 nt, Human
cuugaaagucagcagaguggau

SEQ ID NO: 722996 - RNA, 22 nt, Human
ggagccuugggcgcucucccau

SEQ ID NO: 722997 - RNA, 19 nt, Human
uggcucugucgaaggcaca

SEQ ID NO: 722998 - RNA, 19 nt, Human
uaccaaauugcauuauggc

SEQ ID NO: 722999 - RNA, 17 nt, Human
ggaaaagaagaguagga

SEQ ID NO: 723000 - RNA, 22 nt, Human
ugcagacagagaaaugaggccc

SEQ ID NO: 723001 - RNA, 22 nt, Human
uuccagaggagugauucagagg

SEQ ID NO: 723002 - RNA, 22 nt, Human
gaaauaagaguccaugccaggu

SEQ ID NO: 723003 - RNA, 21 nt, Human
aggguggcucugggucagaac

SEQ ID NO: 723004 - RNA, 22 nt, Human
uuggcagacuggguccugggga

SEQ ID NO: 723005 - RNA, 20 nt, Human
aaguauauguccguguacuu

SEQ ID NO: 723006 - RNA, 22 nt, Human
gccugucucuuggaacuuggua

SEQ ID NO: 723007 - RNA, 22 nt, Human
aggaagaaccuaagaaagucuc

SEQ ID NO: 723008 - RNA, 22 nt, Human
ggcaguggcauguggguagugg

SEQ ID NO: 723009 - RNA, 22 nt, Human
gggaugauggaaaagucuguua

SEQ ID NO: 723010 - RNA, 22 nt, Human
uucuauugcacacaaauaauua

SEQ ID NO: 723011 - RNA, 22 nt, Human
uuauuaugugcuagagaaugua

SEQ ID NO: 723012 - RNA, 22 nt, Human
agccccuuccaguucucagauc

SEQ ID NO: 723013 - RNA, 22 nt, Human
ccaaggcauauggcugaaacca

SEQ ID NO: 723014 - RNA, 22 nt, Human
uauucugcaugaaaauaaacag

SEQ ID NO: 723015 - RNA, 22 nt, Human
agggcagcuggaagguggcuuc

SEQ ID NO: 723016 - RNA, 16 nt, Human
gggcugggggauucug

SEQ ID NO: 723017 - RNA, 22 nt, Human
gaacaucaaggucugugucuag

SEQ ID NO: 723018 - RNA, 22 nt, Human
agcuguggggaggaggcuagca

SEQ ID NO: 723019 - RNA, 22 nt, Human
ucuuuucugccagcugagcccu

SEQ ID NO: 723020 - RNA, 22 nt, Human
ggccaugccaggcugccuggga

SEQ ID NO: 723021 - RNA, 22 nt, Human
agcugggcuggagcuccaagcg

SEQ ID NO: 723022 - RNA, 22 nt, Human
uuaagaggugaggccuuuaaga

SEQ ID NO: 723023 - RNA, 22 nt, Human
aaucuguuccugaggcaccaga

SEQ ID NO: 723024 - RNA, 22 nt, Human
aaugaaugugauuaacuucaag

SEQ ID NO: 723025 - RNA, 22 nt, Human
ucccuggacagccuugccuggg

SEQ ID NO: 723026 - RNA, 22 nt, Human
ugggaagcugcauuuuaacaag

SEQ ID NO: 723027 - RNA, 22 nt, Human
guggccuuggcuucuacccuga

SEQ ID NO: 723028 - RNA, 21 nt, Human
ccagacuugaguguauguugu

SEQ ID NO: 723029 - RNA, 22 nt, Human
uugaacuuugaaccauuccuau

SEQ ID NO: 723030 - RNA, 22 nt, Human
auggcagcauaguggcaaguua

SEQ ID NO: 723031 - RNA, 22 nt, Human
aacaggcuggccuugaagcagu

SEQ ID NO: 723032 - RNA, 22 nt, Human
cugagguuuguccauccuuggu

SEQ ID NO: 723033 - RNA, 22 nt, Human
uagggaaaagacuucacuguuu

SEQ ID NO: 723034 - RNA, 22 nt, Human
aagccagauuucacucuuaauu

SEQ ID NO: 723035 - RNA, 22 nt, Human
ucuguugcaaugugcaugguga

SEQ ID NO: 723036 - RNA, 22 nt, Human
uagcccuggagcagggaaauac

SEQ ID NO: 723037 - RNA, 22 nt, Human
uuccaggguuaauuuauauggu

SEQ ID NO: 723038 - RNA, 22 nt, Human
gcccuggggaaggugucuccaa

SEQ ID NO: 723039 - RNA, 22 nt, Human
cauacaaauguguccaggcucu

SEQ ID NO: 723040 - RNA, 22 nt, Human
uucugcuccaccacuuccagca

SEQ ID NO: 723041 - RNA, 22 nt, Human
uuggcugguaagccaaaugaaa

SEQ ID NO: 723042 - RNA, 22 nt, Human
uuuaggaagaucugaaggaaga

SEQ ID NO: 723043 - RNA, 22 nt, Human
gauacaaaauauaaauggagag

SEQ ID NO: 723044 - RNA, 22 nt, Human
aagaaauacaugguuuuugagu

SEQ ID NO: 723045 - RNA, 22 nt, Human
uucuuauucuugaaauguggga

SEQ ID NO: 723046 - RNA, 22 nt, Human
caaaauguucuggcaccuuuaa

SEQ ID NO: 723047 - RNA, 22 nt, Human
agguagcuggugcugggcuccu

SEQ ID NO: 723048 - RNA, 22 nt, Human
cccaggugcugaaggaggccgc

SEQ ID NO: 723049 - RNA, 22 nt, Human
uccacaggcugaggcccuucug

SEQ ID NO: 723050 - RNA, 22 nt, Human
acauucaaguuucugcucaugg

SEQ ID NO: 723051 - RNA, 22 nt, Human
cagugcacacaauccucugccg

SEQ ID NO: 723052 - RNA, 22 nt, Human
cagugguugucagcaacaauau

SEQ ID NO: 723053 - RNA, 22 nt, Human
acagggccagccugggaccugg

SEQ ID NO: 723054 - RNA, 22 nt, Human
agcccagggcuaauaggaacca

SEQ ID NO: 723055 - RNA, 20 nt, Human
uggccaaguauccaacugga

SEQ ID NO: 723056 - RNA, 22 nt, Human
acacaaguucuaaagauugcgc

SEQ ID NO: 723057 - RNA, 22 nt, Human
aggcucagcccaagguggagag

SEQ ID NO: 723058 - RNA, 22 nt, Human
auagugaaaaugcugucagcau

SEQ ID NO: 723059 - RNA, 22 nt, Human
agagcacagaagaauaggugcu

SEQ ID NO: 723060 - RNA, 22 nt, Human
ugaucacaagucugaagaauga

SEQ ID NO: 723061 - RNA, 22 nt, Human
gagcuguuuuuccaaacuauug

SEQ ID NO: 723062 - RNA, 17 nt, Human
uuccaguuuaguauugu

SEQ ID NO: 723063 - RNA, 22 nt, Human
cauacauauguggaugucauau

SEQ ID NO: 723064 - RNA, 22 nt, Human
uccagcuccacagccucccugu

SEQ ID NO: 723065 - RNA, 22 nt, Human
uacagaaaaacuuggaggcuuu

SEQ ID NO: 723066 - RNA, 22 nt, Human
ucuuucugaauauuugaccuca

SEQ ID NO: 723067 - RNA, 22 nt, Human
caggugcagcuggauggaagcc

SEQ ID NO: 723068 - RNA, 22 nt, Human
ccucagggucugaggagaccgu

SEQ ID NO: 723069 - RNA, 22 nt, Human
uacuuugguugaauauguaaug

SEQ ID NO: 723070 - RNA, 20 nt, Human
uagaaaucuuauaaaagacu

SEQ ID NO: 723071 - RNA, 22 nt, Human
ccagcaucccugggguuggcca

SEQ ID NO: 723072 - RNA, 22 nt, Human
agucacaugagcacuaauuagg

SEQ ID NO: 723073 - RNA, 22 nt, Human
cagucccaugagcccagaacau

SEQ ID NO: 723074 - RNA, 22 nt, Human
acauccaccacaugccaggcuc

SEQ ID NO: 723075 - RNA, 22 nt, Human
ccaaggagcucauauucuuguu

SEQ ID NO: 723076 - RNA, 22 nt, Human
ggcagggcagcgcugauuaggg

SEQ ID NO: 723077 - RNA, 22 nt, Human
uaacacaguguccucagaaaca

SEQ ID NO: 723078 - RNA, 22 nt, Human
aaaugguguuucuaaugcuaga

SEQ ID NO: 723079 - RNA, 22 nt, Human
aggugggcuuggugccaacaug

SEQ ID NO: 723080 - RNA, 22 nt, Human
aguaugaagauuauaauuuuuc

SEQ ID NO: 723081 - RNA, 22 nt, Human
auuagaaugacagaaaugaggc

SEQ ID NO: 723082 - RNA, 22 nt, Human
cauuugaucuccugaauaaaca

SEQ ID NO: 723083 - RNA, 22 nt, Human
aaaaauguuaucuacuguccga

SEQ ID NO: 723084 - RNA, 22 nt, Human
gcucugcucuugacuuaccagg

SEQ ID NO: 723085 - RNA, 19 nt, Human
ucugccucuggucaggcuc

SEQ ID NO: 723086 - RNA, 22 nt, Human
ucugggaaccauugguggggau

SEQ ID NO: 723087 - RNA, 22 nt, Human
cuucccagacgggguggcagcc

SEQ ID NO: 723088 - RNA, 22 nt, Human
gugagagaugcuuucuuaacgc

SEQ ID NO: 723089 - RNA, 22 nt, Human
aguguuuggggugauuguaacc

SEQ ID NO: 723090 - RNA, 22 nt, Human
uucccuggcaugaguguaagau

SEQ ID NO: 723091 - RNA, 22 nt, Human
ggaauugucuaguacucacggc

SEQ ID NO: 723092 - RNA, 22 nt, Human
ucgcugugaaaaccuuggacaa

SEQ ID NO: 723093 - RNA, 22 nt, Human
cugaccaggguagaggugagag

SEQ ID NO: 723094 - RNA, 22 nt, Human
gccagguguaguggccacaccu

SEQ ID NO: 723095 - RNA, 22 nt, Human
ccugagagugagggccuccuua

SEQ ID NO: 723096 - RNA, 22 nt, Human
ugggagaaacugucucucccac

SEQ ID NO: 723097 - RNA, 22 nt, Human
ucugcucacauggcuccaugca

SEQ ID NO: 723098 - RNA, 22 nt, Human
aucuuucuccauauacaucuuu

SEQ ID NO: 723099 - RNA, 22 nt, Human
acagcugcucuauaucucagcc

SEQ ID NO: 723100 - RNA, 22 nt, Human
acagggcuugugacaacuuuaa

SEQ ID NO: 723101 - RNA, 22 nt, Human
aguguguaaugccaggggcugc

SEQ ID NO: 723102 - RNA, 22 nt, Human
acaagcauaagugagaugaaua

SEQ ID NO: 723103 - RNA, 22 nt, Human
aacaugcaaagcuaugauguau

SEQ ID NO: 723104 - RNA, 22 nt, Human
gcugauuuugagaagcacaguc

SEQ ID NO: 723105 - RNA, 23 nt, Human
ugcugcccacucuuccagcccuc

SEQ ID NO: 723106 - RNA, 22 nt, Human
guuuccuguggccacagaauaa

SEQ ID NO: 723107 - RNA, 22 nt, Human
ucugaagaggcucuugauaaga

SEQ ID NO: 723108 - RNA, 22 nt, Human
auaauuaucucagacacuuguu

SEQ ID NO: 723109 - RNA, 22 nt, Human
uuucauugaacuaaagaaucug

SEQ ID NO: 723110 - RNA, 22 nt, Human
ucuggguggcuucagaggccac

SEQ ID NO: 723111 - RNA, 22 nt, Human
ucugcagagguaauuuacagau

SEQ ID NO: 723112 - RNA, 23 nt, Human
uucuuuggaauugggcugcaagg

SEQ ID NO: 723113 - RNA, 18 nt, Human
uucacaagggcuugguuu

SEQ ID NO: 723114 - RNA, 22 nt, Human
ccagcaugagacgaugaugaag

SEQ ID NO: 723115 - RNA, 22 nt, Human
aagcuguguauuacagaauauu

SEQ ID NO: 723116 - RNA, 22 nt, Human
gaaguuaugaaauuuggacagc

SEQ ID NO: 723117 - RNA, 22 nt, Human
gcaagcaauggacggugacuuu

SEQ ID NO: 723118 - RNA, 22 nt, Human
agcugcuuagaguccucaggau

SEQ ID NO: 723119 - RNA, 18 nt, Human
uacuucaacucccagggc

SEQ ID NO: 723120 - RNA, 22 nt, Human
agaccauagggaccucagguug

SEQ ID NO: 723121 - RNA, 22 nt, Human
uuucagaugugugucucugaag

SEQ ID NO: 723122 - RNA, 22 nt, Human
aagcugaauuuucuaaaagaau

SEQ ID NO: 723123 - RNA, 22 nt, Human
caagcagagguuuauguauuag

SEQ ID NO: 723124 - RNA, 22 nt, Human
ccugguguggcugucacagagg

SEQ ID NO: 723125 - RNA, 22 nt, Human
ccagugcccagucucccugguc

SEQ ID NO: 723126 - RNA, 22 nt, Human
aucagcaaguccuguuaauucu

SEQ ID NO: 723127 - RNA, 22 nt, Human
gggugccugaguuagggcagaa

SEQ ID NO: 723128 - RNA, 22 nt, Human
augugucugguuauugacaugc

SEQ ID NO: 723129 - RNA, 21 nt, Human
aacacauccagaguauuugac

SEQ ID NO: 723130 - RNA, 22 nt, Human
cacagaacauuuuuagaugcag

SEQ ID NO: 723131 - RNA, 22 nt, Human
acaaaauuuuuagacaaggcuu

SEQ ID NO: 723132 - RNA, 22 nt, Human
aacugcaaguggggcuugucau

SEQ ID NO: 723133 - RNA, 22 nt, Human
ggcagcccuguggagaggccca

SEQ ID NO: 723134 - RNA, 22 nt, Human
ugaauaauccacagucauucau

SEQ ID NO: 723135 - RNA, 22 nt, Human
auauuuguauuucgugugugua

SEQ ID NO: 723136 - RNA, 22 nt, Human
cuaucauuuuacaugguuggug

SEQ ID NO: 723137 - RNA, 22 nt, Human
gauacuuuguggaauccuggau

SEQ ID NO: 723138 - RNA, 22 nt, Human
augaccaguuuccccacugucc

SEQ ID NO: 723139 - RNA, 22 nt, Human
aagcauauauuuuauauguugu

SEQ ID NO: 723140 - RNA, 22 nt, Human
caagggggcaggaucacacuug

SEQ ID NO: 723141 - RNA, 22 nt, Human
aggggcucuaaagaucauggaa

SEQ ID NO: 723142 - RNA, 22 nt, Human
uucagggcugacaagccuauug

SEQ ID NO: 723143 - RNA, 22 nt, Human
uuuccacaauuugagcagcaga

SEQ ID NO: 723144 - RNA, 22 nt, Human
uuuuaugagugucccucugugg

SEQ ID NO: 723145 - RNA, 22 nt, Human
aaaucugguucaguaaguccuc

SEQ ID NO: 723146 - RNA, 22 nt, Human
agggcugcugcuccgggcccag

SEQ ID NO: 723147 - RNA, 22 nt, Human
uauuucuucgggauucaagcua

SEQ ID NO: 723148 - RNA, 22 nt, Human
gucucagagagcuacucucuua

SEQ ID NO: 723149 - RNA, 22 nt, Human
ugucuucacaugauaagccauu

SEQ ID NO: 723150 - RNA, 22 nt, Human
caacagagcaguugaucaggaa

SEQ ID NO: 723151 - RNA, 22 nt, Human
gccucuggcuucugcaucagug

SEQ ID NO: 723152 - RNA, 22 nt, Human
ugaaacuuauaagaauaugaau

SEQ ID NO: 723153 - RNA, 22 nt, Human
cuuuaacaguuccauucaauuu

SEQ ID NO: 723154 - RNA, 22 nt, Human
cauaugaaguucaacagagaug

SEQ ID NO: 723155 - RNA, 22 nt, Human
cuggcccuauuccaggccuucc

SEQ ID NO: 723156 - RNA, 22 nt, Human
agccaggucagcucacccugcu

SEQ ID NO: 723157 - RNA, 22 nt, Human
agcuuuuauuggcugucauuug

SEQ ID NO: 723158 - RNA, 22 nt, Human
uauacacauccuccaaagauag

SEQ ID NO: 723159 - RNA, 16 nt, Human
aucuaagaauguagag

SEQ ID NO: 723160 - RNA, 22 nt, Human
uuuaucuguagagcuucaccua

SEQ ID NO: 723161 - RNA, 22 nt, Human
uaccagccuuuuaacaugggcc

SEQ ID NO: 723162 - RNA, 22 nt, Human
agacuacauaugccacaugaag

SEQ ID NO: 723163 - RNA, 22 nt, Human
ccauggcuuuugagucucaaga

SEQ ID NO: 723164 - RNA, 23 nt, Human
cucuggagauccucugccugggu

SEQ ID NO: 723165 - RNA, 22 nt, Human
augggggccugaacaggcaaaa

SEQ ID NO: 723166 - RNA, 22 nt, Human
uuugcaaauucuugucuagccu

SEQ ID NO: 723167 - RNA, 22 nt, Human
aaaugacaauaaaaguccaugc

SEQ ID NO: 723168 - RNA, 22 nt, Human
ggucucagcaguugcuuugacu

SEQ ID NO: 723169 - RNA, 22 nt, Human
acagaaagaugauuugaaaugg

SEQ ID NO: 723170 - RNA, 19 nt, Human
uugcauuguaguuggacug

SEQ ID NO: 723171 - RNA, 22 nt, Human
gugcaauaaauaaauagauugu

SEQ ID NO: 723172 - RNA, 22 nt, Human
aagggggcggcagccaguggaa

SEQ ID NO: 723173 - RNA, 20 nt, Human
uacuucugaggcacucugaa

SEQ ID NO: 723174 - RNA, 19 nt, Human
uagaggagaagggaagugg

SEQ ID NO: 723175 - RNA, 22 nt, Human
uaagauaauccauuauaauguu

SEQ ID NO: 723176 - RNA, 22 nt, Human
gcccagaguucaaggcugcagu

SEQ ID NO: 723177 - RNA, 22 nt, Human
uccuugaagaaugauucuugga

SEQ ID NO: 723178 - RNA, 22 nt, Human
uguuuacaaggaguuuauauug

SEQ ID NO: 723179 - RNA, 21 nt, Human
gggugggaggacacagcaggc

SEQ ID NO: 723180 - RNA, 22 nt, Human
caggaacagcugaccugacaau

SEQ ID NO: 723181 - RNA, 22 nt, Human
cugccaggcagcagagggagaa

SEQ ID NO: 723182 - RNA, 22 nt, Human
gccuggcagggcccggacggca

SEQ ID NO: 723183 - RNA, 22 nt, Human
gagggugggccagauaugaggg

SEQ ID NO: 723184 - RNA, 22 nt, Human
ugcugcuagcuguauugcaaga

SEQ ID NO: 723185 - RNA, 22 nt, Human
uaaaguguggacaguaucuaua

SEQ ID NO: 723186 - RNA, 22 nt, Human
auaauaaugaaagccacugugu

SEQ ID NO: 723187 - RNA, 22 nt, Human
aaaauagauaaugccaggguca

SEQ ID NO: 723188 - RNA, 22 nt, Human
uaaaucacccaucuccuaaucu

SEQ ID NO: 723189 - RNA, 22 nt, Human
uuucuuuccauacauauugcua

SEQ ID NO: 723190 - RNA, 17 nt, Human
uaaguuauagcagaaga

SEQ ID NO: 723191 - RNA, 22 nt, Human
acuauacaccaaaauauuaagg

SEQ ID NO: 723192 - RNA, 22 nt, Human
gccuggagacaaggacaaaggg

SEQ ID NO: 723193 - RNA, 22 nt, Human
ccuguuuacaucaucaaggacu

SEQ ID NO: 723194 - RNA, 22 nt, Human
cuggcagcgcagcaugaagucg

SEQ ID NO: 723195 - RNA, 22 nt, Human
uuucugaggaauuaauacagaa

SEQ ID NO: 723196 - RNA, 22 nt, Human
caguaugauugccaguucuauc

SEQ ID NO: 723197 - RNA, 22 nt, Human
aaauugcuauaugugaauguga

SEQ ID NO: 723198 - RNA, 22 nt, Human
ucuacuuuauaaguauauaagu

SEQ ID NO: 723199 - RNA, 22 nt, Human
acucuucauacagucaucuaau

SEQ ID NO: 723200 - RNA, 22 nt, Human
acugucaaaugcaaugaacuca

SEQ ID NO: 723201 - RNA, 22 nt, Human
uucagcaagaccaccauguacc

SEQ ID NO: 723202 - RNA, 22 nt, Human
acauuucugcaucucagagcua

SEQ ID NO: 723203 - RNA, 17 nt, Human
cgggcauggagggcagg

SEQ ID NO: 723204 - RNA, 22 nt, Human
uaauugcuaauccugccuucua

SEQ ID NO: 723205 - RNA, 22 nt, Human
cagacaacuggacuaagaucac

SEQ ID NO: 723206 - RNA, 22 nt, Human
uuuaaggagcuacucaccguca

SEQ ID NO: 723207 - RNA, 22 nt, Human
aaauaugacuagaaugccaggu

SEQ ID NO: 723208 - RNA, 22 nt, Human
cuugcugucuugcauuuagagc

SEQ ID NO: 723209 - RNA, 22 nt, Human
auucaacuguaaacuuguucac

SEQ ID NO: 723210 - RNA, 22 nt, Human
ggcacaggaaucugugaagugc

SEQ ID NO: 723211 - RNA, 22 nt, Human
aucucuucccaacuccacauuc

SEQ ID NO: 723212 - RNA, 22 nt, Human
gagggggucuaugagguagagc

SEQ ID NO: 723213 - RNA, 22 nt, Human
uucugccuggcaggaggacugu

SEQ ID NO: 723214 - RNA, 22 nt, Human
agcugagacacuugagagacua

SEQ ID NO: 723215 - RNA, 22 nt, Human
cagcuguggggagcuugggcca

SEQ ID NO: 723216 - RNA, 22 nt, Human
ggagcccugcugacaugggugu

SEQ ID NO: 723217 - RNA, 22 nt, Human
cuucugggauuuuugaagacuc

SEQ ID NO: 723218 - RNA, 22 nt, Human
uugcuagcugguguaugcauug

SEQ ID NO: 723219 - RNA, 22 nt, Human
gugaggugacuagcaggugggg

SEQ ID NO: 723220 - RNA, 22 nt, Human
uuccacauuccuuacauucaua

SEQ ID NO: 723221 - RNA, 22 nt, Human
agagaaauuucccugccuucug

SEQ ID NO: 723222 - RNA, 22 nt, Human
aggcauggguagaagagaagcc

SEQ ID NO: 723223 - RNA, 22 nt, Human
cuucuaauucuuauguaagcuu

SEQ ID NO: 723224 - RNA, 19 nt, Human
cuucugugauacaucaguc

SEQ ID NO: 723225 - RNA, 22 nt, Human
cagcccacuucccagcaccuac

SEQ ID NO: 723226 - RNA, 22 nt, Human
ucaguaacccugcuguucagag

SEQ ID NO: 723227 - RNA, 22 nt, Human
uacaaaguaauguauaauaucg

SEQ ID NO: 723228 - RNA, 22 nt, Human
ugcguuuaguuucaagacacgu

SEQ ID NO: 723229 - RNA, 22 nt, Human
cagccaggcccccgagucguug

SEQ ID NO: 723230 - RNA, 22 nt, Human
uguauauguuuguauguacaca

SEQ ID NO: 723231 - RNA, 22 nt, Human
ggucggggauggccaggcuccc

SEQ ID NO: 723232 - RNA, 22 nt, Human
gacagggaaacauugaaguguc

SEQ ID NO: 723233 - RNA, 22 nt, Human
ucugggcugcugugcagugacc

SEQ ID NO: 723234 - RNA, 22 nt, Human
uggauaccugguuuuuauuuac

SEQ ID NO: 723235 - RNA, 22 nt, Human
ucuuuggcaucagggccagcua

SEQ ID NO: 723236 - RNA, 22 nt, Human
gcacagaaguaaaauacaaguc

SEQ ID NO: 723237 - RNA, 22 nt, Human
uccaggccucuagcccucucuu

SEQ ID NO: 723238 - RNA, 22 nt, Human
ccauugaauuagaaggggaagg

SEQ ID NO: 723239 - RNA, 21 nt, Human
uccucugcucucauaccacaa

SEQ ID NO: 723240 - RNA, 22 nt, Human
cauuuauuggcauguaguaggu

SEQ ID NO: 723241 - RNA, 22 nt, Human
gggcagccccagcgcguuggcu

SEQ ID NO: 723242 - RNA, 22 nt, Human
gaacuguauaggagcaguguuu

SEQ ID NO: 723243 - RNA, 22 nt, Human
uauuuugcguugagucagauuu

SEQ ID NO: 723244 - RNA, 22 nt, Human
cugguguggacuccgcgcggag

SEQ ID NO: 723245 - RNA, 22 nt, Human
cccaggaugaucgagaguggga

SEQ ID NO: 723246 - RNA, 22 nt, Human
gcagugccuugcuucucugucu

SEQ ID NO: 723247 - RNA, 22 nt, Human
gcuuuucuauaagaacuuucaa

SEQ ID NO: 723248 - RNA, 22 nt, Human
cuccuggcaggcugagugaaau

SEQ ID NO: 723249 - RNA, 22 nt, Human
aagauguuagauuauggggaca

SEQ ID NO: 723250 - RNA, 22 nt, Human
gccaggguugccaaugggggca

SEQ ID NO: 723251 - RNA, 22 nt, Human
cuggcuucccugucuuauggaa

SEQ ID NO: 723252 - RNA, 22 nt, Human
aaggccaggcagggagcuguga

SEQ ID NO: 723253 - RNA, 22 nt, Human
cggagccugcuuguugcagcug

SEQ ID NO: 723254 - RNA, 22 nt, Human
aggcaguggagaagguuuguga

SEQ ID NO: 723255 - RNA, 22 nt, Human
ugggcucauggcccagcacugg

SEQ ID NO: 723256 - RNA, 22 nt, Human
uugaaugaagggaugaccgaag

SEQ ID NO: 723257 - RNA, 22 nt, Human
aagcccagaugagaucccugga

SEQ ID NO: 723258 - RNA, 22 nt, Human
aucuaacugggcuauuuuauug

SEQ ID NO: 723259 - RNA, 23 nt, Human
auagacccaagaguaaaggcauc

SEQ ID NO: 723260 - RNA, 22 nt, Human
uggaaguugaaucucagucaug

SEQ ID NO: 723261 - RNA, 22 nt, Human
ucugccugaaccacucuuggag

SEQ ID NO: 723262 - RNA, 22 nt, Human
agccaagggucagcugcacaga

SEQ ID NO: 723263 - RNA, 22 nt, Human
ccugaggucacaacuugcuuau

SEQ ID NO: 723264 - RNA, 22 nt, Human
uugaagcacaaugucuuuuauc

SEQ ID NO: 723265 - RNA, 22 nt, Human
gcucccacugcagcccugagcc

SEQ ID NO: 723266 - RNA, 22 nt, Human
ucauugaagcccuugacaagcc

SEQ ID NO: 723267 - RNA, 22 nt, Human
gcucuggcuacuccacccuguu

SEQ ID NO: 723268 - RNA, 22 nt, Human
ucugugucguucugugcucugg

SEQ ID NO: 723269 - RNA, 22 nt, Human
ucucagcacguuguuuucauug

SEQ ID NO: 723270 - RNA, 22 nt, Human
gaaagcugugaaauagugcucu

SEQ ID NO: 723271 - RNA, 22 nt, Human
cuccuugguguaguacugagca

SEQ ID NO: 723272 - RNA, 22 nt, Human
aggucugggauugaagacauca

SEQ ID NO: 723273 - RNA, 22 nt, Human
gaucagugaacuauacugccuc

SEQ ID NO: 723274 - RNA, 23 nt, Human
agcaggauaauuuuauuaugccc

SEQ ID NO: 723275 - RNA, 22 nt, Human
aaauauuagggagaacagggac

SEQ ID NO: 723276 - RNA, 22 nt, Human
uuacacacagagcugggccugg

SEQ ID NO: 723277 - RNA, 22 nt, Human
ugagcccaggaguuggagaccg

SEQ ID NO: 723278 - RNA, 19 nt, Human
uugugagcugaagaacagg

SEQ ID NO: 723279 - RNA, 23 nt, Human
uucaugagauuaucugcaugugu

SEQ ID NO: 723280 - RNA, 23 nt, Human
agagccugaaagacuucuggcac

SEQ ID NO: 723281 - RNA, 22 nt, Human
agucaggacacagcaugaacau

SEQ ID NO: 723282 - RNA, 22 nt, Human
aacauuuauauggguucaugaa

SEQ ID NO: 723283 - RNA, 22 nt, Human
ugaggucauggcugauauuucc

SEQ ID NO: 723284 - RNA, 22 nt, Human
uggcuucuuuguagaaauugaa

SEQ ID NO: 723285 - RNA, 22 nt, Human
uuugagaagauguaauguuaag

SEQ ID NO: 723286 - RNA, 20 nt, Human
cagggacagcaguggguuuu

SEQ ID NO: 723287 - RNA, 22 nt, Human
uaggcacugggcuaggacaggu

SEQ ID NO: 723288 - RNA, 22 nt, Human
uuguacaaagauuucacagcuc

SEQ ID NO: 723289 - RNA, 22 nt, Human
ugaaauguucuggaguuucugu

SEQ ID NO: 723290 - RNA, 22 nt, Human
gcucugugaguauuggcccugg

SEQ ID NO: 723291 - RNA, 22 nt, Human
uacauacaguggaugcuuuagg

SEQ ID NO: 723292 - RNA, 21 nt, Human
ugacaguguggcauggaaggu

SEQ ID NO: 723293 - RNA, 22 nt, Human
cuccccauugugaccucaucca

SEQ ID NO: 723294 - RNA, 22 nt, Human
auuuucagcccccacucguggc

SEQ ID NO: 723295 - RNA, 22 nt, Human
ucuuuguuugccuuuaucaaga

SEQ ID NO: 723296 - RNA, 22 nt, Human
acuggcccgggagcagaggccu

SEQ ID NO: 723297 - RNA, 22 nt, Human
cuggccuguccugacccagccu

SEQ ID NO: 723298 - RNA, 22 nt, Human
ucuagguucaugggauucagug

SEQ ID NO: 723299 - RNA, 22 nt, Human
cccaggagagagacuugaaucu

SEQ ID NO: 723300 - RNA, 22 nt, Human
augauucuggugagaaugagga

SEQ ID NO: 723301 - RNA, 22 nt, Human
ccugggcugcaugauggcauuu

SEQ ID NO: 723302 - RNA, 22 nt, Human
guguuuuaucagacaaaguaua

SEQ ID NO: 723303 - RNA, 22 nt, Human
caaagaaugagugaguacauaa

SEQ ID NO: 723304 - RNA, 22 nt, Human
cagaugaaguaggugacgagca

SEQ ID NO: 723305 - RNA, 22 nt, Human
ccugccagugaagcugacgggc

SEQ ID NO: 723306 - RNA, 22 nt, Human
acucugcuguuuacucucuaua

SEQ ID NO: 723307 - RNA, 23 nt, Human
gaauucuuaaggucacuaaaguc

SEQ ID NO: 723308 - RNA, 22 nt, Human
gaaucuuuugucucgugaauaa

SEQ ID NO: 723309 - RNA, 22 nt, Human
ucucaggaauagaguggcagca

SEQ ID NO: 723310 - RNA, 22 nt, Human
ucaggcugaaucauccuagcuu

SEQ ID NO: 723311 - RNA, 22 nt, Human
gcucuggcuaguuaccucuuac

SEQ ID NO: 723312 - RNA, 22 nt, Human
ucaucugaacaugcagccugug

SEQ ID NO: 723313 - RNA, 22 nt, Human
agcugaggcucugagagggaag

SEQ ID NO: 723314 - RNA, 22 nt, Human
uucuaccagaccccagacuugu

SEQ ID NO: 723315 - RNA, 21 nt, Human
auuuuguacauagaauuuguc

SEQ ID NO: 723316 - RNA, 22 nt, Human
auguggcccagcggucaggcug

SEQ ID NO: 723317 - RNA, 22 nt, Human
guggcagggcaaugcucccucu

SEQ ID NO: 723318 - RNA, 22 nt, Human
aaaggcacaaauucagcauuuu

SEQ ID NO: 723319 - RNA, 20 nt, Human
aaguugcagagaguugucuu

SEQ ID NO: 723320 - RNA, 22 nt, Human
augcauugucaggcaauuucau

SEQ ID NO: 723321 - RNA, 22 nt, Human
aacauuucagcaccugauuccu

SEQ ID NO: 723322 - RNA, 22 nt, Human
gucugcccggccuuccuccacc

SEQ ID NO: 723323 - RNA, 22 nt, Human
auuacaguggguaaacagaauu

SEQ ID NO: 723324 - RNA, 21 nt, Human
agcucuggagcagcaaucaag

SEQ ID NO: 723325 - RNA, 22 nt, Human
ggcacagccacuuuggagaacu

SEQ ID NO: 723326 - RNA, 22 nt, Human
uaugugcaaaaugcuagacuag

SEQ ID NO: 723327 - RNA, 22 nt, Human
aggacaggauuccuugccuugc

SEQ ID NO: 723328 - RNA, 22 nt, Human
gccacaggcacuuaagggcugg

SEQ ID NO: 723329 - RNA, 22 nt, Human
ccaggaagccucagaugcugag

SEQ ID NO: 723330 - RNA, 22 nt, Human
gaggagcugagccacguccugg

SEQ ID NO: 723331 - RNA, 22 nt, Human
aggcucaguauagcuggcaagu

SEQ ID NO: 723332 - RNA, 22 nt, Human
guggccagggcccacaggauga

SEQ ID NO: 723333 - RNA, 22 nt, Human
cuucacagaugcugagagggcu

SEQ ID NO: 723334 - RNA, 22 nt, Human
cacauuuaggagguggggaagc

SEQ ID NO: 723335 - RNA, 22 nt, Human
aggaaacaguugguaaugcaua

SEQ ID NO: 723336 - RNA, 22 nt, Human
aguguguacauuuggugcaguu

SEQ ID NO: 723337 - RNA, 19 nt, Human
uggcuuccaucucucucau

SEQ ID NO: 723338 - RNA, 22 nt, Human
cacccacugagcucauguccca

SEQ ID NO: 723339 - RNA, 22 nt, Human
agagaacauauuuuguaugauu

SEQ ID NO: 723340 - RNA, 22 nt, Human
gcauugaaggacuuccauuaua

SEQ ID NO: 723341 - RNA, 22 nt, Human
ucauuuugggguuugucaucuu

SEQ ID NO: 723342 - RNA, 17 nt, Human
uucugcugucguccucu

SEQ ID NO: 723343 - RNA, 22 nt, Human
uacuguacauuccguuuguugc

SEQ ID NO: 723344 - RNA, 22 nt, Human
ugggcagacauugaguuuguuc

SEQ ID NO: 723345 - RNA, 22 nt, Human
uagaggcugggaauuauuuuca

SEQ ID NO: 723346 - RNA, 22 nt, Human
aaaacagacagccaguguagag

SEQ ID NO: 723347 - RNA, 22 nt, Human
gaauguuuuuauaaguguuaca

SEQ ID NO: 723348 - RNA, 23 nt, Human
uauguauguauguuuguauggaa

SEQ ID NO: 723349 - RNA, 22 nt, Human
guggcagagccaaggcuggagc

SEQ ID NO: 723350 - RNA, 22 nt, Human
ucucaagaucucaagauggccc

SEQ ID NO: 723351 - RNA, 22 nt, Human
augcaguuuaaggcacaauuag

SEQ ID NO: 723352 - RNA, 22 nt, Human
ccugggucacucaggcaggcgg

SEQ ID NO: 723353 - RNA, 22 nt, Human
uagcacaagcaacuacugaagu

SEQ ID NO: 723354 - RNA, 22 nt, Human
gccugggagagggauagugcag

SEQ ID NO: 723355 - RNA, 22 nt, Human
aauguguuuaguuaaugaguug

SEQ ID NO: 723356 - RNA, 22 nt, Human
ucaggccuucagaccuggcccg

SEQ ID NO: 723357 - RNA, 22 nt, Human
cuauggugauagaaaucagaau

SEQ ID NO: 723358 - RNA, 22 nt, Human
ggucugaaaauggugaccacca

SEQ ID NO: 723359 - RNA, 22 nt, Human
uggggcuaaacacgccuggccu

SEQ ID NO: 723360 - RNA, 22 nt, Human
gcccagccuccaagcuccaagg

SEQ ID NO: 723361 - RNA, 22 nt, Human
agaagccacugcucccagugag

SEQ ID NO: 723362 - RNA, 22 nt, Human
cccucugacugggccaguucug

SEQ ID NO: 723363 - RNA, 22 nt, Human
acagcucuuaggcagaaccaac

SEQ ID NO: 723364 - RNA, 23 nt, Human
gcucccugucccugcacuuaggc

SEQ ID NO: 723365 - RNA, 20 nt, Human
acacacagagacaugcgcau

SEQ ID NO: 723366 - RNA, 22 nt, Human
auacagaugagaucaggcauaa

SEQ ID NO: 723367 - RNA, 22 nt, Human
gccacuguugcuccucaggaaa

SEQ ID NO: 723368 - RNA, 22 nt, Human
ucagugcuuuugagaagcuccu

SEQ ID NO: 723369 - RNA, 22 nt, Human
uggagcaggccggaaguggcuu

SEQ ID NO: 723370 - RNA, 22 nt, Human
guccucuggugaaagcauuccc

SEQ ID NO: 723371 - RNA, 22 nt, Human
gaacauuuggcaugagaauuug

SEQ ID NO: 723372 - RNA, 22 nt, Human
cuugaauguccuguggcaaagu

SEQ ID NO: 723373 - RNA, 22 nt, Human
auuguaagagguuuggcugugu

SEQ ID NO: 723374 - RNA, 22 nt, Human
uucagcucagcacugacaagau

SEQ ID NO: 723375 - RNA, 22 nt, Human
uauugacagagggucagaagag

SEQ ID NO: 723376 - RNA, 22 nt, Human
agccaggccuuagggagaggca

SEQ ID NO: 723377 - RNA, 22 nt, Human
gugcugagcacagcugcccagg

SEQ ID NO: 723378 - RNA, 22 nt, Human
accuagcugaggagugugagug

SEQ ID NO: 723379 - RNA, 22 nt, Human
ugguuccucaagcgcuggcggc

SEQ ID NO: 723380 - RNA, 22 nt, Human
gaaguggaauuacugggucaua

SEQ ID NO: 723381 - RNA, 22 nt, Human
aggagacagaauuuaaauuugg

SEQ ID NO: 723382 - RNA, 22 nt, Human
guauauaagguaaagcgauugu

SEQ ID NO: 723383 - RNA, 22 nt, Human
aagagccagcuagugaagaggc

SEQ ID NO: 723384 - RNA, 22 nt, Human
uacauacagccaaguaugaagu

SEQ ID NO: 723385 - RNA, 22 nt, Human
augugucuagauugcuguaccg

SEQ ID NO: 723386 - RNA, 23 nt, Human
gguuuucauggcauuccuugccu

SEQ ID NO: 723387 - RNA, 20 nt, Human
ugugggccuucggcgugcuc

SEQ ID NO: 723388 - RNA, 22 nt, Human
cugucuccuccacugcauggga

SEQ ID NO: 723389 - RNA, 22 nt, Human
cuucagaagaaaagcagugugu

SEQ ID NO: 723390 - RNA, 22 nt, Human
ugccagggagcccugcugacca

SEQ ID NO: 723391 - RNA, 22 nt, Human
cacauuauucuaaagagguacu

SEQ ID NO: 723392 - RNA, 22 nt, Human
ccagguguggggaggacucaca

SEQ ID NO: 723393 - RNA, 21 nt, Human
auucagaaagggaauaaacuc

SEQ ID NO: 723394 - RNA, 22 nt, Human
agaggccagguccagaguuugu

SEQ ID NO: 723395 - RNA, 22 nt, Human
uccggacucaccugacaauggc

SEQ ID NO: 723396 - RNA, 22 nt, Human
aucagcaagacuaggggaauac

SEQ ID NO: 723397 - RNA, 22 nt, Human
uggaggaaguugcuggaaguca

SEQ ID NO: 723398 - RNA, 22 nt, Human
gugugcugagugacugucauca

SEQ ID NO: 723399 - RNA, 22 nt, Human
auauguauuuuaacguguaagg

SEQ ID NO: 723400 - RNA, 22 nt, Human
ggcuucucucccccagcuccac

SEQ ID NO: 723401 - RNA, 22 nt, Human
gcuuggaaguaggauugggaga

SEQ ID NO: 723402 - RNA, 22 nt, Human
acugaggauggauaggucauau

SEQ ID NO: 723403 - RNA, 22 nt, Human
ggguguagaaagaacccucugg

SEQ ID NO: 723404 - RNA, 22 nt, Human
aaguuguagucagaugucaguu

SEQ ID NO: 723405 - RNA, 22 nt, Human
acuccagggcuccaccccagau

SEQ ID NO: 723406 - RNA, 22 nt, Human
uauucacauuaauaagucuuca

SEQ ID NO: 723407 - RNA, 18 nt, Human
gcagcuuuugauucaccc

SEQ ID NO: 723408 - RNA, 22 nt, Human
uccucuugggaauaccuuucua

SEQ ID NO: 723409 - RNA, 22 nt, Human
ugugaagguaaggaggggcaag

SEQ ID NO: 723410 - RNA, 22 nt, Human
ugcagagauugaacaagaagga

SEQ ID NO: 723411 - RNA, 22 nt, Human
cucuggaggcagcaccagccag

SEQ ID NO: 723412 - RNA, 22 nt, Human
cacaggaaucgucacuuagcgc

SEQ ID NO: 723413 - RNA, 19 nt, Human
ucacuucuguuagcaugga

SEQ ID NO: 723414 - RNA, 22 nt, Human
gugggcagccccuucaaggcca

SEQ ID NO: 723415 - RNA, 22 nt, Human
uagacaggguggcuuagaaaca

SEQ ID NO: 723416 - RNA, 22 nt, Human
uuuccuuaaaucuguuucuagu

SEQ ID NO: 723417 - RNA, 20 nt, Human
uuuaccaacucaccaguauc

SEQ ID NO: 723418 - RNA, 22 nt, Human
ucaccucaccacccuuaugguu

SEQ ID NO: 723419 - RNA, 22 nt, Human
uuggaaggcccugccuagcagg

SEQ ID NO: 723420 - RNA, 22 nt, Human
agcaacagguuuauuaucuuau

SEQ ID NO: 723421 - RNA, 22 nt, Human
uuguuuaaugccucauacaucu

SEQ ID NO: 723422 - RNA, 22 nt, Human
uucuacagaauaaauguuuaca

SEQ ID NO: 723423 - RNA, 22 nt, Human
gagcugcuucugugugccgggu

SEQ ID NO: 723424 - RNA, 22 nt, Human
uuauauccaaaggcaaggagga

SEQ ID NO: 723425 - RNA, 22 nt, Human
uuucagaugcaauuaauuuuca

SEQ ID NO: 723426 - RNA, 22 nt, Human
agcuggaacuggguuuguugga

SEQ ID NO: 723427 - RNA, 22 nt, Human
ucugggaaggagccugagaauu

SEQ ID NO: 723428 - RNA, 22 nt, Human
ucccuggcagcuaagggugguc

SEQ ID NO: 723429 - RNA, 22 nt, Human
uagggagaggaagcaggccgcu

SEQ ID NO: 723430 - RNA, 22 nt, Human
cuggcagucugccucuucacug

SEQ ID NO: 723431 - RNA, 22 nt, Human
aaaaacuguaauuacuuuugca

SEQ ID NO: 723432 - RNA, 19 nt, Human
guugaaaguaggugagggu

SEQ ID NO: 723433 - RNA, 22 nt, Human
gaggcuaaggugccagacgaau

SEQ ID NO: 723434 - RNA, 21 nt, Human
agauccagugccauaaggccc

SEQ ID NO: 723435 - RNA, 22 nt, Human
agagcagcacguuguccccaca

SEQ ID NO: 723436 - RNA, 22 nt, Human
uggcuggaagucagaaauggga

SEQ ID NO: 723437 - RNA, 22 nt, Human
uucuaguuuucaguccaccagg

SEQ ID NO: 723438 - RNA, 22 nt, Human
cccugacccuaucagagggcca

SEQ ID NO: 723439 - RNA, 21 nt, Human
auagaacaccaggcauauaua

SEQ ID NO: 723440 - RNA, 22 nt, Human
aaauaagaaauucuucuuugca

SEQ ID NO: 723441 - RNA, 22 nt, Human
acccucccauuuccauguagca

SEQ ID NO: 723442 - RNA, 22 nt, Human
ucuguauugauucuguuaggca

SEQ ID NO: 723443 - RNA, 22 nt, Human
uaguuaggaaaguccagggagc

SEQ ID NO: 723444 - RNA, 19 nt, Human
gacauuccugacacuggcu

SEQ ID NO: 723445 - RNA, 22 nt, Human
caugcagucaauaaacaugugu

SEQ ID NO: 723446 - RNA, 22 nt, Human
aggcacagagaaguaaaguauc

SEQ ID NO: 723447 - RNA, 22 nt, Human
ucaaaauucuagggagaauggu

SEQ ID NO: 723448 - RNA, 22 nt, Human
uacaugaaccuuuaugugugau

SEQ ID NO: 723449 - RNA, 22 nt, Human
ggacacagguaaauaccacuga

SEQ ID NO: 723450 - RNA, 22 nt, Human
uauucaggucgagcuaacugcu

SEQ ID NO: 723451 - RNA, 22 nt, Human
aacagcaguggcaggagaaggc

SEQ ID NO: 723452 - RNA, 22 nt, Human
caaggccauaagagauacaaaa

SEQ ID NO: 723453 - RNA, 19 nt, Human
caugugcaugagcacagga

SEQ ID NO: 723454 - RNA, 22 nt, Human
uauaaguguaguuucaaauguu

SEQ ID NO: 723455 - RNA, 22 nt, Human
gcccagggucuacaaaaauauu

SEQ ID NO: 723456 - RNA, 22 nt, Human
aacaaugugauugaagcuagaa

SEQ ID NO: 723457 - RNA, 22 nt, Human
ggccuguccagccugccuggcu

SEQ ID NO: 723458 - RNA, 22 nt, Human
caauuaaagaagaccugccuca

SEQ ID NO: 723459 - RNA, 22 nt, Human
acucagcuaaacucagucuaug

SEQ ID NO: 723460 - RNA, 22 nt, Human
agccauccucccaccucagccu

SEQ ID NO: 723461 - RNA, 22 nt, Human
ugagaaugaggggguagaaggu

SEQ ID NO: 723462 - RNA, 22 nt, Human
caaaaagcuuagguaacaagcc

SEQ ID NO: 723463 - RNA, 22 nt, Human
uucaauucaauucuaaauauau

SEQ ID NO: 723464 - RNA, 22 nt, Human
caggaaaugaacaggaaugaac

SEQ ID NO: 723465 - RNA, 22 nt, Human
ucaugagucugcaaauuaugga

SEQ ID NO: 723466 - RNA, 22 nt, Human
gagaaaauagcauguguaguau

SEQ ID NO: 723467 - RNA, 22 nt, Human
cucagcccagcucaggucuuuc

SEQ ID NO: 723468 - RNA, 23 nt, Human
acuagaaaaugacuuucucccug

SEQ ID NO: 723469 - RNA, 22 nt, Human
acacagaggaaagugugaaggg

SEQ ID NO: 723470 - RNA, 21 nt, Human
uuacagcaauguuagcaggaa

SEQ ID NO: 723471 - RNA, 22 nt, Human
guguccuuauuucugucucuca

SEQ ID NO: 723472 - RNA, 22 nt, Human
ccagcagcccucuuccaagacu

SEQ ID NO: 723473 - RNA, 22 nt, Human
gguguccucaugauuuucuaga

SEQ ID NO: 723474 - RNA, 22 nt, Human
gugauaaaauagaaacaguggu

SEQ ID NO: 723475 - RNA, 22 nt, Human
gucucagauaacauguauucua

SEQ ID NO: 723476 - RNA, 22 nt, Human
uuccuuccgggcaccaggcacu

SEQ ID NO: 723477 - RNA, 20 nt, Human
cagcccugugaccuggcccu

SEQ ID NO: 723478 - RNA, 22 nt, Human
ggcaccagcaggcaccgaugcc

SEQ ID NO: 723479 - RNA, 22 nt, Human
uggcaacauggacaggucugcc

SEQ ID NO: 723480 - RNA, 22 nt, Human
acuguucauuuguccuguaucu

SEQ ID NO: 723481 - RNA, 22 nt, Human
aggacacagcugcucugcagag

SEQ ID NO: 723482 - RNA, 22 nt, Human
guuacaguuugggcuugauuca

SEQ ID NO: 723483 - RNA, 22 nt, Human
gcuguacaaggccucugccauc

SEQ ID NO: 723484 - RNA, 22 nt, Human
ucugcacaaaacugucgcagaa

SEQ ID NO: 723485 - RNA, 22 nt, Human
ccagccaguauauuccaaagcc

SEQ ID NO: 723486 - RNA, 22 nt, Human
gggugggauggcaggagccgcu

SEQ ID NO: 723487 - RNA, 22 nt, Human
uuacuugauguaugaugaguag

SEQ ID NO: 723488 - RNA, 22 nt, Human
uguguucugaaggagaagagug

SEQ ID NO: 723489 - RNA, 22 nt, Human
agggucugacaaugugacuuag

SEQ ID NO: 723490 - RNA, 22 nt, Human
ggacagcucugccaggagcuca

SEQ ID NO: 723491 - RNA, 22 nt, Human
acaacauuuaaggaggcacuga

SEQ ID NO: 723492 - RNA, 22 nt, Human
uccuggguagagaccugaugaa

SEQ ID NO: 723493 - RNA, 22 nt, Human
gaugggcagcacagcuggccaa

SEQ ID NO: 723494 - RNA, 21 nt, Human
ugaguuucagaggggaaggaa

SEQ ID NO: 723495 - RNA, 22 nt, Human
ucccaauuaacagguaucaggc

SEQ ID NO: 723496 - RNA, 22 nt, Human
cucauugauucagugcugcucu

SEQ ID NO: 723497 - RNA, 22 nt, Human
agauggcugauggcaggagcca

SEQ ID NO: 723498 - RNA, 22 nt, Human
gacauugacaguccuccuuaua

SEQ ID NO: 723499 - RNA, 21 nt, Human
uucucuggucaagcacacaua

SEQ ID NO: 723500 - RNA, 22 nt, Human
uguaggccuauguccagcaauu

SEQ ID NO: 723501 - RNA, 22 nt, Human
uggcugaaggaagauucuucua

SEQ ID NO: 723502 - RNA, 22 nt, Human
uggaauaacucaccaaggucau

SEQ ID NO: 723503 - RNA, 21 nt, Human
agaggcgggguuuuggaggcc

SEQ ID NO: 723504 - RNA, 22 nt, Human
ugacugugccgugccccuagga

SEQ ID NO: 723505 - RNA, 16 nt, Human
ggaggaaggcauagug

SEQ ID NO: 723506 - RNA, 22 nt, Human
ccuugcugcgugcuagcacaga

SEQ ID NO: 723507 - RNA, 22 nt, Human
aggcaaaauuacaaaguuauua

SEQ ID NO: 723508 - RNA, 22 nt, Human
aguuauauaacuaucuagaugc

SEQ ID NO: 723509 - RNA, 22 nt, Human
cagcugcacugaagcagguuug

SEQ ID NO: 723510 - RNA, 20 nt, Human
agggaacaauggacgcuguc

SEQ ID NO: 723511 - RNA, 22 nt, Human
cagagggcucaguccugcugga

SEQ ID NO: 723512 - RNA, 22 nt, Human
cugccagguuggcgcucgcucu

SEQ ID NO: 723513 - RNA, 22 nt, Human
auauaugcgcaggcacccagcu

SEQ ID NO: 723514 - RNA, 22 nt, Human
uagcaauguguguguauaaauu

SEQ ID NO: 723515 - RNA, 22 nt, Human
uuuuauauugagugagaguucc

SEQ ID NO: 723516 - RNA, 18 nt, Human
ccaaggccccugcugggg

SEQ ID NO: 723517 - RNA, 22 nt, Human
gucuuaaaaucagaggauauag

SEQ ID NO: 723518 - RNA, 22 nt, Human
aaggggugcuguuggaaaccca

SEQ ID NO: 723519 - RNA, 22 nt, Human
ucuggggaccauggcaucuaaa

SEQ ID NO: 723520 - RNA, 22 nt, Human
auccaguuuaugucauauucuu

SEQ ID NO: 723521 - RNA, 22 nt, Human
uuaguugaucauucaacauggg

SEQ ID NO: 723522 - RNA, 22 nt, Human
ugagcagagcaggcugcgcccu

SEQ ID NO: 723523 - RNA, 22 nt, Human
cagcuccccucuguggggcagu

SEQ ID NO: 723524 - RNA, 22 nt, Human
acuuucuucuuaugcauuaagg

SEQ ID NO: 723525 - RNA, 22 nt, Human
caguucucuugaucgucucuug

SEQ ID NO: 723526 - RNA, 22 nt, Human
acaucaguaauuaagucucaag

SEQ ID NO: 723527 - RNA, 22 nt, Human
cugcagagcaaguaacauccuc

SEQ ID NO: 723528 - RNA, 22 nt, Human
gcccugaacgaggggucuggag

SEQ ID NO: 723529 - RNA, 22 nt, Human
ucaccaggauuccuaucaguag

SEQ ID NO: 723530 - RNA, 22 nt, Human
uccagaccaugugagaggcgca

SEQ ID NO: 723531 - RNA, 22 nt, Human
ggugggcacccgagacuggauc

SEQ ID NO: 723532 - RNA, 22 nt, Human
gagguucaggaaaugggcaaag

SEQ ID NO: 723533 - RNA, 22 nt, Human
uccuccagcuucucuuuugggg

SEQ ID NO: 723534 - RNA, 22 nt, Human
caaacauugcuaccagagguuu

SEQ ID NO: 723535 - RNA, 22 nt, Human
uccagccacucagcagggauug

SEQ ID NO: 723536 - RNA, 22 nt, Human
acaugauuggacuccuuccccu

SEQ ID NO: 723537 - RNA, 22 nt, Human
cccaggcacucuuggucauuuu

SEQ ID NO: 723538 - RNA, 22 nt, Human
gugcucuggcuggucucccggu

SEQ ID NO: 723539 - RNA, 22 nt, Human
caggcagauuugcugcccucca

SEQ ID NO: 723540 - RNA, 22 nt, Human
aaggagaaaugguagaugugca

SEQ ID NO: 723541 - RNA, 22 nt, Human
aaauuggauuuuaaacuguugg

SEQ ID NO: 723542 - RNA, 22 nt, Human
uggaauguuuccccagccugca

SEQ ID NO: 723543 - RNA, 22 nt, Human
cuguggccagauggugccaguu

SEQ ID NO: 723544 - RNA, 22 nt, Human
cuguccucuguccucagcagga

SEQ ID NO: 723545 - RNA, 22 nt, Human
ugccacugggcaugcagauguc

SEQ ID NO: 723546 - RNA, 22 nt, Human
uccucagaugcucuuggacgcc

SEQ ID NO: 723547 - RNA, 22 nt, Human
agcucccaggcagucaugagga

SEQ ID NO: 723548 - RNA, 22 nt, Human
ccagguggacaaggcuuucaca

SEQ ID NO: 723549 - RNA, 19 nt, Human
agcagcagcuaccacuugu

SEQ ID NO: 723550 - RNA, 22 nt, Human
aaauugcuuauaaagaugaaug

SEQ ID NO: 723551 - RNA, 22 nt, Human
gacaggcuuagggagggugcuc

SEQ ID NO: 723552 - RNA, 22 nt, Human
agggcccuuacgcaggcccuuc

SEQ ID NO: 723553 - RNA, 22 nt, Human
cugucacuuaaauucaggcuga

SEQ ID NO: 723554 - RNA, 22 nt, Human
uacaagucacuuccuuucuaaa

SEQ ID NO: 723555 - RNA, 22 nt, Human
aaaucgguugguucaagguaau

SEQ ID NO: 723556 - RNA, 22 nt, Human
cuguacagaguucugaguguac

SEQ ID NO: 723557 - RNA, 16 nt, Human
acccuggguaguccug

SEQ ID NO: 723558 - RNA, 22 nt, Human
agguuagugcugaaaugacaug

SEQ ID NO: 723559 - RNA, 22 nt, Human
ccaauacacuuuauagaagaaa

SEQ ID NO: 723560 - RNA, 22 nt, Human
ggcacugcccacccucacaggg

SEQ ID NO: 723561 - RNA, 22 nt, Human
uugacaaaguuuaguaauaauc

SEQ ID NO: 723562 - RNA, 22 nt, Human
aucuugggaauuuuccaggagu

SEQ ID NO: 723563 - RNA, 19 nt, Human
ucucuggggacacuuucac

SEQ ID NO: 723564 - RNA, 22 nt, Human
ucacauuuguuccucugcacuu

SEQ ID NO: 723565 - RNA, 22 nt, Human
gucugcugcagagcauggcuuu

SEQ ID NO: 723566 - RNA, 22 nt, Human
ccaagcaugggguucaguagga

SEQ ID NO: 723567 - RNA, 22 nt, Human
agggcuccuaugccccauggac

SEQ ID NO: 723568 - RNA, 22 nt, Human
acaugauuucagggaauucuca

SEQ ID NO: 723569 - RNA, 22 nt, Human
ggcucugucaccuaugagcuga

SEQ ID NO: 723570 - RNA, 22 nt, Human
gccuggagcucuccacuugggg

SEQ ID NO: 723571 - RNA, 22 nt, Human
uucucccaucucagucuuacau

SEQ ID NO: 723572 - RNA, 18 nt, Human
cuggcuuucuuauccauc

SEQ ID NO: 723573 - RNA, 22 nt, Human
uucaugaagggugaauauaguc

SEQ ID NO: 723574 - RNA, 22 nt, Human
ucuuuauaaaagucauuauguc

SEQ ID NO: 723575 - RNA, 20 nt, Human
cacaacuguccacaugcucc

SEQ ID NO: 723576 - RNA, 22 nt, Human
gcuucuuuccuugggcuggaac

SEQ ID NO: 723577 - RNA, 22 nt, Human
gccaccaguagcuaacaacagu

SEQ ID NO: 723578 - RNA, 22 nt, Human
uccugcuuugugccucacacuu

SEQ ID NO: 723579 - RNA, 22 nt, Human
auguaucagaaauagcauuggc

SEQ ID NO: 723580 - RNA, 22 nt, Human
uugaggagcaggaugggaggcu

SEQ ID NO: 723581 - RNA, 22 nt, Human
ggcacagcacagagcacaugua

SEQ ID NO: 723582 - RNA, 22 nt, Human
agcaggcuuaugguugaaggga

SEQ ID NO: 723583 - RNA, 22 nt, Human
ccaggucuggcacuggccaguc

SEQ ID NO: 723584 - RNA, 22 nt, Human
uaguuuaggaucuuuuuugugc

SEQ ID NO: 723585 - RNA, 22 nt, Human
aggcagaaaauagucauccaaa

SEQ ID NO: 723586 - RNA, 22 nt, Human
cugaaaggaauaaggcucuuug

SEQ ID NO: 723587 - RNA, 22 nt, Human
auauucguggucaaguaaggcc

SEQ ID NO: 723588 - RNA, 22 nt, Human
uggcaggaaaaagggccagagg

SEQ ID NO: 723589 - RNA, 22 nt, Human
agcagaaauagaagucaaugau

SEQ ID NO: 723590 - RNA, 21 nt, Human
ugcucagucugucuccagcuu

SEQ ID NO: 723591 - RNA, 22 nt, Human
uuaaacauuuuugaugaucgau

SEQ ID NO: 723592 - RNA, 22 nt, Human
guuucuuuugugaucaccaacc

SEQ ID NO: 723593 - RNA, 23 nt, Human
agauccaugugggcuggaaacug

SEQ ID NO: 723594 - RNA, 19 nt, Human
cugcucagagcagcuccag

SEQ ID NO: 723595 - RNA, 22 nt, Human
acugggacuguaugugcuggac

SEQ ID NO: 723596 - RNA, 22 nt, Human
caauugcugauaugcagaagac

SEQ ID NO: 723597 - RNA, 22 nt, Human
aagcccuguccggggggaagaa

SEQ ID NO: 723598 - RNA, 22 nt, Human
cacugugcuccuuccuuagcac

SEQ ID NO: 723599 - RNA, 22 nt, Human
ugccaggccucaggagucucca

SEQ ID NO: 723600 - RNA, 22 nt, Human
uaauacuuuugccuuguauuca

SEQ ID NO: 723601 - RNA, 22 nt, Human
ucuggacuccaugcugccugga

SEQ ID NO: 723602 - RNA, 22 nt, Human
aaagauaauguuuccuuauucu

SEQ ID NO: 723603 - RNA, 22 nt, Human
ugauuuccacagucaggggugc

SEQ ID NO: 723604 - RNA, 22 nt, Human
uuaguuagagcccuauguuagg

SEQ ID NO: 723605 - RNA, 22 nt, Human
uuuuccuauaugcaaagaaugc

SEQ ID NO: 723606 - RNA, 22 nt, Human
uagucacaugaucacaggaucg

SEQ ID NO: 723607 - RNA, 21 nt, Human
ugcugccauagaccugaggga

SEQ ID NO: 723608 - RNA, 22 nt, Human
ccacagcaccugcagccaguug

SEQ ID NO: 723609 - RNA, 22 nt, Human
ucuguucuauuggucuaugugu

SEQ ID NO: 723610 - RNA, 22 nt, Human
ucuucaugaaugaaucuuugac

SEQ ID NO: 723611 - RNA, 22 nt, Human
uguacagaaauuccuacuacau

SEQ ID NO: 723612 - RNA, 22 nt, Human
acccagagcugggcuuggcaaa

SEQ ID NO: 723613 - RNA, 22 nt, Human
cagagcccagggccuacguccc

SEQ ID NO: 723614 - RNA, 22 nt, Human
agaacauuaaugcgagguauua

SEQ ID NO: 723615 - RNA, 22 nt, Human
uggcuuccacugugugcccccu

SEQ ID NO: 723616 - RNA, 22 nt, Human
caauguuuucaacugacaagua

SEQ ID NO: 723617 - RNA, 22 nt, Human
cagcuuugagaguugcauuuua

SEQ ID NO: 723618 - RNA, 21 nt, Human
gccuggcagguggaagggcuc

SEQ ID NO: 723619 - RNA, 22 nt, Human
cauuugugcuuuuauaaaauag

SEQ ID NO: 723620 - RNA, 22 nt, Human
cagugguuauacuuacuguuuc

SEQ ID NO: 723621 - RNA, 22 nt, Human
gaaguuauuuccugguguugga

SEQ ID NO: 723622 - RNA, 22 nt, Human
uuuguucauaauggcaaagaga

SEQ ID NO: 723623 - RNA, 22 nt, Human
ccuucugcuggucaucccagug

SEQ ID NO: 723624 - RNA, 22 nt, Human
gucugcccuuggccugggacuu

SEQ ID NO: 723625 - RNA, 23 nt, Human
uggagggcagaauaacagacuac

SEQ ID NO: 723626 - RNA, 22 nt, Human
gaaaucuuuucaucucauuuga

SEQ ID NO: 723627 - RNA, 22 nt, Human
agacaaauugggacauuguguu

SEQ ID NO: 723628 - RNA, 22 nt, Human
agugugaguuacaaagugugaa

SEQ ID NO: 723629 - RNA, 22 nt, Human
ggugaaguaauaccagguguac

SEQ ID NO: 723630 - RNA, 22 nt, Human
ccugggcucgcgcacuucaccc

SEQ ID NO: 723631 - RNA, 22 nt, Human
aaguguaaauucacagacuuca

SEQ ID NO: 723632 - RNA, 22 nt, Human
agaggcucuugcccuucccaca

SEQ ID NO: 723633 - RNA, 22 nt, Human
aauccaauccuacucagaaagu

SEQ ID NO: 723634 - RNA, 22 nt, Human
gugccuccuuaaauucugcacc

SEQ ID NO: 723635 - RNA, 22 nt, Human
ucagaagggaaacacaagugac

SEQ ID NO: 723636 - RNA, 22 nt, Human
accaggccuggcugggcagcca

SEQ ID NO: 723637 - RNA, 22 nt, Human
agacucaugacacuuccuauga

SEQ ID NO: 723638 - RNA, 22 nt, Human
aggcaagcccccagugaggcuc

SEQ ID NO: 723639 - RNA, 22 nt, Human
ugcauggagauauacuauuuga

SEQ ID NO: 723640 - RNA, 22 nt, Human
ggagucugacucugacccugga

SEQ ID NO: 723641 - RNA, 22 nt, Human
ucccagggcucuagagugcugg

SEQ ID NO: 723642 - RNA, 18 nt, Human
uggcaggaaaugcacuuu

SEQ ID NO: 723643 - RNA, 22 nt, Human
agauuacagaagaauaaguaga

SEQ ID NO: 723644 - RNA, 22 nt, Human
uuugaauagaggccccucagaa

SEQ ID NO: 723645 - RNA, 22 nt, Human
uuucagaguugucuucuugacc

SEQ ID NO: 723646 - RNA, 22 nt, Human
auguaacaaaugguauacaugu

SEQ ID NO: 723647 - RNA, 22 nt, Human
ugaggcagaaaauagcaguuca

SEQ ID NO: 723648 - RNA, 22 nt, Human
ccagccccgggaaccuggccgu

SEQ ID NO: 723649 - RNA, 22 nt, Human
ucugcagaaacugugacuaugu

SEQ ID NO: 723650 - RNA, 22 nt, Human
accaggcagcugggggugaugu

SEQ ID NO: 723651 - RNA, 22 nt, Human
gcaguggcccagcuugcaggcu

SEQ ID NO: 723652 - RNA, 22 nt, Human
ucacuacauuuuagacaguaaa

SEQ ID NO: 723653 - RNA, 22 nt, Human
acaugcagugaggaucuuagaa

SEQ ID NO: 723654 - RNA, 22 nt, Human
aggcuggucuguuggcauuuuu

SEQ ID NO: 723655 - RNA, 22 nt, Human
cagaggcuuugcccuggaaacc

SEQ ID NO: 723656 - RNA, 22 nt, Human
ggagggggaauucagccccagc

SEQ ID NO: 723657 - RNA, 22 nt, Human
cugcugacucuuccuggaguga

SEQ ID NO: 723658 - RNA, 22 nt, Human
aacacaguuuuccaaaauagag

SEQ ID NO: 723659 - RNA, 22 nt, Human
aucuauuuuaaauggcaguaaa

SEQ ID NO: 723660 - RNA, 22 nt, Human
aucaucuugcuuucuguuuacu

SEQ ID NO: 723661 - RNA, 22 nt, Human
aucacaggcuauguggguuuug

SEQ ID NO: 723662 - RNA, 22 nt, Human
uauauucuuucaccuucuuccu

SEQ ID NO: 723663 - RNA, 22 nt, Human
ugguggcuguaagggagagaag

SEQ ID NO: 723664 - RNA, 21 nt, Human
ugcagagauaucugaagcaga

SEQ ID NO: 723665 - RNA, 22 nt, Human
gaaauugucagugauaugauac

SEQ ID NO: 723666 - RNA, 22 nt, Human
gugucccaaucuacuuuucccu

SEQ ID NO: 723667 - RNA, 22 nt, Human
uggggaagggcacccuggagac

SEQ ID NO: 723668 - RNA, 22 nt, Human
auugucugaauccaaagcucug

SEQ ID NO: 723669 - RNA, 21 nt, Human
uggcugcaagcagcugccucc

SEQ ID NO: 723670 - RNA, 22 nt, Human
ggacauuucauaagaccauucu

SEQ ID NO: 723671 - RNA, 22 nt, Human
acauuucagcgugcaugacaug

SEQ ID NO: 723672 - RNA, 19 nt, Human
agccagaacuaguguuucu

SEQ ID NO: 723673 - RNA, 22 nt, Human
gcguccagggaaggcccagcug

SEQ ID NO: 723674 - RNA, 22 nt, Human
gcauggcagaacaccucgcccg

SEQ ID NO: 723675 - RNA, 22 nt, Human
aggccuuaccauagcuguagca

SEQ ID NO: 723676 - RNA, 22 nt, Human
gugcagcagggggaagacagug

SEQ ID NO: 723677 - RNA, 22 nt, Human
cagcaauggcaggcggagagug

SEQ ID NO: 723678 - RNA, 22 nt, Human
gcaggugggagccgcugccuga

SEQ ID NO: 723679 - RNA, 20 nt, Human
ucuuacaaucguuacaucca

SEQ ID NO: 723680 - RNA, 22 nt, Human
gggagcaguuaaaaugauuccu

SEQ ID NO: 723681 - RNA, 22 nt, Human
ccaggcucugccaggcccuuga

SEQ ID NO: 723682 - RNA, 22 nt, Human
ugaagagaagaaaauuaucuuu

SEQ ID NO: 723683 - RNA, 20 nt, Human
auccaugagagucuggauuc

SEQ ID NO: 723684 - RNA, 22 nt, Human
agacaaaggauuaaugaugaug

SEQ ID NO: 723685 - RNA, 22 nt, Human
gagccagguuugaaucucaguc

SEQ ID NO: 723686 - RNA, 22 nt, Human
ugaggucuuuuauaguguguca

SEQ ID NO: 723687 - RNA, 22 nt, Human
augauacaucuuguuuauuuca

SEQ ID NO: 723688 - RNA, 22 nt, Human
auuuccuugcaaguuucuguaa

SEQ ID NO: 723689 - RNA, 22 nt, Human
uaacacaugguuaguacacaau

SEQ ID NO: 723690 - RNA, 22 nt, Human
aucauucaucuuauugccaguc

SEQ ID NO: 723691 - RNA, 22 nt, Human
agggcugucagacugaggaggc

SEQ ID NO: 723692 - RNA, 22 nt, Human
gugugcagcagagacaggacuc

SEQ ID NO: 723693 - RNA, 22 nt, Human
caguuuaaguguguugaaggua

SEQ ID NO: 723694 - RNA, 22 nt, Human
uggaggacguguccaccaugaa

SEQ ID NO: 723695 - RNA, 19 nt, Human
agucaguucugaggaggaa

SEQ ID NO: 723696 - RNA, 22 nt, Human
ucucuaaaugauuguguacucc

SEQ ID NO: 723697 - RNA, 22 nt, Human
aggaguuauggcagaaucaaau

SEQ ID NO: 723698 - RNA, 20 nt, Human
aagcacauuucuacaauaau

SEQ ID NO: 723699 - RNA, 22 nt, Human
auguaagguucagaguauguga

SEQ ID NO: 723700 - RNA, 22 nt, Human
auaugugugccauuucagcagu

SEQ ID NO: 723701 - RNA, 22 nt, Human
gugugggaaggcuaggaugcug

SEQ ID NO: 723702 - RNA, 22 nt, Human
uuacaguauuggucacguuugu

SEQ ID NO: 723703 - RNA, 22 nt, Human
aagauguuaggguggaagggau

SEQ ID NO: 723704 - RNA, 22 nt, Human
cuggaguccugcauuugcucuu

SEQ ID NO: 723705 - RNA, 22 nt, Human
cugaaugaggaaaagagugagg

SEQ ID NO: 723706 - RNA, 22 nt, Human
cuuaagauuugcgauaccuaau

SEQ ID NO: 723707 - RNA, 22 nt, Human
gccuugaucugcuguguuugag

SEQ ID NO: 723708 - RNA, 22 nt, Human
ucauuucuguugugcaucacug

SEQ ID NO: 723709 - RNA, 22 nt, Human
cucuuuaguggugaugaugcua

SEQ ID NO: 723710 - RNA, 22 nt, Human
uuauuuguuuucugagaaguau

SEQ ID NO: 723711 - RNA, 22 nt, Human
gagauggcuugcucucacgugg

SEQ ID NO: 723712 - RNA, 22 nt, Human
aaaucaguuguuauauuaaaga

SEQ ID NO: 723713 - RNA, 22 nt, Human
aaaguuuucugccuucauuaga

SEQ ID NO: 723714 - RNA, 22 nt, Human
ggcagcaggguagccauuucuc

SEQ ID NO: 723715 - RNA, 22 nt, Human
cuuggccugcaggcagcagcgc

SEQ ID NO: 723716 - RNA, 22 nt, Human
ggcagccuugacuagugacuua

SEQ ID NO: 723717 - RNA, 22 nt, Human
aagcaccucuaugauugcuuuu

SEQ ID NO: 723718 - RNA, 22 nt, Human
gcauguguugguuuaugcaugu

SEQ ID NO: 723719 - RNA, 22 nt, Human
auggcagaccuccuggccacaa

SEQ ID NO: 723720 - RNA, 22 nt, Human
guccugguauaauuguuuaaaa

SEQ ID NO: 723721 - RNA, 22 nt, Human
ccuggggaaucuugcaggggaa

SEQ ID NO: 723722 - RNA, 22 nt, Human
acaguggcuuuugugucugcag

SEQ ID NO: 723723 - RNA, 22 nt, Human
aacauauuuggcugauauuccc

SEQ ID NO: 723724 - RNA, 22 nt, Human
uacaauagggcuuuuguuuaug

SEQ ID NO: 723725 - RNA, 22 nt, Human
uccuggagccaggacccuuccc

SEQ ID NO: 723726 - RNA, 22 nt, Human
uacacauacaccaaugugguca

SEQ ID NO: 723727 - RNA, 22 nt, Human
gucauugauuuucaguuugucc

SEQ ID NO: 723728 - RNA, 22 nt, Human
cugcaggaauucaaagugagcu

SEQ ID NO: 723729 - RNA, 22 nt, Human
gggggaggugaaugcaauaagg

SEQ ID NO: 723730 - RNA, 22 nt, Human
gcuggccugaccugaggcuggg

SEQ ID NO: 723731 - RNA, 22 nt, Human
augcagcagccccuugaggugc

SEQ ID NO: 723732 - RNA, 22 nt, Human
uaggaaauucucuugcuaaguu

SEQ ID NO: 723733 - RNA, 22 nt, Human
caugugugggacccuuagguug

SEQ ID NO: 723734 - RNA, 22 nt, Human
auggagguggaagaaugaguua

SEQ ID NO: 723735 - RNA, 18 nt, Human
ugaagacaugagguuagu

SEQ ID NO: 723736 - RNA, 22 nt, Human
ggcagccucagguuuucuuuga

SEQ ID NO: 723737 - RNA, 22 nt, Human
guucacaguguuuucuuugcau

SEQ ID NO: 723738 - RNA, 22 nt, Human
aaugaaaugaagauaugaucag

SEQ ID NO: 723739 - RNA, 22 nt, Human
cuggcccagagcucuggccuuu

SEQ ID NO: 723740 - RNA, 22 nt, Human
ccagcauccucagcucacuucu

SEQ ID NO: 723741 - RNA, 22 nt, Human
cuggccucagagggucauggug

SEQ ID NO: 723742 - RNA, 22 nt, Human
gaggaagcugcguggcauuuca

SEQ ID NO: 723743 - RNA, 22 nt, Human
acagaaagaagguguauuugag

SEQ ID NO: 723744 - RNA, 22 nt, Human
agugauuagaaaguacacuugg

SEQ ID NO: 723745 - RNA, 22 nt, Human
ggccccucuuguggcacauacg

SEQ ID NO: 723746 - RNA, 22 nt, Human
cuucaaagggucacuauuuauc

SEQ ID NO: 723747 - RNA, 22 nt, Human
uuacaguaccuguauggccacu

SEQ ID NO: 723748 - RNA, 22 nt, Human
auaauggccgggggcugaaugc

SEQ ID NO: 723749 - RNA, 22 nt, Human
uacacacugugauaaugaagca

SEQ ID NO: 723750 - RNA, 22 nt, Human
aaggcacuacgcugcuggggcg

SEQ ID NO: 723751 - RNA, 22 nt, Human
guaaaacugucuaaugguauau

SEQ ID NO: 723752 - RNA, 22 nt, Human
cggaucaugugaccuuugagug

SEQ ID NO: 723753 - RNA, 22 nt, Human
ugagcagagucgcuccagagug

SEQ ID NO: 723754 - RNA, 22 nt, Human
gugggcagauuaauuucucaau

SEQ ID NO: 723755 - RNA, 22 nt, Human
uccugcagccacugcaggcaga

SEQ ID NO: 723756 - RNA, 22 nt, Human
ugcaguuuuaucacauauauag

SEQ ID NO: 723757 - RNA, 22 nt, Human
caguguggugugcacagcuuag

SEQ ID NO: 723758 - RNA, 22 nt, Human
cuugcucacaguaccuggcuug

SEQ ID NO: 723759 - RNA, 22 nt, Human
caauuacauuuauugagcauuc

SEQ ID NO: 723760 - RNA, 22 nt, Human
uccagcagaaccagagaccugg

SEQ ID NO: 723761 - RNA, 22 nt, Human
ucauaagugguuuauaugcuug

SEQ ID NO: 723762 - RNA, 22 nt, Human
gccugagcuacuagggagucug

SEQ ID NO: 723763 - RNA, 22 nt, Human
aagauucugaaagggguggggc

SEQ ID NO: 723764 - RNA, 22 nt, Human
uuucucacccaagaguuauuuu

SEQ ID NO: 723765 - RNA, 22 nt, Human
cugcaaaaguaauugcagguuu

SEQ ID NO: 723766 - RNA, 19 nt, Human
uucuaaguuuugcuugcug

SEQ ID NO: 723767 - RNA, 22 nt, Human
acugagguuuacuugaaggaga

SEQ ID NO: 723768 - RNA, 22 nt, Human
caggacaaucucgucggguccu

SEQ ID NO: 723769 - RNA, 22 nt, Human
acaugaucuuauguagaagauc

SEQ ID NO: 723770 - RNA, 22 nt, Human
gacuuuaucuuguccuuccugc

SEQ ID NO: 723771 - RNA, 22 nt, Human
agcaucccaugacucuggagga

SEQ ID NO: 723772 - RNA, 22 nt, Human
cacagugaagcaugcagacauc

SEQ ID NO: 723773 - RNA, 23 nt, Human
uugacaguaggugguuuucauug

SEQ ID NO: 723774 - RNA, 22 nt, Human
ucugggcuggugcucaugaauu

SEQ ID NO: 723775 - RNA, 22 nt, Human
agugcagaggcugggaaaugcu

SEQ ID NO: 723776 - RNA, 22 nt, Human
aacuacaguauguccaaagaau

SEQ ID NO: 723777 - RNA, 22 nt, Human
agcaaagcuaccaauuauugag

SEQ ID NO: 723778 - RNA, 18 nt, Human
uaaauugcuucaccugag

SEQ ID NO: 723779 - RNA, 22 nt, Human
agcuuuauuugucauucacggc

SEQ ID NO: 723780 - RNA, 22 nt, Human
cuccauggggaaaugaaggugg

SEQ ID NO: 723781 - RNA, 22 nt, Human
uggaggccagagguacugggac

SEQ ID NO: 723782 - RNA, 22 nt, Human
ucauuauccuaguaucuugaau

SEQ ID NO: 723783 - RNA, 22 nt, Human
gagacugcauagauggccacaa

SEQ ID NO: 723784 - RNA, 22 nt, Human
ggcuacagcgggguggagacgg

SEQ ID NO: 723785 - RNA, 22 nt, Human
ugccaggcgauugcuaucagca

SEQ ID NO: 723786 - RNA, 22 nt, Human
gagugagggccaacauccagcu

SEQ ID NO: 723787 - RNA, 22 nt, Human
gcugcccuacccgaggcacucu

SEQ ID NO: 723788 - RNA, 22 nt, Human
ccuuuacaguaugguuguauca

SEQ ID NO: 723789 - RNA, 22 nt, Human
ugcugcauuugcaguccuuuaa

SEQ ID NO: 723790 - RNA, 22 nt, Human
ugucugaaaggcuuuuucucac

SEQ ID NO: 723791 - RNA, 22 nt, Human
uccaagaguaagaggacucuuu

SEQ ID NO: 723792 - RNA, 22 nt, Human
aagagguaaccauagcaaccac

SEQ ID NO: 723793 - RNA, 22 nt, Human
augacacccccacagcauuguu

SEQ ID NO: 723794 - RNA, 22 nt, Human
uacagagauuuauugcuaaggc

SEQ ID NO: 723795 - RNA, 22 nt, Human
uucuacauucauguauuaccuc

SEQ ID NO: 723796 - RNA, 22 nt, Human
uguuuagaggaacuggaaucag

SEQ ID NO: 723797 - RNA, 22 nt, Human
agcccugcaggaggugggagag

SEQ ID NO: 723798 - RNA, 22 nt, Human
ugaguccaucgcagggaagugg

SEQ ID NO: 723799 - RNA, 22 nt, Human
uauacuuuccugcaacuuugau

SEQ ID NO: 723800 - RNA, 22 nt, Human
gguugcaaacuccugggaucaa

SEQ ID NO: 723801 - RNA, 22 nt, Human
cugaaauuauuguuuaaucaaa

SEQ ID NO: 723802 - RNA, 22 nt, Human
gccaggcaggugucggagcccu

SEQ ID NO: 723803 - RNA, 22 nt, Human
ggucugaguggggccugagauu

SEQ ID NO: 723804 - RNA, 22 nt, Human
acaggacauggcuucugugacg

SEQ ID NO: 723805 - RNA, 22 nt, Human
ucugcagcuugcacaggcaggc

SEQ ID NO: 723806 - RNA, 22 nt, Human
agugcauucugucaucuugguu

SEQ ID NO: 723807 - RNA, 22 nt, Human
cccagcuugcaaauggguugcu

SEQ ID NO: 723808 - RNA, 22 nt, Human
aggugagguuugggagguguca

SEQ ID NO: 723809 - RNA, 22 nt, Human
auaagaggaauuacagaagagg

SEQ ID NO: 723810 - RNA, 22 nt, Human
cugugaggcggguggaguggag

SEQ ID NO: 723811 - RNA, 22 nt, Human
agugaaauccuggucaacaggu

SEQ ID NO: 723812 - RNA, 22 nt, Human
caugaaggaauuaagguaagga

SEQ ID NO: 723813 - RNA, 22 nt, Human
aaugaacaagaaagacuuugag

SEQ ID NO: 723814 - RNA, 22 nt, Human
ccucucucugcaucuggagggc

SEQ ID NO: 723815 - RNA, 22 nt, Human
uagcagcaaagcaggaucugcu

SEQ ID NO: 723816 - RNA, 22 nt, Human
uauacagauuaacagauuuaaa

SEQ ID NO: 723817 - RNA, 22 nt, Human
cugccuggcauggagaagagaa

SEQ ID NO: 723818 - RNA, 22 nt, Human
aauggcuuauguaaugcuguuu

SEQ ID NO: 723819 - RNA, 22 nt, Human
agugugcuguuuccagaagggc

SEQ ID NO: 723820 - RNA, 22 nt, Human
uauuucugaauccaaaagguca

SEQ ID NO: 723821 - RNA, 22 nt, Human
ugucuuuagaccucucuggccu

SEQ ID NO: 723822 - RNA, 22 nt, Human
cucagaaauuacaaaagggaca

SEQ ID NO: 723823 - RNA, 22 nt, Human
guguaacuuuuauucaugcucu

SEQ ID NO: 723824 - RNA, 22 nt, Human
cacaagacuuauuuguguagaa

SEQ ID NO: 723825 - RNA, 22 nt, Human
guucauaauuugaaggaauagg

SEQ ID NO: 723826 - RNA, 22 nt, Human
gcguguaugcaggucugugcag

SEQ ID NO: 723827 - RNA, 22 nt, Human
aaggcacuuuucuaaagaccuu

SEQ ID NO: 723828 - RNA, 22 nt, Human
uucagucagugacuaagcaguu

SEQ ID NO: 723829 - RNA, 22 nt, Human
cagccugacaccagcuuugggc

SEQ ID NO: 723830 - RNA, 19 nt, Human
acuuugcaugugugucuaa

SEQ ID NO: 723831 - RNA, 22 nt, Human
ugaaacugaaagguauuuauag

SEQ ID NO: 723832 - RNA, 22 nt, Human
cugggcagguauacaaaaaaug

SEQ ID NO: 723833 - RNA, 22 nt, Human
cuggaaagugcuuuucugagag

SEQ ID NO: 723834 - RNA, 22 nt, Human
aggggagcaucugugaugguua

SEQ ID NO: 723835 - RNA, 22 nt, Human
uccuuacaacuuguuauuuuuc

SEQ ID NO: 723836 - RNA, 22 nt, Human
ggacacagauaaucacacagau

SEQ ID NO: 723837 - RNA, 22 nt, Human
gucagacugcacucaaggacag

SEQ ID NO: 723838 - RNA, 22 nt, Human
aucccaugagaccacguuggcu

SEQ ID NO: 723839 - RNA, 22 nt, Human
agaaaguuuggggcugggcacg

SEQ ID NO: 723840 - RNA, 22 nt, Human
uuuccuucaucaucugagagcu

SEQ ID NO: 723841 - RNA, 22 nt, Human
ucaggacagagaucagaacuuc

SEQ ID NO: 723842 - RNA, 20 nt, Human
ugccaggcugcacgccugcc

SEQ ID NO: 723843 - RNA, 22 nt, Human
uauguucauagaaaucaugacc

SEQ ID NO: 723844 - RNA, 22 nt, Human
cuggugcccuguguggcaggag

SEQ ID NO: 723845 - RNA, 22 nt, Human
caugcuuccuccaaacuacccu

SEQ ID NO: 723846 - RNA, 22 nt, Human
uucagaaggugcagccugggcc

SEQ ID NO: 723847 - RNA, 22 nt, Human
agaggccaaagaaucuacaaga

SEQ ID NO: 723848 - RNA, 22 nt, Human
gggauaggagauugggaguguu

SEQ ID NO: 723849 - RNA, 22 nt, Human
cuuagcuucucugcaucugugu

SEQ ID NO: 723850 - RNA, 22 nt, Human
agcugcugcaaguggugcuaac

SEQ ID NO: 723851 - RNA, 22 nt, Human
ugauuuccacgugcacccaggu

SEQ ID NO: 723852 - RNA, 22 nt, Human
cugagguguggucugggaguau

SEQ ID NO: 723853 - RNA, 22 nt, Human
aaaaccuucuagacuuuauauu

SEQ ID NO: 723854 - RNA, 22 nt, Human
ucccagugagaugaaacaggua

SEQ ID NO: 723855 - RNA, 22 nt, Human
ugucagcuggagauggcauggg

SEQ ID NO: 723856 - RNA, 22 nt, Human
ucucuuucuauaugugagucuu

SEQ ID NO: 723857 - RNA, 22 nt, Human
ugaaguuucuugaaucuuggag

SEQ ID NO: 723858 - RNA, 22 nt, Human
gucaggauuugaacucaggucu

SEQ ID NO: 723859 - RNA, 22 nt, Human
aggccagaaaaagacagcucca

SEQ ID NO: 723860 - RNA, 22 nt, Human
gcuuuaaugcuucguggggcca

SEQ ID NO: 723861 - RNA, 22 nt, Human
aagaaauguagagccuaguaaa

SEQ ID NO: 723862 - RNA, 22 nt, Human
agggcgggcucaucacaugcuc

SEQ ID NO: 723863 - RNA, 22 nt, Human
uaugugcauaugcauacacaca

SEQ ID NO: 723864 - RNA, 22 nt, Human
ugaggaaacuuacaaggcagaa

SEQ ID NO: 723865 - RNA, 22 nt, Human
aacacauauuuauauaugcaca

SEQ ID NO: 723866 - RNA, 22 nt, Human
caggcccacgaggcacacagag

SEQ ID NO: 723867 - RNA, 22 nt, Human
aggcugggaaauguagucuucc

SEQ ID NO: 723868 - RNA, 22 nt, Human
ugugaaaagggcuuuguacaaa

SEQ ID NO: 723869 - RNA, 22 nt, Human
aggcuggcugaaaaacacccuu

SEQ ID NO: 723870 - RNA, 22 nt, Human
augguguagcaugugauaugac

SEQ ID NO: 723871 - RNA, 22 nt, Human
gggucuccuaauggaggaugac

SEQ ID NO: 723872 - RNA, 22 nt, Human
cuguggaguguagaugcugggu

SEQ ID NO: 723873 - RNA, 22 nt, Human
uuucagucuuauuuuguugaua

SEQ ID NO: 723874 - RNA, 22 nt, Human
aagaacaguugggaggugagcc

SEQ ID NO: 723875 - RNA, 22 nt, Human
cccagagaaccuucugugccac

SEQ ID NO: 723876 - RNA, 22 nt, Human
ccagaucccuguuugccucugg

SEQ ID NO: 723877 - RNA, 22 nt, Human
cuggacagcccucacugugugc

SEQ ID NO: 723878 - RNA, 22 nt, Human
agccucugcacuucuuacaggu

SEQ ID NO: 723879 - RNA, 22 nt, Human
uuugaugaguuuaauaacagcc

SEQ ID NO: 723880 - RNA, 22 nt, Human
gcuggcuguguuccuucugcca

SEQ ID NO: 723881 - RNA, 22 nt, Human
cucucagugccugcccuaggcu

SEQ ID NO: 723882 - RNA, 22 nt, Human
caccagcuccaccagggcaggu

SEQ ID NO: 723883 - RNA, 22 nt, Human
cugccugaguggaggucgaggg

SEQ ID NO: 723884 - RNA, 22 nt, Human
ugaaugaugaggggagaauaau

SEQ ID NO: 723885 - RNA, 20 nt, Human
cagcagccauucuaguagua

SEQ ID NO: 723886 - RNA, 22 nt, Human
acauuucuuuucaucucuauau

SEQ ID NO: 723887 - RNA, 19 nt, Human
ugcagaggguaggaaggcc

SEQ ID NO: 723888 - RNA, 22 nt, Human
caugaacaaauucuguuugagg

SEQ ID NO: 723889 - RNA, 22 nt, Human
agccaggcgcaguggcuuaugc

SEQ ID NO: 723890 - RNA, 22 nt, Human
aaacaugagcaucucuucaagc

SEQ ID NO: 723891 - RNA, 22 nt, Human
cagauggccagaggcagcugca

SEQ ID NO: 723892 - RNA, 22 nt, Human
uagcagcaauucaggugugaug

SEQ ID NO: 723893 - RNA, 22 nt, Human
aggcaccaggaucaguuagaga

SEQ ID NO: 723894 - RNA, 22 nt, Human
aggagaaaacaguguuuugccu

SEQ ID NO: 723895 - RNA, 22 nt, Human
ucauuuguacuugugugcuugu

SEQ ID NO: 723896 - RNA, 22 nt, Human
augcagaaugaguucacgaucu

SEQ ID NO: 723897 - RNA, 22 nt, Human
ggaacauucuagaguguuguga

SEQ ID NO: 723898 - RNA, 22 nt, Human
uuacaagauaacggagaaagca

SEQ ID NO: 723899 - RNA, 23 nt, Human
aagauguauuuuuaccaaauguc

SEQ ID NO: 723900 - RNA, 22 nt, Human
gaaugcaaagcucucuauguua

SEQ ID NO: 723901 - RNA, 22 nt, Human
acaggccuuggcaggcauguga

SEQ ID NO: 723902 - RNA, 22 nt, Human
gacuuuaaguaagucaaggagc

SEQ ID NO: 723903 - RNA, 22 nt, Human
gguguguguggauuagcaugcc

SEQ ID NO: 723904 - RNA, 23 nt, Human
ugggcccuggagucgccagucug

SEQ ID NO: 723905 - RNA, 22 nt, Human
agaggacagacggaaagugcca

SEQ ID NO: 723906 - RNA, 22 nt, Human
uucuagaggggagauacuagua

SEQ ID NO: 723907 - RNA, 22 nt, Human
aaucaguuguccaaaguucaca

SEQ ID NO: 723908 - RNA, 22 nt, Human
gcugugugcugggcauggcacu

SEQ ID NO: 723909 - RNA, 20 nt, Human
ggguacagauaugcagugaa

SEQ ID NO: 723910 - RNA, 22 nt, Human
aggcugugggaguugagagucu

SEQ ID NO: 723911 - RNA, 22 nt, Human
uuuauugucaaucuauucccag

SEQ ID NO: 723912 - RNA, 22 nt, Human
guuuuccuucucagccauugcc

SEQ ID NO: 723913 - RNA, 22 nt, Human
gaggcacaguguuuggucagug

SEQ ID NO: 723914 - RNA, 22 nt, Human
ggagaagggcaugguaguuuua

SEQ ID NO: 723915 - RNA, 22 nt, Human
aucauccuauugugccccaggu

SEQ ID NO: 723916 - RNA, 22 nt, Human
agcuucuuuuacagcucaugcu

SEQ ID NO: 723917 - RNA, 22 nt, Human
auugcaaagcguagacucuaaa

SEQ ID NO: 723918 - RNA, 17 nt, Human
acagugagaagucaucu

SEQ ID NO: 723919 - RNA, 22 nt, Human
ucuuccucccuacagagcucag

SEQ ID NO: 723920 - RNA, 22 nt, Human
aucucucuaugcacugaggacu

SEQ ID NO: 723921 - RNA, 22 nt, Human
ucucugggaucguuuugggcuc

SEQ ID NO: 723922 - RNA, 22 nt, Human
cagaagccuaaauagugcacca

SEQ ID NO: 723923 - RNA, 22 nt, Human
gcuggcccagugacccacagug

SEQ ID NO: 723924 - RNA, 22 nt, Human
gcagugguccaguucacaccca

SEQ ID NO: 723925 - RNA, 22 nt, Human
ucucuggcagcuugugcuguug

SEQ ID NO: 723926 - RNA, 22 nt, Human
augucuguggcaauuguugaug

SEQ ID NO: 723927 - RNA, 22 nt, Human
gaagaaggugcuacacagggca

SEQ ID NO: 723928 - RNA, 23 nt, Human
acaccugugcuguagucacuaca

SEQ ID NO: 723929 - RNA, 22 nt, Human
cuauucuagauuacaguauaaa

SEQ ID NO: 723930 - RNA, 22 nt, Human
caguagaauuauuauaaaacau

SEQ ID NO: 723931 - RNA, 22 nt, Human
gccagcaguauguccuggcagu

SEQ ID NO: 723932 - RNA, 22 nt, Human
cucucagcaggaaagcaugcaa

SEQ ID NO: 723933 - RNA, 22 nt, Human
aaaggcauuuuaauucuaaaga

SEQ ID NO: 723934 - RNA, 22 nt, Human
agcacagggcccagccuaggcc

SEQ ID NO: 723935 - RNA, 22 nt, Human
ucuguuagagagguaguucuug

SEQ ID NO: 723936 - RNA, 22 nt, Human
ucaucuaagagucuuacauuua

SEQ ID NO: 723937 - RNA, 22 nt, Human
aauaaagcaggguccuugcacu

SEQ ID NO: 723938 - RNA, 20 nt, Human
gucucagaauggauuugcau

SEQ ID NO: 723939 - RNA, 22 nt, Human
acugagcacucacuuuuguuau

SEQ ID NO: 723940 - RNA, 22 nt, Human
caauuucacuaauaauauuuac

SEQ ID NO: 723941 - RNA, 22 nt, Human
agcacagauguacuuugagggg

SEQ ID NO: 723942 - RNA, 22 nt, Human
aaaagaggagugguuuaugaca

SEQ ID NO: 723943 - RNA, 22 nt, Human
gugacaaaugcaaauugggcug

SEQ ID NO: 723944 - RNA, 22 nt, Human
uuccaggaacacucuguguccc

SEQ ID NO: 723945 - RNA, 20 nt, Human
gucaucgccggcagcaaaga

SEQ ID NO: 723946 - RNA, 22 nt, Human
aauguggggaagccauggcuga

SEQ ID NO: 723947 - RNA, 22 nt, Human
ugguggagaccucgcuaacccc

SEQ ID NO: 723948 - RNA, 22 nt, Human
aauuuguuauaacuugggcuga

SEQ ID NO: 723949 - RNA, 23 nt, Human
gcaggacaacagagugggaaggc

SEQ ID NO: 723950 - RNA, 22 nt, Human
gaaagguuuaaguaggauuugu

SEQ ID NO: 723951 - RNA, 22 nt, Human
aggcucagucccggcccgcgcc

SEQ ID NO: 723952 - RNA, 22 nt, Human
ugcauuuaguuuuaauaaagga

SEQ ID NO: 723953 - RNA, 22 nt, Human
gccagagcuucccccgagugug

SEQ ID NO: 723954 - RNA, 22 nt, Human
uuuauauauggcuggucuggau

SEQ ID NO: 723955 - RNA, 22 nt, Human
ugcuugucaggauaagcucugg

SEQ ID NO: 723956 - RNA, 22 nt, Human
acagcagggggagcuguuggac

SEQ ID NO: 723957 - RNA, 22 nt, Human
acuauuuguaaagagcaaacgg

SEQ ID NO: 723958 - RNA, 22 nt, Human
acccaggcuggagugcaguggu

SEQ ID NO: 723959 - RNA, 22 nt, Human
cugagguaccuggagcaggucc

SEQ ID NO: 723960 - RNA, 22 nt, Human
ugggccucggggaagcccgugu

SEQ ID NO: 723961 - RNA, 22 nt, Human
gaugcauugcaucgaguagcuu

SEQ ID NO: 723962 - RNA, 22 nt, Human
aagcaggcaugggaggccaucc

SEQ ID NO: 723963 - RNA, 22 nt, Human
aggaaaagugugaaguauggag

SEQ ID NO: 723964 - RNA, 22 nt, Human
cuggcaggaucuaaccagggaa

SEQ ID NO: 723965 - RNA, 22 nt, Human
gcucacaggggcagacgaguug

SEQ ID NO: 723966 - RNA, 22 nt, Human
uguucagcccucuauuaaucag

SEQ ID NO: 723967 - RNA, 22 nt, Human
uacuuuuugucucuuugaaugu

SEQ ID NO: 723968 - RNA, 22 nt, Human
ugcccaggcuccucgcagccuu

SEQ ID NO: 723969 - RNA, 22 nt, Human
gggauuacagaugugagccauu

SEQ ID NO: 723970 - RNA, 22 nt, Human
ugaguucucacccauucuucuu

SEQ ID NO: 723971 - RNA, 20 nt, Human
ugcagguguuggagaaggua

SEQ ID NO: 723972 - RNA, 23 nt, Human
ucuguacacaucagcaucuccca

SEQ ID NO: 723973 - RNA, 17 nt, Human
agcaccuguccaguccc

SEQ ID NO: 723974 - RNA, 22 nt, Human
cuuauuuacugauccacagaug

SEQ ID NO: 723975 - RNA, 22 nt, Human
uggaaggcacugggagaagacu

SEQ ID NO: 723976 - RNA, 21 nt, Human
ccuggcuccagaacuuccggu

SEQ ID NO: 723977 - RNA, 22 nt, Human
agcugaagaaaugggaagcauu

SEQ ID NO: 723978 - RNA, 22 nt, Human
cuccaggagggggauggcugua

SEQ ID NO: 723979 - RNA, 22 nt, Human
gcacaagcacgagcagcgugcg

SEQ ID NO: 723980 - RNA, 23 nt, Human
uggcuccaggagaagccagaagc

SEQ ID NO: 723981 - RNA, 22 nt, Human
gggaacacagacuugaugauga

SEQ ID NO: 723982 - RNA, 22 nt, Human
gaaaccuguccccucuuccuca

SEQ ID NO: 723983 - RNA, 22 nt, Human
gaaagggaguggacaacaggca

SEQ ID NO: 723984 - RNA, 22 nt, Human
uacaggguauagguacagauga

SEQ ID NO: 723985 - RNA, 22 nt, Human
ucucuucugaaaccugucuuua

SEQ ID NO: 723986 - RNA, 22 nt, Human
cuggggagacgaucgauguucu

SEQ ID NO: 723987 - RNA, 22 nt, Human
uaagacacaugcguacaagaua

SEQ ID NO: 723988 - RNA, 22 nt, Human
guaggcagucucucaggugauc

SEQ ID NO: 723989 - RNA, 22 nt, Human
agaaggguaguuguaagaguga

SEQ ID NO: 723990 - RNA, 22 nt, Human
ugggcagacugagcccuguccc

SEQ ID NO: 723991 - RNA, 19 nt, Human
gccugagccagccaugcaa

SEQ ID NO: 723992 - RNA, 22 nt, Human
uccuuuggcaagcucugcucuu

SEQ ID NO: 723993 - RNA, 22 nt, Human
cucugccugugucgccaccaca

SEQ ID NO: 723994 - RNA, 22 nt, Human
gcuguuucuuuggcaaacugau

SEQ ID NO: 723995 - RNA, 22 nt, Human
ugcuuccuugagcucuccaauc

SEQ ID NO: 723996 - RNA, 22 nt, Human
cagcuuuuaggacugugagaaa

SEQ ID NO: 723997 - RNA, 22 nt, Human
uuggccuuaaccucucugugcc

SEQ ID NO: 723998 - RNA, 22 nt, Human
ugcuggcuggccuggccuggac

SEQ ID NO: 723999 - RNA, 22 nt, Human
gauucuggauugucugcuugaa

SEQ ID NO: 724000 - RNA, 22 nt, Human
acaugcuaauggagaugccaag

SEQ ID NO: 724001 - RNA, 22 nt, Human
ucaggucuugagccaucaggau

SEQ ID NO: 724002 - RNA, 22 nt, Human
uguggcugcagacacuggagcc

SEQ ID NO: 724003 - RNA, 22 nt, Human
aggcuggauuuauggggacuuc

SEQ ID NO: 724004 - RNA, 22 nt, Human
caguggcuguuucuggaaggca

SEQ ID NO: 724005 - RNA, 22 nt, Human
agagacaggguuuugccauguu

SEQ ID NO: 724006 - RNA, 22 nt, Human
ugccauggaaguggccagaccu

SEQ ID NO: 724007 - RNA, 22 nt, Human
gcccucaguggauucuuauugu

SEQ ID NO: 724008 - RNA, 22 nt, Human
uauggcauuuagaaaugucaga

SEQ ID NO: 724009 - RNA, 22 nt, Human
agggcaguucagccacaggcuc

SEQ ID NO: 724010 - RNA, 22 nt, Human
ggcugucaauucauaggucaga

SEQ ID NO: 724011 - RNA, 22 nt, Human
ugcuggcaccagaaugacugca

SEQ ID NO: 724012 - RNA, 19 nt, Human
ucccaagauuucuguauca

SEQ ID NO: 724013 - RNA, 22 nt, Human
augcaucuaugacuuagacauu

SEQ ID NO: 724014 - RNA, 22 nt, Human
ucccugagggcagcucaagucc

SEQ ID NO: 724015 - RNA, 22 nt, Human
ucaguggauuggaugagaucug

SEQ ID NO: 724016 - RNA, 22 nt, Human
ugaagcuuguauuuaaauaagu

SEQ ID NO: 724017 - RNA, 22 nt, Human
ccugcagcuguaggagaaggcg

SEQ ID NO: 724018 - RNA, 22 nt, Human
gaagcccuauccucuccuggga

SEQ ID NO: 724019 - RNA, 22 nt, Human
gcccugugccagucacgcugug

SEQ ID NO: 724020 - RNA, 22 nt, Human
uuggaaagaagggcugagcaag

SEQ ID NO: 724021 - RNA, 18 nt, Human
uauauucugugcccuggu

SEQ ID NO: 724022 - RNA, 22 nt, Human
ugaggucccagggguagugugc

SEQ ID NO: 724023 - RNA, 22 nt, Human
ggugggagagcuugcuuugaug

SEQ ID NO: 724024 - RNA, 22 nt, Human
auagcaaaggacaauagucagu

SEQ ID NO: 724025 - RNA, 22 nt, Human
aacugaggccaagugaggaaag

SEQ ID NO: 724026 - RNA, 22 nt, Human
ucaauagagccuucuuucaggu

SEQ ID NO: 724027 - RNA, 22 nt, Human
uagcauuccuuguggcuucuga

SEQ ID NO: 724028 - RNA, 22 nt, Human
uuguaacaucaccaucaaaauc

SEQ ID NO: 724029 - RNA, 22 nt, Human
cagaacagaaucguguggugag

SEQ ID NO: 724030 - RNA, 22 nt, Human
aagccaggauaaaguuguuuua

SEQ ID NO: 724031 - RNA, 22 nt, Human
uuccugcaaaacuacuaguagc

SEQ ID NO: 724032 - RNA, 22 nt, Human
uugaugagaccauugccgcguc

SEQ ID NO: 724033 - RNA, 22 nt, Human
aguaguggcuuccuggagugcu

SEQ ID NO: 724034 - RNA, 22 nt, Human
ugagaauuuucaguuucacuuu

SEQ ID NO: 724035 - RNA, 22 nt, Human
ugcuuauugcuuucaagacugu

SEQ ID NO: 724036 - RNA, 22 nt, Human
gggcagcuggccagguauucug

SEQ ID NO: 724037 - RNA, 22 nt, Human
auguggcuuucugcguuuucuc

SEQ ID NO: 724038 - RNA, 22 nt, Human
ucagggcauguauguuucuuua

SEQ ID NO: 724039 - RNA, 17 nt, Human
gcucccugaggacagcu

SEQ ID NO: 724040 - RNA, 22 nt, Human
uaacuuucacaucacacugacu

SEQ ID NO: 724041 - RNA, 22 nt, Human
caacuuuagcaauguuaguaua

SEQ ID NO: 724042 - RNA, 22 nt, Human
ucagcaacuauuuaucaaauuc

SEQ ID NO: 724043 - RNA, 22 nt, Human
auaauacaugguuaaccucuuu

SEQ ID NO: 724044 - RNA, 22 nt, Human
uagauuugauguaagcauaguc

SEQ ID NO: 724045 - RNA, 22 nt, Human
agauauacacccauaucacaua

SEQ ID NO: 724046 - RNA, 22 nt, Human
uugauucugauccugucuggag

SEQ ID NO: 724047 - RNA, 22 nt, Human
auugaacuaaauaagcagucau

SEQ ID NO: 724048 - RNA, 22 nt, Human
aauccugugugacucuggggag

SEQ ID NO: 724049 - RNA, 22 nt, Human
uccguugacuuggaagcccuga

SEQ ID NO: 724050 - RNA, 22 nt, Human
acacagggcagagagcuggcuc

SEQ ID NO: 724051 - RNA, 22 nt, Human
cugggaggugaacagaaaaacu

SEQ ID NO: 724052 - RNA, 17 nt, Human
uccuggcaguccccugg

SEQ ID NO: 724053 - RNA, 22 nt, Human
aucugucuugccuugcauauuu

SEQ ID NO: 724054 - RNA, 22 nt, Human
uucccuggggaaggugaccuuu

SEQ ID NO: 724055 - RNA, 22 nt, Human
cacaguggaaguccaggauccc

SEQ ID NO: 724056 - RNA, 22 nt, Human
gcagggcuugcagcagcuagac

SEQ ID NO: 724057 - RNA, 22 nt, Human
guggcagguuauaagcaucuca

SEQ ID NO: 724058 - RNA, 22 nt, Human
ugaauaaauugagagcgaaugu

SEQ ID NO: 724059 - RNA, 22 nt, Human
ggcuuuggggugugcagagaug

SEQ ID NO: 724060 - RNA, 22 nt, Human
uaugcuuuacuuuucauuguga

SEQ ID NO: 724061 - RNA, 18 nt, Human
gcucugugaccuugagca

SEQ ID NO: 724062 - RNA, 22 nt, Human
caucccugacuucuaggugaca

SEQ ID NO: 724063 - RNA, 20 nt, Human
acgcacacgcgggggcgugc

SEQ ID NO: 724064 - RNA, 22 nt, Human
auguuacauaguccuuauuugu

SEQ ID NO: 724065 - RNA, 22 nt, Human
accaggcuugauaccaagaaau

SEQ ID NO: 724066 - RNA, 22 nt, Human
ugggucagauugagccccuggu

SEQ ID NO: 724067 - RNA, 22 nt, Human
gcaguaagauguuucccagagc

SEQ ID NO: 724068 - RNA, 22 nt, Human
ccugagcaacuucaagggccug

SEQ ID NO: 724069 - RNA, 22 nt, Human
uccugaggagaagagugcuagg

SEQ ID NO: 724070 - RNA, 22 nt, Human
uagaggugucacuuugggaagu

SEQ ID NO: 724071 - RNA, 22 nt, Human
caguucuuuguggggaguucuc

SEQ ID NO: 724072 - RNA, 22 nt, Human
uggcugagccuuuggggcuuuc

SEQ ID NO: 724073 - RNA, 22 nt, Human
uuaaggcugguccccucugcgu

SEQ ID NO: 724074 - RNA, 20 nt, Human
aagaggcuguggauccuacu

SEQ ID NO: 724075 - RNA, 22 nt, Human
uuucucauggcccuuggcuuuu

SEQ ID NO: 724076 - RNA, 22 nt, Human
ugggagcacccugaggagcuuc

SEQ ID NO: 724077 - RNA, 20 nt, Human
acccagcucugugcccuggg

SEQ ID NO: 724078 - RNA, 22 nt, Human
agcagcagucaugccuaugcuc

SEQ ID NO: 724079 - RNA, 22 nt, Human
gaaguuauuugcuaucuacuga

SEQ ID NO: 724080 - RNA, 22 nt, Human
aggcacagagaaugcccuccau

SEQ ID NO: 724081 - RNA, 22 nt, Human
uccuccagcuacuaggcaaaua

SEQ ID NO: 724082 - RNA, 22 nt, Human
ggcugcuggccagccuaggagu

SEQ ID NO: 724083 - RNA, 22 nt, Human
gaugucugugagaucaaacuaa

SEQ ID NO: 724084 - RNA, 22 nt, Human
gcaaagauauuagaauagagua

SEQ ID NO: 724085 - RNA, 22 nt, Human
aauacuaguuauuaaagcuuuu

SEQ ID NO: 724086 - RNA, 22 nt, Human
ccuuagcagggagucuguccag

SEQ ID NO: 724087 - RNA, 19 nt, Human
caucuggaugauucuccug

SEQ ID NO: 724088 - RNA, 22 nt, Human
cuuccuagcuucagagucuguu

SEQ ID NO: 724089 - RNA, 22 nt, Human
aauaaaucaauccuauugguag

SEQ ID NO: 724090 - RNA, 22 nt, Human
agacaaaugguaauuaugucua

SEQ ID NO: 724091 - RNA, 22 nt, Human
cugggauccacgggcucccaag

SEQ ID NO: 724092 - RNA, 19 nt, Human
aguaugucuaugagucuuu

SEQ ID NO: 724093 - RNA, 22 nt, Human
gaauuauagguuugcaugcuaa

SEQ ID NO: 724094 - RNA, 18 nt, Human
uaaauauauuucccccuu

SEQ ID NO: 724095 - RNA, 22 nt, Human
augguuuauuagcugcacaggc

SEQ ID NO: 724096 - RNA, 22 nt, Human
ucucaagagggaggcaaucaug

SEQ ID NO: 724097 - RNA, 22 nt, Human
ucauccauaguuugguuggacu

SEQ ID NO: 724098 - RNA, 22 nt, Human
caggaaauaaaaaguaucuucu

SEQ ID NO: 724099 - RNA, 22 nt, Human
gucuccugaggcauccauugaa

SEQ ID NO: 724100 - RNA, 22 nt, Human
uucaaguuaacucuccuuguac

SEQ ID NO: 724101 - RNA, 22 nt, Human
uccaggcauguugggaagauga

SEQ ID NO: 724102 - RNA, 22 nt, Human
ugcauucaauacaguaagaaua

SEQ ID NO: 724103 - RNA, 22 nt, Human
uagcagugcccuguggaauaag

SEQ ID NO: 724104 - RNA, 22 nt, Human
accuuuuuccaaagcuucuuac

SEQ ID NO: 724105 - RNA, 22 nt, Human
gcuaaugauagcaagauaaaca

SEQ ID NO: 724106 - RNA, 22 nt, Human
ccuucagucccauguuucucuu

SEQ ID NO: 724107 - RNA, 19 nt, Human
uccagccugcuguuucucu

SEQ ID NO: 724108 - RNA, 22 nt, Human
augauucagggaguuuucagga

SEQ ID NO: 724109 - RNA, 22 nt, Human
gcauguuuugcaacaagugacc

SEQ ID NO: 724110 - RNA, 22 nt, Human
gcuggagaacccaggaggaaga

SEQ ID NO: 724111 - RNA, 19 nt, Human
ggauucugcaguuuucaca

SEQ ID NO: 724112 - RNA, 22 nt, Human
ccaguccugccacccugucuau

SEQ ID NO: 724113 - RNA, 22 nt, Human
uuuucauuuuuguagaugcaag

SEQ ID NO: 724114 - RNA, 21 nt, Human
uagcauuuuuguauugcugaa

SEQ ID NO: 724115 - RNA, 22 nt, Human
cucccucacacccuugcccaga

SEQ ID NO: 724116 - RNA, 20 nt, Human
uccugcaguuccuaggaggg

SEQ ID NO: 724117 - RNA, 22 nt, Human
guguccugggggacuucagguu

SEQ ID NO: 724118 - RNA, 20 nt, Human
augugucugccucuguguuc

SEQ ID NO: 724119 - RNA, 22 nt, Human
auggcuuucagauggugaaaga

SEQ ID NO: 724120 - RNA, 22 nt, Human
cccagcacaggcaauuccauac

SEQ ID NO: 724121 - RNA, 22 nt, Human
ucugccuggauuccauucucca

SEQ ID NO: 724122 - RNA, 22 nt, Human
uuuguacaauuagcagaggcua

SEQ ID NO: 724123 - RNA, 22 nt, Human
augaggucaucuugaaguaggg

SEQ ID NO: 724124 - RNA, 22 nt, Human
agucauaauuauaaacaucagu

SEQ ID NO: 724125 - RNA, 22 nt, Human
aguggcuguaucagucaacccu

SEQ ID NO: 724126 - RNA, 22 nt, Human
agccagcaugaagacagaggcc

SEQ ID NO: 724127 - RNA, 22 nt, Human
cuaacuacaagcggggcauccu

SEQ ID NO: 724128 - RNA, 22 nt, Human
ugccaaaaugggcuuuauaccg

SEQ ID NO: 724129 - RNA, 22 nt, Human
uauugcuuauucuugagaguca

SEQ ID NO: 724130 - RNA, 22 nt, Human
uccagucaugguguccucacaa

SEQ ID NO: 724131 - RNA, 22 nt, Human
aauguauaaccauaggaaauuu

SEQ ID NO: 724132 - RNA, 22 nt, Human
agacagugcaagaagagcaggc

SEQ ID NO: 724133 - RNA, 22 nt, Human
uucuucaaugugcccuguuuuc

SEQ ID NO: 724134 - RNA, 22 nt, Human
ugggccacugaggguggucauu

SEQ ID NO: 724135 - RNA, 22 nt, Human
gcaccagcugcuggguucuaga

SEQ ID NO: 724136 - RNA, 22 nt, Human
gacauuuaaggcagucacuuaa

SEQ ID NO: 724137 - RNA, 20 nt, Human
gggaucaggaaaggaggcua

SEQ ID NO: 724138 - RNA, 22 nt, Human
uugauacagcagccugugaucc

SEQ ID NO: 724139 - RNA, 22 nt, Human
aacauuucauaacuugacuuuu

SEQ ID NO: 724140 - RNA, 21 nt, Human
ugagugccaccugcuggccaa

SEQ ID NO: 724141 - RNA, 22 nt, Human
uggagcugucacucagaaccaa

SEQ ID NO: 724142 - RNA, 17 nt, Human
ucuggguuuaaauccca

SEQ ID NO: 724143 - RNA, 22 nt, Human
gggcucugaaucccaggucugc

SEQ ID NO: 724144 - RNA, 22 nt, Human
ucaggcugcuuucaugcuuaga

SEQ ID NO: 724145 - RNA, 22 nt, Human
gaggcccuccagcugucagcug

SEQ ID NO: 724146 - RNA, 22 nt, Human
ggcugaugggcaugagcuguca

SEQ ID NO: 724147 - RNA, 22 nt, Human
caccccagucuaaaaccagccu

SEQ ID NO: 724148 - RNA, 22 nt, Human
cuuggaauggggcagaaaaugg

SEQ ID NO: 724149 - RNA, 22 nt, Human
cuggaaggagaaggaggcugug

SEQ ID NO: 724150 - RNA, 22 nt, Human
ucucagggccucccucuguuuc

SEQ ID NO: 724151 - RNA, 22 nt, Human
auugcagcuggucaggguaauu

SEQ ID NO: 724152 - RNA, 22 nt, Human
gaguccaggcucagaaacccgu

SEQ ID NO: 724153 - RNA, 17 nt, Human
ucucagugacugauagc

SEQ ID NO: 724154 - RNA, 22 nt, Human
guacccaggcacgccuugcuga

SEQ ID NO: 724155 - RNA, 19 nt, Human
uugaacacuuucuucaagg

SEQ ID NO: 724156 - RNA, 22 nt, Human
agcaccugcuugugacuaggga

SEQ ID NO: 724157 - RNA, 23 nt, Human
ucagaacaguucuuggugcauag

SEQ ID NO: 724158 - RNA, 22 nt, Human
cugggccaaaagaaguguucuu

SEQ ID NO: 724159 - RNA, 22 nt, Human
agcucuaaauggaauuuugccu

SEQ ID NO: 724160 - RNA, 22 nt, Human
uuggaggaggcauuggaggauu

SEQ ID NO: 724161 - RNA, 22 nt, Human
ccacuggcaguuggcuagccuu

SEQ ID NO: 724162 - RNA, 22 nt, Human
agcugcuuagagucucuucuua

SEQ ID NO: 724163 - RNA, 22 nt, Human
ugacagcauaacacuggucuug

SEQ ID NO: 724164 - RNA, 22 nt, Human
cagaaaaccugacucuagaacu

SEQ ID NO: 724165 - RNA, 22 nt, Human
ucugucugacaggguaugaacu

SEQ ID NO: 724166 - RNA, 22 nt, Human
cuuggaaagguuuuacaaagcg

SEQ ID NO: 724167 - RNA, 22 nt, Human
caguucuaauuaauaggaguaa

SEQ ID NO: 724168 - RNA, 22 nt, Human
ccaugccccaccaggacgcugc

SEQ ID NO: 724169 - RNA, 22 nt, Human
ucauccaucuuugauuucauag

SEQ ID NO: 724170 - RNA, 22 nt, Human
uuggaggcaaugggaaggaggc

SEQ ID NO: 724171 - RNA, 22 nt, Human
agcaggugaugugagucuggaa

SEQ ID NO: 724172 - RNA, 22 nt, Human
gaggcaguguugaaaaggagag

SEQ ID NO: 724173 - RNA, 22 nt, Human
auguaaauuguacugacacacg

SEQ ID NO: 724174 - RNA, 22 nt, Human
caugugguucaaguacuccaca

SEQ ID NO: 724175 - RNA, 20 nt, Human
ugcagaagaacguucugguu

SEQ ID NO: 724176 - RNA, 22 nt, Human
acagauacagggacuugguauu

SEQ ID NO: 724177 - RNA, 22 nt, Human
ucugccaucaagaugcucuggc

SEQ ID NO: 724178 - RNA, 22 nt, Human
uucacaaagcugguuccuucug

SEQ ID NO: 724179 - RNA, 22 nt, Human
auacaaaauauauacuggagac

SEQ ID NO: 724180 - RNA, 22 nt, Human
cccaguggcuuuugcccagguu

SEQ ID NO: 724181 - RNA, 22 nt, Human
agagccaggcaggcaauguuga

SEQ ID NO: 724182 - RNA, 22 nt, Human
uucucuggccugaggcgaggcc

SEQ ID NO: 724183 - RNA, 18 nt, Human
uuggcuucuuuccuuccu

SEQ ID NO: 724184 - RNA, 22 nt, Human
cagggucaggcugcuagaagcu

SEQ ID NO: 724185 - RNA, 22 nt, Human
agcagggcacuggaaggcacug

SEQ ID NO: 724186 - RNA, 22 nt, Human
auguagaggaguuucuggucug

SEQ ID NO: 724187 - RNA, 22 nt, Human
gaaaugcaaauucucucucgcu

SEQ ID NO: 724188 - RNA, 22 nt, Human
cauuacaucuuugaugcaguau

SEQ ID NO: 724189 - RNA, 22 nt, Human
uggcccagcucagggugggcgg

SEQ ID NO: 724190 - RNA, 21 nt, Human
caggaugaugggaagguggug

SEQ ID NO: 724191 - RNA, 22 nt, Human
caagccagucagcucaguagau

SEQ ID NO: 724192 - RNA, 22 nt, Human
ucaaggagacagaaagcaaugg

SEQ ID NO: 724193 - RNA, 22 nt, Human
gguggccuuucaguggaucagg

SEQ ID NO: 724194 - RNA, 22 nt, Human
ucaggguauguucuagaucuga

SEQ ID NO: 724195 - RNA, 22 nt, Human
ucucuugugguuuuguaguuga

SEQ ID NO: 724196 - RNA, 22 nt, Human
uggggugugcucagagcagggg

SEQ ID NO: 724197 - RNA, 22 nt, Human
ucugaggaaucuugacacauuu

SEQ ID NO: 724198 - RNA, 22 nt, Human
caguaaaugugauuuuucuugu

SEQ ID NO: 724199 - RNA, 22 nt, Human
augcuguggccagaguucaacu

SEQ ID NO: 724200 - RNA, 22 nt, Human
agugugucgagggaggguccag

SEQ ID NO: 724201 - RNA, 22 nt, Human
uaaggccauuauggugggcccg

SEQ ID NO: 724202 - RNA, 22 nt, Human
cccaggaaguggagguugcagu

SEQ ID NO: 724203 - RNA, 22 nt, Human
uauugauucugucccaaguuga

SEQ ID NO: 724204 - RNA, 22 nt, Human
uagccgcuuaauuauuugguga

SEQ ID NO: 724205 - RNA, 22 nt, Human
accacugguuuugcagaggcgc

SEQ ID NO: 724206 - RNA, 22 nt, Human
uccaccagcuucuucaccagcu

SEQ ID NO: 724207 - RNA, 22 nt, Human
caugcagcaggaucucauuccc

SEQ ID NO: 724208 - RNA, 22 nt, Human
gcuuuucuccuuagugucccug

SEQ ID NO: 724209 - RNA, 22 nt, Human
cugcagccuccugggguacaug

SEQ ID NO: 724210 - RNA, 22 nt, Human
uauuuagugauagaagcaagga

SEQ ID NO: 724211 - RNA, 22 nt, Human
auuuucacccugaauauauuga

SEQ ID NO: 724212 - RNA, 22 nt, Human
gaggaaccacucugagaagcca

SEQ ID NO: 724213 - RNA, 22 nt, Human
uucuauuucuuaaucuuggcug

SEQ ID NO: 724214 - RNA, 22 nt, Human
cauugaauccuuccuucagaag

SEQ ID NO: 724215 - RNA, 22 nt, Human
ugcuggggauccguaccaaccc

SEQ ID NO: 724216 - RNA, 22 nt, Human
cugggcucuucucacccuguuu

SEQ ID NO: 724217 - RNA, 22 nt, Human
ucuccagaggucccuugucucu

SEQ ID NO: 724218 - RNA, 22 nt, Human
cuaggcaguccugacgguacua

SEQ ID NO: 724219 - RNA, 21 nt, Human
gaccccagaccagcagacaca

SEQ ID NO: 724220 - RNA, 22 nt, Human
ccacagggcacaagggagguug

SEQ ID NO: 724221 - RNA, 22 nt, Human
cagcaugacagucugcagcaga

SEQ ID NO: 724222 - RNA, 22 nt, Human
uggcucaggaucuaagcagaau

SEQ ID NO: 724223 - RNA, 22 nt, Human
agcagaugagccucaugacugg

SEQ ID NO: 724224 - RNA, 22 nt, Human
gggaccugaggcccugcuccac

SEQ ID NO: 724225 - RNA, 22 nt, Human
aucauccaagcguaguucuucu

SEQ ID NO: 724226 - RNA, 22 nt, Human
gcauugaaggcauuuuaucuac

SEQ ID NO: 724227 - RNA, 22 nt, Human
uuccugcauggauugaggcuau

SEQ ID NO: 724228 - RNA, 23 nt, Human
aagauccauucaaauuauguauc

SEQ ID NO: 724229 - RNA, 22 nt, Human
ugugaagcuggauccuggagcu

SEQ ID NO: 724230 - RNA, 22 nt, Human
agaaauacaaaguacuaagaua

SEQ ID NO: 724231 - RNA, 19 nt, Human
aagcccaguguaugcucuu

SEQ ID NO: 724232 - RNA, 22 nt, Human
ugaaggccucugguacaugcca

SEQ ID NO: 724233 - RNA, 22 nt, Human
aggcuccuaucgcuuucagcaa

SEQ ID NO: 724234 - RNA, 22 nt, Human
aauugucuuuaucacaguucaa

SEQ ID NO: 724235 - RNA, 22 nt, Human
uccugacuaggagggcuaaggu

SEQ ID NO: 724236 - RNA, 22 nt, Human
cucacugacugcaagucaaguu

SEQ ID NO: 724237 - RNA, 22 nt, Human
aaauagaauuggaagcagaguu

SEQ ID NO: 724238 - RNA, 22 nt, Human
auuccacugccgaaugauacau

SEQ ID NO: 724239 - RNA, 22 nt, Human
gugcuuuacuguguugccuuua

SEQ ID NO: 724240 - RNA, 22 nt, Human
acagcagcuaaccccugggcca

SEQ ID NO: 724241 - RNA, 22 nt, Human
agcaggcaguguagagccuuca

SEQ ID NO: 724242 - RNA, 22 nt, Human
aaauauaguaaaugcauaguuc

SEQ ID NO: 724243 - RNA, 22 nt, Human
augcugccuccucuucagccgc

SEQ ID NO: 724244 - RNA, 22 nt, Human
aguuggcauuccugcauccuau

SEQ ID NO: 724245 - RNA, 22 nt, Human
uacagugcauagaggcaugaua

SEQ ID NO: 724246 - RNA, 22 nt, Human
uggagagcuauuuggaccucca

SEQ ID NO: 724247 - RNA, 21 nt, Human
aacaguucucuuugaaggugu

SEQ ID NO: 724248 - RNA, 22 nt, Human
caggcugagcucuggccugggc

SEQ ID NO: 724249 - RNA, 22 nt, Human
agcacaauauggguuuuauagu

SEQ ID NO: 724250 - RNA, 21 nt, Human
cuccugggcuaagauauagug

SEQ ID NO: 724251 - RNA, 22 nt, Human
uaggguccaagccuuauaauua

SEQ ID NO: 724252 - RNA, 22 nt, Human
augaacaugugacucagaccug

SEQ ID NO: 724253 - RNA, 22 nt, Human
agagauucugugucaaaacgaa

SEQ ID NO: 724254 - RNA, 22 nt, Human
agaggcaggaagagcugauuuu

SEQ ID NO: 724255 - RNA, 18 nt, Human
aucucccauuggccaagg

SEQ ID NO: 724256 - RNA, 22 nt, Human
aggcgcaggguuuggacccagg

SEQ ID NO: 724257 - RNA, 22 nt, Human
ucuuuguuauugcuuuaucuau

SEQ ID NO: 724258 - RNA, 22 nt, Human
ucugcaucucaggauucccuuc

SEQ ID NO: 724259 - RNA, 22 nt, Human
caggcaugcuucugucugggca

SEQ ID NO: 724260 - RNA, 22 nt, Human
aaugcauucucgguuugugugu

SEQ ID NO: 724261 - RNA, 22 nt, Human
uauggcuuugaaagggcuuuuc

SEQ ID NO: 724262 - RNA, 22 nt, Human
agucucuggacugggagauggc

SEQ ID NO: 724263 - RNA, 19 nt, Human
ugcccugcacgcuguccug

SEQ ID NO: 724264 - RNA, 22 nt, Human
guuuucuuugaaugcuucuaga

SEQ ID NO: 724265 - RNA, 22 nt, Human
cuggucccagcagagcucugag

SEQ ID NO: 724266 - RNA, 22 nt, Human
aaacauuguacauucuguagcu

SEQ ID NO: 724267 - RNA, 22 nt, Human
gcaguggggaaugcuggggaga

SEQ ID NO: 724268 - RNA, 22 nt, Human
ggcuucuugugugucaggcucu

SEQ ID NO: 724269 - RNA, 22 nt, Human
gaagaggcaauugaauaagcua

SEQ ID NO: 724270 - RNA, 22 nt, Human
cggagcugccugccaagccugc

SEQ ID NO: 724271 - RNA, 22 nt, Human
ccuggaaaacaugggaaucaca

SEQ ID NO: 724272 - RNA, 22 nt, Human
uuagaggacuguaggugggaau

SEQ ID NO: 724273 - RNA, 22 nt, Human
uggcacaugguuaaucauaauu

SEQ ID NO: 724274 - RNA, 22 nt, Human
agagcccugacggggacagaug

SEQ ID NO: 724275 - RNA, 22 nt, Human
caggguccccgggucuccugug

SEQ ID NO: 724276 - RNA, 22 nt, Human
caggcacaguuccaagcauuuu

SEQ ID NO: 724277 - RNA, 21 nt, Human
ugacugaaauagaauuuagcu

SEQ ID NO: 724278 - RNA, 22 nt, Human
ggaggcccagaaggaagcccag

SEQ ID NO: 724279 - RNA, 22 nt, Human
acagccccagcgcggcgggguc

SEQ ID NO: 724280 - RNA, 22 nt, Human
ggcuggacucugggccucucca

SEQ ID NO: 724281 - RNA, 22 nt, Human
ucugcuucacuuccccaagcuu

SEQ ID NO: 724282 - RNA, 22 nt, Human
gcuuccauguugcugcugguca

SEQ ID NO: 724283 - RNA, 22 nt, Human
uuuucauuagaaugacugagaa

SEQ ID NO: 724284 - RNA, 22 nt, Human
uuagaggaaagugacuccgaug

SEQ ID NO: 724285 - RNA, 23 nt, Human
uccaauucaauugggucaggaag

SEQ ID NO: 724286 - RNA, 22 nt, Human
aaggguccaaggcuuugcguuu

SEQ ID NO: 724287 - RNA, 22 nt, Human
aauagcaccugagguaguuugu

SEQ ID NO: 724288 - RNA, 19 nt, Human
cagagcugcuggccucguc

SEQ ID NO: 724289 - RNA, 22 nt, Human
aaucuucaacagaaugguagga

SEQ ID NO: 724290 - RNA, 22 nt, Human
cucgccugccugugucucuccc

SEQ ID NO: 724291 - RNA, 22 nt, Human
uaagcacuuuauaugcuuuauc

SEQ ID NO: 724292 - RNA, 22 nt, Human
gagagaaaugugcaguuugggc

SEQ ID NO: 724293 - RNA, 22 nt, Human
uguaacaauuucuuacuauugu

SEQ ID NO: 724294 - RNA, 17 nt, Human
gcuacugguuaccucua

SEQ ID NO: 724295 - RNA, 21 nt, Human
guuauuuuaagugagcuuugc

SEQ ID NO: 724296 - RNA, 22 nt, Human
cacugaagguaggaccaaggcu

SEQ ID NO: 724297 - RNA, 22 nt, Human
cagggcucgcugccagcuucag

SEQ ID NO: 724298 - RNA, 22 nt, Human
aaugcaaccugcugaucugaca

SEQ ID NO: 724299 - RNA, 22 nt, Human
uccuuuaugugaguuguuuccc

SEQ ID NO: 724300 - RNA, 22 nt, Human
caaagcaggcuugucaaauugc

SEQ ID NO: 724301 - RNA, 22 nt, Human
gccagaagacuggagucagcug

SEQ ID NO: 724302 - RNA, 22 nt, Human
gcaaaaguacagccggauuucu

SEQ ID NO: 724303 - RNA, 22 nt, Human
ucugaauaguauauugaaagca

SEQ ID NO: 724304 - RNA, 20 nt, Human
ugggccuguggcagaagucu

SEQ ID NO: 724305 - RNA, 22 nt, Human
caugucugccaauuuggaagga

SEQ ID NO: 724306 - RNA, 22 nt, Human
cucagggacggaggcuugcgga

SEQ ID NO: 724307 - RNA, 22 nt, Human
agccuggccacucagggccuga

SEQ ID NO: 724308 - RNA, 20 nt, Human
ugguggacuuuggcauggcu

SEQ ID NO: 724309 - RNA, 22 nt, Human
aauaauaagauacuaagggagu

SEQ ID NO: 724310 - RNA, 22 nt, Human
acuuuguugaagaauauguuag

SEQ ID NO: 724311 - RNA, 22 nt, Human
ugggguccucucacuuggaggg

SEQ ID NO: 724312 - RNA, 22 nt, Human
cgcaggcaaugcuccgcggggg

SEQ ID NO: 724313 - RNA, 22 nt, Human
gcuccaggguggaugacaauuc

SEQ ID NO: 724314 - RNA, 22 nt, Human
uaccugcagcgggaauccauua

SEQ ID NO: 724315 - RNA, 22 nt, Human
auuuggauaucacugaauacau

SEQ ID NO: 724316 - RNA, 19 nt, Human
agcagcuggagguggagug

SEQ ID NO: 724317 - RNA, 22 nt, Human
gcugggcaacgggcagaaagau

SEQ ID NO: 724318 - RNA, 23 nt, Human
ugugaaauuugaggucagugcuu

SEQ ID NO: 724319 - RNA, 22 nt, Human
agagugaaaagcuagagcagua

SEQ ID NO: 724320 - RNA, 22 nt, Human
gggacccucaacaucugcuucu

SEQ ID NO: 724321 - RNA, 22 nt, Human
aagcuuuaaggaauuuuaugga

SEQ ID NO: 724322 - RNA, 22 nt, Human
augcugugagugugccgcagag

SEQ ID NO: 724323 - RNA, 22 nt, Human
ucagcuguguaucccagggccu

SEQ ID NO: 724324 - RNA, 22 nt, Human
uuggccaaaggaaagacuacug

SEQ ID NO: 724325 - RNA, 22 nt, Human
accacuuuacagaaauggaaag

SEQ ID NO: 724326 - RNA, 18 nt, Human
ggacacagauagguacag

SEQ ID NO: 724327 - RNA, 22 nt, Human
uccauuuuagaagaaaauccac

SEQ ID NO: 724328 - RNA, 22 nt, Human
uggcugcucaagggaggaggcu

SEQ ID NO: 724329 - RNA, 19 nt, Human
ucugggagagugaaucuga

SEQ ID NO: 724330 - RNA, 22 nt, Human
ggcagcucaccucugguccagg

SEQ ID NO: 724331 - RNA, 22 nt, Human
ggccugaggcaauagucagaca

SEQ ID NO: 724332 - RNA, 22 nt, Human
agucacagguucuugggauuag

SEQ ID NO: 724333 - RNA, 22 nt, Human
uacaucucaucugugcucuccg

SEQ ID NO: 724334 - RNA, 22 nt, Human
gccagcuggagugagagugggc

SEQ ID NO: 724335 - RNA, 22 nt, Human
gguuggacacuagguaggagcg

SEQ ID NO: 724336 - RNA, 22 nt, Human
ccagagaaccaucugcuugagg

SEQ ID NO: 724337 - RNA, 21 nt, Human
aauuacagauggaauuacaga

SEQ ID NO: 724338 - RNA, 22 nt, Human
ccuucaaacuuucauuaaccag

SEQ ID NO: 724339 - RNA, 22 nt, Human
uaaaugccauucguuucauaca

SEQ ID NO: 724340 - RNA, 22 nt, Human
uugugucuaugguuugagcauc

SEQ ID NO: 724341 - RNA, 22 nt, Human
gugugccagacaugaugcuaug

SEQ ID NO: 724342 - RNA, 21 nt, Human
ugcugaugucagagaagcaag

SEQ ID NO: 724343 - RNA, 22 nt, Human
agguggcagcagccuggugaaa

SEQ ID NO: 724344 - RNA, 22 nt, Human
ggaagcugggaucucucucccg

SEQ ID NO: 724345 - RNA, 22 nt, Human
ccacuugaaucaaauucuuagg

SEQ ID NO: 724346 - RNA, 22 nt, Human
ggcugucuugggagcucccccg

SEQ ID NO: 724347 - RNA, 22 nt, Human
ggguggggcccaggaaaucuau

SEQ ID NO: 724348 - RNA, 21 nt, Human
uagagauguuugcuaaguagc

SEQ ID NO: 724349 - RNA, 22 nt, Human
gugcaggagcaggagccauguc

SEQ ID NO: 724350 - RNA, 22 nt, Human
ugacuucugggugagccagcau

SEQ ID NO: 724351 - RNA, 22 nt, Human
acucaggccccaucgcccaucu

SEQ ID NO: 724352 - RNA, 22 nt, Human
acaugugcucuugcuguacagc

SEQ ID NO: 724353 - RNA, 22 nt, Human
gccuuuggacugagguagucag

SEQ ID NO: 724354 - RNA, 22 nt, Human
acucacuuuccauucaagcacc

SEQ ID NO: 724355 - RNA, 22 nt, Human
accccagaaucuaugcuuuaca

SEQ ID NO: 724356 - RNA, 22 nt, Human
agcugcaggccucuccugggga

SEQ ID NO: 724357 - RNA, 22 nt, Human
auugccuugucagauuucuuuu

SEQ ID NO: 724358 - RNA, 22 nt, Human
aaggugucacugggacaggaaa

SEQ ID NO: 724359 - RNA, 22 nt, Human
gcuguacauuuguguacacuug

SEQ ID NO: 724360 - RNA, 22 nt, Human
ucuguaaucuuccccagcucag

SEQ ID NO: 724361 - RNA, 20 nt, Human
ccugcugugcuuuccaugga

SEQ ID NO: 724362 - RNA, 22 nt, Human
ucagacuugccuuuuuauaaaa

SEQ ID NO: 724363 - RNA, 22 nt, Human
aaaucucuggcagaaauaaacu

SEQ ID NO: 724364 - RNA, 22 nt, Human
aggggccuggcacugagcuggc

SEQ ID NO: 724365 - RNA, 22 nt, Human
aaagccauuacaaaauuucaua

SEQ ID NO: 724366 - RNA, 22 nt, Human
uucuuacuacauuugcaggcua

SEQ ID NO: 724367 - RNA, 22 nt, Human
gaaucacagaggcaaauucuga

SEQ ID NO: 724368 - RNA, 22 nt, Human
cugaaauuccauuucagccaca

SEQ ID NO: 724369 - RNA, 22 nt, Human
uucuuucagaacacaagugauu

SEQ ID NO: 724370 - RNA, 22 nt, Human
uaccugcaaaguuccuuuugcc

SEQ ID NO: 724371 - RNA, 22 nt, Human
uagaucauauuuguggagaaaa

SEQ ID NO: 724372 - RNA, 22 nt, Human
agucuggagugauuauguggga

SEQ ID NO: 724373 - RNA, 22 nt, Human
agaggcuccuucacucuggcac

SEQ ID NO: 724374 - RNA, 22 nt, Human
gcugucugggaugucacugcug

SEQ ID NO: 724375 - RNA, 22 nt, Human
uagaacaugggauagaguuuuu

SEQ ID NO: 724376 - RNA, 22 nt, Human
aggcucuuugagacuaccugga

SEQ ID NO: 724377 - RNA, 22 nt, Human
gguccagguauguggugugaau

SEQ ID NO: 724378 - RNA, 22 nt, Human
ucaggagggugacaggcccugg

SEQ ID NO: 724379 - RNA, 22 nt, Human
uccugaaauuuguuuuaauucu

SEQ ID NO: 724380 - RNA, 22 nt, Human
caggagguugguagcaguagau

SEQ ID NO: 724381 - RNA, 22 nt, Human
gaaggggguugcagucuagggu

SEQ ID NO: 724382 - RNA, 21 nt, Human
agaacugauuaaauaagcagu

SEQ ID NO: 724383 - RNA, 22 nt, Human
gcugcucucagagcucaugcug

SEQ ID NO: 724384 - RNA, 22 nt, Human
cccuuccuccucgccugucaga

SEQ ID NO: 724385 - RNA, 20 nt, Human
agaaaauguuuucagcugga

SEQ ID NO: 724386 - RNA, 22 nt, Human
uauugccugaguguuucauaau

SEQ ID NO: 724387 - RNA, 21 nt, Human
acccccacaccuccuuaguuc

SEQ ID NO: 724388 - RNA, 22 nt, Human
gugccugcugcagagucgcugu

SEQ ID NO: 724389 - RNA, 22 nt, Human
ggcacugcagguaagugcuguc

SEQ ID NO: 724390 - RNA, 22 nt, Human
ugauggaaaauaaaucuuauuc

SEQ ID NO: 724391 - RNA, 22 nt, Human
ccaaaggaugucccuguguuuu

SEQ ID NO: 724392 - RNA, 22 nt, Human
aggacacagcucuucaguaaga

SEQ ID NO: 724393 - RNA, 22 nt, Human
gccuggugugcgccgcgcagcu

SEQ ID NO: 724394 - RNA, 22 nt, Human
aaguuuguucauucauucaucc

SEQ ID NO: 724395 - RNA, 22 nt, Human
gggcccacuggcugucugaccc

SEQ ID NO: 724396 - RNA, 22 nt, Human
agggagguaggagcuucuagcu

SEQ ID NO: 724397 - RNA, 22 nt, Human
ggcgcacaaugugcagguuugu

SEQ ID NO: 724398 - RNA, 21 nt, Human
gucuuucuaccucuauguggc

SEQ ID NO: 724399 - RNA, 22 nt, Human
gcccaugguccaggaagacaga

SEQ ID NO: 724400 - RNA, 22 nt, Human
ugggagacacuggugggagcuu

SEQ ID NO: 724401 - RNA, 22 nt, Human
caugggaggucugcaaggugcu

SEQ ID NO: 724402 - RNA, 22 nt, Human
gagaggcuugugugaagaacaa

SEQ ID NO: 724403 - RNA, 22 nt, Human
gacuguguccaugugcuggauu

SEQ ID NO: 724404 - RNA, 22 nt, Human
cugagcugggcucucuugaggg

SEQ ID NO: 724405 - RNA, 22 nt, Human
aauucaaauuugaguuugugau

SEQ ID NO: 724406 - RNA, 22 nt, Human
cucugagcccgcugcagcccca

SEQ ID NO: 724407 - RNA, 22 nt, Human
ucagugucuugaccugggugug

SEQ ID NO: 724408 - RNA, 23 nt, Human
acagcaagaggaccagaugugag

SEQ ID NO: 724409 - RNA, 22 nt, Human
auuggucagaguaaauuuauuu

SEQ ID NO: 724410 - RNA, 22 nt, Human
ucagcccaguuuuaucaucugu

SEQ ID NO: 724411 - RNA, 22 nt, Human
aagagugugagguugugcuuuu

SEQ ID NO: 724412 - RNA, 22 nt, Human
agguaacuagcauuagcuucug

SEQ ID NO: 724413 - RNA, 17 nt, Human
uccagcuccucauuguu

SEQ ID NO: 724414 - RNA, 22 nt, Human
uaaaaccauaaggcuggaagga

SEQ ID NO: 724415 - RNA, 22 nt, Human
acuuguuucaacuguacucuca

SEQ ID NO: 724416 - RNA, 22 nt, Human
cauaaauuguacccauuccaac

SEQ ID NO: 724417 - RNA, 22 nt, Human
cagcagcugggaaggaggcuga

SEQ ID NO: 724418 - RNA, 22 nt, Human
ccagggcaauuauuuggagggu

SEQ ID NO: 724419 - RNA, 22 nt, Human
guguuuuauggagucauaacgu

SEQ ID NO: 724420 - RNA, 22 nt, Human
guccugagagaggcuccuugcc

SEQ ID NO: 724421 - RNA, 22 nt, Human
cccaggaagagugaguggcauu

SEQ ID NO: 724422 - RNA, 22 nt, Human
aagaguuugaccugugccaucc

SEQ ID NO: 724423 - RNA, 22 nt, Human
aaauuugauaagccauuguuac

SEQ ID NO: 724424 - RNA, 22 nt, Human
cugugccuaagaugcaugucuc

SEQ ID NO: 724425 - RNA, 22 nt, Human
ggggaggcugaugugggcaaag

SEQ ID NO: 724426 - RNA, 22 nt, Human
uuaugccuccgaaaccuggagu

SEQ ID NO: 724427 - RNA, 20 nt, Human
gcugucccaggccaaagggc

SEQ ID NO: 724428 - RNA, 22 nt, Human
uuguguguagacucagccauug

SEQ ID NO: 724429 - RNA, 22 nt, Human
cuuuggcaacacaugugggaca

SEQ ID NO: 724430 - RNA, 22 nt, Human
cacagcccccuugacacucugg

SEQ ID NO: 724431 - RNA, 22 nt, Human
acugggccagacacugauuccc

SEQ ID NO: 724432 - RNA, 22 nt, Human
ucuuuccucugagcuccuguag

SEQ ID NO: 724433 - RNA, 22 nt, Human
auaggaaugugauuuauaaaug

SEQ ID NO: 724434 - RNA, 22 nt, Human
cucuccaaguuaucaagaugaa

SEQ ID NO: 724435 - RNA, 22 nt, Human
ugcagcagcuccagguuacccu

SEQ ID NO: 724436 - RNA, 22 nt, Human
ugcauuugcuggggaugugauu

SEQ ID NO: 724437 - RNA, 22 nt, Human
acauuucagugagcuauugaag

SEQ ID NO: 724438 - RNA, 22 nt, Human
agcugaacgugcuucugcagca

SEQ ID NO: 724439 - RNA, 22 nt, Human
aagagccagugggaaagucuug

SEQ ID NO: 724440 - RNA, 20 nt, Human
uggaggcagagccagaggga

SEQ ID NO: 724441 - RNA, 22 nt, Human
uagaggugacacugagaccaua

SEQ ID NO: 724442 - RNA, 21 nt, Human
uauugcuuguaggucauccug

SEQ ID NO: 724443 - RNA, 23 nt, Human
ccugcagcugcuggggcuccacc

SEQ ID NO: 724444 - RNA, 22 nt, Human
uaaaugugagugaugcggugaa

SEQ ID NO: 724445 - RNA, 22 nt, Human
auauaggcagaaaggaaggcaa

SEQ ID NO: 724446 - RNA, 22 nt, Human
gagauacaguuggcugcaggcu

SEQ ID NO: 724447 - RNA, 22 nt, Human
aaagguuuucuaggguugaggg

SEQ ID NO: 724448 - RNA, 22 nt, Human
ugcaggaacauagguuccuugg

SEQ ID NO: 724449 - RNA, 22 nt, Human
uaaguacaaauguauacauaag

SEQ ID NO: 724450 - RNA, 22 nt, Human
ugcucaguagcagugugcugcu

SEQ ID NO: 724451 - RNA, 22 nt, Human
gagauucuauguuguugauuau

SEQ ID NO: 724452 - RNA, 22 nt, Human
accaggaaacugugcccacgac

SEQ ID NO: 724453 - RNA, 22 nt, Human
ugggcccaucauugcugugggc

SEQ ID NO: 724454 - RNA, 22 nt, Human
gaggucccccauggcugugacu

SEQ ID NO: 724455 - RNA, 23 nt, Human
acacaauagaguacuauucagcc

SEQ ID NO: 724456 - RNA, 22 nt, Human
auacaagugagaaaacugaaga

SEQ ID NO: 724457 - RNA, 22 nt, Human
cagaaccaggaacugauggaga

SEQ ID NO: 724458 - RNA, 22 nt, Human
uacauugcuuucuaauacaucu

SEQ ID NO: 724459 - RNA, 22 nt, Human
aaacagauaaugcuauaaaugg

SEQ ID NO: 724460 - RNA, 22 nt, Human
aggguauguuuuuaucuacugu

SEQ ID NO: 724461 - RNA, 22 nt, Human
gugugcagaggcaggaggugcu

SEQ ID NO: 724462 - RNA, 22 nt, Human
acaggaagaaagugcaguagau

SEQ ID NO: 724463 - RNA, 22 nt, Human
ugaggcacugggagagcacacu

SEQ ID NO: 724464 - RNA, 22 nt, Human
aacauucuacuguacugcauug

SEQ ID NO: 724465 - RNA, 22 nt, Human
ugucauuuugucucacugcuau

SEQ ID NO: 724466 - RNA, 22 nt, Human
acaucaugagagacuuaaauug

SEQ ID NO: 724467 - RNA, 20 nt, Human
gcagggcgacacgggggagg

SEQ ID NO: 724468 - RNA, 22 nt, Human
cugagguguugaugaccuaugc

SEQ ID NO: 724469 - RNA, 22 nt, Human
cgggucaccuaucaauuuugug

SEQ ID NO: 724470 - RNA, 22 nt, Human
gggcuccagcuguuugccauga

SEQ ID NO: 724471 - RNA, 22 nt, Human
acuaggaaguggcaaaacugga

SEQ ID NO: 724472 - RNA, 22 nt, Human
uuuuccuuaacagagggagaaa

SEQ ID NO: 724473 - RNA, 22 nt, Human
caggcacaagaucggcuagaua

SEQ ID NO: 724474 - RNA, 22 nt, Human
gcugcucuggcucugcaguguc

SEQ ID NO: 724475 - RNA, 22 nt, Human
gcauucauucaggcucccaggg

SEQ ID NO: 724476 - RNA, 22 nt, Human
ucagaggcuugaagcccaagcc

SEQ ID NO: 724477 - RNA, 22 nt, Human
cagcugugcugauugcucagua

SEQ ID NO: 724478 - RNA, 22 nt, Human
accaggccuagcaaguacauua

SEQ ID NO: 724479 - RNA, 21 nt, Human
cucuggagucaagagcuucca

SEQ ID NO: 724480 - RNA, 22 nt, Human
aauucuucaagugcuuuggaga

SEQ ID NO: 724481 - RNA, 22 nt, Human
gccaggcaauguguuagaagcg

SEQ ID NO: 724482 - RNA, 22 nt, Human
gcccucagaggacagcugacuu

SEQ ID NO: 724483 - RNA, 22 nt, Human
ugccaauuagagacauccaucu

SEQ ID NO: 724484 - RNA, 22 nt, Human
ugacauaauaauccaaacauac

SEQ ID NO: 724485 - RNA, 21 nt, Human
uggcucgauuuauagcauuuc

SEQ ID NO: 724486 - RNA, 22 nt, Human
cuuggggaggacgcaguguccu

SEQ ID NO: 724487 - RNA, 22 nt, Human
uggcugcugcagacagacagga

SEQ ID NO: 724488 - RNA, 22 nt, Human
auguaucacagcaauguaguca

SEQ ID NO: 724489 - RNA, 22 nt, Human
cuuuccaagaaugcagauaccu

SEQ ID NO: 724490 - RNA, 22 nt, Human
ccugaggcuugggaguuccgcc

SEQ ID NO: 724491 - RNA, 23 nt, Human
ucaaacuguuauauugccagagu

SEQ ID NO: 724492 - RNA, 22 nt, Human
uggacucaaguccaaguucacg

SEQ ID NO: 724493 - RNA, 22 nt, Human
gguaguucuucauggguuucau

SEQ ID NO: 724494 - RNA, 22 nt, Human
cacuaggcaucugugaggguag

SEQ ID NO: 724495 - RNA, 22 nt, Human
aggcugugauuccaccacucuc

SEQ ID NO: 724496 - RNA, 22 nt, Human
ucccuagaggucuucacaagau

SEQ ID NO: 724497 - RNA, 17 nt, Human
ugaggccugcaucagug

SEQ ID NO: 724498 - RNA, 22 nt, Human
auuuagugaaacccauaaagca

SEQ ID NO: 724499 - RNA, 22 nt, Human
aggcaagcauugggaacagggc

SEQ ID NO: 724500 - RNA, 22 nt, Human
guuauauaagacaaaucagagu

SEQ ID NO: 724501 - RNA, 22 nt, Human
aaugcuagugugauauguaagg

SEQ ID NO: 724502 - RNA, 22 nt, Human
uccauccauggauggaaaugug

SEQ ID NO: 724503 - RNA, 22 nt, Human
ccuuagcuggagugguggaaug

SEQ ID NO: 724504 - RNA, 22 nt, Human
cuguguuugaugagaagccacc

SEQ ID NO: 724505 - RNA, 19 nt, Human
cuuucaugugguucuucuu

SEQ ID NO: 724506 - RNA, 22 nt, Human
cugggccuugccaggggugucu

SEQ ID NO: 724507 - RNA, 22 nt, Human
ucugugguggagugggcaugag

SEQ ID NO: 724508 - RNA, 22 nt, Human
uuuacacauaaauguguagaca

SEQ ID NO: 724509 - RNA, 21 nt, Human
uuauacauauguucucugccu

SEQ ID NO: 724510 - RNA, 22 nt, Human
uuuguaaccuaaagcaccagau

SEQ ID NO: 724511 - RNA, 22 nt, Human
uguagauauagaaaaagacuga

SEQ ID NO: 724512 - RNA, 22 nt, Human
ugcuuaauagugcacugguuuc

SEQ ID NO: 724513 - RNA, 17 nt, Human
ggcuuacaggugccagc

SEQ ID NO: 724514 - RNA, 22 nt, Human
agaaggccuaacuugggggcaa

SEQ ID NO: 724515 - RNA, 22 nt, Human
gacagccucaugugcaugaacu

SEQ ID NO: 724516 - RNA, 22 nt, Human
ugcuauuaaugaggcugcauuu

SEQ ID NO: 724517 - RNA, 22 nt, Human
cuuggaggaugugcggcugccc

SEQ ID NO: 724518 - RNA, 18 nt, Human
ugugccucugcaggacgu

SEQ ID NO: 724519 - RNA, 21 nt, Human
agaugaggauacugaggccua

SEQ ID NO: 724520 - RNA, 22 nt, Human
agacaucuugcacacauauacu

SEQ ID NO: 724521 - RNA, 21 nt, Human
ugugugugcaggcacacacac

SEQ ID NO: 724522 - RNA, 18 nt, Human
aucuuaacuugauggagu

SEQ ID NO: 724523 - RNA, 22 nt, Human
uguagugugacauaggugucca

SEQ ID NO: 724524 - RNA, 22 nt, Human
uacagacaaagagcaugcggua

SEQ ID NO: 724525 - RNA, 22 nt, Human
ugcagcccaggcgucagguggu

SEQ ID NO: 724526 - RNA, 22 nt, Human
acuaggaaggcauaugggcaga

SEQ ID NO: 724527 - RNA, 22 nt, Human
ccaggcaagagaggcucuggca

SEQ ID NO: 724528 - RNA, 22 nt, Human
ggugagugccuggccuggccac

SEQ ID NO: 724529 - RNA, 22 nt, Human
cucacagcagccagucugccuu

SEQ ID NO: 724530 - RNA, 22 nt, Human
uguuuugcuucucuguuuccca

SEQ ID NO: 724531 - RNA, 22 nt, Human
aagugacauaccuuacauaugu

SEQ ID NO: 724532 - RNA, 22 nt, Human
cgggcagugcccagcggggcag

SEQ ID NO: 724533 - RNA, 22 nt, Human
caguggggaggccaggauagaa

SEQ ID NO: 724534 - RNA, 22 nt, Human
ggcuucagugagcugagcucac

SEQ ID NO: 724535 - RNA, 22 nt, Human
caagagcuggagaggcagucua

SEQ ID NO: 724536 - RNA, 22 nt, Human
cuggaagagcauuugcauaggg

SEQ ID NO: 724537 - RNA, 22 nt, Human
cagccacuguggaauagccccc

SEQ ID NO: 724538 - RNA, 22 nt, Human
ucagaagguggagguugcagug

SEQ ID NO: 724539 - RNA, 22 nt, Human
acagaauuaaaguguuugugga

SEQ ID NO: 724540 - RNA, 22 nt, Human
ugggcuucauaauugguccuag

SEQ ID NO: 724541 - RNA, 22 nt, Human
gccauggggcucagcugcacua

SEQ ID NO: 724542 - RNA, 22 nt, Human
ucagagaaggcugagucacggc

SEQ ID NO: 724543 - RNA, 22 nt, Human
uucauguaauuccauaagguaa

SEQ ID NO: 724544 - RNA, 22 nt, Human
acagagcaugcucaguguguga

SEQ ID NO: 724545 - RNA, 18 nt, Human
cuggucagggcaaugggc

SEQ ID NO: 724546 - RNA, 22 nt, Human
caugcacaaagguaagaugcgu

SEQ ID NO: 724547 - RNA, 22 nt, Human
cccagcaguuguuggugcacau

SEQ ID NO: 724548 - RNA, 22 nt, Human
gagcugaguuaccuccagauca

SEQ ID NO: 724549 - RNA, 22 nt, Human
agagaacagccuccuagagaaa

SEQ ID NO: 724550 - RNA, 22 nt, Human
gagcuucuuguuucuucaucug

SEQ ID NO: 724551 - RNA, 22 nt, Human
uuucacagcuuccacuuaagga

SEQ ID NO: 724552 - RNA, 20 nt, Human
guccugggagccacagcaca

SEQ ID NO: 724553 - RNA, 22 nt, Human
ugccagcccaccuuggggccuc

SEQ ID NO: 724554 - RNA, 22 nt, Human
gaguaagagcuggcuuuggugu

SEQ ID NO: 724555 - RNA, 22 nt, Human
aggcacaggccucagcacccag

SEQ ID NO: 724556 - RNA, 22 nt, Human
aauuccugucuuaacaguucug

SEQ ID NO: 724557 - RNA, 22 nt, Human
guaaaguaaacccacuuuguag

SEQ ID NO: 724558 - RNA, 22 nt, Human
ccaaggaguagagcaggaagcu

SEQ ID NO: 724559 - RNA, 22 nt, Human
acucuguuugcagguagcucag

SEQ ID NO: 724560 - RNA, 22 nt, Human
aguggcagagcugggauuuggg

SEQ ID NO: 724561 - RNA, 22 nt, Human
auuuagcaagcaggcaaauuca

SEQ ID NO: 724562 - RNA, 22 nt, Human
gcagucaucaguccuuuaauua

SEQ ID NO: 724563 - RNA, 22 nt, Human
cucacacacgaagcccuuggcc

SEQ ID NO: 724564 - RNA, 22 nt, Human
agcacuuaaguuaauugaacug

SEQ ID NO: 724565 - RNA, 22 nt, Human
augagguacuaguauauacgua

SEQ ID NO: 724566 - RNA, 22 nt, Human
ggagccugugcccaagcccaga

SEQ ID NO: 724567 - RNA, 22 nt, Human
cguuuacuguguaccaggcacu

SEQ ID NO: 724568 - RNA, 22 nt, Human
ugcucagacuuaagaagaucag

SEQ ID NO: 724569 - RNA, 21 nt, Human
uagcaggauuugguuuauuuu

SEQ ID NO: 724570 - RNA, 22 nt, Human
gccucugcugacaagauggaca

SEQ ID NO: 724571 - RNA, 19 nt, Human
ucucuggcuugucugccug

SEQ ID NO: 724572 - RNA, 22 nt, Human
gaacauuacugcuugggagagg

SEQ ID NO: 724573 - RNA, 22 nt, Human
acagguccuuauaagagcacuc

SEQ ID NO: 724574 - RNA, 22 nt, Human
acaggaagugggaagaaacagg

SEQ ID NO: 724575 - RNA, 22 nt, Human
gcugcuggggucacaugguaag

SEQ ID NO: 724576 - RNA, 23 nt, Human
cacaggcagaaaucaagacggua

SEQ ID NO: 724577 - RNA, 22 nt, Human
ucaucuuccucauuucuccagg

SEQ ID NO: 724578 - RNA, 22 nt, Human
cagagcagcagagcuuccaugg

SEQ ID NO: 724579 - RNA, 22 nt, Human
uguuggcacuaucucauguuuu

SEQ ID NO: 724580 - RNA, 22 nt, Human
uuugcaaagaaauuauugcugu

SEQ ID NO: 724581 - RNA, 22 nt, Human
agggccugguucuguguaggga

SEQ ID NO: 724582 - RNA, 22 nt, Human
ucccaguuuuucuccacuaagg

SEQ ID NO: 724583 - RNA, 22 nt, Human
uguacacaauucuuaacauaca

SEQ ID NO: 724584 - RNA, 22 nt, Human
agccaugcaccuuacucuugcu

SEQ ID NO: 724585 - RNA, 22 nt, Human
uggccuggugcucaggcaguag

SEQ ID NO: 724586 - RNA, 20 nt, Human
ucaggugacacacguggcac

SEQ ID NO: 724587 - RNA, 22 nt, Human
aagauguugucguuagugauga

SEQ ID NO: 724588 - RNA, 22 nt, Human
auauagucaaacauauaugugu

SEQ ID NO: 724589 - RNA, 22 nt, Human
ccucauggccuugagcugaggg

SEQ ID NO: 724590 - RNA, 22 nt, Human
gaagugucuccguuuuuaaagg

SEQ ID NO: 724591 - RNA, 22 nt, Human
gucuggguggcugcuuucagcu

SEQ ID NO: 724592 - RNA, 22 nt, Human
uauguuauuuucauacaacaga

SEQ ID NO: 724593 - RNA, 22 nt, Human
ccugcuuccuucaaguuuaucu

SEQ ID NO: 724594 - RNA, 22 nt, Human
acuucucugguugagguccaau

SEQ ID NO: 724595 - RNA, 22 nt, Human
gcuccuggcucucugagggcug

SEQ ID NO: 724596 - RNA, 23 nt, Human
aggcaggcaguucagcuguuguu

SEQ ID NO: 724597 - RNA, 22 nt, Human
uauuucaacguaugaaaagcug

SEQ ID NO: 724598 - RNA, 22 nt, Human
gauuucuugagcaaguugcuua

SEQ ID NO: 724599 - RNA, 22 nt, Human
gucacaaauccccucagcaacu

SEQ ID NO: 724600 - RNA, 22 nt, Human
uguguacaaacuaacaacauau

SEQ ID NO: 724601 - RNA, 22 nt, Human
ggcgguggcgugaagguggcug

SEQ ID NO: 724602 - RNA, 22 nt, Human
agcaauaaccacucuaauuuau

SEQ ID NO: 724603 - RNA, 22 nt, Human
uguccagguuagcuucaaacac

SEQ ID NO: 724604 - RNA, 22 nt, Human
guugcagauguggaacucgugc

SEQ ID NO: 724605 - RNA, 23 nt, Human
ugucuggagccugagcaggugcu

SEQ ID NO: 724606 - RNA, 22 nt, Human
agcgugaauuaguugguacaca

SEQ ID NO: 724607 - RNA, 22 nt, Human
uauuuaugucucugcagagaau

SEQ ID NO: 724608 - RNA, 17 nt, Human
ugacuuuauuugcuugg

SEQ ID NO: 724609 - RNA, 20 nt, Human
ugcuggaggcgccggcgcuc

SEQ ID NO: 724610 - RNA, 22 nt, Human
ucaaauaaugccauucaucauc

SEQ ID NO: 724611 - RNA, 19 nt, Human
ucacuugaaguucagaaau

SEQ ID NO: 724612 - RNA, 22 nt, Human
guauuaggagguggagccuuug

SEQ ID NO: 724613 - RNA, 22 nt, Human
acaugaauauaugaaguucaac

SEQ ID NO: 724614 - RNA, 18 nt, Human
cccacggugcuguagggc

SEQ ID NO: 724615 - RNA, 22 nt, Human
ugggcuccucgucacucgcugu

SEQ ID NO: 724616 - RNA, 22 nt, Human
auauuuacugcuguggugaagg

SEQ ID NO: 724617 - RNA, 22 nt, Human
ucccugggguaacauuagaggg

SEQ ID NO: 724618 - RNA, 20 nt, Human
gcugacuguuuggguggcgg

SEQ ID NO: 724619 - RNA, 22 nt, Human
ugauuagacaaaggaaucaugc

SEQ ID NO: 724620 - RNA, 19 nt, Human
ccacauggcuggaugacag

SEQ ID NO: 724621 - RNA, 17 nt, Human
aucugcauuucuaauga

SEQ ID NO: 724622 - RNA, 22 nt, Human
ccagccccgggccuuaccgugc

SEQ ID NO: 724623 - RNA, 22 nt, Human
aguguccuuaguuagcuuuggg

SEQ ID NO: 724624 - RNA, 22 nt, Human
ugacagugucaguuuccuaaua

SEQ ID NO: 724625 - RNA, 22 nt, Human
augaguucauugcauuugacag

SEQ ID NO: 724626 - RNA, 22 nt, Human
ccugugucuuccccacuggugu

SEQ ID NO: 724627 - RNA, 22 nt, Human
agggccaggcucccaugucagg

SEQ ID NO: 724628 - RNA, 18 nt, Human
acaaaggaucaugaggga

SEQ ID NO: 724629 - RNA, 22 nt, Human
acacugaauaauugagaguuga

SEQ ID NO: 724630 - RNA, 22 nt, Human
uccagcagguccgagacaaguu

SEQ ID NO: 724631 - RNA, 22 nt, Human
uucacaauaauguccauccucu

SEQ ID NO: 724632 - RNA, 22 nt, Human
uccagaaaauuuuacagugccu

SEQ ID NO: 724633 - RNA, 22 nt, Human
ugguccugcuacaggggauuag

SEQ ID NO: 724634 - RNA, 22 nt, Human
aaauuauucucauguguuucuu

SEQ ID NO: 724635 - RNA, 19 nt, Human
accaggccucagaggcccu

SEQ ID NO: 724636 - RNA, 18 nt, Human
cuagaugagcuuggcaag

SEQ ID NO: 724637 - RNA, 22 nt, Human
ugugaggaugugagcgugaacc

SEQ ID NO: 724638 - RNA, 22 nt, Human
ugagauguaagguaugcuuacu

SEQ ID NO: 724639 - RNA, 22 nt, Human
uuugcacacacaauaacaaaug

SEQ ID NO: 724640 - RNA, 22 nt, Human
uuguuuccauaauuaaguguga

SEQ ID NO: 724641 - RNA, 22 nt, Human
caggcugggaacgccacccgcu

SEQ ID NO: 724642 - RNA, 23 nt, Human
aucagucuugguagcugugccca

SEQ ID NO: 724643 - RNA, 22 nt, Human
uaacacuuuggauuaaaauucu

SEQ ID NO: 724644 - RNA, 22 nt, Human
uuugcugugaauccauuacugu

SEQ ID NO: 724645 - RNA, 22 nt, Human
gcaaaaacugcaauuacuuuug

SEQ ID NO: 724646 - RNA, 22 nt, Human
gaucugaagagcaaugaaauau

SEQ ID NO: 724647 - RNA, 20 nt, Human
cuuuggcaaugagaacaggg

SEQ ID NO: 724648 - RNA, 19 nt, Human
cacacccaugcuugccaag

SEQ ID NO: 724649 - RNA, 22 nt, Human
uaagagcucccuucuccuugca

SEQ ID NO: 724650 - RNA, 22 nt, Human
gaaguauaggagacaaacaaga

SEQ ID NO: 724651 - RNA, 22 nt, Human
ccucugacuccacacuugaacu

SEQ ID NO: 724652 - RNA, 22 nt, Human
ggcacugagcgggcucugagcg

SEQ ID NO: 724653 - RNA, 22 nt, Human
gucugcuuuuguuuuacuggua

SEQ ID NO: 724654 - RNA, 22 nt, Human
cuucucuggcauagcaagcagg

SEQ ID NO: 724655 - RNA, 18 nt, Human
gucauugcaacauacugu

SEQ ID NO: 724656 - RNA, 22 nt, Human
uggcuggagccccucaagagca

SEQ ID NO: 724657 - RNA, 22 nt, Human
ucugaggcugcaucuaugugac

SEQ ID NO: 724658 - RNA, 22 nt, Human
auuugcuugacuauggcuugca

SEQ ID NO: 724659 - RNA, 22 nt, Human
gcuggccucgcaggcaggaugu

SEQ ID NO: 724660 - RNA, 22 nt, Human
ucagugugaggucuuccacccg

SEQ ID NO: 724661 - RNA, 22 nt, Human
gccucugcugcaagccugguug

SEQ ID NO: 724662 - RNA, 19 nt, Human
acagcagggauuuuuggag

SEQ ID NO: 724663 - RNA, 22 nt, Human
uacauucacaguuguucaucuc

SEQ ID NO: 724664 - RNA, 22 nt, Human
aguggccaauaugucaugcucu

SEQ ID NO: 724665 - RNA, 22 nt, Human
ucaaugcaugugacaaagagua

SEQ ID NO: 724666 - RNA, 22 nt, Human
ucugagcugcagaguggggugg

SEQ ID NO: 724667 - RNA, 22 nt, Human
uuuucaggugcaguaaucauau

SEQ ID NO: 724668 - RNA, 22 nt, Human
aggcuaggguaacagauguggc

SEQ ID NO: 724669 - RNA, 22 nt, Human
aggcccugcaggaagcaggaug

SEQ ID NO: 724670 - RNA, 22 nt, Human
aaguguuuaaauuauuugcagg

SEQ ID NO: 724671 - RNA, 22 nt, Human
augcaacaggucagccaggaag

SEQ ID NO: 724672 - RNA, 22 nt, Human
caggcagccugagggaucuggg

SEQ ID NO: 724673 - RNA, 21 nt, Human
ggcugcagggagcccuggggu

SEQ ID NO: 724674 - RNA, 21 nt, Human
uccucagggccccagagcacu

SEQ ID NO: 724675 - RNA, 22 nt, Human
uugccccuggucagaggaggcu

SEQ ID NO: 724676 - RNA, 22 nt, Human
ggaggccuaagguacaguuugc

SEQ ID NO: 724677 - RNA, 22 nt, Human
agagaaacugauguccuuugaa

SEQ ID NO: 724678 - RNA, 22 nt, Human
cuguuucucccaacgcccuagu

SEQ ID NO: 724679 - RNA, 22 nt, Human
aagccaaguuggaagacugaau

SEQ ID NO: 724680 - RNA, 22 nt, Human
cugugggcucccagcuucucuc

SEQ ID NO: 724681 - RNA, 21 nt, Human
ccucaaagaugaugggguuuc

SEQ ID NO: 724682 - RNA, 22 nt, Human
ucacagggcauuauggcuccag

SEQ ID NO: 724683 - RNA, 22 nt, Human
cugagccaguagucagggacaa

SEQ ID NO: 724684 - RNA, 22 nt, Human
guauuccuaagucaugacaaau

SEQ ID NO: 724685 - RNA, 22 nt, Human
agccauuuuccugaaauauaac

SEQ ID NO: 724686 - RNA, 22 nt, Human
gcuggcuuugucaagggcagca

SEQ ID NO: 724687 - RNA, 22 nt, Human
uguacaagaauaauuuuauaua

SEQ ID NO: 724688 - RNA, 22 nt, Human
ggagccagaggcugcugcugug

SEQ ID NO: 724689 - RNA, 22 nt, Human
gcugcucuacccaugcaucugu

SEQ ID NO: 724690 - RNA, 22 nt, Human
gcucaggaucagccaccucuuu

SEQ ID NO: 724691 - RNA, 22 nt, Human
aggcuguugcaugccacagaua

SEQ ID NO: 724692 - RNA, 22 nt, Human
gcagcagaugugggcccagagc

SEQ ID NO: 724693 - RNA, 22 nt, Human
gucaagcagaagauaauuuaaa

SEQ ID NO: 724694 - RNA, 22 nt, Human
acaagacugugcucuaagagug

SEQ ID NO: 724695 - RNA, 22 nt, Human
agcaggaaggggccuagccugg

SEQ ID NO: 724696 - RNA, 22 nt, Human
acucucucacacacgccuauau

SEQ ID NO: 724697 - RNA, 22 nt, Human
agcaguggugugaggagggcuc

SEQ ID NO: 724698 - RNA, 22 nt, Human
uccccaccuacacacugcuccu

SEQ ID NO: 724699 - RNA, 19 nt, Human
gggcuuuacuccaaguggg

SEQ ID NO: 724700 - RNA, 22 nt, Human
auguuucuacagcguccacuga

SEQ ID NO: 724701 - RNA, 22 nt, Human
aguucucaggucagcugagucu

SEQ ID NO: 724702 - RNA, 20 nt, Human
acacaugcauucaugugggc

SEQ ID NO: 724703 - RNA, 22 nt, Human
aaaaaaucagaucuuugguuaa

SEQ ID NO: 724704 - RNA, 22 nt, Human
aguggaccagaagacugaagcu

SEQ ID NO: 724705 - RNA, 22 nt, Human
uugaaacuuuucuuggagaaac

SEQ ID NO: 724706 - RNA, 22 nt, Human
aaacuucuggcuacaagcaaua

SEQ ID NO: 724707 - RNA, 19 nt, Human
agagaugcuaagagucuuu

SEQ ID NO: 724708 - RNA, 22 nt, Human
gcacuuggaggugcccacacag

SEQ ID NO: 724709 - RNA, 22 nt, Human
uuucucuaaauagggaggcuua

SEQ ID NO: 724710 - RNA, 22 nt, Human
uguguucaugucacuggaaucc

SEQ ID NO: 724711 - RNA, 22 nt, Human
auugaaacaaguugcuuucuau

SEQ ID NO: 724712 - RNA, 22 nt, Human
ugggccagcucccugccccugg

SEQ ID NO: 724713 - RNA, 22 nt, Human
ucaucucuccccagugucuuua

SEQ ID NO: 724714 - RNA, 18 nt, Human
ugagcaggggcugaccuu

SEQ ID NO: 724715 - RNA, 22 nt, Human
ucaguuucuucaucucccuaac

SEQ ID NO: 724716 - RNA, 21 nt, Human
guuugcaugaacaagucagcc

SEQ ID NO: 724717 - RNA, 22 nt, Human
gaacccaggagguugcagugag

SEQ ID NO: 724718 - RNA, 22 nt, Human
aguggcuggacgacaaggguga

SEQ ID NO: 724719 - RNA, 22 nt, Human
uucugcuguugugacguuaguu

SEQ ID NO: 724720 - RNA, 22 nt, Human
ugggcugcuucuauuggugguc

SEQ ID NO: 724721 - RNA, 22 nt, Human
uaagcauggugguaaaagaggu

SEQ ID NO: 724722 - RNA, 22 nt, Human
gguggcagagacauaggacaua

SEQ ID NO: 724723 - RNA, 16 nt, Human
ggggaaggcaagaggg

SEQ ID NO: 724724 - RNA, 22 nt, Human
ccaggacuuauuacaguauaac

SEQ ID NO: 724725 - RNA, 22 nt, Human
ggcuucuuccugugaacauguu

SEQ ID NO: 724726 - RNA, 22 nt, Human
ccaggaggaaagaccagcccau

SEQ ID NO: 724727 - RNA, 22 nt, Human
ccucaggggugcccacagcugc

SEQ ID NO: 724728 - RNA, 22 nt, Human
uccuggccuuauccccaaacug

SEQ ID NO: 724729 - RNA, 22 nt, Human
gcccacuuucugccagcucacc

SEQ ID NO: 724730 - RNA, 22 nt, Human
gcugugugacccuagccaguag

SEQ ID NO: 724731 - RNA, 22 nt, Human
uuccacucuaugauagaagggu

SEQ ID NO: 724732 - RNA, 22 nt, Human
aagugagauuauauguacggga

SEQ ID NO: 724733 - RNA, 22 nt, Human
uuuaauauuucuuuccugaagc

SEQ ID NO: 724734 - RNA, 22 nt, Human
augggcaggccucucauuucug

SEQ ID NO: 724735 - RNA, 22 nt, Human
caggaaugaucugcugagugau

SEQ ID NO: 724736 - RNA, 22 nt, Human
caggaagcugugaaggagacgg

SEQ ID NO: 724737 - RNA, 22 nt, Human
uuccucagccagcacuuagggg

SEQ ID NO: 724738 - RNA, 22 nt, Human
ggagucugauacugaguuccuc

SEQ ID NO: 724739 - RNA, 22 nt, Human
gaagaaacaggggcuuggggag

SEQ ID NO: 724740 - RNA, 22 nt, Human
uuagcuaaacuguaacuagaau

SEQ ID NO: 724741 - RNA, 22 nt, Human
agucucagaguaccugagggac

SEQ ID NO: 724742 - RNA, 23 nt, Human
auuguuuuuggcucucagggaau

SEQ ID NO: 724743 - RNA, 22 nt, Human
acacaaugucaucauaauguca

SEQ ID NO: 724744 - RNA, 22 nt, Human
ucuggcuugagcuucgaccagu

SEQ ID NO: 724745 - RNA, 22 nt, Human
agacagguagcaggacagauau

SEQ ID NO: 724746 - RNA, 22 nt, Human
uacagucaacauugaugaugau

SEQ ID NO: 724747 - RNA, 22 nt, Human
ugugcaaauuaaguagauuuuc

SEQ ID NO: 724748 - RNA, 22 nt, Human
gaggagcaugggaaggcucugg

SEQ ID NO: 724749 - RNA, 22 nt, Human
aaagagcuuuagaaaucucaga

SEQ ID NO: 724750 - RNA, 22 nt, Human
ccaccagcagugugcaaggauu

SEQ ID NO: 724751 - RNA, 22 nt, Human
ggcaaaaaguucccaucagugu

SEQ ID NO: 724752 - RNA, 22 nt, Human
ggcccagccucagacaugcccu

SEQ ID NO: 724753 - RNA, 22 nt, Human
ccuccuggugacaaggcaaagc

SEQ ID NO: 724754 - RNA, 22 nt, Human
cucuguguauccaaguucaggu

SEQ ID NO: 724755 - RNA, 22 nt, Human
gcuuuacacagcugguucuugu

SEQ ID NO: 724756 - RNA, 22 nt, Human
uauguacuacacuagaacauuu

SEQ ID NO: 724757 - RNA, 22 nt, Human
caaaccugcugcuauuuuaucc

SEQ ID NO: 724758 - RNA, 22 nt, Human
agcagguuguuuuguggccagg

SEQ ID NO: 724759 - RNA, 22 nt, Human
acugcaucugaaacauggguca

SEQ ID NO: 724760 - RNA, 22 nt, Human
gcaaauggagugaagagcugga

SEQ ID NO: 724761 - RNA, 22 nt, Human
gugaacugcugaguuuuaucau

SEQ ID NO: 724762 - RNA, 22 nt, Human
gcuauuuuugagccauuuauaa

SEQ ID NO: 724763 - RNA, 22 nt, Human
uauagcacacaguuuauaaaag

SEQ ID NO: 724764 - RNA, 22 nt, Human
gcugcuggagagcgagacuguu

SEQ ID NO: 724765 - RNA, 22 nt, Human
guacaagaggagaaaauggagu

SEQ ID NO: 724766 - RNA, 17 nt, Human
auacaguuuauuuuaca

SEQ ID NO: 724767 - RNA, 22 nt, Human
uuacagacaaacuguguuaagu

SEQ ID NO: 724768 - RNA, 22 nt, Human
ccagagaggggaagggcuugcc

SEQ ID NO: 724769 - RNA, 22 nt, Human
cuuuggcagccucagcugcagg

SEQ ID NO: 724770 - RNA, 22 nt, Human
ucuuucuuuaucaccugauaug

SEQ ID NO: 724771 - RNA, 23 nt, Human
uggauaaaauacuuacauucaac

SEQ ID NO: 724772 - RNA, 22 nt, Human
cagggcagagccaggauuucaa

SEQ ID NO: 724773 - RNA, 22 nt, Human
ccagcuuuccugcgaguugauu

SEQ ID NO: 724774 - RNA, 19 nt, Human
acauguuuugcagaacagc

SEQ ID NO: 724775 - RNA, 22 nt, Human
aggugccaauuuucagugaaca

SEQ ID NO: 724776 - RNA, 22 nt, Human
ugcacuauuucgccaugguugu

SEQ ID NO: 724777 - RNA, 22 nt, Human
cucagaauuacaucccauuuua

SEQ ID NO: 724778 - RNA, 22 nt, Human
cagcagcucaggcugcuuccca

SEQ ID NO: 724779 - RNA, 22 nt, Human
agugcuccuuucauugcugccc

SEQ ID NO: 724780 - RNA, 22 nt, Human
aucuaacagcaacaccagaaua

SEQ ID NO: 724781 - RNA, 22 nt, Human
ucaggacagguucgggugggua

SEQ ID NO: 724782 - RNA, 22 nt, Human
ugugagagcagaagacacauag

SEQ ID NO: 724783 - RNA, 22 nt, Human
uccagaccaaggaaggcugggc

SEQ ID NO: 724784 - RNA, 22 nt, Human
ccugucugaggaggugcucuuu

SEQ ID NO: 724785 - RNA, 20 nt, Human
ucccuggggcccuacuuccu

SEQ ID NO: 724786 - RNA, 19 nt, Human
aggagaaguagcagaaauu

SEQ ID NO: 724787 - RNA, 22 nt, Human
uccucugccccagaugaaauuu

SEQ ID NO: 724788 - RNA, 22 nt, Human
cuugccagcacuuggccagcug

SEQ ID NO: 724789 - RNA, 22 nt, Human
aucuggaagccagauacucagu

SEQ ID NO: 724790 - RNA, 22 nt, Human
cacugaaggacaguaggaaggg

SEQ ID NO: 724791 - RNA, 22 nt, Human
agcuguuccaggccucauugcu

SEQ ID NO: 724792 - RNA, 22 nt, Human
cuggcaggucucgcugacgugu

SEQ ID NO: 724793 - RNA, 22 nt, Human
accaucuuaguggccagcucuc

SEQ ID NO: 724794 - RNA, 22 nt, Human
caagucacuuaugugcagauau

SEQ ID NO: 724795 - RNA, 22 nt, Human
ugcauacauaaagugcuaucau

SEQ ID NO: 724796 - RNA, 22 nt, Human
cugcccugcccaggccuugggc

SEQ ID NO: 724797 - RNA, 22 nt, Human
uggcaguguuucuaaggggcuc

SEQ ID NO: 724798 - RNA, 22 nt, Human
gcugccaggggcagcugucuca

SEQ ID NO: 724799 - RNA, 22 nt, Human
uacugcauguguuugaugaugg

SEQ ID NO: 724800 - RNA, 22 nt, Human
gaaguuauuuuaccuguuaaag

SEQ ID NO: 724801 - RNA, 22 nt, Human
agcuguguuauuagaaaccugc

SEQ ID NO: 724802 - RNA, 20 nt, Human
uacugcaggaaucagcuagc

SEQ ID NO: 724803 - RNA, 22 nt, Human
agaaauguaauugcaacugucu

SEQ ID NO: 724804 - RNA, 22 nt, Human
augcauauguacccauguucug

SEQ ID NO: 724805 - RNA, 22 nt, Human
uuauccaagcagaagcugcaca

SEQ ID NO: 724806 - RNA, 22 nt, Human
uaacagaauuugcuaaacuccg

SEQ ID NO: 724807 - RNA, 22 nt, Human
cuuuagaauuugauauaaucaa

SEQ ID NO: 724808 - RNA, 22 nt, Human
aaggccagauucacuuuacaau

SEQ ID NO: 724809 - RNA, 22 nt, Human
aucuugaaugaaugacucuuua

SEQ ID NO: 724810 - RNA, 22 nt, Human
ugcugggcuggagcugccaggg

SEQ ID NO: 724811 - RNA, 22 nt, Human
aucuuugcuauuguaaaucacg

SEQ ID NO: 724812 - RNA, 22 nt, Human
gggccccuuguaucucuggcuc

SEQ ID NO: 724813 - RNA, 22 nt, Human
gcugagaaucaagauggagagg

SEQ ID NO: 724814 - RNA, 22 nt, Human
ucuaugucagcaucuuucuacc

SEQ ID NO: 724815 - RNA, 22 nt, Human
ugaauuuaucaaagauucuuaa

SEQ ID NO: 724816 - RNA, 22 nt, Human
caggcugcggccgugugagcau

SEQ ID NO: 724817 - RNA, 22 nt, Human
cacccccaggagcuccagggac

SEQ ID NO: 724818 - RNA, 22 nt, Human
cuggccuaaaauugcuucugca

SEQ ID NO: 724819 - RNA, 22 nt, Human
aaaucucaaaggcuuagcaucu

SEQ ID NO: 724820 - RNA, 22 nt, Human
cagcuuugccaaguaaggucuu

SEQ ID NO: 724821 - RNA, 22 nt, Human
gggcuucugcucuuuuggugcu

SEQ ID NO: 724822 - RNA, 22 nt, Human
uguggggaagaguaugacuugg

SEQ ID NO: 724823 - RNA, 22 nt, Human
cauaauccuguccuggauucuu

SEQ ID NO: 724824 - RNA, 18 nt, Human
ucucuugcaucuucugua

SEQ ID NO: 724825 - RNA, 22 nt, Human
cccaggcagccugcagggaagg

SEQ ID NO: 724826 - RNA, 22 nt, Human
ugcauuuuuaacaaggcuaauu

SEQ ID NO: 724827 - RNA, 22 nt, Human
ucucaucuucauaucugaaaga

SEQ ID NO: 724828 - RNA, 22 nt, Human
ugagcugggaguggugaugagg

SEQ ID NO: 724829 - RNA, 22 nt, Human
agggcagagagaugaaugggau

SEQ ID NO: 724830 - RNA, 22 nt, Human
gaggcucccaaggggcuaggcc

SEQ ID NO: 724831 - RNA, 22 nt, Human
gcaguguguuuggauaacacac

SEQ ID NO: 724832 - RNA, 22 nt, Human
cugugcagugugggguaggccu

SEQ ID NO: 724833 - RNA, 22 nt, Human
uguuaggguccugugcaggggc

SEQ ID NO: 724834 - RNA, 22 nt, Human
aagaguuuccaguuguggcuca

SEQ ID NO: 724835 - RNA, 22 nt, Human
auucuuuuaaauggcaguagua

SEQ ID NO: 724836 - RNA, 22 nt, Human
agauauaguuguugagaagaac

SEQ ID NO: 724837 - RNA, 22 nt, Human
agggggcucagugacugaagug

SEQ ID NO: 724838 - RNA, 22 nt, Human
uggcaaaggaaccuauuuuaaa

SEQ ID NO: 724839 - RNA, 22 nt, Human
ugccuagggccuaaccagagcc

SEQ ID NO: 724840 - RNA, 22 nt, Human
uauucauuaugaccaaaucuag

SEQ ID NO: 724841 - RNA, 22 nt, Human
cagcuaauccucucuauccaag

SEQ ID NO: 724842 - RNA, 22 nt, Human
accuggacaccugcugucaucu

SEQ ID NO: 724843 - RNA, 22 nt, Human
ggaggcugcugccucacguggg

SEQ ID NO: 724844 - RNA, 22 nt, Human
ggccaggcacugugugagauau

SEQ ID NO: 724845 - RNA, 22 nt, Human
uuuccuaacacaaugcaugaga

SEQ ID NO: 724846 - RNA, 23 nt, Human
cuggcuccgaagacuccaggauc

SEQ ID NO: 724847 - RNA, 22 nt, Human
aucauucuagcuguuguguuga

SEQ ID NO: 724848 - RNA, 22 nt, Human
gguguuggaacauggugagauu

SEQ ID NO: 724849 - RNA, 20 nt, Human
gaguauauuucuuccuuugc

SEQ ID NO: 724850 - RNA, 22 nt, Human
cuggaggacagaggccaugucu

SEQ ID NO: 724851 - RNA, 22 nt, Human
ccucuggcuuacuguuggguuu

SEQ ID NO: 724852 - RNA, 22 nt, Human
uuaggaagaaggaggcaguauu

SEQ ID NO: 724853 - RNA, 22 nt, Human
acugaucaaggguuuaauuuua

SEQ ID NO: 724854 - RNA, 19 nt, Human
uggcccagaugguccuggg

SEQ ID NO: 724855 - RNA, 22 nt, Human
gaauuuaaggaccaagcauuuu

SEQ ID NO: 724856 - RNA, 22 nt, Human
gcccagcugcacccuggugggu

SEQ ID NO: 724857 - RNA, 22 nt, Human
ugaaucaauaguugcaaguauu

SEQ ID NO: 724858 - RNA, 22 nt, Human
caggugggagccacagcguaca

SEQ ID NO: 724859 - RNA, 22 nt, Human
ggcaguguucugguugucagga

SEQ ID NO: 724860 - RNA, 22 nt, Human
aacuauacauauuuacauagac

SEQ ID NO: 724861 - RNA, 22 nt, Human
caucucaguguacagggagucu

SEQ ID NO: 724862 - RNA, 22 nt, Human
uuagggagcucaguccucagau

SEQ ID NO: 724863 - RNA, 22 nt, Human
ggccuugauccuccagagcacu

SEQ ID NO: 724864 - RNA, 21 nt, Human
aaauuucugcaagccucaacu

SEQ ID NO: 724865 - RNA, 22 nt, Human
ugaggauggcagugugcucagc

SEQ ID NO: 724866 - RNA, 22 nt, Human
uguucaaaucuuuugcuuauuu

SEQ ID NO: 724867 - RNA, 22 nt, Human
auggggcugggauucuccucgg

SEQ ID NO: 724868 - RNA, 22 nt, Human
caggaaugcauucuagaauggc

SEQ ID NO: 724869 - RNA, 19 nt, Human
ugcucaggccaaggagccc

SEQ ID NO: 724870 - RNA, 22 nt, Human
agcuggcaaguugaagguggcu

SEQ ID NO: 724871 - RNA, 22 nt, Human
uccagggaagagcagaggcuac

SEQ ID NO: 724872 - RNA, 22 nt, Human
ugucugguggguugacaggcag

SEQ ID NO: 724873 - RNA, 22 nt, Human
gccagccccuuagggcucuccc

SEQ ID NO: 724874 - RNA, 22 nt, Human
cugggcagccucacacaauguu

SEQ ID NO: 724875 - RNA, 21 nt, Human
ggagaaggacaauguugagua

SEQ ID NO: 724876 - RNA, 22 nt, Human
cagggugggcacccagccucca

SEQ ID NO: 724877 - RNA, 22 nt, Human
agagcuguguccugugcacuag

SEQ ID NO: 724878 - RNA, 22 nt, Human
guaaaacugcagaacuuggagg

SEQ ID NO: 724879 - RNA, 21 nt, Human
uucucuggcuucuguagcugg

SEQ ID NO: 724880 - RNA, 22 nt, Human
acccugagucacugucugucug

SEQ ID NO: 724881 - RNA, 22 nt, Human
gcgugugugauaugccucugca

SEQ ID NO: 724882 - RNA, 22 nt, Human
augacaccauauuagccuagag

SEQ ID NO: 724883 - RNA, 22 nt, Human
accagcucuucugcucuaguug

SEQ ID NO: 724884 - RNA, 22 nt, Human
uuugaacuguucuaggauuuaa

SEQ ID NO: 724885 - RNA, 22 nt, Human
uucacauuacaaggccauauuu

SEQ ID NO: 724886 - RNA, 22 nt, Human
ugcuguauauauuuugaaguga

SEQ ID NO: 724887 - RNA, 22 nt, Human
gucaggaugacaagugcuuuca

SEQ ID NO: 724888 - RNA, 22 nt, Human
aaucuggcauguaagcuuagag

SEQ ID NO: 724889 - RNA, 22 nt, Human
ugucuccuacugccuguggauc

SEQ ID NO: 724890 - RNA, 22 nt, Human
cccacugaggguuaaugccugc

SEQ ID NO: 724891 - RNA, 22 nt, Human
uucagugacuuaccuggagcca

SEQ ID NO: 724892 - RNA, 20 nt, Human
guugcuuuagucugguuugg

SEQ ID NO: 724893 - RNA, 22 nt, Human
ucaucagcucaucugcuccuag

SEQ ID NO: 724894 - RNA, 22 nt, Human
aaaauccugcugacucgagaug

SEQ ID NO: 724895 - RNA, 22 nt, Human
gccacacuuauucucaugcaca

SEQ ID NO: 724896 - RNA, 22 nt, Human
ccagaagcuucuacacaggaga

SEQ ID NO: 724897 - RNA, 22 nt, Human
gacccggcuccaggcccagcag

SEQ ID NO: 724898 - RNA, 21 nt, Human
gaggggcagcucuuagcauua

SEQ ID NO: 724899 - RNA, 22 nt, Human
ucaaugcacacaggacuuggug

SEQ ID NO: 724900 - RNA, 19 nt, Human
uucaggauugacccuacug

SEQ ID NO: 724901 - RNA, 22 nt, Human
gcucagugugcacgaguacucu

SEQ ID NO: 724902 - RNA, 18 nt, Human
auccucuagcuucucaga

SEQ ID NO: 724903 - RNA, 22 nt, Human
uagauaauuuggcaucauauug

SEQ ID NO: 724904 - RNA, 22 nt, Human
gggagggaggugcugguucacg

SEQ ID NO: 724905 - RNA, 22 nt, Human
uuccagaaaaaaauguauaucu

SEQ ID NO: 724906 - RNA, 22 nt, Human
gaggaugguaugaggcaagcaa

SEQ ID NO: 724907 - RNA, 22 nt, Human
aaaaggaggacaugguuacaga

SEQ ID NO: 724908 - RNA, 22 nt, Human
uuagaaaaaacgucuucuagug

SEQ ID NO: 724909 - RNA, 22 nt, Human
gcagggggauggaguugaaaug

SEQ ID NO: 724910 - RNA, 22 nt, Human
acaguguucacuuaacaaugga

SEQ ID NO: 724911 - RNA, 22 nt, Human
aagaaauuaaugugccauuacu

SEQ ID NO: 724912 - RNA, 22 nt, Human
gcugaggugaggcuggaaagga

SEQ ID NO: 724913 - RNA, 22 nt, Human
gaggagcugaggcugaggccuc

SEQ ID NO: 724914 - RNA, 22 nt, Human
uggcagcugcaggccuccugag

SEQ ID NO: 724915 - RNA, 22 nt, Human
uagaauuaugccuugcugucca

SEQ ID NO: 724916 - RNA, 21 nt, Human
ccuuuagauuucuaugcaguu

SEQ ID NO: 724917 - RNA, 22 nt, Human
auuauacauuuuguguagagau

SEQ ID NO: 724918 - RNA, 18 nt, Human
ugcauauacugccuaucu

SEQ ID NO: 724919 - RNA, 22 nt, Human
gccuucaguaacugagacggaa

SEQ ID NO: 724920 - RNA, 19 nt, Human
gcaccccaucuuccuccug

SEQ ID NO: 724921 - RNA, 22 nt, Human
ugcauacacaugugcacauacg

SEQ ID NO: 724922 - RNA, 22 nt, Human
gugacugugaucuuauuugcaa

SEQ ID NO: 724923 - RNA, 22 nt, Human
gccugggugucgaucacuagug

SEQ ID NO: 724924 - RNA, 22 nt, Human
cuaggcuggagugcaguggcau

SEQ ID NO: 724925 - RNA, 22 nt, Human
uauggcuuucaaaggaacucgg

SEQ ID NO: 724926 - RNA, 22 nt, Human
ccccucugcaaauagccaggcu

SEQ ID NO: 724927 - RNA, 20 nt, Human
uucugagauuagguuacaaa

SEQ ID NO: 724928 - RNA, 22 nt, Human
acaaaauagaguucuccccugg

SEQ ID NO: 724929 - RNA, 22 nt, Human
cucaggacuuucaaauagaaau

SEQ ID NO: 724930 - RNA, 22 nt, Human
aauggcagagacuguugaaaua

SEQ ID NO: 724931 - RNA, 22 nt, Human
gcugccuggauuugcaauccuc

SEQ ID NO: 724932 - RNA, 22 nt, Human
uuucuggaacaguaauugaaga

SEQ ID NO: 724933 - RNA, 22 nt, Human
gucugggcagcagcauuucuua

SEQ ID NO: 724934 - RNA, 22 nt, Human
gaaggcacccggcgugcggcgg

SEQ ID NO: 724935 - RNA, 22 nt, Human
ugcagcugggucugcccuggcu

SEQ ID NO: 724936 - RNA, 22 nt, Human
cucugcuuggaacagggguuug

SEQ ID NO: 724937 - RNA, 22 nt, Human
gaaaggagaggguuaaggagcu

SEQ ID NO: 724938 - RNA, 22 nt, Human
guccuugcuugagacaggcagu

SEQ ID NO: 724939 - RNA, 22 nt, Human
gguggcugaagcagucuucggg

SEQ ID NO: 724940 - RNA, 22 nt, Human
augcuuuaguucaaaggacuua

SEQ ID NO: 724941 - RNA, 22 nt, Human
ucuguccuccggagcucccagu

SEQ ID NO: 724942 - RNA, 22 nt, Human
uugcuuuaacuaguaaaugggg

SEQ ID NO: 724943 - RNA, 22 nt, Human
cuucugugguaaacuuuguugu

SEQ ID NO: 724944 - RNA, 22 nt, Human
agacagcuguuccuucauguuu

SEQ ID NO: 724945 - RNA, 22 nt, Human
gagucagaugaagauaaaaggg

SEQ ID NO: 724946 - RNA, 22 nt, Human
cagcucuggggcagagugacua

SEQ ID NO: 724947 - RNA, 22 nt, Human
uccuguuuaucugugugacucg

SEQ ID NO: 724948 - RNA, 22 nt, Human
ucuucagcuguagucauuguuc

SEQ ID NO: 724949 - RNA, 22 nt, Human
gaauaacauuggaacccugaag

SEQ ID NO: 724950 - RNA, 22 nt, Human
uuuccuuucuagaagccuaaau

SEQ ID NO: 724951 - RNA, 22 nt, Human
auaauaacaccugaauaggaaa

SEQ ID NO: 724952 - RNA, 22 nt, Human
uuugaaacccgucacuuugagu

SEQ ID NO: 724953 - RNA, 22 nt, Human
aaaugcacugaauauuccaaau

SEQ ID NO: 724954 - RNA, 22 nt, Human
ccucugugccucguguccucug

SEQ ID NO: 724955 - RNA, 22 nt, Human
cagcaggugucuagcaaggguc

SEQ ID NO: 724956 - RNA, 20 nt, Human
ccugucuccucuuaccuggc

SEQ ID NO: 724957 - RNA, 22 nt, Human
ggugggagggcugcguuccucu

SEQ ID NO: 724958 - RNA, 21 nt, Human
accuuuggguguuuauaauag

SEQ ID NO: 724959 - RNA, 22 nt, Human
uuccugagggccccagaggagg

SEQ ID NO: 724960 - RNA, 22 nt, Human
gcagggcaugggcccugucugc

SEQ ID NO: 724961 - RNA, 22 nt, Human
gaacuaaauuugacagacaaca

SEQ ID NO: 724962 - RNA, 18 nt, Human
agggccagcugugaguag

SEQ ID NO: 724963 - RNA, 22 nt, Human
cacugcuugcaguaugagugga

SEQ ID NO: 724964 - RNA, 22 nt, Human
ucugacuugcaucuuaaaggag

SEQ ID NO: 724965 - RNA, 22 nt, Human
aguguuccacacaucuggggaa

SEQ ID NO: 724966 - RNA, 22 nt, Human
acaaaagaauaagaugagucau

SEQ ID NO: 724967 - RNA, 22 nt, Human
cagaauguuaccaguuagucug

SEQ ID NO: 724968 - RNA, 21 nt, Human
aggcucagagaucaaacagua

SEQ ID NO: 724969 - RNA, 22 nt, Human
uuggcagaaugggcagcuugag

SEQ ID NO: 724970 - RNA, 22 nt, Human
auguagaguagaauaguacaac

SEQ ID NO: 724971 - RNA, 22 nt, Human
aagagucuauuggaacuagaca

SEQ ID NO: 724972 - RNA, 22 nt, Human
caguggccucuggcuuugcugu

SEQ ID NO: 724973 - RNA, 22 nt, Human
ucuauuuguucucaggaucauc

SEQ ID NO: 724974 - RNA, 19 nt, Human
ccugccugagcugucccuc

SEQ ID NO: 724975 - RNA, 22 nt, Human
caucuucauuuuguccaguacu

SEQ ID NO: 724976 - RNA, 22 nt, Human
uuucuuuccaugagccuaugua

SEQ ID NO: 724977 - RNA, 22 nt, Human
ucucagugcagcaaggaauuua

SEQ ID NO: 724978 - RNA, 22 nt, Human
auuuagugaccugaacugaaac

SEQ ID NO: 724979 - RNA, 22 nt, Human
uaccucaaguuccaggaaagcg

SEQ ID NO: 724980 - RNA, 22 nt, Human
uuacaaugcacucaccuuuaga

SEQ ID NO: 724981 - RNA, 22 nt, Human
uauauucugauuccaucugugu

SEQ ID NO: 724982 - RNA, 22 nt, Human
gagacaggccaggugguacuua

SEQ ID NO: 724983 - RNA, 22 nt, Human
caggccggggcggcgccaucuu

SEQ ID NO: 724984 - RNA, 22 nt, Human
agggccucgggcucaguggguc

SEQ ID NO: 724985 - RNA, 22 nt, Human
agacaucagcuugugugcaggg

SEQ ID NO: 724986 - RNA, 22 nt, Human
uguuuacuucaucgaguacuuc

SEQ ID NO: 724987 - RNA, 22 nt, Human
acauguguggacaugaaucuac

SEQ ID NO: 724988 - RNA, 22 nt, Human
ugcuucuggaaacaguggcugu

SEQ ID NO: 724989 - RNA, 22 nt, Human
acuuuagagaaauguagaagua

SEQ ID NO: 724990 - RNA, 22 nt, Human
caaauagauuguucaauccuga

SEQ ID NO: 724991 - RNA, 22 nt, Human
agcacacaggacuugauucaug

SEQ ID NO: 724992 - RNA, 22 nt, Human
gcauuucagagaaaaucugcuu

SEQ ID NO: 724993 - RNA, 22 nt, Human
ucauuuguugaacuuuagugcg

SEQ ID NO: 724994 - RNA, 22 nt, Human
gacugagguauuaagauggcuu

SEQ ID NO: 724995 - RNA, 22 nt, Human
ugaggcaggaauggggaaaagu

SEQ ID NO: 724996 - RNA, 22 nt, Human
ggcaagagugaggagugucucu

SEQ ID NO: 724997 - RNA, 22 nt, Human
uauucucauuagucuguauucc

SEQ ID NO: 724998 - RNA, 22 nt, Human
uacaugcaugauacaaaguugc

SEQ ID NO: 724999 - RNA, 22 nt, Human
uugagaaacaucuaaucuuugu

SEQ ID NO: 725000 - RNA, 22 nt, Human
cauguguguccaugugacuaag

SEQ ID NO: 725001 - RNA, 22 nt, Human
agcagggcugcagugugucuuu

SEQ ID NO: 725002 - RNA, 22 nt, Human
ucucaguguuguucugcagaug

SEQ ID NO: 725003 - RNA, 22 nt, Human
gcuggcugccuuacuuugugga

SEQ ID NO: 725004 - RNA, 22 nt, Human
auguacagccacuucacaguua

SEQ ID NO: 725005 - RNA, 22 nt, Human
agguucagucuuuggaccccuc

SEQ ID NO: 725006 - RNA, 22 nt, Human
uucaugaauauauugaauuagc

SEQ ID NO: 725007 - RNA, 22 nt, Human
ucaugcuuauugcauauuugga

SEQ ID NO: 725008 - RNA, 22 nt, Human
aggcaguguucuucuaagggca

SEQ ID NO: 725009 - RNA, 22 nt, Human
aaacucuuuccacgauuacuuu

SEQ ID NO: 725010 - RNA, 22 nt, Human
agagaggcugggcguagggcuu

SEQ ID NO: 725011 - RNA, 22 nt, Human
uccaugagaacccuuggagaua

SEQ ID NO: 725012 - RNA, 22 nt, Human
aaagccuugggauuugugauca

SEQ ID NO: 725013 - RNA, 22 nt, Human
gugcuuuaauaagauuucacuu

SEQ ID NO: 725014 - RNA, 22 nt, Human
gggccagguggaccccagccuc

SEQ ID NO: 725015 - RNA, 22 nt, Human
gcucugacuggugggccacagu

SEQ ID NO: 725016 - RNA, 22 nt, Human
aaaauagcuauggaaugucacu

SEQ ID NO: 725017 - RNA, 22 nt, Human
acagauguugcuugucauucuc

SEQ ID NO: 725018 - RNA, 19 nt, Human
ucagggaaguucaaagcuc

SEQ ID NO: 725019 - RNA, 22 nt, Human
cgucacuggcgugaagugagga

SEQ ID NO: 725020 - RNA, 23 nt, Human
agugccagggagaucaggacgga

SEQ ID NO: 725021 - RNA, 22 nt, Human
uagaaaucauuuagaaguauug

SEQ ID NO: 725022 - RNA, 22 nt, Human
auggcaguguuucaguuuuugg

SEQ ID NO: 725023 - RNA, 22 nt, Human
ucugagguugaacuuugcaaag

SEQ ID NO: 725024 - RNA, 19 nt, Human
uucuugaacauguuucuca

SEQ ID NO: 725025 - RNA, 22 nt, Human
guuuuccuguugaguaguauuc

SEQ ID NO: 725026 - RNA, 22 nt, Human
ugccagcaagaauagacaguaa

SEQ ID NO: 725027 - RNA, 17 nt, Human
auuuccucagggcugag

SEQ ID NO: 725028 - RNA, 22 nt, Human
gcugcuuccuagaaggcccagu

SEQ ID NO: 725029 - RNA, 22 nt, Human
gugugccuguaucaugguaacc

SEQ ID NO: 725030 - RNA, 22 nt, Human
gugguaccaguaggucagccau

SEQ ID NO: 725031 - RNA, 22 nt, Human
agacccaggauuggggcugccg

SEQ ID NO: 725032 - RNA, 22 nt, Human
gaauuggggguuuugcaaggca

SEQ ID NO: 725033 - RNA, 22 nt, Human
agacaauggaccaagcaccuuc

SEQ ID NO: 725034 - RNA, 20 nt, Human
aaggaauauuuguaucuggg

SEQ ID NO: 725035 - RNA, 22 nt, Human
gugucacaagagcccaggaaac

SEQ ID NO: 725036 - RNA, 22 nt, Human
augggaguuuucucugaugcuc

SEQ ID NO: 725037 - RNA, 22 nt, Human
acacuccagggagggagggaau

SEQ ID NO: 725038 - RNA, 22 nt, Human
gacacagacaguuagagguaau

SEQ ID NO: 725039 - RNA, 22 nt, Human
cugagguuuacaagcuauugcu

SEQ ID NO: 725040 - RNA, 22 nt, Human
ggcugcugguagggguaggaag

SEQ ID NO: 725041 - RNA, 22 nt, Human
guuccaggcaguggcaacagcu

SEQ ID NO: 725042 - RNA, 23 nt, Human
uggccagguagaggagguaguga

SEQ ID NO: 725043 - RNA, 22 nt, Human
gugcucuaugaggauauagggu

SEQ ID NO: 725044 - RNA, 22 nt, Human
cuggcucuucagugcuugguuc

SEQ ID NO: 725045 - RNA, 22 nt, Human
cagcagccagacaagauacauc

SEQ ID NO: 725046 - RNA, 23 nt, Human
cugacucaucccaccaccuccuc

SEQ ID NO: 725047 - RNA, 22 nt, Human
uugcaaaaacugcaauuacuuu

SEQ ID NO: 725048 - RNA, 22 nt, Human
gccugucaauuuuguguacaau

SEQ ID NO: 725049 - RNA, 22 nt, Human
gcuucauuaauagaauuaguau

SEQ ID NO: 725050 - RNA, 22 nt, Human
gggcacuggcagucggggacgc

SEQ ID NO: 725051 - RNA, 22 nt, Human
cccuggaggaccccaauguggc

SEQ ID NO: 725052 - RNA, 22 nt, Human
cacugaaaggcaaugcugacag

SEQ ID NO: 725053 - RNA, 22 nt, Human
cagcugagaaauggggaaaggg

SEQ ID NO: 725054 - RNA, 22 nt, Human
gcagcagugugggcugaaccua

SEQ ID NO: 725055 - RNA, 23 nt, Human
gcagagcugcccuauugccuugg

SEQ ID NO: 725056 - RNA, 22 nt, Human
gcacaggcuguuggccuucaga

SEQ ID NO: 725057 - RNA, 22 nt, Human
ucuuaaaccacaaaauucagag

SEQ ID NO: 725058 - RNA, 22 nt, Human
ggggccagcuucgcgugcucuu

SEQ ID NO: 725059 - RNA, 22 nt, Human
uggaccugagccuggcccugcc

SEQ ID NO: 725060 - RNA, 22 nt, Human
guggccucuguuggcuccuagg

SEQ ID NO: 725061 - RNA, 22 nt, Human
ggaggccaauuuucuaacugca

SEQ ID NO: 725062 - RNA, 22 nt, Human
ucagcaggcugucagcaggggc

SEQ ID NO: 725063 - RNA, 23 nt, Human
gccagaggaacgcagagcuuucu

SEQ ID NO: 725064 - RNA, 22 nt, Human
uauuaaauauaucuguuaguug

SEQ ID NO: 725065 - RNA, 22 nt, Human
ucacagagaaauguggcacaaa

SEQ ID NO: 725066 - RNA, 22 nt, Human
uacuuucuaagacauacaacuu

SEQ ID NO: 725067 - RNA, 22 nt, Human
cacugugggguuuggcuggaac

SEQ ID NO: 725068 - RNA, 20 nt, Human
ugcuggaaauuguucuagga

SEQ ID NO: 725069 - RNA, 20 nt, Human
ucuaaacaguuggcaugggg

SEQ ID NO: 725070 - RNA, 22 nt, Human
uggcuucuugacuucuuggcug

SEQ ID NO: 725071 - RNA, 22 nt, Human
ggccuugguaaugggggacugu

SEQ ID NO: 725072 - RNA, 22 nt, Human
aggcugagcggggucccagagc

SEQ ID NO: 725073 - RNA, 22 nt, Human
agccuaggggguccugggccac

SEQ ID NO: 725074 - RNA, 22 nt, Human
uaaacaagaaacauuuucuguu

SEQ ID NO: 725075 - RNA, 22 nt, Human
uucuggaauacuaaguuccuuu

SEQ ID NO: 725076 - RNA, 22 nt, Human
acaggcagguccugucccagcu

SEQ ID NO: 725077 - RNA, 22 nt, Human
agcagcugagaugguaagauuc

SEQ ID NO: 725078 - RNA, 22 nt, Human
ucauaaauuagcugucuuugaa

SEQ ID NO: 725079 - RNA, 22 nt, Human
aacuuuaaagaggaggcuuggg

SEQ ID NO: 725080 - RNA, 22 nt, Human
ucccaggguccucuucuggaau

SEQ ID NO: 725081 - RNA, 22 nt, Human
cuggaaggggcagucuuugggc

SEQ ID NO: 725082 - RNA, 22 nt, Human
ucuggggacggggcccagcaau

SEQ ID NO: 725083 - RNA, 22 nt, Human
aguggcagagccaagauaugau

SEQ ID NO: 725084 - RNA, 22 nt, Human
guuuagaaugaaacuuuugagc

SEQ ID NO: 725085 - RNA, 22 nt, Human
uuuauuaaaacuguuggcucug

SEQ ID NO: 725086 - RNA, 22 nt, Human
uguguugguagaucugaggucu

SEQ ID NO: 725087 - RNA, 22 nt, Human
ucaggagguugaccacggggca

SEQ ID NO: 725088 - RNA, 22 nt, Human
uuggccagguguccagcccagg

SEQ ID NO: 725089 - RNA, 22 nt, Human
ggugggggagacuuggucaaga

SEQ ID NO: 725090 - RNA, 22 nt, Human
augccugcuuacuccaggugcu

SEQ ID NO: 725091 - RNA, 22 nt, Human
auuagauacacagauuuccacu

SEQ ID NO: 725092 - RNA, 22 nt, Human
cugccaaggcuggggaggacaa

SEQ ID NO: 725093 - RNA, 22 nt, Human
aaaccuuuaccagacuagcaag

SEQ ID NO: 725094 - RNA, 22 nt, Human
aagcaguguucccagcuggccc

SEQ ID NO: 725095 - RNA, 22 nt, Human
cugugucccaguaccuugggua

SEQ ID NO: 725096 - RNA, 22 nt, Human
guucauuguguguggucuucuu

SEQ ID NO: 725097 - RNA, 22 nt, Human
ggcuggaaggcccuuuguugau

SEQ ID NO: 725098 - RNA, 20 nt, Human
gcagaugagacucacagagg

SEQ ID NO: 725099 - RNA, 22 nt, Human
ccacaugcucucucuccagguu

SEQ ID NO: 725100 - RNA, 22 nt, Human
cuggaaggcucugcugccuguc

SEQ ID NO: 725101 - RNA, 19 nt, Human
ccagagagcuagguacaga

SEQ ID NO: 725102 - RNA, 22 nt, Human
ccucugggagacugcuacugag

SEQ ID NO: 725103 - RNA, 22 nt, Human
agcugcuguggggcucggccug

SEQ ID NO: 725104 - RNA, 22 nt, Human
aggacagcccuugagagcacau

SEQ ID NO: 725105 - RNA, 22 nt, Human
acugggaaccugugcuaggagg

SEQ ID NO: 725106 - RNA, 22 nt, Human
cagcuggacuuuugauagaagu

SEQ ID NO: 725107 - RNA, 22 nt, Human
gcugucuuuccccugcuccaga

SEQ ID NO: 725108 - RNA, 22 nt, Human
ugugcuaaggcagucuaucaca

SEQ ID NO: 725109 - RNA, 21 nt, Human
uccuucaguucugcacuuucu

SEQ ID NO: 725110 - RNA, 22 nt, Human
uuggcagauuugucaguaagcu

SEQ ID NO: 725111 - RNA, 22 nt, Human
aauguguagauguugcauuccu

SEQ ID NO: 725112 - RNA, 22 nt, Human
cacagauaaggauguuaauuuu

SEQ ID NO: 725113 - RNA, 22 nt, Human
cuauuuauguccaaguguuuua

SEQ ID NO: 725114 - RNA, 22 nt, Human
uagcacaucuggcgcuuauagg

SEQ ID NO: 725115 - RNA, 22 nt, Human
ggcuccagaugucuccuggcaa

SEQ ID NO: 725116 - RNA, 22 nt, Human
gacaggguuugcaaggacuucg

SEQ ID NO: 725117 - RNA, 22 nt, Human
agaaggcucacuaagagugacu

SEQ ID NO: 725118 - RNA, 22 nt, Human
agguggcuccucccauggcugg

SEQ ID NO: 725119 - RNA, 22 nt, Human
uaugaagaagacaaaugacacu

SEQ ID NO: 725120 - RNA, 22 nt, Human
acuuagaauuaaauauuuuugg

SEQ ID NO: 725121 - RNA, 22 nt, Human
ggggcagaaagcccacagagug

SEQ ID NO: 725122 - RNA, 19 nt, Human
caggccagugucagggggc

SEQ ID NO: 725123 - RNA, 22 nt, Human
ucccucagagaccguggugcag

SEQ ID NO: 725124 - RNA, 22 nt, Human
ggcuuuaacaacagaaauuuau

SEQ ID NO: 725125 - RNA, 22 nt, Human
uccucugcuggaagggcaagag

SEQ ID NO: 725126 - RNA, 22 nt, Human
uugucucuguguggcuucccua

SEQ ID NO: 725127 - RNA, 22 nt, Human
gaaggcaacaccaggaugcacu

SEQ ID NO: 725128 - RNA, 21 nt, Human
gggccuggcugcgcaggacgg

SEQ ID NO: 725129 - RNA, 22 nt, Human
uggucugaacacauuuuaggua

SEQ ID NO: 725130 - RNA, 21 nt, Human
ggaaagaaggcaaggcucagg

SEQ ID NO: 725131 - RNA, 22 nt, Human
guugaguguugugcaugcacca

SEQ ID NO: 725132 - RNA, 22 nt, Human
cccucacuucacgcucugcaga

SEQ ID NO: 725133 - RNA, 18 nt, Human
uccugggaacuugcuagc

SEQ ID NO: 725134 - RNA, 22 nt, Human
uggccccauuuuacagaugaaa

SEQ ID NO: 725135 - RNA, 22 nt, Human
caguaguggucuaucacuggag

SEQ ID NO: 725136 - RNA, 22 nt, Human
gaguuauuggguggaaagguag

SEQ ID NO: 725137 - RNA, 22 nt, Human
acacaguaugaaaagucuaguu

SEQ ID NO: 725138 - RNA, 22 nt, Human
uacagcuuuagcaaauuaccua

SEQ ID NO: 725139 - RNA, 22 nt, Human
uuucagggaaguguugaaaagg

SEQ ID NO: 725140 - RNA, 18 nt, Human
uaaaggaagugggagagg

SEQ ID NO: 725141 - RNA, 22 nt, Human
uguuaacauguguauuguauga

SEQ ID NO: 725142 - RNA, 23 nt, Human
ucccugagcuggagagacugcac

SEQ ID NO: 725143 - RNA, 22 nt, Human
ccuuccaagugcugcuuuuucc

SEQ ID NO: 725144 - RNA, 20 nt, Human
accagagauagcaauagugc

SEQ ID NO: 725145 - RNA, 22 nt, Human
ucucugagccccugccucuuuc

SEQ ID NO: 725146 - RNA, 22 nt, Human
ugaaugaggauccuugaccuua

SEQ ID NO: 725147 - RNA, 18 nt, Human
guuuugaauugucuuaca

SEQ ID NO: 725148 - RNA, 22 nt, Human
uaggaaauuagaacuuggaaac

SEQ ID NO: 725149 - RNA, 22 nt, Human
ggcccuguccccuucaguuuug

SEQ ID NO: 725150 - RNA, 20 nt, Human
agcuccagugcugacgcuuc

SEQ ID NO: 725151 - RNA, 22 nt, Human
ugcugcuuccugguagauagga

SEQ ID NO: 725152 - RNA, 22 nt, Human
uuaauaaguaguaguuauuguu

SEQ ID NO: 725153 - RNA, 22 nt, Human
ccuagcagggaagcagugagga

SEQ ID NO: 725154 - RNA, 22 nt, Human
uuuuuguguauccugcuccaug

SEQ ID NO: 725155 - RNA, 22 nt, Human
uacaggagcugcucugugauac

SEQ ID NO: 725156 - RNA, 22 nt, Human
acaauagauacugggcacauau

SEQ ID NO: 725157 - RNA, 22 nt, Human
gaagaucugcagccucaggcga

SEQ ID NO: 725158 - RNA, 22 nt, Human
caguuucucucaauaagcaucg

SEQ ID NO: 725159 - RNA, 22 nt, Human
aaagucacaguuuaggggauau

SEQ ID NO: 725160 - RNA, 22 nt, Human
acuuuaauuaaugaacuguggc

SEQ ID NO: 725161 - RNA, 18 nt, Human
auauguuaauuagguagg

SEQ ID NO: 725162 - RNA, 22 nt, Human
uuuggaauuccauuucugcauu

SEQ ID NO: 725163 - RNA, 22 nt, Human
aaaugcacugaacacauguugu

SEQ ID NO: 725164 - RNA, 22 nt, Human
uucuggagcuaaaguccacucu

SEQ ID NO: 725165 - RNA, 23 nt, Human
auagaagauuauugcaacagucc

SEQ ID NO: 725166 - RNA, 22 nt, Human
uggaaaaugugacuauucuaaa

SEQ ID NO: 725167 - RNA, 22 nt, Human
cagugaaguucuacugaauggu

SEQ ID NO: 725168 - RNA, 22 nt, Human
gcagccuccgcacugcgagucc

SEQ ID NO: 725169 - RNA, 22 nt, Human
uccccaggggccugggcacagu

SEQ ID NO: 725170 - RNA, 22 nt, Human
ggaggugggagacauaggcggc

SEQ ID NO: 725171 - RNA, 22 nt, Human
gaccacuggcgcugcgagaccc

SEQ ID NO: 725172 - RNA, 22 nt, Human
ucuguaaucaagauauuugaga

SEQ ID NO: 725173 - RNA, 22 nt, Human
aaaaaguauuggccaugguuga

SEQ ID NO: 725174 - RNA, 22 nt, Human
cucuccccacacccucugcaug

SEQ ID NO: 725175 - RNA, 22 nt, Human
guccuggugagguagugggagg

SEQ ID NO: 725176 - RNA, 22 nt, Human
aaggcagccauagcaccaucca

SEQ ID NO: 725177 - RNA, 20 nt, Human
auuuuggugaacacagcuuc

SEQ ID NO: 725178 - RNA, 22 nt, Human
augaaugcuuauuaaauugaaa

SEQ ID NO: 725179 - RNA, 22 nt, Human
agaggaguauuuucuaagggaa

SEQ ID NO: 725180 - RNA, 22 nt, Human
aaggagcugggagggacacaug

SEQ ID NO: 725181 - RNA, 22 nt, Human
ugggccuggagcccuggagagu

SEQ ID NO: 725182 - RNA, 22 nt, Human
ggcaucuggaucugcuucuccc

SEQ ID NO: 725183 - RNA, 22 nt, Human
caucaucugugcuggagagccu

SEQ ID NO: 725184 - RNA, 22 nt, Human
ugugugaccuggggugagauag

SEQ ID NO: 725185 - RNA, 22 nt, Human
agaacuguccuuggaggagagu

SEQ ID NO: 725186 - RNA, 20 nt, Human
cccagccccuaccuguugcc

SEQ ID NO: 725187 - RNA, 22 nt, Human
cucuucagauaaaagggauauu

SEQ ID NO: 725188 - RNA, 22 nt, Human
ccuuagcaacacuuagcaacug

SEQ ID NO: 725189 - RNA, 22 nt, Human
ucaauucuagagccuuacauug

SEQ ID NO: 725190 - RNA, 23 nt, Human
uugcuuucaucaugagaugcucc

SEQ ID NO: 725191 - RNA, 22 nt, Human
gcuuuagagaagaaagguugcu

SEQ ID NO: 725192 - RNA, 17 nt, Human
ugcugucugcuucccua

SEQ ID NO: 725193 - RNA, 22 nt, Human
uaaaaguauacuuucaaaggag

SEQ ID NO: 725194 - RNA, 22 nt, Human
cuguucaugcugauucuguaug

SEQ ID NO: 725195 - RNA, 22 nt, Human
agacaaagacagcaucucaggu

SEQ ID NO: 725196 - RNA, 22 nt, Human
gcugacugguugcacagagggu

SEQ ID NO: 725197 - RNA, 20 nt, Human
ccuuuagaaacucauaugua

SEQ ID NO: 725198 - RNA, 22 nt, Human
uaaaugagauuuguucuuuugu

SEQ ID NO: 725199 - RNA, 22 nt, Human
gaagucuuuuagcaaaacgaac

SEQ ID NO: 725200 - RNA, 22 nt, Human
ccagcagcaggccaggcccucc

SEQ ID NO: 725201 - RNA, 22 nt, Human
ggauggcaggacaaggacccag

SEQ ID NO: 725202 - RNA, 22 nt, Human
augcacccagugucuggacuau

SEQ ID NO: 725203 - RNA, 21 nt, Human
acaaaggaagucucuuuuaag

SEQ ID NO: 725204 - RNA, 22 nt, Human
agguauauauucugguccuuau

SEQ ID NO: 725205 - RNA, 22 nt, Human
uauggguaaagggcuaggguuu

SEQ ID NO: 725206 - RNA, 22 nt, Human
uacauaauuaaucuuuaaguuc

SEQ ID NO: 725207 - RNA, 22 nt, Human
ucagguccuuacugugcucccu

SEQ ID NO: 725208 - RNA, 20 nt, Human
aaugaucagcauagcaagga

SEQ ID NO: 725209 - RNA, 22 nt, Human
uuaaaauguacaggggaaagug

SEQ ID NO: 725210 - RNA, 22 nt, Human
ggcaguuuuaacagagguagua

SEQ ID NO: 725211 - RNA, 22 nt, Human
acuuauaagagugcuaugggga

SEQ ID NO: 725212 - RNA, 22 nt, Human
uauaaagaaguguaaacaggaa

SEQ ID NO: 725213 - RNA, 22 nt, Human
uccugcaggccagaggggugag

SEQ ID NO: 725214 - RNA, 23 nt, Human
uuguccugccgaucucugagaau

SEQ ID NO: 725215 - RNA, 22 nt, Human
uagugccaccuuccaaguauca

SEQ ID NO: 725216 - RNA, 21 nt, Human
uuuagcaagaguauagugcau

SEQ ID NO: 725217 - RNA, 22 nt, Human
aaaaucacaagcuugggucacu

SEQ ID NO: 725218 - RNA, 22 nt, Human
uugauaaaaugaugaaaucacu

SEQ ID NO: 725219 - RNA, 22 nt, Human
gcaggcucagagcagauuagca

SEQ ID NO: 725220 - RNA, 22 nt, Human
ggccuggaaugcuuuccuacca

SEQ ID NO: 725221 - RNA, 22 nt, Human
ccuucaaauuuagaacaaguga

SEQ ID NO: 725222 - RNA, 22 nt, Human
uuuacaagucuguugaucccaa

SEQ ID NO: 725223 - RNA, 22 nt, Human
cacuuugaugcagggcucagua

SEQ ID NO: 725224 - RNA, 22 nt, Human
gguauuuacugagagccacucu

SEQ ID NO: 725225 - RNA, 23 nt, Human
aaguucuuuuagaugucuucgug

SEQ ID NO: 725226 - RNA, 22 nt, Human
cagaugaaggccugaaugucua

SEQ ID NO: 725227 - RNA, 22 nt, Human
ucaggauggagggaagcacaga

SEQ ID NO: 725228 - RNA, 22 nt, Human
auguccucggcucugugcugcu

SEQ ID NO: 725229 - RNA, 22 nt, Human
uuuuuauaccaccucucacuua

SEQ ID NO: 725230 - RNA, 22 nt, Human
gggcagguggagggcccagcca

SEQ ID NO: 725231 - RNA, 22 nt, Human
cugggacucagaccaguucugu

SEQ ID NO: 725232 - RNA, 22 nt, Human
ugaaggagaaauggaaaguggg

SEQ ID NO: 725233 - RNA, 22 nt, Human
uggcaggaaggagacucagccc

SEQ ID NO: 725234 - RNA, 22 nt, Human
aauaacugcacuuguugaaugc

SEQ ID NO: 725235 - RNA, 20 nt, Human
agaaaucagcauguccucug

SEQ ID NO: 725236 - RNA, 22 nt, Human
cuugggcacaucccugguauuu

SEQ ID NO: 725237 - RNA, 22 nt, Human
agaacaucugaagauacaaagu

SEQ ID NO: 725238 - RNA, 17 nt, Human
ucucuuguucacugcug

SEQ ID NO: 725239 - RNA, 22 nt, Human
ucauuucuccgaccugcugucc

SEQ ID NO: 725240 - RNA, 22 nt, Human
uaguguuccagaagcaaacaag

SEQ ID NO: 725241 - RNA, 22 nt, Human
uccuuuaaacuccuuucaaguc

SEQ ID NO: 725242 - RNA, 22 nt, Human
uuucuaaaauagauuuuauggu

SEQ ID NO: 725243 - RNA, 22 nt, Human
uguuuguacucaaagccaugag

SEQ ID NO: 725244 - RNA, 22 nt, Human
auuuacaccuucuucgauucuc

SEQ ID NO: 725245 - RNA, 22 nt, Human
cugaagaaauaugauugcuuaa

SEQ ID NO: 725246 - RNA, 22 nt, Human
uccuugaauauaauaacaguag

SEQ ID NO: 725247 - RNA, 22 nt, Human
cagaggcauacucccagucuug

SEQ ID NO: 725248 - RNA, 22 nt, Human
gcagaugcugcuccucucuaga

SEQ ID NO: 725249 - RNA, 22 nt, Human
ugaagauuuccaccaaaucaca

SEQ ID NO: 725250 - RNA, 19 nt, Human
uucauuuguaucugcucac

SEQ ID NO: 725251 - RNA, 22 nt, Human
gucuccuggaaauaugcccaua

SEQ ID NO: 725252 - RNA, 22 nt, Human
acacauuugcauaauaccucau

SEQ ID NO: 725253 - RNA, 22 nt, Human
agaggcacggaggcugcaugga

SEQ ID NO: 725254 - RNA, 22 nt, Human
guaaaguucuacuagaaucaac

SEQ ID NO: 725255 - RNA, 22 nt, Human
ucagccuacacuccaacagcau

SEQ ID NO: 725256 - RNA, 22 nt, Human
ccagauauucacuuuuacaugc

SEQ ID NO: 725257 - RNA, 22 nt, Human
ucagagugggagaaugugccaa

SEQ ID NO: 725258 - RNA, 22 nt, Human
cugcugcaggaugggcacucug

SEQ ID NO: 725259 - RNA, 22 nt, Human
ugaggcucaaggucugguggag

SEQ ID NO: 725260 - RNA, 22 nt, Human
uggcacagugcuggauggugcu

SEQ ID NO: 725261 - RNA, 22 nt, Human
agaaaccugugugcugugauga

SEQ ID NO: 725262 - RNA, 21 nt, Human
uguuacaguccaaauguuugu

SEQ ID NO: 725263 - RNA, 22 nt, Human
aagguggcgcuggagcuggucc

SEQ ID NO: 725264 - RNA, 22 nt, Human
cccaggagguagagguugcagu

SEQ ID NO: 725265 - RNA, 22 nt, Human
ggcaugggguguauguggcacg

SEQ ID NO: 725266 - RNA, 22 nt, Human
auuuacuaaugucauaucgcgu

SEQ ID NO: 725267 - RNA, 22 nt, Human
ugauuuccuaggucuggagaag

SEQ ID NO: 725268 - RNA, 22 nt, Human
cagcuuuagagaaaacauauuu

SEQ ID NO: 725269 - RNA, 22 nt, Human
gaauuuuaucuuauuacuugca

SEQ ID NO: 725270 - RNA, 22 nt, Human
aaagccaaaugaaagaugguuc

SEQ ID NO: 725271 - RNA, 22 nt, Human
uuuaagaaguuauguuauaaau

SEQ ID NO: 725272 - RNA, 22 nt, Human
acuuagcaauuugauuaaaaga

SEQ ID NO: 725273 - RNA, 22 nt, Human
uaugaacugcucuuguguuuug

SEQ ID NO: 725274 - RNA, 22 nt, Human
cacacacugacaccuuaucuug

SEQ ID NO: 725275 - RNA, 22 nt, Human
agucaaaacauguacuuuccuu

SEQ ID NO: 725276 - RNA, 22 nt, Human
uuguuugaggucacugauauuu

SEQ ID NO: 725277 - RNA, 22 nt, Human
uccugagcuucaaaacacuuug

SEQ ID NO: 725278 - RNA, 22 nt, Human
ggcucagguuaccagucccucc

SEQ ID NO: 725279 - RNA, 22 nt, Human
acuuuauguuugauaucuaugg

SEQ ID NO: 725280 - RNA, 22 nt, Human
ucagaggccaaacugagcaggg

SEQ ID NO: 725281 - RNA, 22 nt, Human
ugagcaccuacuguauuccagg

SEQ ID NO: 725282 - RNA, 22 nt, Human
auuaaagugaaguucucagaug

SEQ ID NO: 725283 - RNA, 22 nt, Human
uaaugaggcaagagucauggcu

SEQ ID NO: 725284 - RNA, 22 nt, Human
cuggcagcauggagccugugcu

SEQ ID NO: 725285 - RNA, 22 nt, Human
ggugcaggcgguggggcaagua

SEQ ID NO: 725286 - RNA, 22 nt, Human
acccuggccugguucaugugau

SEQ ID NO: 725287 - RNA, 22 nt, Human
cuugucagccaauuguggauuu

SEQ ID NO: 725288 - RNA, 22 nt, Human
auggcuccauccuguugcuagu

SEQ ID NO: 725289 - RNA, 22 nt, Human
gguggcagagaggagguaguuu

SEQ ID NO: 725290 - RNA, 22 nt, Human
agacaugccaagaaacccagug

SEQ ID NO: 725291 - RNA, 22 nt, Human
cccuggagcaucucugcugucu

SEQ ID NO: 725292 - RNA, 22 nt, Human
uggccuggccacauccagcagg

SEQ ID NO: 725293 - RNA, 22 nt, Human
gguagaaggggaagagguccau

SEQ ID NO: 725294 - RNA, 21 nt, Human
uuaaucagucucccugucucc

SEQ ID NO: 725295 - RNA, 22 nt, Human
acagcacagagugguauggcug

SEQ ID NO: 725296 - RNA, 22 nt, Human
gcuguggccuaguuuguuauau

SEQ ID NO: 725297 - RNA, 22 nt, Human
ucucagagggaggauuacugcc

SEQ ID NO: 725298 - RNA, 22 nt, Human
gagaugcaagcaagucuauuuu

SEQ ID NO: 725299 - RNA, 22 nt, Human
uccucuccaggugagccgaaau

SEQ ID NO: 725300 - RNA, 22 nt, Human
ggauguagugcaaggagugaau

SEQ ID NO: 725301 - RNA, 22 nt, Human
aaugagaacugggaguuggugg

SEQ ID NO: 725302 - RNA, 22 nt, Human
acccucugagaggcacacuuug

SEQ ID NO: 725303 - RNA, 22 nt, Human
ggcauagaaugugcugugacaa

SEQ ID NO: 725304 - RNA, 22 nt, Human
cacaugcuagaauaaaucucca

SEQ ID NO: 725305 - RNA, 20 nt, Human
uuagcaguagagugugcuuc

SEQ ID NO: 725306 - RNA, 22 nt, Human
ccgggggacuacugggaaacug

SEQ ID NO: 725307 - RNA, 22 nt, Human
ucuugcagacagcuuccagccu

SEQ ID NO: 725308 - RNA, 22 nt, Human
cugcuagcccgccggccagcga

SEQ ID NO: 725309 - RNA, 22 nt, Human
caaaggagguaaugggugugag

SEQ ID NO: 725310 - RNA, 22 nt, Human
aacaggggauuagauagcaggc

SEQ ID NO: 725311 - RNA, 22 nt, Human
auuuuaaggcuuauuuaaaggc

SEQ ID NO: 725312 - RNA, 22 nt, Human
gucuggagggaagagaugucag

SEQ ID NO: 725313 - RNA, 22 nt, Human
gcugucacucuccggccuuccc

SEQ ID NO: 725314 - RNA, 22 nt, Human
ugaaaucaugaacaagguaggu

SEQ ID NO: 725315 - RNA, 22 nt, Human
uuuccuuugggagcaugaauuu

SEQ ID NO: 725316 - RNA, 22 nt, Human
uucaagcagagauauuucaaga

SEQ ID NO: 725317 - RNA, 22 nt, Human
uuucuaguauauaacuagaucu

SEQ ID NO: 725318 - RNA, 22 nt, Human
cguucuuuucauauuuacaugg

SEQ ID NO: 725319 - RNA, 22 nt, Human
gcauucaucuucaugaaagcac

SEQ ID NO: 725320 - RNA, 22 nt, Human
aacugcaaaauaaucaaguugu

SEQ ID NO: 725321 - RNA, 22 nt, Human
ucugggcugugggaauucaaca

SEQ ID NO: 725322 - RNA, 22 nt, Human
ucucugaagauauuuauuauua

SEQ ID NO: 725323 - RNA, 22 nt, Human
ucccugggccuaucuuagcucc

SEQ ID NO: 725324 - RNA, 22 nt, Human
aguuuaugaaacacagauuuga

SEQ ID NO: 725325 - RNA, 22 nt, Human
uggaaggggagcuggaaagggg

SEQ ID NO: 725326 - RNA, 22 nt, Human
gugacaggcccagugggaugca

SEQ ID NO: 725327 - RNA, 22 nt, Human
guggaagguaaugcagcuuacu

SEQ ID NO: 725328 - RNA, 22 nt, Human
gcagccacuuugcaaccaagag

SEQ ID NO: 725329 - RNA, 22 nt, Human
ggcagccaugucccagggcuuc

SEQ ID NO: 725330 - RNA, 22 nt, Human
augacuuuuaaaagcugguacu

SEQ ID NO: 725331 - RNA, 22 nt, Human
gaauacacgaaggcaagagucc

SEQ ID NO: 725332 - RNA, 22 nt, Human
ggaggggagauguuugggcuca

SEQ ID NO: 725333 - RNA, 22 nt, Human
uuuacagucuauguugaauuaa

SEQ ID NO: 725334 - RNA, 22 nt, Human
cucaggccagguuucucccaca

SEQ ID NO: 725335 - RNA, 22 nt, Human
aaguuguauauaccgcuuuaag

SEQ ID NO: 725336 - RNA, 22 nt, Human
agccucuguagaaagcagugug

SEQ ID NO: 725337 - RNA, 22 nt, Human
ugucuuuaguuuuacugucugg

SEQ ID NO: 725338 - RNA, 22 nt, Human
ggcuggcacgaagcccugcugg

SEQ ID NO: 725339 - RNA, 22 nt, Human
ggggccugcgagguucaacuuc

SEQ ID NO: 725340 - RNA, 22 nt, Human
gccucagguaaaacuugaguuu

SEQ ID NO: 725341 - RNA, 22 nt, Human
ucagaauaaguuaugaaaugaa

SEQ ID NO: 725342 - RNA, 22 nt, Human
augcacaguauguagggucuau

SEQ ID NO: 725343 - RNA, 22 nt, Human
acaauuagugaucagugaugcc

SEQ ID NO: 725344 - RNA, 22 nt, Human
augaggccagaccacucugcau

SEQ ID NO: 725345 - RNA, 17 nt, Human
ggagccaggagcccacc

SEQ ID NO: 725346 - RNA, 22 nt, Human
aacucaaagaugcaugacgcuu

SEQ ID NO: 725347 - RNA, 22 nt, Human
agugucuggugagggcucucuc

SEQ ID NO: 725348 - RNA, 22 nt, Human
uucacagagaguaugcagagaa

SEQ ID NO: 725349 - RNA, 23 nt, Human
cuaggcaggauuguaggcgggua

SEQ ID NO: 725350 - RNA, 22 nt, Human
acaauuuuucaaagaagcuuau

SEQ ID NO: 725351 - RNA, 22 nt, Human
gcacagggagcaggucucuggu

SEQ ID NO: 725352 - RNA, 22 nt, Human
uguggaaaauuggaacguuccu

SEQ ID NO: 725353 - RNA, 22 nt, Human
agaggccagggacacugcucaa

SEQ ID NO: 725354 - RNA, 22 nt, Human
uuaaagcaaccaucaauuugga

SEQ ID NO: 725355 - RNA, 22 nt, Human
uccagcucugcuucacagucuc

SEQ ID NO: 725356 - RNA, 22 nt, Human
gcuguccucugaucucuggagg

SEQ ID NO: 725357 - RNA, 22 nt, Human
gcugaagggagugcugagucug

SEQ ID NO: 725358 - RNA, 22 nt, Human
uuaugcaacaggugagcagaca

SEQ ID NO: 725359 - RNA, 22 nt, Human
agguaacauugccuccaucuga

SEQ ID NO: 725360 - RNA, 22 nt, Human
gaacacugaggacacugagaau

SEQ ID NO: 725361 - RNA, 22 nt, Human
agggcccuagggaaugagacau

SEQ ID NO: 725362 - RNA, 22 nt, Human
gagcuccagggaacagcagcua

SEQ ID NO: 725363 - RNA, 22 nt, Human
aguguuuacauauaaggcccuu

SEQ ID NO: 725364 - RNA, 22 nt, Human
acaugacagugcuuagcaaacu

SEQ ID NO: 725365 - RNA, 22 nt, Human
uagaaagaacuucauguaaaac

SEQ ID NO: 725366 - RNA, 22 nt, Human
ucagaggcuacagucugggagu

SEQ ID NO: 725367 - RNA, 22 nt, Human
gcuggagcggguucgggccgcu

SEQ ID NO: 725368 - RNA, 22 nt, Human
gcuuccauguaugcucuugaca

SEQ ID NO: 725369 - RNA, 22 nt, Human
uuuauuacaccagguuaacuca

SEQ ID NO: 725370 - RNA, 22 nt, Human
caauguuuuguugaaugaauag

SEQ ID NO: 725371 - RNA, 22 nt, Human
acagugugugcuuucccuuacg

SEQ ID NO: 725372 - RNA, 22 nt, Human
auagauauuugaguuguuucca

SEQ ID NO: 725373 - RNA, 22 nt, Human
ugccuggguccaggccaagccu

SEQ ID NO: 725374 - RNA, 22 nt, Human
acagcagccugcagcccugugu

SEQ ID NO: 725375 - RNA, 22 nt, Human
ugaagcugugggcaguggagcc

SEQ ID NO: 725376 - RNA, 21 nt, Human
cggagcugggcagggcauccc

SEQ ID NO: 725377 - RNA, 22 nt, Human
ggucucuggccuuggagauuga

SEQ ID NO: 725378 - RNA, 23 nt, Human
gcucagagguuuuucucuggaug

SEQ ID NO: 725379 - RNA, 20 nt, Human
agcagcauuguucuagagca

SEQ ID NO: 725380 - RNA, 22 nt, Human
aauucaaucuguagauugugau

SEQ ID NO: 725381 - RNA, 19 nt, Human
aggugaugugacucuagaa

SEQ ID NO: 725382 - RNA, 22 nt, Human
ugguggcaaaagaggcaaagug

SEQ ID NO: 725383 - RNA, 22 nt, Human
uagcuguuacccauaaaagcca

SEQ ID NO: 725384 - RNA, 22 nt, Human
ggcggcuacuccuccuggugag

SEQ ID NO: 725385 - RNA, 22 nt, Human
guuucuuauuucaacuggaaca

SEQ ID NO: 725386 - RNA, 22 nt, Human
agucacauucugggguacuggg

SEQ ID NO: 725387 - RNA, 22 nt, Human
ccugugcuuuaggccucaaacu

SEQ ID NO: 725388 - RNA, 22 nt, Human
ugaaggagcucaaugaugaugc

SEQ ID NO: 725389 - RNA, 22 nt, Human
cuauuucagcugccuuugacug

SEQ ID NO: 725390 - RNA, 22 nt, Human
gcagggugugucucauacaguu

SEQ ID NO: 725391 - RNA, 22 nt, Human
auauucacaguaaguguagcag

SEQ ID NO: 725392 - RNA, 22 nt, Human
gugucccacucuggaggugaag

SEQ ID NO: 725393 - RNA, 22 nt, Human
ggccugaaauagcucugagguu

SEQ ID NO: 725394 - RNA, 22 nt, Human
ucaaaggaauuugauuuugaug

SEQ ID NO: 725395 - RNA, 22 nt, Human
ucugggcugaaaugaaggccuu

SEQ ID NO: 725396 - RNA, 22 nt, Human
uacagugaaugaauggcugugc

SEQ ID NO: 725397 - RNA, 22 nt, Human
agguccugaggguucgucugca

SEQ ID NO: 725398 - RNA, 22 nt, Human
uaagacaugagacucagccagu

SEQ ID NO: 725399 - RNA, 22 nt, Human
uguaaaugaaguaugcuuuacu

SEQ ID NO: 725400 - RNA, 22 nt, Human
ggagggugcagacccuuugcaa

SEQ ID NO: 725401 - RNA, 20 nt, Human
cuccagggaacagacuggag

SEQ ID NO: 725402 - RNA, 22 nt, Human
gcagaagucagaccaucugaau

SEQ ID NO: 725403 - RNA, 22 nt, Human
agacaggcaugaggcuggauug

SEQ ID NO: 725404 - RNA, 22 nt, Human
uuucuaaucuuuaguuacaaaa

SEQ ID NO: 725405 - RNA, 22 nt, Human
gacagcaagagacagagcaucc

SEQ ID NO: 725406 - RNA, 19 nt, Human
uauuauuuguagcaaggcc

SEQ ID NO: 725407 - RNA, 22 nt, Human
acaccuuugccccaagucauag

SEQ ID NO: 725408 - RNA, 22 nt, Human
acagagcauuugggacagagag

SEQ ID NO: 725409 - RNA, 22 nt, Human
cauaacugggagauccaagggu

SEQ ID NO: 725410 - RNA, 19 nt, Human
uuaggaaaccacuuuccuu

SEQ ID NO: 725411 - RNA, 22 nt, Human
acagaauuaaugaaaauuacaa

SEQ ID NO: 725412 - RNA, 22 nt, Human
uucucaugaugcaauucauccc

SEQ ID NO: 725413 - RNA, 22 nt, Human
caaugaaaaugaggacuccugu

SEQ ID NO: 725414 - RNA, 22 nt, Human
ucccaaagguccgagcgggaau

SEQ ID NO: 725415 - RNA, 22 nt, Human
gugcaauagacugugguauuaa

SEQ ID NO: 725416 - RNA, 22 nt, Human
caguccuugauccaauaguggg

SEQ ID NO: 725417 - RNA, 22 nt, Human
uuggcuucuugugaaaucugag

SEQ ID NO: 725418 - RNA, 22 nt, Human
auacacauguguaugugcaugc

SEQ ID NO: 725419 - RNA, 22 nt, Human
gccagcuguucagacauucuuu

SEQ ID NO: 725420 - RNA, 22 nt, Human
auacacauuacuuucugucuga

SEQ ID NO: 725421 - RNA, 22 nt, Human
aucugguucuucuuaggcauca

SEQ ID NO: 725422 - RNA, 22 nt, Human
cacuuguugguggugaaaucac

SEQ ID NO: 725423 - RNA, 19 nt, Human
gaggucagcaagaaguauu

SEQ ID NO: 725424 - RNA, 22 nt, Human
cagaggcugagcagucaguuug

SEQ ID NO: 725425 - RNA, 22 nt, Human
ggcacagagcuuugucccaguu

SEQ ID NO: 725426 - RNA, 22 nt, Human
cagcuucagggacagcuucuuu

SEQ ID NO: 725427 - RNA, 22 nt, Human
ccccagcccacaagcauauuaa

SEQ ID NO: 725428 - RNA, 22 nt, Human
cugucuguaucccuguugguaa

SEQ ID NO: 725429 - RNA, 22 nt, Human
uucuuacaaguauuccaggucc

SEQ ID NO: 725430 - RNA, 20 nt, Human
agaaacagcacaauucuguu

SEQ ID NO: 725431 - RNA, 22 nt, Human
augggaggaugcucgggugcuc

SEQ ID NO: 725432 - RNA, 22 nt, Human
uggcucagaguucaucuuuuag

SEQ ID NO: 725433 - RNA, 20 nt, Human
uuuggcuucaagugcauugc

SEQ ID NO: 725434 - RNA, 22 nt, Human
gacagcuuagugaaaauguaaa

SEQ ID NO: 725435 - RNA, 22 nt, Human
agagcugcaggguggacccagg

SEQ ID NO: 725436 - RNA, 22 nt, Human
gacugaggcuccccuaggcuca

SEQ ID NO: 725437 - RNA, 22 nt, Human
uguuauugauaucuaaugcucu

SEQ ID NO: 725438 - RNA, 22 nt, Human
ugggaaauauaauuuagcugug

SEQ ID NO: 725439 - RNA, 22 nt, Human
uucucuguuuuccccucgaugu

SEQ ID NO: 725440 - RNA, 22 nt, Human
cugcagcugccagugauuucag

SEQ ID NO: 725441 - RNA, 18 nt, Human
gggcccuggcguccgccc

SEQ ID NO: 725442 - RNA, 22 nt, Human
aaccagcacugcuggggccugc

SEQ ID NO: 725443 - RNA, 22 nt, Human
ugaaaugagauagauaaucagg

SEQ ID NO: 725444 - RNA, 22 nt, Human
auuccaaaggcuggccuggagg

SEQ ID NO: 725445 - RNA, 22 nt, Human
ucaggaguaaguuauaaguauu

SEQ ID NO: 725446 - RNA, 22 nt, Human
ucuucucuccugcuuggcagaa

SEQ ID NO: 725447 - RNA, 22 nt, Human
gucagcacuuuuccgaggcaga

SEQ ID NO: 725448 - RNA, 22 nt, Human
cuccugagaggaucucuguugu

SEQ ID NO: 725449 - RNA, 22 nt, Human
ucucauggagucaggagcagaa

SEQ ID NO: 725450 - RNA, 18 nt, Human
cuuccugacuagcucugg

SEQ ID NO: 725451 - RNA, 22 nt, Human
agggugcagguguggagucuag

SEQ ID NO: 725452 - RNA, 22 nt, Human
gacuuaaaggcugaauguagga

SEQ ID NO: 725453 - RNA, 22 nt, Human
uccuucaugaugcuuagcagag

SEQ ID NO: 725454 - RNA, 22 nt, Human
cauuccuggacaaacaucaaaa

SEQ ID NO: 725455 - RNA, 21 nt, Human
aaugugugcuauuuaucuuuu

SEQ ID NO: 725456 - RNA, 22 nt, Human
uggagcagcauucauccagcag

SEQ ID NO: 725457 - RNA, 22 nt, Human
ugggcagaaggaagagccaccu

SEQ ID NO: 725458 - RNA, 21 nt, Human
uaucuacuggugucuuucaga

SEQ ID NO: 725459 - RNA, 22 nt, Human
gucagcuagaggaugugacauu

SEQ ID NO: 725460 - RNA, 22 nt, Human
ugucccagcagcuggguucucu

SEQ ID NO: 725461 - RNA, 22 nt, Human
ugaggccauggucuucccaguc

SEQ ID NO: 725462 - RNA, 22 nt, Human
uuguuuuuaugaacauccagga

SEQ ID NO: 725463 - RNA, 22 nt, Human
aggaggugcuagagaagauguu

SEQ ID NO: 725464 - RNA, 22 nt, Human
auuucucugcaguguucggaau

SEQ ID NO: 725465 - RNA, 22 nt, Human
uuccauaaugagauucccagcc

SEQ ID NO: 725466 - RNA, 22 nt, Human
agaaaacugcagaguagccuca

SEQ ID NO: 725467 - RNA, 22 nt, Human
ccagcagaggggcggagugcag

SEQ ID NO: 725468 - RNA, 22 nt, Human
cccugggagcugccuggcugac

SEQ ID NO: 725469 - RNA, 20 nt, Human
gcucaggugacagucaggag

SEQ ID NO: 725470 - RNA, 22 nt, Human
auggcagagggauugaacagcu

SEQ ID NO: 725471 - RNA, 22 nt, Human
caaaugcauagaaagaugaaac

SEQ ID NO: 725472 - RNA, 22 nt, Human
gcauguggugcugaggcugucg

SEQ ID NO: 725473 - RNA, 22 nt, Human
gacaaacugaaguauauuuaga

SEQ ID NO: 725474 - RNA, 22 nt, Human
ccccuuucucccgcgucuggcc

SEQ ID NO: 725475 - RNA, 20 nt, Human
gagagcuggaaauaaagucc

SEQ ID NO: 725476 - RNA, 22 nt, Human
gacaaugguggauacaugucau

SEQ ID NO: 725477 - RNA, 19 nt, Human
ugucuuaauuaacucagag

SEQ ID NO: 725478 - RNA, 22 nt, Human
acagcuaugacagauggauaau

SEQ ID NO: 725479 - RNA, 22 nt, Human
cccuggagugccggaaucaaga

SEQ ID NO: 725480 - RNA, 19 nt, Human
uugaaagauuagcuuucua

SEQ ID NO: 725481 - RNA, 22 nt, Human
gagucucuggaggggucagacc

SEQ ID NO: 725482 - RNA, 22 nt, Human
gagauguuauucuucagugugu

SEQ ID NO: 725483 - RNA, 22 nt, Human
uuaugauuugccacagauuggu

SEQ ID NO: 725484 - RNA, 22 nt, Human
ucugggagguguuuugagaacu

SEQ ID NO: 725485 - RNA, 22 nt, Human
aucaagaauugggagcuauuga

SEQ ID NO: 725486 - RNA, 18 nt, Human
cuuucagauggauaugcu

SEQ ID NO: 725487 - RNA, 22 nt, Human
guccuuggcacccaugugauuc

SEQ ID NO: 725488 - RNA, 22 nt, Human
uggauaaacucacuguaaguug

SEQ ID NO: 725489 - RNA, 22 nt, Human
gaaggcuggcuuucugagagca

SEQ ID NO: 725490 - RNA, 22 nt, Human
ccucuggccaucccccauuaag

SEQ ID NO: 725491 - RNA, 20 nt, Human
uucacagaggacucagguca

SEQ ID NO: 725492 - RNA, 22 nt, Human
cugggccucaugcacagagaug

SEQ ID NO: 725493 - RNA, 22 nt, Human
uuacagauggcaguuucuugag

SEQ ID NO: 725494 - RNA, 22 nt, Human
aaauagcacagcagcugaggcu

SEQ ID NO: 725495 - RNA, 22 nt, Human
ugaugaaaaccagaacucucau

SEQ ID NO: 725496 - RNA, 21 nt, Human
agguuccugagucaugccuua

SEQ ID NO: 725497 - RNA, 22 nt, Human
acaaaguccugguguauggcca

SEQ ID NO: 725498 - RNA, 22 nt, Human
uuggaauucaaguuguagcuua

SEQ ID NO: 725499 - RNA, 22 nt, Human
uuagcugagauuaagugaacuu

SEQ ID NO: 725500 - RNA, 22 nt, Human
cuaaaugauggauuuaaacuuu

SEQ ID NO: 725501 - RNA, 22 nt, Human
auaugcuuacagcuuaaaaucc

SEQ ID NO: 725502 - RNA, 22 nt, Human
uuuggucuuggauuuaucagug

SEQ ID NO: 725503 - RNA, 22 nt, Human
agcuguucccucacugcaguca

SEQ ID NO: 725504 - RNA, 22 nt, Human
ucugcugacauuuaugaauaga

SEQ ID NO: 725505 - RNA, 22 nt, Human
cuccuggccacguucuugcugg

SEQ ID NO: 725506 - RNA, 22 nt, Human
aggcucugguuggcaaguaaag

SEQ ID NO: 725507 - RNA, 22 nt, Human
caguuuuauacacugcagcucc

SEQ ID NO: 725508 - RNA, 22 nt, Human
aaagaagguagggcuggugacu

SEQ ID NO: 725509 - RNA, 20 nt, Human
caucaucacaugagccaauu

SEQ ID NO: 725510 - RNA, 22 nt, Human
cuauuagacacaauuagugauu

SEQ ID NO: 725511 - RNA, 22 nt, Human
cagcugccuguauuguccucau

SEQ ID NO: 725512 - RNA, 22 nt, Human
agggggcuccuccggugcuucc

SEQ ID NO: 725513 - RNA, 22 nt, Human
ucauuguuucugcuuuucauga

SEQ ID NO: 725514 - RNA, 22 nt, Human
ugugggaaugacgaggaagagg

SEQ ID NO: 725515 - RNA, 19 nt, Human
uugcagcaaaguuaggacc

SEQ ID NO: 725516 - RNA, 22 nt, Human
cauucccaugacuccugcucag

SEQ ID NO: 725517 - RNA, 22 nt, Human
caggugggagcggagacugauu

SEQ ID NO: 725518 - RNA, 19 nt, Human
gcuuuaguuuacucaucua

SEQ ID NO: 725519 - RNA, 22 nt, Human
gggauggacuuggggacuccag

SEQ ID NO: 725520 - RNA, 22 nt, Human
ugucuucaguaaaauacacuau

SEQ ID NO: 725521 - RNA, 22 nt, Human
agugcauuugggguaguggaag

SEQ ID NO: 725522 - RNA, 22 nt, Human
uaggcuccucucacauucuauu

SEQ ID NO: 725523 - RNA, 22 nt, Human
ugccugggaucugugcccuuug

SEQ ID NO: 725524 - RNA, 22 nt, Human
ggcugccucaaagcucaagcuc

SEQ ID NO: 725525 - RNA, 22 nt, Human
caggaacuggaacccuggccga

SEQ ID NO: 725526 - RNA, 22 nt, Human
cccuaggcugaggccagggugc

SEQ ID NO: 725527 - RNA, 22 nt, Human
ugaccuuucuuugagauuccug

SEQ ID NO: 725528 - RNA, 22 nt, Human
cuggagggaguuaggacccgga

SEQ ID NO: 725529 - RNA, 22 nt, Human
ugagcccuggagcccucuguua

SEQ ID NO: 725530 - RNA, 22 nt, Human
cugagagcaucgcuggagauag

SEQ ID NO: 725531 - RNA, 22 nt, Human
uguaguagcauucacgaagugu

SEQ ID NO: 725532 - RNA, 19 nt, Human
gcucagagggcccugugcu

SEQ ID NO: 725533 - RNA, 22 nt, Human
gccugcagauauauaggauggu

SEQ ID NO: 725534 - RNA, 22 nt, Human
ugucugcugaugucacauagcc

SEQ ID NO: 725535 - RNA, 22 nt, Human
uuauccugguggccccuaaauc

SEQ ID NO: 725536 - RNA, 22 nt, Human
acgcaguuuguggacauuuuuu

SEQ ID NO: 725537 - RNA, 22 nt, Human
gcugccuuuagggggugcucag

SEQ ID NO: 725538 - RNA, 22 nt, Human
cagugggauaugggggcagcau

SEQ ID NO: 725539 - RNA, 22 nt, Human
gcaggaggaucacuugagccca

SEQ ID NO: 725540 - RNA, 21 nt, Human
uaagcuaaacauucaguuaac

SEQ ID NO: 725541 - RNA, 22 nt, Human
gcagagaaggauugaaaccaga

SEQ ID NO: 725542 - RNA, 20 nt, Human
ugggagaugaucuccuugcu

SEQ ID NO: 725543 - RNA, 22 nt, Human
auucuuggcaaggagauuuaaa

SEQ ID NO: 725544 - RNA, 22 nt, Human
ugcccacuucaaaaucuucauu

SEQ ID NO: 725545 - RNA, 22 nt, Human
uuucugaaaucucuuuugagga

SEQ ID NO: 725546 - RNA, 20 nt, Human
uguauucuuugcucuccacu

SEQ ID NO: 725547 - RNA, 22 nt, Human
ugacaaacucuuugagaacaag

SEQ ID NO: 725548 - RNA, 22 nt, Human
ggaagcugaggcccagugaagg

SEQ ID NO: 725549 - RNA, 22 nt, Human
uuggaggaugcaaugagggagu

SEQ ID NO: 725550 - RNA, 22 nt, Human
gcacuagagcagcucucagaga

SEQ ID NO: 725551 - RNA, 21 nt, Human
gggcucuccugaggccaugaa

SEQ ID NO: 725552 - RNA, 20 nt, Human
aggcuuggcuuggcaggaac

SEQ ID NO: 725553 - RNA, 22 nt, Human
caugcauuucuaccaaggaaua

SEQ ID NO: 725554 - RNA, 22 nt, Human
aaguucuagagguugauuuggu

SEQ ID NO: 725555 - RNA, 22 nt, Human
gggcuggaggugagcaggacag

SEQ ID NO: 725556 - RNA, 22 nt, Human
uuaacagagaacauagaaguag

SEQ ID NO: 725557 - RNA, 22 nt, Human
ugcuggaaaaaucauuugcuuu

SEQ ID NO: 725558 - RNA, 22 nt, Human
cacagguuagguauuauacuau

SEQ ID NO: 725559 - RNA, 19 nt, Human
auaaggcagugacuuuuuu

SEQ ID NO: 725560 - RNA, 22 nt, Human
cuggcagcccaaccuagagucu

SEQ ID NO: 725561 - RNA, 22 nt, Human
cuggccccuguggcuaaaauca

SEQ ID NO: 725562 - RNA, 22 nt, Human
acacugcucacuucuucccuug

SEQ ID NO: 725563 - RNA, 22 nt, Human
uuuaggaucucucuuguuacau

SEQ ID NO: 725564 - RNA, 22 nt, Human
aggaacacaacuuccugagagc

SEQ ID NO: 725565 - RNA, 22 nt, Human
cagaaauggagcccaggaaucu

SEQ ID NO: 725566 - RNA, 22 nt, Human
agauuuuggcuggcuggagaga

SEQ ID NO: 725567 - RNA, 22 nt, Human
ugagagaggaugcccucauauu

SEQ ID NO: 725568 - RNA, 22 nt, Human
caaggcagcccgcugaaccaca

SEQ ID NO: 725569 - RNA, 22 nt, Human
ccuggccacagggcucugcauu

SEQ ID NO: 725570 - RNA, 22 nt, Human
ucuggcagggucagggcccagg

SEQ ID NO: 725571 - RNA, 22 nt, Human
ugaagauuuucggguacuugau

SEQ ID NO: 725572 - RNA, 22 nt, Human
gcugccaugguccaggcuccag

SEQ ID NO: 725573 - RNA, 22 nt, Human
uaaaggauuuuguauaauauaa

SEQ ID NO: 725574 - RNA, 23 nt, Human
ugguccugccaacggugccccuc

SEQ ID NO: 725575 - RNA, 22 nt, Human
ugggcacuguagcuggugcugg

SEQ ID NO: 725576 - RNA, 22 nt, Human
gagucccaggaaugagcauagu

SEQ ID NO: 725577 - RNA, 22 nt, Human
gcaccagggagggugugcuuca

SEQ ID NO: 725578 - RNA, 23 nt, Human
agccacuucuaucuugcuccugg

SEQ ID NO: 725579 - RNA, 20 nt, Human
uacaaagagccccucucuuc

SEQ ID NO: 725580 - RNA, 22 nt, Human
auuacacauagacauucguuca

SEQ ID NO: 725581 - RNA, 22 nt, Human
aaagaaucuauauaucaccacc

SEQ ID NO: 725582 - RNA, 22 nt, Human
cuggccuuuaaaaugaccuuau

SEQ ID NO: 725583 - RNA, 22 nt, Human
gaagagagaacauuacauaaac

SEQ ID NO: 725584 - RNA, 22 nt, Human
ucagaggauugccucagcgagc

SEQ ID NO: 725585 - RNA, 22 nt, Human
uuaaggaaagccaaaaugaauu

SEQ ID NO: 725586 - RNA, 22 nt, Human
uauaacacucagaaagaaucau

SEQ ID NO: 725587 - RNA, 22 nt, Human
ucuggccccuggucucuggugu

SEQ ID NO: 725588 - RNA, 22 nt, Human
uuuacaaggcaguuauuuuccu

SEQ ID NO: 725589 - RNA, 22 nt, Human
uuucaauaacaaagcucauuuu

SEQ ID NO: 725590 - RNA, 16 nt, Human
uuucucucugcuauuu

SEQ ID NO: 725591 - RNA, 22 nt, Human
gacuuucugauguaaacauuua

SEQ ID NO: 725592 - RNA, 22 nt, Human
acagcaggcaugaaugacacug

SEQ ID NO: 725593 - RNA, 22 nt, Human
uaguaaaucucagaaaaagauc

SEQ ID NO: 725594 - RNA, 22 nt, Human
cucaaauauguggucagaaagc

SEQ ID NO: 725595 - RNA, 22 nt, Human
uggaauguuguguauaggucag

SEQ ID NO: 725596 - RNA, 22 nt, Human
uuacuuuugcaccaaacuaaua

SEQ ID NO: 725597 - RNA, 22 nt, Human
cucugcugguagcucauuccau

SEQ ID NO: 725598 - RNA, 22 nt, Human
uaaagcauaaugaauaucuaga

SEQ ID NO: 725599 - RNA, 22 nt, Human
agagaccagaauccagcugccu

SEQ ID NO: 725600 - RNA, 22 nt, Human
aaggcugguuuccuugauguuu

SEQ ID NO: 725601 - RNA, 22 nt, Human
ccuuuucuauguaccagcagug

SEQ ID NO: 725602 - RNA, 22 nt, Human
ugcccucccacauuauggcugu

SEQ ID NO: 725603 - RNA, 22 nt, Human
gccugcaggcuguaguuuguga

SEQ ID NO: 725604 - RNA, 22 nt, Human
gugggccaguuccucacaggua

SEQ ID NO: 725605 - RNA, 22 nt, Human
agcugguggaagggagcccaaa

SEQ ID NO: 725606 - RNA, 22 nt, Human
accagagagccuaggcugggca

SEQ ID NO: 725607 - RNA, 22 nt, Human
cccagcuggccagguggcuuug

SEQ ID NO: 725608 - RNA, 22 nt, Human
ccccugcuggccugcugguuuc

SEQ ID NO: 725609 - RNA, 22 nt, Human
uaugcacacaggcuuaauucau

SEQ ID NO: 725610 - RNA, 20 nt, Human
aaucacaguuaacucuuucu

SEQ ID NO: 725611 - RNA, 22 nt, Human
auggccagcaaguucagaauuu

SEQ ID NO: 725612 - RNA, 22 nt, Human
caugaaugcuggguucauguaa

SEQ ID NO: 725613 - RNA, 22 nt, Human
aacuccaggcagggaggccacu

SEQ ID NO: 725614 - RNA, 20 nt, Human
uuucugcagauguuuacaug

SEQ ID NO: 725615 - RNA, 19 nt, Human
cugaggugaggggcaucau

SEQ ID NO: 725616 - RNA, 22 nt, Human
ccaaagaaacccaagcucaggg

SEQ ID NO: 725617 - RNA, 22 nt, Human
cggcugagcagugcugauggaa

SEQ ID NO: 725618 - RNA, 22 nt, Human
aguuuaauuggaggcguggcuc

SEQ ID NO: 725619 - RNA, 22 nt, Human
ugcauuuauggaguuaccucau

SEQ ID NO: 725620 - RNA, 22 nt, Human
ccuuagcaaauuggcaucuucu

SEQ ID NO: 725621 - RNA, 22 nt, Human
gaucucugaaucugaagccuuc

SEQ ID NO: 725622 - RNA, 22 nt, Human
acaucauuucuaguuccuguca

SEQ ID NO: 725623 - RNA, 20 nt, Human
ccuguggagcugccuccucc

SEQ ID NO: 725624 - RNA, 22 nt, Human
uugaagaucuuugcauugcagg

SEQ ID NO: 725625 - RNA, 22 nt, Human
aacuguaagaaauaaaauucug

SEQ ID NO: 725626 - RNA, 22 nt, Human
cugaggccucacuguagucccu

SEQ ID NO: 725627 - RNA, 22 nt, Human
ggucagggggaucugugaggua

SEQ ID NO: 725628 - RNA, 22 nt, Human
agcuggggcugcagagaacagg

SEQ ID NO: 725629 - RNA, 22 nt, Human
auucagcaaacauuuauuaucu

SEQ ID NO: 725630 - RNA, 22 nt, Human
gccuggcugcuuagccuacuuc

SEQ ID NO: 725631 - RNA, 22 nt, Human
ugcugagguuguggagugcauu

SEQ ID NO: 725632 - RNA, 22 nt, Human
agccagagauccaucccuagga

SEQ ID NO: 725633 - RNA, 22 nt, Human
cauacauuuauacacaucuaug

SEQ ID NO: 725634 - RNA, 22 nt, Human
cugucuuuucuucucauugaug

SEQ ID NO: 725635 - RNA, 22 nt, Human
agcagggcaguuaaaggguccu

SEQ ID NO: 725636 - RNA, 22 nt, Human
uacacuguuuuuggaaagaaga

SEQ ID NO: 725637 - RNA, 22 nt, Human
caguauuuucaggauuuggaag

SEQ ID NO: 725638 - RNA, 22 nt, Human
caggcuggucccagagcauugc

SEQ ID NO: 725639 - RNA, 22 nt, Human
ucaucuuuaccccuugcuucaa

SEQ ID NO: 725640 - RNA, 22 nt, Human
gcuuucuggagccugggggaac

SEQ ID NO: 725641 - RNA, 22 nt, Human
uggccagugauuaaugacgcuu

SEQ ID NO: 725642 - RNA, 19 nt, Human
cucugccucccuccugggu

SEQ ID NO: 725643 - RNA, 22 nt, Human
uagucagacccaagagagccau

SEQ ID NO: 725644 - RNA, 22 nt, Human
uugauucugggcucauuucuuu

SEQ ID NO: 725645 - RNA, 22 nt, Human
uuuugugaauaguuuaucuaag

SEQ ID NO: 725646 - RNA, 22 nt, Human
cguccugggucugggaaggcau

SEQ ID NO: 725647 - RNA, 22 nt, Human
auuggcuugcacuguauuuuaa

SEQ ID NO: 725648 - RNA, 22 nt, Human
ggccuuugcguccacgccgcuu

SEQ ID NO: 725649 - RNA, 22 nt, Human
ugccuuuaaggaaucauucuug

SEQ ID NO: 725650 - RNA, 22 nt, Human
uccaaguccauuaugguggucu

SEQ ID NO: 725651 - RNA, 22 nt, Human
aagcagugacucucagaggcag

SEQ ID NO: 725652 - RNA, 21 nt, Human
cucuucaguggugagcucuuc

SEQ ID NO: 725653 - RNA, 22 nt, Human
uggcagcagggaggccaguguu

SEQ ID NO: 725654 - RNA, 22 nt, Human
ucugggaaaguaaauguaaagg

SEQ ID NO: 725655 - RNA, 22 nt, Human
gauuucagaagcaagaggaggu

SEQ ID NO: 725656 - RNA, 22 nt, Human
auuaucaaguuuacugugugga

SEQ ID NO: 725657 - RNA, 22 nt, Human
ggcagcagcaagguuggagcug

SEQ ID NO: 725658 - RNA, 22 nt, Human
ugggaggcagaaguugacugga

SEQ ID NO: 725659 - RNA, 19 nt, Human
gauauaaagagauggugaa

SEQ ID NO: 725660 - RNA, 21 nt, Human
aggcugugacuuacacuaucu

SEQ ID NO: 725661 - RNA, 22 nt, Human
acauauaugcgugggcucaugg

SEQ ID NO: 725662 - RNA, 22 nt, Human
caggaaguuguguguucgaggc

SEQ ID NO: 725663 - RNA, 22 nt, Human
aaugcuuuuacgacauguaccu

SEQ ID NO: 725664 - RNA, 22 nt, Human
ucugggaauaaaacuagggacu

SEQ ID NO: 725665 - RNA, 22 nt, Human
cugggagacgcagcuggggauc

SEQ ID NO: 725666 - RNA, 21 nt, Human
agagacagagaaaguaacauu

SEQ ID NO: 725667 - RNA, 22 nt, Human
ccauggaacucaguaaauuaua

SEQ ID NO: 725668 - RNA, 22 nt, Human
cacugagaguagggcacaagug

SEQ ID NO: 725669 - RNA, 22 nt, Human
agaggcuuccugccaccugaga

SEQ ID NO: 725670 - RNA, 22 nt, Human
ucuuggaaucuccauagaguga

SEQ ID NO: 725671 - RNA, 22 nt, Human
caagagcuggguggcaagcuag

SEQ ID NO: 725672 - RNA, 22 nt, Human
cagaagcauuccagcaaauagu

SEQ ID NO: 725673 - RNA, 22 nt, Human
ucuuggauuuuaauggaucaaa

SEQ ID NO: 725674 - RNA, 22 nt, Human
acauccauguuguaauguuccu

SEQ ID NO: 725675 - RNA, 22 nt, Human
gaggcaguuugccaugccagga

SEQ ID NO: 725676 - RNA, 22 nt, Human
gggagcugagcucugagccacg

SEQ ID NO: 725677 - RNA, 22 nt, Human
uuagaaagcuuuccauagucaa

SEQ ID NO: 725678 - RNA, 20 nt, Human
uucuucucuaguuaucuuca

SEQ ID NO: 725679 - RNA, 22 nt, Human
auucuccaucaccacuggcacu

SEQ ID NO: 725680 - RNA, 22 nt, Human
gacaaugugacagaccaaugau

SEQ ID NO: 725681 - RNA, 22 nt, Human
uccaggcaagggaggagcaugg

SEQ ID NO: 725682 - RNA, 22 nt, Human
cuggcccuugacuuacagcagg

SEQ ID NO: 725683 - RNA, 22 nt, Human
ucugaugucugaaaugcucuug

SEQ ID NO: 725684 - RNA, 22 nt, Human
auuucuuaucugaggucuacau

SEQ ID NO: 725685 - RNA, 22 nt, Human
cagaauguauaugaucuaaggu

SEQ ID NO: 725686 - RNA, 22 nt, Human
ccugccugaaggucagccaccc

SEQ ID NO: 725687 - RNA, 22 nt, Human
uuuggaauauuaaaaugucuca

SEQ ID NO: 725688 - RNA, 22 nt, Human
ucacuccucauugcugcccauu

SEQ ID NO: 725689 - RNA, 22 nt, Human
uuagaacuuaaacuucagaaag

SEQ ID NO: 725690 - RNA, 22 nt, Human
uuggaacuggaggaacaugcua

SEQ ID NO: 725691 - RNA, 22 nt, Human
uccaagaaguuucguuaaaugu

SEQ ID NO: 725692 - RNA, 22 nt, Human
ugggcaagucacuucugucuuu

SEQ ID NO: 725693 - RNA, 22 nt, Human
uacccagcaaucccuagagguu

SEQ ID NO: 725694 - RNA, 22 nt, Human
ugagcugucugaauggugagga

SEQ ID NO: 725695 - RNA, 22 nt, Human
aauauacuauacuacuuucugg

SEQ ID NO: 725696 - RNA, 22 nt, Human
uaaagcagugugguuguguccc

SEQ ID NO: 725697 - RNA, 22 nt, Human
gcucugugccacaugcaguguu

SEQ ID NO: 725698 - RNA, 22 nt, Human
cuccagccucagaugacgguac

SEQ ID NO: 725699 - RNA, 23 nt, Human
uuuaacuuuccaauaauucauug

SEQ ID NO: 725700 - RNA, 22 nt, Human
uuccaaaggaauggggagcuau

SEQ ID NO: 725701 - RNA, 22 nt, Human
cucugggacaucccuuggccua

SEQ ID NO: 725702 - RNA, 22 nt, Human
gaaaugcauaaucuuaguagau

SEQ ID NO: 725703 - RNA, 19 nt, Human
cugggcugaggucugccuu

SEQ ID NO: 725704 - RNA, 22 nt, Human
uuuaguauucucuauuuccauc

SEQ ID NO: 725705 - RNA, 22 nt, Human
agggagucaacacaguaauguu

SEQ ID NO: 725706 - RNA, 22 nt, Human
gcaguguuccuucuacuggggc

SEQ ID NO: 725707 - RNA, 22 nt, Human
uauauucuauuguaccucuccu

SEQ ID NO: 725708 - RNA, 22 nt, Human
aacugcaauuacuuuugcacca

SEQ ID NO: 725709 - RNA, 22 nt, Human
ggugcaugguggaggugacccu

SEQ ID NO: 725710 - RNA, 22 nt, Human
aucuuccaagcucccuggugua

SEQ ID NO: 725711 - RNA, 22 nt, Human
gcuccaggagagggaagcagau

SEQ ID NO: 725712 - RNA, 19 nt, Human
uccagacuguccaggcuau

SEQ ID NO: 725713 - RNA, 21 nt, Human
acugugauaaugcuuuuucug

SEQ ID NO: 725714 - RNA, 22 nt, Human
auucaaauuaaguuaauucagc

SEQ ID NO: 725715 - RNA, 22 nt, Human
gcagggcuguaauuugagccug

SEQ ID NO: 725716 - RNA, 22 nt, Human
uggagccugagucagcggaggc

SEQ ID NO: 725717 - RNA, 22 nt, Human
cuccccauccaggcagcaggug

SEQ ID NO: 725718 - RNA, 22 nt, Human
agacaugugguauaaucagggg

SEQ ID NO: 725719 - RNA, 22 nt, Human
gaugaaauucagaauugagggg

SEQ ID NO: 725720 - RNA, 21 nt, Human
agcucagcaagauggaggcuc

SEQ ID NO: 725721 - RNA, 22 nt, Human
uucuccgcuaaguucucugcag

SEQ ID NO: 725722 - RNA, 22 nt, Human
uuuaaccugucaauuugcaugc

SEQ ID NO: 725723 - RNA, 22 nt, Human
ucagaccauccugcuguuagug

SEQ ID NO: 725724 - RNA, 22 nt, Human
aauggcaugacuugcccaaggc

SEQ ID NO: 725725 - RNA, 22 nt, Human
guauuucugguaacugcugcua

SEQ ID NO: 725726 - RNA, 22 nt, Human
gagaauaaaucuaaaguuucuu

SEQ ID NO: 725727 - RNA, 22 nt, Human
gucauaaagacagaaacauucc

SEQ ID NO: 725728 - RNA, 22 nt, Human
cuuucacagccuucguucugaa

SEQ ID NO: 725729 - RNA, 22 nt, Human
gagaacugauuagcauuugcca

SEQ ID NO: 725730 - RNA, 22 nt, Human
aaagcaaucuaguuccaauucu

SEQ ID NO: 725731 - RNA, 22 nt, Human
caugccaugugugaggagagga

SEQ ID NO: 725732 - RNA, 22 nt, Human
uuuaagauucaguaaggcaaac

SEQ ID NO: 725733 - RNA, 22 nt, Human
uuuguauuuuucccagcuagcu

SEQ ID NO: 725734 - RNA, 22 nt, Human
ggcuuugguagacacagauuga

SEQ ID NO: 725735 - RNA, 22 nt, Human
uggacacacauguaugucagag

SEQ ID NO: 725736 - RNA, 22 nt, Human
acaguaccugcucucaagcaaa

SEQ ID NO: 725737 - RNA, 22 nt, Human
cuauacaguaaccacagugauu

SEQ ID NO: 725738 - RNA, 19 nt, Human
ugcuggaacaucaguagcu

SEQ ID NO: 725739 - RNA, 22 nt, Human
uuucaguguaucuuccaaaagc

SEQ ID NO: 725740 - RNA, 19 nt, Human
cacuuuauuucuguuuugu

SEQ ID NO: 725741 - RNA, 21 nt, Human
augugugcuagaggacuacug

SEQ ID NO: 725742 - RNA, 22 nt, Human
uucucuccaguccuggauucug

SEQ ID NO: 725743 - RNA, 22 nt, Human
cagcagacuggaguaggcagug

SEQ ID NO: 725744 - RNA, 21 nt, Human
aggcuuggaucuagacaggcc

SEQ ID NO: 725745 - RNA, 22 nt, Human
augcccuggggcuaccucugag

SEQ ID NO: 725746 - RNA, 22 nt, Human
uucagggcuuagggaaauagug

SEQ ID NO: 725747 - RNA, 22 nt, Human
ggguccaggucuucaggcagag

SEQ ID NO: 725748 - RNA, 22 nt, Human
gcauuucuuccuggugugagcc

SEQ ID NO: 725749 - RNA, 22 nt, Human
ggcggggucugagcgccgcgcc

SEQ ID NO: 725750 - RNA, 22 nt, Human
uacuuuauauuguggcuggcca

SEQ ID NO: 725751 - RNA, 22 nt, Human
gggccccaagaaccuccuccug

SEQ ID NO: 725752 - RNA, 19 nt, Human
uuucugcagcucagagaag

SEQ ID NO: 725753 - RNA, 22 nt, Human
aauuauguagccauaugaaaca

SEQ ID NO: 725754 - RNA, 22 nt, Human
uuagcugcauuaucaaaguuau

SEQ ID NO: 725755 - RNA, 22 nt, Human
uuagaaagggugucugaaucug

SEQ ID NO: 725756 - RNA, 19 nt, Human
ucuugaugagguuucucca

SEQ ID NO: 725757 - RNA, 22 nt, Human
guagggacaauauguuauuaga

SEQ ID NO: 725758 - RNA, 22 nt, Human
cugucuggaaugcaguacauag

SEQ ID NO: 725759 - RNA, 22 nt, Human
cugcugguuagucuuaguggga

SEQ ID NO: 725760 - RNA, 22 nt, Human
cucagaaaucccacucugugua

SEQ ID NO: 725761 - RNA, 22 nt, Human
uggaagaaggcagagaggcauu

SEQ ID NO: 725762 - RNA, 22 nt, Human
ccagccugaaaugccucauccu

SEQ ID NO: 725763 - RNA, 22 nt, Human
uccuggccaaguuacucucugc

SEQ ID NO: 725764 - RNA, 22 nt, Human
aagcugaggcccauggcaaggu

SEQ ID NO: 725765 - RNA, 22 nt, Human
ccaggaccuggagcucuaugaa

SEQ ID NO: 725766 - RNA, 22 nt, Human
guuccucaaaaaggagagcccc

SEQ ID NO: 725767 - RNA, 22 nt, Human
uccucagcauggaaucuggacu

SEQ ID NO: 725768 - RNA, 22 nt, Human
gagcacaguguguugugauuuc

SEQ ID NO: 725769 - RNA, 22 nt, Human
guggccagagauuaaauagagu

SEQ ID NO: 725770 - RNA, 22 nt, Human
uaggcucagggcugggugacgg

SEQ ID NO: 725771 - RNA, 22 nt, Human
gggcuccaguuuggccaggaag

SEQ ID NO: 725772 - RNA, 22 nt, Human
cuccagugcccuccuugggggc

SEQ ID NO: 725773 - RNA, 22 nt, Human
cuggcccuggagggcugugcga

SEQ ID NO: 725774 - RNA, 22 nt, Human
uguacacauaucauuuguggga

SEQ ID NO: 725775 - RNA, 22 nt, Human
cagagguagaaggcaugcagug

SEQ ID NO: 725776 - RNA, 22 nt, Human
ugggagaagcagugggacagua

SEQ ID NO: 725777 - RNA, 22 nt, Human
agacccugguaaacacuccagg

SEQ ID NO: 725778 - RNA, 22 nt, Human
uucaguuugaauucuguagaac

SEQ ID NO: 725779 - RNA, 22 nt, Human
ugugugugaaccauugagggcu

SEQ ID NO: 725780 - RNA, 22 nt, Human
uggccacaguguccagcagcag

SEQ ID NO: 725781 - RNA, 22 nt, Human
cuguggcagggaagaggccaug

SEQ ID NO: 725782 - RNA, 22 nt, Human
ugucugugacagaccuuugcua

SEQ ID NO: 725783 - RNA, 22 nt, Human
ugucucuggcugcagccuguuc

SEQ ID NO: 725784 - RNA, 18 nt, Human
ggaaggaguggaccccag

SEQ ID NO: 725785 - RNA, 22 nt, Human
uccagccauaucuuguagcccu

SEQ ID NO: 725786 - RNA, 22 nt, Human
aaacaugaugccuguacuaaga

SEQ ID NO: 725787 - RNA, 22 nt, Human
cccuccagcucaaagcaaccgg

SEQ ID NO: 725788 - RNA, 22 nt, Human
uucuaugaagguaagauguacg

SEQ ID NO: 725789 - RNA, 22 nt, Human
uccaggccacgaccuccuggau

SEQ ID NO: 725790 - RNA, 22 nt, Human
ugcagggcaguuuguuucggca

SEQ ID NO: 725791 - RNA, 22 nt, Human
agauaugguuugcauaaauaag

SEQ ID NO: 725792 - RNA, 23 nt, Human
agauugaaguauugaccagagcu

SEQ ID NO: 725793 - RNA, 21 nt, Human
ccacuguagacucauucugag

SEQ ID NO: 725794 - RNA, 22 nt, Human
aaggguugaagauaaauaaggu

SEQ ID NO: 725795 - RNA, 22 nt, Human
gcugugaguggaguucugugcu

SEQ ID NO: 725796 - RNA, 21 nt, Human
uggcagcacccacacccucug

SEQ ID NO: 725797 - RNA, 23 nt, Human
aagaggaggcccugcucccgucc

SEQ ID NO: 725798 - RNA, 22 nt, Human
cuaguaaaucagaagcuguggg

SEQ ID NO: 725799 - RNA, 22 nt, Human
gauggcuuacagacaguuagga

SEQ ID NO: 725800 - RNA, 22 nt, Human
ugcaauuuucagaaauuccaaa

SEQ ID NO: 725801 - RNA, 22 nt, Human
ggugagaaagggauuccuguuc

SEQ ID NO: 725802 - RNA, 22 nt, Human
uggagacucugcaucugugaca

SEQ ID NO: 725803 - RNA, 22 nt, Human
gcuuugcuagcacugcgcuucc

SEQ ID NO: 725804 - RNA, 21 nt, Human
cagaucuguagguacuaccau

SEQ ID NO: 725805 - RNA, 22 nt, Human
cagauaaaauuaauauuaccaa

SEQ ID NO: 725806 - RNA, 22 nt, Human
acauuuguacauuggcaugucu

SEQ ID NO: 725807 - RNA, 22 nt, Human
caaagugcuggaauuacaggug

SEQ ID NO: 725808 - RNA, 22 nt, Human
guuauacacauuccuggugagg

SEQ ID NO: 725809 - RNA, 22 nt, Human
ucacccuuaguguacuaucaug

SEQ ID NO: 725810 - RNA, 22 nt, Human
caggcccuggcagggcugaguc

SEQ ID NO: 725811 - RNA, 22 nt, Human
gccuccuggccuuugcuccuca

SEQ ID NO: 725812 - RNA, 22 nt, Human
cuaggaaagacacagagaguuu

SEQ ID NO: 725813 - RNA, 20 nt, Human
accauaauguuaauuacaaa

SEQ ID NO: 725814 - RNA, 22 nt, Human
agaaaauauucauugagaggcu

SEQ ID NO: 725815 - RNA, 22 nt, Human
aauucugaugauacugcauugu

SEQ ID NO: 725816 - RNA, 22 nt, Human
agugggggccaacgagggcagc

SEQ ID NO: 725817 - RNA, 22 nt, Human
guuuacaacaucuuguccuuca

SEQ ID NO: 725818 - RNA, 22 nt, Human
ugcuuuauaacuuaguuuaugg

SEQ ID NO: 725819 - RNA, 22 nt, Human
agcagaacauuuucagggcugu

SEQ ID NO: 725820 - RNA, 22 nt, Human
acagauauuaugguuucuccuu

SEQ ID NO: 725821 - RNA, 22 nt, Human
agcugcccagauaggaggaggc

SEQ ID NO: 725822 - RNA, 22 nt, Human
ucacguuuuacugagugagaua

SEQ ID NO: 725823 - RNA, 22 nt, Human
ccugggagccgacugacugugc

SEQ ID NO: 725824 - RNA, 21 nt, Human
cgcagagcgaacuugcggcgc

SEQ ID NO: 725825 - RNA, 22 nt, Human
cucuguccuccaccugcuuuca

SEQ ID NO: 725826 - RNA, 22 nt, Human
cugaggccccucuugugagcau

SEQ ID NO: 725827 - RNA, 18 nt, Human
ugaccugcgcuucacggu

SEQ ID NO: 725828 - RNA, 22 nt, Human
gcugaggacaucauggaaggaa

SEQ ID NO: 725829 - RNA, 23 nt, Human
agcagggccagaauacuugcugu

SEQ ID NO: 725830 - RNA, 22 nt, Human
gggggcagaauguacucuuguc

SEQ ID NO: 725831 - RNA, 22 nt, Human
aaacccauggcugauaucacua

SEQ ID NO: 725832 - RNA, 22 nt, Human
aguaaacauuucagauuuauuu

SEQ ID NO: 725833 - RNA, 22 nt, Human
agaauccugaugaaaaggagag

SEQ ID NO: 725834 - RNA, 22 nt, Human
ugaaucaaugaauugcacuuca

SEQ ID NO: 725835 - RNA, 22 nt, Human
gagggaugguaguugacacuga

SEQ ID NO: 725836 - RNA, 22 nt, Human
uucagcaaauggcuugagauaa

SEQ ID NO: 725837 - RNA, 22 nt, Human
agcagcagauccaaaaaaugug

SEQ ID NO: 725838 - RNA, 22 nt, Human
gggucagcucccuccccagggc

SEQ ID NO: 725839 - RNA, 22 nt, Human
uuccuuucacguuuuaaugcac

SEQ ID NO: 725840 - RNA, 22 nt, Human
uucaggaauaauuaucauauga

SEQ ID NO: 725841 - RNA, 22 nt, Human
cagcacaggccugucuuugucu

SEQ ID NO: 725842 - RNA, 22 nt, Human
gcugaguugaaagcagaggaua

SEQ ID NO: 725843 - RNA, 22 nt, Human
acucugagcaucccaagucuua

SEQ ID NO: 725844 - RNA, 22 nt, Human
auguucuuuggaauuuaugaaa

SEQ ID NO: 725845 - RNA, 22 nt, Human
guggugcauccuugaguaagcu

SEQ ID NO: 725846 - RNA, 22 nt, Human
caagacuucaccgcucugugcu

SEQ ID NO: 725847 - RNA, 22 nt, Human
gccuaauaacuagcuguguaac

SEQ ID NO: 725848 - RNA, 22 nt, Human
aaauagcuucuaagccuuuuga

SEQ ID NO: 725849 - RNA, 22 nt, Human
gcuuuacaaguggugcagauua

SEQ ID NO: 725850 - RNA, 19 nt, Human
guucuuuucaccucugugc

SEQ ID NO: 725851 - RNA, 22 nt, Human
uuguucuugccaagacaugaag

SEQ ID NO: 725852 - RNA, 22 nt, Human
cccucgcucuaggcagcccugu

SEQ ID NO: 725853 - RNA, 22 nt, Human
guucacaauggcuuuaccuaag

SEQ ID NO: 725854 - RNA, 18 nt, Human
gagguccugcucuagccc

SEQ ID NO: 725855 - RNA, 23 nt, Human
uccuaacugauucugcagucucu

SEQ ID NO: 725856 - RNA, 21 nt, Human
ugacauuuccaauauaaagcc

SEQ ID NO: 725857 - RNA, 22 nt, Human
gcuggccugaccagccacaggc

SEQ ID NO: 725858 - RNA, 20 nt, Human
gaacauuuggccauacugag

SEQ ID NO: 725859 - RNA, 18 nt, Human
acauuucuaugcuucugg

SEQ ID NO: 725860 - RNA, 22 nt, Human
ugcuggcucaguuugcagacuc

SEQ ID NO: 725861 - RNA, 22 nt, Human
gggcacuguacacugugcaugg

SEQ ID NO: 725862 - RNA, 22 nt, Human
aagugauucuagucaugauucu

SEQ ID NO: 725863 - RNA, 22 nt, Human
uggcucaaguaacaaaaauaua

SEQ ID NO: 725864 - RNA, 22 nt, Human
uuagcugaaaaaauucaugcaa

SEQ ID NO: 725865 - RNA, 22 nt, Human
uccuuaaaugaacucugcauga

SEQ ID NO: 725866 - RNA, 22 nt, Human
cucugccaccaugcuuccugac

SEQ ID NO: 725867 - RNA, 23 nt, Human
acagagaucuugacuuguaugga

SEQ ID NO: 725868 - RNA, 22 nt, Human
cagagccagcccacuguucccg

SEQ ID NO: 725869 - RNA, 22 nt, Human
acaggaaaugaaaugguaucua

SEQ ID NO: 725870 - RNA, 22 nt, Human
acauaccauacauggugagaug

SEQ ID NO: 725871 - RNA, 17 nt, Human
uuucccuccuuccacuc

SEQ ID NO: 725872 - RNA, 22 nt, Human
ccuucuagcaaaucaacauaaa

SEQ ID NO: 725873 - RNA, 22 nt, Human
aaaugcauucuguuuucacuag

SEQ ID NO: 725874 - RNA, 22 nt, Human
ucacugcucuccaauguggagu

SEQ ID NO: 725875 - RNA, 22 nt, Human
gcuucugcgcacgcuucuuccc

SEQ ID NO: 725876 - RNA, 22 nt, Human
aagcauuucaauauaauauuca

SEQ ID NO: 725877 - RNA, 22 nt, Human
ucacagaaagcuguguccugac

SEQ ID NO: 725878 - RNA, 22 nt, Human
acagcagugucugguacugagu

SEQ ID NO: 725879 - RNA, 23 nt, Human
aggaagaggcaauuucucuuaga

SEQ ID NO: 725880 - RNA, 22 nt, Human
ugaaucaugccacugagcuccc

SEQ ID NO: 725881 - RNA, 22 nt, Human
cucaggccuugaagucuuuucu

SEQ ID NO: 725882 - RNA, 21 nt, Human
agauccuggggucuggggagg

SEQ ID NO: 725883 - RNA, 22 nt, Human
acagauggccauauuacuauau

SEQ ID NO: 725884 - RNA, 22 nt, Human
aucugaggguuugggcaucagc

SEQ ID NO: 725885 - RNA, 22 nt, Human
auucugggcaagccuucuuaua

SEQ ID NO: 725886 - RNA, 22 nt, Human
auuguaaauagugccacaauaa

SEQ ID NO: 725887 - RNA, 22 nt, Human
uugaauaauuaauuacacucag

SEQ ID NO: 725888 - RNA, 22 nt, Human
uucauugaagcacaagugaucu

SEQ ID NO: 725889 - RNA, 22 nt, Human
ccagcuccugggucuuagucag

SEQ ID NO: 725890 - RNA, 22 nt, Human
aauaucagcucugucacuuacu

SEQ ID NO: 725891 - RNA, 22 nt, Human
ugagcuugcagugccagccuug

SEQ ID NO: 725892 - RNA, 22 nt, Human
aaagcagcacauggauaucagu

SEQ ID NO: 725893 - RNA, 22 nt, Human
acauucauugagcaacaacaau

SEQ ID NO: 725894 - RNA, 22 nt, Human
aagugugguuuaggcaucuuuu

SEQ ID NO: 725895 - RNA, 22 nt, Human
ugaguccagaugggccagcagg

SEQ ID NO: 725896 - RNA, 22 nt, Human
auacagaagccuguauuucugg

SEQ ID NO: 725897 - RNA, 22 nt, Human
uucaggauuguguuuuuccuga

SEQ ID NO: 725898 - RNA, 22 nt, Human
uccaggcuagguuuacaggaca

SEQ ID NO: 725899 - RNA, 22 nt, Human
guggguggacggugcuuuuguu

SEQ ID NO: 725900 - RNA, 22 nt, Human
auguuuuauuaccaacuuguac

SEQ ID NO: 725901 - RNA, 22 nt, Human
ugugccugcuagaugguugucg

SEQ ID NO: 725902 - RNA, 22 nt, Human
uggcccaggucucucugagccc

SEQ ID NO: 725903 - RNA, 22 nt, Human
gcuccuggagagauugagaaag

SEQ ID NO: 725904 - RNA, 22 nt, Human
ugugugggcgaagacagccuuu

SEQ ID NO: 725905 - RNA, 22 nt, Human
ggcguuucaccauguugaccag

SEQ ID NO: 725906 - RNA, 23 nt, Human
ggugguggugagucacgggcuca

SEQ ID NO: 725907 - RNA, 22 nt, Human
aagggacccuggaucaaaugga

SEQ ID NO: 725908 - RNA, 22 nt, Human
acuucucuuccccggaacucua

SEQ ID NO: 725909 - RNA, 22 nt, Human
acucucccugcuauccacuucc

SEQ ID NO: 725910 - RNA, 22 nt, Human
acacucacccucccacugccug

SEQ ID NO: 725911 - RNA, 22 nt, Human
cugcuccaguagccccaugugg

SEQ ID NO: 725912 - RNA, 22 nt, Human
uucucacaggcuggaaugauga

SEQ ID NO: 725913 - RNA, 21 nt, Human
cuguccaguaauuccuggcac

SEQ ID NO: 725914 - RNA, 22 nt, Human
aggucagcaugcuccucucugu

SEQ ID NO: 725915 - RNA, 22 nt, Human
cugaggugcuagggucccugcu

SEQ ID NO: 725916 - RNA, 22 nt, Human
cccuugggugccagccacaagu

SEQ ID NO: 725917 - RNA, 22 nt, Human
agcacagggacaaugccaggug

SEQ ID NO: 725918 - RNA, 22 nt, Human
cuuggaacaaauuaaacaauac

SEQ ID NO: 725919 - RNA, 22 nt, Human
uggcugugggauaugugacuga

SEQ ID NO: 725920 - RNA, 22 nt, Human
acacaguugauugucacucagg

SEQ ID NO: 725921 - RNA, 22 nt, Human
cccagcucugccaucuacccac

SEQ ID NO: 725922 - RNA, 22 nt, Human
cugaagagcucuccuguccccu

SEQ ID NO: 725923 - RNA, 22 nt, Human
auacaaaguauuaauccuggau

SEQ ID NO: 725924 - RNA, 18 nt, Human
aggccagcccugcuacug

SEQ ID NO: 725925 - RNA, 22 nt, Human
ucccaaaguauuagcauuucaa

SEQ ID NO: 725926 - RNA, 20 nt, Human
ucuguacacucaucuucugc

SEQ ID NO: 725927 - RNA, 22 nt, Human
ccaggccugauugggaaucuug

SEQ ID NO: 725928 - RNA, 22 nt, Human
cauugucugguaggaagugggc

SEQ ID NO: 725929 - RNA, 22 nt, Human
agagcacugagugagcaaggcc

SEQ ID NO: 725930 - RNA, 22 nt, Human
ucauugaagacuuacuggcuuc

SEQ ID NO: 725931 - RNA, 20 nt, Human
uuagaguuagcuguuaugca

SEQ ID NO: 725932 - RNA, 22 nt, Human
cccuaggguuuggccagagccc

SEQ ID NO: 725933 - RNA, 22 nt, Human
uagauuucgcugcaucucaauc

SEQ ID NO: 725934 - RNA, 22 nt, Human
uuuucauuguuccucgagcauu

SEQ ID NO: 725935 - RNA, 22 nt, Human
aguauguugaguuuugcuuuag

SEQ ID NO: 725936 - RNA, 22 nt, Human
cuggggcaucauccauucuuuc

SEQ ID NO: 725937 - RNA, 22 nt, Human
uggaggugagugugguacagca

SEQ ID NO: 725938 - RNA, 22 nt, Human
gcuaaauaaucuucuucugaca

SEQ ID NO: 725939 - RNA, 22 nt, Human
uuucuaaguguauugagcuugg

SEQ ID NO: 725940 - RNA, 18 nt, Human
uccagagcuggugcuucu

SEQ ID NO: 725941 - RNA, 22 nt, Human
cucucccuggccagcugugcag

SEQ ID NO: 725942 - RNA, 22 nt, Human
gaaagauaaucaauuacuccuu

SEQ ID NO: 725943 - RNA, 22 nt, Human
augcuuccaacaguucugugaa

SEQ ID NO: 725944 - RNA, 22 nt, Human
agauaaaaugauuuucuggauc

SEQ ID NO: 725945 - RNA, 22 nt, Human
auucuuuaguuggcuucuugcc

SEQ ID NO: 725946 - RNA, 22 nt, Human
cucagggucugguccuuagauu

SEQ ID NO: 725947 - RNA, 23 nt, Human
auauucacgccgccagagguccc

SEQ ID NO: 725948 - RNA, 22 nt, Human
uuguuuuaacgacucagcuugu

SEQ ID NO: 725949 - RNA, 22 nt, Human
aauguauuccucaugcaagagu

SEQ ID NO: 725950 - RNA, 22 nt, Human
cagguccuggcaucaggcaggu

SEQ ID NO: 725951 - RNA, 22 nt, Human
uuauuuggaaauauggcuucug

SEQ ID NO: 725952 - RNA, 22 nt, Human
aaucuguuuguuuacaccuuuu

SEQ ID NO: 725953 - RNA, 22 nt, Human
ugggccaggggccucuucugau

SEQ ID NO: 725954 - RNA, 22 nt, Human
acucagaaugacugaugcugug

SEQ ID NO: 725955 - RNA, 22 nt, Human
aggcucuggaguuagccaggca

SEQ ID NO: 725956 - RNA, 22 nt, Human
gccuggcugaggccucugcuaa

SEQ ID NO: 725957 - RNA, 22 nt, Human
cuucuuuugaagggcguugugu

SEQ ID NO: 725958 - RNA, 22 nt, Human
aguuguauuagagaacacaaac

SEQ ID NO: 725959 - RNA, 22 nt, Human
uagcuucagggaaaccacugcu

SEQ ID NO: 725960 - RNA, 23 nt, Human
aucucucuuuauucuuggggaua

SEQ ID NO: 725961 - RNA, 23 nt, Human
agcaggcaucuguggcacaaggc

SEQ ID NO: 725962 - RNA, 18 nt, Human
uguuuauucuccugacag

SEQ ID NO: 725963 - RNA, 22 nt, Human
acuuccaguuuuaauuaaauug

SEQ ID NO: 725964 - RNA, 20 nt, Human
acuggcagccugccugcugu

SEQ ID NO: 725965 - RNA, 22 nt, Human
ggcaagauccaaggggcuagga

SEQ ID NO: 725966 - RNA, 22 nt, Human
gacagaaucaucuccugggacu

SEQ ID NO: 725967 - RNA, 20 nt, Human
cuagccuggccuugcucugg

SEQ ID NO: 725968 - RNA, 22 nt, Human
aggaaggguggauaguaacgug

SEQ ID NO: 725969 - RNA, 22 nt, Human
uaugaaaugauggggaaaauag

SEQ ID NO: 725970 - RNA, 22 nt, Human
ugcugccuuagcagccaggcaa

SEQ ID NO: 725971 - RNA, 22 nt, Human
aaauguaagucuuuguuucuua

SEQ ID NO: 725972 - RNA, 22 nt, Human
augacaguacuggugacaauac

SEQ ID NO: 725973 - RNA, 22 nt, Human
cuuugugauaguguuaagacca

SEQ ID NO: 725974 - RNA, 22 nt, Human
aguggggaagagcaugggcccu

SEQ ID NO: 725975 - RNA, 22 nt, Human
cuggcagucugguggaaggccu

SEQ ID NO: 725976 - RNA, 22 nt, Human
gccagcugaagggaagcuccug

SEQ ID NO: 725977 - RNA, 22 nt, Human
gaguggguaccggagcaggugc

SEQ ID NO: 725978 - RNA, 22 nt, Human
ucaguguuuuuaaagcaauaua

SEQ ID NO: 725979 - RNA, 22 nt, Human
ugaggccuggacucugcaugga

SEQ ID NO: 725980 - RNA, 22 nt, Human
ucauggggugaauuaguaugcu

SEQ ID NO: 725981 - RNA, 22 nt, Human
cagcuacagaggccacauggcu

SEQ ID NO: 725982 - RNA, 22 nt, Human
cagcccaaagccccaggcuaga

SEQ ID NO: 725983 - RNA, 22 nt, Human
aacuuucagaauccuaugcauu

SEQ ID NO: 725984 - RNA, 22 nt, Human
aauaugcagcaugaugaaguaa

SEQ ID NO: 725985 - RNA, 22 nt, Human
agaauucuccuucagggcagga

SEQ ID NO: 725986 - RNA, 22 nt, Human
gcugggaaugauuuuggagagg

SEQ ID NO: 725987 - RNA, 19 nt, Human
agcuccuguucagcagcuc

SEQ ID NO: 725988 - RNA, 22 nt, Human
agaguuauauugguugagaauu

SEQ ID NO: 725989 - RNA, 22 nt, Human
uuacaacuggugaauuuuaugg

SEQ ID NO: 725990 - RNA, 21 nt, Human
guuuuaagggagaaaaccuag

SEQ ID NO: 725991 - RNA, 22 nt, Human
gucauuuaucaucagaagucau

SEQ ID NO: 725992 - RNA, 22 nt, Human
uuuccauguguacuggccagaa

SEQ ID NO: 725993 - RNA, 22 nt, Human
ccacagagacaggguccuugcu

SEQ ID NO: 725994 - RNA, 20 nt, Human
ugcucuggggguggagagac

SEQ ID NO: 725995 - RNA, 22 nt, Human
aacaguaucuuuuaucagaaau

SEQ ID NO: 725996 - RNA, 22 nt, Human
acuccaggauguagaaucagag

SEQ ID NO: 725997 - RNA, 22 nt, Human
gacaaccgagcagcugugggaa

SEQ ID NO: 725998 - RNA, 22 nt, Human
aggacacaccagguccagcugu

SEQ ID NO: 725999 - RNA, 22 nt, Human
uuccucaggcugcuuucacaua

SEQ ID NO: 726000 - RNA, 22 nt, Human
uugcaaggucaucaugcauugg

SEQ ID NO: 726001 - RNA, 22 nt, Human
ucaccuugugaucucccugccu

SEQ ID NO: 726002 - RNA, 22 nt, Human
aaucaagaguuguguaauauuu

SEQ ID NO: 726003 - RNA, 22 nt, Human
uucuccagaccuugugacuaug

SEQ ID NO: 726004 - RNA, 22 nt, Human
gguuucaacuucaaccucucca

SEQ ID NO: 726005 - RNA, 20 nt, Human
ggcugcccacuccagaguac

SEQ ID NO: 726006 - RNA, 22 nt, Human
gauuucagaguuuauuagguua

SEQ ID NO: 726007 - RNA, 22 nt, Human
agcagguggauuuagacgggag

SEQ ID NO: 726008 - RNA, 22 nt, Human
aggaggccuguuuucuccugga

SEQ ID NO: 726009 - RNA, 22 nt, Human
ggagauagacuuggugagccac

SEQ ID NO: 726010 - RNA, 22 nt, Human
gggugagggaugagccuucuuc

SEQ ID NO: 726011 - RNA, 22 nt, Human
cugaggggauaaagguuugggu

SEQ ID NO: 726012 - RNA, 22 nt, Human
ccucccauggagcucuguccau

SEQ ID NO: 726013 - RNA, 22 nt, Human
cagcugaacauguagagcaucu

SEQ ID NO: 726014 - RNA, 22 nt, Human
auucuuuuaagccccagggauu

SEQ ID NO: 726015 - RNA, 22 nt, Human
caggagcaaauccaaaagaauu

SEQ ID NO: 726016 - RNA, 21 nt, Human
cucugcagcccugcuuccagg

SEQ ID NO: 726017 - RNA, 22 nt, Human
gacaauaagaacagauacugug

SEQ ID NO: 726018 - RNA, 22 nt, Human
cuggaagaggaagccagcugga

SEQ ID NO: 726019 - RNA, 22 nt, Human
cugggcucagaugagaggaagg

SEQ ID NO: 726020 - RNA, 22 nt, Human
cugcaaggcuggggugagcugg

SEQ ID NO: 726021 - RNA, 22 nt, Human
caggcacugugcugagcucugc

SEQ ID NO: 726022 - RNA, 22 nt, Human
ucagaguccuuuggccugacag

SEQ ID NO: 726023 - RNA, 22 nt, Human
acguauauugaaauaucaugag

SEQ ID NO: 726024 - RNA, 22 nt, Human
ucuguagcuucuugagaggcca

SEQ ID NO: 726025 - RNA, 22 nt, Human
uccgaggccaaagcugugaaua

SEQ ID NO: 726026 - RNA, 22 nt, Human
uauuucugaggcccaggaagug

SEQ ID NO: 726027 - RNA, 22 nt, Human
ucugucugcucauuuaccucag

SEQ ID NO: 726028 - RNA, 22 nt, Human
acuuuguuuuauagcacauaag

SEQ ID NO: 726029 - RNA, 22 nt, Human
uccggguuuuacacucacauca

SEQ ID NO: 726030 - RNA, 22 nt, Human
cuuugcauacaauuuuuagaaa

SEQ ID NO: 726031 - RNA, 22 nt, Human
caggaccuggaaugcuugugaa

SEQ ID NO: 726032 - RNA, 22 nt, Human
uggaagugcucuucugaccaac

SEQ ID NO: 726033 - RNA, 22 nt, Human
aaucagaaagaucuugaugaga

SEQ ID NO: 726034 - RNA, 22 nt, Human
cuucuugcugggggccucagug

SEQ ID NO: 726035 - RNA, 22 nt, Human
gagccuggacaucucaggccca

SEQ ID NO: 726036 - RNA, 22 nt, Human
cacacauuccaaaaucaagggu

SEQ ID NO: 726037 - RNA, 22 nt, Human
ucccugggacucagacauggaa

SEQ ID NO: 726038 - RNA, 22 nt, Human
uguacauugucacucaucaagu

SEQ ID NO: 726039 - RNA, 22 nt, Human
aaaugcuugcaacaucccaggu

SEQ ID NO: 726040 - RNA, 20 nt, Human
gcccucagucuugucuuuau

SEQ ID NO: 726041 - RNA, 22 nt, Human
ggcuuguggcaaguguuuuaag

SEQ ID NO: 726042 - RNA, 22 nt, Human
guugcugcaaaggaguguaggu

SEQ ID NO: 726043 - RNA, 22 nt, Human
uucagacaaauuugaggaagcu

SEQ ID NO: 726044 - RNA, 22 nt, Human
cugguuccagaauugccugugg

SEQ ID NO: 726045 - RNA, 22 nt, Human
cuuaggaagcuuuugaggacaa

SEQ ID NO: 726046 - RNA, 22 nt, Human
cuccaggacacuaacccaggcu

SEQ ID NO: 726047 - RNA, 19 nt, Human
agacucugccacucuucuc

SEQ ID NO: 726048 - RNA, 22 nt, Human
uucacagggcagaucauuucug

SEQ ID NO: 726049 - RNA, 22 nt, Human
uuugagaaaaccagaaagaucu

SEQ ID NO: 726050 - RNA, 22 nt, Human
uggcucuguugugcugagccag

SEQ ID NO: 726051 - RNA, 20 nt, Human
cucuuuacaugucucuuccu

SEQ ID NO: 726052 - RNA, 22 nt, Human
aaaauauuuuagggccaggaga

SEQ ID NO: 726053 - RNA, 22 nt, Human
cagauacagguuuuuguuagau

SEQ ID NO: 726054 - RNA, 22 nt, Human
ccaggcuggagugcaauggugc

SEQ ID NO: 726055 - RNA, 22 nt, Human
uccaguacugaagcuccuucaa

SEQ ID NO: 726056 - RNA, 22 nt, Human
accugccagaauccaagccaca

SEQ ID NO: 726057 - RNA, 22 nt, Human
cuguggcucucagaggcugcug

SEQ ID NO: 726058 - RNA, 22 nt, Human
cagcagcuaccugcucuugugg

SEQ ID NO: 726059 - RNA, 22 nt, Human
aauuccacagaugucuaucugu

SEQ ID NO: 726060 - RNA, 22 nt, Human
cugaggucaauuaaucaacaac

SEQ ID NO: 726061 - RNA, 22 nt, Human
ugaguguauaugaagguuguaa

SEQ ID NO: 726062 - RNA, 22 nt, Human
agcgugaaggcgggcagucggc

SEQ ID NO: 726063 - RNA, 22 nt, Human
uugugaaacauucauggauuug

SEQ ID NO: 726064 - RNA, 22 nt, Human
ugcuaagcugaggaagaugaga

SEQ ID NO: 726065 - RNA, 22 nt, Human
ucagcuggaagauggugcagaa

SEQ ID NO: 726066 - RNA, 23 nt, Human
agcuccugaggccagccucuccu

SEQ ID NO: 726067 - RNA, 22 nt, Human
aaguucaauggaaaagcuuuag

SEQ ID NO: 726068 - RNA, 20 nt, Human
ccucaagcagacugacagcu

SEQ ID NO: 726069 - RNA, 22 nt, Human
ugucuguacaaauuuucugugu

SEQ ID NO: 726070 - RNA, 22 nt, Human
cugucgccugguccucucugga

SEQ ID NO: 726071 - RNA, 22 nt, Human
ucucuaaauacagaugucaugg

SEQ ID NO: 726072 - RNA, 22 nt, Human
cuguaugaaauuaaguaaacag

SEQ ID NO: 726073 - RNA, 22 nt, Human
cuggcucauccagguguugcuc

SEQ ID NO: 726074 - RNA, 22 nt, Human
uggcaucuccgacagucuugau

SEQ ID NO: 726075 - RNA, 16 nt, Human
agcagccagcacugga

SEQ ID NO: 726076 - RNA, 23 nt, Human
gggcaccaggagcaccggacagg

SEQ ID NO: 726077 - RNA, 18 nt, Human
uccaggacucugcguggc

SEQ ID NO: 726078 - RNA, 22 nt, Human
ccucagagaaaugucuauucaa

SEQ ID NO: 726079 - RNA, 22 nt, Human
uccaggagguagugcuuaauuu

SEQ ID NO: 726080 - RNA, 22 nt, Human
gacuacagauagccaauuaagu

SEQ ID NO: 726081 - RNA, 22 nt, Human
ggaagacaucugcuugcaccag

SEQ ID NO: 726082 - RNA, 22 nt, Human
gaguccaguuagugaggcuggg

SEQ ID NO: 726083 - RNA, 22 nt, Human
ccagaggcuggcaagggcuccu

SEQ ID NO: 726084 - RNA, 19 nt, Human
ucagggcaguccggucccc

SEQ ID NO: 726085 - RNA, 23 nt, Human
ucccagccucuucucuugcauac

SEQ ID NO: 726086 - RNA, 22 nt, Human
uagcacuauuuuucacuauccu

SEQ ID NO: 726087 - RNA, 22 nt, Human
ccugucacgaugacugcacucu

SEQ ID NO: 726088 - RNA, 22 nt, Human
ugggcugcggauaggccucgga

SEQ ID NO: 726089 - RNA, 22 nt, Human
cugccugcuuaccaugcaucag

SEQ ID NO: 726090 - RNA, 22 nt, Human
ccacagggacuguuaaaacccu

SEQ ID NO: 726091 - RNA, 22 nt, Human
ugaagauuuagaccucuuugcc

SEQ ID NO: 726092 - RNA, 22 nt, Human
ucucuuucuauugcaccaugcu

SEQ ID NO: 726093 - RNA, 23 nt, Human
uucauugauugcaaggagauugg

SEQ ID NO: 726094 - RNA, 22 nt, Human
gggcucagccccauugaaccag

SEQ ID NO: 726095 - RNA, 23 nt, Human
gcagcugguuagaagggaaggag

SEQ ID NO: 726096 - RNA, 22 nt, Human
guuuuauaauugcuucauaaga

SEQ ID NO: 726097 - RNA, 22 nt, Human
auggcuuggcaccaucuccuug

SEQ ID NO: 726098 - RNA, 22 nt, Human
cagcuucagacccugggcugca

SEQ ID NO: 726099 - RNA, 22 nt, Human
aaacuacugauuugugaauuga

SEQ ID NO: 726100 - RNA, 22 nt, Human
cugggccaugggccagcgaggc

SEQ ID NO: 726101 - RNA, 22 nt, Human
ugaggagcaggguggcuuacuc

SEQ ID NO: 726102 - RNA, 22 nt, Human
cagggccaagcugcagcaucug

SEQ ID NO: 726103 - RNA, 22 nt, Human
aggccagaguuaaggagaacag

SEQ ID NO: 726104 - RNA, 22 nt, Human
agcagaaccacagcacuguuga

SEQ ID NO: 726105 - RNA, 22 nt, Human
gaacagcuauaaucaucugucc

SEQ ID NO: 726106 - RNA, 22 nt, Human
aguucuucauaaccuuacugug

SEQ ID NO: 726107 - RNA, 22 nt, Human
gucugcccaucuccgggcgggg

SEQ ID NO: 726108 - RNA, 22 nt, Human
aaucacaggcauagauugcucc

SEQ ID NO: 726109 - RNA, 23 nt, Human
acuggacagaguggacgaggcug

SEQ ID NO: 726110 - RNA, 22 nt, Human
uguguacagcaggauuucucaa

SEQ ID NO: 726111 - RNA, 21 nt, Human
cuggagucuggggguggcagu

SEQ ID NO: 726112 - RNA, 23 nt, Human
aguacauucgaaaaauucuguga

SEQ ID NO: 726113 - RNA, 22 nt, Human
ugagcuaggugugcagauauga

SEQ ID NO: 726114 - RNA, 22 nt, Human
aggccgccuggggagaggcccu

SEQ ID NO: 726115 - RNA, 22 nt, Human
cuauucuguguauuuacuggcu

SEQ ID NO: 726116 - RNA, 22 nt, Human
caccagcuuugcccacugccca

SEQ ID NO: 726117 - RNA, 22 nt, Human
uccugggcgaguggugguacac

SEQ ID NO: 726118 - RNA, 22 nt, Human
aggcucagccccugggaggaga

SEQ ID NO: 726119 - RNA, 22 nt, Human
ggugggcaacauuuggccugag

SEQ ID NO: 726120 - RNA, 21 nt, Human
ugcuugcagaacuuucaggcu

SEQ ID NO: 726121 - RNA, 22 nt, Human
agugcuguuggauaaugcuguc

SEQ ID NO: 726122 - RNA, 22 nt, Human
uccauugucuuugguccuagcc

SEQ ID NO: 726123 - RNA, 22 nt, Human
acaguacaggacgaguuuuccu

SEQ ID NO: 726124 - RNA, 22 nt, Human
aauagcaaaguuaucaaauuaa

SEQ ID NO: 726125 - RNA, 22 nt, Human
ccagagguccccugccaggagg

SEQ ID NO: 726126 - RNA, 18 nt, Human
augaacacugagcugaau

SEQ ID NO: 726127 - RNA, 22 nt, Human
aguaacacuuggaaugauagca

SEQ ID NO: 726128 - RNA, 22 nt, Human
ucgggcucgcucuccuagcgga

SEQ ID NO: 726129 - RNA, 22 nt, Human
gguagcagggcugugagucaga

SEQ ID NO: 726130 - RNA, 22 nt, Human
gaagguuugaaauagguauaga

SEQ ID NO: 726131 - RNA, 22 nt, Human
gaagccagauuuggggcauauc

SEQ ID NO: 726132 - RNA, 22 nt, Human
gaggugggaugugugugcuacu

SEQ ID NO: 726133 - RNA, 22 nt, Human
auaaaggcagauuuuggaccuc

SEQ ID NO: 726134 - RNA, 22 nt, Human
uuuugcagccacaucugaccug

SEQ ID NO: 726135 - RNA, 22 nt, Human
acaaauuucauaggcaaauuuu

SEQ ID NO: 726136 - RNA, 21 nt, Human
aguuuucugaguuauaaaaua

SEQ ID NO: 726137 - RNA, 22 nt, Human
uuucagauuaucucaacuuugg

SEQ ID NO: 726138 - RNA, 22 nt, Human
aaagcuaucaucaaugcaacuu

SEQ ID NO: 726139 - RNA, 22 nt, Human
ccugcccagagccccuuucacu

SEQ ID NO: 726140 - RNA, 22 nt, Human
auugugcaaauauuaucuguag

SEQ ID NO: 726141 - RNA, 22 nt, Human
ucccacagaugcuguccagagu

SEQ ID NO: 726142 - RNA, 22 nt, Human
acuugaauucaaagcgaaagca

SEQ ID NO: 726143 - RNA, 22 nt, Human
cuguacauaugucuccagagug

SEQ ID NO: 726144 - RNA, 22 nt, Human
cuucaucaacucuaacaaaugu

SEQ ID NO: 726145 - RNA, 22 nt, Human
uuugaaaggaauuaggaugaca

SEQ ID NO: 726146 - RNA, 22 nt, Human
acauuuuuauccugagugccag

SEQ ID NO: 726147 - RNA, 22 nt, Human
aagaaggaaguguggacaucac

SEQ ID NO: 726148 - RNA, 22 nt, Human
ugcuauuagaagccaugcuguu

SEQ ID NO: 726149 - RNA, 22 nt, Human
gcaccugaggaggcaucuggag

SEQ ID NO: 726150 - RNA, 22 nt, Human
augggcucuaugucuaggagau

SEQ ID NO: 726151 - RNA, 22 nt, Human
ggucugagcuugagcccaugcu

SEQ ID NO: 726152 - RNA, 22 nt, Human
agccccuugugggcgcacagca

SEQ ID NO: 726153 - RNA, 22 nt, Human
ugggcauggacuguggagccgc

SEQ ID NO: 726154 - RNA, 22 nt, Human
aggcugugggugauuuacugug

SEQ ID NO: 726155 - RNA, 22 nt, Human
augaaagcaaauuauaggccau

SEQ ID NO: 726156 - RNA, 22 nt, Human
uaaacaucugucauguguuuau

SEQ ID NO: 726157 - RNA, 22 nt, Human
cugaagaugucugagaugcuca

SEQ ID NO: 726158 - RNA, 22 nt, Human
auuugcuuucagccuuaaggau

SEQ ID NO: 726159 - RNA, 22 nt, Human
ucugcaggagagugcccuagag

SEQ ID NO: 726160 - RNA, 22 nt, Human
caggaagcaucuggcuagcuaa

SEQ ID NO: 726161 - RNA, 22 nt, Human
ggccagaggccauccuccugcu

SEQ ID NO: 726162 - RNA, 22 nt, Human
agaauuuuugauuaucuacucg

SEQ ID NO: 726163 - RNA, 22 nt, Human
cacagaaucugugacuccaaga

SEQ ID NO: 726164 - RNA, 22 nt, Human
ccaccuccucggccaugugacg

SEQ ID NO: 726165 - RNA, 22 nt, Human
auggcugcucuggauggagucc

SEQ ID NO: 726166 - RNA, 22 nt, Human
cagaaauguuuguuaauauugu

SEQ ID NO: 726167 - RNA, 22 nt, Human
guagaagugaugucauguuaua

SEQ ID NO: 726168 - RNA, 22 nt, Human
ucacccagggacugugauggaa

SEQ ID NO: 726169 - RNA, 22 nt, Human
aggaaugucgucauaaacauga

SEQ ID NO: 726170 - RNA, 22 nt, Human
aguaugcauauuucaaaguaag

SEQ ID NO: 726171 - RNA, 22 nt, Human
cugggcccaggcggcucucgga

SEQ ID NO: 726172 - RNA, 22 nt, Human
uaagguuucuucagauacuagu

SEQ ID NO: 726173 - RNA, 22 nt, Human
uuacuuugcuuucucauuacag

SEQ ID NO: 726174 - RNA, 22 nt, Human
ggcucuggggaagcucucuuca

SEQ ID NO: 726175 - RNA, 22 nt, Human
ccucuccaguuuuaacgugacc

SEQ ID NO: 726176 - RNA, 22 nt, Human
ccucuuugacucucaggucuuu

SEQ ID NO: 726177 - RNA, 22 nt, Human
ugaggaggugggcacacagagu

SEQ ID NO: 726178 - RNA, 22 nt, Human
acugggagucaugaggaaggag

SEQ ID NO: 726179 - RNA, 20 nt, Human
gagcacaguaaugacugcua

SEQ ID NO: 726180 - RNA, 22 nt, Human
uuccaaguugagcgauuuuccu

SEQ ID NO: 726181 - RNA, 22 nt, Human
ucagcaaguggaccauccuggg

SEQ ID NO: 726182 - RNA, 19 nt, Human
uguggggagucagggggcu

SEQ ID NO: 726183 - RNA, 22 nt, Human
cuuccaaaauuuauauguugaa

SEQ ID NO: 726184 - RNA, 18 nt, Human
ucucuccaucuauuuguu

SEQ ID NO: 726185 - RNA, 22 nt, Human
aggcugucuuccucccucuugg

SEQ ID NO: 726186 - RNA, 22 nt, Human
uagagguguuguugauauagaa

SEQ ID NO: 726187 - RNA, 22 nt, Human
cuuguuuaaauaagauagcagu

SEQ ID NO: 726188 - RNA, 22 nt, Human
ugcugaggacuaaaggagauga

SEQ ID NO: 726189 - RNA, 22 nt, Human
uagaauaugauuaauuuucuua

SEQ ID NO: 726190 - RNA, 22 nt, Human
cuguuuucaaagagagagaaug

SEQ ID NO: 726191 - RNA, 22 nt, Human
aggcaucuauacauuauguuca

SEQ ID NO: 726192 - RNA, 22 nt, Human
acugagaacuugccaaggacug

SEQ ID NO: 726193 - RNA, 22 nt, Human
agccugggcaugggacgggagg

SEQ ID NO: 726194 - RNA, 22 nt, Human
uuuauuauccaguguugucaug

SEQ ID NO: 726195 - RNA, 22 nt, Human
ccuacauucucugaguuuuccu

SEQ ID NO: 726196 - RNA, 22 nt, Human
cccugugucuucuugccuuugu

SEQ ID NO: 726197 - RNA, 18 nt, Human
gaaaccugaggaagaaag

SEQ ID NO: 726198 - RNA, 22 nt, Human
gagccagagcuacaagugucug

SEQ ID NO: 726199 - RNA, 22 nt, Human
ugaaaugaucaguuugguuacu

SEQ ID NO: 726200 - RNA, 22 nt, Human
auauauuugagaauauucauga

SEQ ID NO: 726201 - RNA, 22 nt, Human
uauuugcuuugcuuuauagaga

SEQ ID NO: 726202 - RNA, 22 nt, Human
auauuuggaaagaaaaucauug

SEQ ID NO: 726203 - RNA, 22 nt, Human
gcuuggcuggaaauagguugag

SEQ ID NO: 726204 - RNA, 22 nt, Human
augggcaggcaagguggcgagu

SEQ ID NO: 726205 - RNA, 22 nt, Human
auucacaguauggacgaaauga

SEQ ID NO: 726206 - RNA, 22 nt, Human
cagguuggggacuuaggaugac

SEQ ID NO: 726207 - RNA, 22 nt, Human
aaaugugucaguuucauucucu

SEQ ID NO: 726208 - RNA, 22 nt, Human
aaaggucuuaagguuaagcagg

SEQ ID NO: 726209 - RNA, 22 nt, Human
ccucucucuuguagucccugcc

SEQ ID NO: 726210 - RNA, 22 nt, Human
aucucagagaaauuugaaugca

SEQ ID NO: 726211 - RNA, 22 nt, Human
agccacagugcaagagagaaaa

SEQ ID NO: 726212 - RNA, 22 nt, Human
aaaagcaguuaucugggaggaa

SEQ ID NO: 726213 - RNA, 22 nt, Human
uaagauuauacuuaaagagaaa

SEQ ID NO: 726214 - RNA, 22 nt, Human
acccuuuguccaauagaaauga

SEQ ID NO: 726215 - RNA, 22 nt, Human
uaaguucaaugaacucaguucu

SEQ ID NO: 726216 - RNA, 21 nt, Human
caagccagaccaauagcagcc

SEQ ID NO: 726217 - RNA, 22 nt, Human
gauacauuuuaucuccuaacag

SEQ ID NO: 726218 - RNA, 22 nt, Human
uccacaggcaagucucuuggca

SEQ ID NO: 726219 - RNA, 22 nt, Human
gacaggcccgaguagcugauga

SEQ ID NO: 726220 - RNA, 22 nt, Human
uggcagggucuugcuguguugc

SEQ ID NO: 726221 - RNA, 22 nt, Human
ugucauuuauuuugcugucugu

SEQ ID NO: 726222 - RNA, 22 nt, Human
uugaagaacauaauagcuacuu

SEQ ID NO: 726223 - RNA, 21 nt, Human
gguguccagaggaguccccag

SEQ ID NO: 726224 - RNA, 22 nt, Human
caggccaagccuccccagcucc

SEQ ID NO: 726225 - RNA, 22 nt, Human
auuaacagaauuuuacaugcuu

SEQ ID NO: 726226 - RNA, 22 nt, Human
gcccagggugaagugcaguugu

SEQ ID NO: 726227 - RNA, 22 nt, Human
cugugccaucuuuuugcuaccu

SEQ ID NO: 726228 - RNA, 22 nt, Human
ucugucacccagagugcagugg

SEQ ID NO: 726229 - RNA, 22 nt, Human
gaauggcuaucggauuauuagg

SEQ ID NO: 726230 - RNA, 22 nt, Human
cuacagcagagcuacacuaacu

SEQ ID NO: 726231 - RNA, 22 nt, Human
gaaugcuuggaaccugaaguuc

SEQ ID NO: 726232 - RNA, 22 nt, Human
ugguugccucucagagauuccg

SEQ ID NO: 726233 - RNA, 22 nt, Human
gucaggaucaaauugaaguuau

SEQ ID NO: 726234 - RNA, 22 nt, Human
gcauucuucacaguauuccucc

SEQ ID NO: 726235 - RNA, 22 nt, Human
ugcugcacaauuggaaaguauc

SEQ ID NO: 726236 - RNA, 22 nt, Human
ggcuggaaaagacaaagcuauu

SEQ ID NO: 726237 - RNA, 22 nt, Human
agcugccugugcugggagccca

SEQ ID NO: 726238 - RNA, 22 nt, Human
ucucugugagauuuguauuaag

SEQ ID NO: 726239 - RNA, 22 nt, Human
uauuaucauuaacuguugaauu

SEQ ID NO: 726240 - RNA, 22 nt, Human
ucaguguuuauucaauguuauu

SEQ ID NO: 726241 - RNA, 23 nt, Human
uugcauguagcccaugaguaacu

SEQ ID NO: 726242 - RNA, 22 nt, Human
acugugugacuguuauuacugu

SEQ ID NO: 726243 - RNA, 22 nt, Human
agucaacugcauuaggaaauga

SEQ ID NO: 726244 - RNA, 22 nt, Human
acagugugguuguuucugguua

SEQ ID NO: 726245 - RNA, 22 nt, Human
gccuggcccagggcucuuguug

SEQ ID NO: 726246 - RNA, 22 nt, Human
cugcugcuuagcauagcagagg

SEQ ID NO: 726247 - RNA, 22 nt, Human
uagcugacgcuaaauaaauguu

SEQ ID NO: 726248 - RNA, 21 nt, Human
gccagggaguuaaagagucuu

SEQ ID NO: 726249 - RNA, 22 nt, Human
uccagggagucaaaugaacuac

SEQ ID NO: 726250 - RNA, 22 nt, Human
acagcccaagucaccugcagga

SEQ ID NO: 726251 - RNA, 22 nt, Human
cccuguggaggcagcauccugc

SEQ ID NO: 726252 - RNA, 22 nt, Human
ggcagcucgaugacuucugcau

SEQ ID NO: 726253 - RNA, 22 nt, Human
caagggcuucaaguggccaaga

SEQ ID NO: 726254 - RNA, 20 nt, Human
augcauugugauucuguuuu

SEQ ID NO: 726255 - RNA, 22 nt, Human
acagaagaccagagagcuaacu

SEQ ID NO: 726256 - RNA, 16 nt, Human
ccucugggccugcaag

SEQ ID NO: 726257 - RNA, 22 nt, Human
gcagaaggucaaagcaagaugu

SEQ ID NO: 726258 - RNA, 22 nt, Human
cauuucacaaauggccacauca

SEQ ID NO: 726259 - RNA, 22 nt, Human
agaaaugaauauguagugguua

SEQ ID NO: 726260 - RNA, 22 nt, Human
cuucucugcaccccacuuuugc

SEQ ID NO: 726261 - RNA, 22 nt, Human
acacagaguuauuaugugaacu

SEQ ID NO: 726262 - RNA, 22 nt, Human
auggguaaggcugaaggaaagu

SEQ ID NO: 726263 - RNA, 22 nt, Human
agcaauaaauguaaagguuaag

SEQ ID NO: 726264 - RNA, 22 nt, Human
uggaaaauauuuaggugaauga

SEQ ID NO: 726265 - RNA, 22 nt, Human
aacaucuccaaccuacauccac

SEQ ID NO: 726266 - RNA, 22 nt, Human
agaaggguucaggaauauguua

SEQ ID NO: 726267 - RNA, 22 nt, Human
ucagugcucaggggagccgagg

SEQ ID NO: 726268 - RNA, 22 nt, Human
aacugcaagcucuuuacugcua

SEQ ID NO: 726269 - RNA, 16 nt, Human
ccccucaggaaguaca

SEQ ID NO: 726270 - RNA, 18 nt, Human
ggucuuuaggucaguguc

SEQ ID NO: 726271 - RNA, 22 nt, Human
aaaacauucugugaacucucaa

SEQ ID NO: 726272 - RNA, 20 nt, Human
gcuggugggggcuugacaug

SEQ ID NO: 726273 - RNA, 22 nt, Human
acaguccuagcugcaaagaagu

SEQ ID NO: 726274 - RNA, 22 nt, Human
gcaggaccaggcacgagggcca

SEQ ID NO: 726275 - RNA, 22 nt, Human
guacaguacuucagaaccagcc

SEQ ID NO: 726276 - RNA, 22 nt, Human
gccuggagccucagcaaggagg

SEQ ID NO: 726277 - RNA, 19 nt, Human
ugcucacucucagucccuc

SEQ ID NO: 726278 - RNA, 22 nt, Human
uggccacaugcgucugugaggc

SEQ ID NO: 726279 - RNA, 22 nt, Human
uacaaagauggaagguuauguu

SEQ ID NO: 726280 - RNA, 22 nt, Human
agggcugacacaccuuauccuc

SEQ ID NO: 726281 - RNA, 21 nt, Human
caaugucugcucucugccuag

SEQ ID NO: 726282 - RNA, 22 nt, Human
augcugugucaccuuaggauuu

SEQ ID NO: 726283 - RNA, 22 nt, Human
uuaaaccaccagaagccauuau

SEQ ID NO: 726284 - RNA, 22 nt, Human
cuggcuguggauuaucacaggc

SEQ ID NO: 726285 - RNA, 22 nt, Human
gccugggagcacaucggggucc

SEQ ID NO: 726286 - RNA, 22 nt, Human
uccagugguacauggagacacu

SEQ ID NO: 726287 - RNA, 22 nt, Human
ggcagcuuuuaucccugacaga

SEQ ID NO: 726288 - RNA, 22 nt, Human
acacacaaaucuauuagugaau

SEQ ID NO: 726289 - RNA, 22 nt, Human
ggggugugaguagagcugggga

SEQ ID NO: 726290 - RNA, 19 nt, Human
ggccuggauuuagggcucc

SEQ ID NO: 726291 - RNA, 22 nt, Human
ccaggagucaauaaaggaagcu

SEQ ID NO: 726292 - RNA, 22 nt, Human
ccaggcagagugcuccagaaag

SEQ ID NO: 726293 - RNA, 22 nt, Human
ccagcuuuucuuaucauuauaa

SEQ ID NO: 726294 - RNA, 22 nt, Human
accuucuggucugccugacagc

SEQ ID NO: 726295 - RNA, 22 nt, Human
gacugcuuauauguuaaagaua

SEQ ID NO: 726296 - RNA, 22 nt, Human
gaagacauuuuaugcauacucu

SEQ ID NO: 726297 - RNA, 22 nt, Human
acccacacaucucuaauucagu

SEQ ID NO: 726298 - RNA, 22 nt, Human
cuccaggcgggaggcgguucca

SEQ ID NO: 726299 - RNA, 22 nt, Human
agacaacugcagagcaaagaau

SEQ ID NO: 726300 - RNA, 22 nt, Human
uugacaggauauaaagacauaa

SEQ ID NO: 726301 - RNA, 22 nt, Human
aagcuggggacucagaccccau

SEQ ID NO: 726302 - RNA, 22 nt, Human
ugcaggcuauaucuuauuugac

SEQ ID NO: 726303 - RNA, 22 nt, Human
acucugagaaucccuggacuuu

SEQ ID NO: 726304 - RNA, 22 nt, Human
cccacucuggcucccuucuagu

SEQ ID NO: 726305 - RNA, 19 nt, Human
aggugagugugggaaaggg

SEQ ID NO: 726306 - RNA, 22 nt, Human
ugaacauauucaccucuaaaua

SEQ ID NO: 726307 - RNA, 22 nt, Human
aagccacugcagcaggagcugc

SEQ ID NO: 726308 - RNA, 22 nt, Human
cuugucuuuauuucauauucca

SEQ ID NO: 726309 - RNA, 22 nt, Human
ccagagguggugggugcuacag

SEQ ID NO: 726310 - RNA, 19 nt, Human
auggcuguguuccaguaaa

SEQ ID NO: 726311 - RNA, 22 nt, Human
uaguuuaugauuuuuuggaagg

SEQ ID NO: 726312 - RNA, 22 nt, Human
gaaagagaggggcugagaugca

SEQ ID NO: 726313 - RNA, 18 nt, Human
gucugccuucucccuucc

SEQ ID NO: 726314 - RNA, 16 nt, Human
guucucucacuguacc

SEQ ID NO: 726315 - RNA, 22 nt, Human
gcaauagauuaugaucuacagu

SEQ ID NO: 726316 - RNA, 22 nt, Human
gcccauggucagggaggcaggg

SEQ ID NO: 726317 - RNA, 22 nt, Human
gcugguagaccucacugcacuc

SEQ ID NO: 726318 - RNA, 22 nt, Human
cgucugcccgacuguucuucac

SEQ ID NO: 726319 - RNA, 22 nt, Human
agaaacaucauuggaacacaag

SEQ ID NO: 726320 - RNA, 22 nt, Human
cugccugcaggacaccucgcua

SEQ ID NO: 726321 - RNA, 22 nt, Human
agugaauacaugucacucagca

SEQ ID NO: 726322 - RNA, 22 nt, Human
acagagcaaugcguguucucua

SEQ ID NO: 726323 - RNA, 22 nt, Human
acauacaaauagagcuguagua

SEQ ID NO: 726324 - RNA, 22 nt, Human
guguggcuaccucagaggagca

SEQ ID NO: 726325 - RNA, 22 nt, Human
uuucacauggacuuuuuguucu

SEQ ID NO: 726326 - RNA, 19 nt, Human
cugguccugacugaggggu

SEQ ID NO: 726327 - RNA, 22 nt, Human
ugcaggugcuacaagaacucac

SEQ ID NO: 726328 - RNA, 22 nt, Human
cccaggcacauccacucuguga

SEQ ID NO: 726329 - RNA, 22 nt, Human
uguauacauuuaacuagauaga

SEQ ID NO: 726330 - RNA, 22 nt, Human
uacaugugguagggagggcagu

SEQ ID NO: 726331 - RNA, 22 nt, Human
gcuggccauucucuuugagaug

SEQ ID NO: 726332 - RNA, 22 nt, Human
uugaaucuuagcucugccacuu

SEQ ID NO: 726333 - RNA, 22 nt, Human
aaucuguugucaggaauccaca

SEQ ID NO: 726334 - RNA, 22 nt, Human
ugcugccaccugguggcugaag

SEQ ID NO: 726335 - RNA, 22 nt, Human
aaaugauggaaaugaggcugaa

SEQ ID NO: 726336 - RNA, 22 nt, Human
aauggcuucaugucuguggaaa

SEQ ID NO: 726337 - RNA, 22 nt, Human
gccuggcuggucacugccuggc

SEQ ID NO: 726338 - RNA, 22 nt, Human
uuccuuagauccuucaaucacg

SEQ ID NO: 726339 - RNA, 22 nt, Human
gaauucugucgcuuacuagaug

SEQ ID NO: 726340 - RNA, 22 nt, Human
agaggccagcccaggccaccga

SEQ ID NO: 726341 - RNA, 18 nt, Human
ugucucugaauuccagug

SEQ ID NO: 726342 - RNA, 22 nt, Human
aaagccacugcauguguaguau

SEQ ID NO: 726343 - RNA, 22 nt, Human
uggcagugugggaggaagguac

SEQ ID NO: 726344 - RNA, 22 nt, Human
gacccagcuuaagucacauguu

SEQ ID NO: 726345 - RNA, 22 nt, Human
guggagcuggacccaggccucu

SEQ ID NO: 726346 - RNA, 22 nt, Human
ccagcuuuuggggugacaauuu

SEQ ID NO: 726347 - RNA, 22 nt, Human
augucuuugccauaguucauau

SEQ ID NO: 726348 - RNA, 22 nt, Human
uugcuuuaggauuuaaguggca

SEQ ID NO: 726349 - RNA, 22 nt, Human
auggacagggcacaggcgcaga

SEQ ID NO: 726350 - RNA, 22 nt, Human
cuggcugaguuacuccacugag

SEQ ID NO: 726351 - RNA, 22 nt, Human
uauggguagaaguggcccaagc

SEQ ID NO: 726352 - RNA, 22 nt, Human
uccaucuggagacuuccugguc

SEQ ID NO: 726353 - RNA, 22 nt, Human
caucuuaacaggucucugaggg

SEQ ID NO: 726354 - RNA, 22 nt, Human
ccacagugguucucaaccaggg

SEQ ID NO: 726355 - RNA, 22 nt, Human
cagggaaacuaggaaauaagcu

SEQ ID NO: 726356 - RNA, 22 nt, Human
uaugaaauuuaaacacagauca

SEQ ID NO: 726357 - RNA, 22 nt, Human
uucugucugauggugccagaac

SEQ ID NO: 726358 - RNA, 22 nt, Human
ggcugggccgcggcuacccaga

SEQ ID NO: 726359 - RNA, 22 nt, Human
ccuguggcacaugcagggauuc

SEQ ID NO: 726360 - RNA, 22 nt, Human
gguggcagggagugucccuggg

SEQ ID NO: 726361 - RNA, 22 nt, Human
guuuccugcgugugccacucau

SEQ ID NO: 726362 - RNA, 22 nt, Human
caggucuggguugauggccugg

SEQ ID NO: 726363 - RNA, 19 nt, Human
agugcaugggcgaggugca

SEQ ID NO: 726364 - RNA, 22 nt, Human
gguucacagguccugggagcag

SEQ ID NO: 726365 - RNA, 22 nt, Human
gucauagguucaaaaggcagau

SEQ ID NO: 726366 - RNA, 22 nt, Human
ugucaaauuauguaaugggaag

SEQ ID NO: 726367 - RNA, 22 nt, Human
ucugcagaagaauuaaggacag

SEQ ID NO: 726368 - RNA, 22 nt, Human
auguucagcauucuauaaauau

SEQ ID NO: 726369 - RNA, 22 nt, Human
gaaaucugaacaacagcuguca

SEQ ID NO: 726370 - RNA, 22 nt, Human
cugggccugccaccaucuuagg

SEQ ID NO: 726371 - RNA, 22 nt, Human
agggggucuccuaucauggaag

SEQ ID NO: 726372 - RNA, 22 nt, Human
cucuuaaaaacuugauauauuu

SEQ ID NO: 726373 - RNA, 22 nt, Human
uagggccagauaggcuucuuga

SEQ ID NO: 726374 - RNA, 22 nt, Human
ucagaagccggaagugcuccuc

SEQ ID NO: 726375 - RNA, 22 nt, Human
cccccagucugaacagcagcug

SEQ ID NO: 726376 - RNA, 22 nt, Human
uggcgugcccuccagacuuggc

SEQ ID NO: 726377 - RNA, 22 nt, Human
aaguuuaacuugaauucuuucu

SEQ ID NO: 726378 - RNA, 22 nt, Human
gauagagacuauaaugcucuuu

SEQ ID NO: 726379 - RNA, 22 nt, Human
caugagauuugggaggggccag

SEQ ID NO: 726380 - RNA, 23 nt, Human
aucauucuccaaucuggagcagg

SEQ ID NO: 726381 - RNA, 19 nt, Human
agucugucugcuuucccuc

SEQ ID NO: 726382 - RNA, 22 nt, Human
auuucucuaagcauccguuugc

SEQ ID NO: 726383 - RNA, 22 nt, Human
cuuccuguuguauuugugagcc

SEQ ID NO: 726384 - RNA, 22 nt, Human
cacucugacacaugaacuugau

SEQ ID NO: 726385 - RNA, 22 nt, Human
uuguuuaagccacccaaucugu

SEQ ID NO: 726386 - RNA, 22 nt, Human
guguuuaacaucugguuuauac

SEQ ID NO: 726387 - RNA, 22 nt, Human
ggcccugcgauuagguggcagg

SEQ ID NO: 726388 - RNA, 22 nt, Human
cucagggaggcccugggacccu

SEQ ID NO: 726389 - RNA, 22 nt, Human
gccuccuggaagucacauguuu

SEQ ID NO: 726390 - RNA, 22 nt, Human
uccagcucuuguugcccacugc

SEQ ID NO: 726391 - RNA, 22 nt, Human
cacaauuuguauuuugcaucca

SEQ ID NO: 726392 - RNA, 22 nt, Human
ugcuggaauaauuucauguuaa

SEQ ID NO: 726393 - RNA, 22 nt, Human
guucccacuagacugcuacuua

SEQ ID NO: 726394 - RNA, 17 nt, Human
ugagcaguagaagaugc

SEQ ID NO: 726395 - RNA, 21 nt, Human
acagauauuucauugaacauu

SEQ ID NO: 726396 - RNA, 22 nt, Human
auuuccaagaaagcuuuaggau

SEQ ID NO: 726397 - RNA, 17 nt, Human
gcacagugauauuauuu

SEQ ID NO: 726398 - RNA, 22 nt, Human
gagcuucucaacaguuaucucu

SEQ ID NO: 726399 - RNA, 22 nt, Human
uggcucaucuuuuuagacuuau

SEQ ID NO: 726400 - RNA, 22 nt, Human
agggagaaaauuggaugcacaa

SEQ ID NO: 726401 - RNA, 22 nt, Human
ggaaccaggaguuacacgaguu

SEQ ID NO: 726402 - RNA, 22 nt, Human
cagucacauugcccugcauuua

SEQ ID NO: 726403 - RNA, 22 nt, Human
uuugggaauuguagcugucuug

SEQ ID NO: 726404 - RNA, 22 nt, Human
auccuugaaugacucugcccuc

SEQ ID NO: 726405 - RNA, 22 nt, Human
ugcagguggacacgggagacgg

SEQ ID NO: 726406 - RNA, 22 nt, Human
uguguuugaguccucacagugc

SEQ ID NO: 726407 - RNA, 22 nt, Human
auaaaguagcuuucagugccaa

SEQ ID NO: 726408 - RNA, 22 nt, Human
caaaggcaguuacugaaugaag

SEQ ID NO: 726409 - RNA, 22 nt, Human
ggggccccucggacacgugcgg

SEQ ID NO: 726410 - RNA, 22 nt, Human
ucagcacugauagaagucaaua

SEQ ID NO: 726411 - RNA, 22 nt, Human
cucuucccagcuccacgagagg

SEQ ID NO: 726412 - RNA, 22 nt, Human
ccaguccaggccauggauuuug

SEQ ID NO: 726413 - RNA, 22 nt, Human
gagccugaugaaacaggcagac

SEQ ID NO: 726414 - RNA, 22 nt, Human
uggugccuugggccuacagcgc

SEQ ID NO: 726415 - RNA, 22 nt, Human
agagcagacauccuugucuugu

SEQ ID NO: 726416 - RNA, 22 nt, Human
gaagccacccuccuuccagccc

SEQ ID NO: 726417 - RNA, 22 nt, Human
ucagcaaugagaacuggcauuu

SEQ ID NO: 726418 - RNA, 22 nt, Human
gcucucugcaagucagcagccu

SEQ ID NO: 726419 - RNA, 22 nt, Human
aaaggaagugccacucuucuuc

SEQ ID NO: 726420 - RNA, 22 nt, Human
uggacaacauagugagaccuca

SEQ ID NO: 726421 - RNA, 22 nt, Human
aggaagaggguggcagauaauc

SEQ ID NO: 726422 - RNA, 22 nt, Human
cuuguuauuggaaaugucaugc

SEQ ID NO: 726423 - RNA, 22 nt, Human
acacauggucuacuucuucuca

SEQ ID NO: 726424 - RNA, 22 nt, Human
cuagccugggauuugaacuuau

SEQ ID NO: 726425 - RNA, 22 nt, Human
cuucaaguugggcggcgggcag

SEQ ID NO: 726426 - RNA, 22 nt, Human
uccuagugcaaauuggagcaug

SEQ ID NO: 726427 - RNA, 20 nt, Human
gcuucauuugcaagucuagu

SEQ ID NO: 726428 - RNA, 22 nt, Human
uacagacagacuucccacccuc

SEQ ID NO: 726429 - RNA, 22 nt, Human
aaaggccacuugaaggauuuuu

SEQ ID NO: 726430 - RNA, 23 nt, Human
agccccucauggugucuagacag

SEQ ID NO: 726431 - RNA, 22 nt, Human
ggggagcuuagggucucugaau

SEQ ID NO: 726432 - RNA, 22 nt, Human
cuuuacaaauagggagggagug

SEQ ID NO: 726433 - RNA, 21 nt, Human
aauagcugaggucacccagcc

SEQ ID NO: 726434 - RNA, 22 nt, Human
cccagggucccugcucucugug

SEQ ID NO: 726435 - RNA, 22 nt, Human
ugaaauagacacagugcuauac

SEQ ID NO: 726436 - RNA, 22 nt, Human
uuuucuguuugcuucaagacau

SEQ ID NO: 726437 - RNA, 22 nt, Human
uagagcugggcagugcucugag

SEQ ID NO: 726438 - RNA, 20 nt, Human
gcacuguuacaaagcacacc

SEQ ID NO: 726439 - RNA, 22 nt, Human
ugaggcuggcaaggcugguauu

SEQ ID NO: 726440 - RNA, 22 nt, Human
auacagaucccacagcauguga

SEQ ID NO: 726441 - RNA, 22 nt, Human
uccuggccuugcgucuugggag

SEQ ID NO: 726442 - RNA, 22 nt, Human
uccuggcacauugcaggggcuc

SEQ ID NO: 726443 - RNA, 22 nt, Human
gcacaugagaagcuggcgaugc

SEQ ID NO: 726444 - RNA, 22 nt, Human
gggggcugaggcuguucugagg

SEQ ID NO: 726445 - RNA, 22 nt, Human
uauucccacuccucagcaauuu

SEQ ID NO: 726446 - RNA, 22 nt, Human
cacagggaggacaucaacagug

SEQ ID NO: 726447 - RNA, 22 nt, Human
auugaguacuuagugucauaua

SEQ ID NO: 726448 - RNA, 21 nt, Human
gccugcccucugugauggcca

SEQ ID NO: 726449 - RNA, 22 nt, Human
caccaggcuggagugcagaggu

SEQ ID NO: 726450 - RNA, 22 nt, Human
gaccaggaaagagugugacuaa

SEQ ID NO: 726451 - RNA, 22 nt, Human
cagagcuggagaaguggauuua

SEQ ID NO: 726452 - RNA, 22 nt, Human
cagcccugaguuagcccacgga

SEQ ID NO: 726453 - RNA, 22 nt, Human
aucuuugugaaucucaacuugg

SEQ ID NO: 726454 - RNA, 20 nt, Human
cugggcugggcuacaggguc

SEQ ID NO: 726455 - RNA, 22 nt, Human
cucucucuaugcguuguuccua

SEQ ID NO: 726456 - RNA, 22 nt, Human
auguuauucaauuugaauccaa

SEQ ID NO: 726457 - RNA, 18 nt, Human
uggcuucuauuuuacuca

SEQ ID NO: 726458 - RNA, 20 nt, Human
gucuuuauguuuuaugaccu

SEQ ID NO: 726459 - RNA, 21 nt, Human
acagagccgggcacaaagcug

SEQ ID NO: 726460 - RNA, 22 nt, Human
acccugcuuggccccacuucua

SEQ ID NO: 726461 - RNA, 22 nt, Human
cauuauggcagccaggauauug

SEQ ID NO: 726462 - RNA, 22 nt, Human
auuuggcaacauuaauugaauc

SEQ ID NO: 726463 - RNA, 22 nt, Human
augauguugauaaauuacuuua

SEQ ID NO: 726464 - RNA, 22 nt, Human
gacaguuuugcugaaauugagc

SEQ ID NO: 726465 - RNA, 22 nt, Human
cugcgugucucugucucauggc

SEQ ID NO: 726466 - RNA, 22 nt, Human
auauacuuccccauuauggggg

SEQ ID NO: 726467 - RNA, 22 nt, Human
cccagcuugucugauucagccu

SEQ ID NO: 726468 - RNA, 20 nt, Human
gggugugggcccggccaggc

SEQ ID NO: 726469 - RNA, 22 nt, Human
auucacaaguucuagggauuag

SEQ ID NO: 726470 - RNA, 22 nt, Human
ccugccugcaccuucucugggg

SEQ ID NO: 726471 - RNA, 22 nt, Human
ccauggaguuccucuggucuau

SEQ ID NO: 726472 - RNA, 22 nt, Human
gauaagcacuauauaaguauuu

SEQ ID NO: 726473 - RNA, 22 nt, Human
gcugaaaucccagcauucccca

SEQ ID NO: 726474 - RNA, 22 nt, Human
gaaguuauaaacuuuuccuccc

SEQ ID NO: 726475 - RNA, 22 nt, Human
gccuucccucucauccugcugg

SEQ ID NO: 726476 - RNA, 22 nt, Human
ggaacauuuaaauucuuauuug

SEQ ID NO: 726477 - RNA, 22 nt, Human
agacacaguauaagcacaacaa

SEQ ID NO: 726478 - RNA, 22 nt, Human
cuccgcagcgggccaauccgga

SEQ ID NO: 726479 - RNA, 22 nt, Human
guggccagaaguuaagugguua

SEQ ID NO: 726480 - RNA, 22 nt, Human
uguuaacuuccuccuccucugc

SEQ ID NO: 726481 - RNA, 20 nt, Human
agaaaaaguguggaaauuuc

SEQ ID NO: 726482 - RNA, 22 nt, Human
acauacauaugacaacuuuccu

SEQ ID NO: 726483 - RNA, 22 nt, Human
gcugcccaggaagccugggguu

SEQ ID NO: 726484 - RNA, 22 nt, Human
ugauaacucucaguuucucaug

SEQ ID NO: 726485 - RNA, 22 nt, Human
gccuguucuccagcauccaggu

SEQ ID NO: 726486 - RNA, 22 nt, Human
uggcaguguugugccacauucc

SEQ ID NO: 726487 - RNA, 22 nt, Human
uccucaggagagcuccuaugcc

SEQ ID NO: 726488 - RNA, 22 nt, Human
gaugauuucuccauucccuucu

SEQ ID NO: 726489 - RNA, 22 nt, Human
cugccgaguacagccauagaaa

SEQ ID NO: 726490 - RNA, 22 nt, Human
uguaaugagaaagagagugaau

SEQ ID NO: 726491 - RNA, 22 nt, Human
ugguuaguguauauuuggacug

SEQ ID NO: 726492 - RNA, 22 nt, Human
aauguuuuguaugccucugagc

SEQ ID NO: 726493 - RNA, 22 nt, Human
uauaaaguuggggcugaaguaa

SEQ ID NO: 726494 - RNA, 22 nt, Human
acacuuugggcuggauaauuau

SEQ ID NO: 726495 - RNA, 22 nt, Human
uuauucuguauuucagguaugu

SEQ ID NO: 726496 - RNA, 22 nt, Human
guuuuucuagaaaucuccuccu

SEQ ID NO: 726497 - RNA, 22 nt, Human
cuagggaguggcagagcuggga

SEQ ID NO: 726498 - RNA, 22 nt, Human
guggcuuucauuucaggaugug

SEQ ID NO: 726499 - RNA, 22 nt, Human
ccuccagucaccuggaugagaa

SEQ ID NO: 726500 - RNA, 18 nt, Human
guccugagcucugcugua

SEQ ID NO: 726501 - RNA, 22 nt, Human
cagggacuacagccagcccucc

SEQ ID NO: 726502 - RNA, 22 nt, Human
ggggcggggcucugagaagcau

SEQ ID NO: 726503 - RNA, 22 nt, Human
auuaaggaagccuauucucucc

SEQ ID NO: 726504 - RNA, 22 nt, Human
uggcagaggcucugugauguug

SEQ ID NO: 726505 - RNA, 22 nt, Human
aaugucuacauucugaauucgu

SEQ ID NO: 726506 - RNA, 22 nt, Human
auuucaugugaagaagagauaa

SEQ ID NO: 726507 - RNA, 22 nt, Human
aguggcaauugacaacaaagga

SEQ ID NO: 726508 - RNA, 22 nt, Human
gugggaugcuuaggaucuugcc

SEQ ID NO: 726509 - RNA, 22 nt, Human
uucugcauuuaaaauauuacua

SEQ ID NO: 726510 - RNA, 22 nt, Human
ccaaagucugcauuuuaacaug

SEQ ID NO: 726511 - RNA, 22 nt, Human
agggcugaguggugcagucaaa

SEQ ID NO: 726512 - RNA, 22 nt, Human
cugaaaaauauguuuuggagaa

SEQ ID NO: 726513 - RNA, 22 nt, Human
gaaggcugucagagaggagggc

SEQ ID NO: 726514 - RNA, 19 nt, Human
gggcauggaugagcuuacc

SEQ ID NO: 726515 - RNA, 22 nt, Human
uucccugguuaaccauuuucug

SEQ ID NO: 726516 - RNA, 22 nt, Human
ucagagaauucucagaugacuc

SEQ ID NO: 726517 - RNA, 22 nt, Human
aaaucucagcccuuauuuuaga

SEQ ID NO: 726518 - RNA, 22 nt, Human
uggcucugggaaugggaagaug

SEQ ID NO: 726519 - RNA, 22 nt, Human
uucuucugccucccaccugaua

SEQ ID NO: 726520 - RNA, 22 nt, Human
cacgcacgcuggguggaggcgc

SEQ ID NO: 726521 - RNA, 22 nt, Human
cugucucagcaggaagucauca

SEQ ID NO: 726522 - RNA, 22 nt, Human
ccucaaaggccuggcaccagaa

SEQ ID NO: 726523 - RNA, 22 nt, Human
cucucugggaauauuuuauucu

SEQ ID NO: 726524 - RNA, 22 nt, Human
uuuuaaaggcuguaugaccaag

SEQ ID NO: 726525 - RNA, 22 nt, Human
ggggaccuuuccauuucugaga

SEQ ID NO: 726526 - RNA, 23 nt, Human
uaugagaauuaagugcgagugcc

SEQ ID NO: 726527 - RNA, 22 nt, Human
ggcaggcuuugagaaagagcau

SEQ ID NO: 726528 - RNA, 22 nt, Human
uccuucagauuccugcuucugg

SEQ ID NO: 726529 - RNA, 22 nt, Human
uccuccagagauuugaguuauu

SEQ ID NO: 726530 - RNA, 21 nt, Human
gaggacugcacacucugauug

SEQ ID NO: 726531 - RNA, 22 nt, Human
aacugcuugagauauguuuguc

SEQ ID NO: 726532 - RNA, 22 nt, Human
aacuguagcaaagaacagcucu

SEQ ID NO: 726533 - RNA, 22 nt, Human
gaaaccugguucugcgugaggg

SEQ ID NO: 726534 - RNA, 22 nt, Human
aguguuuaaacugaagugauga

SEQ ID NO: 726535 - RNA, 22 nt, Human
aacauguauuuuccuuggcaac

SEQ ID NO: 726536 - RNA, 22 nt, Human
aguggcagaguugaauaauuga

SEQ ID NO: 726537 - RNA, 22 nt, Human
uuuccacaauguuuuugcagga

SEQ ID NO: 726538 - RNA, 18 nt, Human
gagaagcugauugaaugc

SEQ ID NO: 726539 - RNA, 22 nt, Human
uuccucacacucccccauucga

SEQ ID NO: 726540 - RNA, 19 nt, Human
ucaugucucucaucuguga

SEQ ID NO: 726541 - RNA, 18 nt, Human
ggcugugcguggaggcug

SEQ ID NO: 726542 - RNA, 22 nt, Human
ugugaucucuauaggauucaau

SEQ ID NO: 726543 - RNA, 22 nt, Human
gcaauacucaacacuuuugcuu

SEQ ID NO: 726544 - RNA, 21 nt, Human
auacagaacauugauccaaga

SEQ ID NO: 726545 - RNA, 22 nt, Human
cuucacaugauguccgugcugu

SEQ ID NO: 726546 - RNA, 22 nt, Human
uuuuagacuccaucugauucag

SEQ ID NO: 726547 - RNA, 22 nt, Human
uguguauuaccauuuuacagcu

SEQ ID NO: 726548 - RNA, 21 nt, Human
ccagauccugcuuccucaccc

SEQ ID NO: 726549 - RNA, 22 nt, Human
cucuuauuccuacaguaacagg

SEQ ID NO: 726550 - RNA, 22 nt, Human
ggagguucucucuuugcagagc

SEQ ID NO: 726551 - RNA, 22 nt, Human
aggccucagugaucaucaucag

SEQ ID NO: 726552 - RNA, 22 nt, Human
ugaaauaggaaacagauguuuc

SEQ ID NO: 726553 - RNA, 22 nt, Human
cauuuuaagaugaccugguuuc

SEQ ID NO: 726554 - RNA, 22 nt, Human
aaauugcagaugcuaaaugacu

SEQ ID NO: 726555 - RNA, 20 nt, Human
ccugucucacguuccgcccc

SEQ ID NO: 726556 - RNA, 22 nt, Human
auguucuacagauggaaagggg

SEQ ID NO: 726557 - RNA, 22 nt, Human
aggcagugguguuugcuggugg

SEQ ID NO: 726558 - RNA, 22 nt, Human
gcugugagugagcugccuaggc

SEQ ID NO: 726559 - RNA, 22 nt, Human
guuucuaugguuuauauuacug

SEQ ID NO: 726560 - RNA, 22 nt, Human
cucuccugguguggaggacagg

SEQ ID NO: 726561 - RNA, 22 nt, Human
cucaaggacuuauucaugccug

SEQ ID NO: 726562 - RNA, 22 nt, Human
uacacaaucuguuuuuccauuu

SEQ ID NO: 726563 - RNA, 22 nt, Human
aaauugcucuuuaaaaguacug

SEQ ID NO: 726564 - RNA, 22 nt, Human
ggcuuggaaaugguaaugagcu

SEQ ID NO: 726565 - RNA, 22 nt, Human
cucuuaguaaugccaugaagca

SEQ ID NO: 726566 - RNA, 22 nt, Human
cuuccugcauugugccagaguu

SEQ ID NO: 726567 - RNA, 22 nt, Human
uccaggccacauggauggcgau

SEQ ID NO: 726568 - RNA, 22 nt, Human
ccaaggaggccccaggucagcu

SEQ ID NO: 726569 - RNA, 22 nt, Human
cuccagcuagggcuggcuuacu

SEQ ID NO: 726570 - RNA, 22 nt, Human
ggugguggagccagcugggagu

SEQ ID NO: 726571 - RNA, 22 nt, Human
ucugaaagagaguacauacagu

SEQ ID NO: 726572 - RNA, 19 nt, Human
ggggagaacuagagacagc

SEQ ID NO: 726573 - RNA, 22 nt, Human
aaaguucuggagaaaauaauga

SEQ ID NO: 726574 - RNA, 22 nt, Human
ucccuuggaaaguagccucaca

SEQ ID NO: 726575 - RNA, 22 nt, Human
cacgcauguggaucagaugaag

SEQ ID NO: 726576 - RNA, 22 nt, Human
cugggucuggccacaggaagua

SEQ ID NO: 726577 - RNA, 22 nt, Human
ccagaagaccccguccaccucc

SEQ ID NO: 726578 - RNA, 22 nt, Human
gcccaggagguggaggugcagu

SEQ ID NO: 726579 - RNA, 22 nt, Human
aaauggaucuuuuuauaaugca

SEQ ID NO: 726580 - RNA, 22 nt, Human
acugauuaugcguacucucuac

SEQ ID NO: 726581 - RNA, 22 nt, Human
ugucugagcuggggcagacaga

SEQ ID NO: 726582 - RNA, 22 nt, Human
cuuugcagugauuguucuugga

SEQ ID NO: 726583 - RNA, 22 nt, Human
agagggguuaagugcuaguccg

SEQ ID NO: 726584 - RNA, 22 nt, Human
uucaauaucauuguuuagucuc

SEQ ID NO: 726585 - RNA, 22 nt, Human
agcuccugugugaagccucccu

SEQ ID NO: 726586 - RNA, 22 nt, Human
ggagucuggaguggggcccaag

SEQ ID NO: 726587 - RNA, 22 nt, Human
agccaggcagacucucuuucuu

SEQ ID NO: 726588 - RNA, 22 nt, Human
gucauucaacugcacauuaggu

SEQ ID NO: 726589 - RNA, 22 nt, Human
cagaucaugggacugucucagc

SEQ ID NO: 726590 - RNA, 22 nt, Human
guuaagaacuuguugaaggucu

SEQ ID NO: 726591 - RNA, 22 nt, Human
gagaaaugcaugcaugucauca

SEQ ID NO: 726592 - RNA, 22 nt, Human
uaaguuuccagauuguaagucc

SEQ ID NO: 726593 - RNA, 22 nt, Human
gauuuauuuuuaaucagcaggg

SEQ ID NO: 726594 - RNA, 22 nt, Human
cacagguguucuugcagugaaa

SEQ ID NO: 726595 - RNA, 22 nt, Human
aggccaggaccauuagcccaga

SEQ ID NO: 726596 - RNA, 22 nt, Human
cuacacaguucugccuaauggc

SEQ ID NO: 726597 - RNA, 22 nt, Human
gaguguggaucccagaagcaga

SEQ ID NO: 726598 - RNA, 22 nt, Human
uagaugauggaaaaaagcaaua

SEQ ID NO: 726599 - RNA, 22 nt, Human
uaugagguauuacaggaaauau

SEQ ID NO: 726600 - RNA, 22 nt, Human
caccacuggaggucuuggcuuu

SEQ ID NO: 726601 - RNA, 22 nt, Human
uuacauguucucauacacagag

SEQ ID NO: 726602 - RNA, 22 nt, Human
guccucuugcucauuggggcag

SEQ ID NO: 726603 - RNA, 21 nt, Human
agagaauugccuuagauguuc

SEQ ID NO: 726604 - RNA, 22 nt, Human
agaucuuuugguuauuauaaga

SEQ ID NO: 726605 - RNA, 22 nt, Human
ucugucuuggccagccaucugg

SEQ ID NO: 726606 - RNA, 22 nt, Human
gucagaggggcagcugccaggc

SEQ ID NO: 726607 - RNA, 22 nt, Human
cuucuguguuaaaugagucuuu

SEQ ID NO: 726608 - RNA, 22 nt, Human
aaagcuagaaggaaauuuuaug

SEQ ID NO: 726609 - RNA, 18 nt, Human
gacccaggaaagaguccu

SEQ ID NO: 726610 - RNA, 22 nt, Human
guucugggucuggacacacaga

SEQ ID NO: 726611 - RNA, 22 nt, Human
ucugggucuuuacccauggaau

SEQ ID NO: 726612 - RNA, 22 nt, Human
cugaauauuagucaugucugau

SEQ ID NO: 726613 - RNA, 22 nt, Human
uuauugucaaaaacaggacacu

SEQ ID NO: 726614 - RNA, 22 nt, Human
ucccucagcaggaauguggcag

SEQ ID NO: 726615 - RNA, 22 nt, Human
ccugcucaccugauguggcaac

SEQ ID NO: 726616 - RNA, 22 nt, Human
augcuuggaugcugccauggga

SEQ ID NO: 726617 - RNA, 22 nt, Human
cacugcuuuucagacaguuauu

SEQ ID NO: 726618 - RNA, 19 nt, Human
gacuaaauaauaauagcag

SEQ ID NO: 726619 - RNA, 22 nt, Human
uugcaguagguggagugaauuu

SEQ ID NO: 726620 - RNA, 22 nt, Human
uccagccuccuauuuacccuaa

SEQ ID NO: 726621 - RNA, 19 nt, Human
ugggaaaguaacauacaaa

SEQ ID NO: 726622 - RNA, 22 nt, Human
uugcugagagcgugucaacaag

SEQ ID NO: 726623 - RNA, 21 nt, Human
auucuuugaugugcaauaagu

SEQ ID NO: 726624 - RNA, 22 nt, Human
caguuucuuaucuucaaaauug

SEQ ID NO: 726625 - RNA, 22 nt, Human
uucacagacuuuccauagauug

SEQ ID NO: 726626 - RNA, 22 nt, Human
aggcuggcuucccaagcguccu

SEQ ID NO: 726627 - RNA, 22 nt, Human
uacauugugucucuaucuaguc

SEQ ID NO: 726628 - RNA, 22 nt, Human
cagagccucucagccccuuggg

SEQ ID NO: 726629 - RNA, 22 nt, Human
auaaaaguaggaccaacuuaca

SEQ ID NO: 726630 - RNA, 22 nt, Human
ugacagacagcuucucauuuua

SEQ ID NO: 726631 - RNA, 22 nt, Human
aaugcacagcguuccaugcuug

SEQ ID NO: 726632 - RNA, 22 nt, Human
gucccaggggagcucucugauu

SEQ ID NO: 726633 - RNA, 22 nt, Human
uacugugggauguugugauuag

SEQ ID NO: 726634 - RNA, 22 nt, Human
uguacucagcucagaucucagg

SEQ ID NO: 726635 - RNA, 22 nt, Human
gagagguccauuccccugucag

SEQ ID NO: 726636 - RNA, 21 nt, Human
ucacagagccacagaauuggu

SEQ ID NO: 726637 - RNA, 22 nt, Human
cuuccugaagagguuggucagg

SEQ ID NO: 726638 - RNA, 22 nt, Human
caggguggcacucagcgcaucu

SEQ ID NO: 726639 - RNA, 22 nt, Human
aagugugucuugggaagggagg

SEQ ID NO: 726640 - RNA, 22 nt, Human
uucucuuagcuguaaagucaau

SEQ ID NO: 726641 - RNA, 22 nt, Human
gcuuuuucaaaugaaagcuggu

SEQ ID NO: 726642 - RNA, 22 nt, Human
uuucagacaugggggcaaacag

SEQ ID NO: 726643 - RNA, 22 nt, Human
aggaauuguguuguaguggaga

SEQ ID NO: 726644 - RNA, 17 nt, Human
ugguccagguggagcca

SEQ ID NO: 726645 - RNA, 22 nt, Human
uucccuccgaaccucagugcug

SEQ ID NO: 726646 - RNA, 22 nt, Human
gcaaguacaaacgcaucggcug

SEQ ID NO: 726647 - RNA, 22 nt, Human
acuggcugaaguuuacuuuuug

SEQ ID NO: 726648 - RNA, 22 nt, Human
aaggccuugccgaaggaugcca

SEQ ID NO: 726649 - RNA, 22 nt, Human
ggccuaggaaggggauguaacu

SEQ ID NO: 726650 - RNA, 22 nt, Human
aguccauaguuuacauuacagc

SEQ ID NO: 726651 - RNA, 22 nt, Human
ucccuuugaucacuaacagaac

SEQ ID NO: 726652 - RNA, 22 nt, Human
cucccacuccuggcucaccaca

SEQ ID NO: 726653 - RNA, 17 nt, Human
aguguggcccugguuaa

SEQ ID NO: 726654 - RNA, 22 nt, Human
agcacaaugugaaaagagcucu

SEQ ID NO: 726655 - RNA, 22 nt, Human
uccuucagcuuauuucuuagga

SEQ ID NO: 726656 - RNA, 22 nt, Human
gcauuauuaauagcugcaugag

SEQ ID NO: 726657 - RNA, 22 nt, Human
ugaacuuuguaguaauggagau

SEQ ID NO: 726658 - RNA, 22 nt, Human
gccuccugacuuacacugagcu

SEQ ID NO: 726659 - RNA, 22 nt, Human
ucccuggguccugcuugcucuc

SEQ ID NO: 726660 - RNA, 22 nt, Human
agccuggcuaaauucucccaug

SEQ ID NO: 726661 - RNA, 22 nt, Human
auuguacacuaguggcagcagu

SEQ ID NO: 726662 - RNA, 22 nt, Human
cuuggcuguaaaaucagaggcu

SEQ ID NO: 726663 - RNA, 22 nt, Human
acaaaugacuauuugguacagg

SEQ ID NO: 726664 - RNA, 22 nt, Human
ccguuaaucccauaauauggau

SEQ ID NO: 726665 - RNA, 22 nt, Human
cauccacuagaaugacagaguu

SEQ ID NO: 726666 - RNA, 20 nt, Human
uggguccugcacauucucca

SEQ ID NO: 726667 - RNA, 22 nt, Human
uucccacaacagaucuguauua

SEQ ID NO: 726668 - RNA, 22 nt, Human
ucugugcagucagggcucaguc

SEQ ID NO: 726669 - RNA, 22 nt, Human
caaauucaaugaacauguuuaa

SEQ ID NO: 726670 - RNA, 22 nt, Human
aagggcuuuuaagauuuauccu

SEQ ID NO: 726671 - RNA, 18 nt, Human
uccagagguguuggagcc

SEQ ID NO: 726672 - RNA, 22 nt, Human
agguuucuaugcuguuuaucuu

SEQ ID NO: 726673 - RNA, 22 nt, Human
uccaaguugauguuucuuaaau

SEQ ID NO: 726674 - RNA, 22 nt, Human
ccuguguguaggccaggggagu

SEQ ID NO: 726675 - RNA, 22 nt, Human
ucccuggggauguuggccugcc

SEQ ID NO: 726676 - RNA, 19 nt, Human
uuugaaagaguuuuauugg

SEQ ID NO: 726677 - RNA, 22 nt, Human
ucugcugaggccuucccacucc

SEQ ID NO: 726678 - RNA, 22 nt, Human
uuauauauauguagaggucacg

SEQ ID NO: 726679 - RNA, 22 nt, Human
ucugaagaacugucuagagaac

SEQ ID NO: 726680 - RNA, 22 nt, Human
gagccuggauugaagugggugg

SEQ ID NO: 726681 - RNA, 20 nt, Human
auauuucuuaagaacuuuca

SEQ ID NO: 726682 - RNA, 22 nt, Human
ugcaggaaaacaccuaucaccc

SEQ ID NO: 726683 - RNA, 22 nt, Human
agagccaggcucccauggggca

SEQ ID NO: 726684 - RNA, 22 nt, Human
uucuuuccacagaggggaugau

SEQ ID NO: 726685 - RNA, 22 nt, Human
acccagggucaccccguagggu

SEQ ID NO: 726686 - RNA, 22 nt, Human
agggcuggcaucucuaaugcug

SEQ ID NO: 726687 - RNA, 22 nt, Human
ggcuuccugggcauguguucua

SEQ ID NO: 726688 - RNA, 22 nt, Human
ccagcagcagcguccaaggaga

SEQ ID NO: 726689 - RNA, 22 nt, Human
acaaggagagcacacaugggga

SEQ ID NO: 726690 - RNA, 22 nt, Human
cagaguccuggacacagagaca

SEQ ID NO: 726691 - RNA, 22 nt, Human
gcaauaaacauguuugaugcgc

SEQ ID NO: 726692 - RNA, 22 nt, Human
gaggcccaggucaagcagccac

SEQ ID NO: 726693 - RNA, 22 nt, Human
uaucuacaggugucagguaaga

SEQ ID NO: 726694 - RNA, 22 nt, Human
uaaggcagugagaagaaacagg

SEQ ID NO: 726695 - RNA, 22 nt, Human
ccagcucugcauguuucccuug

SEQ ID NO: 726696 - RNA, 22 nt, Human
uggucugauuccaccuaacuga

SEQ ID NO: 726697 - RNA, 22 nt, Human
auccucuguggauuacaccuag

SEQ ID NO: 726698 - RNA, 22 nt, Human
uucuucagucccacuagccaca

SEQ ID NO: 726699 - RNA, 22 nt, Human
acagagaaagugggcugaagau

SEQ ID NO: 726700 - RNA, 22 nt, Human
gagcccugaacaacagcaggaa

SEQ ID NO: 726701 - RNA, 22 nt, Human
cacuucagguucuggcagggcg

SEQ ID NO: 726702 - RNA, 22 nt, Human
cagagcugcagauugaaggcau

SEQ ID NO: 726703 - RNA, 22 nt, Human
auucacaguuuccucauauucu

SEQ ID NO: 726704 - RNA, 18 nt, Human
ucauucauuaaacuuggc

SEQ ID NO: 726705 - RNA, 23 nt, Human
cccuucagcgagggcauuaaggu

SEQ ID NO: 726706 - RNA, 22 nt, Human
ugaaagaguuugacaugauucu

SEQ ID NO: 726707 - RNA, 22 nt, Human
cagguaaagcuucaaaucacuu

SEQ ID NO: 726708 - RNA, 22 nt, Human
cacuaaauguuucaauguggga

SEQ ID NO: 726709 - RNA, 22 nt, Human
ucacucucuaagcaugacagac

SEQ ID NO: 726710 - RNA, 22 nt, Human
acuuuacccgcacucagacaca

SEQ ID NO: 726711 - RNA, 22 nt, Human
gcucccaguucccaaagugacc

SEQ ID NO: 726712 - RNA, 22 nt, Human
gggccaggucggugaaugguca

SEQ ID NO: 726713 - RNA, 22 nt, Human
gcccaggcuggagugcaguagc

SEQ ID NO: 726714 - RNA, 20 nt, Human
agccucugcccuucccacug

SEQ ID NO: 726715 - RNA, 22 nt, Human
aacaugucuuuagagaaacauu

SEQ ID NO: 726716 - RNA, 22 nt, Human
aggugucuggauggguguccuu

SEQ ID NO: 726717 - RNA, 21 nt, Human
agcuuccugcagugggagguc

SEQ ID NO: 726718 - RNA, 22 nt, Human
ucccugggaauuaauauuugga

SEQ ID NO: 726719 - RNA, 22 nt, Human
aaugucaaagugcuuugcaaac

SEQ ID NO: 726720 - RNA, 22 nt, Human
uuggggcagagaggauacggca

SEQ ID NO: 726721 - RNA, 22 nt, Human
uugagcaucaauuaagugaguu

SEQ ID NO: 726722 - RNA, 22 nt, Human
cagagcaguagaaaacagccuu

SEQ ID NO: 726723 - RNA, 22 nt, Human
uccucacagaguggcaggcaau

SEQ ID NO: 726724 - RNA, 22 nt, Human
cgcagagggagccgcgggcugc

SEQ ID NO: 726725 - RNA, 22 nt, Human
caaagcucaugcucuuagccau

SEQ ID NO: 726726 - RNA, 22 nt, Human
auauacuguaggccacuauaag

SEQ ID NO: 726727 - RNA, 22 nt, Human
uaggccaguugguggcccugga

SEQ ID NO: 726728 - RNA, 22 nt, Human
ggcugcugggucaugaugcaga

SEQ ID NO: 726729 - RNA, 22 nt, Human
uccuuugguaguuuucuuaaag

SEQ ID NO: 726730 - RNA, 22 nt, Human
auaauguagguauguguauuua

SEQ ID NO: 726731 - RNA, 22 nt, Human
augaggcaucuaacauugcaaa

SEQ ID NO: 726732 - RNA, 22 nt, Human
gggcacugcuuugcucugucac

SEQ ID NO: 726733 - RNA, 22 nt, Human
ucuacagggucagaguuucaug

SEQ ID NO: 726734 - RNA, 22 nt, Human
cauguccuucucauugccucau

SEQ ID NO: 726735 - RNA, 22 nt, Human
caagaaacuuuauucugccaua

SEQ ID NO: 726736 - RNA, 22 nt, Human
gcuuggagaugggggaugagcc

SEQ ID NO: 726737 - RNA, 22 nt, Human
gcagggcuaggucuucuagggc

SEQ ID NO: 726738 - RNA, 22 nt, Human
acguguguaugaguguacauau

SEQ ID NO: 726739 - RNA, 22 nt, Human
uagaaacauauguuugagacau

SEQ ID NO: 726740 - RNA, 22 nt, Human
uuggcccuuuaugggaugggca

SEQ ID NO: 726741 - RNA, 22 nt, Human
uauuacaauuuacauugcacuu

SEQ ID NO: 726742 - RNA, 22 nt, Human
uuuugguacaugcaauagcaau

SEQ ID NO: 726743 - RNA, 22 nt, Human
uuucacaucagagguagauuag

SEQ ID NO: 726744 - RNA, 22 nt, Human
ugaagguguaugcuguggguca

SEQ ID NO: 726745 - RNA, 21 nt, Human
gcccagaagacuggcucugcc

SEQ ID NO: 726746 - RNA, 22 nt, Human
uccugguuuauagacugauggc

SEQ ID NO: 726747 - RNA, 22 nt, Human
cugcccuguuuggacagcccgg

SEQ ID NO: 726748 - RNA, 18 nt, Human
agauugugucuacaaauc

SEQ ID NO: 726749 - RNA, 22 nt, Human
agagccuggcaaaagguccugc

SEQ ID NO: 726750 - RNA, 23 nt, Human
ggccucagcgcacagaaacugcu

SEQ ID NO: 726751 - RNA, 17 nt, Human
ggagaucuggcagaggg

SEQ ID NO: 726752 - RNA, 22 nt, Human
ggcucaagcagucugccugccu

SEQ ID NO: 726753 - RNA, 22 nt, Human
uccuggaggcaaaugagcacau

SEQ ID NO: 726754 - RNA, 22 nt, Human
aguugaaaauuaagugaauuuc

SEQ ID NO: 726755 - RNA, 22 nt, Human
uauuugaugguucuaaaacagc

SEQ ID NO: 726756 - RNA, 22 nt, Human
ggugccaggcucccagcucagg

SEQ ID NO: 726757 - RNA, 22 nt, Human
ucugagcuacgaugccugucac

SEQ ID NO: 726758 - RNA, 21 nt, Human
uggucugaaaguauuuguggc

SEQ ID NO: 726759 - RNA, 22 nt, Human
ucaugacaacuauauuauucca

SEQ ID NO: 726760 - RNA, 22 nt, Human
auuaguugggguggagaaggau

SEQ ID NO: 726761 - RNA, 22 nt, Human
gugacauugcuaggaacagauu

SEQ ID NO: 726762 - RNA, 22 nt, Human
ggugugaauuuugaccuuuuaa

SEQ ID NO: 726763 - RNA, 22 nt, Human
uguccucaaggagcuucagucu

SEQ ID NO: 726764 - RNA, 22 nt, Human
ggcuggcagaggggagucugug

SEQ ID NO: 726765 - RNA, 22 nt, Human
cugagacuuucaugugcuuuua

SEQ ID NO: 726766 - RNA, 22 nt, Human
augacaugaccugguagagaca

SEQ ID NO: 726767 - RNA, 22 nt, Human
aggccagcacgacagccgcagg

SEQ ID NO: 726768 - RNA, 23 nt, Human
ucccuggaggcagguccagggcc

SEQ ID NO: 726769 - RNA, 22 nt, Human
agucacauggcagagagaaguu

SEQ ID NO: 726770 - RNA, 22 nt, Human
agggcaucuaguucccucucuu

SEQ ID NO: 726771 - RNA, 22 nt, Human
cugagcaccccaggaccugcgc

SEQ ID NO: 726772 - RNA, 22 nt, Human
uuguacaacacauauucuacag

SEQ ID NO: 726773 - RNA, 22 nt, Human
ucaggaaguauaaucagauuca

SEQ ID NO: 726774 - RNA, 22 nt, Human
uaggaaauuuuacuggucuggg

SEQ ID NO: 726775 - RNA, 23 nt, Human
aggagacagggaagugccuggcu

SEQ ID NO: 726776 - RNA, 22 nt, Human
uuguuuuggaagaacuuacucu

SEQ ID NO: 726777 - RNA, 22 nt, Human
cuccagacagaucuucuagcag

SEQ ID NO: 726778 - RNA, 22 nt, Human
ucaaaggcauugccaauaagua

SEQ ID NO: 726779 - RNA, 22 nt, Human
augcucacuucagagaagauga

SEQ ID NO: 726780 - RNA, 22 nt, Human
cagcaguuaugaguagaauagu

SEQ ID NO: 726781 - RNA, 22 nt, Human
aagccagauuccuuaagcacag

SEQ ID NO: 726782 - RNA, 22 nt, Human
augaaggauggcuggcugcccu

SEQ ID NO: 726783 - RNA, 22 nt, Human
uucagugcacaguacugagacu

SEQ ID NO: 726784 - RNA, 22 nt, Human
uuucacagaaagaagcuaguuu

SEQ ID NO: 726785 - RNA, 17 nt, Human
gagguaggaagugaguc

SEQ ID NO: 726786 - RNA, 22 nt, Human
cugagcuuggccaggaaugaau

SEQ ID NO: 726787 - RNA, 22 nt, Human
aucucagaucuacagaucuaca

SEQ ID NO: 726788 - RNA, 22 nt, Human
agacccucuccaugcccacugc

SEQ ID NO: 726789 - RNA, 22 nt, Human
auuuggucauguucaguguaga

SEQ ID NO: 726790 - RNA, 22 nt, Human
aaaaguaauugcaguuuuugcc

SEQ ID NO: 726791 - RNA, 23 nt, Human
agucaagaugcaucugugaggaa

SEQ ID NO: 726792 - RNA, 22 nt, Human
uaaacaaggguuacugagcaug

SEQ ID NO: 726793 - RNA, 22 nt, Human
ucuggcuggcagugauggugug

SEQ ID NO: 726794 - RNA, 22 nt, Human
guuucucaacaugcuuucuaac

SEQ ID NO: 726795 - RNA, 22 nt, Human
ugcagcucaggauucucagggc

SEQ ID NO: 726796 - RNA, 22 nt, Human
uguauuagaucugagaacuucu

SEQ ID NO: 726797 - RNA, 22 nt, Human
cagaggcuuauaccugauuagg

SEQ ID NO: 726798 - RNA, 20 nt, Human
gagugggccauggagugaga

SEQ ID NO: 726799 - RNA, 16 nt, Human
cucagcuaaggagagg

SEQ ID NO: 726800 - RNA, 22 nt, Human
gccugcuggcuguccauugcag

SEQ ID NO: 726801 - RNA, 16 nt, Human
ccucucuuauuccucc

SEQ ID NO: 726802 - RNA, 22 nt, Human
auucucaauggcuacuuucaua

SEQ ID NO: 726803 - RNA, 22 nt, Human
gaaaguuuucucacacaguaau

SEQ ID NO: 726804 - RNA, 22 nt, Human
ucugugcucaaguucugccucu

SEQ ID NO: 726805 - RNA, 22 nt, Human
ggacugaacacuuaaaugucca

SEQ ID NO: 726806 - RNA, 22 nt, Human
ugaauccuaauucuaucacuua

SEQ ID NO: 726807 - RNA, 22 nt, Human
gcaaagguagccaaggagcuca

SEQ ID NO: 726808 - RNA, 20 nt, Human
aaagcaguaugcaaguagag

SEQ ID NO: 726809 - RNA, 22 nt, Human
cagauggcagggcagcucugca

SEQ ID NO: 726810 - RNA, 21 nt, Human
cucagagacaaaugccauccc

SEQ ID NO: 726811 - RNA, 22 nt, Human
ugggugagccacaggaguuguc

SEQ ID NO: 726812 - RNA, 22 nt, Human
gugucugcacauaggaucucaa

SEQ ID NO: 726813 - RNA, 22 nt, Human
aggagaucagcuuagggaaggu

SEQ ID NO: 726814 - RNA, 22 nt, Human
uaagacauaaauaggcuuuuua

SEQ ID NO: 726815 - RNA, 22 nt, Human
uagcagaggaaaagagaacauu

SEQ ID NO: 726816 - RNA, 22 nt, Human
caaggcugcugcgggucgcacc

SEQ ID NO: 726817 - RNA, 22 nt, Human
accugugcaaagacuggucagg

SEQ ID NO: 726818 - RNA, 22 nt, Human
ccuggguuggagagcaauggug

SEQ ID NO: 726819 - RNA, 22 nt, Human
aaauccuuuggaggacaugaug

SEQ ID NO: 726820 - RNA, 22 nt, Human
gacugaggugcccagaggugac

SEQ ID NO: 726821 - RNA, 22 nt, Human
gggggaaguaauuauaaaccaa

SEQ ID NO: 726822 - RNA, 23 nt, Human
auuuuacaggucaguuccuugaa

SEQ ID NO: 726823 - RNA, 22 nt, Human
ggcggcgcguagccggagacuu

SEQ ID NO: 726824 - RNA, 22 nt, Human
ucagaacagugccuggcacuaa

SEQ ID NO: 726825 - RNA, 22 nt, Human
uguuugaaaaguggagauuuau

SEQ ID NO: 726826 - RNA, 22 nt, Human
ccuggcagcaggugggcccgug

SEQ ID NO: 726827 - RNA, 22 nt, Human
uggcccugggcaucuuucguga

SEQ ID NO: 726828 - RNA, 22 nt, Human
uuacaugacugcccuugucagg

SEQ ID NO: 726829 - RNA, 22 nt, Human
gggccugggaacuugcauuuag

SEQ ID NO: 726830 - RNA, 20 nt, Human
uaucaguaggauauucugcc

SEQ ID NO: 726831 - RNA, 22 nt, Human
ccacacagggggaugaguuauu

SEQ ID NO: 726832 - RNA, 22 nt, Human
cugacaaaccacugcuccagcu

SEQ ID NO: 726833 - RNA, 23 nt, Human
aguuuguaaagaaauauuugcac

SEQ ID NO: 726834 - RNA, 19 nt, Human
gcagguggauguggucagc

SEQ ID NO: 726835 - RNA, 22 nt, Human
aaugaugguuaaacacuggagg

SEQ ID NO: 726836 - RNA, 22 nt, Human
uuuuccuggagauggaguuguu

SEQ ID NO: 726837 - RNA, 22 nt, Human
ggggcaggagguguucucuuuu

SEQ ID NO: 726838 - RNA, 22 nt, Human
acaguauauauagucuaaaagc

SEQ ID NO: 726839 - RNA, 22 nt, Human
uugauuuugccugaucugagag

SEQ ID NO: 726840 - RNA, 22 nt, Human
ucagauuuacugcagagcagau

SEQ ID NO: 726841 - RNA, 22 nt, Human
cucuggagcaccgggcuaucca

SEQ ID NO: 726842 - RNA, 22 nt, Human
cagcuuguuuuauuuggggacc

SEQ ID NO: 726843 - RNA, 22 nt, Human
gcuacauaguaacccacaaauc

SEQ ID NO: 726844 - RNA, 22 nt, Human
aggucaagguucacaggggauc

SEQ ID NO: 726845 - RNA, 22 nt, Human
uuuaagagcauuugcaauuuau

SEQ ID NO: 726846 - RNA, 22 nt, Human
cacuguaucuuuuccaaagucu

SEQ ID NO: 726847 - RNA, 22 nt, Human
aaaaucacacaaguagaugggg

SEQ ID NO: 726848 - RNA, 22 nt, Human
uaucuauaaguacuaacauggu

SEQ ID NO: 726849 - RNA, 22 nt, Human
uuccaugagcucugaguucaca

SEQ ID NO: 726850 - RNA, 22 nt, Human
gcuuccagaccccagucccuca

SEQ ID NO: 726851 - RNA, 22 nt, Human
cuaagcaagaaugagugcaaca

SEQ ID NO: 726852 - RNA, 22 nt, Human
aggaaagcucccaguagggcuc

SEQ ID NO: 726853 - RNA, 22 nt, Human
gugucugaguuuggaaagucca

SEQ ID NO: 726854 - RNA, 22 nt, Human
gcaggagagccagcaggcuucc

SEQ ID NO: 726855 - RNA, 22 nt, Human
uauuuugucuucugcucaucac

SEQ ID NO: 726856 - RNA, 22 nt, Human
cuccuggagggccaaagaaaua

SEQ ID NO: 726857 - RNA, 22 nt, Human
agaaaggacaucucccuuuaag

SEQ ID NO: 726858 - RNA, 22 nt, Human
agggccaggaacaccugaaggg

SEQ ID NO: 726859 - RNA, 18 nt, Human
agccugggcucugccugg

SEQ ID NO: 726860 - RNA, 22 nt, Human
guccuuaacaaacggggaaaag

SEQ ID NO: 726861 - RNA, 22 nt, Human
guucacaguuuuauaccugaga

SEQ ID NO: 726862 - RNA, 22 nt, Human
ugcugagaaucacagguuauaa

SEQ ID NO: 726863 - RNA, 22 nt, Human
aagagaauucugguuuuccuau

SEQ ID NO: 726864 - RNA, 22 nt, Human
cugccuuuuaaagccaguguua

SEQ ID NO: 726865 - RNA, 22 nt, Human
gcugggucagaaucucccugug

SEQ ID NO: 726866 - RNA, 22 nt, Human
gcuuagcaaacaucuguagucc

SEQ ID NO: 726867 - RNA, 22 nt, Human
agaggcugcaggcuggaaauca

SEQ ID NO: 726868 - RNA, 22 nt, Human
ugugggcucccccucacucugu

SEQ ID NO: 726869 - RNA, 22 nt, Human
cccugugcacacacuucacucu

SEQ ID NO: 726870 - RNA, 22 nt, Human
ugacccaucaggccacaugagg

SEQ ID NO: 726871 - RNA, 22 nt, Human
gcugcagcaagcccuccagggg

SEQ ID NO: 726872 - RNA, 22 nt, Human
ugcagcagccucaucugguuuc

SEQ ID NO: 726873 - RNA, 21 nt, Human
aaacugaggcuucaagcagug

SEQ ID NO: 726874 - RNA, 22 nt, Human
ccuccaggauaagucagggccu

SEQ ID NO: 726875 - RNA, 22 nt, Human
guaugaaaauuguaaaguucuu

SEQ ID NO: 726876 - RNA, 19 nt, Human
cacagggcaggucucaugu

SEQ ID NO: 726877 - RNA, 22 nt, Human
gggcuccuggcagucaugcuca

SEQ ID NO: 726878 - RNA, 23 nt, Human
uugcagggauggaguucaaaaug

SEQ ID NO: 726879 - RNA, 22 nt, Human
cuccaggcgcuuaccaagcgcu

SEQ ID NO: 726880 - RNA, 22 nt, Human
auugcacaaacacagucagacu

SEQ ID NO: 726881 - RNA, 22 nt, Human
ggcccaggcuggagugcggugg

SEQ ID NO: 726882 - RNA, 22 nt, Human
augucuaaaagauaaaguuuaa

SEQ ID NO: 726883 - RNA, 22 nt, Human
aagaguuuuagacaaacugauu

SEQ ID NO: 726884 - RNA, 22 nt, Human
uggucugauuuuucaucuguug

SEQ ID NO: 726885 - RNA, 22 nt, Human
uuuuccuggggcuucuggacuc

SEQ ID NO: 726886 - RNA, 20 nt, Human
aguaccuuuuguauguuacc

SEQ ID NO: 726887 - RNA, 22 nt, Human
ccagccaugcacaaaccaugag

SEQ ID NO: 726888 - RNA, 22 nt, Human
ccagcaggggaauauuuuuagg

SEQ ID NO: 726889 - RNA, 22 nt, Human
acacccagcuuuugaaugcccu

SEQ ID NO: 726890 - RNA, 22 nt, Human
uuuuaucuucauuccuaucuac

SEQ ID NO: 726891 - RNA, 21 nt, Human
ucugugcuuuuuuggcuccua

SEQ ID NO: 726892 - RNA, 22 nt, Human
cuccauggaaccggggcugcuu

SEQ ID NO: 726893 - RNA, 22 nt, Human
guggcuguauagccaagucaga

SEQ ID NO: 726894 - RNA, 22 nt, Human
aaggaaaugagguugauggaug

SEQ ID NO: 726895 - RNA, 23 nt, Human
ugcaggcuaggaagagagccuuc

SEQ ID NO: 726896 - RNA, 22 nt, Human
auuuucuauguuguaauuguua

SEQ ID NO: 726897 - RNA, 21 nt, Human
auuacagcaguggccaaaugc

SEQ ID NO: 726898 - RNA, 22 nt, Human
acagaagccuuuggccauuuga

SEQ ID NO: 726899 - RNA, 22 nt, Human
agcagccacagucugggacagg

SEQ ID NO: 726900 - RNA, 22 nt, Human
acagaugaggaagagucagcca

SEQ ID NO: 726901 - RNA, 22 nt, Human
acacacaugguauuguucagaa

SEQ ID NO: 726902 - RNA, 20 nt, Human
ugucugugccacggcacucc

SEQ ID NO: 726903 - RNA, 22 nt, Human
cuucucucccuggcacucagac

SEQ ID NO: 726904 - RNA, 22 nt, Human
acuuuuugcuggucucuuccau

SEQ ID NO: 726905 - RNA, 22 nt, Human
cuuuucaaacgcugaugucagu

SEQ ID NO: 726906 - RNA, 22 nt, Human
caaaugugguuucucagcauuc

SEQ ID NO: 726907 - RNA, 22 nt, Human
aucuacccacugaacacaauau

SEQ ID NO: 726908 - RNA, 22 nt, Human
ucucaaacuaacaaugauuaua

SEQ ID NO: 726909 - RNA, 22 nt, Human
gaagguagcugcugagaugaca

SEQ ID NO: 726910 - RNA, 22 nt, Human
guucagcuaggaauggagaugc

SEQ ID NO: 726911 - RNA, 22 nt, Human
uuuuugauacucaagaggggua

SEQ ID NO: 726912 - RNA, 22 nt, Human
uggcccaggcgaggugggcaga

SEQ ID NO: 726913 - RNA, 22 nt, Human
caggaagcugagcugcacugca

SEQ ID NO: 726914 - RNA, 22 nt, Human
uaaugcacagaauugacauggg

SEQ ID NO: 726915 - RNA, 22 nt, Human
ccagggaaaaucaacuucuacu

SEQ ID NO: 726916 - RNA, 22 nt, Human
ucacgugagggaccugugucug

SEQ ID NO: 726917 - RNA, 22 nt, Human
gcacuugaaaagaucaggugca

SEQ ID NO: 726918 - RNA, 23 nt, Human
aacaccaaggcucagagagauaa

SEQ ID NO: 726919 - RNA, 21 nt, Human
agccugccugaacucuguggc

SEQ ID NO: 726920 - RNA, 22 nt, Human
uucuguguucugugcaaugagc

SEQ ID NO: 726921 - RNA, 22 nt, Human
caguuuuaugaaugcuuauuag

SEQ ID NO: 726922 - RNA, 22 nt, Human
caacuaauccuuugaaaagaag

SEQ ID NO: 726923 - RNA, 22 nt, Human
caacagcuggaggcuuggcccg

SEQ ID NO: 726924 - RNA, 22 nt, Human
agcagggccugagugaccuaac

SEQ ID NO: 726925 - RNA, 22 nt, Human
guguaaacacccuuacuguggc

SEQ ID NO: 726926 - RNA, 22 nt, Human
uggcccugugugcaggcugcac

SEQ ID NO: 726927 - RNA, 22 nt, Human
cuaauguaucauggcucucagc

SEQ ID NO: 726928 - RNA, 22 nt, Human
augugucuugcggcaguuggua

SEQ ID NO: 726929 - RNA, 22 nt, Human
caaagucauaaaacuuguaagu

SEQ ID NO: 726930 - RNA, 22 nt, Human
uuucuauaaaaagugcuaggau

SEQ ID NO: 726931 - RNA, 22 nt, Human
uugcucugucagggccucaguc

SEQ ID NO: 726932 - RNA, 22 nt, Human
auugcaaagcauugugagcgca

SEQ ID NO: 726933 - RNA, 22 nt, Human
ggugagcagcugucuguaugga

SEQ ID NO: 726934 - RNA, 22 nt, Human
acagaaauugcuaauagcucau

SEQ ID NO: 726935 - RNA, 22 nt, Human
ugcaagcuuggcugauguugau

SEQ ID NO: 726936 - RNA, 22 nt, Human
aaaucaugaggacauuaugcca

SEQ ID NO: 726937 - RNA, 22 nt, Human
aauucucuccaggguaacauca

SEQ ID NO: 726938 - RNA, 22 nt, Human
uuccucagccaaggcugggauc

SEQ ID NO: 726939 - RNA, 22 nt, Human
uucagagaguuugugaguccuu

SEQ ID NO: 726940 - RNA, 22 nt, Human
cagagucagagcaccugggauu

SEQ ID NO: 726941 - RNA, 22 nt, Human
uguuccugacggccaaagaggu

SEQ ID NO: 726942 - RNA, 19 nt, Human
uuuugaaguaugagacagg

SEQ ID NO: 726943 - RNA, 22 nt, Human
uuuaaauguguucuuaguagcu

SEQ ID NO: 726944 - RNA, 22 nt, Human
cuaguauuacauuuuugugugu

SEQ ID NO: 726945 - RNA, 22 nt, Human
ucagaacauauauuuugugaug

SEQ ID NO: 726946 - RNA, 22 nt, Human
ggcuagaugguauauaaggaug

SEQ ID NO: 726947 - RNA, 22 nt, Human
uaugcccuuacaaugagcacaa

SEQ ID NO: 726948 - RNA, 22 nt, Human
ccuggagugggguccgugcaug

SEQ ID NO: 726949 - RNA, 22 nt, Human
cagguaggcagccggucucugg

SEQ ID NO: 726950 - RNA, 22 nt, Human
cacagcugaaguagccaugugg

SEQ ID NO: 726951 - RNA, 22 nt, Human
gcugagaggcacuaucuccgga

SEQ ID NO: 726952 - RNA, 22 nt, Human
uggagcccagggugagaaggag

SEQ ID NO: 726953 - RNA, 22 nt, Human
gagcccaggaugguguauggcu

SEQ ID NO: 726954 - RNA, 22 nt, Human
ucacaaauauagugagaaccag

SEQ ID NO: 726955 - RNA, 22 nt, Human
agugugagugcucauguccauc

SEQ ID NO: 726956 - RNA, 22 nt, Human
agcacuagagccaaaauuuggg

SEQ ID NO: 726957 - RNA, 22 nt, Human
auguccagggcacacagcagug

SEQ ID NO: 726958 - RNA, 22 nt, Human
ucaggcuggagugcaguggcgc

SEQ ID NO: 726959 - RNA, 22 nt, Human
cugcuuuagacggcuuucgcug

SEQ ID NO: 726960 - RNA, 22 nt, Human
caucagcaggcaacacucuugg

SEQ ID NO: 726961 - RNA, 20 nt, Human
ccucucugaagaggucaucu

SEQ ID NO: 726962 - RNA, 22 nt, Human
ucucagaaaaaggagaaacugg

SEQ ID NO: 726963 - RNA, 22 nt, Human
ugucacaccucguuuagcauuc

SEQ ID NO: 726964 - RNA, 22 nt, Human
augaugaaauuuucuaucaugu

SEQ ID NO: 726965 - RNA, 22 nt, Human
ccucuggggugagugggccacu

SEQ ID NO: 726966 - RNA, 22 nt, Human
gauauuuuuaggugaugcaggc

SEQ ID NO: 726967 - RNA, 22 nt, Human
uuuuuguagucauuagaagagg

SEQ ID NO: 726968 - RNA, 22 nt, Human
uucauccauaugcagagagcuu

SEQ ID NO: 726969 - RNA, 22 nt, Human
cuuggacuuuagucucucucca

SEQ ID NO: 726970 - RNA, 22 nt, Human
uguacaguuuuaacucugaggg

SEQ ID NO: 726971 - RNA, 22 nt, Human
ucugaaaugcaaauuugacuga

SEQ ID NO: 726972 - RNA, 18 nt, Human
ucucaaaaauaauggcuu

SEQ ID NO: 726973 - RNA, 22 nt, Human
uuugaauauacuucaaacaaag

SEQ ID NO: 726974 - RNA, 19 nt, Human
uggcaggcccaggauggac

SEQ ID NO: 726975 - RNA, 22 nt, Human
ugaggggcgcuggcagguuccu

SEQ ID NO: 726976 - RNA, 22 nt, Human
ucccaagcuuagggcucucagu

SEQ ID NO: 726977 - RNA, 22 nt, Human
uuagagaugucccaaaaugaag

SEQ ID NO: 726978 - RNA, 22 nt, Human
auaccaccaucuaugaaaggua

SEQ ID NO: 726979 - RNA, 22 nt, Human
auguguacacuggacuucugau

SEQ ID NO: 726980 - RNA, 22 nt, Human
ccucugggaagccaguccugcu

SEQ ID NO: 726981 - RNA, 22 nt, Human
ucaggguugcugugaucagucc

SEQ ID NO: 726982 - RNA, 22 nt, Human
acaggcagggaccucuugaguu

SEQ ID NO: 726983 - RNA, 22 nt, Human
ucucuuaauccggugcuuucug

SEQ ID NO: 726984 - RNA, 22 nt, Human
uauuuuacaugacagguguuua

SEQ ID NO: 726985 - RNA, 22 nt, Human
aauaucucaccaugacaaagca

SEQ ID NO: 726986 - RNA, 22 nt, Human
uauuuuaucugccagaguggag

SEQ ID NO: 726987 - RNA, 22 nt, Human
uuugaacuucuaccugucauau

SEQ ID NO: 726988 - RNA, 22 nt, Human
uggaaagaaaguaaaggcguau

SEQ ID NO: 726989 - RNA, 22 nt, Human
ggcuccagauguccccuggcaa

SEQ ID NO: 726990 - RNA, 22 nt, Human
uagcacauaacuuagaauaguu

SEQ ID NO: 726991 - RNA, 22 nt, Human
uggggagugaugccucggauaa

SEQ ID NO: 726992 - RNA, 23 nt, Human
aucuguucaucugacacagauuc

SEQ ID NO: 726993 - RNA, 20 nt, Human
caaggggaguaguaugggcc

SEQ ID NO: 726994 - RNA, 22 nt, Human
aaacuucauggauaauauaaag

SEQ ID NO: 726995 - RNA, 22 nt, Human
gucugcccugcagacaugccuc

SEQ ID NO: 726996 - RNA, 22 nt, Human
uaauuagaguuugguaaacaau

SEQ ID NO: 726997 - RNA, 22 nt, Human
cuuuguuuauauuucuccucga

SEQ ID NO: 726998 - RNA, 22 nt, Human
uggcagaguucgcuccuauuca

SEQ ID NO: 726999 - RNA, 22 nt, Human
gcauuuauuucuuuacugcauc

SEQ ID NO: 727000 - RNA, 18 nt, Human
ucccugggauauaauuac

SEQ ID NO: 727001 - RNA, 22 nt, Human
agguccugaagauuuuacuaga

SEQ ID NO: 727002 - RNA, 23 nt, Human
agcaggcugcuucuccacagcug

SEQ ID NO: 727003 - RNA, 20 nt, Human
ggugcugauaagaaagaagu

SEQ ID NO: 727004 - RNA, 22 nt, Human
aaaaaccuuucccauacuaaga

SEQ ID NO: 727005 - RNA, 22 nt, Human
uuuguugugaacagaauaauau

SEQ ID NO: 727006 - RNA, 22 nt, Human
uuucacauaaauauuaugccua

SEQ ID NO: 727007 - RNA, 22 nt, Human
ugcaauaaggaguaauaguaaa

SEQ ID NO: 727008 - RNA, 22 nt, Human
ugugacuggcagaggugucugg

SEQ ID NO: 727009 - RNA, 22 nt, Human
uagggcuauaagagaauaagac

SEQ ID NO: 727010 - RNA, 23 nt, Human
ucagugcaaaaauaggauuuugg

SEQ ID NO: 727011 - RNA, 22 nt, Human
cagccugcccuggaagcccagc

SEQ ID NO: 727012 - RNA, 22 nt, Human
agccacaccuguccugccagcu

SEQ ID NO: 727013 - RNA, 22 nt, Human
uaacugaauguauuacaacaga

SEQ ID NO: 727014 - RNA, 22 nt, Human
ucuuguauguguauuuugcugu

SEQ ID NO: 727015 - RNA, 22 nt, Human
ugggaacaccugcugcccagug

SEQ ID NO: 727016 - RNA, 23 nt, Human
agcuccagggaacaggcaguagg

SEQ ID NO: 727017 - RNA, 18 nt, Human
uguuuccuccuggaggcu

SEQ ID NO: 727018 - RNA, 22 nt, Human
aguacaaguagaaugcuacaag

SEQ ID NO: 727019 - RNA, 22 nt, Human
uccgcccgcacguauggagugg

SEQ ID NO: 727020 - RNA, 22 nt, Human
ucaggcugauaggaggaacuga

SEQ ID NO: 727021 - RNA, 22 nt, Human
gauucagugagggugagaagaa

SEQ ID NO: 727022 - RNA, 22 nt, Human
uuucagaggaaaucucauugag

SEQ ID NO: 727023 - RNA, 22 nt, Human
gggaaauuuuagguuugucucg

SEQ ID NO: 727024 - RNA, 22 nt, Human
uauaaccuggauucuggcacua

SEQ ID NO: 727025 - RNA, 22 nt, Human
ggcggcacgcaggcugcugucg

SEQ ID NO: 727026 - RNA, 22 nt, Human
ucuguuccucaaggucugugug

SEQ ID NO: 727027 - RNA, 22 nt, Human
aagcacagacacaaaaggcuuu

SEQ ID NO: 727028 - RNA, 22 nt, Human
ccugcccuucuuuccccagcau

SEQ ID NO: 727029 - RNA, 22 nt, Human
agggugcagaacaaauuaagac

SEQ ID NO: 727030 - RNA, 22 nt, Human
ucagcuugggaaauugagcaag

SEQ ID NO: 727031 - RNA, 22 nt, Human
gggcagccugcuuucugaucca

SEQ ID NO: 727032 - RNA, 22 nt, Human
augaugaagaguaacaggcuga

SEQ ID NO: 727033 - RNA, 22 nt, Human
uccuggcccaaucugcccauga

SEQ ID NO: 727034 - RNA, 22 nt, Human
agcagcagggcaugucuuacuc

SEQ ID NO: 727035 - RNA, 22 nt, Human
gaggcugggaaguccaauauca

SEQ ID NO: 727036 - RNA, 22 nt, Human
gugugggaauggcggucgugca

SEQ ID NO: 727037 - RNA, 22 nt, Human
cugugacaguuucucagacuuu

SEQ ID NO: 727038 - RNA, 22 nt, Human
gccuaggaguggggauggcggu

SEQ ID NO: 727039 - RNA, 20 nt, Human
cacaguauucuuccuuaaaa

SEQ ID NO: 727040 - RNA, 22 nt, Human
auggcucagcgccuuucugugg

SEQ ID NO: 727041 - RNA, 19 nt, Human
ugcuuccucaccaucuccc

SEQ ID NO: 727042 - RNA, 22 nt, Human
aagauacaucaaagcaaauugg

SEQ ID NO: 727043 - RNA, 22 nt, Human
gaaagcacaguucaugagacaa

SEQ ID NO: 727044 - RNA, 22 nt, Human
gggcuuuaacacccagucaggg

SEQ ID NO: 727045 - RNA, 22 nt, Human
ccugccaggcuuugggcuucug

SEQ ID NO: 727046 - RNA, 22 nt, Human
cucccuggugacucccaaagcu

SEQ ID NO: 727047 - RNA, 22 nt, Human
aaggucauggcaaauuacuuuu

SEQ ID NO: 727048 - RNA, 21 nt, Human
agucacauuggggguuuaggg

SEQ ID NO: 727049 - RNA, 22 nt, Human
uggcaguggauaggggagcggu

SEQ ID NO: 727050 - RNA, 22 nt, Human
uagcugguucuccaggagcuag

SEQ ID NO: 727051 - RNA, 22 nt, Human
uuugucaaucccuugaaaaccu

SEQ ID NO: 727052 - RNA, 22 nt, Human
agcccuggauucugagguccaa

SEQ ID NO: 727053 - RNA, 22 nt, Human
ggcaaaggaaaacgucucagcu

SEQ ID NO: 727054 - RNA, 19 nt, Human
ugaucuggaaggaaccagg

SEQ ID NO: 727055 - RNA, 22 nt, Human
gcugugucagaaacucugggga

SEQ ID NO: 727056 - RNA, 22 nt, Human
aacuguauacaauugucagaca

SEQ ID NO: 727057 - RNA, 22 nt, Human
aucauccuagaaggaagcuagg

SEQ ID NO: 727058 - RNA, 22 nt, Human
gggcuucuauucaagucuguuu

SEQ ID NO: 727059 - RNA, 22 nt, Human
acuauaacccauggaauauaag

SEQ ID NO: 727060 - RNA, 22 nt, Human
uucuuucuucucaggcugggua

SEQ ID NO: 727061 - RNA, 22 nt, Human
uuugugaacaaacaugaagaug

SEQ ID NO: 727062 - RNA, 22 nt, Human
augcuugcccauguuucugaag

SEQ ID NO: 727063 - RNA, 22 nt, Human
ucucuaaagauauuuauggcaa

SEQ ID NO: 727064 - RNA, 22 nt, Human
gggcugagucugcugccuguca

SEQ ID NO: 727065 - RNA, 22 nt, Human
agaggcucagaggccugguccu

SEQ ID NO: 727066 - RNA, 22 nt, Human
uccuguccugaggcuccaggcc

SEQ ID NO: 727067 - RNA, 22 nt, Human
uuagucaauagugaauauagag

SEQ ID NO: 727068 - RNA, 22 nt, Human
acucugugugaguagagccugu

SEQ ID NO: 727069 - RNA, 23 nt, Human
cucuccugaaggacaagcugccg

SEQ ID NO: 727070 - RNA, 22 nt, Human
gacagaagaggaacuuggacag

SEQ ID NO: 727071 - RNA, 22 nt, Human
uguaaauaauuccuaggcuuuu

SEQ ID NO: 727072 - RNA, 22 nt, Human
accccagcucugagccacacca

SEQ ID NO: 727073 - RNA, 22 nt, Human
auggaaaucgaugucuaaguua

SEQ ID NO: 727074 - RNA, 22 nt, Human
gggcaggggucaguggccccaa

SEQ ID NO: 727075 - RNA, 22 nt, Human
aaccaggauuuaagauucuaga

SEQ ID NO: 727076 - RNA, 22 nt, Human
uccagcaaagugauaggauuuc

SEQ ID NO: 727077 - RNA, 22 nt, Human
gcagcaguggcaguuaauauuu

SEQ ID NO: 727078 - RNA, 22 nt, Human
uuggaugagagggugugguaca

SEQ ID NO: 727079 - RNA, 22 nt, Human
uugugguuaaccgcacauuuuu

SEQ ID NO: 727080 - RNA, 22 nt, Human
cccaggcugccacgauuacugc

SEQ ID NO: 727081 - RNA, 22 nt, Human
agcauuaauaagaaauggcucc

SEQ ID NO: 727082 - RNA, 22 nt, Human
cucagagcacaguuuaugacag

SEQ ID NO: 727083 - RNA, 22 nt, Human
uuacaagauaaccugaugcugu

SEQ ID NO: 727084 - RNA, 22 nt, Human
ucaagagauugaauaauaacug

SEQ ID NO: 727085 - RNA, 22 nt, Human
ggcugugccucuggcagcacau

SEQ ID NO: 727086 - RNA, 22 nt, Human
cugccugcuuuucugggagccg

SEQ ID NO: 727087 - RNA, 22 nt, Human
aagggcagggaguuugugucua

SEQ ID NO: 727088 - RNA, 22 nt, Human
acacauuugggcuccuacauaa

SEQ ID NO: 727089 - RNA, 22 nt, Human
aggcugugggacaguuaggaga

SEQ ID NO: 727090 - RNA, 22 nt, Human
acagggcuggggaaagaggcua

SEQ ID NO: 727091 - RNA, 22 nt, Human
cggagaggaccugcaacucgcu

SEQ ID NO: 727092 - RNA, 22 nt, Human
uauaauaugaggcaggagugau

SEQ ID NO: 727093 - RNA, 22 nt, Human
guuuauaaauucugcuuuuguu

SEQ ID NO: 727094 - RNA, 22 nt, Human
ugcaaagccacaaugaaaucag

SEQ ID NO: 727095 - RNA, 22 nt, Human
uucuccuggggccgugauguga

SEQ ID NO: 727096 - RNA, 22 nt, Human
gcaggucuaucaggcugcaggu

SEQ ID NO: 727097 - RNA, 22 nt, Human
ggcuuuugcuguguuuuccaga

SEQ ID NO: 727098 - RNA, 22 nt, Human
uaacacaaaagaauaugugugu

SEQ ID NO: 727099 - RNA, 22 nt, Human
aaguuuuacugaggacacaugu

SEQ ID NO: 727100 - RNA, 19 nt, Human
guggcucauguagugggcc

SEQ ID NO: 727101 - RNA, 22 nt, Human
cucagaggggaugcuuggagaa

SEQ ID NO: 727102 - RNA, 22 nt, Human
aagcccuggcccaaccuugauu

SEQ ID NO: 727103 - RNA, 20 nt, Human
ugccuggccuuucucugccc

SEQ ID NO: 727104 - RNA, 20 nt, Human
uccaccaggaaggguaggga

SEQ ID NO: 727105 - RNA, 22 nt, Human
ucagaggacuaccuucuccagu

SEQ ID NO: 727106 - RNA, 22 nt, Human
uuaaggcauugauauggugcua

SEQ ID NO: 727107 - RNA, 22 nt, Human
aaccaaggacagcuagugaugc

SEQ ID NO: 727108 - RNA, 22 nt, Human
ggccucacccaucggugccuuu

SEQ ID NO: 727109 - RNA, 22 nt, Human
guaauugaacauuaaguugaag

SEQ ID NO: 727110 - RNA, 21 nt, Human
cuggcccagggaucugcauuu

SEQ ID NO: 727111 - RNA, 22 nt, Human
uggcccaggccaaagcccugga

SEQ ID NO: 727112 - RNA, 22 nt, Human
uuuagcaaagguaggguucaga

SEQ ID NO: 727113 - RNA, 22 nt, Human
guuucucuuugaagccuggcug

SEQ ID NO: 727114 - RNA, 22 nt, Human
cuucccuucugugcagggcaga

SEQ ID NO: 727115 - RNA, 22 nt, Human
caaaauagauguuaaccuggaa

SEQ ID NO: 727116 - RNA, 22 nt, Human
ggucagaauuaggucuagagua

SEQ ID NO: 727117 - RNA, 22 nt, Human
ugugaagauuuggcaugcagaa

SEQ ID NO: 727118 - RNA, 22 nt, Human
ucuggcuugcuggcuugguccc

SEQ ID NO: 727119 - RNA, 22 nt, Human
aauuucagagguagagauucua

SEQ ID NO: 727120 - RNA, 22 nt, Human
ggagacucaccccgcauucuag

SEQ ID NO: 727121 - RNA, 22 nt, Human
ugaugaggagacuguggcuugg

SEQ ID NO: 727122 - RNA, 22 nt, Human
ccaggccuccugugaguggacc

SEQ ID NO: 727123 - RNA, 22 nt, Human
uuucuccuugugucuccuuuga

SEQ ID NO: 727124 - RNA, 22 nt, Human
gcagagcauuucgguugcuucc

SEQ ID NO: 727125 - RNA, 20 nt, Human
acaggggcagcacaauaaug

SEQ ID NO: 727126 - RNA, 22 nt, Human
cuagucucuggaggucagggcu

SEQ ID NO: 727127 - RNA, 22 nt, Human
uggccucaccacuagcugggug

SEQ ID NO: 727128 - RNA, 22 nt, Human
uggagcagcucuagcgggcgcc

SEQ ID NO: 727129 - RNA, 22 nt, Human
auguaguuuggggcuagauuua

SEQ ID NO: 727130 - RNA, 22 nt, Human
uaaaaaguagugagaauggcgc

SEQ ID NO: 727131 - RNA, 22 nt, Human
ggcuuugcuuuggcuguuucag

SEQ ID NO: 727132 - RNA, 22 nt, Human
cacuucaccacuaggcuauacu

SEQ ID NO: 727133 - RNA, 22 nt, Human
uccugggaggcugugccuggcu

SEQ ID NO: 727134 - RNA, 22 nt, Human
aggcugggaaauguauuccagc

SEQ ID NO: 727135 - RNA, 21 nt, Human
aaauccaaacacuaguccaca

SEQ ID NO: 727136 - RNA, 22 nt, Human
cuucuuaacuguauauacuaug

SEQ ID NO: 727137 - RNA, 22 nt, Human
aaggcugaccaguuuacacuuu

SEQ ID NO: 727138 - RNA, 19 nt, Human
cuggaaggagggacuguuc

SEQ ID NO: 727139 - RNA, 22 nt, Human
uuuggcaacggagaacuuacuc

SEQ ID NO: 727140 - RNA, 18 nt, Human
gucauggguaguuuagua

SEQ ID NO: 727141 - RNA, 22 nt, Human
gggacauggaggcgcgcaggca

SEQ ID NO: 727142 - RNA, 22 nt, Human
gaagaauauucuugaucuuaga

SEQ ID NO: 727143 - RNA, 22 nt, Human
ccaggaggaaauucuaaaggua

SEQ ID NO: 727144 - RNA, 19 nt, Human
uccauaagcuuguguucau

SEQ ID NO: 727145 - RNA, 22 nt, Human
gucuauaagcaggggaaaacuu

SEQ ID NO: 727146 - RNA, 22 nt, Human
ggagggguggaaggagugccug

SEQ ID NO: 727147 - RNA, 20 nt, Human
uuggucagugguucaguuug

SEQ ID NO: 727148 - RNA, 22 nt, Human
auaaacuugagucucagaguau

SEQ ID NO: 727149 - RNA, 22 nt, Human
uauacacaggaaucugugaaaa

SEQ ID NO: 727150 - RNA, 22 nt, Human
uagucaaaagcuucacucggaa

SEQ ID NO: 727151 - RNA, 22 nt, Human
aacagauuugugaagcuacuca

SEQ ID NO: 727152 - RNA, 22 nt, Human
aacugaaacggugaucuuuuaa

SEQ ID NO: 727153 - RNA, 22 nt, Human
auaaaaacugacccauccuuug

SEQ ID NO: 727154 - RNA, 22 nt, Human
cucugcuagaaggucaaucucu

SEQ ID NO: 727155 - RNA, 22 nt, Human
ggagcugcuccuucagccaagu

SEQ ID NO: 727156 - RNA, 22 nt, Human
gccagguugcugacgacgaucu

SEQ ID NO: 727157 - RNA, 22 nt, Human
acaggcacuuugacaugccauc

SEQ ID NO: 727158 - RNA, 22 nt, Human
ucagaaaagaccacauuauucu

SEQ ID NO: 727159 - RNA, 22 nt, Human
agcagcauaucagagaaaguca

SEQ ID NO: 727160 - RNA, 22 nt, Human
ucacuugccuagcccaguucag

SEQ ID NO: 727161 - RNA, 22 nt, Human
uuagaguuaggauuugucuuua

SEQ ID NO: 727162 - RNA, 22 nt, Human
gcugccguuggcucuucaggcc

SEQ ID NO: 727163 - RNA, 22 nt, Human
ggagugguggucaggccauggc

SEQ ID NO: 727164 - RNA, 22 nt, Human
gacuggacucugaagaugggug

SEQ ID NO: 727165 - RNA, 22 nt, Human
gcaaugcauauguggguagcau

SEQ ID NO: 727166 - RNA, 22 nt, Human
augcuaaauucagacaggguua

SEQ ID NO: 727167 - RNA, 22 nt, Human
auccaugauuaguaggauaaag

SEQ ID NO: 727168 - RNA, 22 nt, Human
auuuuuuagaaccuggccugau

SEQ ID NO: 727169 - RNA, 22 nt, Human
uuacacaggcacuuaaaaugca

SEQ ID NO: 727170 - RNA, 20 nt, Human
cugcccacuagaacuaccug

SEQ ID NO: 727171 - RNA, 22 nt, Human
uggcuuuauaaauccacugguu

SEQ ID NO: 727172 - RNA, 22 nt, Human
uaauggauuaacgucccugucg

SEQ ID NO: 727173 - RNA, 22 nt, Human
ccacagaaaauaaagcacgauu

SEQ ID NO: 727174 - RNA, 22 nt, Human
gaggguggaagagcugcugaga

SEQ ID NO: 727175 - RNA, 22 nt, Human
uccuggaguggagucuguuguu

SEQ ID NO: 727176 - RNA, 22 nt, Human
ucccagaaaaaggaggcuauga

SEQ ID NO: 727177 - RNA, 22 nt, Human
ggacccagaggggagucuggca

SEQ ID NO: 727178 - RNA, 22 nt, Human
acaguaaagccuucugguugac

SEQ ID NO: 727179 - RNA, 22 nt, Human
uaauaccuagagaugauacaaa

SEQ ID NO: 727180 - RNA, 22 nt, Human
accagggcacauuccggccaga

SEQ ID NO: 727181 - RNA, 21 nt, Human
agauucaggacagcagucacu

SEQ ID NO: 727182 - RNA, 22 nt, Human
uagccauguguggaacacagcc

SEQ ID NO: 727183 - RNA, 22 nt, Human
uuuuguaugagaagugcuuuac

SEQ ID NO: 727184 - RNA, 22 nt, Human
ggcuggcagaagugugcuggcu

SEQ ID NO: 727185 - RNA, 22 nt, Human
aguauuuucgccaucacaagaa

SEQ ID NO: 727186 - RNA, 22 nt, Human
aggcugaggaucccuguguucu

SEQ ID NO: 727187 - RNA, 22 nt, Human
cuuauguauaauguuccacaua

SEQ ID NO: 727188 - RNA, 22 nt, Human
cugggggucuugaaagggagag

SEQ ID NO: 727189 - RNA, 22 nt, Human
cuguuuauggagguaaggcauc

SEQ ID NO: 727190 - RNA, 22 nt, Human
acacauauaccacuguaaauga

SEQ ID NO: 727191 - RNA, 22 nt, Human
cagggccuuucaggguaaaagg

SEQ ID NO: 727192 - RNA, 22 nt, Human
uaguucuugguucuuaguucuu

SEQ ID NO: 727193 - RNA, 22 nt, Human
accugggcauuuuggaugauua

SEQ ID NO: 727194 - RNA, 18 nt, Human
agaguccagggugaggug

SEQ ID NO: 727195 - RNA, 22 nt, Human
cagccuggccugggacugcuga

SEQ ID NO: 727196 - RNA, 23 nt, Human
aucaagauaauccagaugaccua

SEQ ID NO: 727197 - RNA, 20 nt, Human
agcugcccuuuucacauguu

SEQ ID NO: 727198 - RNA, 21 nt, Human
uauacagaggggaacaggaga

SEQ ID NO: 727199 - RNA, 22 nt, Human
aaaaaucacuuuuauaggcagc

SEQ ID NO: 727200 - RNA, 22 nt, Human
cacuuguagaggcauuauucca

SEQ ID NO: 727201 - RNA, 22 nt, Human
uugcagcauauugaucuccugu

SEQ ID NO: 727202 - RNA, 22 nt, Human
ggcaccuguguaagaucuggaa

SEQ ID NO: 727203 - RNA, 22 nt, Human
cugcagagcuaggcugagugaa

SEQ ID NO: 727204 - RNA, 22 nt, Human
aguggcaggcagaagcuucuca

SEQ ID NO: 727205 - RNA, 22 nt, Human
gcuagcuuuauaaugcugggcg

SEQ ID NO: 727206 - RNA, 22 nt, Human
uagucccauuuugagguauuug

SEQ ID NO: 727207 - RNA, 22 nt, Human
agguggaguuggcuguaguuca

SEQ ID NO: 727208 - RNA, 22 nt, Human
agaaaauuuauucauguuaguu

SEQ ID NO: 727209 - RNA, 22 nt, Human
agucacuguucugucaugucaa

SEQ ID NO: 727210 - RNA, 22 nt, Human
ccucccucuuucagucccacag

SEQ ID NO: 727211 - RNA, 22 nt, Human
aggcacugugcuucuuauaugu

SEQ ID NO: 727212 - RNA, 22 nt, Human
cucacugugaccucagcagaca

SEQ ID NO: 727213 - RNA, 22 nt, Human
uguggccaaaauaaaaugaggu

SEQ ID NO: 727214 - RNA, 22 nt, Human
gagcugcuuccagaguugagug

SEQ ID NO: 727215 - RNA, 22 nt, Human
cugggagauucaggugaaguuu

SEQ ID NO: 727216 - RNA, 22 nt, Human
gacagugauuaguuacuauaaa

SEQ ID NO: 727217 - RNA, 22 nt, Human
gcagggacaacugugcaccuga

SEQ ID NO: 727218 - RNA, 18 nt, Human
uggcagguccagcugugg

SEQ ID NO: 727219 - RNA, 22 nt, Human
cucaccauaugacuuuacuaac

SEQ ID NO: 727220 - RNA, 22 nt, Human
cucucucaguguaauacaggau

SEQ ID NO: 727221 - RNA, 22 nt, Human
aagaugaugcagacuuugaugu

SEQ ID NO: 727222 - RNA, 22 nt, Human
uuaacaauagaguuucuucagg

SEQ ID NO: 727223 - RNA, 22 nt, Human
uuuacacauaccucuuuaaagu

SEQ ID NO: 727224 - RNA, 22 nt, Human
cuucaugagacuccacugccau

SEQ ID NO: 727225 - RNA, 22 nt, Human
aguuagaauggauguugagagc

SEQ ID NO: 727226 - RNA, 22 nt, Human
uauaauuuuaagugguaaauua

SEQ ID NO: 727227 - RNA, 22 nt, Human
aagauauauuuuggugauuuca

SEQ ID NO: 727228 - RNA, 22 nt, Human
ccagugcccagcugcccaggca

SEQ ID NO: 727229 - RNA, 22 nt, Human
ugaggaagaacaagaauuuaga

SEQ ID NO: 727230 - RNA, 22 nt, Human
ucaggaaggcaaauugcaugau

SEQ ID NO: 727231 - RNA, 19 nt, Human
cagaguacaccagauagga

SEQ ID NO: 727232 - RNA, 21 nt, Human
guucaauagcucuuugaaugc

SEQ ID NO: 727233 - RNA, 22 nt, Human
ccauguggugggaaggagaaug

SEQ ID NO: 727234 - RNA, 22 nt, Human
agugaugucuaacuugaucccu

SEQ ID NO: 727235 - RNA, 22 nt, Human
agaugaagaugccacuaagacc

SEQ ID NO: 727236 - RNA, 22 nt, Human
cugggccuccucugcccaagcu

SEQ ID NO: 727237 - RNA, 22 nt, Human
uuguuauuauuacuaagucuuc

SEQ ID NO: 727238 - RNA, 22 nt, Human
ugcagaaggccugacauugcac

SEQ ID NO: 727239 - RNA, 22 nt, Human
caggagaggaggcuacuucuua

SEQ ID NO: 727240 - RNA, 22 nt, Human
auuuucucacaauccuaugggg

SEQ ID NO: 727241 - RNA, 18 nt, Human
uccaggcuccaggcuaac

SEQ ID NO: 727242 - RNA, 22 nt, Human
ugccugaguuuaacccucagag

SEQ ID NO: 727243 - RNA, 22 nt, Human
gugggugugguucguuuaagac

SEQ ID NO: 727244 - RNA, 22 nt, Human
cccuucagugcgugagaaugag

SEQ ID NO: 727245 - RNA, 22 nt, Human
uuuacauagugcuuucccacua

SEQ ID NO: 727246 - RNA, 19 nt, Human
uuucucugugcaccuuuuc

SEQ ID NO: 727247 - RNA, 22 nt, Human
auacaucucauguaagagauaa

SEQ ID NO: 727248 - RNA, 22 nt, Human
cagcacagggcuugagaggugu

SEQ ID NO: 727249 - RNA, 22 nt, Human
gccugcagccucagagaauuuu

SEQ ID NO: 727250 - RNA, 22 nt, Human
uugauagguuuuauguauaguu

SEQ ID NO: 727251 - RNA, 22 nt, Human
cacccaguaagcaugaggcccu

SEQ ID NO: 727252 - RNA, 22 nt, Human
ucuggggcaguuacuggggccu

SEQ ID NO: 727253 - RNA, 19 nt, Human
cugauguuccagagaagcu

SEQ ID NO: 727254 - RNA, 22 nt, Human
caucauaauaacccagacacag

SEQ ID NO: 727255 - RNA, 22 nt, Human
cuguggcuggcucaucauaggu

SEQ ID NO: 727256 - RNA, 22 nt, Human
uaagaugguuguagauggacug

SEQ ID NO: 727257 - RNA, 22 nt, Human
cugugcuggcagaccuggaguu

SEQ ID NO: 727258 - RNA, 21 nt, Human
ggacaauuguucauuuucuuu

SEQ ID NO: 727259 - RNA, 22 nt, Human
acccagagaacugaggcaugaa

SEQ ID NO: 727260 - RNA, 22 nt, Human
cccguguggacagcgugccagu

SEQ ID NO: 727261 - RNA, 23 nt, Human
uuccuuaacuguuaagauugucu

SEQ ID NO: 727262 - RNA, 22 nt, Human
augggcaguuaggaggccagga

SEQ ID NO: 727263 - RNA, 22 nt, Human
uagggcagaguccaggaugggc

SEQ ID NO: 727264 - RNA, 22 nt, Human
ucaaaguaaaaguauagaguuu

SEQ ID NO: 727265 - RNA, 22 nt, Human
uugcagggccuuggcuucuucc

SEQ ID NO: 727266 - RNA, 22 nt, Human
uagucuuuuuaauaaauaaugc

SEQ ID NO: 727267 - RNA, 22 nt, Human
uuuccuguugccaucaagaaug

SEQ ID NO: 727268 - RNA, 22 nt, Human
cugaacaucccgcagugcacga

SEQ ID NO: 727269 - RNA, 22 nt, Human
gcgucucaaggcccccaggcca

SEQ ID NO: 727270 - RNA, 22 nt, Human
gaagagcugacagugucauccu

SEQ ID NO: 727271 - RNA, 22 nt, Human
ugguuggcugagcagagucacu

SEQ ID NO: 727272 - RNA, 22 nt, Human
uucacagaauugucuugacugg

SEQ ID NO: 727273 - RNA, 22 nt, Human
cccaggucuaugccagcucuga

SEQ ID NO: 727274 - RNA, 22 nt, Human
auucaaaccucauuuauuguuc

SEQ ID NO: 727275 - RNA, 22 nt, Human
agagcuggaagcugcucuuaga

SEQ ID NO: 727276 - RNA, 22 nt, Human
ggggauggaggcgugugguccu

SEQ ID NO: 727277 - RNA, 22 nt, Human
gcucuguggcaggaggucuugu

SEQ ID NO: 727278 - RNA, 19 nt, Human
cugagaauccuacuuauuu

SEQ ID NO: 727279 - RNA, 17 nt, Human
ucuggaugucauggaag

SEQ ID NO: 727280 - RNA, 22 nt, Human
ggagggcacaggaccagaaauc

SEQ ID NO: 727281 - RNA, 22 nt, Human
uccugugugggcaggaugagaa

SEQ ID NO: 727282 - RNA, 22 nt, Human
gagguggcacugugaggagcac

SEQ ID NO: 727283 - RNA, 22 nt, Human
aucagcaucuuuaacaauuacc

SEQ ID NO: 727284 - RNA, 22 nt, Human
ucugugucagaagauaucaugg

SEQ ID NO: 727285 - RNA, 22 nt, Human
cucugugggaggaggaguaggc

SEQ ID NO: 727286 - RNA, 22 nt, Human
agggaaaguaagcauuucauua

SEQ ID NO: 727287 - RNA, 22 nt, Human
uuagaacauuuuuagaccaaua

SEQ ID NO: 727288 - RNA, 22 nt, Human
uagaucaagaauguccacuugu

SEQ ID NO: 727289 - RNA, 22 nt, Human
cgagugucccuaccauuuccua

SEQ ID NO: 727290 - RNA, 22 nt, Human
ccuugguucugccuggccugga

SEQ ID NO: 727291 - RNA, 22 nt, Human
ugccagggucagcugcagcucu

SEQ ID NO: 727292 - RNA, 19 nt, Human
ggugugccaaaugggaaug

SEQ ID NO: 727293 - RNA, 22 nt, Human
agaggggagagcuaagcaauuc

SEQ ID NO: 727294 - RNA, 21 nt, Human
ggcugggcaggacccaccccu

SEQ ID NO: 727295 - RNA, 22 nt, Human
uuuguagaauaauaucuuucug

SEQ ID NO: 727296 - RNA, 22 nt, Human
uggagccuguguuucugcccag

SEQ ID NO: 727297 - RNA, 22 nt, Human
gcucuguguaaauguagggucc

SEQ ID NO: 727298 - RNA, 22 nt, Human
aagcacaguaaaagcagauuuu

SEQ ID NO: 727299 - RNA, 22 nt, Human
aauaacuggcacauaucacaua

SEQ ID NO: 727300 - RNA, 22 nt, Human
augugucugauggcccugaauu

SEQ ID NO: 727301 - RNA, 22 nt, Human
gcucagggaacuuuuugcaggc

SEQ ID NO: 727302 - RNA, 22 nt, Human
ucugcaagggcacagccaaccc

SEQ ID NO: 727303 - RNA, 22 nt, Human
auuccaaagguuaaugcccauu

SEQ ID NO: 727304 - RNA, 22 nt, Human
aagggacuuugucagcuuucca

SEQ ID NO: 727305 - RNA, 22 nt, Human
auuaaaagcuucccaagaguua

SEQ ID NO: 727306 - RNA, 22 nt, Human
uacaugucuacagccaugucug

SEQ ID NO: 727307 - RNA, 22 nt, Human
gaugcaggauagcuucacccag

SEQ ID NO: 727308 - RNA, 22 nt, Human
cagcuuggcuucacauucugua

SEQ ID NO: 727309 - RNA, 22 nt, Human
uuuccagugauugcugcucuca

SEQ ID NO: 727310 - RNA, 22 nt, Human
cgaguccaggguuaggaguccg

SEQ ID NO: 727311 - RNA, 20 nt, Human
agcagcagauguuggaggug

SEQ ID NO: 727312 - RNA, 22 nt, Human
cugugucuccuuggugggauau

SEQ ID NO: 727313 - RNA, 22 nt, Human
uucaaaugcaaguuacuacuuu

SEQ ID NO: 727314 - RNA, 22 nt, Human
cagaagcaaguagugauucuuu

SEQ ID NO: 727315 - RNA, 22 nt, Human
cucggagaugcuggcugagauc

SEQ ID NO: 727316 - RNA, 22 nt, Human
cuuaacagcaagaucuguguca

SEQ ID NO: 727317 - RNA, 22 nt, Human
aaagucugagcagaauuucuca

SEQ ID NO: 727318 - RNA, 22 nt, Human
uuaaguacuucccuguuggaca

SEQ ID NO: 727319 - RNA, 22 nt, Human
aggaccuguguuuuccuugaau

SEQ ID NO: 727320 - RNA, 22 nt, Human
uccauccacauuaacagauacg

SEQ ID NO: 727321 - RNA, 21 nt, Human
cacuuuaauggauauuuguuu

SEQ ID NO: 727322 - RNA, 22 nt, Human
acaggaaguuuggaaagccuca

SEQ ID NO: 727323 - RNA, 21 nt, Human
ucaguugccaaagugauguca

SEQ ID NO: 727324 - RNA, 22 nt, Human
ugugugggcaugcuuuuaauuu

SEQ ID NO: 727325 - RNA, 22 nt, Human
uaugagaagguauggugacuug

SEQ ID NO: 727326 - RNA, 22 nt, Human
acuccagggcuucuaugauggu

SEQ ID NO: 727327 - RNA, 22 nt, Human
cacuugaacuguuugaaugaga

SEQ ID NO: 727328 - RNA, 22 nt, Human
ugagaauuugugaacuuuucuc

SEQ ID NO: 727329 - RNA, 22 nt, Human
uucuggaggagaaagggugggc

SEQ ID NO: 727330 - RNA, 22 nt, Human
caggcaaggagcuggcucaagu

SEQ ID NO: 727331 - RNA, 22 nt, Human
uuucacagcagugugcugcuuu

SEQ ID NO: 727332 - RNA, 21 nt, Human
ucaggcugaugucgauguuag

SEQ ID NO: 727333 - RNA, 22 nt, Human
auacaucuaugccuuucugaca

SEQ ID NO: 727334 - RNA, 22 nt, Human
uagcauucagaacugagagcaa

SEQ ID NO: 727335 - RNA, 22 nt, Human
gcuugcuggugccugcaggcuc

SEQ ID NO: 727336 - RNA, 22 nt, Human
gcuuuacagagaaaguuugccu

SEQ ID NO: 727337 - RNA, 22 nt, Human
gcacacauucuagccuuuugug

SEQ ID NO: 727338 - RNA, 22 nt, Human
uugcuucaucagaguaaacaag

SEQ ID NO: 727339 - RNA, 22 nt, Human
uaguucuggacacacguuccca

SEQ ID NO: 727340 - RNA, 22 nt, Human
cagaguggugcaagggcagugu

SEQ ID NO: 727341 - RNA, 22 nt, Human
agcacuccugucuuuccccuuu

SEQ ID NO: 727342 - RNA, 22 nt, Human
agggucucuggagagcugagga

SEQ ID NO: 727343 - RNA, 22 nt, Human
cauuguuuugagaacaaccuga

SEQ ID NO: 727344 - RNA, 19 nt, Human
aggucauugauagugcagg

SEQ ID NO: 727345 - RNA, 22 nt, Human
auagcaaacuggcagcuugugg

SEQ ID NO: 727346 - RNA, 22 nt, Human
acaguacaaaacccaccagagg

SEQ ID NO: 727347 - RNA, 22 nt, Human
acaguauaccauugugacuuug

SEQ ID NO: 727348 - RNA, 22 nt, Human
gcugcuucuccucccuggggau

SEQ ID NO: 727349 - RNA, 22 nt, Human
auuuccuauuucuuguccccua

SEQ ID NO: 727350 - RNA, 22 nt, Human
auguuuccagcucagcugcagg

SEQ ID NO: 727351 - RNA, 22 nt, Human
aaauggucacuggugaguguca

SEQ ID NO: 727352 - RNA, 22 nt, Human
ucugagguuacugcuuuguaga

SEQ ID NO: 727353 - RNA, 22 nt, Human
ccuguggcucucuuuggagguc

SEQ ID NO: 727354 - RNA, 17 nt, Human
cagucacaggucuuuuc

SEQ ID NO: 727355 - RNA, 22 nt, Human
uaccuuggaaaugcuagaguaa

SEQ ID NO: 727356 - RNA, 22 nt, Human
uccuggcuuccacuccucuguu

SEQ ID NO: 727357 - RNA, 22 nt, Human
gccuggaggggccaggguggua

SEQ ID NO: 727358 - RNA, 22 nt, Human
cuaaggaaaggaaauacaguaa

SEQ ID NO: 727359 - RNA, 22 nt, Human
uuuaucuuuggaucuucagaaa

SEQ ID NO: 727360 - RNA, 22 nt, Human
caguggcuuacaaugaacuaga

SEQ ID NO: 727361 - RNA, 22 nt, Human
aggugaguuacaggaggagguc

SEQ ID NO: 727362 - RNA, 22 nt, Human
ugauacuuuggagacuugagua

SEQ ID NO: 727363 - RNA, 22 nt, Human
uccaaaguaauuucacuucugu

SEQ ID NO: 727364 - RNA, 22 nt, Human
cuuucucuuacccaaggaucug

SEQ ID NO: 727365 - RNA, 22 nt, Human
gugagcagagaucgcgugauug

SEQ ID NO: 727366 - RNA, 22 nt, Human
aaaauaaguugguccuguccuu

SEQ ID NO: 727367 - RNA, 22 nt, Human
ccagguccuguuuucaccacag

SEQ ID NO: 727368 - RNA, 22 nt, Human
uggcaggagguuuucuccagga

SEQ ID NO: 727369 - RNA, 22 nt, Human
cccugguguccacuggaggaag

SEQ ID NO: 727370 - RNA, 22 nt, Human
agaaagugaacguguucaguuu

SEQ ID NO: 727371 - RNA, 22 nt, Human
uuuaaagugguccauuucagaa

SEQ ID NO: 727372 - RNA, 22 nt, Human
ggaaguuugggagcugguaauc

SEQ ID NO: 727373 - RNA, 22 nt, Human
gcugagcucccagcaguaucug

SEQ ID NO: 727374 - RNA, 22 nt, Human
agagagguuugcuggaagauuc

SEQ ID NO: 727375 - RNA, 22 nt, Human
aauuucagaacuaucugggagu

SEQ ID NO: 727376 - RNA, 22 nt, Human
aggaagcugggaaacugacauu

SEQ ID NO: 727377 - RNA, 22 nt, Human
ugacuucugauugcuucuauuu

SEQ ID NO: 727378 - RNA, 22 nt, Human
cuucacauggguacugcugauc

SEQ ID NO: 727379 - RNA, 22 nt, Human
acuuuggggaacuuuucuccuc

SEQ ID NO: 727380 - RNA, 22 nt, Human
gcccuuggcaaauucuccuuua

SEQ ID NO: 727381 - RNA, 22 nt, Human
uagcuccuggugagccuacucu

SEQ ID NO: 727382 - RNA, 20 nt, Human
gcuucaaagccauccuuuua

SEQ ID NO: 727383 - RNA, 22 nt, Human
cacaaagucugcagcugcugua

SEQ ID NO: 727384 - RNA, 22 nt, Human
agcuggcuaugcccugugaacc

SEQ ID NO: 727385 - RNA, 22 nt, Human
auacauguucguguacauguuc

SEQ ID NO: 727386 - RNA, 22 nt, Human
acuaaaguauggaagugaauaa

SEQ ID NO: 727387 - RNA, 22 nt, Human
gccaccugugugggccuuugug

SEQ ID NO: 727388 - RNA, 18 nt, Human
ggacaggagacaugggug

SEQ ID NO: 727389 - RNA, 22 nt, Human
gaacaacuccaagggacaucau

SEQ ID NO: 727390 - RNA, 22 nt, Human
aaaguccuugcaguuuccucuu

SEQ ID NO: 727391 - RNA, 22 nt, Human
acccaggcuagggugcaguggc

SEQ ID NO: 727392 - RNA, 22 nt, Human
caauacaauuaccaguuaauca

SEQ ID NO: 727393 - RNA, 22 nt, Human
agcacaugacuuuuagucgagu

SEQ ID NO: 727394 - RNA, 22 nt, Human
gacaggcagaccugugcccugg

SEQ ID NO: 727395 - RNA, 22 nt, Human
auugacaaggaaacuauaccag

SEQ ID NO: 727396 - RNA, 22 nt, Human
acugcccagugauuggugguua

SEQ ID NO: 727397 - RNA, 22 nt, Human
caccagaguuguccaaaugauu

SEQ ID NO: 727398 - RNA, 18 nt, Human
uccagucccaaggccagc

SEQ ID NO: 727399 - RNA, 22 nt, Human
ugcagcucauauuagagagaag

SEQ ID NO: 727400 - RNA, 22 nt, Human
uguucuuuggcuucacagcucu

SEQ ID NO: 727401 - RNA, 21 nt, Human
uccugugaggaccugucagug

SEQ ID NO: 727402 - RNA, 22 nt, Human
ucaggcugaaggaggccuaucu

SEQ ID NO: 727403 - RNA, 22 nt, Human
guggccagcugucagcacccuu

SEQ ID NO: 727404 - RNA, 22 nt, Human
agggcugcaucugccuggugaa

SEQ ID NO: 727405 - RNA, 22 nt, Human
acacuuuaugucuagaucuggg

SEQ ID NO: 727406 - RNA, 22 nt, Human
aauaaaggcaccauaaggcaaa

SEQ ID NO: 727407 - RNA, 22 nt, Human
uuggagaguuaauugacaguua

SEQ ID NO: 727408 - RNA, 23 nt, Human
aguuuccacccaggguagaaggg

SEQ ID NO: 727409 - RNA, 20 nt, Human
ucaggcuccgcauuaacuua

SEQ ID NO: 727410 - RNA, 22 nt, Human
ugugugcauuagcauucuaggg

SEQ ID NO: 727411 - RNA, 22 nt, Human
gugugaaaugguucucuuuguu

SEQ ID NO: 727412 - RNA, 21 nt, Human
ugcaggcaggcagagaugcug

SEQ ID NO: 727413 - RNA, 20 nt, Human
aggaagauccuuucuuuuaa

SEQ ID NO: 727414 - RNA, 22 nt, Human
ccugggaagcccauagcagcuu

SEQ ID NO: 727415 - RNA, 19 nt, Human
uuucuaauguguuuuucuu

SEQ ID NO: 727416 - RNA, 22 nt, Human
ucacaggcucuagggauuaaga

SEQ ID NO: 727417 - RNA, 22 nt, Human
aguaaaaauaugcuuguggcua

SEQ ID NO: 727418 - RNA, 22 nt, Human
gccaagcuuggaaggaucaugg

SEQ ID NO: 727419 - RNA, 22 nt, Human
uugagacagugggguguugccg

SEQ ID NO: 727420 - RNA, 22 nt, Human
gcugugcagccaagugccucug

SEQ ID NO: 727421 - RNA, 22 nt, Human
agggccagccgacuuccagccu

SEQ ID NO: 727422 - RNA, 22 nt, Human
ucucucagcuuugagaccugcu

SEQ ID NO: 727423 - RNA, 22 nt, Human
uccaccugggcaacagugccuc

SEQ ID NO: 727424 - RNA, 22 nt, Human
ucagaacagcaggguguggcug

SEQ ID NO: 727425 - RNA, 22 nt, Human
ugagguaauguguacguuaauu

SEQ ID NO: 727426 - RNA, 22 nt, Human
gucugaagccagugguaguccg

SEQ ID NO: 727427 - RNA, 22 nt, Human
acauuucucauucuccccuaac

SEQ ID NO: 727428 - RNA, 22 nt, Human
uacauugacuuggauuguuaga

SEQ ID NO: 727429 - RNA, 22 nt, Human
cagaggcacagcuucuuuuaau

SEQ ID NO: 727430 - RNA, 22 nt, Human
uggagccaggagccugggaguc

SEQ ID NO: 727431 - RNA, 22 nt, Human
ccuggcucuguccucgcgcaaa

SEQ ID NO: 727432 - RNA, 22 nt, Human
agaguaacuuuuaacuuuacgu

SEQ ID NO: 727433 - RNA, 21 nt, Human
aagcuuggcugauguuauugg

SEQ ID NO: 727434 - RNA, 22 nt, Human
uacagcaaugccugaaauagua

SEQ ID NO: 727435 - RNA, 22 nt, Human
acagacugauucauugcucagg

SEQ ID NO: 727436 - RNA, 22 nt, Human
uguguguggggaggcagcagau

SEQ ID NO: 727437 - RNA, 22 nt, Human
cccuggaagguucucuggcuca

SEQ ID NO: 727438 - RNA, 22 nt, Human
uaauacaucauucaucuaagga

SEQ ID NO: 727439 - RNA, 22 nt, Human
augggcugacuaaugguaaacu

SEQ ID NO: 727440 - RNA, 22 nt, Human
ucccagcacagggcagauguga

SEQ ID NO: 727441 - RNA, 22 nt, Human
uuuacagcagcaugauuuauaa

SEQ ID NO: 727442 - RNA, 22 nt, Human
ucaauucaguccaacaguaauu

SEQ ID NO: 727443 - RNA, 17 nt, Human
agugucagaagacaguu

SEQ ID NO: 727444 - RNA, 22 nt, Human
cagaaauaucaccuggacucua

SEQ ID NO: 727445 - RNA, 22 nt, Human
acugggcauuuugaacguucuu

SEQ ID NO: 727446 - RNA, 22 nt, Human
cuguggaauugaugcuuagugu

SEQ ID NO: 727447 - RNA, 22 nt, Human
uugacaagaacaccgguuugag

SEQ ID NO: 727448 - RNA, 22 nt, Human
gaacagagcugacuacaaggca

SEQ ID NO: 727449 - RNA, 22 nt, Human
guggacacaggagagagaacug

SEQ ID NO: 727450 - RNA, 22 nt, Human
uguugaguauauaccuacaagu

SEQ ID NO: 727451 - RNA, 22 nt, Human
caguguccucagccagcagcua

SEQ ID NO: 727452 - RNA, 22 nt, Human
caaacauuugacuucucucagg

SEQ ID NO: 727453 - RNA, 22 nt, Human
caguaacacaaccacuccguga

SEQ ID NO: 727454 - RNA, 22 nt, Human
uuucacaaguuucaggauucug

SEQ ID NO: 727455 - RNA, 22 nt, Human
gcucuauuacuuucaauaaaaa

SEQ ID NO: 727456 - RNA, 22 nt, Human
uaaagugcgacccaguccccag

SEQ ID NO: 727457 - RNA, 22 nt, Human
uucuacacucacccagcuguaa

SEQ ID NO: 727458 - RNA, 16 nt, Human
ggguggucuuggagac

SEQ ID NO: 727459 - RNA, 22 nt, Human
ugaaauguguucuaguguuuug

SEQ ID NO: 727460 - RNA, 22 nt, Human
auucagauugguuuaagcuagu

SEQ ID NO: 727461 - RNA, 22 nt, Human
aagcagccagccaucaugcccg

SEQ ID NO: 727462 - RNA, 22 nt, Human
gaggcagugaacaauuccugug

SEQ ID NO: 727463 - RNA, 22 nt, Human
uguucugcaagcccugccaccu

SEQ ID NO: 727464 - RNA, 22 nt, Human
guuucauuaccugacccaugag

SEQ ID NO: 727465 - RNA, 22 nt, Human
uagaaacagaaaacuguaauag

SEQ ID NO: 727466 - RNA, 22 nt, Human
ucaguucuaagugcuuuacaug

SEQ ID NO: 727467 - RNA, 22 nt, Human
ccagccuugcaccgagccagcc

SEQ ID NO: 727468 - RNA, 22 nt, Human
cuucugcugccgccucggcaca

SEQ ID NO: 727469 - RNA, 22 nt, Human
agacaugacagauaguugcuag

SEQ ID NO: 727470 - RNA, 20 nt, Human
agcuggccuguccuaggccu

SEQ ID NO: 727471 - RNA, 22 nt, Human
uagaaugagaaaguguagcagg

SEQ ID NO: 727472 - RNA, 22 nt, Human
acacauaugguugcugcaguga

SEQ ID NO: 727473 - RNA, 22 nt, Human
cuguggccuuggaccagcaucu

SEQ ID NO: 727474 - RNA, 22 nt, Human
auaugcuuugggauuagaucau

SEQ ID NO: 727475 - RNA, 22 nt, Human
ucugugaaacagcucuggcaug

SEQ ID NO: 727476 - RNA, 22 nt, Human
ggccacagaacagcuacaggac

SEQ ID NO: 727477 - RNA, 22 nt, Human
ugagcuacacacuaggcauggg

SEQ ID NO: 727478 - RNA, 22 nt, Human
uccagccuucucaaggcuggcu

SEQ ID NO: 727479 - RNA, 22 nt, Human
aggcagaaccagcugggacuuu

SEQ ID NO: 727480 - RNA, 22 nt, Human
gagcugccggcccacaguacua

SEQ ID NO: 727481 - RNA, 22 nt, Human
agaauacaucaaucuauuuucu

SEQ ID NO: 727482 - RNA, 22 nt, Human
ugugaaaagcguguguucuagg

SEQ ID NO: 727483 - RNA, 22 nt, Human
cuggguguagcccaguaugagg

SEQ ID NO: 727484 - RNA, 22 nt, Human
gcacugggugggagaucugaau

SEQ ID NO: 727485 - RNA, 22 nt, Human
acauuccugaaugggcacauuu

SEQ ID NO: 727486 - RNA, 22 nt, Human
uucagcgauauuauucaugagc

SEQ ID NO: 727487 - RNA, 22 nt, Human
aagcccagggaauggucgggag

SEQ ID NO: 727488 - RNA, 22 nt, Human
uuguuacagcagugauuucaga

SEQ ID NO: 727489 - RNA, 22 nt, Human
auuuagacacaaaagugccaug

SEQ ID NO: 727490 - RNA, 22 nt, Human
aggaguuucaaagcuuccaugu

SEQ ID NO: 727491 - RNA, 22 nt, Human
ucauucauaaaaauuaguuggc

SEQ ID NO: 727492 - RNA, 20 nt, Human
aggccaggaaauguaguucu

SEQ ID NO: 727493 - RNA, 22 nt, Human
cuguuauuuuauaauucaagaa

SEQ ID NO: 727494 - RNA, 22 nt, Human
gucaaauauacuaagagguaaa

SEQ ID NO: 727495 - RNA, 22 nt, Human
ugagagaguaauugagugguaa

SEQ ID NO: 727496 - RNA, 23 nt, Human
ccacgucugcacuguagcuguug

SEQ ID NO: 727497 - RNA, 22 nt, Human
cgggcgcacuccgggcagcugu

SEQ ID NO: 727498 - RNA, 22 nt, Human
cugcaaaauuguucuuugcucc

SEQ ID NO: 727499 - RNA, 22 nt, Human
gcaauacagaagaguggcaagg

SEQ ID NO: 727500 - RNA, 22 nt, Human
cuuccagagcugggcugaccuu

SEQ ID NO: 727501 - RNA, 21 nt, Human
uccaacaugccugauggugcc

SEQ ID NO: 727502 - RNA, 22 nt, Human
uuuauuauucucuggagaaugu

SEQ ID NO: 727503 - RNA, 22 nt, Human
uuugaggaagaucggagggaaa

SEQ ID NO: 727504 - RNA, 22 nt, Human
ggagcaagagguggugaaaaau

SEQ ID NO: 727505 - RNA, 22 nt, Human
ccacagaaugaugacacuucag

SEQ ID NO: 727506 - RNA, 22 nt, Human
uuggggcucugaaaaagaugua

SEQ ID NO: 727507 - RNA, 22 nt, Human
guuuacagagacagaaaguagu

SEQ ID NO: 727508 - RNA, 22 nt, Human
aguuuuauuccaaugugcagca

SEQ ID NO: 727509 - RNA, 22 nt, Human
ccuggcucccuggaccucauua

SEQ ID NO: 727510 - RNA, 22 nt, Human
cauugcacucuggcuggaacgg

SEQ ID NO: 727511 - RNA, 22 nt, Human
ugcacauggcaaugcugcuccc

SEQ ID NO: 727512 - RNA, 22 nt, Human
cugaggcugggcuugccuucuu

SEQ ID NO: 727513 - RNA, 22 nt, Human
uuuccuuguucauuugcccuau

SEQ ID NO: 727514 - RNA, 22 nt, Human
uugagcccaggaggccugggug

SEQ ID NO: 727515 - RNA, 22 nt, Human
ucugggaacauggcuuggaauc

SEQ ID NO: 727516 - RNA, 22 nt, Human
cuggcugugaaauggcaguguc

SEQ ID NO: 727517 - RNA, 22 nt, Human
aaugucugagucucuguauccc

SEQ ID NO: 727518 - RNA, 23 nt, Human
ucacugugcccauugagguagag

SEQ ID NO: 727519 - RNA, 20 nt, Human
ccuggcuuugcaucugugau

SEQ ID NO: 727520 - RNA, 22 nt, Human
cugaaauucugccucugcacaa

SEQ ID NO: 727521 - RNA, 22 nt, Human
gaggagagaagcuaacggugcu

SEQ ID NO: 727522 - RNA, 23 nt, Human
cuaguaaauccugaauagcaggc

SEQ ID NO: 727523 - RNA, 21 nt, Human
agggaaaaggcugagugaggg

SEQ ID NO: 727524 - RNA, 22 nt, Human
cuauuagguaugugguugcuau

SEQ ID NO: 727525 - RNA, 22 nt, Human
ucugagagauacaaggaggcaa

SEQ ID NO: 727526 - RNA, 22 nt, Human
auuugcaagaguaagaauuucu

SEQ ID NO: 727527 - RNA, 22 nt, Human
guggcuucugcggugugcgcag

SEQ ID NO: 727528 - RNA, 22 nt, Human
aagauuuagggccaguuuacau

SEQ ID NO: 727529 - RNA, 22 nt, Human
gcugcagggaauguauggauuu

SEQ ID NO: 727530 - RNA, 22 nt, Human
aacaugcugccuuucuacgagu

SEQ ID NO: 727531 - RNA, 22 nt, Human
uggcuuuagguugcauguuucu

SEQ ID NO: 727532 - RNA, 22 nt, Human
cugcaguaaccacuguaggugu

SEQ ID NO: 727533 - RNA, 22 nt, Human
ucuacaaauaaauuacuaugua

SEQ ID NO: 727534 - RNA, 19 nt, Human
aucuuuagcaacuuucaaa

SEQ ID NO: 727535 - RNA, 22 nt, Human
uggcucagagccuugagagcug

SEQ ID NO: 727536 - RNA, 22 nt, Human
agaugguuaucuaagugaaaaa

SEQ ID NO: 727537 - RNA, 22 nt, Human
ggcacugagaacaggcugacuu

SEQ ID NO: 727538 - RNA, 22 nt, Human
cacaggaagagguauacaauuc

SEQ ID NO: 727539 - RNA, 22 nt, Human
ucuugugcuugcagcuggggag

SEQ ID NO: 727540 - RNA, 22 nt, Human
aaacuguaaugcaggaucaaga

SEQ ID NO: 727541 - RNA, 22 nt, Human
gcagaagcuguucgaaggccgc

SEQ ID NO: 727542 - RNA, 22 nt, Human
aaagaugucauacacauuaaga

SEQ ID NO: 727543 - RNA, 22 nt, Human
ccuggggaauagagucaagggg

SEQ ID NO: 727544 - RNA, 22 nt, Human
ugguuugacaaugaggacuggu

SEQ ID NO: 727545 - RNA, 22 nt, Human
gagucuuugguaaagucugcug

SEQ ID NO: 727546 - RNA, 22 nt, Human
cacaagucuguggucuccaaca

SEQ ID NO: 727547 - RNA, 22 nt, Human
uagacaggaaacauuaggaugg

SEQ ID NO: 727548 - RNA, 22 nt, Human
ucaucagaggcaucuggcaagg

SEQ ID NO: 727549 - RNA, 22 nt, Human
agcagcucagaggcaccagggc

SEQ ID NO: 727550 - RNA, 22 nt, Human
acacaugugauucuaagacagc

SEQ ID NO: 727551 - RNA, 22 nt, Human
acacuuauuuuuguccacuucc

SEQ ID NO: 727552 - RNA, 22 nt, Human
cuggaggcaaagcagaggcaug

SEQ ID NO: 727553 - RNA, 22 nt, Human
aggcugugacuacgcagggaag

SEQ ID NO: 727554 - RNA, 22 nt, Human
uccuggauuuaacccuggcucu

SEQ ID NO: 727555 - RNA, 22 nt, Human
agcugcagccgcagcuguggcc

SEQ ID NO: 727556 - RNA, 22 nt, Human
accacuguacagcagauauagu

SEQ ID NO: 727557 - RNA, 22 nt, Human
uuacagaguagugcagaacuca

SEQ ID NO: 727558 - RNA, 23 nt, Human
uucagggccucagaggugaagcu

SEQ ID NO: 727559 - RNA, 22 nt, Human
uaucauuuguuauuauuagugg

SEQ ID NO: 727560 - RNA, 22 nt, Human
ccugagagagugagcccugaca

SEQ ID NO: 727561 - RNA, 23 nt, Human
agagaaaaauaucugggcacauu

SEQ ID NO: 727562 - RNA, 22 nt, Human
uaccuggaauagagucucucca

SEQ ID NO: 727563 - RNA, 22 nt, Human
auuagauauuugcuguuggauu

SEQ ID NO: 727564 - RNA, 22 nt, Human
guacaacaugauuuuacucucu

SEQ ID NO: 727565 - RNA, 22 nt, Human
caguuuauauucuagugcuguu

SEQ ID NO: 727566 - RNA, 22 nt, Human
gagggugcucugagcccuuuug

SEQ ID NO: 727567 - RNA, 19 nt, Human
uuucuuccaaagacuaugg

SEQ ID NO: 727568 - RNA, 22 nt, Human
gggaagugaaguguagcugucu

SEQ ID NO: 727569 - RNA, 22 nt, Human
gcgaggcugggcccugcaggcg

SEQ ID NO: 727570 - RNA, 22 nt, Human
gugugccugacaugaugguuaa

SEQ ID NO: 727571 - RNA, 22 nt, Human
uucccacauucuuuacauucau

SEQ ID NO: 727572 - RNA, 22 nt, Human
cuacagaauggagggucagaga

SEQ ID NO: 727573 - RNA, 22 nt, Human
cuagaaauacaggcacgugcca

SEQ ID NO: 727574 - RNA, 22 nt, Human
ggugcaaagggccuagagagug

SEQ ID NO: 727575 - RNA, 22 nt, Human
gggcucagggacacaugugugu

SEQ ID NO: 727576 - RNA, 22 nt, Human
caaugacagguucaugacuccu

SEQ ID NO: 727577 - RNA, 22 nt, Human
acaugagaggcuguggaguaca

SEQ ID NO: 727578 - RNA, 22 nt, Human
ggccucaguuucuccauggguu

SEQ ID NO: 727579 - RNA, 22 nt, Human
ccuccagccuuccugaagagcc

SEQ ID NO: 727580 - RNA, 22 nt, Human
ccugugggucacaugggugacu

SEQ ID NO: 727581 - RNA, 22 nt, Human
ugaucuuugggccauuaauaaa

SEQ ID NO: 727582 - RNA, 22 nt, Human
aaauuccauuaggaaacuucca

SEQ ID NO: 727583 - RNA, 22 nt, Human
agaggggcagggucuccggauu

SEQ ID NO: 727584 - RNA, 22 nt, Human
cuuccugggucuggagacugga

SEQ ID NO: 727585 - RNA, 22 nt, Human
uuauggaaaugaaauuuuauug

SEQ ID NO: 727586 - RNA, 22 nt, Human
cuuuugcaccuuuuaaguaaug

SEQ ID NO: 727587 - RNA, 22 nt, Human
cagaacaguaccuagcacauag

SEQ ID NO: 727588 - RNA, 22 nt, Human
aaaccuagaaggaagggucucu

SEQ ID NO: 727589 - RNA, 22 nt, Human
cucucuggaauuaaagcccaau

SEQ ID NO: 727590 - RNA, 22 nt, Human
gcagcacugauccuaaacuuag

SEQ ID NO: 727591 - RNA, 22 nt, Human
cucugagguccuacagugaccc

SEQ ID NO: 727592 - RNA, 22 nt, Human
cuuuuuccagcuucaggguggg

SEQ ID NO: 727593 - RNA, 22 nt, Human
gccagccacaagggaggcuugu

SEQ ID NO: 727594 - RNA, 22 nt, Human
gcuccaggugucccagguaaaa

SEQ ID NO: 727595 - RNA, 22 nt, Human
cucugcaguguaacagcgcuug

SEQ ID NO: 727596 - RNA, 22 nt, Human
guguuuccaguucagaaagcaa

SEQ ID NO: 727597 - RNA, 22 nt, Human
uagcugugagcacccaggcugu

SEQ ID NO: 727598 - RNA, 22 nt, Human
agugucauuuuguccaucuucu

SEQ ID NO: 727599 - RNA, 22 nt, Human
auuuccaugaauucccacucau

SEQ ID NO: 727600 - RNA, 22 nt, Human
ugcugaaaaugcguaucuucca

SEQ ID NO: 727601 - RNA, 22 nt, Human
guagaauuaccucucuaugucc

SEQ ID NO: 727602 - RNA, 22 nt, Human
ccucagcucccaugagaucugc

SEQ ID NO: 727603 - RNA, 22 nt, Human
uuaaguccuugguaauuuucuu

SEQ ID NO: 727604 - RNA, 22 nt, Human
auucuucauuuacuguuacuug

SEQ ID NO: 727605 - RNA, 22 nt, Human
ucccacugucugucuugcugca

SEQ ID NO: 727606 - RNA, 22 nt, Human
ucuuucaaagcuguaguagauu

SEQ ID NO: 727607 - RNA, 22 nt, Human
ggacagcccauacacaugucug

SEQ ID NO: 727608 - RNA, 22 nt, Human
cucugaggcuccaugcaggcuu

SEQ ID NO: 727609 - RNA, 22 nt, Human
gcugggcucuuuaccccuguac

SEQ ID NO: 727610 - RNA, 22 nt, Human
ugggcuggagcuuguugcuucc

SEQ ID NO: 727611 - RNA, 22 nt, Human
ucacuuuagaggaaacauugag

SEQ ID NO: 727612 - RNA, 21 nt, Human
caggaaaagcggaagucuagc

SEQ ID NO: 727613 - RNA, 20 nt, Human
ugcugaggccugaggccugg

SEQ ID NO: 727614 - RNA, 22 nt, Human
cuucuggcguuggaggucugag

SEQ ID NO: 727615 - RNA, 22 nt, Human
uccaggugggcugcacccaggc

SEQ ID NO: 727616 - RNA, 22 nt, Human
guguacaugagaaaucaacuuu

SEQ ID NO: 727617 - RNA, 22 nt, Human
uagcccugcugugaugugaagu

SEQ ID NO: 727618 - RNA, 22 nt, Human
uauggcuugucccuggucaguc

SEQ ID NO: 727619 - RNA, 22 nt, Human
aaagcuuucuagcuauguucua

SEQ ID NO: 727620 - RNA, 21 nt, Human
gccagccaugcuugccuaggc

SEQ ID NO: 727621 - RNA, 22 nt, Human
augauacucuaggugauuuaca

SEQ ID NO: 727622 - RNA, 19 nt, Human
gcaggcuugggucucccca

SEQ ID NO: 727623 - RNA, 22 nt, Human
ccucagccuuggccccaggcag

SEQ ID NO: 727624 - RNA, 22 nt, Human
agagagcaggacuucacugagc

SEQ ID NO: 727625 - RNA, 22 nt, Human
cuguggcucugcagucccaaca

SEQ ID NO: 727626 - RNA, 22 nt, Human
acuucacagaaauuuuaugagg

SEQ ID NO: 727627 - RNA, 17 nt, Human
agcacuaaaaugcuucc

SEQ ID NO: 727628 - RNA, 22 nt, Human
aacagcuugaggaauaucauca

SEQ ID NO: 727629 - RNA, 22 nt, Human
cugggaguggugacagcucucg

SEQ ID NO: 727630 - RNA, 23 nt, Human
agccccucauaucugcuuucucu

SEQ ID NO: 727631 - RNA, 22 nt, Human
cuccugagcugcagccuugugu

SEQ ID NO: 727632 - RNA, 22 nt, Human
cugcuggccuagcccauccucu

SEQ ID NO: 727633 - RNA, 22 nt, Human
caguggguccuaaguacaguuc

SEQ ID NO: 727634 - RNA, 22 nt, Human
acagcagagccaguggcucuag

SEQ ID NO: 727635 - RNA, 22 nt, Human
cugagucucccggcaguggagg

SEQ ID NO: 727636 - RNA, 22 nt, Human
aagaggcuggaggauacugcgc

SEQ ID NO: 727637 - RNA, 22 nt, Human
gaacaguaaauuuaugcagcac

SEQ ID NO: 727638 - RNA, 22 nt, Human
cuucacagucuuuauuuccucc

SEQ ID NO: 727639 - RNA, 22 nt, Human
acacuucaaaugguuggaaaau

SEQ ID NO: 727640 - RNA, 22 nt, Human
gucuuucuucagagcuuggacu

SEQ ID NO: 727641 - RNA, 22 nt, Human
aggaaacuaaagcccagagagg

SEQ ID NO: 727642 - RNA, 22 nt, Human
acuguacacgugucauuuacag

SEQ ID NO: 727643 - RNA, 22 nt, Human
uccuucaagugcaguaccugag

SEQ ID NO: 727644 - RNA, 22 nt, Human
uuacaguguuacuugaugucca

SEQ ID NO: 727645 - RNA, 22 nt, Human
cucagggcucugcaugcacacg

SEQ ID NO: 727646 - RNA, 22 nt, Human
agcugcagucaagcugggccac

SEQ ID NO: 727647 - RNA, 22 nt, Human
uuguguacagguguuuccaagu

SEQ ID NO: 727648 - RNA, 22 nt, Human
cuucccugauaagagccucaga

SEQ ID NO: 727649 - RNA, 18 nt, Human
ccagguggugacagagau

SEQ ID NO: 727650 - RNA, 22 nt, Human
gccagaggcccaaggacagcug

SEQ ID NO: 727651 - RNA, 22 nt, Human
uagcagcuaccuggcuaagagu

SEQ ID NO: 727652 - RNA, 22 nt, Human
uucucugcucucacauacagaa

SEQ ID NO: 727653 - RNA, 22 nt, Human
acguuuucagccuuaauguaga

SEQ ID NO: 727654 - RNA, 22 nt, Human
cuccagaggaaagcacauagug

SEQ ID NO: 727655 - RNA, 22 nt, Human
aagacacugggggcugcagcca

SEQ ID NO: 727656 - RNA, 22 nt, Human
cucucuggcccauccuguugcc

SEQ ID NO: 727657 - RNA, 22 nt, Human
agcaggcugccuuccaaagccu

SEQ ID NO: 727658 - RNA, 22 nt, Human
ugucuuaaacuugugggacuuc

SEQ ID NO: 727659 - RNA, 22 nt, Human
acagggcagagggcaguuggua

SEQ ID NO: 727660 - RNA, 22 nt, Human
agcagcuuggggccgagauaga

SEQ ID NO: 727661 - RNA, 22 nt, Human
agauuaugcuggcugcuacaag

SEQ ID NO: 727662 - RNA, 22 nt, Human
gcagccaggaaagcuggacccu

SEQ ID NO: 727663 - RNA, 22 nt, Human
cccucagucuggcugggaagac

SEQ ID NO: 727664 - RNA, 22 nt, Human
guggccaacucaauguuuuuca

SEQ ID NO: 727665 - RNA, 22 nt, Human
agagcacagaaguuauauguua

SEQ ID NO: 727666 - RNA, 20 nt, Human
aacuccuagccucaagugau

SEQ ID NO: 727667 - RNA, 22 nt, Human
aaggcacaugaccuaggccugg

SEQ ID NO: 727668 - RNA, 22 nt, Human
uccuuacagguuacagaaagca

SEQ ID NO: 727669 - RNA, 22 nt, Human
ucugaaauauauuuugaguguu

SEQ ID NO: 727670 - RNA, 22 nt, Human
uggcagauuguaggcaguuagg

SEQ ID NO: 727671 - RNA, 22 nt, Human
uaugagcaagaguuugugaagg

SEQ ID NO: 727672 - RNA, 22 nt, Human
ggcaccagcacuugggauggcu

SEQ ID NO: 727673 - RNA, 23 nt, Human
gccaucacguucaaccaaagccu

SEQ ID NO: 727674 - RNA, 22 nt, Human
gagggcugcugccagauaugcc

SEQ ID NO: 727675 - RNA, 22 nt, Human
gaugaaauccagaucacaggug

SEQ ID NO: 727676 - RNA, 22 nt, Human
ucugugucugguugggccagua

SEQ ID NO: 727677 - RNA, 22 nt, Human
aacugcuuugugagcuuucugg

SEQ ID NO: 727678 - RNA, 22 nt, Human
cucaaguuggcaugaacaaauu

SEQ ID NO: 727679 - RNA, 21 nt, Human
uggcugccuggcucugugguu

SEQ ID NO: 727680 - RNA, 22 nt, Human
cuguacagaagcuagagcaaau

SEQ ID NO: 727681 - RNA, 17 nt, Human
aggccucccuccaggcc

SEQ ID NO: 727682 - RNA, 22 nt, Human
cuccucuucugaguaccaggga

SEQ ID NO: 727683 - RNA, 22 nt, Human
ucugucugaggaguuuuugacc

SEQ ID NO: 727684 - RNA, 22 nt, Human
aaacaaagccagggaaguuaug

SEQ ID NO: 727685 - RNA, 22 nt, Human
gcccaagggcaucaaguucuac

SEQ ID NO: 727686 - RNA, 22 nt, Human
ugcuuuaaaguauuucucgcaa

SEQ ID NO: 727687 - RNA, 22 nt, Human
acaaugucaaaauaggaaacau

SEQ ID NO: 727688 - RNA, 22 nt, Human
ugacugccaugagggugagggc

SEQ ID NO: 727689 - RNA, 22 nt, Human
uaggaagccuaaauuaaguggu

SEQ ID NO: 727690 - RNA, 19 nt, Human
uuuuuaaugggcuggagca

SEQ ID NO: 727691 - RNA, 23 nt, Human
ggcuggaagaaaacagaauuguu

SEQ ID NO: 727692 - RNA, 22 nt, Human
cagcagcaguggcugcagaaca

SEQ ID NO: 727693 - RNA, 22 nt, Human
aaaguauucuugacuguuuuuc

SEQ ID NO: 727694 - RNA, 22 nt, Human
gagcugaaucagagauauuauu

SEQ ID NO: 727695 - RNA, 22 nt, Human
uguguagcuuucuucugugggg

SEQ ID NO: 727696 - RNA, 22 nt, Human
gcaugugggagggucuucccac

SEQ ID NO: 727697 - RNA, 22 nt, Human
cuguaacuuaaugagaggcaga

SEQ ID NO: 727698 - RNA, 22 nt, Human
uucacauuaucaggauuguuuc

SEQ ID NO: 727699 - RNA, 17 nt, Human
ucgguuugccaggcuuc

SEQ ID NO: 727700 - RNA, 22 nt, Human
gaauagcuguaggcuagugucu

SEQ ID NO: 727701 - RNA, 22 nt, Human
ugaauaaaguauguccugggaa

SEQ ID NO: 727702 - RNA, 22 nt, Human
gaggaggcuggcgccgccugcc

SEQ ID NO: 727703 - RNA, 22 nt, Human
uacaaagaggcagcuccauuuu

SEQ ID NO: 727704 - RNA, 22 nt, Human
aagauuauuuaagacaggaacc

SEQ ID NO: 727705 - RNA, 19 nt, Human
uuugggaagcccagagugu

SEQ ID NO: 727706 - RNA, 22 nt, Human
ugcagaacagggccaugucacc

SEQ ID NO: 727707 - RNA, 22 nt, Human
uucugggcagagcuggagcugc

SEQ ID NO: 727708 - RNA, 22 nt, Human
ccuggcugcuauagcagcaugu

SEQ ID NO: 727709 - RNA, 23 nt, Human
cucagaggccuguccaggguggu

SEQ ID NO: 727710 - RNA, 22 nt, Human
gugugcagaagacacaagacau

SEQ ID NO: 727711 - RNA, 22 nt, Human
aaacagauugaaauucguagua

SEQ ID NO: 727712 - RNA, 22 nt, Human
guguggggaggagagagcccuu

SEQ ID NO: 727713 - RNA, 22 nt, Human
cauucucugaucuucacauacc

SEQ ID NO: 727714 - RNA, 22 nt, Human
cauugagaggcugccugccuga

SEQ ID NO: 727715 - RNA, 22 nt, Human
ggcccagagucugcaauggagu

SEQ ID NO: 727716 - RNA, 22 nt, Human
acugagcugugacaaugcuuaa

SEQ ID NO: 727717 - RNA, 23 nt, Human
ccaggcucuuucaccugcuauuc

SEQ ID NO: 727718 - RNA, 20 nt, Human
ccucaaauaagugccagcau

SEQ ID NO: 727719 - RNA, 22 nt, Human
gggagccacucagcugagaguu

SEQ ID NO: 727720 - RNA, 22 nt, Human
gaguucucaagcaaucaaagag

SEQ ID NO: 727721 - RNA, 22 nt, Human
caucucaggucugugguucacu

SEQ ID NO: 727722 - RNA, 22 nt, Human
caggucucccauccccucuguu

SEQ ID NO: 727723 - RNA, 22 nt, Human
agcuggccggccuccaggugga

SEQ ID NO: 727724 - RNA, 22 nt, Human
guggucaucuggguuuguggca

SEQ ID NO: 727725 - RNA, 22 nt, Human
ugagcaggucaggaaguacauu

SEQ ID NO: 727726 - RNA, 22 nt, Human
ucagagaguuagugucuuagcu

SEQ ID NO: 727727 - RNA, 22 nt, Human
ucccaggacaugggcucugcuc

SEQ ID NO: 727728 - RNA, 22 nt, Human
cugaggcaccggcaauguucug

SEQ ID NO: 727729 - RNA, 22 nt, Human
cuggaagggucagagugaugag

SEQ ID NO: 727730 - RNA, 22 nt, Human
aagugcuuagaaguugcauuag

SEQ ID NO: 727731 - RNA, 22 nt, Human
cagguccaauugcgcuaaaauc

SEQ ID NO: 727732 - RNA, 22 nt, Human
acagauugaucuugagaauuau

SEQ ID NO: 727733 - RNA, 22 nt, Human
gagacugauggggcucccagaa

SEQ ID NO: 727734 - RNA, 22 nt, Human
aagaaauuaaggaaugcaacga

SEQ ID NO: 727735 - RNA, 22 nt, Human
agugcuuauaccaaagacucuu

SEQ ID NO: 727736 - RNA, 22 nt, Human
aauuggcuauauuauuuagccu

SEQ ID NO: 727737 - RNA, 22 nt, Human
ugcaggugcugugucaagagag

SEQ ID NO: 727738 - RNA, 22 nt, Human
cucugcugucucagaugggcca

SEQ ID NO: 727739 - RNA, 22 nt, Human
ucaaugcaaucauuggacaagu

SEQ ID NO: 727740 - RNA, 22 nt, Human
uuggaagacagugaaacagcac

SEQ ID NO: 727741 - RNA, 22 nt, Human
gucccagaugucuggaacuccc

SEQ ID NO: 727742 - RNA, 22 nt, Human
auccuuaagaaaguuuucuaua

SEQ ID NO: 727743 - RNA, 22 nt, Human
ggagucaccaaguaggagucuu

SEQ ID NO: 727744 - RNA, 22 nt, Human
aucagaaaucuaggauucagaa

SEQ ID NO: 727745 - RNA, 22 nt, Human
gagcaucuaugugcuggguacu

SEQ ID NO: 727746 - RNA, 19 nt, Human
auuuauuguaugauuccau

SEQ ID NO: 727747 - RNA, 22 nt, Human
gagcaugagggaaggcagcaga

SEQ ID NO: 727748 - RNA, 22 nt, Human
cucccaggcagggcugcccacu

SEQ ID NO: 727749 - RNA, 22 nt, Human
aggcugccaaagcuucugucuc

SEQ ID NO: 727750 - RNA, 22 nt, Human
ucacaucucccuggaggacaca

SEQ ID NO: 727751 - RNA, 22 nt, Human
ugugacuuaauccuuggguggg

SEQ ID NO: 727752 - RNA, 23 nt, Human
ugacagagcaagacuuggucuca

SEQ ID NO: 727753 - RNA, 22 nt, Human
cauaaucagauguguacauaag

SEQ ID NO: 727754 - RNA, 22 nt, Human
ucacaggcuugugaacauugca

SEQ ID NO: 727755 - RNA, 22 nt, Human
cacagaggaaaugacuuucuua

SEQ ID NO: 727756 - RNA, 22 nt, Human
aaaagcucuuucugcuguagau

SEQ ID NO: 727757 - RNA, 22 nt, Human
uuucucagccuccuugcuggag

SEQ ID NO: 727758 - RNA, 22 nt, Human
gcguggcuuagagugggguacc

SEQ ID NO: 727759 - RNA, 22 nt, Human
uuuaaauuuagaagaaacacug

SEQ ID NO: 727760 - RNA, 22 nt, Human
ucaucugaaauuguauauguag

SEQ ID NO: 727761 - RNA, 22 nt, Human
uaucagcaggccaaagcugcaa

SEQ ID NO: 727762 - RNA, 22 nt, Human
uugaaagaaggugguagagaau

SEQ ID NO: 727763 - RNA, 22 nt, Human
acugucaugaucgaagauguca

SEQ ID NO: 727764 - RNA, 22 nt, Human
uacuuagagcgauaauuuauac

SEQ ID NO: 727765 - RNA, 22 nt, Human
cuggcacucauaggccaguuca

SEQ ID NO: 727766 - RNA, 22 nt, Human
aaagucaugcaguugaacuuuu

SEQ ID NO: 727767 - RNA, 22 nt, Human
aauaccagagacaguguuuacc

SEQ ID NO: 727768 - RNA, 22 nt, Human
cccuggccuccaggcaguccug

SEQ ID NO: 727769 - RNA, 22 nt, Human
acagauggcacuuuuuaggacu

SEQ ID NO: 727770 - RNA, 22 nt, Human
ccagaaucaucaucugaagccu

SEQ ID NO: 727771 - RNA, 22 nt, Human
acuucauugcuaagaacaaggu

SEQ ID NO: 727772 - RNA, 22 nt, Human
cacaggagagguuaaugggggc

SEQ ID NO: 727773 - RNA, 22 nt, Human
ucugggcuugccugguugugca

SEQ ID NO: 727774 - RNA, 21 nt, Human
cagaggcagguccugggacgg

SEQ ID NO: 727775 - RNA, 22 nt, Human
ucuuaaaugacugauaagagga

SEQ ID NO: 727776 - RNA, 22 nt, Human
agcuccagcggauggucuuaua

SEQ ID NO: 727777 - RNA, 22 nt, Human
ucugagcagagcaucauuucag

SEQ ID NO: 727778 - RNA, 22 nt, Human
acuggccaggcacagcuguggg

SEQ ID NO: 727779 - RNA, 22 nt, Human
uggcuggaccugggcuggaauu

SEQ ID NO: 727780 - RNA, 22 nt, Human
cuuuuacugugaaaagaaacug

SEQ ID NO: 727781 - RNA, 22 nt, Human
guaaauauaaaugcuagcugcc

SEQ ID NO: 727782 - RNA, 22 nt, Human
agccccaggaugggccgcagga

SEQ ID NO: 727783 - RNA, 16 nt, Human
acagugugcuaagcau

SEQ ID NO: 727784 - RNA, 22 nt, Human
ggcuggagacaacguccugccc

SEQ ID NO: 727785 - RNA, 22 nt, Human
acugucccauuuauguagacau

SEQ ID NO: 727786 - RNA, 22 nt, Human
aaauugcaaccaggucucuguc

SEQ ID NO: 727787 - RNA, 22 nt, Human
uaggaggguuagagggaaauau

SEQ ID NO: 727788 - RNA, 23 nt, Human
uccaggcugggacuucaacuggc

SEQ ID NO: 727789 - RNA, 22 nt, Human
uucaaguaaugcuacuccuaug

SEQ ID NO: 727790 - RNA, 22 nt, Human
uggcccaggugcaagagacaga

SEQ ID NO: 727791 - RNA, 22 nt, Human
aaggcugaaagaccuugaaccu

SEQ ID NO: 727792 - RNA, 22 nt, Human
aucaaugcucuguacccagaau

SEQ ID NO: 727793 - RNA, 22 nt, Human
ucaguagcccuugaguucaugu

SEQ ID NO: 727794 - RNA, 19 nt, Human
cucaccuggaggugcugau

SEQ ID NO: 727795 - RNA, 22 nt, Human
ccagggcugccuggccgugugu

SEQ ID NO: 727796 - RNA, 22 nt, Human
cagcuaguaaauggcaagacua

SEQ ID NO: 727797 - RNA, 22 nt, Human
ugguccuggggugcaggcugac

SEQ ID NO: 727798 - RNA, 22 nt, Human
guuuggauagugagagauacuu

SEQ ID NO: 727799 - RNA, 22 nt, Human
gccuucagcggccgcucgcugc

SEQ ID NO: 727800 - RNA, 22 nt, Human
auacaugugcuauguuggugua

SEQ ID NO: 727801 - RNA, 22 nt, Human
ucuacuuccgcaaaaggcacau

SEQ ID NO: 727802 - RNA, 22 nt, Human
agauccugccaauggaagcagg

SEQ ID NO: 727803 - RNA, 22 nt, Human
cagggcuguggaaaacuggugc

SEQ ID NO: 727804 - RNA, 22 nt, Human
cuggcucugaguggcucuaauu

SEQ ID NO: 727805 - RNA, 22 nt, Human
gccuuccaccuaggccucugcu

SEQ ID NO: 727806 - RNA, 22 nt, Human
ucccaggcuggggccaggugac

SEQ ID NO: 727807 - RNA, 22 nt, Human
uuguagcagggaucagaauaca

SEQ ID NO: 727808 - RNA, 22 nt, Human
uagcucauguaauccgaacaua

SEQ ID NO: 727809 - RNA, 22 nt, Human
gcagcccagguguagcucuuug

SEQ ID NO: 727810 - RNA, 22 nt, Human
aacagaacuguuguucuggagg

SEQ ID NO: 727811 - RNA, 22 nt, Human
ucacuguaccuuccauuucauu

SEQ ID NO: 727812 - RNA, 18 nt, Human
acuccccacaggcucugu

SEQ ID NO: 727813 - RNA, 22 nt, Human
guacaguaguaaaagugaauga

SEQ ID NO: 727814 - RNA, 22 nt, Human
ggguggugggcacagaaucugg

SEQ ID NO: 727815 - RNA, 22 nt, Human
cagacagguugcaaaacuucaa

SEQ ID NO: 727816 - RNA, 23 nt, Human
uccuggguuugaauucuagucuu

SEQ ID NO: 727817 - RNA, 22 nt, Human
uccaggcagagcaacaaaauau

SEQ ID NO: 727818 - RNA, 22 nt, Human
aaguacauccuagucucuuuca

SEQ ID NO: 727819 - RNA, 22 nt, Human
ugugccagccucuggcuguguc

SEQ ID NO: 727820 - RNA, 22 nt, Human
ggacugucuccuugcugguagg

SEQ ID NO: 727821 - RNA, 22 nt, Human
caggacuggcucgcagugggug

SEQ ID NO: 727822 - RNA, 22 nt, Human
gguaugaaaugauuccauguua

SEQ ID NO: 727823 - RNA, 21 nt, Human
ucuuuccugcccaguugcccu

SEQ ID NO: 727824 - RNA, 22 nt, Human
ggagagcugacaucaugauguu

SEQ ID NO: 727825 - RNA, 22 nt, Human
uaagacauccuggauguucaaa

SEQ ID NO: 727826 - RNA, 22 nt, Human
agaggccaauaguagguggcau

SEQ ID NO: 727827 - RNA, 22 nt, Human
aaugacucugcugcagagacac

SEQ ID NO: 727828 - RNA, 22 nt, Human
uuacaacagcgauuuaccuguc

SEQ ID NO: 727829 - RNA, 22 nt, Human
ccuggcagcgccgaagcuggcc

SEQ ID NO: 727830 - RNA, 22 nt, Human
ccuaguccccaggaggucagug

SEQ ID NO: 727831 - RNA, 22 nt, Human
gaaccuuaugguaaaucuagag

SEQ ID NO: 727832 - RNA, 22 nt, Human
gaugucugccaaagaaucaagc

SEQ ID NO: 727833 - RNA, 22 nt, Human
gcuguguggcaaagggauuaca

SEQ ID NO: 727834 - RNA, 22 nt, Human
cccuccagagcuugaccugcug

SEQ ID NO: 727835 - RNA, 22 nt, Human
uaguggggccugggaggguucc

SEQ ID NO: 727836 - RNA, 22 nt, Human
aaaguacaaggaaaggaucuga

SEQ ID NO: 727837 - RNA, 22 nt, Human
cacagagaucggaacagaagua

SEQ ID NO: 727838 - RNA, 21 nt, Human
aaagaaucauggguaauuuca

SEQ ID NO: 727839 - RNA, 22 nt, Human
uggcagagagacucuccuugau

SEQ ID NO: 727840 - RNA, 22 nt, Human
uccagcucaaauucagcuucca

SEQ ID NO: 727841 - RNA, 22 nt, Human
ugaucuagguuggcuucaacug

SEQ ID NO: 727842 - RNA, 22 nt, Human
cuggcaugccuugggugccucu

SEQ ID NO: 727843 - RNA, 22 nt, Human
gagaaugggaaugaaaguagca

SEQ ID NO: 727844 - RNA, 22 nt, Human
gaccugccugagcugccucugc

SEQ ID NO: 727845 - RNA, 22 nt, Human
auuuguaccauacuguuuauua

SEQ ID NO: 727846 - RNA, 20 nt, Human
aaaauauguauaacucuucu

SEQ ID NO: 727847 - RNA, 22 nt, Human
cccuccuggaggcggaugccca

SEQ ID NO: 727848 - RNA, 22 nt, Human
cagccagagaggaaggaaugca

SEQ ID NO: 727849 - RNA, 22 nt, Human
aaggugugaacugauucauugg

SEQ ID NO: 727850 - RNA, 22 nt, Human
ggagcccuagcugugcaucaga

SEQ ID NO: 727851 - RNA, 22 nt, Human
cugcaguucuucuccucaaggc

SEQ ID NO: 727852 - RNA, 22 nt, Human
gcccucagaguuccccacagug

SEQ ID NO: 727853 - RNA, 22 nt, Human
uagcaucuugauuucagaccag

SEQ ID NO: 727854 - RNA, 22 nt, Human
augaaguucucaauaaucaugu

SEQ ID NO: 727855 - RNA, 22 nt, Human
aggugcccaucaccucacaguc

SEQ ID NO: 727856 - RNA, 22 nt, Human
uaaagguuauaaagguuagggg

SEQ ID NO: 727857 - RNA, 22 nt, Human
auaaucugacaaagacuuaagc

SEQ ID NO: 727858 - RNA, 22 nt, Human
ggagaagccaggugauaagcaa

SEQ ID NO: 727859 - RNA, 22 nt, Human
aacaggcuauuucuuuacaaac

SEQ ID NO: 727860 - RNA, 22 nt, Human
uacaaacuguccagcccagagg

SEQ ID NO: 727861 - RNA, 22 nt, Human
caguguuccaggcggcagugaa

SEQ ID NO: 727862 - RNA, 22 nt, Human
acugucugcuggccccugguua

SEQ ID NO: 727863 - RNA, 21 nt, Human
auguagugacuucauuccuuc

SEQ ID NO: 727864 - RNA, 22 nt, Human
uggccaugggauagugcagggg

SEQ ID NO: 727865 - RNA, 22 nt, Human
gaaguacaguuuuaucuagcca

SEQ ID NO: 727866 - RNA, 22 nt, Human
cuggucagggcucuuugggagc

SEQ ID NO: 727867 - RNA, 22 nt, Human
uaugucugcuugguuuuggaau

SEQ ID NO: 727868 - RNA, 22 nt, Human
aguaugucagagugaaaauggu

SEQ ID NO: 727869 - RNA, 22 nt, Human
guggccagccccauggacaguu

SEQ ID NO: 727870 - RNA, 22 nt, Human
uaaacagagagugcaguuauag

SEQ ID NO: 727871 - RNA, 22 nt, Human
gaaagaaugagcaucaugacuu

SEQ ID NO: 727872 - RNA, 22 nt, Human
gcuuuucuucagcagccugaug

SEQ ID NO: 727873 - RNA, 22 nt, Human
cagcugaauucuucagacucca

SEQ ID NO: 727874 - RNA, 22 nt, Human
cacagcauugccuuccaaaagg

SEQ ID NO: 727875 - RNA, 19 nt, Human
aacuagaaagguuuugaga

SEQ ID NO: 727876 - RNA, 22 nt, Human
ucacagugaugacgugggagca

SEQ ID NO: 727877 - RNA, 22 nt, Human
agagauuugucaaugauuucca

SEQ ID NO: 727878 - RNA, 20 nt, Human
cagcagaaauggggugggaa

SEQ ID NO: 727879 - RNA, 22 nt, Human
gacaugcaacaauuuggcauuu

SEQ ID NO: 727880 - RNA, 22 nt, Human
uguuugaacugaauaacauagu

SEQ ID NO: 727881 - RNA, 22 nt, Human
gcugagccccccugcguggguc

SEQ ID NO: 727882 - RNA, 20 nt, Human
caauaauuuacuucccuauu

SEQ ID NO: 727883 - RNA, 22 nt, Human
uuagauuuacaagcacuguuua

SEQ ID NO: 727884 - RNA, 22 nt, Human
ucagcaucuacagcuuugcuau

SEQ ID NO: 727885 - RNA, 22 nt, Human
uuuaauguuaaauuuguagaug

SEQ ID NO: 727886 - RNA, 22 nt, Human
ugacaucuaguagguagagacc

SEQ ID NO: 727887 - RNA, 22 nt, Human
ggacaggggcguggggauuguu

SEQ ID NO: 727888 - RNA, 22 nt, Human
caugugcuguagcagagaggaa

SEQ ID NO: 727889 - RNA, 22 nt, Human
guggccugccgugugguauggg

SEQ ID NO: 727890 - RNA, 22 nt, Human
agcuucuagcccauccagcagg

SEQ ID NO: 727891 - RNA, 22 nt, Human
gaggcucccucaacucugggug

SEQ ID NO: 727892 - RNA, 22 nt, Human
aagcaauguguuugaaaggcca

SEQ ID NO: 727893 - RNA, 22 nt, Human
uuaguuaauugacuauguugca

SEQ ID NO: 727894 - RNA, 22 nt, Human
acuguuacagagcaggaaauug

SEQ ID NO: 727895 - RNA, 21 nt, Human
ugaaugcuucgucauccuggc

SEQ ID NO: 727896 - RNA, 22 nt, Human
cuccugguucagagagcugaga

SEQ ID NO: 727897 - RNA, 22 nt, Human
ggacagugugggccaucucacu

SEQ ID NO: 727898 - RNA, 22 nt, Human
caggcugaggguuaggccuuag

SEQ ID NO: 727899 - RNA, 22 nt, Human
gagcacuguacucauuugcacu

SEQ ID NO: 727900 - RNA, 22 nt, Human
ucaggaaagaguguauccauca

SEQ ID NO: 727901 - RNA, 22 nt, Human
acagcucugcauuuuggguuaa

SEQ ID NO: 727902 - RNA, 22 nt, Human
acacagaggcaugacaguggcu

SEQ ID NO: 727903 - RNA, 22 nt, Human
gcugucuuggguagaaagaggu

SEQ ID NO: 727904 - RNA, 18 nt, Human
aguaggcacugugggguu

SEQ ID NO: 727905 - RNA, 22 nt, Human
guccuggaguggcauggcaugg

SEQ ID NO: 727906 - RNA, 22 nt, Human
auguauuuacugagaaggaaac

SEQ ID NO: 727907 - RNA, 19 nt, Human
ugagauuucuuaggugauu

SEQ ID NO: 727908 - RNA, 22 nt, Human
gcaggaaucuaacccaaggaga

SEQ ID NO: 727909 - RNA, 22 nt, Human
aaacacauuagcccuguggaaa

SEQ ID NO: 727910 - RNA, 22 nt, Human
aaggaugugacucagucagcua

SEQ ID NO: 727911 - RNA, 22 nt, Human
aucaaaguggaaguuuacuagg

SEQ ID NO: 727912 - RNA, 21 nt, Human
uuucuuaggcucuaaaaugac

SEQ ID NO: 727913 - RNA, 22 nt, Human
ugggccugauucuugaauccug

SEQ ID NO: 727914 - RNA, 22 nt, Human
ggagaagccacacauugggugu

SEQ ID NO: 727915 - RNA, 22 nt, Human
aggacacuuggcuauuguucca

SEQ ID NO: 727916 - RNA, 22 nt, Human
auaagguuggucuuaacuaccu

SEQ ID NO: 727917 - RNA, 22 nt, Human
agccucugcuuaugcaaaggua

SEQ ID NO: 727918 - RNA, 20 nt, Human
uggagagccucuggacugug

SEQ ID NO: 727919 - RNA, 22 nt, Human
ugcugaaagucccaaaucucau

SEQ ID NO: 727920 - RNA, 22 nt, Human
aaaugaccagaauacaggcuuc

SEQ ID NO: 727921 - RNA, 23 nt, Human
auaugucaugcaccagcacuuua

SEQ ID NO: 727922 - RNA, 22 nt, Human
ucuacuucuccuucauuuccca

SEQ ID NO: 727923 - RNA, 22 nt, Human
cacuuagauacuagaucacaaa

SEQ ID NO: 727924 - RNA, 20 nt, Human
gcagagugugagagggugaa

SEQ ID NO: 727925 - RNA, 22 nt, Human
ucugccaggccugcuuccgggg

SEQ ID NO: 727926 - RNA, 22 nt, Human
ccuuccagugacuaaggaggaa

SEQ ID NO: 727927 - RNA, 22 nt, Human
ucagaagaguaauagggugaga

SEQ ID NO: 727928 - RNA, 22 nt, Human
acaugcagaauucuuagagagc

SEQ ID NO: 727929 - RNA, 19 nt, Human
cagaugagaaaagugaggu

SEQ ID NO: 727930 - RNA, 22 nt, Human
ucuuaacugacaguuuaauggg

SEQ ID NO: 727931 - RNA, 22 nt, Human
aguuuguaaacuugagcuagcc

SEQ ID NO: 727932 - RNA, 22 nt, Human
cugccuggggcaucagucaagg

SEQ ID NO: 727933 - RNA, 22 nt, Human
cuugagaacaggguuagguaac

SEQ ID NO: 727934 - RNA, 20 nt, Human
uccaguggccugaaucugga

SEQ ID NO: 727935 - RNA, 22 nt, Human
aguuucucuuugacaccaaaau

SEQ ID NO: 727936 - RNA, 23 nt, Human
ugcagccacucaggagcucagug

SEQ ID NO: 727937 - RNA, 22 nt, Human
gagcagugaagacagaaguaca

SEQ ID NO: 727938 - RNA, 22 nt, Human
acagaaauugggcaaauggaag

SEQ ID NO: 727939 - RNA, 22 nt, Human
uugaucaucuaagaguaauagu

SEQ ID NO: 727940 - RNA, 22 nt, Human
uggaggaugccauccaggauac

SEQ ID NO: 727941 - RNA, 22 nt, Human
uggccucagauuauugcacagu

SEQ ID NO: 727942 - RNA, 22 nt, Human
gaauaacauuuuuuccuuuaca

SEQ ID NO: 727943 - RNA, 21 nt, Human
gaggcugucugcugcuggccu

SEQ ID NO: 727944 - RNA, 22 nt, Human
ugguggagccuaggcuaagucu

SEQ ID NO: 727945 - RNA, 22 nt, Human
ucucucagauggggcacuagua

SEQ ID NO: 727946 - RNA, 22 nt, Human
ucugugacugauggaggcuuuu

SEQ ID NO: 727947 - RNA, 19 nt, Human
aggaauuucucagggaggc

SEQ ID NO: 727948 - RNA, 22 nt, Human
uagugaaagucaaagacagcua

SEQ ID NO: 727949 - RNA, 22 nt, Human
uccagagguauguagagaguau

SEQ ID NO: 727950 - RNA, 22 nt, Human
cugcagcuauauuuucccacag

SEQ ID NO: 727951 - RNA, 22 nt, Human
agucagugaaaacuagaauguu

SEQ ID NO: 727952 - RNA, 22 nt, Human
ugcucauuaggacugcaaauuc

SEQ ID NO: 727953 - RNA, 22 nt, Human
acagggaauggagggaucagua

SEQ ID NO: 727954 - RNA, 22 nt, Human
ucucccuacugacuccaggacc

SEQ ID NO: 727955 - RNA, 22 nt, Human
uugagcaggaacuagaagauag

SEQ ID NO: 727956 - RNA, 22 nt, Human
gccugaccucuucugcccuggg

SEQ ID NO: 727957 - RNA, 22 nt, Human
cagacagggaccucgcuccaga

SEQ ID NO: 727958 - RNA, 22 nt, Human
ccugagcuccaguagcagccag

SEQ ID NO: 727959 - RNA, 22 nt, Human
auacaaugaaguauagaugaaa

SEQ ID NO: 727960 - RNA, 22 nt, Human
aaacuguugugguuuaucauua

SEQ ID NO: 727961 - RNA, 22 nt, Human
agugucuggucucugaacuaaa

SEQ ID NO: 727962 - RNA, 22 nt, Human
accccucagcucuucgugcccc

SEQ ID NO: 727963 - RNA, 22 nt, Human
ugacaagucacuguucuucaau

SEQ ID NO: 727964 - RNA, 23 nt, Human
cacaggcugcgcauaagcuucuc

SEQ ID NO: 727965 - RNA, 22 nt, Human
gagaaguuuggagugaagguuu

SEQ ID NO: 727966 - RNA, 22 nt, Human
gugaggauugcucuggagaauu

SEQ ID NO: 727967 - RNA, 22 nt, Human
gauuuguuucaaguuagcaucu

SEQ ID NO: 727968 - RNA, 22 nt, Human
auugaacauuguucuaggaggc

SEQ ID NO: 727969 - RNA, 22 nt, Human
aguaugaaaguuaaucaauuua

SEQ ID NO: 727970 - RNA, 18 nt, Human
ggcacuggugaugcagag

SEQ ID NO: 727971 - RNA, 22 nt, Human
uagaagaacaugucaaacuaua

SEQ ID NO: 727972 - RNA, 22 nt, Human
gggcagugaauauuggugggaa

SEQ ID NO: 727973 - RNA, 22 nt, Human
uuugucuuauccaaucucucag

SEQ ID NO: 727974 - RNA, 22 nt, Human
ucccagccuuccuuguggugaa

SEQ ID NO: 727975 - RNA, 22 nt, Human
ugccuuuuauggcuagccucag

SEQ ID NO: 727976 - RNA, 22 nt, Human
cugagaaaagcuuucuuauaca

SEQ ID NO: 727977 - RNA, 22 nt, Human
caggaaauuuaagaguguacaa

SEQ ID NO: 727978 - RNA, 22 nt, Human
auacaucguuuauuuuaguuca

SEQ ID NO: 727979 - RNA, 22 nt, Human
ugcagcagagugggccugggug

SEQ ID NO: 727980 - RNA, 22 nt, Human
gcuggcucagggacuagaguuu

SEQ ID NO: 727981 - RNA, 22 nt, Human
cugucccaggagcuguaagaca

SEQ ID NO: 727982 - RNA, 22 nt, Human
uuuauuugucuugccauuuagu

SEQ ID NO: 727983 - RNA, 22 nt, Human
gggacaugccccucagugggug

SEQ ID NO: 727984 - RNA, 22 nt, Human
aagcagcauguggguuaucggg

SEQ ID NO: 727985 - RNA, 22 nt, Human
cucaagauauuccagcucucaa

SEQ ID NO: 727986 - RNA, 22 nt, Human
gcccaagagagcgaagguuggc

SEQ ID NO: 727987 - RNA, 20 nt, Human
acaguguuaguuaucaucuc

SEQ ID NO: 727988 - RNA, 23 nt, Human
ucugaguuauguccuuacauuug

SEQ ID NO: 727989 - RNA, 22 nt, Human
uccugacucugguguccucuac

SEQ ID NO: 727990 - RNA, 22 nt, Human
aagggcccauucucucagaaaa

SEQ ID NO: 727991 - RNA, 22 nt, Human
gugaguguuaacccacugcuuc

SEQ ID NO: 727992 - RNA, 22 nt, Human
guuacaacucccugaaccucgg

SEQ ID NO: 727993 - RNA, 22 nt, Human
gauaaaauauguggccuuuagu

SEQ ID NO: 727994 - RNA, 22 nt, Human
ucucuaaagcacuuuaaccaca

SEQ ID NO: 727995 - RNA, 22 nt, Human
uucuaugucagugugcucugug

SEQ ID NO: 727996 - RNA, 22 nt, Human
agucagcuacaaguucauucac

SEQ ID NO: 727997 - RNA, 22 nt, Human
caaggccaguucaccaagggca

SEQ ID NO: 727998 - RNA, 22 nt, Human
ucuagagacaaaggaaggaggg

SEQ ID NO: 727999 - RNA, 22 nt, Human
acccagggcucaagcguaggca

SEQ ID NO: 728000 - RNA, 22 nt, Human
gugagagggcugggcucaugau

SEQ ID NO: 728001 - RNA, 22 nt, Human
ucaaauaugugauagaagcuaa

SEQ ID NO: 728002 - RNA, 22 nt, Human
ccgggccucgggacaccgggua

SEQ ID NO: 728003 - RNA, 22 nt, Human
aggaacaagggagccuuuucuc

SEQ ID NO: 728004 - RNA, 22 nt, Human
gugcaggagccagggguaggaa

SEQ ID NO: 728005 - RNA, 22 nt, Human
ugcuggaaagugaggugaauga

SEQ ID NO: 728006 - RNA, 22 nt, Human
aauuguaacuacauugagaaca

SEQ ID NO: 728007 - RNA, 22 nt, Human
aagaaaguguggagagccuagc

SEQ ID NO: 728008 - RNA, 22 nt, Human
gugcugagcacaaggcccagag

SEQ ID NO: 728009 - RNA, 22 nt, Human
ccugggaggcagagguugcagu

SEQ ID NO: 728010 - RNA, 22 nt, Human
ugguuuuagaguauauucaggg

SEQ ID NO: 728011 - RNA, 22 nt, Human
gaugauuuuaugucuugucauu

SEQ ID NO: 728012 - RNA, 22 nt, Human
gcucagcucuauggacacaaag

SEQ ID NO: 728013 - RNA, 22 nt, Human
ccucagaauaguccucagauca

SEQ ID NO: 728014 - RNA, 22 nt, Human
uggcacaggagcacugcccugg

SEQ ID NO: 728015 - RNA, 22 nt, Human
uccugagauguggagcuccaug

SEQ ID NO: 728016 - RNA, 22 nt, Human
cuucccaagacuguauugcaag

SEQ ID NO: 728017 - RNA, 22 nt, Human
aggucuggugggcuuuagauug

SEQ ID NO: 728018 - RNA, 22 nt, Human
ugugggaaguuuggagggaaag

SEQ ID NO: 728019 - RNA, 22 nt, Human
uuccagaggcucuaggggagaa

SEQ ID NO: 728020 - RNA, 21 nt, Human
aggcccagagucuugggggga

SEQ ID NO: 728021 - RNA, 22 nt, Human
gccagcaguggccaccaccagg

SEQ ID NO: 728022 - RNA, 22 nt, Human
uacaagagaacuaauguaaguc

SEQ ID NO: 728023 - RNA, 22 nt, Human
uuaaccuguaaaaugggagaag

SEQ ID NO: 728024 - RNA, 22 nt, Human
gaagcugaguggacucuggcca

SEQ ID NO: 728025 - RNA, 22 nt, Human
ccuucaugucauuggacaccuu

SEQ ID NO: 728026 - RNA, 22 nt, Human
aaguguauuaagcaacguuauu

SEQ ID NO: 728027 - RNA, 17 nt, Human
gcugagaggcagcacag

SEQ ID NO: 728028 - RNA, 22 nt, Human
uugacaaauacccauuagacca

SEQ ID NO: 728029 - RNA, 22 nt, Human
uucuuuauugagacuucauugu

SEQ ID NO: 728030 - RNA, 22 nt, Human
gguaacugcagaaugugccuca

SEQ ID NO: 728031 - RNA, 22 nt, Human
auuaucucaagggauagcagau

SEQ ID NO: 728032 - RNA, 22 nt, Human
ugcugcaggaacuuaagaagcu

SEQ ID NO: 728033 - RNA, 22 nt, Human
gcugccucaggcaccuccuggc

SEQ ID NO: 728034 - RNA, 18 nt, Human
agagagaauuccaguagg

SEQ ID NO: 728035 - RNA, 22 nt, Human
uguaaacauauguauguaugua

SEQ ID NO: 728036 - RNA, 20 nt, Human
cccugugauuggcaaguguc

SEQ ID NO: 728037 - RNA, 22 nt, Human
agacugaaauagugcacaccaa

SEQ ID NO: 728038 - RNA, 22 nt, Human
ucugugcuaaugcuucacaaua

SEQ ID NO: 728039 - RNA, 22 nt, Human
aagcacugagcacaguggcuga

SEQ ID NO: 728040 - RNA, 22 nt, Human
ggcagcgcccgaguccgcagcu

SEQ ID NO: 728041 - RNA, 22 nt, Human
ccagcuuuuagugggcuuauua

SEQ ID NO: 728042 - RNA, 22 nt, Human
aaagaugaguccggcagacaua

SEQ ID NO: 728043 - RNA, 22 nt, Human
acuguacacagugguguacugu

SEQ ID NO: 728044 - RNA, 22 nt, Human
uccaggacuuggcaggagauga

SEQ ID NO: 728045 - RNA, 22 nt, Human
ucucaugcuguagugcacuaac

SEQ ID NO: 728046 - RNA, 22 nt, Human
uuaagggccauuauggaugggu

SEQ ID NO: 728047 - RNA, 22 nt, Human
uuacagcagugggaaggaguca

SEQ ID NO: 728048 - RNA, 22 nt, Human
ugagcagagacuucaagggcag

SEQ ID NO: 728049 - RNA, 22 nt, Human
auuccacaagaccauaaauuag

SEQ ID NO: 728050 - RNA, 22 nt, Human
ucauauaacuggauauuuucaa

SEQ ID NO: 728051 - RNA, 22 nt, Human
gggaugucacugugccuggcac

SEQ ID NO: 728052 - RNA, 22 nt, Human
cauugcucaggcccagcaggaa

SEQ ID NO: 728053 - RNA, 22 nt, Human
aauguguuuuaugagagaauau

SEQ ID NO: 728054 - RNA, 22 nt, Human
acuccacauuugaacacaguuc

SEQ ID NO: 728055 - RNA, 22 nt, Human
uugugugucuucuucacugccc

SEQ ID NO: 728056 - RNA, 22 nt, Human
uacaguagcugagguucucagg

SEQ ID NO: 728057 - RNA, 22 nt, Human
uaauugucuuaggugugaugau

SEQ ID NO: 728058 - RNA, 22 nt, Human
caaauugcuaacugucagacua

SEQ ID NO: 728059 - RNA, 22 nt, Human
ucaguauccacaaaugcucaaa

SEQ ID NO: 728060 - RNA, 22 nt, Human
augauucaagaaaauaggaugg

SEQ ID NO: 728061 - RNA, 22 nt, Human
ggacacagcugcagccacaccc

SEQ ID NO: 728062 - RNA, 22 nt, Human
uggccagccuugucaucgcuuu

SEQ ID NO: 728063 - RNA, 22 nt, Human
agguuaaaaaggauucaguuaa

SEQ ID NO: 728064 - RNA, 23 nt, Human
aggauaugacuugucugccaacc

SEQ ID NO: 728065 - RNA, 22 nt, Human
agugaagaggaaguggggcaca

SEQ ID NO: 728066 - RNA, 22 nt, Human
auuucuguugcuuauaaauuac

SEQ ID NO: 728067 - RNA, 22 nt, Human
auaauuuacaacugcuuuuaau

SEQ ID NO: 728068 - RNA, 22 nt, Human
uacauacacaaauauacuguuu

SEQ ID NO: 728069 - RNA, 21 nt, Human
uccaggcuggaaggggcguug

SEQ ID NO: 728070 - RNA, 22 nt, Human
guggccaggccgacugccaggc

SEQ ID NO: 728071 - RNA, 22 nt, Human
cuuauacagaucaagggaaaag

SEQ ID NO: 728072 - RNA, 22 nt, Human
cugcaagauuggaagaugcaau

SEQ ID NO: 728073 - RNA, 22 nt, Human
ucagaggugagcaugugaccaa

SEQ ID NO: 728074 - RNA, 22 nt, Human
cauguacaugccuacuaucaau

SEQ ID NO: 728075 - RNA, 22 nt, Human
ccuggcagacagcacugaagcu

SEQ ID NO: 728076 - RNA, 22 nt, Human
uggagagcugguucaaagcaga

SEQ ID NO: 728077 - RNA, 22 nt, Human
ccagggccugccacuuagcaag

SEQ ID NO: 728078 - RNA, 22 nt, Human
cuccuggaccagggcuauuggg

SEQ ID NO: 728079 - RNA, 22 nt, Human
uuagcucagaaaauuuaaacuu

SEQ ID NO: 728080 - RNA, 22 nt, Human
gcugggcaccggagagacccca

SEQ ID NO: 728081 - RNA, 22 nt, Human
aacauacauauuucagugucca

SEQ ID NO: 728082 - RNA, 22 nt, Human
caggcagagucagauuagacuu

SEQ ID NO: 728083 - RNA, 22 nt, Human
agcagacuccauugagugaguc

SEQ ID NO: 728084 - RNA, 22 nt, Human
auggcagggcacagcucuaguu

SEQ ID NO: 728085 - RNA, 22 nt, Human
gacaugggaugagaugaagcau

SEQ ID NO: 728086 - RNA, 22 nt, Human
caaauguugcuguaauguuugu

SEQ ID NO: 728087 - RNA, 22 nt, Human
ucauacaggcucaagcuauacg

SEQ ID NO: 728088 - RNA, 22 nt, Human
caugcacagugauaucugaaga

SEQ ID NO: 728089 - RNA, 22 nt, Human
cucccucaccaugacccgcugu

SEQ ID NO: 728090 - RNA, 22 nt, Human
cacuaguggccccaugugguug

SEQ ID NO: 728091 - RNA, 21 nt, Human
uuguuacaaugcaagaguaug

SEQ ID NO: 728092 - RNA, 22 nt, Human
uaugcuguauucuguauguuag

SEQ ID NO: 728093 - RNA, 22 nt, Human
ucuucaaagaauuuuaguaauu

SEQ ID NO: 728094 - RNA, 22 nt, Human
cacuuuaugggaagcaaaaauu

SEQ ID NO: 728095 - RNA, 22 nt, Human
ucugaaaacuccaugagcucgu

SEQ ID NO: 728096 - RNA, 22 nt, Human
ucuccuugcuacccaguauguc

SEQ ID NO: 728097 - RNA, 22 nt, Human
ggccuggcucuugcccagccug

SEQ ID NO: 728098 - RNA, 22 nt, Human
cagaauggcuuuuauggcucag

SEQ ID NO: 728099 - RNA, 22 nt, Human
uucccacaguucagaacaaagg

SEQ ID NO: 728100 - RNA, 22 nt, Human
agcagggcaaagucaggcuaac

SEQ ID NO: 728101 - RNA, 22 nt, Human
caggacaggcccuguggggucu

SEQ ID NO: 728102 - RNA, 22 nt, Human
aagcaggaagcucagguccuug

SEQ ID NO: 728103 - RNA, 22 nt, Human
ucaggaugacuucaaggaggaa

SEQ ID NO: 728104 - RNA, 22 nt, Human
augaggcaugugaggagaaggg

SEQ ID NO: 728105 - RNA, 22 nt, Human
ucacagcagaauuuaggaggca

SEQ ID NO: 728106 - RNA, 22 nt, Human
cauguguuucgagacuguugag

SEQ ID NO: 728107 - RNA, 22 nt, Human
auuaaauuggacgcugggggaa

SEQ ID NO: 728108 - RNA, 22 nt, Human
cuuuaccagauuccauugcaag

SEQ ID NO: 728109 - RNA, 22 nt, Human
cccugccucugaagcugcucag

SEQ ID NO: 728110 - RNA, 22 nt, Human
ugugccugauggucacguggcc

SEQ ID NO: 728111 - RNA, 22 nt, Human
uagguucagcuuucauccugaa

SEQ ID NO: 728112 - RNA, 22 nt, Human
uuacaagacagugugguaaaua

SEQ ID NO: 728113 - RNA, 22 nt, Human
ucaguucugaaguucugccucc

SEQ ID NO: 728114 - RNA, 22 nt, Human
ccauccugaauggucucagcca

SEQ ID NO: 728115 - RNA, 22 nt, Human
augcacagcugaacacucuaaa

SEQ ID NO: 728116 - RNA, 22 nt, Human
gagcuuccacucuagaaggagu

SEQ ID NO: 728117 - RNA, 23 nt, Human
gagagcugacugucaagacuguu

SEQ ID NO: 728118 - RNA, 22 nt, Human
uucaacaaaauauauuuuucca

SEQ ID NO: 728119 - RNA, 22 nt, Human
cuaggccauauuuugagaacug

SEQ ID NO: 728120 - RNA, 22 nt, Human
cagugcuccugauguacccuug

SEQ ID NO: 728121 - RNA, 20 nt, Human
auggagugaagagugaaagc

SEQ ID NO: 728122 - RNA, 22 nt, Human
uauggcuuuuuauucaucuuac

SEQ ID NO: 728123 - RNA, 22 nt, Human
gaucuagaccagaagcuguugu

SEQ ID NO: 728124 - RNA, 22 nt, Human
uugaggcagggcaugguggccc

SEQ ID NO: 728125 - RNA, 22 nt, Human
auacucagcugcuagacagaag

SEQ ID NO: 728126 - RNA, 22 nt, Human
uuucacagcagaauuucugagg

SEQ ID NO: 728127 - RNA, 22 nt, Human
aacacagcuaauuucugucaau

SEQ ID NO: 728128 - RNA, 22 nt, Human
uccugccucuccaugcuaacua

SEQ ID NO: 728129 - RNA, 22 nt, Human
uaucagcgugcaaaucuuugga

SEQ ID NO: 728130 - RNA, 22 nt, Human
acacagaguccuuacugaggua

SEQ ID NO: 728131 - RNA, 22 nt, Human
agcaacuuuucuagacaugguc

SEQ ID NO: 728132 - RNA, 22 nt, Human
gggagcugaauggcaauggaga

SEQ ID NO: 728133 - RNA, 22 nt, Human
gguccucaaucccaacaaggca

SEQ ID NO: 728134 - RNA, 22 nt, Human
ugucugcccucaacccagaggc

SEQ ID NO: 728135 - RNA, 19 nt, Human
ggcugcagagccccggcgc

SEQ ID NO: 728136 - RNA, 22 nt, Human
caggcucccacccuccugcagc

SEQ ID NO: 728137 - RNA, 22 nt, Human
uguuaaaaaugcagauuccuau

SEQ ID NO: 728138 - RNA, 22 nt, Human
ucuguuagcugucaaaguguuu

SEQ ID NO: 728139 - RNA, 22 nt, Human
acucauugaaacuuaagaucua

SEQ ID NO: 728140 - RNA, 22 nt, Human
uaugcauagguaucuauacuca

SEQ ID NO: 728141 - RNA, 22 nt, Human
ucaauucaacacaugcacauug

SEQ ID NO: 728142 - RNA, 22 nt, Human
gagaccugcagcuguagucugc

SEQ ID NO: 728143 - RNA, 22 nt, Human
uuagcuuuucucuauguuggcu

SEQ ID NO: 728144 - RNA, 22 nt, Human
ccugggucuguauugguaggua

SEQ ID NO: 728145 - RNA, 22 nt, Human
ccacagggaacaugacagccuu

SEQ ID NO: 728146 - RNA, 22 nt, Human
aauguucauuagcauuguugac

SEQ ID NO: 728147 - RNA, 22 nt, Human
gcugucugagaacaugguggaa

SEQ ID NO: 728148 - RNA, 21 nt, Human
ucaggcaggcgcagagggaag

SEQ ID NO: 728149 - RNA, 22 nt, Human
ugagcccaggaguaugaggcug

SEQ ID NO: 728150 - RNA, 22 nt, Human
cagcagagcuuauuaacuaaaa

SEQ ID NO: 728151 - RNA, 22 nt, Human
ucacaugcccuguauuuaccag

SEQ ID NO: 728152 - RNA, 22 nt, Human
ugaggcucagaagugccaagug

SEQ ID NO: 728153 - RNA, 22 nt, Human
gugccugguuuggggaauguuc

SEQ ID NO: 728154 - RNA, 22 nt, Human
agguucuugacucuaccuucca

SEQ ID NO: 728155 - RNA, 22 nt, Human
agguucaggcacuugcccaaca

SEQ ID NO: 728156 - RNA, 22 nt, Human
agaggcuggauugagcauagac

SEQ ID NO: 728157 - RNA, 22 nt, Human
gcucaggaaacagcagggcuug

SEQ ID NO: 728158 - RNA, 22 nt, Human
auauauaucgaguucaugucuc

SEQ ID NO: 728159 - RNA, 22 nt, Human
augcuuguacuaaaaaaauauu

SEQ ID NO: 728160 - RNA, 22 nt, Human
aaucaggaugacugucauuuca

SEQ ID NO: 728161 - RNA, 22 nt, Human
ccagugugguuuaggauaggga

SEQ ID NO: 728162 - RNA, 22 nt, Human
accagcugugugaccugaggca

SEQ ID NO: 728163 - RNA, 22 nt, Human
uuggcucuggaacuauuucuga

SEQ ID NO: 728164 - RNA, 22 nt, Human
uuuacaguauaguaggacucau

SEQ ID NO: 728165 - RNA, 22 nt, Human
aauuucaagucuugaagaagua

SEQ ID NO: 728166 - RNA, 22 nt, Human
uuguaacuuugcauacuccugu

SEQ ID NO: 728167 - RNA, 22 nt, Human
cugugcacuaaccacacccacg

SEQ ID NO: 728168 - RNA, 22 nt, Human
aagcugcagcacagagaggugg

SEQ ID NO: 728169 - RNA, 18 nt, Human
agcuggcccuggcugccg

SEQ ID NO: 728170 - RNA, 22 nt, Human
cccugccccaggcggcuucacu

SEQ ID NO: 728171 - RNA, 22 nt, Human
aaggccauuauucugauauauu

SEQ ID NO: 728172 - RNA, 22 nt, Human
gcccuagggcuuuugggccugu

SEQ ID NO: 728173 - RNA, 22 nt, Human
auguguauauuuauuguaguuu

SEQ ID NO: 728174 - RNA, 19 nt, Human
ugggaugaugcagaaggua

SEQ ID NO: 728175 - RNA, 22 nt, Human
aagcacaggggaaauaaguugu

SEQ ID NO: 728176 - RNA, 22 nt, Human
ggaguggccacgacugggagau

SEQ ID NO: 728177 - RNA, 22 nt, Human
uagguuuacugaauuaguggaa

SEQ ID NO: 728178 - RNA, 22 nt, Human
ucacugugauucuguauggauu

SEQ ID NO: 728179 - RNA, 20 nt, Human
gcucuaaagccacagauuga

SEQ ID NO: 728180 - RNA, 22 nt, Human
gccauggcccauaccaggugca

SEQ ID NO: 728181 - RNA, 22 nt, Human
aggucugaucaugggcccacuu

SEQ ID NO: 728182 - RNA, 22 nt, Human
ugcccucauuauaagaggcuca

SEQ ID NO: 728183 - RNA, 21 nt, Human
ucccugugagcagcucuuccu

SEQ ID NO: 728184 - RNA, 23 nt, Human
auguuaaacauaacugaagagcc

SEQ ID NO: 728185 - RNA, 22 nt, Human
acauuucuuugcuagacagcag

SEQ ID NO: 728186 - RNA, 22 nt, Human
acaggcagauuaaggguaggca

SEQ ID NO: 728187 - RNA, 22 nt, Human
aguauaaagugguuuucagcac

SEQ ID NO: 728188 - RNA, 22 nt, Human
gccagcuguaagcagugauucu

SEQ ID NO: 728189 - RNA, 22 nt, Human
auccugucucuacccaucggcu

SEQ ID NO: 728190 - RNA, 19 nt, Human
cccucaggucugagcaguc

SEQ ID NO: 728191 - RNA, 22 nt, Human
augucuguuaaucgacccuaau

SEQ ID NO: 728192 - RNA, 22 nt, Human
ugcugggcuugaaagcugcuaa

SEQ ID NO: 728193 - RNA, 22 nt, Human
uggggccagguggcugcagguc

SEQ ID NO: 728194 - RNA, 22 nt, Human
auccacucccuaacaccauguu

SEQ ID NO: 728195 - RNA, 22 nt, Human
ccagggccucguguucugagug

SEQ ID NO: 728196 - RNA, 22 nt, Human
uggcagcuacagacagagguga

SEQ ID NO: 728197 - RNA, 22 nt, Human
gcucaggauuucauccaugugu

SEQ ID NO: 728198 - RNA, 22 nt, Human
cagcaucccucaggggccucug

SEQ ID NO: 728199 - RNA, 21 nt, Human
aguacaaaaauuccuuucuca

SEQ ID NO: 728200 - RNA, 22 nt, Human
auggaacaagaacucagauuua

SEQ ID NO: 728201 - RNA, 22 nt, Human
cauuuccagcuccugcaucaug

SEQ ID NO: 728202 - RNA, 18 nt, Human
ucaggcugggccuccuuc

SEQ ID NO: 728203 - RNA, 22 nt, Human
uacuauuuggaauuuuaaauug

SEQ ID NO: 728204 - RNA, 17 nt, Human
ugcaugcgucugugaua

SEQ ID NO: 728205 - RNA, 22 nt, Human
uucuagaugauaaaccagcagc

SEQ ID NO: 728206 - RNA, 22 nt, Human
agaaggguagggacuuauccaa

SEQ ID NO: 728207 - RNA, 22 nt, Human
ucagucaucccagcuuucaucu

SEQ ID NO: 728208 - RNA, 22 nt, Human
agucccagcuacucaagaggcu

SEQ ID NO: 728209 - RNA, 22 nt, Human
cggcccuggcggaggcgggaga

SEQ ID NO: 728210 - RNA, 22 nt, Human
ccugcguccacggcugggagac

SEQ ID NO: 728211 - RNA, 22 nt, Human
aagcugaugucccaguuugaag

SEQ ID NO: 728212 - RNA, 22 nt, Human
uacacagaagccagaaggccug

SEQ ID NO: 728213 - RNA, 22 nt, Human
ugcugccugcuacgagggaaga

SEQ ID NO: 728214 - RNA, 22 nt, Human
cuuuacacauccuaaccagugu

SEQ ID NO: 728215 - RNA, 22 nt, Human
cuuaucugagaaagaugcuaca

SEQ ID NO: 728216 - RNA, 22 nt, Human
cucucaguuuccucaacuguaa

SEQ ID NO: 728217 - RNA, 22 nt, Human
aucuggagaauaaauguccaag

SEQ ID NO: 728218 - RNA, 22 nt, Human
uuagcacugucugguuaucuug

SEQ ID NO: 728219 - RNA, 22 nt, Human
agagacaaacacugcaacuucu

SEQ ID NO: 728220 - RNA, 22 nt, Human
uuacuuuccagcucuagcuuca

SEQ ID NO: 728221 - RNA, 22 nt, Human
cagucacugguucuauaggccc

SEQ ID NO: 728222 - RNA, 21 nt, Human
ggggucaagugaaugguguug

SEQ ID NO: 728223 - RNA, 22 nt, Human
agcaguggcugacagacuuacc

SEQ ID NO: 728224 - RNA, 22 nt, Human
agaggucuaugcuaggggaacu

SEQ ID NO: 728225 - RNA, 22 nt, Human
caguuuuagcuagagcaaacca

SEQ ID NO: 728226 - RNA, 22 nt, Human
aacuacagaaaagguaagcucu

SEQ ID NO: 728227 - RNA, 22 nt, Human
aaaggcaggcuuucacaucuca

SEQ ID NO: 728228 - RNA, 22 nt, Human
cuuguuaaaaugcagauuccaa

SEQ ID NO: 728229 - RNA, 22 nt, Human
gauuuuauuagcccaaacuuug

SEQ ID NO: 728230 - RNA, 22 nt, Human
uggcugagcucccuguguguug

SEQ ID NO: 728231 - RNA, 22 nt, Human
ucacaguaucacacaaggauua

SEQ ID NO: 728232 - RNA, 22 nt, Human
acuuucugugguuaccagggag

SEQ ID NO: 728233 - RNA, 22 nt, Human
aguugcugguaaauguuaucaa

SEQ ID NO: 728234 - RNA, 22 nt, Human
ucaggccccuugucagcucugu

SEQ ID NO: 728235 - RNA, 22 nt, Human
cccagcaucuccaggcauggcc

SEQ ID NO: 728236 - RNA, 22 nt, Human
ucuaaugaggacuuuauagaga

SEQ ID NO: 728237 - RNA, 22 nt, Human
auccaacacguauuugcuggcc

SEQ ID NO: 728238 - RNA, 22 nt, Human
gagacguggccuuugccugagc

SEQ ID NO: 728239 - RNA, 22 nt, Human
cugcauccuggaaauagcuaag

SEQ ID NO: 728240 - RNA, 18 nt, Human
gagcagcaggaucaagaa

SEQ ID NO: 728241 - RNA, 22 nt, Human
cagucaggggugggaucaaggc

SEQ ID NO: 728242 - RNA, 22 nt, Human
cucuucaaaagucuaauccuua

SEQ ID NO: 728243 - RNA, 23 nt, Human
uucaagauacgguuuccaggcug

SEQ ID NO: 728244 - RNA, 20 nt, Human
ugcugccuguuuuugugaau

SEQ ID NO: 728245 - RNA, 22 nt, Human
acaggcaggcgggacagcccga

SEQ ID NO: 728246 - RNA, 22 nt, Human
uuuccucugacugcuccccugc

SEQ ID NO: 728247 - RNA, 22 nt, Human
caaauaucuuuggcaaagagaa

SEQ ID NO: 728248 - RNA, 22 nt, Human
auugcucagcacaagcagcaga

SEQ ID NO: 728249 - RNA, 22 nt, Human
ggaggugggaguuuaguucuug

SEQ ID NO: 728250 - RNA, 22 nt, Human
uuuacuaaguacuuguaucccu

SEQ ID NO: 728251 - RNA, 21 nt, Human
gacuggagagaggaagucugg

SEQ ID NO: 728252 - RNA, 22 nt, Human
ggccucaguuucuucaacugua

SEQ ID NO: 728253 - RNA, 22 nt, Human
uacagugaggugguuuccuuua

SEQ ID NO: 728254 - RNA, 22 nt, Human
agcacagauuugucaacauaga

SEQ ID NO: 728255 - RNA, 22 nt, Human
ucuucuggaucgaucacauugu

SEQ ID NO: 728256 - RNA, 22 nt, Human
gagugucuaaucacguuucaca

SEQ ID NO: 728257 - RNA, 22 nt, Human
ugcuggagaagcuccugggacu

SEQ ID NO: 728258 - RNA, 22 nt, Human
caaagcaccacaaaccagguga

SEQ ID NO: 728259 - RNA, 22 nt, Human
ccugggcucuauccugacccag

SEQ ID NO: 728260 - RNA, 22 nt, Human
guccuuaaagagagcaucauuc

SEQ ID NO: 728261 - RNA, 22 nt, Human
agcaggcuuguuaugucugaga

SEQ ID NO: 728262 - RNA, 22 nt, Human
guuauuuaacuuuguagcaugg

SEQ ID NO: 728263 - RNA, 22 nt, Human
uagaaacucucacgagugaaac

SEQ ID NO: 728264 - RNA, 22 nt, Human
aauuuucugguguguaaugaag

SEQ ID NO: 728265 - RNA, 20 nt, Human
aggaaggaaguuugcaugga

SEQ ID NO: 728266 - RNA, 22 nt, Human
cccagggcuguagaauguccaa

SEQ ID NO: 728267 - RNA, 22 nt, Human
gacaguggagggcugauguuaa

SEQ ID NO: 728268 - RNA, 22 nt, Human
uuuaaaccuaucuaagaaauag

SEQ ID NO: 728269 - RNA, 22 nt, Human
gaaccagcagacuuugacaggu

SEQ ID NO: 728270 - RNA, 22 nt, Human
ggcugagcucaggggcagcagg

SEQ ID NO: 728271 - RNA, 22 nt, Human
agaaaucuauguuuugguuaga

SEQ ID NO: 728272 - RNA, 22 nt, Human
uuuccagagcaugucugcucag

SEQ ID NO: 728273 - RNA, 22 nt, Human
ucuggcucugacacuacuguua

SEQ ID NO: 728274 - RNA, 22 nt, Human
ccccaaaguguuggauaauuga

SEQ ID NO: 728275 - RNA, 22 nt, Human
gagcugcagaguaaccuuugca

SEQ ID NO: 728276 - RNA, 20 nt, Human
gaggaaccacugggaggaga

SEQ ID NO: 728277 - RNA, 22 nt, Human
agcccuucaagagcucuguccu

SEQ ID NO: 728278 - RNA, 22 nt, Human
ccucucagccggacugucaggc

SEQ ID NO: 728279 - RNA, 22 nt, Human
auguguacaaccaagcacuaaa

SEQ ID NO: 728280 - RNA, 22 nt, Human
uugaaaauaucacaggagcagc

SEQ ID NO: 728281 - RNA, 22 nt, Human
agugcuuucagugugcucuuuu

SEQ ID NO: 728282 - RNA, 22 nt, Human
uaggagcuauaaugugaagucu

SEQ ID NO: 728283 - RNA, 22 nt, Human
ucugagcaccuuauauucuuga

SEQ ID NO: 728284 - RNA, 22 nt, Human
uugagaaauaagcaugucuaga

SEQ ID NO: 728285 - RNA, 22 nt, Human
ccagggucuucgaggcagcaau

SEQ ID NO: 728286 - RNA, 22 nt, Human
ccagggcagcagaauuggggca

SEQ ID NO: 728287 - RNA, 22 nt, Human
ggaacccaugauuaugguuagg

SEQ ID NO: 728288 - RNA, 22 nt, Human
uucuacacugaguuuuuucccu

SEQ ID NO: 728289 - RNA, 22 nt, Human
agcagaagaggucuuguugcug

SEQ ID NO: 728290 - RNA, 22 nt, Human
ugagcuucaaaauaugugaauc

SEQ ID NO: 728291 - RNA, 22 nt, Human
gugacagucaaagacaugacuu

SEQ ID NO: 728292 - RNA, 22 nt, Human
uagauucuuugcuagaucauug

SEQ ID NO: 728293 - RNA, 22 nt, Human
aaguuuuauuggaacauagcca

SEQ ID NO: 728294 - RNA, 22 nt, Human
guugguuaggucaggauucaga

SEQ ID NO: 728295 - RNA, 22 nt, Human
caggcacccagcccagucgcac

SEQ ID NO: 728296 - RNA, 22 nt, Human
aaagugcucggcgcugguccca

SEQ ID NO: 728297 - RNA, 22 nt, Human
uuaagcauuuauuaugugccag

SEQ ID NO: 728298 - RNA, 22 nt, Human
cuguauuaaaggcagugaucuu

SEQ ID NO: 728299 - RNA, 19 nt, Human
auucuuguuaagugucauc

SEQ ID NO: 728300 - RNA, 22 nt, Human
ugaagccaucccucagauggcc

SEQ ID NO: 728301 - RNA, 22 nt, Human
acuccugguuuguguccuggcu

SEQ ID NO: 728302 - RNA, 22 nt, Human
ggcguggggccuucugcccgcu

SEQ ID NO: 728303 - RNA, 22 nt, Human
uggcauguuaaaguaguauuaa

SEQ ID NO: 728304 - RNA, 22 nt, Human
ccagguggaaggucugugcucu

SEQ ID NO: 728305 - RNA, 22 nt, Human
ugaugaaugucauacauaauga

SEQ ID NO: 728306 - RNA, 22 nt, Human
gauaugaaguggcauugugaag

SEQ ID NO: 728307 - RNA, 22 nt, Human
agaaauguauagugaauuuuuc

SEQ ID NO: 728308 - RNA, 22 nt, Human
aguuucaguguugacagauggu

SEQ ID NO: 728309 - RNA, 17 nt, Human
ggaaagguagaguaauc

SEQ ID NO: 728310 - RNA, 22 nt, Human
ugggccuggacaucuguauuuu

SEQ ID NO: 728311 - RNA, 22 nt, Human
acuuuugaagaauuaugcaaaa

SEQ ID NO: 728312 - RNA, 22 nt, Human
gauuuuacaaacugcaggaccc

SEQ ID NO: 728313 - RNA, 22 nt, Human
ccagcagcuguggcuuugccuc

SEQ ID NO: 728314 - RNA, 22 nt, Human
aaagaccugaaauauaaucuag

SEQ ID NO: 728315 - RNA, 22 nt, Human
gcuguauuggaacacauccaug

SEQ ID NO: 728316 - RNA, 22 nt, Human
ggagugacucucggggccacua

SEQ ID NO: 728317 - RNA, 22 nt, Human
ugaggugaauggugucccugga

SEQ ID NO: 728318 - RNA, 18 nt, Human
cagagcagagguggagcg

SEQ ID NO: 728319 - RNA, 22 nt, Human
gccugcucagaccuagcaggcc

SEQ ID NO: 728320 - RNA, 22 nt, Human
gagcugccaagauuacaaucag

SEQ ID NO: 728321 - RNA, 22 nt, Human
gcagugaagcaguccuuguuga

SEQ ID NO: 728322 - RNA, 22 nt, Human
cauuucucauaauauuagcacu

SEQ ID NO: 728323 - RNA, 22 nt, Human
ucuaaugaguuagauaauuuug

SEQ ID NO: 728324 - RNA, 22 nt, Human
auuuccuagccucucuugcagu

SEQ ID NO: 728325 - RNA, 22 nt, Human
acacaaacugcuagaaaauugg

SEQ ID NO: 728326 - RNA, 22 nt, Human
ugccuucauccauguuauagug

SEQ ID NO: 728327 - RNA, 22 nt, Human
ucaaacuagccugacugguauu

SEQ ID NO: 728328 - RNA, 22 nt, Human
cagggcagggauguugcggcag

SEQ ID NO: 728329 - RNA, 22 nt, Human
aaacaaagcaucuugcuaugca

SEQ ID NO: 728330 - RNA, 22 nt, Human
gucuggagccugggucccugcu

SEQ ID NO: 728331 - RNA, 22 nt, Human
ugguggcaugauagugugaaug

SEQ ID NO: 728332 - RNA, 23 nt, Human
aauauuccugccauuaaugacuc

SEQ ID NO: 728333 - RNA, 21 nt, Human
uauuaauaugucuaagcugau

SEQ ID NO: 728334 - RNA, 18 nt, Human
ugcaggcuguugaaacug

SEQ ID NO: 728335 - RNA, 22 nt, Human
auaacaauagugguagugcugg

SEQ ID NO: 728336 - RNA, 22 nt, Human
aggcaauccucuuacagauggg

SEQ ID NO: 728337 - RNA, 22 nt, Human
ugaaagggguugaguuacagcu

SEQ ID NO: 728338 - RNA, 22 nt, Human
aucuccagauugugaucaucag

SEQ ID NO: 728339 - RNA, 22 nt, Human
uccuuccugcucuaacauucag

SEQ ID NO: 728340 - RNA, 19 nt, Human
gaggugucuuuccugagua

SEQ ID NO: 728341 - RNA, 22 nt, Human
agacacuguguacagaaaaaga

SEQ ID NO: 728342 - RNA, 19 nt, Human
ugcacguuggaaucaccug

SEQ ID NO: 728343 - RNA, 22 nt, Human
aaucagaacuucucaggguggg

SEQ ID NO: 728344 - RNA, 22 nt, Human
aguguacaaaaugauagauaaa

SEQ ID NO: 728345 - RNA, 22 nt, Human
ucugagcauaugcagcaccugg

SEQ ID NO: 728346 - RNA, 22 nt, Human
uugcugccuuggagaagcuccu

SEQ ID NO: 728347 - RNA, 22 nt, Human
aguuugauuugucuaucuucau

SEQ ID NO: 728348 - RNA, 22 nt, Human
gcuggccuucugcagaguucug

SEQ ID NO: 728349 - RNA, 22 nt, Human
uuuauuauguacaggcacuaua

SEQ ID NO: 728350 - RNA, 22 nt, Human
cagauucucacuguauucaggu

SEQ ID NO: 728351 - RNA, 22 nt, Human
cacacaguaguaugaggcaaaa

SEQ ID NO: 728352 - RNA, 22 nt, Human
agccucucugaugugacagcua

SEQ ID NO: 728353 - RNA, 22 nt, Human
uuacaauggguauacuuccauu

SEQ ID NO: 728354 - RNA, 22 nt, Human
cagugggauugggauuggaacc

SEQ ID NO: 728355 - RNA, 22 nt, Human
agugacaugcucucaggcauaa

SEQ ID NO: 728356 - RNA, 22 nt, Human
aauucaguugugucugaccucg

SEQ ID NO: 728357 - RNA, 22 nt, Human
ucaggagcagggucuguuacca

SEQ ID NO: 728358 - RNA, 22 nt, Human
uuccaaauuccaauccccugaa

SEQ ID NO: 728359 - RNA, 22 nt, Human
uaacucugcuuguucucugagu

SEQ ID NO: 728360 - RNA, 22 nt, Human
aagagaaggugaggaagccggu

SEQ ID NO: 728361 - RNA, 22 nt, Human
caggaggcccacaggccccugc

SEQ ID NO: 728362 - RNA, 22 nt, Human
aauguauaaaguguuaauaacu

SEQ ID NO: 728363 - RNA, 22 nt, Human
gcaguaagaaagucaagcaguu

SEQ ID NO: 728364 - RNA, 20 nt, Human
uggaauaaguuaaguuguuu

SEQ ID NO: 728365 - RNA, 23 nt, Human
ugccguguuagaaauguuuuaca

SEQ ID NO: 728366 - RNA, 22 nt, Human
cugugucuucacauuugugugc

SEQ ID NO: 728367 - RNA, 22 nt, Human
agccagagcugaugucauucuc

SEQ ID NO: 728368 - RNA, 22 nt, Human
uuaucuguuuaacaaaguaucu

SEQ ID NO: 728369 - RNA, 22 nt, Human
uucaagucuuccaugguauucu

SEQ ID NO: 728370 - RNA, 22 nt, Human
gcauggaugggaguggacagau

SEQ ID NO: 728371 - RNA, 22 nt, Human
ucagaggcuucuggccagucug

SEQ ID NO: 728372 - RNA, 22 nt, Human
gaaacacaugcagcuccauaga

SEQ ID NO: 728373 - RNA, 22 nt, Human
uccuguggucauucuucugccc

SEQ ID NO: 728374 - RNA, 22 nt, Human
ccuuuugaggcuugggcucaga

SEQ ID NO: 728375 - RNA, 22 nt, Human
guggaaggugaaggagcagcga

SEQ ID NO: 728376 - RNA, 22 nt, Human
gauaccaaaaucaucuuauagg

SEQ ID NO: 728377 - RNA, 22 nt, Human
uugcucuguaauaaucuggggu

SEQ ID NO: 728378 - RNA, 22 nt, Human
gcugggccagagcagcagcacu

SEQ ID NO: 728379 - RNA, 23 nt, Human
ccacucucccaccauaucuguau

SEQ ID NO: 728380 - RNA, 22 nt, Human
cagguggcuucucccuaggcca

SEQ ID NO: 728381 - RNA, 22 nt, Human
ugucuagggagcugcucaggcu

SEQ ID NO: 728382 - RNA, 22 nt, Human
uucugcaucccagaagaggaca

SEQ ID NO: 728383 - RNA, 22 nt, Human
gagcuggccucaggcacaggag

SEQ ID NO: 728384 - RNA, 22 nt, Human
guaguucuuucucaauguucaa

SEQ ID NO: 728385 - RNA, 22 nt, Human
guaugcuuauuccuuguuguga

SEQ ID NO: 728386 - RNA, 22 nt, Human
ccacccuggguucugaugugga

SEQ ID NO: 728387 - RNA, 22 nt, Human
ccuccugguccagcaucucuuu

SEQ ID NO: 728388 - RNA, 22 nt, Human
uaaagguuauugcacuggaguu

SEQ ID NO: 728389 - RNA, 22 nt, Human
uucacuuauuucuugaguagca

SEQ ID NO: 728390 - RNA, 22 nt, Human
cugccaaucugaagagcuucuu

SEQ ID NO: 728391 - RNA, 22 nt, Human
acaggcugcugagccauuugcu

SEQ ID NO: 728392 - RNA, 22 nt, Human
ugggccaguccugccuaaggug

SEQ ID NO: 728393 - RNA, 21 nt, Human
ucagaggcugggggaaugccc

SEQ ID NO: 728394 - RNA, 22 nt, Human
cagacuugacggcagcugcuuu

SEQ ID NO: 728395 - RNA, 22 nt, Human
uaugggucuggaaaauggcuug

SEQ ID NO: 728396 - RNA, 22 nt, Human
ugguuacccagucgcuggaguu

SEQ ID NO: 728397 - RNA, 22 nt, Human
agcacauuaagugaguucaugu

SEQ ID NO: 728398 - RNA, 22 nt, Human
gacagggcgcccagccuguuuc

SEQ ID NO: 728399 - RNA, 22 nt, Human
uuccccaggugauucucauggc

SEQ ID NO: 728400 - RNA, 22 nt, Human
cuuauucagauacagacucuug

SEQ ID NO: 728401 - RNA, 22 nt, Human
gcccaggaguugaagggcugac

SEQ ID NO: 728402 - RNA, 18 nt, Human
acacaggcugacagcacc

SEQ ID NO: 728403 - RNA, 22 nt, Human
cacagcuucuuccauuccacuc

SEQ ID NO: 728404 - RNA, 22 nt, Human
ccugcucugccaaguccucuuu

SEQ ID NO: 728405 - RNA, 21 nt, Human
uccaagcucaacucccuuccu

SEQ ID NO: 728406 - RNA, 22 nt, Human
uauaauuuaucaugucacaguu

SEQ ID NO: 728407 - RNA, 22 nt, Human
cccugcagacgucuugaugccu

SEQ ID NO: 728408 - RNA, 22 nt, Human
gcucuguccagcgugcacagaa

SEQ ID NO: 728409 - RNA, 23 nt, Human
acaaaugcccauacaucuaguuc

SEQ ID NO: 728410 - RNA, 17 nt, Human
cugucugcugcuuccuc

SEQ ID NO: 728411 - RNA, 18 nt, Human
acccaggcucaugguccu

SEQ ID NO: 728412 - RNA, 22 nt, Human
cagagagcaugggaggcccgag

SEQ ID NO: 728413 - RNA, 22 nt, Human
ggagcauguggggugagcaggg

SEQ ID NO: 728414 - RNA, 22 nt, Human
aggacagagcccuaguuucaua

SEQ ID NO: 728415 - RNA, 22 nt, Human
ucgaagguuauugucuuuacgu

SEQ ID NO: 728416 - RNA, 22 nt, Human
ucuguaucacccguucccagaa

SEQ ID NO: 728417 - RNA, 22 nt, Human
uucaacaggaaagcacuuuaca

SEQ ID NO: 728418 - RNA, 22 nt, Human
ccuucacaccaucuuuaccagg

SEQ ID NO: 728419 - RNA, 21 nt, Human
aguggucuuuuucacccagug

SEQ ID NO: 728420 - RNA, 22 nt, Human
caugaagcauguuuugucauga

SEQ ID NO: 728421 - RNA, 23 nt, Human
gguuccugagcagggaucuggaa

SEQ ID NO: 728422 - RNA, 22 nt, Human
ucagacagucaucagagcuugu

SEQ ID NO: 728423 - RNA, 22 nt, Human
cuggucuguccgcaggucaccu

SEQ ID NO: 728424 - RNA, 21 nt, Human
aucaccagcagaagcugcaga

SEQ ID NO: 728425 - RNA, 22 nt, Human
gagaacuucaggauuauucaag

SEQ ID NO: 728426 - RNA, 22 nt, Human
agcuggguuucuggcaggcuua

SEQ ID NO: 728427 - RNA, 22 nt, Human
agggaggauaguagucaguuua

SEQ ID NO: 728428 - RNA, 22 nt, Human
ggaaagcucagaucuuguugga

SEQ ID NO: 728429 - RNA, 22 nt, Human
uucacaaacaccagaauggcua

SEQ ID NO: 728430 - RNA, 22 nt, Human
ugggauauaaucugaaaaguau

SEQ ID NO: 728431 - RNA, 22 nt, Human
uccuuugguuguagacaggaau

SEQ ID NO: 728432 - RNA, 22 nt, Human
auugcaaaugagucuuaauaua

SEQ ID NO: 728433 - RNA, 22 nt, Human
cuguguuccccugcugcugagg

SEQ ID NO: 728434 - RNA, 21 nt, Human
aggaggccaguacugcugaac

SEQ ID NO: 728435 - RNA, 22 nt, Human
uuucaagacucauugaguauug

SEQ ID NO: 728436 - RNA, 22 nt, Human
agcucagagggaggugaagugg

SEQ ID NO: 728437 - RNA, 22 nt, Human
cagcuguccaaacacauuaacu

SEQ ID NO: 728438 - RNA, 22 nt, Human
ggccucucuagcauccagccug

SEQ ID NO: 728439 - RNA, 22 nt, Human
uauggcuugacuugcaccggca

SEQ ID NO: 728440 - RNA, 22 nt, Human
auuauuaaagcuacaucaagga

SEQ ID NO: 728441 - RNA, 22 nt, Human
uugaauaguuuuggauagcaua

SEQ ID NO: 728442 - RNA, 22 nt, Human
ugcaggcugaggcuggcucaac

SEQ ID NO: 728443 - RNA, 22 nt, Human
cacaugcaguuuacgucacuga

SEQ ID NO: 728444 - RNA, 22 nt, Human
cgucccuaccuggcagcugcgc

SEQ ID NO: 728445 - RNA, 22 nt, Human
cacugcuaugaugaugauauuu

SEQ ID NO: 728446 - RNA, 21 nt, Human
agauucauaaucuguaaaaug

SEQ ID NO: 728447 - RNA, 22 nt, Human
cuaaagcauucucagauuuugc

SEQ ID NO: 728448 - RNA, 22 nt, Human
gaagggugugugugagggacac

SEQ ID NO: 728449 - RNA, 22 nt, Human
uagcagcaaaaugaccuucuaa

SEQ ID NO: 728450 - RNA, 22 nt, Human
ggagcagcacugccacacagag

SEQ ID NO: 728451 - RNA, 22 nt, Human
aauaauuacccaucuuuuugua

SEQ ID NO: 728452 - RNA, 22 nt, Human
gugugugcuccccaggagagcu

SEQ ID NO: 728453 - RNA, 22 nt, Human
caauguuugugaucuacugacu

SEQ ID NO: 728454 - RNA, 22 nt, Human
gauuuuacaugucauaucuauu

SEQ ID NO: 728455 - RNA, 22 nt, Human
uugaggucugugauaaaaguca

SEQ ID NO: 728456 - RNA, 22 nt, Human
aaggaggcccucuccuucugga

SEQ ID NO: 728457 - RNA, 22 nt, Human
ucuuccagugcuguguagagcu

SEQ ID NO: 728458 - RNA, 22 nt, Human
caccucuuugauuugaggcaag

SEQ ID NO: 728459 - RNA, 22 nt, Human
ucacccagacugucugacucuu

SEQ ID NO: 728460 - RNA, 20 nt, Human
ccauucugggugcagucugg

SEQ ID NO: 728461 - RNA, 22 nt, Human
cuucccuuggugaacagagcau

SEQ ID NO: 728462 - RNA, 22 nt, Human
aucuuucaguuucauaccaauu

SEQ ID NO: 728463 - RNA, 22 nt, Human
agggugaaucucacaacucuua

SEQ ID NO: 728464 - RNA, 22 nt, Human
gagcagcugugggguugaccau

SEQ ID NO: 728465 - RNA, 22 nt, Human
agauuuguaugucuaaauguaa

SEQ ID NO: 728466 - RNA, 22 nt, Human
ggaaggggccuugagcaaacug

SEQ ID NO: 728467 - RNA, 22 nt, Human
uucaguauacuucauaacauuu

SEQ ID NO: 728468 - RNA, 22 nt, Human
uuggcucagugugagggagaug

SEQ ID NO: 728469 - RNA, 22 nt, Human
cagcaauaagccagguuagaca

SEQ ID NO: 728470 - RNA, 22 nt, Human
cuucacagccaacaugggcaca

SEQ ID NO: 728471 - RNA, 18 nt, Human
cauuguacaaugcuuuau

SEQ ID NO: 728472 - RNA, 22 nt, Human
cugcccuguagcuguucuagca

SEQ ID NO: 728473 - RNA, 17 nt, Human
auuuacauugucaccga

SEQ ID NO: 728474 - RNA, 22 nt, Human
auuccaaagcacaucagaacua

SEQ ID NO: 728475 - RNA, 20 nt, Human
agugugucucggagguaagu

SEQ ID NO: 728476 - RNA, 22 nt, Human
aaauucacucuguuccucaugg

SEQ ID NO: 728477 - RNA, 22 nt, Human
uuuaagacuuaggaaagaggau

SEQ ID NO: 728478 - RNA, 22 nt, Human
ugcagcagaaguguucuucucu

SEQ ID NO: 728479 - RNA, 22 nt, Human
uuugugaagggaacagaagugu

SEQ ID NO: 728480 - RNA, 22 nt, Human
ugcugcuuggcacccucagagu

SEQ ID NO: 728481 - RNA, 22 nt, Human
cugagaucccaggcaggguggc

SEQ ID NO: 728482 - RNA, 22 nt, Human
agugucugagcuaucauuaggg

SEQ ID NO: 728483 - RNA, 22 nt, Human
cucccccuuagcucuugucuuu

SEQ ID NO: 728484 - RNA, 22 nt, Human
agggucaggagacacuggcaac

SEQ ID NO: 728485 - RNA, 22 nt, Human
aagcaacauucucuguggcauu

SEQ ID NO: 728486 - RNA, 22 nt, Human
aagaugcgguugaccauggugu

SEQ ID NO: 728487 - RNA, 22 nt, Human
ugacagcagcauagugagcaau

SEQ ID NO: 728488 - RNA, 22 nt, Human
ccagggcauccucacaucgcag

SEQ ID NO: 728489 - RNA, 22 nt, Human
aggauuuaaucaguuggcauuu

SEQ ID NO: 728490 - RNA, 22 nt, Human
gagaaagggaacuuacagagug

SEQ ID NO: 728491 - RNA, 22 nt, Human
cagugguuuuauaucuaagcuu

SEQ ID NO: 728492 - RNA, 22 nt, Human
ugcagaugaaugcugagacacu

SEQ ID NO: 728493 - RNA, 22 nt, Human
uuuccaagcugucuuggcccac

SEQ ID NO: 728494 - RNA, 22 nt, Human
auguguuuuuauucuggcaugu

SEQ ID NO: 728495 - RNA, 22 nt, Human
uaugucuuuuucucacuauagu

SEQ ID NO: 728496 - RNA, 22 nt, Human
aucuggagagaucuucacaaaa

SEQ ID NO: 728497 - RNA, 22 nt, Human
ucucauuuugagucagacacua

SEQ ID NO: 728498 - RNA, 22 nt, Human
ggagauguagugucacuggacu

SEQ ID NO: 728499 - RNA, 22 nt, Human
agcugagccagcagcaacagga

SEQ ID NO: 728500 - RNA, 20 nt, Human
guggagaggcuggcgggacu

SEQ ID NO: 728501 - RNA, 22 nt, Human
uggcugagaaaaaagagcuaua

SEQ ID NO: 728502 - RNA, 22 nt, Human
aaaacaguuuaggcaucacagu

SEQ ID NO: 728503 - RNA, 22 nt, Human
guguuuauacagcaaagagcau

SEQ ID NO: 728504 - RNA, 22 nt, Human
ccugccuggcacauaguacucu

SEQ ID NO: 728505 - RNA, 22 nt, Human
cccagggguucuagaccagcuu

SEQ ID NO: 728506 - RNA, 22 nt, Human
acagcaguggguugccaguggg

SEQ ID NO: 728507 - RNA, 22 nt, Human
aaguggagccagggaaacugaa

SEQ ID NO: 728508 - RNA, 22 nt, Human
ucugaauucugacaauuugaau

SEQ ID NO: 728509 - RNA, 22 nt, Human
uacuuccagcaaucugcauauu

SEQ ID NO: 728510 - RNA, 22 nt, Human
gguaggcacuggugggaagaga

SEQ ID NO: 728511 - RNA, 22 nt, Human
ccagggaaggcugcuggcugug

SEQ ID NO: 728512 - RNA, 19 nt, Human
uuggaaggagccagagugg

SEQ ID NO: 728513 - RNA, 22 nt, Human
cacauguccugggaaaauaacu

SEQ ID NO: 728514 - RNA, 18 nt, Human
ucagggaagagaauauga

SEQ ID NO: 728515 - RNA, 22 nt, Human
cagcaugcaaguccagaugugg

SEQ ID NO: 728516 - RNA, 22 nt, Human
uaacauuagguagacauaagcc

SEQ ID NO: 728517 - RNA, 22 nt, Human
uuugggcaggcuuuucccuaga

SEQ ID NO: 728518 - RNA, 22 nt, Human
uaagcuucaaagaacauauugg

SEQ ID NO: 728519 - RNA, 23 nt, Human
aggguccagggaucaccaggugu

SEQ ID NO: 728520 - RNA, 22 nt, Human
aacuguaagacaaaugacuucu

SEQ ID NO: 728521 - RNA, 22 nt, Human
cagcuggcauaccugggcccgg

SEQ ID NO: 728522 - RNA, 22 nt, Human
uucugcauaggcuauauuuguu

SEQ ID NO: 728523 - RNA, 22 nt, Human
uuuaaaaucagaugggaguugg

SEQ ID NO: 728524 - RNA, 22 nt, Human
aaagugcugaagaccuagcugu

SEQ ID NO: 728525 - RNA, 22 nt, Human
ugguuaaguccagaaaggaagc

SEQ ID NO: 728526 - RNA, 22 nt, Human
ggguaggcugcuccuggggccc

SEQ ID NO: 728527 - RNA, 22 nt, Human
gcugccagccaacuugcugugc

SEQ ID NO: 728528 - RNA, 22 nt, Human
uauucuuguauacuacaaucuu

SEQ ID NO: 728529 - RNA, 22 nt, Human
accugcccagacucagauccua

SEQ ID NO: 728530 - RNA, 22 nt, Human
cgcuccuugagcgugucggccu

SEQ ID NO: 728531 - RNA, 22 nt, Human
agggaccuugauggguuuggga

SEQ ID NO: 728532 - RNA, 22 nt, Human
uccuuguaacguugggcugggg

SEQ ID NO: 728533 - RNA, 22 nt, Human
uauccauaccacuacuucccuu

SEQ ID NO: 728534 - RNA, 22 nt, Human
agacacugccacuucuguuccc

SEQ ID NO: 728535 - RNA, 22 nt, Human
aauuagaagggaguuauugaua

SEQ ID NO: 728536 - RNA, 22 nt, Human
gcucugggcugaaucauuuauc

SEQ ID NO: 728537 - RNA, 22 nt, Human
caggcuggagugcaauggcaca

SEQ ID NO: 728538 - RNA, 20 nt, Human
uccacaucuuuugagaugug

SEQ ID NO: 728539 - RNA, 22 nt, Human
cuguggcugcagaccuuaaaca

SEQ ID NO: 728540 - RNA, 22 nt, Human
cauggacucugguuuggggagc

SEQ ID NO: 728541 - RNA, 22 nt, Human
aaugccuuauaggcugaaaauu

SEQ ID NO: 728542 - RNA, 22 nt, Human
uuccaggggcagcagugauggu

SEQ ID NO: 728543 - RNA, 22 nt, Human
aagugacaccucuucccuuucc

SEQ ID NO: 728544 - RNA, 22 nt, Human
guacacagagugguggaagaaa

SEQ ID NO: 728545 - RNA, 22 nt, Human
caugaguuuuuuaguucaugca

SEQ ID NO: 728546 - RNA, 22 nt, Human
aucaccacuacaaacaucauug

SEQ ID NO: 728547 - RNA, 18 nt, Human
aguguuuauuuaggugaa

SEQ ID NO: 728548 - RNA, 22 nt, Human
uuucuagaggcuccaggggagu

SEQ ID NO: 728549 - RNA, 22 nt, Human
ucaauuacagcaaugacuguac

SEQ ID NO: 728550 - RNA, 22 nt, Human
ugggaaaguguugaggugucuu

SEQ ID NO: 728551 - RNA, 22 nt, Human
cacagucacauaucuaugugug

SEQ ID NO: 728552 - RNA, 22 nt, Human
uucugugcccauuuuaaaaugg

SEQ ID NO: 728553 - RNA, 19 nt, Human
cuggaauguggcuggugca

SEQ ID NO: 728554 - RNA, 22 nt, Human
augcuccucgagugucucacag

SEQ ID NO: 728555 - RNA, 22 nt, Human
cuugaaagcuuugcgucuucua

SEQ ID NO: 728556 - RNA, 22 nt, Human
ucuguuuaugugucuaaauaaa

SEQ ID NO: 728557 - RNA, 23 nt, Human
ggcuggugcccuuggccagucgg

SEQ ID NO: 728558 - RNA, 22 nt, Human
cugggcugcgggcgccccucca

SEQ ID NO: 728559 - RNA, 22 nt, Human
gagagcugggggacuguggaug

SEQ ID NO: 728560 - RNA, 22 nt, Human
aagcccugcagucucugccaca

SEQ ID NO: 728561 - RNA, 22 nt, Human
uugaacauuaacuucagucuau

SEQ ID NO: 728562 - RNA, 20 nt, Human
acagaauaugcugguugugg

SEQ ID NO: 728563 - RNA, 22 nt, Human
gggguggccuguaggcagcaug

SEQ ID NO: 728564 - RNA, 22 nt, Human
uagcugccauugcuccaggaag

SEQ ID NO: 728565 - RNA, 22 nt, Human
gacacauacagcaguaagucua

SEQ ID NO: 728566 - RNA, 22 nt, Human
uguggccaggaaaaggagaugg

SEQ ID NO: 728567 - RNA, 22 nt, Human
gagcuggacuuucagauacauc

SEQ ID NO: 728568 - RNA, 22 nt, Human
aguuuguaucaauuugcuuuau

SEQ ID NO: 728569 - RNA, 22 nt, Human
aggggagccccugguccuggug

SEQ ID NO: 728570 - RNA, 22 nt, Human
gcuucuugccuguguagagaau

SEQ ID NO: 728571 - RNA, 22 nt, Human
ugcuagugugugagauguucaa

SEQ ID NO: 728572 - RNA, 22 nt, Human
gucuacuuuuuaaucuuggcag

SEQ ID NO: 728573 - RNA, 19 nt, Human
gggaaauucacuugcuucc

SEQ ID NO: 728574 - RNA, 22 nt, Human
aagggccaucccagaacagaaa

SEQ ID NO: 728575 - RNA, 22 nt, Human
uugcuguaaguaucuuucuacc

SEQ ID NO: 728576 - RNA, 22 nt, Human
uaccagggaacagggauauuaa

SEQ ID NO: 728577 - RNA, 21 nt, Human
agaguaauuccugcuggaaag

SEQ ID NO: 728578 - RNA, 22 nt, Human
ccuguuugguacaaucugccaa

SEQ ID NO: 728579 - RNA, 22 nt, Human
aaauuucuaagcagccacuucc

SEQ ID NO: 728580 - RNA, 20 nt, Human
uacauuguagaaauauucaa

SEQ ID NO: 728581 - RNA, 22 nt, Human
cuaaacaugaacuacauuuagg

SEQ ID NO: 728582 - RNA, 22 nt, Human
cccaggaacagggcucagaccc

SEQ ID NO: 728583 - RNA, 22 nt, Human
uacauugcuagaaauguauuuu

SEQ ID NO: 728584 - RNA, 22 nt, Human
acacaugagaaacaucaguugu

SEQ ID NO: 728585 - RNA, 17 nt, Human
augcacauguaagagga

SEQ ID NO: 728586 - RNA, 22 nt, Human
acacuuugauagauaaugcagg

SEQ ID NO: 728587 - RNA, 20 nt, Human
uguggaugagguaaggauag

SEQ ID NO: 728588 - RNA, 22 nt, Human
cugcuuaaaaugcagauucugu

SEQ ID NO: 728589 - RNA, 22 nt, Human
aggaggguggccucaugugagu

SEQ ID NO: 728590 - RNA, 22 nt, Human
acaggguggggauggugagcuu

SEQ ID NO: 728591 - RNA, 22 nt, Human
gcucagggccauggaccagcag

SEQ ID NO: 728592 - RNA, 22 nt, Human
aaacauguuuagaaagcagcug

SEQ ID NO: 728593 - RNA, 22 nt, Human
ggccugccucacagucagcacc

SEQ ID NO: 728594 - RNA, 22 nt, Human
aaaguacugaugccaucagcac

SEQ ID NO: 728595 - RNA, 22 nt, Human
gcuucagaaauaucaucauuau

SEQ ID NO: 728596 - RNA, 22 nt, Human
cauuucuccugggugauaaauu

SEQ ID NO: 728597 - RNA, 21 nt, Human
cacugaggucagggguagggu

SEQ ID NO: 728598 - RNA, 23 nt, Human
uuccagaggaagaagucaugacu

SEQ ID NO: 728599 - RNA, 18 nt, Human
uucaggucagaaagaugg

SEQ ID NO: 728600 - RNA, 22 nt, Human
auugugcagaauuggaauugca

SEQ ID NO: 728601 - RNA, 22 nt, Human
uucuccucagcaaggcagcuuu

SEQ ID NO: 728602 - RNA, 23 nt, Human
aggcugagcucucccagcuucag

SEQ ID NO: 728603 - RNA, 21 nt, Human
cauuccucggcucauagagga

SEQ ID NO: 728604 - RNA, 22 nt, Human
uggcagggugccaguugcgagu

SEQ ID NO: 728605 - RNA, 22 nt, Human
aggagagagcugagcuuugcug

SEQ ID NO: 728606 - RNA, 22 nt, Human
ggguacuuaauauuuacggggu

SEQ ID NO: 728607 - RNA, 22 nt, Human
aguuauucauuuauucuguaca

SEQ ID NO: 728608 - RNA, 22 nt, Human
ccuguacacggucuaugccucc

SEQ ID NO: 728609 - RNA, 22 nt, Human
cagagguagccgagugcaaucg

SEQ ID NO: 728610 - RNA, 22 nt, Human
ugcaguggaaagacucagacuu

SEQ ID NO: 728611 - RNA, 22 nt, Human
ucagaggcaaagaacuuuauua

SEQ ID NO: 728612 - RNA, 20 nt, Human
gcuaggcuggugauugucaa

SEQ ID NO: 728613 - RNA, 22 nt, Human
uggggcugucccgguuuggcga

SEQ ID NO: 728614 - RNA, 22 nt, Human
auuugcugagcucaaagaaaag

SEQ ID NO: 728615 - RNA, 22 nt, Human
uguuacaacuauagaucccaag

SEQ ID NO: 728616 - RNA, 22 nt, Human
ggggaagaaaucuggguucuuc

SEQ ID NO: 728617 - RNA, 22 nt, Human
uagcugucaccagaaauggcca

SEQ ID NO: 728618 - RNA, 22 nt, Human
augcuguggaugccuugcccca

SEQ ID NO: 728619 - RNA, 22 nt, Human
uugauauuagaguauuuguuug

SEQ ID NO: 728620 - RNA, 22 nt, Human
guagcuucaaguacucucccug

SEQ ID NO: 728621 - RNA, 22 nt, Human
aacaguaguggucaauaugcca

SEQ ID NO: 728622 - RNA, 22 nt, Human
ccagucugugugccagccugcg

SEQ ID NO: 728623 - RNA, 22 nt, Human
acuuacaaucaaccaccuugga

SEQ ID NO: 728624 - RNA, 22 nt, Human
cacauauaccagccgcgguacg

SEQ ID NO: 728625 - RNA, 22 nt, Human
ugagcccuaagggucaagcagg

SEQ ID NO: 728626 - RNA, 22 nt, Human
aucucuguaauuacaugauauu

SEQ ID NO: 728627 - RNA, 22 nt, Human
uucuuuuccuguggcucaucca

SEQ ID NO: 728628 - RNA, 22 nt, Human
ggaggcucuaaacuuuccuugg

SEQ ID NO: 728629 - RNA, 22 nt, Human
auauguuuugugcuucauuggu

SEQ ID NO: 728630 - RNA, 19 nt, Human
acagaagcauagaaaagga

SEQ ID NO: 728631 - RNA, 22 nt, Human
agcuggcuuuaugguuggcuaa

SEQ ID NO: 728632 - RNA, 22 nt, Human
gagcucugccauggcucccacc

SEQ ID NO: 728633 - RNA, 22 nt, Human
aaugaagccagguagaagagaa

SEQ ID NO: 728634 - RNA, 22 nt, Human
cuggcuuugcuggacugggagu

SEQ ID NO: 728635 - RNA, 22 nt, Human
cacagagaauucccauauguga

SEQ ID NO: 728636 - RNA, 22 nt, Human
ucagaacauuugggacuuuggg

SEQ ID NO: 728637 - RNA, 22 nt, Human
auuuacagacccucccacuaag

SEQ ID NO: 728638 - RNA, 22 nt, Human
acugagguauaauugacauaac

SEQ ID NO: 728639 - RNA, 22 nt, Human
uguauauucacugagcaagggg

SEQ ID NO: 728640 - RNA, 22 nt, Human
caucaucuggcuuuuagaaaaa

SEQ ID NO: 728641 - RNA, 22 nt, Human
uauaugcaugcccauguauaca

SEQ ID NO: 728642 - RNA, 22 nt, Human
cugugacaguuucucagaauuu

SEQ ID NO: 728643 - RNA, 18 nt, Human
ccucagggagagagacgc

SEQ ID NO: 728644 - RNA, 22 nt, Human
cauucauucuguaaguaacuau

SEQ ID NO: 728645 - RNA, 22 nt, Human
gggagaaguggaaaucucauua

SEQ ID NO: 728646 - RNA, 19 nt, Human
ucauggaucagguaguuua

SEQ ID NO: 728647 - RNA, 20 nt, Human
ugccaggcacggagugcaug

SEQ ID NO: 728648 - RNA, 22 nt, Human
cugcuucacguugugccuuguu

SEQ ID NO: 728649 - RNA, 22 nt, Human
acagagcuaauguugcauaggc

SEQ ID NO: 728650 - RNA, 17 nt, Human
uaguaaaugaguagagc

SEQ ID NO: 728651 - RNA, 22 nt, Human
guccuguguguugccggcugaa

SEQ ID NO: 728652 - RNA, 22 nt, Human
ccucccuucaguagagcccaau

SEQ ID NO: 728653 - RNA, 22 nt, Human
aggcuuuaaguggccuacagcu

SEQ ID NO: 728654 - RNA, 22 nt, Human
cugcaguguucuggaaugcauu

SEQ ID NO: 728655 - RNA, 22 nt, Human
agagccuggcucccagcuaccg

SEQ ID NO: 728656 - RNA, 22 nt, Human
ccuuagugugccugaggcagau

SEQ ID NO: 728657 - RNA, 22 nt, Human
uugagucucugccaaaacacaa

SEQ ID NO: 728658 - RNA, 21 nt, Human
agcaggugaaccuccaguaca

SEQ ID NO: 728659 - RNA, 20 nt, Human
uaaggcuguuuuguauuccu

SEQ ID NO: 728660 - RNA, 22 nt, Human
aggaauguuuagaaugucagaa

SEQ ID NO: 728661 - RNA, 22 nt, Human
acagaaauauucguggugcuug

SEQ ID NO: 728662 - RNA, 22 nt, Human
uuucagugcuucuguuuaccgg

SEQ ID NO: 728663 - RNA, 21 nt, Human
cuucagcaaauacuuggcagg

SEQ ID NO: 728664 - RNA, 20 nt, Human
cuggggagccucgcgguggc

SEQ ID NO: 728665 - RNA, 22 nt, Human
ucugucuucuguagcuaauaau

SEQ ID NO: 728666 - RNA, 22 nt, Human
auaauuacauuauacuguuaga

SEQ ID NO: 728667 - RNA, 22 nt, Human
gagauucuaauauaaggauggg

SEQ ID NO: 728668 - RNA, 20 nt, Human
aaagauacuuuuuguaaugg

SEQ ID NO: 728669 - RNA, 22 nt, Human
ugcaccauuaauuuaugugaga

SEQ ID NO: 728670 - RNA, 21 nt, Human
agccuguugguuuacugcuca

SEQ ID NO: 728671 - RNA, 22 nt, Human
ucccugggccacagcugugagc

SEQ ID NO: 728672 - RNA, 22 nt, Human
cagaggggcugacacccuuggc

SEQ ID NO: 728673 - RNA, 22 nt, Human
agaggggcucauauccugucau

SEQ ID NO: 728674 - RNA, 22 nt, Human
cugggacccccacugcguagcu

SEQ ID NO: 728675 - RNA, 22 nt, Human
ggcaugggagugagcaaccuua

SEQ ID NO: 728676 - RNA, 19 nt, Human
ugagaaauuccacaggaug

SEQ ID NO: 728677 - RNA, 22 nt, Human
uuauuucuacuauuuugccuga

SEQ ID NO: 728678 - RNA, 22 nt, Human
uuccucagggcggaugggcagg

SEQ ID NO: 728679 - RNA, 22 nt, Human
aggagcuguuuuguucagcaaa

SEQ ID NO: 728680 - RNA, 22 nt, Human
ugcauauugugaaaauguagau

SEQ ID NO: 728681 - RNA, 22 nt, Human
uuccuaacucuggcaccuaguc

SEQ ID NO: 728682 - RNA, 22 nt, Human
ucacagugcacagcaggcgugg

SEQ ID NO: 728683 - RNA, 22 nt, Human
auguguuaaugucaaccagaaa

SEQ ID NO: 728684 - RNA, 22 nt, Human
augagaaaauucauuccaucca

SEQ ID NO: 728685 - RNA, 22 nt, Human
uaacagaaauuuuaguuagggg

SEQ ID NO: 728686 - RNA, 22 nt, Human
caaacugaacacgaaagucuuu

SEQ ID NO: 728687 - RNA, 22 nt, Human
aagcauuuuguuuuaagaauga

SEQ ID NO: 728688 - RNA, 22 nt, Human
ugguuggauggcucuuguggcu

SEQ ID NO: 728689 - RNA, 22 nt, Human
gcaggaugagugaguacauuua

SEQ ID NO: 728690 - RNA, 22 nt, Human
gugggcagacagugcuuugcag

SEQ ID NO: 728691 - RNA, 22 nt, Human
caugcacaugcaauagugcuuu

SEQ ID NO: 728692 - RNA, 22 nt, Human
ugcuaucaccaacucugcuaag

SEQ ID NO: 728693 - RNA, 20 nt, Human
cccagagccauagccagaca

SEQ ID NO: 728694 - RNA, 22 nt, Human
aauucaguuggcaaacaugcug

SEQ ID NO: 728695 - RNA, 22 nt, Human
uugugccuggcuuguauucaca

SEQ ID NO: 728696 - RNA, 22 nt, Human
cauuagggucucucagcugaau

SEQ ID NO: 728697 - RNA, 19 nt, Human
augagguagcagcuggugc

SEQ ID NO: 728698 - RNA, 22 nt, Human
gcuggcuggcgggugcguccuc

SEQ ID NO: 728699 - RNA, 22 nt, Human
ugaggcagugugagauaauaaa

SEQ ID NO: 728700 - RNA, 22 nt, Human
uugcagagugguugugaggauu

SEQ ID NO: 728701 - RNA, 22 nt, Human
ucauaaaaguacucauguucau

SEQ ID NO: 728702 - RNA, 21 nt, Human
ucaaaucagguaucacuauug

SEQ ID NO: 728703 - RNA, 20 nt, Human
acagaaagcugccuuguccc

SEQ ID NO: 728704 - RNA, 22 nt, Human
ugaaagaaacagguauauuggg

SEQ ID NO: 728705 - RNA, 22 nt, Human
aacucuuuguggacauuaaauu

SEQ ID NO: 728706 - RNA, 22 nt, Human
uuuuggcacugcgucuacaugg

SEQ ID NO: 728707 - RNA, 22 nt, Human
agugaaaucagguuuugacugc

SEQ ID NO: 728708 - RNA, 22 nt, Human
uauugccaaaugucugcuggaa

SEQ ID NO: 728709 - RNA, 22 nt, Human
uggcucuccagcucuaaggccu

SEQ ID NO: 728710 - RNA, 22 nt, Human
ggcaggcacugugcuaggcgcu

SEQ ID NO: 728711 - RNA, 22 nt, Human
cagggccaggcugauggccugg

SEQ ID NO: 728712 - RNA, 22 nt, Human
ccuggcagucaggggaguccuu

SEQ ID NO: 728713 - RNA, 22 nt, Human
ccuuucugauggccucccagcc

SEQ ID NO: 728714 - RNA, 22 nt, Human
ugcuggagagccuuggccaagg

SEQ ID NO: 728715 - RNA, 22 nt, Human
ucacauguguggcagugcaagu

SEQ ID NO: 728716 - RNA, 22 nt, Human
caggaaccuaaagagacauuac

SEQ ID NO: 728717 - RNA, 22 nt, Human
uggcugaguguuccaaggagca

SEQ ID NO: 728718 - RNA, 22 nt, Human
ucugaacagcauggaaucauuu

SEQ ID NO: 728719 - RNA, 22 nt, Human
uuuaggagucaaauguuuuagg

SEQ ID NO: 728720 - RNA, 22 nt, Human
uccaaagagcuuaggagagaaa

SEQ ID NO: 728721 - RNA, 22 nt, Human
gcugggucucucccugguccug

SEQ ID NO: 728722 - RNA, 22 nt, Human
gugucugcuuggucaucuuuca

SEQ ID NO: 728723 - RNA, 22 nt, Human
caauuucauuaauagauauaga

SEQ ID NO: 728724 - RNA, 21 nt, Human
gagauggcccaguagcgggcc

SEQ ID NO: 728725 - RNA, 22 nt, Human
acaaaaucaaaggagugauuca

SEQ ID NO: 728726 - RNA, 22 nt, Human
uccugcccagagcucuccacuc

SEQ ID NO: 728727 - RNA, 22 nt, Human
ugccuuuugaagccucacaggu

SEQ ID NO: 728728 - RNA, 22 nt, Human
ugucugggucaccccuccuggc

SEQ ID NO: 728729 - RNA, 22 nt, Human
augcugaagaaucacagggacu

SEQ ID NO: 728730 - RNA, 22 nt, Human
cauggcuucgucacagagggca

SEQ ID NO: 728731 - RNA, 22 nt, Human
acuuucuaggucucaguccuuu

SEQ ID NO: 728732 - RNA, 22 nt, Human
agcagcugaaaggcaaacuucu

SEQ ID NO: 728733 - RNA, 22 nt, Human
uuucuaaaugguggcugcauug

SEQ ID NO: 728734 - RNA, 22 nt, Human
ggccacaacuugcuccuagccc

SEQ ID NO: 728735 - RNA, 22 nt, Human
ugucaacagaucucaaagcugg

SEQ ID NO: 728736 - RNA, 22 nt, Human
ccuggcuuuuguuuauaaauuc

SEQ ID NO: 728737 - RNA, 22 nt, Human
ugucuugauuagaaugaugggc

SEQ ID NO: 728738 - RNA, 22 nt, Human
uuacagaagaguaacuuggcaa

SEQ ID NO: 728739 - RNA, 22 nt, Human
ugagccaguggaagauggcagu

SEQ ID NO: 728740 - RNA, 22 nt, Human
aagaaaguggguaauaugauuu

SEQ ID NO: 728741 - RNA, 22 nt, Human
aagucccugugggguggaggcu

SEQ ID NO: 728742 - RNA, 22 nt, Human
agaaguuaccacauacuucucu

SEQ ID NO: 728743 - RNA, 22 nt, Human
ucaggcagguggcuggcuaugg

SEQ ID NO: 728744 - RNA, 19 nt, Human
cugucccagacucugcucu

SEQ ID NO: 728745 - RNA, 18 nt, Human
uaucuuuuccagugguau

SEQ ID NO: 728746 - RNA, 22 nt, Human
acagggugacuuugugacagau

SEQ ID NO: 728747 - RNA, 22 nt, Human
aggcugcaggucugggucaugu

SEQ ID NO: 728748 - RNA, 22 nt, Human
ccuguguuucaccaaaagaguc

SEQ ID NO: 728749 - RNA, 22 nt, Human
caggaacaaucuuacuacuauu

SEQ ID NO: 728750 - RNA, 22 nt, Human
cagcuuuguggccuugaccucg

SEQ ID NO: 728751 - RNA, 22 nt, Human
auagaaucuuuguaaaacacuu

SEQ ID NO: 728752 - RNA, 22 nt, Human
caucuguuuccuaaucuguagc

SEQ ID NO: 728753 - RNA, 22 nt, Human
ucuacagacuccuauguaacac

SEQ ID NO: 728754 - RNA, 22 nt, Human
ugucacaugaaacuugcucauc

SEQ ID NO: 728755 - RNA, 22 nt, Human
aggggagcaaggccguggugua

SEQ ID NO: 728756 - RNA, 23 nt, Human
ccuccccuucccacagcugggug

SEQ ID NO: 728757 - RNA, 22 nt, Human
cccaggcagccccagaagcuug

SEQ ID NO: 728758 - RNA, 22 nt, Human
aggcaagcgcagaagcggagga

SEQ ID NO: 728759 - RNA, 22 nt, Human
agggcugacaaauggcagugac

SEQ ID NO: 728760 - RNA, 22 nt, Human
gugaacaaggagacuacaacuu

SEQ ID NO: 728761 - RNA, 22 nt, Human
ugugcugagugaucccauuccu

SEQ ID NO: 728762 - RNA, 22 nt, Human
ccagauguuccccuggaggccu

SEQ ID NO: 728763 - RNA, 22 nt, Human
uacaagaagaggcagagcugga

SEQ ID NO: 728764 - RNA, 22 nt, Human
ugguccuguagcacuugauuag

SEQ ID NO: 728765 - RNA, 22 nt, Human
cagcaaggucugucaauagugg

SEQ ID NO: 728766 - RNA, 18 nt, Human
uggcucugccacucaccg

SEQ ID NO: 728767 - RNA, 22 nt, Human
uaucuuagggaauuaacuaaaa

SEQ ID NO: 728768 - RNA, 22 nt, Human
cggcaggaccucauuuccuucu

SEQ ID NO: 728769 - RNA, 22 nt, Human
uaaagcccucugaucacacugg

SEQ ID NO: 728770 - RNA, 22 nt, Human
cugucugucaccaaaacagacu

SEQ ID NO: 728771 - RNA, 22 nt, Human
aaucaagagcugacuauauuuu

SEQ ID NO: 728772 - RNA, 19 nt, Human
cuggugcuugagugaguca

SEQ ID NO: 728773 - RNA, 22 nt, Human
ccugcagagggacuggcaggaa

SEQ ID NO: 728774 - RNA, 23 nt, Human
uccaggcugaaggagcagauuuu

SEQ ID NO: 728775 - RNA, 22 nt, Human
aaaugccucuggguuauucuag

SEQ ID NO: 728776 - RNA, 22 nt, Human
cacaucuacugauauuccagga

SEQ ID NO: 728777 - RNA, 22 nt, Human
gaaaugcagauucugauucugu

SEQ ID NO: 728778 - RNA, 22 nt, Human
cacgggcuguuuccaugcaaaa

SEQ ID NO: 728779 - RNA, 22 nt, Human
cuaaacuucuuggcaauuuuau

SEQ ID NO: 728780 - RNA, 22 nt, Human
gguggcauucagaagagcuggc

SEQ ID NO: 728781 - RNA, 22 nt, Human
aggacuuagaacauuauguacu

SEQ ID NO: 728782 - RNA, 22 nt, Human
aggcuccaggccucccugcaug

SEQ ID NO: 728783 - RNA, 22 nt, Human
uaggaaacucucagcuggucau

SEQ ID NO: 728784 - RNA, 22 nt, Human
aagcagagccugagacagggau

SEQ ID NO: 728785 - RNA, 22 nt, Human
augaaauuugaccaauuauuua

SEQ ID NO: 728786 - RNA, 22 nt, Human
caggcacagacgcaaacuucuu

SEQ ID NO: 728787 - RNA, 21 nt, Human
cugcucuggggaccggcugug

SEQ ID NO: 728788 - RNA, 22 nt, Human
aucuguuguuuguuugcuaaag

SEQ ID NO: 728789 - RNA, 22 nt, Human
cccaagagaucgcauguaguug

SEQ ID NO: 728790 - RNA, 22 nt, Human
ugcuggaaagagaguuucaaug

SEQ ID NO: 728791 - RNA, 22 nt, Human
cugagagaguaaaguagaauua

SEQ ID NO: 728792 - RNA, 22 nt, Human
ccaaaaagcucagagauauguu

SEQ ID NO: 728793 - RNA, 22 nt, Human
gcugagacuggcagcaggaagu

SEQ ID NO: 728794 - RNA, 22 nt, Human
agggcccaugugggagcacuug

SEQ ID NO: 728795 - RNA, 22 nt, Human
uuggcuuccugcacuugaguuu

SEQ ID NO: 728796 - RNA, 22 nt, Human
cuacauaaucuggauuugucug

SEQ ID NO: 728797 - RNA, 22 nt, Human
agacacuucauguaaguggaau

SEQ ID NO: 728798 - RNA, 22 nt, Human
cagggagaagucuggucagucc

SEQ ID NO: 728799 - RNA, 22 nt, Human
uuggcucagcugggacuguuga

SEQ ID NO: 728800 - RNA, 22 nt, Human
accaaagggcagaacaugagca

SEQ ID NO: 728801 - RNA, 22 nt, Human
cugugugccuccugugaucagg

SEQ ID NO: 728802 - RNA, 22 nt, Human
gagaaggaggcgaagcgugugc

SEQ ID NO: 728803 - RNA, 22 nt, Human
caggcagaaggaaguaccaggc

SEQ ID NO: 728804 - RNA, 22 nt, Human
aaagaugugccuguuucauagu

SEQ ID NO: 728805 - RNA, 22 nt, Human
uggaagccaggcccgcuccuaa

SEQ ID NO: 728806 - RNA, 21 nt, Human
ugaaugaugccccagaguugu

SEQ ID NO: 728807 - RNA, 22 nt, Human
caucuggguucucagauggaua

SEQ ID NO: 728808 - RNA, 22 nt, Human
uugaaaggguuaaagugguaaa

SEQ ID NO: 728809 - RNA, 22 nt, Human
ugaugcugagccugggacugac

SEQ ID NO: 728810 - RNA, 22 nt, Human
aauuaguauugcgauucauuag

SEQ ID NO: 728811 - RNA, 22 nt, Human
agccagcugugggcucaggcgg

SEQ ID NO: 728812 - RNA, 22 nt, Human
gccaggcccugggcacuucgug

SEQ ID NO: 728813 - RNA, 22 nt, Human
acagaauucucucugcagaggc

SEQ ID NO: 728814 - RNA, 22 nt, Human
ggcacagcucaggucccagcuc

SEQ ID NO: 728815 - RNA, 22 nt, Human
agggggugcuacuuccagaguu

SEQ ID NO: 728816 - RNA, 22 nt, Human
caucacugacgcugagauucca

SEQ ID NO: 728817 - RNA, 22 nt, Human
uggucugaagguggauuugaga

SEQ ID NO: 728818 - RNA, 22 nt, Human
aagagcauuuccacuggcacug

SEQ ID NO: 728819 - RNA, 22 nt, Human
gaacacauguccuccuuggauu

SEQ ID NO: 728820 - RNA, 22 nt, Human
cuucccagaccuuagagugcag

SEQ ID NO: 728821 - RNA, 19 nt, Human
uaggccagaaguuuuccac

SEQ ID NO: 728822 - RNA, 22 nt, Human
caaauagaagguacucagagaa

SEQ ID NO: 728823 - RNA, 22 nt, Human
gaagcagcucagauugacugaa

SEQ ID NO: 728824 - RNA, 22 nt, Human
uuacaaguauuuaagaugcugu

SEQ ID NO: 728825 - RNA, 22 nt, Human
uucuuuuccuacacagcgauuu

SEQ ID NO: 728826 - RNA, 22 nt, Human
augugugugcauuucucucccu

SEQ ID NO: 728827 - RNA, 22 nt, Human
uuccaaguuaggcgagcuggug

SEQ ID NO: 728828 - RNA, 22 nt, Human
aagcagucuuggcuggguucag

SEQ ID NO: 728829 - RNA, 18 nt, Human
uugagggaggggcagagu

SEQ ID NO: 728830 - RNA, 22 nt, Human
auuacaagggucugacuggagg

SEQ ID NO: 728831 - RNA, 22 nt, Human
uauggaaacuaauucauuuuuc

SEQ ID NO: 728832 - RNA, 22 nt, Human
uccugaaggcagauggggauca

SEQ ID NO: 728833 - RNA, 18 nt, Human
gagcuucaggcuaaccug

SEQ ID NO: 728834 - RNA, 22 nt, Human
ccucagagguucugugugggaa

SEQ ID NO: 728835 - RNA, 22 nt, Human
acauguaaacauuuacaguauu

SEQ ID NO: 728836 - RNA, 22 nt, Human
guuuacacauaacuccuaucaa

SEQ ID NO: 728837 - RNA, 22 nt, Human
uuucuuggagcucuuagggucg

SEQ ID NO: 728838 - RNA, 23 nt, Human
uaaccugaguuuuuuagaugcaa

SEQ ID NO: 728839 - RNA, 19 nt, Human
aaaaggagagaucagaguu

SEQ ID NO: 728840 - RNA, 22 nt, Human
ucuuuuggaaaugaugugcagg

SEQ ID NO: 728841 - RNA, 22 nt, Human
aucaggugaagucacugagugg

SEQ ID NO: 728842 - RNA, 22 nt, Human
gauuauuuugugcaauaaucgg

SEQ ID NO: 728843 - RNA, 22 nt, Human
ccuguucagagcuaagcaucau

SEQ ID NO: 728844 - RNA, 21 nt, Human
aaaguguguggggaagaagga

SEQ ID NO: 728845 - RNA, 22 nt, Human
aaagugcagggugcucugguau

SEQ ID NO: 728846 - RNA, 22 nt, Human
acauuuacccuggaacauugga

SEQ ID NO: 728847 - RNA, 22 nt, Human
cuacccuuaaguuucugugggg

SEQ ID NO: 728848 - RNA, 22 nt, Human
uuuagucuagucuccucagaaa

SEQ ID NO: 728849 - RNA, 22 nt, Human
gagacacagcagauauucaauc

SEQ ID NO: 728850 - RNA, 22 nt, Human
ggggaccuucccagagcaguug

SEQ ID NO: 728851 - RNA, 19 nt, Human
ugggcagugccagggcuua

SEQ ID NO: 728852 - RNA, 22 nt, Human
acagccugcugccugcuucuug

SEQ ID NO: 728853 - RNA, 22 nt, Human
uccaacuaggcacacagcuggu

SEQ ID NO: 728854 - RNA, 22 nt, Human
uuauuugaaucuggcuagagaa

SEQ ID NO: 728855 - RNA, 22 nt, Human
ugcuuuacaagccugcuuccuc

SEQ ID NO: 728856 - RNA, 23 nt, Human
aagucagagccaagucaaugaga

SEQ ID NO: 728857 - RNA, 22 nt, Human
aagcaggcaucuuggaggucaa

SEQ ID NO: 728858 - RNA, 21 nt, Human
uuguaaauggcuuuuuccuuc

SEQ ID NO: 728859 - RNA, 22 nt, Human
cugcacagagcggcaguucuua

SEQ ID NO: 728860 - RNA, 22 nt, Human
ggauggcauguugggcucuguu

SEQ ID NO: 728861 - RNA, 22 nt, Human
gggucucucucggcuccacgcg

SEQ ID NO: 728862 - RNA, 21 nt, Human
gcucccuggcugugugaccug

SEQ ID NO: 728863 - RNA, 22 nt, Human
cccaggguggaugcaagcagca

SEQ ID NO: 728864 - RNA, 20 nt, Human
ugucuuccagcagguguuua

SEQ ID NO: 728865 - RNA, 18 nt, Human
uggagcugagugcugugc

SEQ ID NO: 728866 - RNA, 22 nt, Human
aacagcaugcuggguaacauug

SEQ ID NO: 728867 - RNA, 22 nt, Human
aggccugagccccagguuuguu

SEQ ID NO: 728868 - RNA, 22 nt, Human
ggaggccaaagugugggcggcu

SEQ ID NO: 728869 - RNA, 22 nt, Human
acugggaagacuggaauugcuc

SEQ ID NO: 728870 - RNA, 22 nt, Human
gaggcugcuuuccuccuauccu

SEQ ID NO: 728871 - RNA, 22 nt, Human
uaauacaaggcaggaagcagua

SEQ ID NO: 728872 - RNA, 22 nt, Human
gagguggcaauuuaaugcaguc

SEQ ID NO: 728873 - RNA, 17 nt, Human
gcacugaacaauccugu

SEQ ID NO: 728874 - RNA, 22 nt, Human
gccuggcuaagcagaaggaccc

SEQ ID NO: 728875 - RNA, 22 nt, Human
ggagcuguugcgcaugcgcucg

SEQ ID NO: 728876 - RNA, 22 nt, Human
cugcugugagcacuccagccug

SEQ ID NO: 728877 - RNA, 22 nt, Human
aguaguggggccaggguuugaa

SEQ ID NO: 728878 - RNA, 22 nt, Human
agugauggagcuuccucugcua

SEQ ID NO: 728879 - RNA, 22 nt, Human
aagugugauuuguagaaugccu

SEQ ID NO: 728880 - RNA, 22 nt, Human
cuccuggaggcuccaagggaga

SEQ ID NO: 728881 - RNA, 22 nt, Human
gugccuggaacuggguaggcug

SEQ ID NO: 728882 - RNA, 21 nt, Human
auguacauucggcaacagaua

SEQ ID NO: 728883 - RNA, 22 nt, Human
uguuuacuuuuaauuaccuguc

SEQ ID NO: 728884 - RNA, 22 nt, Human
ccaggggcuggugcugagcugg

SEQ ID NO: 728885 - RNA, 22 nt, Human
augacugcucugggcucccaug

SEQ ID NO: 728886 - RNA, 20 nt, Human
auucacaaagccaguguugc

SEQ ID NO: 728887 - RNA, 22 nt, Human
agagccuugaagaucuggaaaa

SEQ ID NO: 728888 - RNA, 22 nt, Human
uuacagaaagguugugggauag

SEQ ID NO: 728889 - RNA, 22 nt, Human
auggccagagaaggcaggguca

SEQ ID NO: 728890 - RNA, 18 nt, Human
aggccacacuccagaaca

SEQ ID NO: 728891 - RNA, 22 nt, Human
gccacagggaggcguuuucagg

SEQ ID NO: 728892 - RNA, 21 nt, Human
aaggcuccuccucuaggccuc

SEQ ID NO: 728893 - RNA, 22 nt, Human
cucaguuuuugcugucugguuc

SEQ ID NO: 728894 - RNA, 22 nt, Human
ggucugaaaugugacuuuugaa

SEQ ID NO: 728895 - RNA, 22 nt, Human
aguguuuacucccugcccucca

SEQ ID NO: 728896 - RNA, 19 nt, Human
agucucacccaagcagucu

SEQ ID NO: 728897 - RNA, 22 nt, Human
ugcaggcuccaggugcacauau

SEQ ID NO: 728898 - RNA, 22 nt, Human
uacuaacuuguacacagccuaa

SEQ ID NO: 728899 - RNA, 22 nt, Human
aaagccacaguucuaugucugc

SEQ ID NO: 728900 - RNA, 22 nt, Human
ucuaggguugaggccacaggga

SEQ ID NO: 728901 - RNA, 22 nt, Human
agagaugcaggguacauggaau

SEQ ID NO: 728902 - RNA, 21 nt, Human
cuggaggcagguggugccagg

SEQ ID NO: 728903 - RNA, 22 nt, Human
aaguuuuucacauugcuguugu

SEQ ID NO: 728904 - RNA, 22 nt, Human
gagucagaauguccuccugcgg

SEQ ID NO: 728905 - RNA, 22 nt, Human
uguucccaagauaagauuauga

SEQ ID NO: 728906 - RNA, 22 nt, Human
caguuucuacgacuuaagcaca

SEQ ID NO: 728907 - RNA, 22 nt, Human
cagccuucgacaguuggaguag

SEQ ID NO: 728908 - RNA, 17 nt, Human
gucaacaggauuucuuu

SEQ ID NO: 728909 - RNA, 22 nt, Human
cuuuagguuuugccugagaucu

SEQ ID NO: 728910 - RNA, 22 nt, Human
agagccucugucauggagagaa

SEQ ID NO: 728911 - RNA, 22 nt, Human
acacauaugucauugaaaaauc

SEQ ID NO: 728912 - RNA, 22 nt, Human
cuguugcaucauggcucuuaau

SEQ ID NO: 728913 - RNA, 22 nt, Human
cacaggagaaaggggaagcucg

SEQ ID NO: 728914 - RNA, 22 nt, Human
auauagcacuuguuuugcaugu

SEQ ID NO: 728915 - RNA, 22 nt, Human
uacacagacucuucaauucaga

SEQ ID NO: 728916 - RNA, 22 nt, Human
gcagccagugggaugagaaaga

SEQ ID NO: 728917 - RNA, 19 nt, Human
ccugucugucuucagcuag

SEQ ID NO: 728918 - RNA, 22 nt, Human
gaaagguugggugaauggugga

SEQ ID NO: 728919 - RNA, 22 nt, Human
cuggugauuacaaugaugacaa

SEQ ID NO: 728920 - RNA, 22 nt, Human
ucugguuucccaguuccuccgu

SEQ ID NO: 728921 - RNA, 22 nt, Human
uuagcuuuucacuugcauuauc

SEQ ID NO: 728922 - RNA, 22 nt, Human
acaaacacgagacgccacugug

SEQ ID NO: 728923 - RNA, 22 nt, Human
ggccaggagcugcacagggcuc

SEQ ID NO: 728924 - RNA, 22 nt, Human
ggcuaggcucaccuggagaguu

SEQ ID NO: 728925 - RNA, 22 nt, Human
uagcacaaagagucuuucagag

SEQ ID NO: 728926 - RNA, 22 nt, Human
aucguaaagcccuauggcuuca

SEQ ID NO: 728927 - RNA, 20 nt, Human
agcugaggcaccugagguua

SEQ ID NO: 728928 - RNA, 22 nt, Human
cagggccagggcuauggugaag

SEQ ID NO: 728929 - RNA, 22 nt, Human
gccugaagaacagcugugagga

SEQ ID NO: 728930 - RNA, 22 nt, Human
auugaacauacauauccacacc

SEQ ID NO: 728931 - RNA, 22 nt, Human
uucaggauggaguaccuuuuau

SEQ ID NO: 728932 - RNA, 22 nt, Human
acucagaggcagcugcucaccc

SEQ ID NO: 728933 - RNA, 22 nt, Human
agcuguguuuccagaugguagc

SEQ ID NO: 728934 - RNA, 22 nt, Human
accagcuggucagggcuuuucu

SEQ ID NO: 728935 - RNA, 22 nt, Human
ugcaugugcccacucuggcuua

SEQ ID NO: 728936 - RNA, 23 nt, Human
auaauaacgucugucuugucucu

SEQ ID NO: 728937 - RNA, 22 nt, Human
ugaaaccucaaccaaagguuac

SEQ ID NO: 728938 - RNA, 22 nt, Human
uuaggaaguguguccagaagcg

SEQ ID NO: 728939 - RNA, 22 nt, Human
uugaaauacugcauuguucagu

SEQ ID NO: 728940 - RNA, 22 nt, Human
cagcuguguagaugcaggguca

SEQ ID NO: 728941 - RNA, 22 nt, Human
cucagcuggcaauucuggcucc

SEQ ID NO: 728942 - RNA, 22 nt, Human
cauguuucugagaaaaguagga

SEQ ID NO: 728943 - RNA, 22 nt, Human
gguggccaggccagcucuggcc

SEQ ID NO: 728944 - RNA, 22 nt, Human
ccugcuguccccugagccugga

SEQ ID NO: 728945 - RNA, 22 nt, Human
uuggacugagaguuccaccauu

SEQ ID NO: 728946 - RNA, 22 nt, Human
cugccugcucaccagggcucug

SEQ ID NO: 728947 - RNA, 22 nt, Human
gaaauaacagcucuggaagagu

SEQ ID NO: 728948 - RNA, 22 nt, Human
uugcaggaaacugagugugagc

SEQ ID NO: 728949 - RNA, 20 nt, Human
agucuggcaccuauuccugu

SEQ ID NO: 728950 - RNA, 22 nt, Human
aggcacagauuuggggaaagca

SEQ ID NO: 728951 - RNA, 22 nt, Human
ggucaugagggagcagugcagg

SEQ ID NO: 728952 - RNA, 22 nt, Human
aguccuggcucuacgggcuuca

SEQ ID NO: 728953 - RNA, 21 nt, Human
uuugcuucaauuccagaagcu

SEQ ID NO: 728954 - RNA, 23 nt, Human
auccaugcuuaaguaaucauuug

SEQ ID NO: 728955 - RNA, 22 nt, Human
ggucucuguuuggggcuggcaa

SEQ ID NO: 728956 - RNA, 22 nt, Human
uaaaaugaucucucauguucuu

SEQ ID NO: 728957 - RNA, 22 nt, Human
uaauacagauacaaaggaggac

SEQ ID NO: 728958 - RNA, 22 nt, Human
ugcuucaaggacacugacuuuu

SEQ ID NO: 728959 - RNA, 22 nt, Human
ugcuggcuuccugugcacagca

SEQ ID NO: 728960 - RNA, 22 nt, Human
uuuuccuucaccucuugagccu

SEQ ID NO: 728961 - RNA, 22 nt, Human
aaucuguugaugcaaaccuccc

SEQ ID NO: 728962 - RNA, 22 nt, Human
caguggccaugguggcaggggu

SEQ ID NO: 728963 - RNA, 22 nt, Human
aaggcacuagcaagcugccugg

SEQ ID NO: 728964 - RNA, 22 nt, Human
aauaagauccugaagauauguu

SEQ ID NO: 728965 - RNA, 22 nt, Human
aaaguugaccgaaagauuuuga

SEQ ID NO: 728966 - RNA, 22 nt, Human
ugcaggcuguuugguggaucuc

SEQ ID NO: 728967 - RNA, 22 nt, Human
ggagcuccuggcagugacagag

SEQ ID NO: 728968 - RNA, 22 nt, Human
ccagguacuugguaugcauuca

SEQ ID NO: 728969 - RNA, 22 nt, Human
ucucacagcaucauugcucaug

SEQ ID NO: 728970 - RNA, 23 nt, Human
ggcagcucucaucugaugacuga

SEQ ID NO: 728971 - RNA, 22 nt, Human
ugggcagacgggagcuugccuu

SEQ ID NO: 728972 - RNA, 22 nt, Human
ucaguauagcuaaaaguuuguc

SEQ ID NO: 728973 - RNA, 22 nt, Human
gaaguauaugucuuuaaucuau

SEQ ID NO: 728974 - RNA, 22 nt, Human
uuggaaggaccaggccuugauu

SEQ ID NO: 728975 - RNA, 22 nt, Human
ggcuggguacagggcagugugc

SEQ ID NO: 728976 - RNA, 22 nt, Human
uaggcuggggguaggaauugag

SEQ ID NO: 728977 - RNA, 22 nt, Human
auucucuguggugaugcuggug

SEQ ID NO: 728978 - RNA, 22 nt, Human
gccucaugagggaucugcccuc

SEQ ID NO: 728979 - RNA, 22 nt, Human
gggguagggcgauugcugcuuu

SEQ ID NO: 728980 - RNA, 22 nt, Human
agagggcugcugcacagugcuc

SEQ ID NO: 728981 - RNA, 22 nt, Human
ucagacagaaggacuauuugaa

SEQ ID NO: 728982 - RNA, 22 nt, Human
agcaggcuaaucuugcugaaca

SEQ ID NO: 728983 - RNA, 22 nt, Human
guggucagugguacaguuugaa

SEQ ID NO: 728984 - RNA, 22 nt, Human
uaugcacacauuagcacagggu

SEQ ID NO: 728985 - RNA, 22 nt, Human
cagggcacggagaagucacccc

SEQ ID NO: 728986 - RNA, 22 nt, Human
uuguaauggagcaaacagguug

SEQ ID NO: 728987 - RNA, 22 nt, Human
ugaggccagagaguuugcauuu

SEQ ID NO: 728988 - RNA, 22 nt, Human
agagcccugccaauggaugagg

SEQ ID NO: 728989 - RNA, 22 nt, Human
ccucagcugcugcacagcuuuu

SEQ ID NO: 728990 - RNA, 22 nt, Human
agugaacuguggcccgugaacu

SEQ ID NO: 728991 - RNA, 22 nt, Human
uacagagagauaaguguaaaag

SEQ ID NO: 728992 - RNA, 22 nt, Human
uauccaaaguggcauauuauag

SEQ ID NO: 728993 - RNA, 22 nt, Human
gcccccucaaagaggaagcucu

SEQ ID NO: 728994 - RNA, 21 nt, Human
aauacagugaagaauuucuuu

SEQ ID NO: 728995 - RNA, 22 nt, Human
aggaguggaauuacuggguucu

SEQ ID NO: 728996 - RNA, 22 nt, Human
guggaagggucacagccccuac

SEQ ID NO: 728997 - RNA, 22 nt, Human
gucucuuuuauggugaguugau

SEQ ID NO: 728998 - RNA, 22 nt, Human
aaguugauuaaucuuucgagaa

SEQ ID NO: 728999 - RNA, 22 nt, Human
ugucagggcaugcgguccagcc

SEQ ID NO: 729000 - RNA, 22 nt, Human
cugaggcaccuacagucucggg

SEQ ID NO: 729001 - RNA, 22 nt, Human
aucaugacauacuuuugagaag

SEQ ID NO: 729002 - RNA, 22 nt, Human
ucaagaaacugugcuacagagu

SEQ ID NO: 729003 - RNA, 22 nt, Human
gagccugcaggccucggccuca

SEQ ID NO: 729004 - RNA, 22 nt, Human
uguucucucuggcugccaguac

SEQ ID NO: 729005 - RNA, 22 nt, Human
uggucccuagcacagcuguccu

SEQ ID NO: 729006 - RNA, 22 nt, Human
aguucuuugucaucucuggagu

SEQ ID NO: 729007 - RNA, 22 nt, Human
aaucuuuaaggacucagucucu

SEQ ID NO: 729008 - RNA, 22 nt, Human
guguccaucagcagccacugug

SEQ ID NO: 729009 - RNA, 22 nt, Human
acauuuaaccaaacuguuuaau

SEQ ID NO: 729010 - RNA, 22 nt, Human
uggcuucaguuucccagucugg

SEQ ID NO: 729011 - RNA, 22 nt, Human
uuuacuaagcccaguuauaugc

SEQ ID NO: 729012 - RNA, 23 nt, Human
cccugcccauugagcaggacguc

SEQ ID NO: 729013 - RNA, 22 nt, Human
ugguaaauauguccauucucuu

SEQ ID NO: 729014 - RNA, 20 nt, Human
uugcagcagugaggugaagg

SEQ ID NO: 729015 - RNA, 22 nt, Human
guguaauugaaauugagaacca

SEQ ID NO: 729016 - RNA, 22 nt, Human
ucagcaggcagugggucacaau

SEQ ID NO: 729017 - RNA, 22 nt, Human
gugugugccaacuuuaugugca

SEQ ID NO: 729018 - RNA, 21 nt, Human
aauggaaguuuaaagguaucc

SEQ ID NO: 729019 - RNA, 20 nt, Human
ggcagaugcagagcuaugca

SEQ ID NO: 729020 - RNA, 22 nt, Human
uagugucugaaugcaccuguuu

SEQ ID NO: 729021 - RNA, 22 nt, Human
cuuuggcaugguccucacuaua

SEQ ID NO: 729022 - RNA, 22 nt, Human
uugggggcauauugaguagugg

SEQ ID NO: 729023 - RNA, 22 nt, Human
agagaagacuuacagccacagu

SEQ ID NO: 729024 - RNA, 22 nt, Human
cuggaugcugagagguaccaag

SEQ ID NO: 729025 - RNA, 22 nt, Human
uuagugugcauggaugccucaa

SEQ ID NO: 729026 - RNA, 22 nt, Human
ugaagaauaaaugguugagacu

SEQ ID NO: 729027 - RNA, 22 nt, Human
uuuaguguaagcauaaagaaca

SEQ ID NO: 729028 - RNA, 22 nt, Human
agcagcugccacuggaauagga

SEQ ID NO: 729029 - RNA, 23 nt, Human
acugccugcuacuaugcccacgg

SEQ ID NO: 729030 - RNA, 22 nt, Human
gcacacuggagccuggaagauu

SEQ ID NO: 729031 - RNA, 19 nt, Human
agggcggggcccaggcaca

SEQ ID NO: 729032 - RNA, 22 nt, Human
uacaauaugugaacuuuggugu

SEQ ID NO: 729033 - RNA, 22 nt, Human
cucuauuuauggcaucuuuaug

SEQ ID NO: 729034 - RNA, 22 nt, Human
cucaguuugaaugcugacacug

SEQ ID NO: 729035 - RNA, 20 nt, Human
ucuguagucuguggcaagac

SEQ ID NO: 729036 - RNA, 22 nt, Human
guuuuuaucuaauagcaguuau

SEQ ID NO: 729037 - RNA, 22 nt, Human
gcugcccuagaaguacagagag

SEQ ID NO: 729038 - RNA, 22 nt, Human
aaagguuugccgaccucugcuu

SEQ ID NO: 729039 - RNA, 19 nt, Human
ccagaagggcagcuaugga

SEQ ID NO: 729040 - RNA, 22 nt, Human
ccugaagaaaauuccacgagaa

SEQ ID NO: 729041 - RNA, 22 nt, Human
gaaauucacuguauuucuuggg

SEQ ID NO: 729042 - RNA, 22 nt, Human
ugacugaaggacuagauugauu

SEQ ID NO: 729043 - RNA, 22 nt, Human
gagcuaguagaacaagugagga

SEQ ID NO: 729044 - RNA, 19 nt, Human
uuuaccuucuugagagcag

SEQ ID NO: 729045 - RNA, 22 nt, Human
uuugagaagcugucuugggcuc

SEQ ID NO: 729046 - RNA, 22 nt, Human
ccaggcacuuguuugccaggca

SEQ ID NO: 729047 - RNA, 22 nt, Human
uugaguucagggguugauugga

SEQ ID NO: 729048 - RNA, 22 nt, Human
gcuuuuauuucuucacaaaagu

SEQ ID NO: 729049 - RNA, 22 nt, Human
ggaagaaagcacacaaacuuga

SEQ ID NO: 729050 - RNA, 22 nt, Human
ugggaaguaggacagugcaguu

SEQ ID NO: 729051 - RNA, 21 nt, Human
agguggagugcuuagcaucca

SEQ ID NO: 729052 - RNA, 22 nt, Human
cagucuggcacagcacacugaa

SEQ ID NO: 729053 - RNA, 22 nt, Human
gucuggcauaugcaaagugcau

SEQ ID NO: 729054 - RNA, 22 nt, Human
gagguauguaugcuacauucuu

SEQ ID NO: 729055 - RNA, 22 nt, Human
acacugcagaugaaagcauaag

SEQ ID NO: 729056 - RNA, 22 nt, Human
caggcugggcagccuccccggc

SEQ ID NO: 729057 - RNA, 22 nt, Human
uacugugguuacugcuauuaga

SEQ ID NO: 729058 - RNA, 22 nt, Human
auacuuuagagcuagauugccu

SEQ ID NO: 729059 - RNA, 22 nt, Human
cauacauacugaguggacugau

SEQ ID NO: 729060 - RNA, 22 nt, Human
caguuuagcaaauuuguaucaa

SEQ ID NO: 729061 - RNA, 22 nt, Human
ucucagggcgcagugaggcagu

SEQ ID NO: 729062 - RNA, 22 nt, Human
ucccugugagaaaugaagcagg

SEQ ID NO: 729063 - RNA, 22 nt, Human
ugauugcugaauuuuaggaacu

SEQ ID NO: 729064 - RNA, 22 nt, Human
cuacauuuugugauuaugaaau

SEQ ID NO: 729065 - RNA, 22 nt, Human
auuuguuucagggccuugguau

SEQ ID NO: 729066 - RNA, 22 nt, Human
uccgcagaggaggaguugcugu

SEQ ID NO: 729067 - RNA, 18 nt, Human
agccuggaggguugaagu

SEQ ID NO: 729068 - RNA, 22 nt, Human
ccucucuguagcagcccccagu

SEQ ID NO: 729069 - RNA, 22 nt, Human
augaccagacucucaguggggu

SEQ ID NO: 729070 - RNA, 22 nt, Human
cuggcuuugaaaugcauuucag

SEQ ID NO: 729071 - RNA, 21 nt, Human
ugcauauucuucugguggcug

SEQ ID NO: 729072 - RNA, 22 nt, Human
uggugaggucauagagaacugu

SEQ ID NO: 729073 - RNA, 22 nt, Human
uuuguucuuaguaucugugugc

SEQ ID NO: 729074 - RNA, 22 nt, Human
uguguacaagaguguuuacugu

SEQ ID NO: 729075 - RNA, 22 nt, Human
cauuugaaugagauugcuguaa

SEQ ID NO: 729076 - RNA, 22 nt, Human
uggcucaguuucugcccagcug

SEQ ID NO: 729077 - RNA, 22 nt, Human
cagcacaguagaguaguuguaa

SEQ ID NO: 729078 - RNA, 22 nt, Human
uaacauucuuaacuuagaaaca

SEQ ID NO: 729079 - RNA, 22 nt, Human
uggccacucagggaugcaggaa

SEQ ID NO: 729080 - RNA, 22 nt, Human
uugugcccucaaagggugcguc

SEQ ID NO: 729081 - RNA, 22 nt, Human
agugaauuguugccacagagac

SEQ ID NO: 729082 - RNA, 22 nt, Human
uagcacaaguaucugcuuuucc

SEQ ID NO: 729083 - RNA, 22 nt, Human
uuuccauguuggugaaaugagg

SEQ ID NO: 729084 - RNA, 22 nt, Human
cugugcuugacagugggaagca

SEQ ID NO: 729085 - RNA, 20 nt, Human
ugggauuguuuuuuagcuuc

SEQ ID NO: 729086 - RNA, 22 nt, Human
caaagugcagaaggaacugggu

SEQ ID NO: 729087 - RNA, 22 nt, Human
aagaugguuauuucaucaccua

SEQ ID NO: 729088 - RNA, 22 nt, Human
agguuuacugagggugcugguu

SEQ ID NO: 729089 - RNA, 22 nt, Human
gcccucuguguaacaauccaga

SEQ ID NO: 729090 - RNA, 22 nt, Human
cacagugcacuaagcuccgggg

SEQ ID NO: 729091 - RNA, 22 nt, Human
uucacuuaacaucauaucauga

SEQ ID NO: 729092 - RNA, 22 nt, Human
ccugggcaucucaugcaccugc

SEQ ID NO: 729093 - RNA, 22 nt, Human
aacagaguggagccaaacuuug

SEQ ID NO: 729094 - RNA, 20 nt, Human
aguggcugauggaaagaagc

SEQ ID NO: 729095 - RNA, 22 nt, Human
augagcauccagaacagugccu

SEQ ID NO: 729096 - RNA, 19 nt, Human
aggugaggggcaccauguc

SEQ ID NO: 729097 - RNA, 18 nt, Human
aguccuggagaucaccaa

SEQ ID NO: 729098 - RNA, 22 nt, Human
ugugauucaagaaaguaaaaug

SEQ ID NO: 729099 - RNA, 17 nt, Human
agcaggcugcagaggcc

SEQ ID NO: 729100 - RNA, 22 nt, Human
aaccauuagucaaucagcaaga

SEQ ID NO: 729101 - RNA, 22 nt, Human
ugcaaagaaggggaggaggauu

SEQ ID NO: 729102 - RNA, 22 nt, Human
ugucccagucaaggcugucauc

SEQ ID NO: 729103 - RNA, 22 nt, Human
agagagggaauauuugggguau

SEQ ID NO: 729104 - RNA, 22 nt, Human
acacggcacuuuaggaaggggc

SEQ ID NO: 729105 - RNA, 22 nt, Human
acugagacugccccuguaacaa

SEQ ID NO: 729106 - RNA, 22 nt, Human
cugggucuaaaaauucucagau

SEQ ID NO: 729107 - RNA, 22 nt, Human
aggucucaauuccugcuccugu

SEQ ID NO: 729108 - RNA, 22 nt, Human
aucuggguuucaaagaagccuu

SEQ ID NO: 729109 - RNA, 19 nt, Human
uucugggcauucauauuua

SEQ ID NO: 729110 - RNA, 22 nt, Human
ggccucuucugcucauacuuuc

SEQ ID NO: 729111 - RNA, 22 nt, Human
aggagagagaacacuugggucc

SEQ ID NO: 729112 - RNA, 22 nt, Human
uuuaccauccucuuuuagaauu

SEQ ID NO: 729113 - RNA, 22 nt, Human
aaugcacacauuugguacugaa

SEQ ID NO: 729114 - RNA, 22 nt, Human
ggguggcaaaggcgcugaaagg

SEQ ID NO: 729115 - RNA, 22 nt, Human
ucugucugggugccucgaguac

SEQ ID NO: 729116 - RNA, 22 nt, Human
acagugaggaagcagcugugcu

SEQ ID NO: 729117 - RNA, 22 nt, Human
gaaggucaccuccccucucugg

SEQ ID NO: 729118 - RNA, 22 nt, Human
uuggaauccugagaugagaauu

SEQ ID NO: 729119 - RNA, 22 nt, Human
cauucacaaaaccacaugccau

SEQ ID NO: 729120 - RNA, 22 nt, Human
ucaaggaagauagcuauuauga

SEQ ID NO: 729121 - RNA, 22 nt, Human
aagcagcaaguuuauuucuauc

SEQ ID NO: 729122 - RNA, 17 nt, Human
aggcagcucagaacauc

SEQ ID NO: 729123 - RNA, 22 nt, Human
cauuagggacugaggaauaagg

SEQ ID NO: 729124 - RNA, 22 nt, Human
gcacagagguggaggacaaaua

SEQ ID NO: 729125 - RNA, 22 nt, Human
cugcagagggguugaagggucc

SEQ ID NO: 729126 - RNA, 22 nt, Human
gugagaguaccaccucaacauc

SEQ ID NO: 729127 - RNA, 22 nt, Human
uucagaaagguaaauggauuuc

SEQ ID NO: 729128 - RNA, 22 nt, Human
cuuuccagaccuccuuguagcu

SEQ ID NO: 729129 - RNA, 22 nt, Human
ccagagguccugugaugcugca

SEQ ID NO: 729130 - RNA, 22 nt, Human
cggcuggagcugagaaaggagc

SEQ ID NO: 729131 - RNA, 22 nt, Human
aggaacccggucugucacugug

SEQ ID NO: 729132 - RNA, 15 nt, Human
aucucucuagcugcu

SEQ ID NO: 729133 - RNA, 22 nt, Human
uuacauuuugggguaaggauaa

SEQ ID NO: 729134 - RNA, 22 nt, Human
ugagaacugaggauuugaauuc

SEQ ID NO: 729135 - RNA, 22 nt, Human
cucaucugucugggcugguuuu

SEQ ID NO: 729136 - RNA, 23 nt, Human
augcagagaauaacaaaugccau

SEQ ID NO: 729137 - RNA, 22 nt, Human
aauacagaggcuuccaguaaaa

SEQ ID NO: 729138 - RNA, 22 nt, Human
cauccugacaagaaagccagaa

SEQ ID NO: 729139 - RNA, 20 nt, Human
ucuggccccuuccuguccug

SEQ ID NO: 729140 - RNA, 22 nt, Human
uccagcucaaagugcuccuguc

SEQ ID NO: 729141 - RNA, 22 nt, Human
aggagccagcguuccucaggau

SEQ ID NO: 729142 - RNA, 22 nt, Human
cuucucagaucucagcuuugag

SEQ ID NO: 729143 - RNA, 22 nt, Human
uaggacagaguucccugauggc

SEQ ID NO: 729144 - RNA, 22 nt, Human
ucuccugcucagaacagccuca

SEQ ID NO: 729145 - RNA, 22 nt, Human
aaguuucuguucauaucucuga

SEQ ID NO: 729146 - RNA, 22 nt, Human
ugauggaaauauugacaccaca

SEQ ID NO: 729147 - RNA, 22 nt, Human
uuucugucugacaucccugccu

SEQ ID NO: 729148 - RNA, 22 nt, Human
gaaacacuaugccaagacaggg

SEQ ID NO: 729149 - RNA, 22 nt, Human
uggggagucgcugcagagcgau

SEQ ID NO: 729150 - RNA, 23 nt, Human
aggcagguuugggcucuucuugu

SEQ ID NO: 729151 - RNA, 22 nt, Human
gcagcagccacuauucuggcau

SEQ ID NO: 729152 - RNA, 22 nt, Human
uugaacaguuuugucagguuca

SEQ ID NO: 729153 - RNA, 22 nt, Human
uagggucccagauaggagccag

SEQ ID NO: 729154 - RNA, 22 nt, Human
ucuauuuaccaaauguaguucc

SEQ ID NO: 729155 - RNA, 22 nt, Human
ggcggugguugagaggacggcg

SEQ ID NO: 729156 - RNA, 22 nt, Human
uggauuugcuaccuucugauau

SEQ ID NO: 729157 - RNA, 20 nt, Human
gcugaccauaaaucacacug

SEQ ID NO: 729158 - RNA, 22 nt, Human
uccucuggauauaagccucacc

SEQ ID NO: 729159 - RNA, 22 nt, Human
uuguagaaucauuauuucuagu

SEQ ID NO: 729160 - RNA, 22 nt, Human
cccagagaaucuuucagaaagg

SEQ ID NO: 729161 - RNA, 22 nt, Human
cacugagaccagagucccugac

SEQ ID NO: 729162 - RNA, 22 nt, Human
auggcaggaugagacaacaauu

SEQ ID NO: 729163 - RNA, 22 nt, Human
ucauacaacuaagaguuucaga

SEQ ID NO: 729164 - RNA, 22 nt, Human
aagauucuuaccuauacccagu

SEQ ID NO: 729165 - RNA, 22 nt, Human
gcagcaggagaguuuguccugc

SEQ ID NO: 729166 - RNA, 17 nt, Human
aggcaccucuuccugcu

SEQ ID NO: 729167 - RNA, 22 nt, Human
ugaguuauugcagcuuccuccu

SEQ ID NO: 729168 - RNA, 20 nt, Human
ggaagccagggugcagggga

SEQ ID NO: 729169 - RNA, 22 nt, Human
ugaaaucauugggguugaauaa

SEQ ID NO: 729170 - RNA, 22 nt, Human
cgugucuguguaugcaggccgu

SEQ ID NO: 729171 - RNA, 22 nt, Human
uaacagaagaaaacauauugga

SEQ ID NO: 729172 - RNA, 22 nt, Human
uuaguugauagccaaaauuuau

SEQ ID NO: 729173 - RNA, 22 nt, Human
acaucugggccuaaggcuauau

SEQ ID NO: 729174 - RNA, 22 nt, Human
gcaaugcauaacagagugggcc

SEQ ID NO: 729175 - RNA, 22 nt, Human
guaguaauaguacauuagaaug

SEQ ID NO: 729176 - RNA, 17 nt, Human
agcaggaccccagagca

SEQ ID NO: 729177 - RNA, 22 nt, Human
ggaagccaguugcuuggugugg

SEQ ID NO: 729178 - RNA, 22 nt, Human
uggcauggguggagagagcaca

SEQ ID NO: 729179 - RNA, 22 nt, Human
caaauguuugguggcauuuugu

SEQ ID NO: 729180 - RNA, 22 nt, Human
uuucacauacaguguauaguag

SEQ ID NO: 729181 - RNA, 22 nt, Human
ucaaguuaggugguuguuagga

SEQ ID NO: 729182 - RNA, 22 nt, Human
ugauucaauaggaauugaguag

SEQ ID NO: 729183 - RNA, 22 nt, Human
acuacaaaagcacuggguauua

SEQ ID NO: 729184 - RNA, 22 nt, Human
gcugucucggggcuuucuccug

SEQ ID NO: 729185 - RNA, 22 nt, Human
accaggaauauuuugcucauuu

SEQ ID NO: 729186 - RNA, 22 nt, Human
uugggcaaaguguuucuggagc

SEQ ID NO: 729187 - RNA, 22 nt, Human
aaaugugugcacaaagacagcu

SEQ ID NO: 729188 - RNA, 22 nt, Human
uuuaaaccuccugauucagcua

SEQ ID NO: 729189 - RNA, 22 nt, Human
cccagagcugauuguuggagcc

SEQ ID NO: 729190 - RNA, 22 nt, Human
aaugcaccuuggcagggauuca

SEQ ID NO: 729191 - RNA, 22 nt, Human
uccccacagcagaagaucugag

SEQ ID NO: 729192 - RNA, 22 nt, Human
guaagaggagugggaagccuca

SEQ ID NO: 729193 - RNA, 22 nt, Human
ccuuuccugccucaggaaguag

SEQ ID NO: 729194 - RNA, 22 nt, Human
ggaaagccaggugcucuggugu

SEQ ID NO: 729195 - RNA, 22 nt, Human
gauggagugccaggguggaacu

SEQ ID NO: 729196 - RNA, 22 nt, Human
uuucaacaccagagaccaugcg

SEQ ID NO: 729197 - RNA, 22 nt, Human
cuauacacuuuuugaaaauaga

SEQ ID NO: 729198 - RNA, 22 nt, Human
aguggggaguuuccagaugugu

SEQ ID NO: 729199 - RNA, 22 nt, Human
cgugggaggaaaaaugggcuuc

SEQ ID NO: 729200 - RNA, 22 nt, Human
ccacauacaaauggggugcugu

SEQ ID NO: 729201 - RNA, 23 nt, Human
gcuugccugguguguggcugacc

SEQ ID NO: 729202 - RNA, 22 nt, Human
agacuggaagccugccaagcaa

SEQ ID NO: 729203 - RNA, 21 nt, Human
ucugagaacuucugcugcagc

SEQ ID NO: 729204 - RNA, 22 nt, Human
augaguuaggggccugagugga

SEQ ID NO: 729205 - RNA, 23 nt, Human
ccucagggucuagcagagagaag

SEQ ID NO: 729206 - RNA, 22 nt, Human
ucagugcuugccucuggaggag

SEQ ID NO: 729207 - RNA, 22 nt, Human
acagugaaugcccaagaaaagu

SEQ ID NO: 729208 - RNA, 22 nt, Human
ucuccuggcucuaaaaggcugu

SEQ ID NO: 729209 - RNA, 22 nt, Human
gcaguccuggaggaagguguga

SEQ ID NO: 729210 - RNA, 22 nt, Human
agguucagugccuggaacaggg

SEQ ID NO: 729211 - RNA, 22 nt, Human
agguuuauaggaaauuuguucc

SEQ ID NO: 729212 - RNA, 18 nt, Human
gcagcaaagggcccgggg

SEQ ID NO: 729213 - RNA, 22 nt, Human
agcucagggcgaucugucucgg

SEQ ID NO: 729214 - RNA, 22 nt, Human
acucauuugcaugaugugcuau

SEQ ID NO: 729215 - RNA, 22 nt, Human
cuuggugcauuacucaaucugu

SEQ ID NO: 729216 - RNA, 22 nt, Human
uacuauaaagucuuaaugaguc

SEQ ID NO: 729217 - RNA, 22 nt, Human
agggccugugaauucucccugc

SEQ ID NO: 729218 - RNA, 22 nt, Human
uuuguucagcucucauugauua

SEQ ID NO: 729219 - RNA, 22 nt, Human
ucaguuuuuaagaguuaugcga

SEQ ID NO: 729220 - RNA, 22 nt, Human
cccugccuugggguccacaccg

SEQ ID NO: 729221 - RNA, 22 nt, Human
auucaguaggugugaacuuauu

SEQ ID NO: 729222 - RNA, 22 nt, Human
cugucucuguugccuguaggug

SEQ ID NO: 729223 - RNA, 21 nt, Human
uuguuacauucuuauggcaua

SEQ ID NO: 729224 - RNA, 22 nt, Human
agauacaaaagauaagauuuag

SEQ ID NO: 729225 - RNA, 20 nt, Human
gagccugggaagucuaaggu

SEQ ID NO: 729226 - RNA, 22 nt, Human
aagcagagagcagaauuaaguu

SEQ ID NO: 729227 - RNA, 22 nt, Human
cuugggugcucagggaaagcuu

SEQ ID NO: 729228 - RNA, 22 nt, Human
cuuggucauuucuuguccuguu

SEQ ID NO: 729229 - RNA, 22 nt, Human
cagugauucagacucaucauuu

SEQ ID NO: 729230 - RNA, 22 nt, Human
ggaggccaaggcagguggaucg

SEQ ID NO: 729231 - RNA, 22 nt, Human
uggggugacagugcagugguca

SEQ ID NO: 729232 - RNA, 22 nt, Human
caaugcauacuucgaaauuuca

SEQ ID NO: 729233 - RNA, 22 nt, Human
acaaaguuauucuuucagagga

SEQ ID NO: 729234 - RNA, 22 nt, Human
uccuucaccuuagcccuccuag

SEQ ID NO: 729235 - RNA, 22 nt, Human
caucuaaauuugacuccaagga

SEQ ID NO: 729236 - RNA, 23 nt, Human
ggguccagagaagccauuagggc

SEQ ID NO: 729237 - RNA, 22 nt, Human
uaacaauacccauucuaauuac

SEQ ID NO: 729238 - RNA, 22 nt, Human
acaaaguuugugguauuccaag

SEQ ID NO: 729239 - RNA, 22 nt, Human
cuggagccuucaccaggggaaa

SEQ ID NO: 729240 - RNA, 22 nt, Human
ccuugucuugcacagaugcagc

SEQ ID NO: 729241 - RNA, 22 nt, Human
uccugaggaugguugaagugca

SEQ ID NO: 729242 - RNA, 22 nt, Human
cuccucuguauugauugggacu

SEQ ID NO: 729243 - RNA, 22 nt, Human
uuaaacacuggagcuggguguu

SEQ ID NO: 729244 - RNA, 22 nt, Human
aguuagaaaguaaaucauuuga

SEQ ID NO: 729245 - RNA, 22 nt, Human
ucuacuguagugaugcugcagu

SEQ ID NO: 729246 - RNA, 22 nt, Human
uuugcuuugacugucagcaagu

SEQ ID NO: 729247 - RNA, 19 nt, Human
ccacuuugcuucucugggu

SEQ ID NO: 729248 - RNA, 17 nt, Human
agacagaccucugcauc

SEQ ID NO: 729249 - RNA, 22 nt, Human
agagcagauuucaaauauuggc

SEQ ID NO: 729250 - RNA, 23 nt, Human
agcuggaggcugucuacucccaa

SEQ ID NO: 729251 - RNA, 22 nt, Human
acuguaaugguggauccauguc

SEQ ID NO: 729252 - RNA, 22 nt, Human
ccuggcaggccccuccuggauu

SEQ ID NO: 729253 - RNA, 22 nt, Human
uacuguuuuuuagacucauggu

SEQ ID NO: 729254 - RNA, 22 nt, Human
ugagugaauucaaguaaagggc

SEQ ID NO: 729255 - RNA, 22 nt, Human
acacaaugauucacaagcagca

SEQ ID NO: 729256 - RNA, 22 nt, Human
uuugcauuuugauaagaucacu

SEQ ID NO: 729257 - RNA, 22 nt, Human
uacuauugaaucauugucaauc

SEQ ID NO: 729258 - RNA, 22 nt, Human
agcugaaguucaguccagagaa

SEQ ID NO: 729259 - RNA, 22 nt, Human
gucccuggucuaccguggcuuc

SEQ ID NO: 729260 - RNA, 22 nt, Human
uccuacagauacuaaggagauc

SEQ ID NO: 729261 - RNA, 22 nt, Human
ggggacugccuuccacagacac

SEQ ID NO: 729262 - RNA, 22 nt, Human
gugggcaggccccaaagcaggg

SEQ ID NO: 729263 - RNA, 22 nt, Human
ugcagagguuugugguguugcu

SEQ ID NO: 729264 - RNA, 22 nt, Human
aaguauacugaagguauccagg

SEQ ID NO: 729265 - RNA, 19 nt, Human
caccccaguccucuuuccc

SEQ ID NO: 729266 - RNA, 19 nt, Human
acuuccugcccgcuccuuu

SEQ ID NO: 729267 - RNA, 22 nt, Human
auuucuuucuggccacgguuuu

SEQ ID NO: 729268 - RNA, 22 nt, Human
uugcaggggaaggagcagagcu

SEQ ID NO: 729269 - RNA, 22 nt, Human
ucacagagaacuauaauccauc

SEQ ID NO: 729270 - RNA, 22 nt, Human
aagcagaaagaacaacugagug

SEQ ID NO: 729271 - RNA, 22 nt, Human
gggcagagaaauggacaguugg

SEQ ID NO: 729272 - RNA, 22 nt, Human
ucaacacuauccaggcaaucuu

SEQ ID NO: 729273 - RNA, 22 nt, Human
aauucagagacucauucuggag

SEQ ID NO: 729274 - RNA, 22 nt, Human
gaggagaagcuaagaaacacag

SEQ ID NO: 729275 - RNA, 22 nt, Human
ggcaggugggaacccuccccac

SEQ ID NO: 729276 - RNA, 22 nt, Human
ucucugagaaguuccuuuguga

SEQ ID NO: 729277 - RNA, 22 nt, Human
ccuggagggacccuggcccugu

SEQ ID NO: 729278 - RNA, 22 nt, Human
ugcuggagcggaggugagccag

SEQ ID NO: 729279 - RNA, 22 nt, Human
uccaguugcccaucucucuucu

SEQ ID NO: 729280 - RNA, 22 nt, Human
aggcuaggcugaugccucuucc

SEQ ID NO: 729281 - RNA, 22 nt, Human
gucagcaauucaagagcucuua

SEQ ID NO: 729282 - RNA, 22 nt, Human
ugcacagugaccccuggugacu

SEQ ID NO: 729283 - RNA, 22 nt, Human
agcucugggaguaguuccaccu

SEQ ID NO: 729284 - RNA, 22 nt, Human
uccaucucaccugcacucugcg

SEQ ID NO: 729285 - RNA, 22 nt, Human
uauccauauucagacugugaau

SEQ ID NO: 729286 - RNA, 22 nt, Human
guggggugggcugaguuaggcc

SEQ ID NO: 729287 - RNA, 22 nt, Human
uucuuaagcaguuuggcauguu

SEQ ID NO: 729288 - RNA, 22 nt, Human
cuuuacacuuggacccacacuu

SEQ ID NO: 729289 - RNA, 22 nt, Human
gcucccaacucaggccuccucc

SEQ ID NO: 729290 - RNA, 22 nt, Human
ggguccaguuucaucugagguu

SEQ ID NO: 729291 - RNA, 22 nt, Human
ggugucuggacagugagccagg

SEQ ID NO: 729292 - RNA, 22 nt, Human
aacaaauuuagcucugagugcu

SEQ ID NO: 729293 - RNA, 22 nt, Human
gucuggacagcagcaccucggc

SEQ ID NO: 729294 - RNA, 22 nt, Human
guuuuauuuccaugagagaccg

SEQ ID NO: 729295 - RNA, 22 nt, Human
ggguccaccugagcagcagccu

SEQ ID NO: 729296 - RNA, 22 nt, Human
auucacauuuagccucugacau

SEQ ID NO: 729297 - RNA, 22 nt, Human
acaugcuuguuuuucacaaccu

SEQ ID NO: 729298 - RNA, 22 nt, Human
aggcaugugacccuggacucag

SEQ ID NO: 729299 - RNA, 22 nt, Human
ugcugcucgccacggcccaggg

SEQ ID NO: 729300 - RNA, 22 nt, Human
augcugugucaggaauuugaua

SEQ ID NO: 729301 - RNA, 22 nt, Human
ugaauucuuuuagaauucagug

SEQ ID NO: 729302 - RNA, 22 nt, Human
auggcaaaaauuaacagaucaa

SEQ ID NO: 729303 - RNA, 22 nt, Human
aaaaucugcuuccuuuuacaga

SEQ ID NO: 729304 - RNA, 22 nt, Human
uagaggcucuucauugcaguag

SEQ ID NO: 729305 - RNA, 22 nt, Human
gugugggcuaugugcgugggca

SEQ ID NO: 729306 - RNA, 19 nt, Human
ggcucucccuugagagagc

SEQ ID NO: 729307 - RNA, 22 nt, Human
cacagcagcguuccuccgugug

SEQ ID NO: 729308 - RNA, 22 nt, Human
uuucacagaaagacaacagaua

SEQ ID NO: 729309 - RNA, 22 nt, Human
cuccucagagagcagcuugggg

SEQ ID NO: 729310 - RNA, 22 nt, Human
uccagugcauucagacacuugg

SEQ ID NO: 729311 - RNA, 20 nt, Human
gccaggcacuguucucaaua

SEQ ID NO: 729312 - RNA, 22 nt, Human
ucaggcugcagcugucagcagc

SEQ ID NO: 729313 - RNA, 22 nt, Human
gucagugugagauaaucuugga

SEQ ID NO: 729314 - RNA, 22 nt, Human
gggcagguacaagaugcuucuu

SEQ ID NO: 729315 - RNA, 22 nt, Human
aacuugguaccaccuucugaag

SEQ ID NO: 729316 - RNA, 22 nt, Human
aaaugcacaauaaaguaaaggc

SEQ ID NO: 729317 - RNA, 22 nt, Human
uccugauggaggggucaucuuu

SEQ ID NO: 729318 - RNA, 22 nt, Human
gggcacagucuaaaguugggcc

SEQ ID NO: 729319 - RNA, 22 nt, Human
ucaggggagguugaaucgucuc

SEQ ID NO: 729320 - RNA, 20 nt, Human
aacucagagaugaaaaagac

SEQ ID NO: 729321 - RNA, 22 nt, Human
ugcuggaaggguaguauuaacu

SEQ ID NO: 729322 - RNA, 22 nt, Human
ggccagagaauaugccuuacgu

SEQ ID NO: 729323 - RNA, 22 nt, Human
ccuggcucugggaucuucgcuu

SEQ ID NO: 729324 - RNA, 22 nt, Human
ucugucugagggagugacauuu

SEQ ID NO: 729325 - RNA, 22 nt, Human
ggcaggugcucugugggccugg

SEQ ID NO: 729326 - RNA, 22 nt, Human
augcacaagcaagagauaaugg

SEQ ID NO: 729327 - RNA, 21 nt, Human
aaggcuggagaugcaggucug

SEQ ID NO: 729328 - RNA, 22 nt, Human
ugaggucugcagggcugugcau

SEQ ID NO: 729329 - RNA, 22 nt, Human
acagcagguuacaguggcacag

SEQ ID NO: 729330 - RNA, 23 nt, Human
agucuucauuguauuuccagacc

SEQ ID NO: 729331 - RNA, 22 nt, Human
uugauucuaugagguaagcuau

SEQ ID NO: 729332 - RNA, 22 nt, Human
uggaacacuuuguugaaaugca

SEQ ID NO: 729333 - RNA, 22 nt, Human
ucaaugucagcugguaggaaau

SEQ ID NO: 729334 - RNA, 22 nt, Human
guacacuauuaaaccugcucau

SEQ ID NO: 729335 - RNA, 22 nt, Human
uaucuuuaacuugcaguauuua

SEQ ID NO: 729336 - RNA, 19 nt, Human
ugcuggaggguagugaguc

SEQ ID NO: 729337 - RNA, 22 nt, Human
cagcccagagaaggggcccgug

SEQ ID NO: 729338 - RNA, 23 nt, Human
gaagccacacaaaggucgccaag

SEQ ID NO: 729339 - RNA, 22 nt, Human
ggcagccaugcuccaggugcag

SEQ ID NO: 729340 - RNA, 22 nt, Human
gaaguccagaauacugcucuga

SEQ ID NO: 729341 - RNA, 22 nt, Human
uggaacuucaugagauuaugga

SEQ ID NO: 729342 - RNA, 22 nt, Human
cauagagugauguaagguaugu

SEQ ID NO: 729343 - RNA, 22 nt, Human
agaaaguuguuggaggaaauga

SEQ ID NO: 729344 - RNA, 22 nt, Human
acucuggcccuccugcugccag

SEQ ID NO: 729345 - RNA, 22 nt, Human
aaggcacuagcagaauuaguga

SEQ ID NO: 729346 - RNA, 22 nt, Human
augagcuugguccagcaggcuu

SEQ ID NO: 729347 - RNA, 22 nt, Human
agagaauuuuaaaagccuugaa

SEQ ID NO: 729348 - RNA, 20 nt, Human
uccagagaguggcaaagcuc

SEQ ID NO: 729349 - RNA, 22 nt, Human
aauagcauaagaugucaaauag

SEQ ID NO: 729350 - RNA, 22 nt, Human
agagcuguuaauuuugcacugg

SEQ ID NO: 729351 - RNA, 22 nt, Human
guccuggauugaacauaggcag

SEQ ID NO: 729352 - RNA, 22 nt, Human
agaaacauuuagauuauauguc

SEQ ID NO: 729353 - RNA, 22 nt, Human
aaucauuguaaaugguuuuguu

SEQ ID NO: 729354 - RNA, 18 nt, Human
aagucuuggaauuuccac

SEQ ID NO: 729355 - RNA, 22 nt, Human
cagugagggcauucagugcugg

SEQ ID NO: 729356 - RNA, 22 nt, Human
agaaacuauuaugguaaacaaa

SEQ ID NO: 729357 - RNA, 19 nt, Human
gcgggcggcgccugcgagg

SEQ ID NO: 729358 - RNA, 22 nt, Human
acucugcuauugcagugcaaaa

SEQ ID NO: 729359 - RNA, 22 nt, Human
cccagagcaugugcugccuuug

SEQ ID NO: 729360 - RNA, 22 nt, Human
aagcagcauucagugaaaugug

SEQ ID NO: 729361 - RNA, 22 nt, Human
gcaguguuaccucuucaguggg

SEQ ID NO: 729362 - RNA, 22 nt, Human
auagcaaugaucaagacagaca

SEQ ID NO: 729363 - RNA, 21 nt, Human
ucaggguucaaaggaacugau

SEQ ID NO: 729364 - RNA, 21 nt, Human
uggcuuugcccugcuugcccc

SEQ ID NO: 729365 - RNA, 22 nt, Human
auccagucaaaauuaguaaggu

SEQ ID NO: 729366 - RNA, 17 nt, Human
cugaggauuaugguugu

SEQ ID NO: 729367 - RNA, 22 nt, Human
ucacugcuuucaaaaauuauug

SEQ ID NO: 729368 - RNA, 22 nt, Human
ucuuuaauaucugccccagagc

SEQ ID NO: 729369 - RNA, 22 nt, Human
ugcugaaaaguaaauaggccua

SEQ ID NO: 729370 - RNA, 22 nt, Human
aauaauguuuauuuguauucuc

SEQ ID NO: 729371 - RNA, 22 nt, Human
ggucuggcaggugaggacucag

SEQ ID NO: 729372 - RNA, 20 nt, Human
aacaguaccauuuaucucag

SEQ ID NO: 729373 - RNA, 22 nt, Human
aagcaaaacgugcucuaggagg

SEQ ID NO: 729374 - RNA, 22 nt, Human
aagcaaggcaaccuauguccag

SEQ ID NO: 729375 - RNA, 22 nt, Human
gacagggcauggugcagaguuc

SEQ ID NO: 729376 - RNA, 22 nt, Human
acacuggagcuucuagcccacg

SEQ ID NO: 729377 - RNA, 23 nt, Human
uucaggaaaugaauacagacaca

SEQ ID NO: 729378 - RNA, 22 nt, Human
ucugauaaaugccaucuuuuug

SEQ ID NO: 729379 - RNA, 22 nt, Human
agcugcuguuucuugcacguau

SEQ ID NO: 729380 - RNA, 22 nt, Human
acugagcauggcucacagagag

SEQ ID NO: 729381 - RNA, 22 nt, Human
ccuggagcacauggcaggaggc

SEQ ID NO: 729382 - RNA, 22 nt, Human
aggggagcuaacaccagagccc

SEQ ID NO: 729383 - RNA, 22 nt, Human
accuaauaaagguaaauucugu

SEQ ID NO: 729384 - RNA, 22 nt, Human
gugcugaggaaggaagacuuau

SEQ ID NO: 729385 - RNA, 20 nt, Human
ggcugcaggacucauuggcu

SEQ ID NO: 729386 - RNA, 22 nt, Human
ggccuggccuccagaugugggc

SEQ ID NO: 729387 - RNA, 22 nt, Human
ucaggagugauaccauuuguca

SEQ ID NO: 729388 - RNA, 22 nt, Human
agaaauuaugcaguaguuuuau

SEQ ID NO: 729389 - RNA, 22 nt, Human
agcuacaacuuuuccaugagca

SEQ ID NO: 729390 - RNA, 22 nt, Human
ggcccugaucuccuggauucuu

SEQ ID NO: 729391 - RNA, 22 nt, Human
auuuuccuccaugugagcaguu

SEQ ID NO: 729392 - RNA, 22 nt, Human
cagugcuggaggcuggagggaa

SEQ ID NO: 729393 - RNA, 22 nt, Human
aacaucaucaugaacaacuaau

SEQ ID NO: 729394 - RNA, 22 nt, Human
caucccugguuccuguguuuaa

SEQ ID NO: 729395 - RNA, 22 nt, Human
uccuuggcagcagggagcauga

SEQ ID NO: 729396 - RNA, 22 nt, Human
agaaauguacgauguuaugcag

SEQ ID NO: 729397 - RNA, 22 nt, Human
gagugcaguuggggugagggga

SEQ ID NO: 729398 - RNA, 23 nt, Human
aaacugcuuccaauuccugccau

SEQ ID NO: 729399 - RNA, 22 nt, Human
acagaguuaauggauaggcagg

SEQ ID NO: 729400 - RNA, 22 nt, Human
gucugacaccuagaguccagga

SEQ ID NO: 729401 - RNA, 22 nt, Human
agccaaggagugcagguggcuu

SEQ ID NO: 729402 - RNA, 22 nt, Human
aguaaacacugucuuuauauau

SEQ ID NO: 729403 - RNA, 20 nt, Human
uccuggagucugguuuggcu

SEQ ID NO: 729404 - RNA, 22 nt, Human
ucugaaguucuuaaauuaguuu

SEQ ID NO: 729405 - RNA, 19 nt, Human
gucaggcacgugagagcau

SEQ ID NO: 729406 - RNA, 22 nt, Human
acacagagguggccacucuuuu

SEQ ID NO: 729407 - RNA, 22 nt, Human
auugaagaaacccaaauaaugg

SEQ ID NO: 729408 - RNA, 21 nt, Human
uacaucaguuuucuuggcuca

SEQ ID NO: 729409 - RNA, 22 nt, Human
uuucucauuuagaguggcaggg

SEQ ID NO: 729410 - RNA, 22 nt, Human
agcuccaguuuccugacugagc

SEQ ID NO: 729411 - RNA, 22 nt, Human
ccugaagaugcuguggccuggu

SEQ ID NO: 729412 - RNA, 22 nt, Human
ccugcugugaaacuggcauaug

SEQ ID NO: 729413 - RNA, 20 nt, Human
agcuacaaugcgaagcuggc

SEQ ID NO: 729414 - RNA, 22 nt, Human
acaguauauaugguuaucugau

SEQ ID NO: 729415 - RNA, 22 nt, Human
gaguuauauuugcgauauugga

SEQ ID NO: 729416 - RNA, 22 nt, Human
ccagcugugccguguggauagc

SEQ ID NO: 729417 - RNA, 22 nt, Human
aaccccgcucaggcugggugag

SEQ ID NO: 729418 - RNA, 22 nt, Human
guggcagucggaagucaggaga

SEQ ID NO: 729419 - RNA, 22 nt, Human
agccacacagcuuaaugacaga

SEQ ID NO: 729420 - RNA, 22 nt, Human
ggcucugaaauucucacuuuua

SEQ ID NO: 729421 - RNA, 22 nt, Human
ccacagaccuuggcuuccaccu

SEQ ID NO: 729422 - RNA, 22 nt, Human
ugcaugcaugugagcaugcaua

SEQ ID NO: 729423 - RNA, 22 nt, Human
cugccugcugcccuccagagcc

SEQ ID NO: 729424 - RNA, 22 nt, Human
uacagaguauuuuuaauauggu

SEQ ID NO: 729425 - RNA, 22 nt, Human
aaauacucucaauaaagaaagu

SEQ ID NO: 729426 - RNA, 22 nt, Human
uuacacaugaagguccaauguu

SEQ ID NO: 729427 - RNA, 22 nt, Human
gggcugacuccuauuggaugaa

SEQ ID NO: 729428 - RNA, 22 nt, Human
uagcugcuucucacaugggcaa

SEQ ID NO: 729429 - RNA, 22 nt, Human
agugucuguugcuuuugcagug

SEQ ID NO: 729430 - RNA, 22 nt, Human
uugcuugcagacuuagcaaauu

SEQ ID NO: 729431 - RNA, 22 nt, Human
cuagagaaacagugcucugaac

SEQ ID NO: 729432 - RNA, 18 nt, Human
aguccuucuugguuuuac

SEQ ID NO: 729433 - RNA, 22 nt, Human
aaggagugcaugacucagagua

SEQ ID NO: 729434 - RNA, 22 nt, Human
guggauggagcuggaagccauu

SEQ ID NO: 729435 - RNA, 22 nt, Human
ugaggcucagagaagugcuguu

SEQ ID NO: 729436 - RNA, 21 nt, Human
cagacccucuagaggccaccu

SEQ ID NO: 729437 - RNA, 17 nt, Human
aggcuggccuucacagu

SEQ ID NO: 729438 - RNA, 22 nt, Human
acagcucagacaucacugcucu

SEQ ID NO: 729439 - RNA, 22 nt, Human
guggggggagcugcaagcugga

SEQ ID NO: 729440 - RNA, 22 nt, Human
agccagcacuuuuucucugggc

SEQ ID NO: 729441 - RNA, 22 nt, Human
uccucagcuuuuauuucacuug

SEQ ID NO: 729442 - RNA, 22 nt, Human
augcauuguaugaaaggaaaua

SEQ ID NO: 729443 - RNA, 22 nt, Human
aaacuguaaacacagcaguaca

SEQ ID NO: 729444 - RNA, 22 nt, Human
uuugcauaagucauguccagug

SEQ ID NO: 729445 - RNA, 21 nt, Human
acuggccaccacuggcagggg

SEQ ID NO: 729446 - RNA, 22 nt, Human
agggccagccccacccucucug

SEQ ID NO: 729447 - RNA, 22 nt, Human
gacuagaagggcaagagucccu

SEQ ID NO: 729448 - RNA, 22 nt, Human
acauauauuacuaguaaagaca

SEQ ID NO: 729449 - RNA, 22 nt, Human
gcugucacauuuggagcacugg

SEQ ID NO: 729450 - RNA, 22 nt, Human
acaugcauacguguguuuaaaa

SEQ ID NO: 729451 - RNA, 22 nt, Human
ccacccugaggaaugguccggc

SEQ ID NO: 729452 - RNA, 22 nt, Human
acagaugcuuacuggugguucc

SEQ ID NO: 729453 - RNA, 22 nt, Human
agcagugagugggaggaccaug

SEQ ID NO: 729454 - RNA, 22 nt, Human
uuugcuuaaaguucuuucuggu

SEQ ID NO: 729455 - RNA, 22 nt, Human
ucugggagcacacgcagugauc

SEQ ID NO: 729456 - RNA, 23 nt, Human
uuacuacacaaguaacgauuccc

SEQ ID NO: 729457 - RNA, 22 nt, Human
uauguacaauuuguuguauguc

SEQ ID NO: 729458 - RNA, 22 nt, Human
caguuuauagcucuagcagcuu

SEQ ID NO: 729459 - RNA, 19 nt, Human
ucauuuguuaguagaaguu

SEQ ID NO: 729460 - RNA, 22 nt, Human
gauucuggaguuaaggaugccu

SEQ ID NO: 729461 - RNA, 22 nt, Human
agucagcaucugcacugugcug

SEQ ID NO: 729462 - RNA, 22 nt, Human
cugggagcuuggagccuuuggu

SEQ ID NO: 729463 - RNA, 22 nt, Human
agaggccagaaaguaugccacc

SEQ ID NO: 729464 - RNA, 22 nt, Human
uuuacagaucuguugauuuguu

SEQ ID NO: 729465 - RNA, 22 nt, Human
gcuuuacauguuucccuuuaag

SEQ ID NO: 729466 - RNA, 22 nt, Human
acagcagcagaccagcauaugu

SEQ ID NO: 729467 - RNA, 22 nt, Human
ccagaggugaacaggaggcugu

SEQ ID NO: 729468 - RNA, 22 nt, Human
ccuccuggaaaaauucccuggc

SEQ ID NO: 729469 - RNA, 22 nt, Human
auauauaauacuugcugugggc

SEQ ID NO: 729470 - RNA, 22 nt, Human
aguggcagaagccaagucugca

SEQ ID NO: 729471 - RNA, 22 nt, Human
gcucagagcuugaaguuccacu

SEQ ID NO: 729472 - RNA, 22 nt, Human
aggacucaucccugcuugucag

SEQ ID NO: 729473 - RNA, 20 nt, Human
ccagggcuggcuccugggau

SEQ ID NO: 729474 - RNA, 22 nt, Human
guccagagcuggcacacuguca

SEQ ID NO: 729475 - RNA, 22 nt, Human
caaacuauuguucacaagacaa

SEQ ID NO: 729476 - RNA, 22 nt, Human
uaaaaggagguugaagcuguca

SEQ ID NO: 729477 - RNA, 22 nt, Human
agagcuguguuaagaacaggcc

SEQ ID NO: 729478 - RNA, 22 nt, Human
aaauagcagaagcagagggggu

SEQ ID NO: 729479 - RNA, 22 nt, Human
cauggcagugauucagccuuug

SEQ ID NO: 729480 - RNA, 22 nt, Human
gccagcugcucgcguaggguag

SEQ ID NO: 729481 - RNA, 22 nt, Human
uugcaaauugcaagaguuggau

SEQ ID NO: 729482 - RNA, 22 nt, Human
agaauuuguaaaagauaagaca

SEQ ID NO: 729483 - RNA, 22 nt, Human
gagcuggucgaaaugggcugac

SEQ ID NO: 729484 - RNA, 22 nt, Human
ucucagugaagaguauaacaaa

SEQ ID NO: 729485 - RNA, 22 nt, Human
ugcugggccucuucccuggaua

SEQ ID NO: 729486 - RNA, 22 nt, Human
gccucugcaugcucagcaccca

SEQ ID NO: 729487 - RNA, 21 nt, Human
uccugccuuaguccagagcag

SEQ ID NO: 729488 - RNA, 22 nt, Human
augcaugaaagaauccaagccu

SEQ ID NO: 729489 - RNA, 22 nt, Human
gucaggaugcuauuguuauuaa

SEQ ID NO: 729490 - RNA, 22 nt, Human
gaauguuuuuaggaauguuaug

SEQ ID NO: 729491 - RNA, 22 nt, Human
uuaccuaaaauagcucaauuua

SEQ ID NO: 729492 - RNA, 22 nt, Human
aucucugguuguuuugcuccca

SEQ ID NO: 729493 - RNA, 22 nt, Human
ucagccagagguggaugaguca

SEQ ID NO: 729494 - RNA, 22 nt, Human
auucugcauguagguuugcuca

SEQ ID NO: 729495 - RNA, 22 nt, Human
acaaaguuaacaguuggauagu

SEQ ID NO: 729496 - RNA, 22 nt, Human
cuacccagcaccuaggcugccu

SEQ ID NO: 729497 - RNA, 22 nt, Human
uucuuuuaaaagagagcagaaa

SEQ ID NO: 729498 - RNA, 22 nt, Human
agaauauaguuaccaaauucug

SEQ ID NO: 729499 - RNA, 22 nt, Human
uucaaucauuuuuacauagucc

SEQ ID NO: 729500 - RNA, 22 nt, Human
auggcuuucagauuucuauguu

SEQ ID NO: 729501 - RNA, 22 nt, Human
aggauccuuuuucugcuguuug

SEQ ID NO: 729502 - RNA, 22 nt, Human
cauuacaacaaucugccauggc

SEQ ID NO: 729503 - RNA, 22 nt, Human
cugagcgcaugguugcugggga

SEQ ID NO: 729504 - RNA, 22 nt, Human
ucuugugugguggaagauaugg

SEQ ID NO: 729505 - RNA, 22 nt, Human
gugacucuguuucugaaaacag

SEQ ID NO: 729506 - RNA, 23 nt, Human
cuggcuucuggggccucuguuuc

SEQ ID NO: 729507 - RNA, 22 nt, Human
agagcucugcagcuggccucag

SEQ ID NO: 729508 - RNA, 22 nt, Human
uuuccuaugauauucuaugugu

SEQ ID NO: 729509 - RNA, 22 nt, Human
uguucucuucucauugaacaug

SEQ ID NO: 729510 - RNA, 23 nt, Human
agacuggggcauaagaagauggc

SEQ ID NO: 729511 - RNA, 21 nt, Human
cgggugaguugagcaggacac

SEQ ID NO: 729512 - RNA, 23 nt, Human
gaacuguugaugaauagaauaua

SEQ ID NO: 729513 - RNA, 22 nt, Human
uuugauucucaauugcccucug

SEQ ID NO: 729514 - RNA, 20 nt, Human
gaggcccagagaggugaagc

SEQ ID NO: 729515 - RNA, 22 nt, Human
cagggccacugcaugagguuca

SEQ ID NO: 729516 - RNA, 22 nt, Human
gugcauaugguuacagcaccgc

SEQ ID NO: 729517 - RNA, 22 nt, Human
aggaagaguguuaccuaugggu

SEQ ID NO: 729518 - RNA, 22 nt, Human
uggcuggagugggagaaguuua

SEQ ID NO: 729519 - RNA, 22 nt, Human
gucucuggguuaagcagugcau

SEQ ID NO: 729520 - RNA, 19 nt, Human
uggcuucuucgguguuccc

SEQ ID NO: 729521 - RNA, 22 nt, Human
auuauucauggucuuccacaau

SEQ ID NO: 729522 - RNA, 22 nt, Human
cagcaucucugcacccuccccc

SEQ ID NO: 729523 - RNA, 22 nt, Human
cugcacacaucgcacugcccgu

SEQ ID NO: 729524 - RNA, 22 nt, Human
cuucauuacuugcucguagcac

SEQ ID NO: 729525 - RNA, 22 nt, Human
cuauagaaacaaccucucuuuc

SEQ ID NO: 729526 - RNA, 22 nt, Human
auaacuucaucaaauaggcaca

SEQ ID NO: 729527 - RNA, 20 nt, Human
uaacaguaagugauguuaca

SEQ ID NO: 729528 - RNA, 22 nt, Human
ccaaggcaacguuggugucagg

SEQ ID NO: 729529 - RNA, 22 nt, Human
ugggcgaggcccagggcugcgu

SEQ ID NO: 729530 - RNA, 22 nt, Human
uccaggucugguuggacagguu

SEQ ID NO: 729531 - RNA, 22 nt, Human
ugaugacagcaaaaaaugcuag

SEQ ID NO: 729532 - RNA, 22 nt, Human
ugcuggaaaaagauuguguuuu

SEQ ID NO: 729533 - RNA, 22 nt, Human
uagauucaugcaguaugcuagu

SEQ ID NO: 729534 - RNA, 22 nt, Human
agccccaggcccggacgccucu

SEQ ID NO: 729535 - RNA, 22 nt, Human
uauuuugacgauuuuaugcaaa

SEQ ID NO: 729536 - RNA, 22 nt, Human
gagauauuuauucauacuguca

SEQ ID NO: 729537 - RNA, 22 nt, Human
uggaggcagucaaaugacugac

SEQ ID NO: 729538 - RNA, 22 nt, Human
caaauguaauugcgguuuuugc

SEQ ID NO: 729539 - RNA, 22 nt, Human
agcuuaggaggaugaugaacau

SEQ ID NO: 729540 - RNA, 22 nt, Human
acaacauuauacauagaaagcu

SEQ ID NO: 729541 - RNA, 22 nt, Human
cuuucccagaguaguugaugcu

SEQ ID NO: 729542 - RNA, 22 nt, Human
ggagggagcagagaacccaacc

SEQ ID NO: 729543 - RNA, 22 nt, Human
gcugaaaugggcacugaaggcc

SEQ ID NO: 729544 - RNA, 22 nt, Human
gccaccaugucuggcugaguuu

SEQ ID NO: 729545 - RNA, 22 nt, Human
auuugcuuggucuucucuccgu

SEQ ID NO: 729546 - RNA, 16 nt, Human
ccuuucucugccuucc

SEQ ID NO: 729547 - RNA, 22 nt, Human
uaauccguacauuauucugaac

SEQ ID NO: 729548 - RNA, 22 nt, Human
uaacagaaaagaacugaguuug

SEQ ID NO: 729549 - RNA, 22 nt, Human
uucuucagucuaggccuuucuu

SEQ ID NO: 729550 - RNA, 22 nt, Human
augugcuuuuacuccccagagu

SEQ ID NO: 729551 - RNA, 22 nt, Human
uugcuuaauucugaaaauauag

SEQ ID NO: 729552 - RNA, 22 nt, Human
acucugaaccagagaucauacc

SEQ ID NO: 729553 - RNA, 22 nt, Human
agcuucuggaaggcaaggcuug

SEQ ID NO: 729554 - RNA, 22 nt, Human
aagauacagacagagccaaaau

SEQ ID NO: 729555 - RNA, 22 nt, Human
uacauucugaaauaaaugguuu

SEQ ID NO: 729556 - RNA, 22 nt, Human
uucugcagugugcagggccugu

SEQ ID NO: 729557 - RNA, 22 nt, Human
ggccaccaguccucuggcaggg

SEQ ID NO: 729558 - RNA, 15 nt, Human
cacacagacagcuug

SEQ ID NO: 729559 - RNA, 22 nt, Human
aggcucaggaggagcugccgga

SEQ ID NO: 729560 - RNA, 22 nt, Human
auuauguauuugguauaguuug

SEQ ID NO: 729561 - RNA, 22 nt, Human
gagcuguccaagauggucguaa

SEQ ID NO: 729562 - RNA, 22 nt, Human
cagucaggcugcgcuucucuga

SEQ ID NO: 729563 - RNA, 22 nt, Human
cuguuucaccacuggcucuuug

SEQ ID NO: 729564 - RNA, 22 nt, Human
ccagaggucuccugcacgggau

SEQ ID NO: 729565 - RNA, 22 nt, Human
guuucccaggcuguggggcccu

SEQ ID NO: 729566 - RNA, 22 nt, Human
agugucugccaacugcaugguc

SEQ ID NO: 729567 - RNA, 22 nt, Human
ccaggugugccagcagggacug

SEQ ID NO: 729568 - RNA, 22 nt, Human
cacagaagaaucaugcuguguu

SEQ ID NO: 729569 - RNA, 22 nt, Human
gggugcaagcaaguggcacaga

SEQ ID NO: 729570 - RNA, 21 nt, Human
uauucaguccauugauguuua

SEQ ID NO: 729571 - RNA, 22 nt, Human
caugauuuugucuuguguuaau

SEQ ID NO: 729572 - RNA, 22 nt, Human
ccucucaguauugaacuuuaua

SEQ ID NO: 729573 - RNA, 23 nt, Human
uccuucaggcucuuccccuggac

SEQ ID NO: 729574 - RNA, 22 nt, Human
guacauuggcaacucucuuaga

SEQ ID NO: 729575 - RNA, 22 nt, Human
auagauucauucuauuucuccg

SEQ ID NO: 729576 - RNA, 22 nt, Human
gggaucugcuccagagggaaaa

SEQ ID NO: 729577 - RNA, 22 nt, Human
aggagccaaacauauugagaga

SEQ ID NO: 729578 - RNA, 22 nt, Human
acucagcuuccuacagcuagaa

SEQ ID NO: 729579 - RNA, 20 nt, Human
ugcugcugugagcgucccug

SEQ ID NO: 729580 - RNA, 22 nt, Human
aaguuuagugaaacucuagggg

SEQ ID NO: 729581 - RNA, 22 nt, Human
uucuguuuuagaaauaaguagu

SEQ ID NO: 729582 - RNA, 22 nt, Human
aggaauguaguuugaguagaaa

SEQ ID NO: 729583 - RNA, 22 nt, Human
aagagaugauggcagccagagg

SEQ ID NO: 729584 - RNA, 22 nt, Human
aauuccauaucugugauuauua

SEQ ID NO: 729585 - RNA, 22 nt, Human
ugcugggcaucguaggagguac

SEQ ID NO: 729586 - RNA, 21 nt, Human
gcagagccggggcgagaaggc

SEQ ID NO: 729587 - RNA, 21 nt, Human
gggcucagcgcucggcuccuc

SEQ ID NO: 729588 - RNA, 22 nt, Human
gaagauuaaacauauuuagugu

SEQ ID NO: 729589 - RNA, 22 nt, Human
cagugucugguuggcucuacgu

SEQ ID NO: 729590 - RNA, 22 nt, Human
aguacaaaggcccuugauuacu

SEQ ID NO: 729591 - RNA, 19 nt, Human
ggagaucccgcugcagaug

SEQ ID NO: 729592 - RNA, 22 nt, Human
gauugcuucuggaaagcaguuu

SEQ ID NO: 729593 - RNA, 22 nt, Human
cuguguuuugagauauuauuaa

SEQ ID NO: 729594 - RNA, 22 nt, Human
gacaggggcuuugcaugcuuua

SEQ ID NO: 729595 - RNA, 20 nt, Human
aguaugauccacucugcucu

SEQ ID NO: 729596 - RNA, 17 nt, Human
ugaggccauggcaccau

SEQ ID NO: 729597 - RNA, 22 nt, Human
cagaaacuagauuuagacacaa

SEQ ID NO: 729598 - RNA, 22 nt, Human
cccaggcuccugacucauucua

SEQ ID NO: 729599 - RNA, 22 nt, Human
uccuggagccaugauuccccuc

SEQ ID NO: 729600 - RNA, 22 nt, Human
acugugcacacaaaaauagauu

SEQ ID NO: 729601 - RNA, 22 nt, Human
auugaaaauauaauucuaggag

SEQ ID NO: 729602 - RNA, 22 nt, Human
gcugugcacuaccuauacaucc

SEQ ID NO: 729603 - RNA, 22 nt, Human
auggcuggcauccaggugggcu

SEQ ID NO: 729604 - RNA, 18 nt, Human
agccucuggcagagagaa

SEQ ID NO: 729605 - RNA, 22 nt, Human
ugaggaaacugaggcacagaug

SEQ ID NO: 729606 - RNA, 22 nt, Human
ucuuugcaucccuuccauaguu

SEQ ID NO: 729607 - RNA, 22 nt, Human
uagacauuuucucaacaucucu

SEQ ID NO: 729608 - RNA, 22 nt, Human
aaaguccuagcgauccacagaa

SEQ ID NO: 729609 - RNA, 22 nt, Human
agcuccagccucuucuggaggu

SEQ ID NO: 729610 - RNA, 22 nt, Human
agcugaccaaaugccuacaguu

SEQ ID NO: 729611 - RNA, 22 nt, Human
gaucaguguuuugugcauucuu

SEQ ID NO: 729612 - RNA, 19 nt, Human
aggcugcaagguggugggc

SEQ ID NO: 729613 - RNA, 22 nt, Human
uuaacaaggugacugcauuaaa

SEQ ID NO: 729614 - RNA, 22 nt, Human
aggcuggggaauugaauuugcu

SEQ ID NO: 729615 - RNA, 21 nt, Human
aggaggaacccguggcugggc

SEQ ID NO: 729616 - RNA, 22 nt, Human
uacuagcuaacauucucaccaa

SEQ ID NO: 729617 - RNA, 22 nt, Human
agcugcugaaugacacugcaag

SEQ ID NO: 729618 - RNA, 22 nt, Human
aggggagcuugaggcauggccu

SEQ ID NO: 729619 - RNA, 22 nt, Human
uucauuaguucugaagaugucu

SEQ ID NO: 729620 - RNA, 15 nt, Human
ugauuuccuacuaac

SEQ ID NO: 729621 - RNA, 22 nt, Human
ugaaggaaagagggaacauccc

SEQ ID NO: 729622 - RNA, 22 nt, Human
caggucucggguucagcaguga

SEQ ID NO: 729623 - RNA, 22 nt, Human
gucaggcauuuaggaugaguuc

SEQ ID NO: 729624 - RNA, 19 nt, Human
agagauccagcuucuagcu

SEQ ID NO: 729625 - RNA, 22 nt, Human
uggaggccagugaaaguagauu

SEQ ID NO: 729626 - RNA, 22 nt, Human
ucucauucauacccuacaugcu

SEQ ID NO: 729627 - RNA, 22 nt, Human
aacauucuucaaauaucacucu

SEQ ID NO: 729628 - RNA, 22 nt, Human
uacaguuuagaaccauagaugg

SEQ ID NO: 729629 - RNA, 22 nt, Human
agguggaguuaagugugaacug

SEQ ID NO: 729630 - RNA, 22 nt, Human
cuacugaugcuauacuucucag

SEQ ID NO: 729631 - RNA, 22 nt, Human
gccagaaacauacacaucacuu

SEQ ID NO: 729632 - RNA, 22 nt, Human
uaggcugacuuguuucauaaag

SEQ ID NO: 729633 - RNA, 22 nt, Human
ccugggcucugucagaauuggg

SEQ ID NO: 729634 - RNA, 22 nt, Human
cugggcagcacaucaucguauc

SEQ ID NO: 729635 - RNA, 22 nt, Human
gagccugagugcugccuccccu

SEQ ID NO: 729636 - RNA, 22 nt, Human
uacacuuuauggauccuacuuu

SEQ ID NO: 729637 - RNA, 22 nt, Human
ccuguggaccaggaggcagccc

SEQ ID NO: 729638 - RNA, 22 nt, Human
auugaggagcagagauggggua

SEQ ID NO: 729639 - RNA, 22 nt, Human
agauuggaucaagcagcaguug

SEQ ID NO: 729640 - RNA, 22 nt, Human
auuucaggagcaguuucagugg

SEQ ID NO: 729641 - RNA, 22 nt, Human
ugcagcaugccaaacgaggagg

SEQ ID NO: 729642 - RNA, 22 nt, Human
uauugcuuugugucauaagcaa

SEQ ID NO: 729643 - RNA, 22 nt, Human
aacaguguguacacaucauagg

SEQ ID NO: 729644 - RNA, 22 nt, Human
ucugcagguagagcucaggaau

SEQ ID NO: 729645 - RNA, 22 nt, Human
ucacuuauaaaaugcaagaucu

SEQ ID NO: 729646 - RNA, 22 nt, Human
uaggcuaggcugaagguuuugg

SEQ ID NO: 729647 - RNA, 22 nt, Human
agaauaaccaguguuucacagu

SEQ ID NO: 729648 - RNA, 22 nt, Human
cuuggcugucuauaggaaagag

SEQ ID NO: 729649 - RNA, 22 nt, Human
ucuuucauguauaugcaaccua

SEQ ID NO: 729650 - RNA, 22 nt, Human
ccacugaaggucaacauagagc

SEQ ID NO: 729651 - RNA, 22 nt, Human
uguaaacaaaugcauucuugcu

SEQ ID NO: 729652 - RNA, 22 nt, Human
guggcagucgcugacagauaca

SEQ ID NO: 729653 - RNA, 22 nt, Human
uaggaacuuagaugaacacaug

SEQ ID NO: 729654 - RNA, 22 nt, Human
ccaauacuuagauuaaaauagu

SEQ ID NO: 729655 - RNA, 22 nt, Human
cccaggcagugugugcaugcgu

SEQ ID NO: 729656 - RNA, 22 nt, Human
cuacacuuguucgacugcagga

SEQ ID NO: 729657 - RNA, 22 nt, Human
uuccaggacuggguguuugaag

SEQ ID NO: 729658 - RNA, 22 nt, Human
cuggccaauccauuaauuuguu

SEQ ID NO: 729659 - RNA, 21 nt, Human
uucaaaaugguguguuugucu

SEQ ID NO: 729660 - RNA, 22 nt, Human
uagaguauagcuaacuguauua

SEQ ID NO: 729661 - RNA, 22 nt, Human
guuucuuaaauguagcaggacc

SEQ ID NO: 729662 - RNA, 22 nt, Human
agucuucuuucauuuacucagu

SEQ ID NO: 729663 - RNA, 22 nt, Human
ccagggucuuggagaggagugc

SEQ ID NO: 729664 - RNA, 22 nt, Human
gugcugaaauggaccucaggaa

SEQ ID NO: 729665 - RNA, 22 nt, Human
uccaggacagaguagaagcagc

SEQ ID NO: 729666 - RNA, 22 nt, Human
uuucauucauuauacaguagag

SEQ ID NO: 729667 - RNA, 18 nt, Human
gacacaggagagaguccc

SEQ ID NO: 729668 - RNA, 21 nt, Human
gggcucaguggaaaagagugu

SEQ ID NO: 729669 - RNA, 22 nt, Human
gcagggacaaggcagguguucu

SEQ ID NO: 729670 - RNA, 22 nt, Human
cuuccugaaaguaguagguuga

SEQ ID NO: 729671 - RNA, 22 nt, Human
aacaugagcauucuugugcuug

SEQ ID NO: 729672 - RNA, 19 nt, Human
aggaaaggaucaaaauagc

SEQ ID NO: 729673 - RNA, 22 nt, Human
ucacugggcaucggagcugaaa

SEQ ID NO: 729674 - RNA, 19 nt, Human
ggcucuggcggcuguagcc

SEQ ID NO: 729675 - RNA, 22 nt, Human
uguuaguguaauuccaguuuuc

SEQ ID NO: 729676 - RNA, 22 nt, Human
caagccugucucaccagugcua

SEQ ID NO: 729677 - RNA, 22 nt, Human
ccucagaguaggucucagcugu

SEQ ID NO: 729678 - RNA, 22 nt, Human
gcuccugucaucaaacaauccu

SEQ ID NO: 729679 - RNA, 22 nt, Human
cauguaucuuaauugcuuugga

SEQ ID NO: 729680 - RNA, 22 nt, Human
ucccaucuccaacauuuuucuu

SEQ ID NO: 729681 - RNA, 22 nt, Human
guggcagauugcucaccauggu

SEQ ID NO: 729682 - RNA, 22 nt, Human
cacagcuagauggauagauaga

SEQ ID NO: 729683 - RNA, 22 nt, Human
ucuuuagagcucagaaauacag

SEQ ID NO: 729684 - RNA, 22 nt, Human
gagucuggcccugaugcaucau

SEQ ID NO: 729685 - RNA, 22 nt, Human
acugugagugauuuccuucugg

SEQ ID NO: 729686 - RNA, 22 nt, Human
agcugccugcauuuauauccug

SEQ ID NO: 729687 - RNA, 22 nt, Human
cucccaggacuggcucuaacug

SEQ ID NO: 729688 - RNA, 22 nt, Human
gcagggcagagggagaaucucu

SEQ ID NO: 729689 - RNA, 22 nt, Human
uaucagauuuagaggagucaua

SEQ ID NO: 729690 - RNA, 22 nt, Human
uauguguaaucaaacacaugcu

SEQ ID NO: 729691 - RNA, 22 nt, Human
ugggaagggucaacagcuggaa

SEQ ID NO: 729692 - RNA, 22 nt, Human
ggcagauggagaagcagcaggu

SEQ ID NO: 729693 - RNA, 22 nt, Human
augcucucuguccugcucagag

SEQ ID NO: 729694 - RNA, 22 nt, Human
uuucauugccuuuggaaggucu

SEQ ID NO: 729695 - RNA, 19 nt, Human
ccacacagugugcaauuua

SEQ ID NO: 729696 - RNA, 22 nt, Human
uuggccacaauccaagccuugg

SEQ ID NO: 729697 - RNA, 22 nt, Human
auugauucuguaagucaacaau

SEQ ID NO: 729698 - RNA, 22 nt, Human
cuuggagaaaggaaagggcuug

SEQ ID NO: 729699 - RNA, 22 nt, Human
auccaggcugcuuucuaugccc

SEQ ID NO: 729700 - RNA, 22 nt, Human
ucaaauaaggagucaugaccau

SEQ ID NO: 729701 - RNA, 22 nt, Human
ccacagugaaaucuugauggag

SEQ ID NO: 729702 - RNA, 17 nt, Human
ccugccugagccauagc

SEQ ID NO: 729703 - RNA, 22 nt, Human
uguacaguacauguguagugau

SEQ ID NO: 729704 - RNA, 22 nt, Human
ccuucaaucuuaagucagccca

SEQ ID NO: 729705 - RNA, 22 nt, Human
uacucaaacucacuaagacaga

SEQ ID NO: 729706 - RNA, 22 nt, Human
gaggccugaggcugccuggagc

SEQ ID NO: 729707 - RNA, 22 nt, Human
ucugggcccacucaacuucacu

SEQ ID NO: 729708 - RNA, 22 nt, Human
gcugcagcuuuaggauccagug

SEQ ID NO: 729709 - RNA, 22 nt, Human
aagacucuaucuuuagagauca

SEQ ID NO: 729710 - RNA, 22 nt, Human
uguguucuggaaagcucacuga

SEQ ID NO: 729711 - RNA, 18 nt, Human
ccuggcuuuucuacuugc

SEQ ID NO: 729712 - RNA, 22 nt, Human
uuacaguuagaaucugaugaaa

SEQ ID NO: 729713 - RNA, 22 nt, Human
aaaguaacaauaagguucuauu

SEQ ID NO: 729714 - RNA, 20 nt, Human
uuuaacuggccuucuggcuc

SEQ ID NO: 729715 - RNA, 22 nt, Human
uuauuccaccuccauuuuccua

SEQ ID NO: 729716 - RNA, 20 nt, Human
ccagaagguaggauggaaca

SEQ ID NO: 729717 - RNA, 22 nt, Human
gggcucaggaguuugaggcugc

SEQ ID NO: 729718 - RNA, 22 nt, Human
uuuucuaaaauauccaggacag

SEQ ID NO: 729719 - RNA, 22 nt, Human
acagcagugcacagagaacccu

SEQ ID NO: 729720 - RNA, 22 nt, Human
uuccugugaagaucugggugcu

SEQ ID NO: 729721 - RNA, 22 nt, Human
agcagcugagccccagcuguga

SEQ ID NO: 729722 - RNA, 20 nt, Human
cuggcuggaaacuuagccuu

SEQ ID NO: 729723 - RNA, 22 nt, Human
agcuuuccacuaucuuaggggu

SEQ ID NO: 729724 - RNA, 22 nt, Human
gcugccuucccggaaugucauc

SEQ ID NO: 729725 - RNA, 22 nt, Human
uagcagcucuuuacuaaccagu

SEQ ID NO: 729726 - RNA, 21 nt, Human
uaggcagaggagcagguaucu

SEQ ID NO: 729727 - RNA, 22 nt, Human
aaaugaguuugccucuagauag

SEQ ID NO: 729728 - RNA, 20 nt, Human
ucacagaaacaaauagagaa

SEQ ID NO: 729729 - RNA, 22 nt, Human
gcagcaagaauaauuuggguag

SEQ ID NO: 729730 - RNA, 22 nt, Human
ucauccaugugcaaacuuuggu

SEQ ID NO: 729731 - RNA, 22 nt, Human
ggugggccaggaaggccgccag

SEQ ID NO: 729732 - RNA, 22 nt, Human
accagcucucuagcccuggucc

SEQ ID NO: 729733 - RNA, 22 nt, Human
gacaggaggcagagcucaggug

SEQ ID NO: 729734 - RNA, 22 nt, Human
augggcugcuucuccagcaccu

SEQ ID NO: 729735 - RNA, 22 nt, Human
caggaggaggugagguagaacu

SEQ ID NO: 729736 - RNA, 22 nt, Human
gaucaaugguguaacuuguccu

SEQ ID NO: 729737 - RNA, 22 nt, Human
aagccaggaagggagcuguccc

SEQ ID NO: 729738 - RNA, 22 nt, Human
gcuggccugggcagccugucgg

SEQ ID NO: 729739 - RNA, 22 nt, Human
ggaugcugauuccagucuccag

SEQ ID NO: 729740 - RNA, 22 nt, Human
ccuggcuguggcggugcucuca

SEQ ID NO: 729741 - RNA, 22 nt, Human
cuuuuguugcccuugucgcagg

SEQ ID NO: 729742 - RNA, 22 nt, Human
ugaggcagaaauuccuguuuuc

SEQ ID NO: 729743 - RNA, 22 nt, Human
guucaguauuaaugagaugauu

SEQ ID NO: 729744 - RNA, 22 nt, Human
uguggaaaagaauaagggagau

SEQ ID NO: 729745 - RNA, 22 nt, Human
gccugugccucagccugcagcc

SEQ ID NO: 729746 - RNA, 20 nt, Human
ggcagcucuagucgaggccc

SEQ ID NO: 729747 - RNA, 22 nt, Human
uagggaggcuacuucuuguagg

SEQ ID NO: 729748 - RNA, 22 nt, Human
caggagcugggucuggaagcag

SEQ ID NO: 729749 - RNA, 22 nt, Human
cagagacauguggccugcacgu

SEQ ID NO: 729750 - RNA, 21 nt, Human
gcugggcuccagucugccgcu

SEQ ID NO: 729751 - RNA, 22 nt, Human
guacaguaaucccguucuucug

SEQ ID NO: 729752 - RNA, 22 nt, Human
ccucaggccagggggcggccag

SEQ ID NO: 729753 - RNA, 21 nt, Human
aaagauguuucaucugagaaa

SEQ ID NO: 729754 - RNA, 22 nt, Human
aucccgaaccucuacuucuuuc

SEQ ID NO: 729755 - RNA, 22 nt, Human
aaacucuggagauguuuaugca

SEQ ID NO: 729756 - RNA, 22 nt, Human
ggggugggcgugcagggacacc

SEQ ID NO: 729757 - RNA, 22 nt, Human
aggcucagcaucugauucauau

SEQ ID NO: 729758 - RNA, 22 nt, Human
auggagggugguaagacagaga

SEQ ID NO: 729759 - RNA, 22 nt, Human
ugucccagaucacaggagggga

SEQ ID NO: 729760 - RNA, 22 nt, Human
uccucugcucagcauuccucac

SEQ ID NO: 729761 - RNA, 22 nt, Human
aaagcugcaagcuccugaggaa

SEQ ID NO: 729762 - RNA, 19 nt, Human
gcugcucugggucucaucu

SEQ ID NO: 729763 - RNA, 22 nt, Human
guuucaaagggaagacgcugga

SEQ ID NO: 729764 - RNA, 22 nt, Human
cacuggcagauuugggaucugg

SEQ ID NO: 729765 - RNA, 22 nt, Human
acagcagcuggguucccaccau

SEQ ID NO: 729766 - RNA, 22 nt, Human
uccaggcuucacgucugcccuc

SEQ ID NO: 729767 - RNA, 22 nt, Human
cuggcuuucugaacaucaguga

SEQ ID NO: 729768 - RNA, 22 nt, Human
cugaggcugcccagggccaggu

SEQ ID NO: 729769 - RNA, 22 nt, Human
cacacagguauauauauguaca

SEQ ID NO: 729770 - RNA, 22 nt, Human
gaucacaguauuuuagaugugu

SEQ ID NO: 729771 - RNA, 22 nt, Human
auacagucagacuuuagccauu

SEQ ID NO: 729772 - RNA, 22 nt, Human
cugccaggcugucccagguccg

SEQ ID NO: 729773 - RNA, 22 nt, Human
agagcagcugugacauggacag

SEQ ID NO: 729774 - RNA, 22 nt, Human
aaaaaauuaucauaguuccuga

SEQ ID NO: 729775 - RNA, 22 nt, Human
aguaggcauuuaauaaacauga

SEQ ID NO: 729776 - RNA, 22 nt, Human
aacugcaaagccaaucucagga

SEQ ID NO: 729777 - RNA, 22 nt, Human
agcaaggcuucagagcugucug

SEQ ID NO: 729778 - RNA, 22 nt, Human
gcaagcagacauucagguaggu

SEQ ID NO: 729779 - RNA, 22 nt, Human
uauuugucacuagaaaggguaa

SEQ ID NO: 729780 - RNA, 18 nt, Human
ggacuacaggcacaggga

SEQ ID NO: 729781 - RNA, 22 nt, Human
agggcagcacaaggcauggacu

SEQ ID NO: 729782 - RNA, 22 nt, Human
agccacagucugaugccugaga

SEQ ID NO: 729783 - RNA, 22 nt, Human
agcagagucugugugcacuuua

SEQ ID NO: 729784 - RNA, 22 nt, Human
uacauacagagaugcuaguuaa

SEQ ID NO: 729785 - RNA, 22 nt, Human
ggagccuggucagguuggcucc

SEQ ID NO: 729786 - RNA, 22 nt, Human
auuacaauaagguuuauuugua

SEQ ID NO: 729787 - RNA, 22 nt, Human
gagggcagagacagugauucac

SEQ ID NO: 729788 - RNA, 22 nt, Human
agaaugcauuuuguguagcuau

SEQ ID NO: 729789 - RNA, 22 nt, Human
agaaaguuaaacagugauaaga

SEQ ID NO: 729790 - RNA, 22 nt, Human
ggcuuuacuauaugguacauuu

SEQ ID NO: 729791 - RNA, 22 nt, Human
uauugaggaucuccugcuaauu

SEQ ID NO: 729792 - RNA, 22 nt, Human
ccugcccaggagucucucugug

SEQ ID NO: 729793 - RNA, 22 nt, Human
aaaucagaguagaauugagcca

SEQ ID NO: 729794 - RNA, 21 nt, Human
aaugaugaaagaugacagagu

SEQ ID NO: 729795 - RNA, 22 nt, Human
ucucuuauuuugccuuugacaa

SEQ ID NO: 729796 - RNA, 19 nt, Human
aagcuuucccauuaacccc

SEQ ID NO: 729797 - RNA, 22 nt, Human
uuuaauuagcaagccagagagc

SEQ ID NO: 729798 - RNA, 22 nt, Human
ucuagguggaugaggaacauag

SEQ ID NO: 729799 - RNA, 22 nt, Human
gggcauggugcugguguucaug

SEQ ID NO: 729800 - RNA, 22 nt, Human
aaggcagaaagggaugugagug

SEQ ID NO: 729801 - RNA, 22 nt, Human
aucuucuggucaaauuuuugca

SEQ ID NO: 729802 - RNA, 22 nt, Human
acaugaaauucuagcugaaccc

SEQ ID NO: 729803 - RNA, 22 nt, Human
auacaaauuuauagaugcauuu

SEQ ID NO: 729804 - RNA, 19 nt, Human
acauauguggauauacaug

SEQ ID NO: 729805 - RNA, 22 nt, Human
ucuggagaccuagcccuguugu

SEQ ID NO: 729806 - RNA, 22 nt, Human
gacaugcaaugcagugguaagu

SEQ ID NO: 729807 - RNA, 22 nt, Human
agugugaccuuauuuggaaaca

SEQ ID NO: 729808 - RNA, 22 nt, Human
ucccugcagcaggugaucaaug

SEQ ID NO: 729809 - RNA, 22 nt, Human
gggcugagucaucuggggccuc

SEQ ID NO: 729810 - RNA, 22 nt, Human
gcugccaguguggcaugaugca

SEQ ID NO: 729811 - RNA, 22 nt, Human
uaaguuuggggaaaauguuaag

SEQ ID NO: 729812 - RNA, 22 nt, Human
agccagugggauuagagccucu

SEQ ID NO: 729813 - RNA, 22 nt, Human
gauccugucuccgcaccguguu

SEQ ID NO: 729814 - RNA, 22 nt, Human
acuucauuguaauauuauagca

SEQ ID NO: 729815 - RNA, 22 nt, Human
cucuccagucaggaacucugac

SEQ ID NO: 729816 - RNA, 22 nt, Human
ugccaggcagugucagauugag

SEQ ID NO: 729817 - RNA, 22 nt, Human
uggcaggaaccuuaaccacaaa

SEQ ID NO: 729818 - RNA, 22 nt, Human
gagcuuggggcauauggugcua

SEQ ID NO: 729819 - RNA, 22 nt, Human
acauugaucagccucccaugca

SEQ ID NO: 729820 - RNA, 22 nt, Human
uucugugugcuuacugguguuc

SEQ ID NO: 729821 - RNA, 22 nt, Human
gggcuucagcuggggauggagc

SEQ ID NO: 729822 - RNA, 22 nt, Human
gcagcaucaauccaugcuucuc

SEQ ID NO: 729823 - RNA, 22 nt, Human
ucagcuuuugucagaaauugua

SEQ ID NO: 729824 - RNA, 22 nt, Human
uuaaauuucuacgugauccagg

SEQ ID NO: 729825 - RNA, 22 nt, Human
uauggguaggccugccgccugu

SEQ ID NO: 729826 - RNA, 22 nt, Human
uaaggcaagagcagggucuuug

SEQ ID NO: 729827 - RNA, 22 nt, Human
uuccuagcuauaaagcucuucc

SEQ ID NO: 729828 - RNA, 22 nt, Human
uuccugaggugauucuaaugug

SEQ ID NO: 729829 - RNA, 22 nt, Human
uggcuggcuagaauggaaaugu

SEQ ID NO: 729830 - RNA, 22 nt, Human
gaaaggaaauauucuaagcacu

SEQ ID NO: 729831 - RNA, 22 nt, Human
ggccagguccaguggaaggccc

SEQ ID NO: 729832 - RNA, 22 nt, Human
cugccagagaucugggcagagu

SEQ ID NO: 729833 - RNA, 22 nt, Human
cuacaucaaguaaucuucaaaa

SEQ ID NO: 729834 - RNA, 22 nt, Human
caggaaauuuugugaucuguuc

SEQ ID NO: 729835 - RNA, 22 nt, Human
cagcccuccuuucacucccagg

SEQ ID NO: 729836 - RNA, 22 nt, Human
acugacuuuggaauauuucuag

SEQ ID NO: 729837 - RNA, 22 nt, Human
gucuucuguucugugaggcuuc

SEQ ID NO: 729838 - RNA, 22 nt, Human
aaucuugagggacucaugaggu

SEQ ID NO: 729839 - RNA, 22 nt, Human
gacuuuauaaaugagaggcgga

SEQ ID NO: 729840 - RNA, 22 nt, Human
uccuggacagauccccaucauc

SEQ ID NO: 729841 - RNA, 22 nt, Human
agcagcaauuuucacugucaau

SEQ ID NO: 729842 - RNA, 22 nt, Human
cucacaugauggccuuuuucau

SEQ ID NO: 729843 - RNA, 21 nt, Human
agaaacaugaucaaaggaacc

SEQ ID NO: 729844 - RNA, 22 nt, Human
caugcaaaugugcuaaucugaa

SEQ ID NO: 729845 - RNA, 22 nt, Human
aagaagcacuuuccuacauguu

SEQ ID NO: 729846 - RNA, 22 nt, Human
ucuggaaauaaaauuauaguug

SEQ ID NO: 729847 - RNA, 22 nt, Human
caggaaaugcuaucauagcuga

SEQ ID NO: 729848 - RNA, 18 nt, Human
auugucagaagucaugug

SEQ ID NO: 729849 - RNA, 22 nt, Human
cugucagcuucuccuggccaga

SEQ ID NO: 729850 - RNA, 23 nt, Human
ggacuaggcaacagaugggacag

SEQ ID NO: 729851 - RNA, 22 nt, Human
cuacaguagagaggauguagaa

SEQ ID NO: 729852 - RNA, 22 nt, Human
gcagcugcugggaucauuuagg

SEQ ID NO: 729853 - RNA, 22 nt, Human
uagagguagaguuacauuaguc

SEQ ID NO: 729854 - RNA, 21 nt, Human
agacugccaucuuugggccac

SEQ ID NO: 729855 - RNA, 22 nt, Human
gggcuccacgcacgcgagaggu

SEQ ID NO: 729856 - RNA, 22 nt, Human
cgggcuuccuccagggaagugc

SEQ ID NO: 729857 - RNA, 23 nt, Human
ucugggccacuugucugcacuuc

SEQ ID NO: 729858 - RNA, 22 nt, Human
uuuaaacauaucuguugaggga

SEQ ID NO: 729859 - RNA, 22 nt, Human
ggcugcggaucuaaggcuggga

SEQ ID NO: 729860 - RNA, 22 nt, Human
cagugagguggauggauggccu

SEQ ID NO: 729861 - RNA, 22 nt, Human
uggcuguggguggaaggaaacc

SEQ ID NO: 729862 - RNA, 22 nt, Human
auuugccuuacugaagaaggag

SEQ ID NO: 729863 - RNA, 22 nt, Human
aagaguuucuuacuggcaucua

SEQ ID NO: 729864 - RNA, 21 nt, Human
uacaugaagcugguguuuguc

SEQ ID NO: 729865 - RNA, 22 nt, Human
gggagcugguuccugcccucca

SEQ ID NO: 729866 - RNA, 22 nt, Human
cccugugcagauggcagcuggg

SEQ ID NO: 729867 - RNA, 22 nt, Human
gcaggcaguuauuuaguagaau

SEQ ID NO: 729868 - RNA, 22 nt, Human
ugcaugugugacaaggacaguu

SEQ ID NO: 729869 - RNA, 22 nt, Human
aaagaacaaaugauauaugguu

SEQ ID NO: 729870 - RNA, 22 nt, Human
uggagagccuucccggcaucgc

SEQ ID NO: 729871 - RNA, 22 nt, Human
ccuugggagaaauugcagaguc

SEQ ID NO: 729872 - RNA, 22 nt, Human
acugggcaaggauaugaugggu

SEQ ID NO: 729873 - RNA, 22 nt, Human
cacaugcaucacgacuuccuuu

SEQ ID NO: 729874 - RNA, 22 nt, Human
acagcagcauaaacugacuaag

SEQ ID NO: 729875 - RNA, 22 nt, Human
ucugcagaaaguggcucagugg

SEQ ID NO: 729876 - RNA, 22 nt, Human
ugagaugcuaaagggcugcuca

SEQ ID NO: 729877 - RNA, 22 nt, Human
agugcaaagcagccuguacacc

SEQ ID NO: 729878 - RNA, 22 nt, Human
uaacuucucugagccucauucc

SEQ ID NO: 729879 - RNA, 22 nt, Human
uuguuuauguguugucuauggc

SEQ ID NO: 729880 - RNA, 22 nt, Human
auacauagauagauaaucuggc

SEQ ID NO: 729881 - RNA, 23 nt, Human
uuucaacaggcagagaagacuua

SEQ ID NO: 729882 - RNA, 22 nt, Human
ugcagaagugagucaugaggaa

SEQ ID NO: 729883 - RNA, 22 nt, Human
uuccuauuuccaugaaacacaa

SEQ ID NO: 729884 - RNA, 22 nt, Human
uauaauuaguaaauggcagauu

SEQ ID NO: 729885 - RNA, 22 nt, Human
ugcagaccucccauggcugccu

SEQ ID NO: 729886 - RNA, 22 nt, Human
ugucuccucauacugucauauu

SEQ ID NO: 729887 - RNA, 22 nt, Human
uauguuauauuuugucaauugu

SEQ ID NO: 729888 - RNA, 22 nt, Human
agggggcaggagagaccugcug

SEQ ID NO: 729889 - RNA, 22 nt, Human
ucaggcagaugcagggauggau

SEQ ID NO: 729890 - RNA, 22 nt, Human
agcgugugccucgggguacacg

SEQ ID NO: 729891 - RNA, 17 nt, Human
cagcucugcagacuucc

SEQ ID NO: 729892 - RNA, 22 nt, Human
auacacaugcacacaugugugu

SEQ ID NO: 729893 - RNA, 22 nt, Human
gguguggaucaucugaggucag

SEQ ID NO: 729894 - RNA, 22 nt, Human
agugcuuuauguuguugugcaa

SEQ ID NO: 729895 - RNA, 22 nt, Human
aacgucuucucuccaaguaaau

SEQ ID NO: 729896 - RNA, 22 nt, Human
agcagggacugagccaguggga

SEQ ID NO: 729897 - RNA, 22 nt, Human
cucaggggaccuggcuccgagu

SEQ ID NO: 729898 - RNA, 22 nt, Human
aacaugcaugaagaaguuauau

SEQ ID NO: 729899 - RNA, 21 nt, Human
aggagcuguguuagcuggucg

SEQ ID NO: 729900 - RNA, 19 nt, Human
aaggcugguaccauagguu

SEQ ID NO: 729901 - RNA, 22 nt, Human
uaagcauuaacucugcugcaag

SEQ ID NO: 729902 - RNA, 23 nt, Human
ugcuggcuguguuauugccaaca

SEQ ID NO: 729903 - RNA, 22 nt, Human
ugggaccugaagcagguuggca

SEQ ID NO: 729904 - RNA, 22 nt, Human
agcaggagaacacuguggcucu

SEQ ID NO: 729905 - RNA, 22 nt, Human
ggaggagcugcugugggggccc

SEQ ID NO: 729906 - RNA, 22 nt, Human
ggucccagcugcucaagaggcu

SEQ ID NO: 729907 - RNA, 22 nt, Human
aggugcugggcagcagucauug

SEQ ID NO: 729908 - RNA, 22 nt, Human
aggauuuggccauggcuucggg

SEQ ID NO: 729909 - RNA, 22 nt, Human
uggagcagagaugguggccuuc

SEQ ID NO: 729910 - RNA, 22 nt, Human
caucauauauuucuacaagugc

SEQ ID NO: 729911 - RNA, 22 nt, Human
ucuaaucuacaaaaggaaauuc

SEQ ID NO: 729912 - RNA, 22 nt, Human
uaguccaguaaaacagcuaacg

SEQ ID NO: 729913 - RNA, 22 nt, Human
ccaucacaguccccaucgugau

SEQ ID NO: 729914 - RNA, 22 nt, Human
gagagagagcuaauauuaagcu

SEQ ID NO: 729915 - RNA, 22 nt, Human
uaagaauagucccuagaugugu

SEQ ID NO: 729916 - RNA, 22 nt, Human
gcagcuccuccugggcuggaga

SEQ ID NO: 729917 - RNA, 20 nt, Human
ugccagggccagcagaggcu

SEQ ID NO: 729918 - RNA, 22 nt, Human
gagcugagaucgugccauugca

SEQ ID NO: 729919 - RNA, 21 nt, Human
gucagagaugcccaacugccu

SEQ ID NO: 729920 - RNA, 22 nt, Human
cugaauaauauuccauuaugag

SEQ ID NO: 729921 - RNA, 22 nt, Human
gggcugagcuguucugaguuua

SEQ ID NO: 729922 - RNA, 22 nt, Human
gugggcagguaggcaccagcua

SEQ ID NO: 729923 - RNA, 22 nt, Human
uaagacacgggcugaucuaaag

SEQ ID NO: 729924 - RNA, 22 nt, Human
caucugugccggguguuuguca

SEQ ID NO: 729925 - RNA, 22 nt, Human
aggaaaaugaaacagcaacugu

SEQ ID NO: 729926 - RNA, 22 nt, Human
uuuaguguaauucugccuuuug

SEQ ID NO: 729927 - RNA, 18 nt, Human
gugggguguugugaggau

SEQ ID NO: 729928 - RNA, 22 nt, Human
uuuagcauuaagcuuuucaaau

SEQ ID NO: 729929 - RNA, 21 nt, Human
ucacugugcaaauguugaugg

SEQ ID NO: 729930 - RNA, 20 nt, Human
auacaguaggugcucaauau

SEQ ID NO: 729931 - RNA, 22 nt, Human
ggacccuggagacccacuggga

SEQ ID NO: 729932 - RNA, 22 nt, Human
ucauugaguucaaauccuucau

SEQ ID NO: 729933 - RNA, 22 nt, Human
ucuuuagaaacuuuucuucaug

SEQ ID NO: 729934 - RNA, 22 nt, Human
uccaaagccgacugacaucuga

SEQ ID NO: 729935 - RNA, 22 nt, Human
gcccaggaagugacucagaugu

SEQ ID NO: 729936 - RNA, 22 nt, Human
aagccgggccugagaaaugaca

SEQ ID NO: 729937 - RNA, 22 nt, Human
gccacagcccgagcaccaugag

SEQ ID NO: 729938 - RNA, 22 nt, Human
acaggcugguuuguaaaagaug

SEQ ID NO: 729939 - RNA, 22 nt, Human
ggccucuguucugcauuccucc

SEQ ID NO: 729940 - RNA, 22 nt, Human
cucuccagaucugcugagccag

SEQ ID NO: 729941 - RNA, 22 nt, Human
cagcccagccuugucucuuuau

SEQ ID NO: 729942 - RNA, 22 nt, Human
aaccaugucuuguuuuccuagu

SEQ ID NO: 729943 - RNA, 22 nt, Human
aguguuuauuagauuucccuuu

SEQ ID NO: 729944 - RNA, 22 nt, Human
ggaaggaagaggaccgagcugg

SEQ ID NO: 729945 - RNA, 22 nt, Human
uuggcugagagaggaaaagggc

SEQ ID NO: 729946 - RNA, 22 nt, Human
caaacauuuugagugguuucug

SEQ ID NO: 729947 - RNA, 22 nt, Human
ucugcauggagaggagaugcua

SEQ ID NO: 729948 - RNA, 22 nt, Human
ucccuagucgcaucuguggaga

SEQ ID NO: 729949 - RNA, 22 nt, Human
ccaaaauuaagccucuuauguu

SEQ ID NO: 729950 - RNA, 22 nt, Human
caggccagcagggccuccgugg

SEQ ID NO: 729951 - RNA, 22 nt, Human
cugcugggauagaaguaucuca

SEQ ID NO: 729952 - RNA, 22 nt, Human
aggagcucuugaugcuugaggg

SEQ ID NO: 729953 - RNA, 22 nt, Human
ccuggcagacugugagggcagg

SEQ ID NO: 729954 - RNA, 23 nt, Human
ugccuauucagcagagugauagc

SEQ ID NO: 729955 - RNA, 22 nt, Human
aggcacugaagugguaaaugua

SEQ ID NO: 729956 - RNA, 22 nt, Human
cauucugggucuggcucaggga

SEQ ID NO: 729957 - RNA, 22 nt, Human
ucaguaucaggcuggaauuaag

SEQ ID NO: 729958 - RNA, 22 nt, Human
acacacugcucgcucagauuaa

SEQ ID NO: 729959 - RNA, 22 nt, Human
gauuuguggugugaggaagagc

SEQ ID NO: 729960 - RNA, 22 nt, Human
aaauaaguuaaacuagaaugau

SEQ ID NO: 729961 - RNA, 22 nt, Human
ugacaugcuuguuuuccuugaa

SEQ ID NO: 729962 - RNA, 22 nt, Human
ugcugggugguugcuccucccg

SEQ ID NO: 729963 - RNA, 22 nt, Human
gagaaggaguagcugaccuggg

SEQ ID NO: 729964 - RNA, 22 nt, Human
uuuucuuauggugaagcacaaa

SEQ ID NO: 729965 - RNA, 17 nt, Human
uuccuggaagucauucc

SEQ ID NO: 729966 - RNA, 22 nt, Human
aaggcaggaugcggacccaucu

SEQ ID NO: 729967 - RNA, 22 nt, Human
auguucuuagcaaaguacuugc

SEQ ID NO: 729968 - RNA, 22 nt, Human
ggcuggaagagacugaggacac

SEQ ID NO: 729969 - RNA, 22 nt, Human
uuucccaauugagagguucugu

SEQ ID NO: 729970 - RNA, 22 nt, Human
uccaagaucuacagcaguuuag

SEQ ID NO: 729971 - RNA, 22 nt, Human
uuucucaacagaguaugcccuu

SEQ ID NO: 729972 - RNA, 22 nt, Human
cucuggguccuggggcuacaag

SEQ ID NO: 729973 - RNA, 22 nt, Human
uaaguggaagguuauaugcuaa

SEQ ID NO: 729974 - RNA, 22 nt, Human
cuggcuguuucaggcagugucc

SEQ ID NO: 729975 - RNA, 22 nt, Human
ucagggcagguuaacuugggug

SEQ ID NO: 729976 - RNA, 17 nt, Human
cccguucucuucgcugg

SEQ ID NO: 729977 - RNA, 22 nt, Human
agccugugugaagcccucagag

SEQ ID NO: 729978 - RNA, 22 nt, Human
auauucauugaacaccuacuac

SEQ ID NO: 729979 - RNA, 22 nt, Human
cagagccccucagcucucuccc

SEQ ID NO: 729980 - RNA, 22 nt, Human
caugcagugccucuggauucuu

SEQ ID NO: 729981 - RNA, 22 nt, Human
acaaugcucauauuuaugccaa

SEQ ID NO: 729982 - RNA, 22 nt, Human
cagccccagcacuuagcugagu

SEQ ID NO: 729983 - RNA, 22 nt, Human
ugcucauugcugauuuacaugu

SEQ ID NO: 729984 - RNA, 22 nt, Human
ucuuuucuucuuaaugguuaau

SEQ ID NO: 729985 - RNA, 22 nt, Human
uccuggaggcaaaugaagacuc

SEQ ID NO: 729986 - RNA, 22 nt, Human
ggaggaggggugacugaaugcu

SEQ ID NO: 729987 - RNA, 21 nt, Human
gccuguguaaauugaguuucc

SEQ ID NO: 729988 - RNA, 22 nt, Human
gacauuuagaaguuagauucaa

SEQ ID NO: 729989 - RNA, 22 nt, Human
aggaaaaaagucugugauuaua

SEQ ID NO: 729990 - RNA, 18 nt, Human
gcugagguggugucagag

SEQ ID NO: 729991 - RNA, 22 nt, Human
gcauugauucugaagugaaaug

SEQ ID NO: 729992 - RNA, 20 nt, Human
ugagugauggaggcggguca

SEQ ID NO: 729993 - RNA, 22 nt, Human
ggcaccagggcaagggucuuuc

SEQ ID NO: 729994 - RNA, 22 nt, Human
gacaggcuucauccucagaguu

SEQ ID NO: 729995 - RNA, 23 nt, Human
ugcagguagggcccagcagucuu

SEQ ID NO: 729996 - RNA, 22 nt, Human
aaaucagacacagugaaaguua

SEQ ID NO: 729997 - RNA, 22 nt, Human
cauacauugcucauucaguauc

SEQ ID NO: 729998 - RNA, 19 nt, Human
auggcugcugauuggggau

SEQ ID NO: 729999 - RNA, 22 nt, Human
agagguaugugucagugcuuau

SEQ ID NO: 730000 - RNA, 22 nt, Human
cuagucacgucuuucaguuacc

SEQ ID NO: 730001 - RNA, 21 nt, Human
acacaagcacucguacauacg

SEQ ID NO: 730002 - RNA, 17 nt, Human
cguggcugagccauaga

SEQ ID NO: 730003 - RNA, 22 nt, Human
agagaugaaaaguggagacugg

SEQ ID NO: 730004 - RNA, 22 nt, Human
guggugaagcauugagaaguca

SEQ ID NO: 730005 - RNA, 22 nt, Human
gggagcugaggagccccgucgg

SEQ ID NO: 730006 - RNA, 22 nt, Human
ucuggagggguuuagagggaca

SEQ ID NO: 730007 - RNA, 22 nt, Human
gaugguggcaagagccaagucu

SEQ ID NO: 730008 - RNA, 22 nt, Human
cuguaugaguugggaauagaau

SEQ ID NO: 730009 - RNA, 19 nt, Human
gccugggaugggcagaacu

SEQ ID NO: 730010 - RNA, 22 nt, Human
uggcucagccauucguguugcc

SEQ ID NO: 730011 - RNA, 18 nt, Human
ucuggcucaggacugaac

SEQ ID NO: 730012 - RNA, 22 nt, Human
ucaacaaauacuuaaagcagag

SEQ ID NO: 730013 - RNA, 22 nt, Human
ugcggagggagcagucggcugu

SEQ ID NO: 730014 - RNA, 22 nt, Human
guccugugggcccaccaugagc

SEQ ID NO: 730015 - RNA, 22 nt, Human
uaaauguacugaggcaacagga

SEQ ID NO: 730016 - RNA, 21 nt, Human
gccacguuucagucuucucag

SEQ ID NO: 730017 - RNA, 22 nt, Human
gggacaauggaggccucucucc

SEQ ID NO: 730018 - RNA, 22 nt, Human
uuuccaauaaagugucauuguu

SEQ ID NO: 730019 - RNA, 22 nt, Human
ugagucagucugcccuggcuuc

SEQ ID NO: 730020 - RNA, 22 nt, Human
aguuacaaccaugacacaagca

SEQ ID NO: 730021 - RNA, 22 nt, Human
guauuuuauggcaugcaguggc

SEQ ID NO: 730022 - RNA, 22 nt, Human
gcacagcagcugggggcccugg

SEQ ID NO: 730023 - RNA, 22 nt, Human
ugccuuuacugauuagcugugu

SEQ ID NO: 730024 - RNA, 22 nt, Human
agccaggguuagaagauaguca

SEQ ID NO: 730025 - RNA, 22 nt, Human
ugacucuuaaauauacuguuga

SEQ ID NO: 730026 - RNA, 22 nt, Human
agucucuuuguggacucugccu

SEQ ID NO: 730027 - RNA, 22 nt, Human
ucugggagccugaaagugaaug

SEQ ID NO: 730028 - RNA, 22 nt, Human
uuauuaugccauuaccucccug

SEQ ID NO: 730029 - RNA, 22 nt, Human
augagcugugggauuccagagg

SEQ ID NO: 730030 - RNA, 22 nt, Human
uguuuaaauagaacauacugca

SEQ ID NO: 730031 - RNA, 20 nt, Human
aagagucuuuacugagcuaa

SEQ ID NO: 730032 - RNA, 22 nt, Human
aaaaacugcaauuacuuuuguc

SEQ ID NO: 730033 - RNA, 22 nt, Human
acacagggggcauucuaggagu

SEQ ID NO: 730034 - RNA, 22 nt, Human
gaagcaauguguuuucaacauu

SEQ ID NO: 730035 - RNA, 23 nt, Human
aaucuauacuuaggcugguaaua

SEQ ID NO: 730036 - RNA, 22 nt, Human
gcucagaggaugcuccuuuaug

SEQ ID NO: 730037 - RNA, 22 nt, Human
aggaagccuggcauuaaaaagc

SEQ ID NO: 730038 - RNA, 22 nt, Human
gggaugcagacuacagggcuua

SEQ ID NO: 730039 - RNA, 22 nt, Human
aagacagcagcaccucucguuu

SEQ ID NO: 730040 - RNA, 22 nt, Human
aagcuuccugaaugcucauuua

SEQ ID NO: 730041 - RNA, 20 nt, Human
auuguuucauuuaauguaca

SEQ ID NO: 730042 - RNA, 22 nt, Human
ggggccacuggcaggaccuugg

SEQ ID NO: 730043 - RNA, 22 nt, Human
uccuggccgccgcguggggccg

SEQ ID NO: 730044 - RNA, 22 nt, Human
uucacaagucauuagcugcaua

SEQ ID NO: 730045 - RNA, 22 nt, Human
ggucuccagcugggacccugca

SEQ ID NO: 730046 - RNA, 22 nt, Human
acagaagcagcgcggcucuucu

SEQ ID NO: 730047 - RNA, 23 nt, Human
acucucagguucuuuccagcagg

SEQ ID NO: 730048 - RNA, 22 nt, Human
auagaagauagcuuuuguuucu

SEQ ID NO: 730049 - RNA, 22 nt, Human
uaacacuguaaaccuagauguu

SEQ ID NO: 730050 - RNA, 22 nt, Human
gugcccaggugucccugagaag

SEQ ID NO: 730051 - RNA, 22 nt, Human
ugccaggcauauggccucuuug

SEQ ID NO: 730052 - RNA, 22 nt, Human
aggcccagcugggccaggaaca

SEQ ID NO: 730053 - RNA, 22 nt, Human
uggcauccucccucaagcugaa

SEQ ID NO: 730054 - RNA, 22 nt, Human
gaaauguagaauugcuuaacug

SEQ ID NO: 730055 - RNA, 22 nt, Human
uggaugagauuaaagugagguu

SEQ ID NO: 730056 - RNA, 22 nt, Human
ugguuuauuucucugaaagguu

SEQ ID NO: 730057 - RNA, 22 nt, Human
cgcccuccacacagccccuggc

SEQ ID NO: 730058 - RNA, 22 nt, Human
ucacaugccuuuuacucugcac

SEQ ID NO: 730059 - RNA, 22 nt, Human
agauauuaccagcagucuaugc

SEQ ID NO: 730060 - RNA, 23 nt, Human
aaacaugcagcacaugaaugcua

SEQ ID NO: 730061 - RNA, 22 nt, Human
agugaacaguuuggaacacaug

SEQ ID NO: 730062 - RNA, 22 nt, Human
acaauuacucaacuuugcugcu

SEQ ID NO: 730063 - RNA, 22 nt, Human
auuuaaaugcuuaagaggguuu

SEQ ID NO: 730064 - RNA, 22 nt, Human
ucucagcucagcuuccacagag

SEQ ID NO: 730065 - RNA, 22 nt, Human
acaggaaccaggcaggucgauu

SEQ ID NO: 730066 - RNA, 22 nt, Human
aguacacuggcaaauguggugg

SEQ ID NO: 730067 - RNA, 22 nt, Human
cuugcaggcagggccuccugga

SEQ ID NO: 730068 - RNA, 22 nt, Human
gcuuuagacauaaaguucuuca

SEQ ID NO: 730069 - RNA, 22 nt, Human
acacugugcaugcauauacaca

SEQ ID NO: 730070 - RNA, 22 nt, Human
cauggccucaaaggacugcaga

SEQ ID NO: 730071 - RNA, 22 nt, Human
aaaauguaugauggaggugcua

SEQ ID NO: 730072 - RNA, 22 nt, Human
agaagggagagaaaguugguua

SEQ ID NO: 730073 - RNA, 22 nt, Human
ccacucccuuccgguccagggc

SEQ ID NO: 730074 - RNA, 23 nt, Human
uggacagcagcagcagugucacc

SEQ ID NO: 730075 - RNA, 20 nt, Human
caguagcaauaauuagaagc

SEQ ID NO: 730076 - RNA, 22 nt, Human
uugcagaggcaaaaaugaacuc

SEQ ID NO: 730077 - RNA, 22 nt, Human
cagcacagcuggcucuggaagc

SEQ ID NO: 730078 - RNA, 22 nt, Human
ccugcuggccaguggagggcug

SEQ ID NO: 730079 - RNA, 22 nt, Human
gcaggucuggagggcacugggg

SEQ ID NO: 730080 - RNA, 22 nt, Human
ucagagaacuccacaccuuagg

SEQ ID NO: 730081 - RNA, 20 nt, Human
ucuggcaggugaacgagcug

SEQ ID NO: 730082 - RNA, 22 nt, Human
aguucuuauugaauagaaauca

SEQ ID NO: 730083 - RNA, 22 nt, Human
agggcgaggagacggaggcaca

SEQ ID NO: 730084 - RNA, 22 nt, Human
uuaagugcaaaaaugaaaguau

SEQ ID NO: 730085 - RNA, 22 nt, Human
caaugauguuuagauaaaaucc

SEQ ID NO: 730086 - RNA, 22 nt, Human
auagaacuccaucccucugacc

SEQ ID NO: 730087 - RNA, 22 nt, Human
aucaaagugauuuguaaacagg

SEQ ID NO: 730088 - RNA, 22 nt, Human
uuucuuuaggcuguguugccaa

SEQ ID NO: 730089 - RNA, 22 nt, Human
caugugugaaucuugugaucau

SEQ ID NO: 730090 - RNA, 22 nt, Human
acagcuuuuaugggaccagcca

SEQ ID NO: 730091 - RNA, 22 nt, Human
uucauugacugguucguuaagu

SEQ ID NO: 730092 - RNA, 22 nt, Human
cuguccagaaagggggcaacaa

SEQ ID NO: 730093 - RNA, 22 nt, Human
aaaucccugauaauguaggucu

SEQ ID NO: 730094 - RNA, 22 nt, Human
gacaguccuugcccaguaucua

SEQ ID NO: 730095 - RNA, 22 nt, Human
aaagguuuuuauuuauccugga

SEQ ID NO: 730096 - RNA, 22 nt, Human
gucauuuugcugcauauuuaga

SEQ ID NO: 730097 - RNA, 21 nt, Human
cccaggaggagcuccggcucc

SEQ ID NO: 730098 - RNA, 22 nt, Human
cugaggcucaagggcagguggg

SEQ ID NO: 730099 - RNA, 22 nt, Human
cuggcucuaucuccaaggcugg

SEQ ID NO: 730100 - RNA, 23 nt, Human
aggaggaaaaguuaucugcugag

SEQ ID NO: 730101 - RNA, 22 nt, Human
acaggcuuacuguuucauaggg

SEQ ID NO: 730102 - RNA, 22 nt, Human
uuuucuauuaacucauuuugca

SEQ ID NO: 730103 - RNA, 22 nt, Human
cccaauggcuggauggagggau

SEQ ID NO: 730104 - RNA, 23 nt, Human
agucugaauugagaugugcugug

SEQ ID NO: 730105 - RNA, 22 nt, Human
cucccucaggccuuagcccugc

SEQ ID NO: 730106 - RNA, 22 nt, Human
ucuguguauaggguugugcgcu

SEQ ID NO: 730107 - RNA, 22 nt, Human
augugcuugcagaugagccuca

SEQ ID NO: 730108 - RNA, 22 nt, Human
guuauucuaccacuauguacag

SEQ ID NO: 730109 - RNA, 22 nt, Human
gauucacaacugcccugaaggg

SEQ ID NO: 730110 - RNA, 22 nt, Human
gaggcacugaauacuugagggu

SEQ ID NO: 730111 - RNA, 22 nt, Human
gcccuccaccagagcccuucuc

SEQ ID NO: 730112 - RNA, 22 nt, Human
ucuggccaggauggcaagacca

SEQ ID NO: 730113 - RNA, 22 nt, Human
gagccuccuccuggugugccga

SEQ ID NO: 730114 - RNA, 22 nt, Human
aggcuucaaggacagcagccac

SEQ ID NO: 730115 - RNA, 22 nt, Human
gacuggauauugaguacugcaa

SEQ ID NO: 730116 - RNA, 22 nt, Human
gacagacauuuccugauccaau

SEQ ID NO: 730117 - RNA, 22 nt, Human
cuggugggaagauggaaaacau

SEQ ID NO: 730118 - RNA, 22 nt, Human
aaucuagucuccuuaagucuuu

SEQ ID NO: 730119 - RNA, 22 nt, Human
cucaggaaaauauugaagaagu

SEQ ID NO: 730120 - RNA, 22 nt, Human
agggaggugguuccccagugga

SEQ ID NO: 730121 - RNA, 22 nt, Human
aagcagcuuucuuuccugugaa

SEQ ID NO: 730122 - RNA, 22 nt, Human
cugcucugcagcuuggacuccc

SEQ ID NO: 730123 - RNA, 22 nt, Human
aagggccauaacuugcaguguu

SEQ ID NO: 730124 - RNA, 22 nt, Human
uuaaagucuauguacuacacuu

SEQ ID NO: 730125 - RNA, 22 nt, Human
cugcauccuaaccuccaugcag

SEQ ID NO: 730126 - RNA, 21 nt, Human
ugcuugucaugaaugggccag

SEQ ID NO: 730127 - RNA, 22 nt, Human
ccaagagguaucuugccauaaa

SEQ ID NO: 730128 - RNA, 22 nt, Human
uugauucagagaagauuggccc

SEQ ID NO: 730129 - RNA, 22 nt, Human
aaaagagagcugaggagcucca

SEQ ID NO: 730130 - RNA, 22 nt, Human
uucuugggugugaccagucuga

SEQ ID NO: 730131 - RNA, 22 nt, Human
uuaaaagagacuuccuuuguuu

SEQ ID NO: 730132 - RNA, 21 nt, Human
uuuaauuugcauguaugacgc

SEQ ID NO: 730133 - RNA, 22 nt, Human
gaagugaugacgcuguguuuuu

SEQ ID NO: 730134 - RNA, 22 nt, Human
aagcugccaccagcccagggca

SEQ ID NO: 730135 - RNA, 22 nt, Human
gcagagcccuggggguauggug

SEQ ID NO: 730136 - RNA, 22 nt, Human
aucacuguguauguauaugcag

SEQ ID NO: 730137 - RNA, 19 nt, Human
cuccaggauggcugggcga

SEQ ID NO: 730138 - RNA, 22 nt, Human
gacuuucucuccucccaggugu

SEQ ID NO: 730139 - RNA, 22 nt, Human
cuguuauuugcuggaagaguuu

SEQ ID NO: 730140 - RNA, 22 nt, Human
acaugcacagcaagggugagag

SEQ ID NO: 730141 - RNA, 22 nt, Human
guggccagaagacugcaaugcu

SEQ ID NO: 730142 - RNA, 22 nt, Human
gcccugcucuggucucugcccg

SEQ ID NO: 730143 - RNA, 22 nt, Human
uacccagcuccucagaagacca

SEQ ID NO: 730144 - RNA, 22 nt, Human
accaagcuguauauuauugguu

SEQ ID NO: 730145 - RNA, 22 nt, Human
ccuggggauucugacacggagu

SEQ ID NO: 730146 - RNA, 22 nt, Human
ccagcuguuggaguuucacugc

SEQ ID NO: 730147 - RNA, 23 nt, Human
aacagccaacuuuagcggguggc

SEQ ID NO: 730148 - RNA, 22 nt, Human
uuacuaguauaugucaagcaac

SEQ ID NO: 730149 - RNA, 22 nt, Human
cuucuccuuauaugucccguuc

SEQ ID NO: 730150 - RNA, 21 nt, Human
uagggcucucugugucaggug

SEQ ID NO: 730151 - RNA, 22 nt, Human
uugcagcagggugaauucacuc

SEQ ID NO: 730152 - RNA, 22 nt, Human
ccagagcuucggggcggcugua

SEQ ID NO: 730153 - RNA, 22 nt, Human
augacaaacccaggauguaaca

SEQ ID NO: 730154 - RNA, 20 nt, Human
agugucuggugcagggccuc

SEQ ID NO: 730155 - RNA, 22 nt, Human
cagggcugaaaucaagguguag

SEQ ID NO: 730156 - RNA, 23 nt, Human
uucuuacaaggcuggcccacuug

SEQ ID NO: 730157 - RNA, 22 nt, Human
guagggacuuguuuuacuagua

SEQ ID NO: 730158 - RNA, 22 nt, Human
aggcuuuacugccucaggacuc

SEQ ID NO: 730159 - RNA, 22 nt, Human
uucugggcuuggcuguuuccau

SEQ ID NO: 730160 - RNA, 22 nt, Human
auuagugucugugaauaauucu

SEQ ID NO: 730161 - RNA, 22 nt, Human
gcuggaggaucacuugagccca

SEQ ID NO: 730162 - RNA, 22 nt, Human
ggccugcuauuggugggcagac

SEQ ID NO: 730163 - RNA, 22 nt, Human
acacagaugcuauuuagucucu

SEQ ID NO: 730164 - RNA, 22 nt, Human
gguucacacuuucaugauuuca

SEQ ID NO: 730165 - RNA, 22 nt, Human
ggucagcaauuuggacugggcu

SEQ ID NO: 730166 - RNA, 22 nt, Human
gccaggcucuugguuauguuuu

SEQ ID NO: 730167 - RNA, 22 nt, Human
auaugcaugcaugcuugugaga

SEQ ID NO: 730168 - RNA, 22 nt, Human
agagugaaguuuuugaaaguga

SEQ ID NO: 730169 - RNA, 22 nt, Human
auggcugcaucauccugguuga

SEQ ID NO: 730170 - RNA, 22 nt, Human
gaggucaggggagaggcugaug

SEQ ID NO: 730171 - RNA, 19 nt, Human
ggcccaaguacugagugcc

SEQ ID NO: 730172 - RNA, 21 nt, Human
ugcucacagaugugcucagug

SEQ ID NO: 730173 - RNA, 22 nt, Human
uuaagaaugugccuuuugguug

SEQ ID NO: 730174 - RNA, 22 nt, Human
uggcacagagggacccagcagc

SEQ ID NO: 730175 - RNA, 22 nt, Human
uuauuugcccauguuuagcaga

SEQ ID NO: 730176 - RNA, 22 nt, Human
uucugcaggaugcucugguggu

SEQ ID NO: 730177 - RNA, 22 nt, Human
caaggaaacaugaaaugcauug

SEQ ID NO: 730178 - RNA, 22 nt, Human
aagaacauuuaugauggcauuu

SEQ ID NO: 730179 - RNA, 22 nt, Human
auccugggcugcacccucagcc

SEQ ID NO: 730180 - RNA, 23 nt, Human
agaucacaugcugauggaaaaug

SEQ ID NO: 730181 - RNA, 22 nt, Human
caaaugauccuugcaagcugug

SEQ ID NO: 730182 - RNA, 22 nt, Human
gagaugggcgagaagguggacu

SEQ ID NO: 730183 - RNA, 22 nt, Human
uaguauaucuuuaguacauagu

SEQ ID NO: 730184 - RNA, 23 nt, Human
ucagagaaugguaugcuuuuccu

SEQ ID NO: 730185 - RNA, 22 nt, Human
cugcauaugauagaugccuugc

SEQ ID NO: 730186 - RNA, 22 nt, Human
uccagcuuauagguagauuuaa

SEQ ID NO: 730187 - RNA, 21 nt, Human
uuuauuuauauaggacacaug

SEQ ID NO: 730188 - RNA, 22 nt, Human
aaaugcacagaggccagagagg

SEQ ID NO: 730189 - RNA, 22 nt, Human
uuuauccauucaccaguugaac

SEQ ID NO: 730190 - RNA, 22 nt, Human
augaaaacuuuagccucauuag

SEQ ID NO: 730191 - RNA, 22 nt, Human
gagccccagcccugcuucuaua

SEQ ID NO: 730192 - RNA, 22 nt, Human
uugccugggcuaguaagccaga

SEQ ID NO: 730193 - RNA, 22 nt, Human
uugagggaacaugagaaucauc

SEQ ID NO: 730194 - RNA, 22 nt, Human
aagauauacuauuaaguaccau

SEQ ID NO: 730195 - RNA, 22 nt, Human
uggcccugucccuggagccugg

SEQ ID NO: 730196 - RNA, 22 nt, Human
ggagggggaaacuuuggcugcc

SEQ ID NO: 730197 - RNA, 22 nt, Human
ccaacagguugagagucugaau

SEQ ID NO: 730198 - RNA, 22 nt, Human
ccagaugggccagggguuuguu

SEQ ID NO: 730199 - RNA, 22 nt, Human
ugggccuccuggaagaaugugg

SEQ ID NO: 730200 - RNA, 22 nt, Human
uggcuggggccugaauccugca

SEQ ID NO: 730201 - RNA, 22 nt, Human
ucuggagagaucuuccacaaca

SEQ ID NO: 730202 - RNA, 22 nt, Human
aguugcugcuucucucuagaga

SEQ ID NO: 730203 - RNA, 22 nt, Human
gggaggcuggcucuggccacag

SEQ ID NO: 730204 - RNA, 22 nt, Human
auguauuuugccagacugucuc

SEQ ID NO: 730205 - RNA, 22 nt, Human
auuucucacugagcagauaaaa

SEQ ID NO: 730206 - RNA, 22 nt, Human
ugagcuguagcagaugcuguug

SEQ ID NO: 730207 - RNA, 22 nt, Human
aacagcauauuucauauauuga

SEQ ID NO: 730208 - RNA, 22 nt, Human
cuggagucuccccaggagcgug

SEQ ID NO: 730209 - RNA, 22 nt, Human
aguuugauuguauggguuuuaa

SEQ ID NO: 730210 - RNA, 22 nt, Human
uccaggagcucauccacgucaa

SEQ ID NO: 730211 - RNA, 22 nt, Human
caccugccugcaggggcuccac

SEQ ID NO: 730212 - RNA, 18 nt, Human
ugcaugcuuuuguuucca

SEQ ID NO: 730213 - RNA, 22 nt, Human
gagcugaguaugaaggauguga

SEQ ID NO: 730214 - RNA, 22 nt, Human
agcagcucuuaacaaagcaugg

SEQ ID NO: 730215 - RNA, 22 nt, Human
ugggagaguuuguuuagaguga

SEQ ID NO: 730216 - RNA, 22 nt, Human
ggccaguccccuaauccagggc

SEQ ID NO: 730217 - RNA, 22 nt, Human
uagaaaagauaacauucugugc

SEQ ID NO: 730218 - RNA, 22 nt, Human
uugggagcaaauaggaaagagg

SEQ ID NO: 730219 - RNA, 22 nt, Human
aguccagccuucaaucuuagug

SEQ ID NO: 730220 - RNA, 22 nt, Human
uuugacagauccuuaacucagc

SEQ ID NO: 730221 - RNA, 18 nt, Human
ggcuccaggaccuaccca

SEQ ID NO: 730222 - RNA, 22 nt, Human
cuaguaaagcuaugauucugcc

SEQ ID NO: 730223 - RNA, 22 nt, Human
ccuggcuucucugcauuguucu

SEQ ID NO: 730224 - RNA, 22 nt, Human
gggcgccgugggaaacagccgg

SEQ ID NO: 730225 - RNA, 22 nt, Human
ggguccagcuacaucagggugg

SEQ ID NO: 730226 - RNA, 22 nt, Human
cagguccagaaaccaaaggauu

SEQ ID NO: 730227 - RNA, 22 nt, Human
caggagcucacagucuuugggu

SEQ ID NO: 730228 - RNA, 22 nt, Human
gucugccucuuucuuucugggu

SEQ ID NO: 730229 - RNA, 22 nt, Human
aacacuuucuauuauuaugguu

SEQ ID NO: 730230 - RNA, 22 nt, Human
gaaauagaucucugggaugcaa

SEQ ID NO: 730231 - RNA, 22 nt, Human
gaccuggcauauucauuggcac

SEQ ID NO: 730232 - RNA, 22 nt, Human
gcugugggacagguccagccag

SEQ ID NO: 730233 - RNA, 22 nt, Human
uuaugcagucgacaucugauca

SEQ ID NO: 730234 - RNA, 22 nt, Human
agcuccaguuacuuaccuagag

SEQ ID NO: 730235 - RNA, 22 nt, Human
auuaguguuguggcuucauggc

SEQ ID NO: 730236 - RNA, 22 nt, Human
uuuuuccaccguacuuccugag

SEQ ID NO: 730237 - RNA, 22 nt, Human
cagacaggcaggugagagcucc

SEQ ID NO: 730238 - RNA, 22 nt, Human
aauuucagcucaaacuuguguu

SEQ ID NO: 730239 - RNA, 22 nt, Human
ccuggagucugugacuuuccuc

SEQ ID NO: 730240 - RNA, 22 nt, Human
acuuuuaugauaaucaauguuc

SEQ ID NO: 730241 - RNA, 22 nt, Human
guucacaguuaggacaacugcu

SEQ ID NO: 730242 - RNA, 22 nt, Human
cugggcuggcgcauccgacacg

SEQ ID NO: 730243 - RNA, 17 nt, Human
ugcagcaaaugggggac

SEQ ID NO: 730244 - RNA, 22 nt, Human
caugcacacugcaacaaggacu

SEQ ID NO: 730245 - RNA, 22 nt, Human
caaaaugcaucugagaccaggc

SEQ ID NO: 730246 - RNA, 22 nt, Human
gagagcuguccggcugagcagc

SEQ ID NO: 730247 - RNA, 23 nt, Human
aaaaaaccauguaggcacucagu

SEQ ID NO: 730248 - RNA, 22 nt, Human
uacagguuacacuuuuaaaagu

SEQ ID NO: 730249 - RNA, 22 nt, Human
caggggcuuaagugacagaagg

SEQ ID NO: 730250 - RNA, 22 nt, Human
gggcucaggccuggccucucac

SEQ ID NO: 730251 - RNA, 22 nt, Human
uuuuagaaauacugauuuagug

SEQ ID NO: 730252 - RNA, 22 nt, Human
uugcuuuauucacaucuauauu

SEQ ID NO: 730253 - RNA, 22 nt, Human
aaagguuugcauggaauuuacc

SEQ ID NO: 730254 - RNA, 22 nt, Human
aguuucacagaggguuagacgc

SEQ ID NO: 730255 - RNA, 22 nt, Human
auucacaaaugcugccccauuc

SEQ ID NO: 730256 - RNA, 23 nt, Human
gguuccaggaacacagccugaug

SEQ ID NO: 730257 - RNA, 22 nt, Human
gccagagguaucaaagauagua

SEQ ID NO: 730258 - RNA, 22 nt, Human
ugugccagaaaauaugcugagg

SEQ ID NO: 730259 - RNA, 22 nt, Human
uuccagucuggccugugcuuag

SEQ ID NO: 730260 - RNA, 22 nt, Human
uaacaguagccuuauguggucu

SEQ ID NO: 730261 - RNA, 19 nt, Human
agaagcaccagucauuccu

SEQ ID NO: 730262 - RNA, 22 nt, Human
aauucaguuauauguccacuuc

SEQ ID NO: 730263 - RNA, 23 nt, Human
uagaaucuguauuucugcaguuc

SEQ ID NO: 730264 - RNA, 19 nt, Human
aaagaucugggauugagac

SEQ ID NO: 730265 - RNA, 22 nt, Human
guucccacgccuccucuccagc

SEQ ID NO: 730266 - RNA, 22 nt, Human
uuaacuauuauuagcaucuuug

SEQ ID NO: 730267 - RNA, 22 nt, Human
ugagagagccugaaucucuuac

SEQ ID NO: 730268 - RNA, 22 nt, Human
ugucuaaaugcaauggauuucc

SEQ ID NO: 730269 - RNA, 22 nt, Human
uucucuucccacuuucuguauu

SEQ ID NO: 730270 - RNA, 22 nt, Human
ugagacacucucgggcacauuu

SEQ ID NO: 730271 - RNA, 22 nt, Human
gguccaggaucaaggcaucacc

SEQ ID NO: 730272 - RNA, 22 nt, Human
acugcucuguuuucauauguuu

SEQ ID NO: 730273 - RNA, 22 nt, Human
aggaagcccaagucucaucuuc

SEQ ID NO: 730274 - RNA, 22 nt, Human
ggccagaggugguacauagcuu

SEQ ID NO: 730275 - RNA, 22 nt, Human
gggcuggcucugucuagaaagg

SEQ ID NO: 730276 - RNA, 22 nt, Human
gcaggcugaguauuacccuagu

SEQ ID NO: 730277 - RNA, 23 nt, Human
uauuuggaaagagggaagaagac

SEQ ID NO: 730278 - RNA, 22 nt, Human
ucugggaagcugcgugccuguu

SEQ ID NO: 730279 - RNA, 22 nt, Human
acauaucugugagguuuuguug

SEQ ID NO: 730280 - RNA, 22 nt, Human
cuuggagaccagugacauugcu

SEQ ID NO: 730281 - RNA, 22 nt, Human
gacugucauucuagugcccaug

SEQ ID NO: 730282 - RNA, 22 nt, Human
uguguuuuggaaggaacaugca

SEQ ID NO: 730283 - RNA, 22 nt, Human
uuauccugcauccuggaacuca

SEQ ID NO: 730284 - RNA, 22 nt, Human
uuuucguuuauuugacauguaa

SEQ ID NO: 730285 - RNA, 22 nt, Human
gccugugacucgucuugggcca

SEQ ID NO: 730286 - RNA, 22 nt, Human
uauacugaguguguuaaugaug

SEQ ID NO: 730287 - RNA, 22 nt, Human
acauacacaugaauauauuuuu

SEQ ID NO: 730288 - RNA, 22 nt, Human
ugucacagagcaacuauuucuu

SEQ ID NO: 730289 - RNA, 21 nt, Human
acacaaaccuccucagccugg

SEQ ID NO: 730290 - RNA, 19 nt, Human
agggccacggggagguauu

SEQ ID NO: 730291 - RNA, 22 nt, Human
ugcaccauguaaguggccacgu

SEQ ID NO: 730292 - RNA, 22 nt, Human
uuauguuaugaauggaugaucu

SEQ ID NO: 730293 - RNA, 22 nt, Human
cuucaggaguaguuaccuagca

SEQ ID NO: 730294 - RNA, 22 nt, Human
gagaaagaugaagaguggcguu

SEQ ID NO: 730295 - RNA, 22 nt, Human
ugcagcugagucacccagccau

SEQ ID NO: 730296 - RNA, 22 nt, Human
ucagaaauaaugaaugaugggg

SEQ ID NO: 730297 - RNA, 22 nt, Human
cauagaaugcagcaggaaaguu

SEQ ID NO: 730298 - RNA, 22 nt, Human
cagugccagagguacuagugga

SEQ ID NO: 730299 - RNA, 22 nt, Human
ucaucccucugccaggcccagg

SEQ ID NO: 730300 - RNA, 22 nt, Human
agaaaacauaggagacaggaaa

SEQ ID NO: 730301 - RNA, 22 nt, Human
acagaauaguagcuuaaaguca

SEQ ID NO: 730302 - RNA, 22 nt, Human
uggcacuauggaugagacugau

SEQ ID NO: 730303 - RNA, 22 nt, Human
cucagggagagccaagaguucc

SEQ ID NO: 730304 - RNA, 22 nt, Human
ccaggagcauuaagagaacaua

SEQ ID NO: 730305 - RNA, 22 nt, Human
guaacauuauucaugagauaca

SEQ ID NO: 730306 - RNA, 22 nt, Human
ucuuauacagaagauguuuaau

SEQ ID NO: 730307 - RNA, 22 nt, Human
auguauguuuucaguuguauua

SEQ ID NO: 730308 - RNA, 22 nt, Human
aaagcagaggugauaugacuua

SEQ ID NO: 730309 - RNA, 22 nt, Human
agacagcagggagcaggauuca

SEQ ID NO: 730310 - RNA, 22 nt, Human
uuuuuacagucauggucacuca

SEQ ID NO: 730311 - RNA, 18 nt, Human
acuugggacuuuugcauu

SEQ ID NO: 730312 - RNA, 22 nt, Human
cuaaggaaaaggauauauaugu

SEQ ID NO: 730313 - RNA, 22 nt, Human
ucuauucaggcagagugcagca

SEQ ID NO: 730314 - RNA, 19 nt, Human
gcugagguggaggaaggag

SEQ ID NO: 730315 - RNA, 22 nt, Human
ugcaggaaguuuccugaacuuu

SEQ ID NO: 730316 - RNA, 22 nt, Human
cucauacauaugccauuccugc

SEQ ID NO: 730317 - RNA, 22 nt, Human
guguacaguuagccaccaaauu

SEQ ID NO: 730318 - RNA, 22 nt, Human
ucccagcagaugagcugaccua

SEQ ID NO: 730319 - RNA, 22 nt, Human
uggaggcagguggaggagugaa

SEQ ID NO: 730320 - RNA, 23 nt, Human
ucugucuguguaugugcagaaag

SEQ ID NO: 730321 - RNA, 22 nt, Human
ucuugaaagcaugagauggaca

SEQ ID NO: 730322 - RNA, 22 nt, Human
gaccagggucacucacagggcu

SEQ ID NO: 730323 - RNA, 22 nt, Human
gaaacaauuuuuguugucuaag

SEQ ID NO: 730324 - RNA, 22 nt, Human
aaacaucuuucuauugcaaguu

SEQ ID NO: 730325 - RNA, 22 nt, Human
gggucagcugcugggggcugac

SEQ ID NO: 730326 - RNA, 22 nt, Human
ucuggggagggagccacagguc

SEQ ID NO: 730327 - RNA, 22 nt, Human
gacuucaacuucuggggagcaa

SEQ ID NO: 730328 - RNA, 22 nt, Human
auuuucaucauggguuuaacau

SEQ ID NO: 730329 - RNA, 22 nt, Human
gagcuggaggaccaggacuggg

SEQ ID NO: 730330 - RNA, 22 nt, Human
gcagcugggucugugugggcug

SEQ ID NO: 730331 - RNA, 22 nt, Human
gugaggagcugacacuggggug

SEQ ID NO: 730332 - RNA, 22 nt, Human
aagcagcugugugacauaaucu

SEQ ID NO: 730333 - RNA, 22 nt, Human
uaggggcuuguaauuuaauaga

SEQ ID NO: 730334 - RNA, 22 nt, Human
ggacacugaagaaucucagaug

SEQ ID NO: 730335 - RNA, 22 nt, Human
uuaagaucaagauaagcaauaa

SEQ ID NO: 730336 - RNA, 22 nt, Human
gagaagggauaugccacucucg

SEQ ID NO: 730337 - RNA, 22 nt, Human
acacaucaugccaaguuucacc

SEQ ID NO: 730338 - RNA, 22 nt, Human
gucugcucaugcuaccgcgggc

SEQ ID NO: 730339 - RNA, 22 nt, Human
gcagacagacugcagugauuuu

SEQ ID NO: 730340 - RNA, 22 nt, Human
uggcagugucuugcuggggcag

SEQ ID NO: 730341 - RNA, 22 nt, Human
uugccuuugacggugcagcagu

SEQ ID NO: 730342 - RNA, 22 nt, Human
aucagcuggaacaagugucuga

SEQ ID NO: 730343 - RNA, 22 nt, Human
gcagaugcuuggcacugacagu

SEQ ID NO: 730344 - RNA, 22 nt, Human
ugucuauuaacacaagaaagga

SEQ ID NO: 730345 - RNA, 21 nt, Human
ccuucuccauuacaguaagcu

SEQ ID NO: 730346 - RNA, 22 nt, Human
acauucaggccacaguggaguc

SEQ ID NO: 730347 - RNA, 21 nt, Human
gaaaaccauuugcaucaugag

SEQ ID NO: 730348 - RNA, 20 nt, Human
uuacaaguuucuaauaacca

SEQ ID NO: 730349 - RNA, 22 nt, Human
ugguauuacagcauuccauauu

SEQ ID NO: 730350 - RNA, 22 nt, Human
agucugggagaaggugagauua

SEQ ID NO: 730351 - RNA, 19 nt, Human
uuacacuccugggcagugg

SEQ ID NO: 730352 - RNA, 22 nt, Human
augcuguuaagaaucucuuccu

SEQ ID NO: 730353 - RNA, 22 nt, Human
ugcuggaagcuccugcaugucu

SEQ ID NO: 730354 - RNA, 22 nt, Human
agaaagcuggagucaagcagag

SEQ ID NO: 730355 - RNA, 22 nt, Human
acaaugcauaccuagcagcuca

SEQ ID NO: 730356 - RNA, 22 nt, Human
gcagugaauuuaacacucagau

SEQ ID NO: 730357 - RNA, 22 nt, Human
gagugaguggccaggaggcaga

SEQ ID NO: 730358 - RNA, 22 nt, Human
uuggccagcagcucuggcuuag

SEQ ID NO: 730359 - RNA, 22 nt, Human
acagaagagcacauuuaguaug

SEQ ID NO: 730360 - RNA, 22 nt, Human
ccaauguuaggcucugguuuua

SEQ ID NO: 730361 - RNA, 22 nt, Human
uucccucuccaggagcccugag

SEQ ID NO: 730362 - RNA, 22 nt, Human
gaguuuauucaggaaauagcca

SEQ ID NO: 730363 - RNA, 22 nt, Human
aggcuguguggaugagucuuac

SEQ ID NO: 730364 - RNA, 22 nt, Human
ucucagaaccucaguuugcucu

SEQ ID NO: 730365 - RNA, 22 nt, Human
ugugcuucucacaucacuguug

SEQ ID NO: 730366 - RNA, 22 nt, Human
cauguaaagcacuucauaacag

SEQ ID NO: 730367 - RNA, 22 nt, Human
ugacauuucgguguaugugaug

SEQ ID NO: 730368 - RNA, 22 nt, Human
uuucagagguaugcugcuuauc

SEQ ID NO: 730369 - RNA, 22 nt, Human
auggcugcagccggcccugcgc

SEQ ID NO: 730370 - RNA, 22 nt, Human
agccucagcacgcagcucugug

SEQ ID NO: 730371 - RNA, 22 nt, Human
ucacuuagauggggaucaucac

SEQ ID NO: 730372 - RNA, 22 nt, Human
uguccucagauaugucuacucu

SEQ ID NO: 730373 - RNA, 22 nt, Human
acacugugcuuagaugcugaac

SEQ ID NO: 730374 - RNA, 22 nt, Human
gaagcacacugauuuuauuucu

SEQ ID NO: 730375 - RNA, 21 nt, Human
aucacauuggcuguuauuauu

SEQ ID NO: 730376 - RNA, 22 nt, Human
gguggcacacuggggagcucgg

SEQ ID NO: 730377 - RNA, 22 nt, Human
augaugaaacuaggaacuagag

SEQ ID NO: 730378 - RNA, 22 nt, Human
guccucagaagccugcuuagcu

SEQ ID NO: 730379 - RNA, 21 nt, Human
cccaggucguggucuucccag

SEQ ID NO: 730380 - RNA, 22 nt, Human
agggucagagaucggccaugug

SEQ ID NO: 730381 - RNA, 21 nt, Human
uugaauuguaugauuaaacug

SEQ ID NO: 730382 - RNA, 22 nt, Human
agccauccuacuaccucagcau

SEQ ID NO: 730383 - RNA, 22 nt, Human
cugaacucuuuaugacagcuug

SEQ ID NO: 730384 - RNA, 22 nt, Human
ucaguuuuguauguuguaaguc

SEQ ID NO: 730385 - RNA, 22 nt, Human
guuuaugaguuacguagggguu

SEQ ID NO: 730386 - RNA, 22 nt, Human
aaguuuguagcuggaugucugu

SEQ ID NO: 730387 - RNA, 22 nt, Human
ugcauuccacagaagggaaaac

SEQ ID NO: 730388 - RNA, 22 nt, Human
auucugggaacuuugucucuca

SEQ ID NO: 730389 - RNA, 22 nt, Human
agguccagugcucuuggugguu

SEQ ID NO: 730390 - RNA, 22 nt, Human
agacuucuugagcuggcacuuc

SEQ ID NO: 730391 - RNA, 17 nt, Human
auggaggcagacagguc

SEQ ID NO: 730392 - RNA, 22 nt, Human
ucugaaauaagggagaagggaa

SEQ ID NO: 730393 - RNA, 22 nt, Human
ucucagagaccugaacucccug

SEQ ID NO: 730394 - RNA, 22 nt, Human
gaaccucuuuaaagaacagaau

SEQ ID NO: 730395 - RNA, 22 nt, Human
uaggaaauugccaauauaugac

SEQ ID NO: 730396 - RNA, 22 nt, Human
uuaaaugucuguagaugugcug

SEQ ID NO: 730397 - RNA, 22 nt, Human
uucuguauuucaaugucuuuau

SEQ ID NO: 730398 - RNA, 22 nt, Human
acugcauuugucugucucaauu

SEQ ID NO: 730399 - RNA, 22 nt, Human
gcucagcuacuuacagguggcu

SEQ ID NO: 730400 - RNA, 22 nt, Human
gccaggcucaguagcgauuccu

SEQ ID NO: 730401 - RNA, 22 nt, Human
gcugagauuacgggcaugagcc

SEQ ID NO: 730402 - RNA, 22 nt, Human
caggcucagaagccaguggagc

SEQ ID NO: 730403 - RNA, 22 nt, Human
ucacuuuacagaugggaaaacu

SEQ ID NO: 730404 - RNA, 22 nt, Human
ggauuuuagaguaccuaagugu

SEQ ID NO: 730405 - RNA, 21 nt, Human
gccagagcaguacaaugaggu

SEQ ID NO: 730406 - RNA, 22 nt, Human
uauuguacauuucaaaguagcu

SEQ ID NO: 730407 - RNA, 22 nt, Human
cucugaguuucauuucccuccu

SEQ ID NO: 730408 - RNA, 22 nt, Human
gauggguagaaguggaagaggu

SEQ ID NO: 730409 - RNA, 22 nt, Human
ccuggcucagaccccaguucug

SEQ ID NO: 730410 - RNA, 22 nt, Human
ucugcauauuguuaauggaaug

SEQ ID NO: 730411 - RNA, 22 nt, Human
gagaaggggugauguggguaau

SEQ ID NO: 730412 - RNA, 22 nt, Human
uuggcccugagguuaucaucua

SEQ ID NO: 730413 - RNA, 22 nt, Human
ucauuuguaccauuuuuuaaga

SEQ ID NO: 730414 - RNA, 22 nt, Human
ccaggcuugguguguggucagg

SEQ ID NO: 730415 - RNA, 22 nt, Human
gcaggagcucguuuccaggcug

SEQ ID NO: 730416 - RNA, 18 nt, Human
cauuccaaguucuaccuc

SEQ ID NO: 730417 - RNA, 22 nt, Human
uguugguaggauuugcuucagc

SEQ ID NO: 730418 - RNA, 22 nt, Human
uuauugcaaccuuuucuggugu

SEQ ID NO: 730419 - RNA, 23 nt, Human
gccuuggagaagucacucaggga

SEQ ID NO: 730420 - RNA, 22 nt, Human
gcucccagaaccaaggcugggg

SEQ ID NO: 730421 - RNA, 22 nt, Human
agaugguguuuccccaggugga

SEQ ID NO: 730422 - RNA, 22 nt, Human
ggaguuggugagcaccaggcuu

SEQ ID NO: 730423 - RNA, 22 nt, Human
acugcaauuauuuguucaccaa

SEQ ID NO: 730424 - RNA, 22 nt, Human
agcucugacaaggauuuucugc

SEQ ID NO: 730425 - RNA, 20 nt, Human
uuucuauggggccagcacau

SEQ ID NO: 730426 - RNA, 22 nt, Human
uuuguagagaauaaaacaaauu

SEQ ID NO: 730427 - RNA, 22 nt, Human
ugcuguagcccugcacagugca

SEQ ID NO: 730428 - RNA, 22 nt, Human
cagcauucuacuuugugaacug

SEQ ID NO: 730429 - RNA, 22 nt, Human
uuucaugagauuccuccacauc

SEQ ID NO: 730430 - RNA, 20 nt, Human
aguuuucagcagaacaccca

SEQ ID NO: 730431 - RNA, 22 nt, Human
gcacauggcggccagcagguga

SEQ ID NO: 730432 - RNA, 22 nt, Human
agaggaggauuuguaaaggucu

SEQ ID NO: 730433 - RNA, 22 nt, Human
caugcagugacucagacacagg

SEQ ID NO: 730434 - RNA, 22 nt, Human
auucuuuuuuaaggaauagaac

SEQ ID NO: 730435 - RNA, 22 nt, Human
cuuauguaaaacggaaagggaa

SEQ ID NO: 730436 - RNA, 22 nt, Human
ccuggcaguggugaagaagagg

SEQ ID NO: 730437 - RNA, 22 nt, Human
uaauugcagggagccugggggc

SEQ ID NO: 730438 - RNA, 22 nt, Human
gcugaaggcccggaggacaggg

SEQ ID NO: 730439 - RNA, 22 nt, Human
agccuccaucucccaucuguga

SEQ ID NO: 730440 - RNA, 22 nt, Human
ugguggcaucaauugacuucuc

SEQ ID NO: 730441 - RNA, 22 nt, Human
caauccaucaauuacacaggcu

SEQ ID NO: 730442 - RNA, 22 nt, Human
ggugggcaggucacucugccuc

SEQ ID NO: 730443 - RNA, 22 nt, Human
uguauauaagcauuuacuuguu

SEQ ID NO: 730444 - RNA, 22 nt, Human
cuuauucuugucuuauugugcu

SEQ ID NO: 730445 - RNA, 22 nt, Human
aaacaaugagcuuuuacacacu

SEQ ID NO: 730446 - RNA, 22 nt, Human
caggaaggggcucacucuggcc

SEQ ID NO: 730447 - RNA, 22 nt, Human
gaccagaaucuggacucugauu

SEQ ID NO: 730448 - RNA, 22 nt, Human
cucuucuugcuagacugagugc

SEQ ID NO: 730449 - RNA, 22 nt, Human
gggcagguggcaaagccagagg

SEQ ID NO: 730450 - RNA, 22 nt, Human
cacuugggagcauugcacaugu

SEQ ID NO: 730451 - RNA, 18 nt, Human
cagcugccagcucaugga

SEQ ID NO: 730452 - RNA, 22 nt, Human
gcuggcugcacaggggcucacu

SEQ ID NO: 730453 - RNA, 23 nt, Human
uguagcaucucuuauuucucagc

SEQ ID NO: 730454 - RNA, 22 nt, Human
uguguggaugcagcgugggucu

SEQ ID NO: 730455 - RNA, 22 nt, Human
cugcauaucaaauuacuccugg

SEQ ID NO: 730456 - RNA, 22 nt, Human
aagaauacuucguaaguaggau

SEQ ID NO: 730457 - RNA, 22 nt, Human
cucuagcugaggucacugcuau

SEQ ID NO: 730458 - RNA, 22 nt, Human
uguaaacuguagaaaauacuuu

SEQ ID NO: 730459 - RNA, 22 nt, Human
ggcaggcaaggcagccugguga

SEQ ID NO: 730460 - RNA, 22 nt, Human
guugggcugggagcugcccuga

SEQ ID NO: 730461 - RNA, 22 nt, Human
gagauucuaagucguugguuag

SEQ ID NO: 730462 - RNA, 22 nt, Human
cugcucuggggaagccagaugu

SEQ ID NO: 730463 - RNA, 22 nt, Human
ucuggaaagaucauuaaaucca

SEQ ID NO: 730464 - RNA, 22 nt, Human
ugacucugggguugaccagaug

SEQ ID NO: 730465 - RNA, 22 nt, Human
agcuguugaaaaugguguccua

SEQ ID NO: 730466 - RNA, 22 nt, Human
uccaguggaacagauguugccu

SEQ ID NO: 730467 - RNA, 22 nt, Human
cagucacauuucgacauaacua

SEQ ID NO: 730468 - RNA, 22 nt, Human
gauguagacacuuggaggcuua

SEQ ID NO: 730469 - RNA, 22 nt, Human
cuccagagucaucgagcauucc

SEQ ID NO: 730470 - RNA, 22 nt, Human
cuucuuggcugcaagucucugu

SEQ ID NO: 730471 - RNA, 20 nt, Human
ggaaaaaugcaugcucaaga

SEQ ID NO: 730472 - RNA, 16 nt, Human
gaggggagcaguaggc

SEQ ID NO: 730473 - RNA, 22 nt, Human
aaagaugaucuacaaguucauu

SEQ ID NO: 730474 - RNA, 22 nt, Human
gggcacagucugcagcccccca

SEQ ID NO: 730475 - RNA, 22 nt, Human
ugaggcucacaaaucugcauuu

SEQ ID NO: 730476 - RNA, 19 nt, Human
acauugaauuuucuucuuu

SEQ ID NO: 730477 - RNA, 22 nt, Human
uuugucagucaugucugcuuuu

SEQ ID NO: 730478 - RNA, 22 nt, Human
auggccacauuuaguaacuggu

SEQ ID NO: 730479 - RNA, 22 nt, Human
agggaauguagcaagaugccaa

SEQ ID NO: 730480 - RNA, 22 nt, Human
gcuggacucaggggacucaggg

SEQ ID NO: 730481 - RNA, 17 nt, Human
uuacacaggagagcucu

SEQ ID NO: 730482 - RNA, 22 nt, Human
gcagaggccugaagguggcggg

SEQ ID NO: 730483 - RNA, 22 nt, Human
cucugcugaucucagcugggcu

SEQ ID NO: 730484 - RNA, 22 nt, Human
aggaccugacauuguguuuucu

SEQ ID NO: 730485 - RNA, 22 nt, Human
ugcauuugucuugucucaugaa

SEQ ID NO: 730486 - RNA, 22 nt, Human
acacacagaaggaagccccacu

SEQ ID NO: 730487 - RNA, 22 nt, Human
ugaaagggaaccugcuggacug

SEQ ID NO: 730488 - RNA, 22 nt, Human
acacuuuacagaauguuuugau

SEQ ID NO: 730489 - RNA, 22 nt, Human
auuuguugcuagcagcacugau

SEQ ID NO: 730490 - RNA, 22 nt, Human
ucuuuccaaggacucuguagca

SEQ ID NO: 730491 - RNA, 22 nt, Human
uucuucaaaguaauagagacua

SEQ ID NO: 730492 - RNA, 22 nt, Human
aggagcugggcccaaggaugcu

SEQ ID NO: 730493 - RNA, 22 nt, Human
aacagucuuacagaaguagcca

SEQ ID NO: 730494 - RNA, 22 nt, Human
auuucaugaguuauuauagugg

SEQ ID NO: 730495 - RNA, 22 nt, Human
acaguucuuaaaacuugaauua

SEQ ID NO: 730496 - RNA, 22 nt, Human
cagaggagugggccguuauggu

SEQ ID NO: 730497 - RNA, 20 nt, Human
aggcaguuagaaggagauga

SEQ ID NO: 730498 - RNA, 22 nt, Human
uugugcuccugugagaaucuag

SEQ ID NO: 730499 - RNA, 22 nt, Human
aggaguccucaugucugugcga

SEQ ID NO: 730500 - RNA, 22 nt, Human
ggucacaugugauuugagccaa

SEQ ID NO: 730501 - RNA, 22 nt, Human
auuauggacaucaaauaacucu

SEQ ID NO: 730502 - RNA, 22 nt, Human
gcucaggcuggauugcaguggc

SEQ ID NO: 730503 - RNA, 22 nt, Human
ucugucuccucagaugacucca

SEQ ID NO: 730504 - RNA, 22 nt, Human
cucccuggaggcccagaccugg

SEQ ID NO: 730505 - RNA, 22 nt, Human
gggcaagcagugaggacagcac

SEQ ID NO: 730506 - RNA, 22 nt, Human
gguagcacauugcauuaggaga

SEQ ID NO: 730507 - RNA, 22 nt, Human
ugcuggaaugagucggggaggg

SEQ ID NO: 730508 - RNA, 22 nt, Human
uauucacaugaaaacaaauuuu

SEQ ID NO: 730509 - RNA, 22 nt, Human
gcuuugaagucugugucuuuug

SEQ ID NO: 730510 - RNA, 22 nt, Human
ugucuggcauaguugcucccug

SEQ ID NO: 730511 - RNA, 22 nt, Human
cuggcuggccggagcgaggcgg

SEQ ID NO: 730512 - RNA, 22 nt, Human
agccugcuucccuuugugcccc

SEQ ID NO: 730513 - RNA, 22 nt, Human
ugugcugacaagaucagaaggu

SEQ ID NO: 730514 - RNA, 22 nt, Human
aaaugauguuauaagaccagga

SEQ ID NO: 730515 - RNA, 15 nt, Human
ugggcagaucacuug

SEQ ID NO: 730516 - RNA, 22 nt, Human
uuccuucugaagccuuuguguu

SEQ ID NO: 730517 - RNA, 22 nt, Human
gguuuuauuaccccuuaaacac

SEQ ID NO: 730518 - RNA, 22 nt, Human
agggggguggaucaccugaggu

SEQ ID NO: 730519 - RNA, 22 nt, Human
gcucagagcccgaggcuugcau

SEQ ID NO: 730520 - RNA, 22 nt, Human
cucuggucauuuggaagagcau

SEQ ID NO: 730521 - RNA, 20 nt, Human
cacaggccuugugagcagac

SEQ ID NO: 730522 - RNA, 22 nt, Human
agucucagccacacagaccuau

SEQ ID NO: 730523 - RNA, 22 nt, Human
auucuuaaauuuaggucuguga

SEQ ID NO: 730524 - RNA, 19 nt, Human
gucucuggauuucaggucc

SEQ ID NO: 730525 - RNA, 22 nt, Human
ggcaguggguggaucucaggga

SEQ ID NO: 730526 - RNA, 22 nt, Human
agguuggccaagcugcuggccc

SEQ ID NO: 730527 - RNA, 22 nt, Human
guggcagcagaggggugguaug

SEQ ID NO: 730528 - RNA, 22 nt, Human
uggcuuaguucuagaaauuugg

SEQ ID NO: 730529 - RNA, 22 nt, Human
uuucacagcugauaccucuucc

SEQ ID NO: 730530 - RNA, 22 nt, Human
gagcugaacaaauugcgagugg

SEQ ID NO: 730531 - RNA, 17 nt, Human
uugacuguuaauggguu

SEQ ID NO: 730532 - RNA, 22 nt, Human
ucucagagaugucaagagucua

SEQ ID NO: 730533 - RNA, 22 nt, Human
gugagagaucccccacucaucu

SEQ ID NO: 730534 - RNA, 22 nt, Human
gcaaguccuuugcaugcaggga

SEQ ID NO: 730535 - RNA, 22 nt, Human
ggcuuccuccuuccugcuguca

SEQ ID NO: 730536 - RNA, 20 nt, Human
cugcucugcuuugcaggugg

SEQ ID NO: 730537 - RNA, 22 nt, Human
ucaggccaaagaaacagcauga

SEQ ID NO: 730538 - RNA, 22 nt, Human
ggccagguuggguggaaguggc

SEQ ID NO: 730539 - RNA, 22 nt, Human
cuguccuguagcuccaucaguc

SEQ ID NO: 730540 - RNA, 22 nt, Human
uaacaucaaacauguuuuaaag

SEQ ID NO: 730541 - RNA, 22 nt, Human
aguguuugcaucucauugauuu

SEQ ID NO: 730542 - RNA, 22 nt, Human
uuauuuucuccucagaaagugg

SEQ ID NO: 730543 - RNA, 22 nt, Human
gaucgaguuguuuguucugggg

SEQ ID NO: 730544 - RNA, 22 nt, Human
uagggacccucccugcucuaac

SEQ ID NO: 730545 - RNA, 22 nt, Human
gagagacugggcagggccggca

SEQ ID NO: 730546 - RNA, 22 nt, Human
cuuacauacugagaaaauaucc

SEQ ID NO: 730547 - RNA, 19 nt, Human
uuucuguuugcuucugguu

SEQ ID NO: 730548 - RNA, 23 nt, Human
aagcugccuucgcaguuggucug

SEQ ID NO: 730549 - RNA, 22 nt, Human
ucugggucuggcugcuggugca

SEQ ID NO: 730550 - RNA, 22 nt, Human
guauucuguuuacagugagcaa

SEQ ID NO: 730551 - RNA, 22 nt, Human
uucacagaauggcaaguuaugg

SEQ ID NO: 730552 - RNA, 22 nt, Human
uaugcacaauaugaucuauuug

SEQ ID NO: 730553 - RNA, 21 nt, Human
ucucacaauaugaugccagau

SEQ ID NO: 730554 - RNA, 22 nt, Human
cuauuuguacagcauucgaguu

SEQ ID NO: 730555 - RNA, 22 nt, Human
auggcuguuccugggaguucua

SEQ ID NO: 730556 - RNA, 22 nt, Human
agccucugggggagcugggagc

SEQ ID NO: 730557 - RNA, 22 nt, Human
ggcuggaaguccaagaucaaga

SEQ ID NO: 730558 - RNA, 22 nt, Human
uugaaacucaucuuagugaugu

SEQ ID NO: 730559 - RNA, 22 nt, Human
ugcagugguugagagcccagac

SEQ ID NO: 730560 - RNA, 22 nt, Human
uuccuucuggaagcuucagggg

SEQ ID NO: 730561 - RNA, 22 nt, Human
cauuucaauacuaucugagaau

SEQ ID NO: 730562 - RNA, 22 nt, Human
ucaggagaguguucaguggagg

SEQ ID NO: 730563 - RNA, 22 nt, Human
aggagcugcauggauaccuggu

SEQ ID NO: 730564 - RNA, 22 nt, Human
uggguccuugcuaacuucuaug

SEQ ID NO: 730565 - RNA, 22 nt, Human
gcucccucccaccagccugcag

SEQ ID NO: 730566 - RNA, 22 nt, Human
cuuauguacacacauauauugu

SEQ ID NO: 730567 - RNA, 18 nt, Human
aaagcuguuauuccagaa

SEQ ID NO: 730568 - RNA, 22 nt, Human
ucagcuuuuuggauugcccaag

SEQ ID NO: 730569 - RNA, 22 nt, Human
ucaggcucuacacuugacacac

SEQ ID NO: 730570 - RNA, 22 nt, Human
gcccaggauggagaauaguggu

SEQ ID NO: 730571 - RNA, 22 nt, Human
gcucaggccuggcccaugggac

SEQ ID NO: 730572 - RNA, 22 nt, Human
agcagcuugaggcuggauucca

SEQ ID NO: 730573 - RNA, 22 nt, Human
gucuauguaaacgucuacauua

SEQ ID NO: 730574 - RNA, 22 nt, Human
caggcuccucacucaugcuccc

SEQ ID NO: 730575 - RNA, 22 nt, Human
ugauaugcauguaagggagaca

SEQ ID NO: 730576 - RNA, 22 nt, Human
uauuccuggguuccagcccaga

SEQ ID NO: 730577 - RNA, 22 nt, Human
auuacaguagcaaaagaccgga

SEQ ID NO: 730578 - RNA, 22 nt, Human
caggaaagggaugggcugccac

SEQ ID NO: 730579 - RNA, 22 nt, Human
caacauauaauauuugaguucu

SEQ ID NO: 730580 - RNA, 22 nt, Human
ggaccagagcucgggcuucuca

SEQ ID NO: 730581 - RNA, 21 nt, Human
ucucuggaguuagcagagaga

SEQ ID NO: 730582 - RNA, 22 nt, Human
uaugcacgucuauuuaugaaga

SEQ ID NO: 730583 - RNA, 22 nt, Human
ugcugcaggaauucucaaggga

SEQ ID NO: 730584 - RNA, 22 nt, Human
uagcagcugugaguaaaagcca

SEQ ID NO: 730585 - RNA, 22 nt, Human
ucaaaggaaacacaagcuucug

SEQ ID NO: 730586 - RNA, 22 nt, Human
guuguuuguaaugacaggagac

SEQ ID NO: 730587 - RNA, 22 nt, Human
aggagcugaugauucuuugauc

SEQ ID NO: 730588 - RNA, 22 nt, Human
ucagccagggggagagaaugga

SEQ ID NO: 730589 - RNA, 22 nt, Human
augugugcauguuagagagagu

SEQ ID NO: 730590 - RNA, 23 nt, Human
gccagcuuuggucugucuccuag

SEQ ID NO: 730591 - RNA, 22 nt, Human
uucaguaaaacacugcaauguc

SEQ ID NO: 730592 - RNA, 22 nt, Human
ccuggacucagaggugcuggug

SEQ ID NO: 730593 - RNA, 20 nt, Human
ugcaauguccauguuccagg

SEQ ID NO: 730594 - RNA, 22 nt, Human
gucuccugagccuugacugcaa

SEQ ID NO: 730595 - RNA, 22 nt, Human
uaguuauuauuguuacuaucag

SEQ ID NO: 730596 - RNA, 22 nt, Human
uucucuuuugugaugugagaug

SEQ ID NO: 730597 - RNA, 22 nt, Human
cagcccaccuggcacguguguu

SEQ ID NO: 730598 - RNA, 22 nt, Human
uggggccuggucagagcugcac

SEQ ID NO: 730599 - RNA, 20 nt, Human
cucuuaauugcucacauuag

SEQ ID NO: 730600 - RNA, 22 nt, Human
aauacuuuugaacugaaaggca

SEQ ID NO: 730601 - RNA, 22 nt, Human
auagucuuagaaucuugagugu

SEQ ID NO: 730602 - RNA, 22 nt, Human
gacccaggguggucaccugaaa

SEQ ID NO: 730603 - RNA, 22 nt, Human
gacuguggacucucaugauaga

SEQ ID NO: 730604 - RNA, 22 nt, Human
uagcaaaguuuuguggugauua

SEQ ID NO: 730605 - RNA, 22 nt, Human
gcuggcuguguuucaucucuga

SEQ ID NO: 730606 - RNA, 22 nt, Human
auuuugugaacccucaagcaau

SEQ ID NO: 730607 - RNA, 22 nt, Human
aaauuguagagaucgcuuugug

SEQ ID NO: 730608 - RNA, 22 nt, Human
aggacagaccuaggacuggagc

SEQ ID NO: 730609 - RNA, 22 nt, Human
ugcccugggaggcuuuccuguu

SEQ ID NO: 730610 - RNA, 22 nt, Human
aaugaaguucuauucauuuucu

SEQ ID NO: 730611 - RNA, 22 nt, Human
uggcuucuuagaccaguggccu

SEQ ID NO: 730612 - RNA, 22 nt, Human
ucacugcuauauuggauacuga

SEQ ID NO: 730613 - RNA, 22 nt, Human
ugcaguuuugccaggcaaugga

SEQ ID NO: 730614 - RNA, 22 nt, Human
gaaaaguauguuuauuuugacu

SEQ ID NO: 730615 - RNA, 22 nt, Human
acauguuugauaaauauuuggg

SEQ ID NO: 730616 - RNA, 22 nt, Human
uugaaaggcacaggcaccuggg

SEQ ID NO: 730617 - RNA, 22 nt, Human
uucugcaaucgcucugaccauu

SEQ ID NO: 730618 - RNA, 22 nt, Human
gacugaaccucaaauuuggcuc

SEQ ID NO: 730619 - RNA, 22 nt, Human
cugagccccaucugaggugccc

SEQ ID NO: 730620 - RNA, 21 nt, Human
gcagaggaaugguauacauaa

SEQ ID NO: 730621 - RNA, 22 nt, Human
agggccagucguguauuacugu

SEQ ID NO: 730622 - RNA, 22 nt, Human
acaguucugaagacuagagccu

SEQ ID NO: 730623 - RNA, 22 nt, Human
ggcagggaguggagacucccua

SEQ ID NO: 730624 - RNA, 18 nt, Human
cuggcauucuucccugga

SEQ ID NO: 730625 - RNA, 21 nt, Human
uccagggcuuugauucucuca

SEQ ID NO: 730626 - RNA, 22 nt, Human
ucagagguuccggccauaacca

SEQ ID NO: 730627 - RNA, 22 nt, Human
uacagauuuugugaagaagugu

SEQ ID NO: 730628 - RNA, 20 nt, Human
ucagcucuuagaggucgcuu

SEQ ID NO: 730629 - RNA, 22 nt, Human
gagcaggucuuucauggugcau

SEQ ID NO: 730630 - RNA, 22 nt, Human
cuacagcuguaaaaggaauguc

SEQ ID NO: 730631 - RNA, 22 nt, Human
ucucuuugacccuuuagcucca

SEQ ID NO: 730632 - RNA, 22 nt, Human
gacauuuauuggauuuuacgag

SEQ ID NO: 730633 - RNA, 22 nt, Human
guuggcucauuuuauagacagc

SEQ ID NO: 730634 - RNA, 22 nt, Human
agggccagaaucccucagucua

SEQ ID NO: 730635 - RNA, 22 nt, Human
uuacuguugguguauccauagc

SEQ ID NO: 730636 - RNA, 22 nt, Human
cacaggagauugaucuauuggu

SEQ ID NO: 730637 - RNA, 22 nt, Human
ugcaggcuggcagauaucucau

SEQ ID NO: 730638 - RNA, 22 nt, Human
cugucauucuuacauaauguga

SEQ ID NO: 730639 - RNA, 19 nt, Human
agcugugcagacacuucgc

SEQ ID NO: 730640 - RNA, 22 nt, Human
ggcaggacauugacuacaguga

SEQ ID NO: 730641 - RNA, 23 nt, Human
augcucugggcugugggaccugc

SEQ ID NO: 730642 - RNA, 22 nt, Human
cuuuagaaggguaacggaauua

SEQ ID NO: 730643 - RNA, 22 nt, Human
aauaucaacaguguccuucuaa

SEQ ID NO: 730644 - RNA, 22 nt, Human
uucuaugccauguucagcuacu

SEQ ID NO: 730645 - RNA, 22 nt, Human
aggaaagggguagguguggacg

SEQ ID NO: 730646 - RNA, 21 nt, Human
uuuauguacuucauagaguag

SEQ ID NO: 730647 - RNA, 22 nt, Human
gccuuguuucauuacacguggu

SEQ ID NO: 730648 - RNA, 22 nt, Human
cuggaagaacuccaguucugug

SEQ ID NO: 730649 - RNA, 22 nt, Human
auccuaaagcagacagcagguu

SEQ ID NO: 730650 - RNA, 22 nt, Human
ggcucacaaaauguugcuuaau

SEQ ID NO: 730651 - RNA, 22 nt, Human
uuuagcauuccugggaugauuu

SEQ ID NO: 730652 - RNA, 22 nt, Human
cagcagcugauggggaagugau

SEQ ID NO: 730653 - RNA, 22 nt, Human
cuguaugaaauugucauuuuua

SEQ ID NO: 730654 - RNA, 22 nt, Human
ugugcucuugggcaauagcugc

SEQ ID NO: 730655 - RNA, 22 nt, Human
gaggaacagagggcaaggccag

SEQ ID NO: 730656 - RNA, 22 nt, Human
cuguggcuucagcauucagagc

SEQ ID NO: 730657 - RNA, 22 nt, Human
gacaggguggcugauagggcuc

SEQ ID NO: 730658 - RNA, 22 nt, Human
uguggugguaaugagccagaug

SEQ ID NO: 730659 - RNA, 22 nt, Human
gcaaaauuuacacuccuucuuc

SEQ ID NO: 730660 - RNA, 16 nt, Human
ucccaggaggcggaac

SEQ ID NO: 730661 - RNA, 22 nt, Human
uagguucagugucuuguucugc

SEQ ID NO: 730662 - RNA, 22 nt, Human
ugggccugccccaggcuucagc

SEQ ID NO: 730663 - RNA, 22 nt, Human
uugggccaagugauucucugcc

SEQ ID NO: 730664 - RNA, 22 nt, Human
aagucuggaagucucaguuuuc

SEQ ID NO: 730665 - RNA, 22 nt, Human
ucagaacauccugguuuaaaau

SEQ ID NO: 730666 - RNA, 22 nt, Human
cagggacauugguggccagguu

SEQ ID NO: 730667 - RNA, 22 nt, Human
ggguccagggccaguggcugag

SEQ ID NO: 730668 - RNA, 22 nt, Human
ccucccuccauugccaucgucu

SEQ ID NO: 730669 - RNA, 20 nt, Human
ggaggguggaagaaagcaag

SEQ ID NO: 730670 - RNA, 22 nt, Human
gucugagacuuuuucugugugg

SEQ ID NO: 730671 - RNA, 22 nt, Human
uuccccaggcuggagugcagug

SEQ ID NO: 730672 - RNA, 19 nt, Human
uggaccugugcccauggcu

SEQ ID NO: 730673 - RNA, 22 nt, Human
cagaguccaauugcucagagcg

SEQ ID NO: 730674 - RNA, 22 nt, Human
ugugaaagcaagucuaguucuc

SEQ ID NO: 730675 - RNA, 19 nt, Human
ccugaguugggugaagaga

SEQ ID NO: 730676 - RNA, 22 nt, Human
acuucaaauuuucagaagaaau

SEQ ID NO: 730677 - RNA, 22 nt, Human
cagaaugcauugcuucugaugg

SEQ ID NO: 730678 - RNA, 22 nt, Human
auugacuuucccuucuccucau

SEQ ID NO: 730679 - RNA, 22 nt, Human
uggaagcggacguuguggggug

SEQ ID NO: 730680 - RNA, 22 nt, Human
ucuuccagaaugcauucucuuu

SEQ ID NO: 730681 - RNA, 22 nt, Human
uugaauugaaacauacccuggu

SEQ ID NO: 730682 - RNA, 22 nt, Human
gcuggcucgggaagcaggggau

SEQ ID NO: 730683 - RNA, 23 nt, Human
ugcugggguaguuuguggcacag

SEQ ID NO: 730684 - RNA, 20 nt, Human
agcuaggagaaagcauggag

SEQ ID NO: 730685 - RNA, 22 nt, Human
aaaugguccauccuaaagaagu

SEQ ID NO: 730686 - RNA, 22 nt, Human
gugggacagcggggugggacag

SEQ ID NO: 730687 - RNA, 22 nt, Human
acuguaaagaaguaaguauggg

SEQ ID NO: 730688 - RNA, 22 nt, Human
uagaaagugaagguuaauuaau

SEQ ID NO: 730689 - RNA, 22 nt, Human
uuuucauguuccuuguuaagug

SEQ ID NO: 730690 - RNA, 22 nt, Human
uugacuuuucuuggucacauga

SEQ ID NO: 730691 - RNA, 22 nt, Human
aaucuaacuucauagcugauuu

SEQ ID NO: 730692 - RNA, 22 nt, Human
ccaggagcaggagcuggacaga

SEQ ID NO: 730693 - RNA, 22 nt, Human
guuauuguccagcacaguuggg

SEQ ID NO: 730694 - RNA, 22 nt, Human
gcauucuugagguguggacuca

SEQ ID NO: 730695 - RNA, 22 nt, Human
agagcugcucagaugucacugc

SEQ ID NO: 730696 - RNA, 22 nt, Human
gcaugcagaaaaugaacaacga

SEQ ID NO: 730697 - RNA, 22 nt, Human
cuacaggucaguaagaccuaga

SEQ ID NO: 730698 - RNA, 22 nt, Human
ggcugagaagacaguggggugg

SEQ ID NO: 730699 - RNA, 23 nt, Human
cagcagcugccugguuuuuuggu

SEQ ID NO: 730700 - RNA, 22 nt, Human
accaggagucuagccuagucaa

SEQ ID NO: 730701 - RNA, 22 nt, Human
aauuggcuuugugguuucugca

SEQ ID NO: 730702 - RNA, 22 nt, Human
ccacccuggacaggccucugag

SEQ ID NO: 730703 - RNA, 22 nt, Human
gcaggcaguuugcuuuucccuc

SEQ ID NO: 730704 - RNA, 22 nt, Human
gcccagagggaagaggugucau

SEQ ID NO: 730705 - RNA, 22 nt, Human
auuugucugcuugcugccuucc

SEQ ID NO: 730706 - RNA, 22 nt, Human
cuguuucaaaacuaguacaaca

SEQ ID NO: 730707 - RNA, 22 nt, Human
aaagucaucagaaccuuccaga

SEQ ID NO: 730708 - RNA, 22 nt, Human
acagauuugacugguaccuggc

SEQ ID NO: 730709 - RNA, 22 nt, Human
ggcuaggccucaggccugccug

SEQ ID NO: 730710 - RNA, 22 nt, Human
ccacccuuggguucggaggccg

SEQ ID NO: 730711 - RNA, 19 nt, Human
ccagccucucuuccacccc

SEQ ID NO: 730712 - RNA, 22 nt, Human
agagcccuugcccucagucacc

SEQ ID NO: 730713 - RNA, 21 nt, Human
uacgugugugcauguuuauau

SEQ ID NO: 730714 - RNA, 22 nt, Human
agucucugcaugccugcugugc

SEQ ID NO: 730715 - RNA, 22 nt, Human
auccuucaaggggcugacagcu

SEQ ID NO: 730716 - RNA, 22 nt, Human
uuguauuugauugucauaucgu

SEQ ID NO: 730717 - RNA, 22 nt, Human
gagauggaaaacugcugguagu

SEQ ID NO: 730718 - RNA, 22 nt, Human
cagggacccuacuagcucacac

SEQ ID NO: 730719 - RNA, 22 nt, Human
ugcuuucaugaagucuauagag

SEQ ID NO: 730720 - RNA, 22 nt, Human
aggucugacucuuugccacaua

SEQ ID NO: 730721 - RNA, 17 nt, Human
cagggcugucugccuag

SEQ ID NO: 730722 - RNA, 22 nt, Human
acaggcaacuucaaaucucacu

SEQ ID NO: 730723 - RNA, 22 nt, Human
ucucugccacagcuucugccuu

SEQ ID NO: 730724 - RNA, 22 nt, Human
guucaaauugagaugguauaaa

SEQ ID NO: 730725 - RNA, 22 nt, Human
cuuauggaagaaaccucagaga

SEQ ID NO: 730726 - RNA, 22 nt, Human
auguuacugugaucaugauacu

SEQ ID NO: 730727 - RNA, 22 nt, Human
cucuguccacagguuugucccu

SEQ ID NO: 730728 - RNA, 21 nt, Human
uugaagcaaggguggcucuga

SEQ ID NO: 730729 - RNA, 22 nt, Human
ugucuuccucuuggcuugagcu

SEQ ID NO: 730730 - RNA, 22 nt, Human
cagggcacaguuauggaggugg

SEQ ID NO: 730731 - RNA, 22 nt, Human
uuugauaagagcugcugaaacu

SEQ ID NO: 730732 - RNA, 22 nt, Human
ucugagaagcgugucucuguuu

SEQ ID NO: 730733 - RNA, 22 nt, Human
ucacagaagaugcuggauguug

SEQ ID NO: 730734 - RNA, 22 nt, Human
aaguacaugcuguaaugauugg

SEQ ID NO: 730735 - RNA, 15 nt, Human
uguggcuggcuccug

SEQ ID NO: 730736 - RNA, 22 nt, Human
cuucccuuuagcauauaguagu

SEQ ID NO: 730737 - RNA, 22 nt, Human
uucuggccaaggcugccagauu

SEQ ID NO: 730738 - RNA, 22 nt, Human
ugucuuuagccacuugccucuu

SEQ ID NO: 730739 - RNA, 22 nt, Human
ggccugcuggggccucagacac

SEQ ID NO: 730740 - RNA, 22 nt, Human
ccagggcagggaccacgugucu

SEQ ID NO: 730741 - RNA, 22 nt, Human
uucauugagcuguacacuuagg

SEQ ID NO: 730742 - RNA, 22 nt, Human
acagugcacauccugagugauu

SEQ ID NO: 730743 - RNA, 22 nt, Human
gcugcugugccuggcguccugu

SEQ ID NO: 730744 - RNA, 22 nt, Human
cucacagguaccagcacccucc

SEQ ID NO: 730745 - RNA, 22 nt, Human
uccugcagugugucuccugcac

SEQ ID NO: 730746 - RNA, 22 nt, Human
cuggagaguaaucucuguguua

SEQ ID NO: 730747 - RNA, 18 nt, Human
acauacauucugucugca

SEQ ID NO: 730748 - RNA, 22 nt, Human
caguggcugugaccagggaccu

SEQ ID NO: 730749 - RNA, 19 nt, Human
uuuacucuccaaggugagu

SEQ ID NO: 730750 - RNA, 22 nt, Human
augcacugggugaggaaggaga

SEQ ID NO: 730751 - RNA, 22 nt, Human
agaucuggaacugagguuuauu

SEQ ID NO: 730752 - RNA, 22 nt, Human
agcccaggagccuuuggagggu

SEQ ID NO: 730753 - RNA, 22 nt, Human
ugcauguuugugucugagaacu

SEQ ID NO: 730754 - RNA, 20 nt, Human
ucaaagcaaagggagaugau

SEQ ID NO: 730755 - RNA, 22 nt, Human
uuuccaagacuccaguucuccc

SEQ ID NO: 730756 - RNA, 22 nt, Human
uggcaaaggggaccauguugaa

SEQ ID NO: 730757 - RNA, 22 nt, Human
uuggaaggcugaauggccucuc

SEQ ID NO: 730758 - RNA, 22 nt, Human
uccuguggcguuaucaugugau

SEQ ID NO: 730759 - RNA, 22 nt, Human
ucugggccaacccuuccauggg

SEQ ID NO: 730760 - RNA, 22 nt, Human
aguuucauguagccauauuuac

SEQ ID NO: 730761 - RNA, 22 nt, Human
cggcagugggcgccaggucucc

SEQ ID NO: 730762 - RNA, 22 nt, Human
acaauugcuaaugcuucuguug

SEQ ID NO: 730763 - RNA, 22 nt, Human
gcggggcccccggccgagcucu

SEQ ID NO: 730764 - RNA, 22 nt, Human
ucugggcaguaccccucuccua

SEQ ID NO: 730765 - RNA, 22 nt, Human
uaagacacauuggaguagauga

SEQ ID NO: 730766 - RNA, 22 nt, Human
ccuuggcaagacaguggagggu

SEQ ID NO: 730767 - RNA, 22 nt, Human
gugucccaauguucaggacggc

SEQ ID NO: 730768 - RNA, 22 nt, Human
agugucugaucaguugacuaga

SEQ ID NO: 730769 - RNA, 22 nt, Human
aagggcugcaauccaaaacacu

SEQ ID NO: 730770 - RNA, 22 nt, Human
cagcacagugcagaugcugacu

SEQ ID NO: 730771 - RNA, 23 nt, Human
gugagcagcaccaugaggcuaga

SEQ ID NO: 730772 - RNA, 22 nt, Human
aagagagaguuccuaggcaaaa

SEQ ID NO: 730773 - RNA, 22 nt, Human
uuccaagaguaaauucaaauug

SEQ ID NO: 730774 - RNA, 22 nt, Human
uaggaaggaagagccucagauu

SEQ ID NO: 730775 - RNA, 22 nt, Human
uucuuuguggcagugagcuggg

SEQ ID NO: 730776 - RNA, 22 nt, Human
auaguacaaucaguuaauuagu

SEQ ID NO: 730777 - RNA, 22 nt, Human
aucuggagcuuguuagauguuu

SEQ ID NO: 730778 - RNA, 22 nt, Human
ggggccagguccagcuuccaaa

SEQ ID NO: 730779 - RNA, 19 nt, Human
cauuuucccaucauccuuu

SEQ ID NO: 730780 - RNA, 18 nt, Human
agcucucccccacaugcc

SEQ ID NO: 730781 - RNA, 22 nt, Human
uuaaacacuggggguuaaugca

SEQ ID NO: 730782 - RNA, 22 nt, Human
uccucagaauggauggcagggg

SEQ ID NO: 730783 - RNA, 22 nt, Human
cugggcuuuugagucacaaggg

SEQ ID NO: 730784 - RNA, 22 nt, Human
agaguauugugaccauuuguca

SEQ ID NO: 730785 - RNA, 22 nt, Human
agcaacaggaccauggagccca

SEQ ID NO: 730786 - RNA, 22 nt, Human
cuaauaauagagguggcauuug

SEQ ID NO: 730787 - RNA, 19 nt, Human
uucucaguucaggagaaga

SEQ ID NO: 730788 - RNA, 22 nt, Human
aagugauuuguacaaaaugucg

SEQ ID NO: 730789 - RNA, 22 nt, Human
uaggaaauuugaaauauguggg

SEQ ID NO: 730790 - RNA, 22 nt, Human
uugcuuuaagguaucuggagaa

SEQ ID NO: 730791 - RNA, 22 nt, Human
ucucccacugcaagcccaggcu

SEQ ID NO: 730792 - RNA, 22 nt, Human
acaugauucuugauaggcauug

SEQ ID NO: 730793 - RNA, 23 nt, Human
ugcgugugugcugaggggcgucc

SEQ ID NO: 730794 - RNA, 22 nt, Human
gcagcuuuagaaacaagggcug

SEQ ID NO: 730795 - RNA, 22 nt, Human
uccagcauucuuagaccucuau

SEQ ID NO: 730796 - RNA, 22 nt, Human
auguggcuuucaugauuaagca

SEQ ID NO: 730797 - RNA, 22 nt, Human
ccacagucuagcuagaaggcau

SEQ ID NO: 730798 - RNA, 22 nt, Human
gauguucagugguugaccauaa

SEQ ID NO: 730799 - RNA, 22 nt, Human
gauuucaguggcugucucaaau

SEQ ID NO: 730800 - RNA, 22 nt, Human
augaaaaguucgaucuagaagg

SEQ ID NO: 730801 - RNA, 23 nt, Human
ggauuggccccaggaguaugggu

SEQ ID NO: 730802 - RNA, 22 nt, Human
gcaguaguucugauuggaacuu

SEQ ID NO: 730803 - RNA, 22 nt, Human
cuggcuuuuccuaaacugggaa

SEQ ID NO: 730804 - RNA, 22 nt, Human
agaggccauggggcauuuuuca

SEQ ID NO: 730805 - RNA, 22 nt, Human
aguaaucaauuuuucgguggau

SEQ ID NO: 730806 - RNA, 22 nt, Human
aagugguagacaaagauaauug

SEQ ID NO: 730807 - RNA, 22 nt, Human
aaugaacauauaaagagaucuu

SEQ ID NO: 730808 - RNA, 22 nt, Human
gaagagcauaugaagagcauau

SEQ ID NO: 730809 - RNA, 21 nt, Human
uuugaacuagagguaaauucc

SEQ ID NO: 730810 - RNA, 22 nt, Human
acuuucaacuuggugggagagc

SEQ ID NO: 730811 - RNA, 22 nt, Human
ugcagcugcaggagggugggag

SEQ ID NO: 730812 - RNA, 22 nt, Human
gaguggggcccacugcugggug

SEQ ID NO: 730813 - RNA, 22 nt, Human
uaacagaagagcaggcagcccu

SEQ ID NO: 730814 - RNA, 22 nt, Human
cuguguguccucggacgaguuu

SEQ ID NO: 730815 - RNA, 22 nt, Human
ucccacccauccugcaucucuu

SEQ ID NO: 730816 - RNA, 22 nt, Human
ucuuuagauguuuagaggaaga

SEQ ID NO: 730817 - RNA, 22 nt, Human
gcaaaggccacuggggcgaugg

SEQ ID NO: 730818 - RNA, 20 nt, Human
ugguccugucccacccacuc

SEQ ID NO: 730819 - RNA, 22 nt, Human
auguuuaaaggguugagaaaua

SEQ ID NO: 730820 - RNA, 22 nt, Human
gggcaugagcgagcugcuuuga

SEQ ID NO: 730821 - RNA, 22 nt, Human
agugugaguaauugagucuguc

SEQ ID NO: 730822 - RNA, 22 nt, Human
uaggcuguaagagagggcagag

SEQ ID NO: 730823 - RNA, 22 nt, Human
acacugugacggaaauaaagaa

SEQ ID NO: 730824 - RNA, 21 nt, Human
ugcuaggccauauugguugcu

SEQ ID NO: 730825 - RNA, 22 nt, Human
aguaaaguaccaaagugugagu

SEQ ID NO: 730826 - RNA, 22 nt, Human
uucugagcugcaacacuaacau

SEQ ID NO: 730827 - RNA, 22 nt, Human
uuucaggccauagcacagggaa

SEQ ID NO: 730828 - RNA, 22 nt, Human
ccagaggcagacuuacacucca

SEQ ID NO: 730829 - RNA, 22 nt, Human
uacaauauguggccuuuuguga

SEQ ID NO: 730830 - RNA, 22 nt, Human
ucugaggaaaagaggagguagc

SEQ ID NO: 730831 - RNA, 20 nt, Human
cacccuacggccucaccucc

SEQ ID NO: 730832 - RNA, 22 nt, Human
auguuuaugcaaacaugugagu

SEQ ID NO: 730833 - RNA, 22 nt, Human
ggcuucucuaaagaucaugcgu

SEQ ID NO: 730834 - RNA, 22 nt, Human
cacaggaaaaauggguccuuua

SEQ ID NO: 730835 - RNA, 22 nt, Human
uuugaaaggguuaugagacuga

SEQ ID NO: 730836 - RNA, 22 nt, Human
uagggcagagcuuguacacgau

SEQ ID NO: 730837 - RNA, 22 nt, Human
gaggcucaguuaugucaucagg

SEQ ID NO: 730838 - RNA, 22 nt, Human
auguagaagcugacagugcugu

SEQ ID NO: 730839 - RNA, 22 nt, Human
aggcacugugcugaugucuuau

SEQ ID NO: 730840 - RNA, 22 nt, Human
cacuuagucucaccaguucagu

SEQ ID NO: 730841 - RNA, 22 nt, Human
agcuggagaucaugcugauacu

SEQ ID NO: 730842 - RNA, 20 nt, Human
agaagcaucauucugauguc

SEQ ID NO: 730843 - RNA, 22 nt, Human
cagugcccuuccaggacugcag

SEQ ID NO: 730844 - RNA, 22 nt, Human
gccacccugcaaaugcccagga

SEQ ID NO: 730845 - RNA, 22 nt, Human
auucuuguuuaauuugcauccc

SEQ ID NO: 730846 - RNA, 22 nt, Human
acuauacauaaaacauuugggu

SEQ ID NO: 730847 - RNA, 22 nt, Human
uauucucuccccaaucuugcuu

SEQ ID NO: 730848 - RNA, 22 nt, Human
acugcucucuuugcaggggcua

SEQ ID NO: 730849 - RNA, 22 nt, Human
aggcugugggaauggcugcuug

SEQ ID NO: 730850 - RNA, 22 nt, Human
uuucucaaguucagauauuuga

SEQ ID NO: 730851 - RNA, 22 nt, Human
agggaauggaugauggcagguu

SEQ ID NO: 730852 - RNA, 20 nt, Human
ccugccuguguuugugauga

SEQ ID NO: 730853 - RNA, 22 nt, Human
cagucagaaggaagaugcuuaa

SEQ ID NO: 730854 - RNA, 22 nt, Human
auggccuuucucaguggugcuu

SEQ ID NO: 730855 - RNA, 22 nt, Human
ugcuuaaaauuuuccaaggauu

SEQ ID NO: 730856 - RNA, 22 nt, Human
aaguaaaauucaaucuucacug

SEQ ID NO: 730857 - RNA, 20 nt, Human
acaguccugcacugguguuu

SEQ ID NO: 730858 - RNA, 22 nt, Human
accugggaggcggagguugcag

SEQ ID NO: 730859 - RNA, 22 nt, Human
gggcgggguggcucaugccugu

SEQ ID NO: 730860 - RNA, 22 nt, Human
uucagcucugcuagcucugugc

SEQ ID NO: 730861 - RNA, 22 nt, Human
cugcaguaacgaucauggugcc

SEQ ID NO: 730862 - RNA, 22 nt, Human
aaguguguuuccgugauugagg

SEQ ID NO: 730863 - RNA, 18 nt, Human
ccagugccaagaguggca

SEQ ID NO: 730864 - RNA, 22 nt, Human
gccaggcugccuuaucucuagc

SEQ ID NO: 730865 - RNA, 22 nt, Human
cauguaaaaaauuaggucaucu

SEQ ID NO: 730866 - RNA, 22 nt, Human
uggauugcagcagcuccugugg

SEQ ID NO: 730867 - RNA, 22 nt, Human
cugggcacuuuggggagccuac

SEQ ID NO: 730868 - RNA, 22 nt, Human
aaucccagcuacucaggaaguu

SEQ ID NO: 730869 - RNA, 22 nt, Human
uagcaucuguacugacauaauc

SEQ ID NO: 730870 - RNA, 22 nt, Human
gugaaguugauuguuaucguca

SEQ ID NO: 730871 - RNA, 22 nt, Human
ugccuucuucucccuggcucag

SEQ ID NO: 730872 - RNA, 22 nt, Human
uuuguucuaacuucugcagaca

SEQ ID NO: 730873 - RNA, 22 nt, Human
gcaagcagcccagaacagcucu

SEQ ID NO: 730874 - RNA, 22 nt, Human
uucacaguggcugugccauuug

SEQ ID NO: 730875 - RNA, 22 nt, Human
ggccugggcccacugucaagag

SEQ ID NO: 730876 - RNA, 22 nt, Human
gaacacugagaaagucagcuuu

SEQ ID NO: 730877 - RNA, 22 nt, Human
ccuuccaguauguuaagauggu

SEQ ID NO: 730878 - RNA, 22 nt, Human
augauggaggccgugauggacg

SEQ ID NO: 730879 - RNA, 22 nt, Human
gaaggaaaaauacucuguaagg

SEQ ID NO: 730880 - RNA, 22 nt, Human
uggaucaugugaugucaggagu

SEQ ID NO: 730881 - RNA, 22 nt, Human
acugcuuacaaaaggaaagaau

SEQ ID NO: 730882 - RNA, 22 nt, Human
ugucauuuaucuuauaguaauc

SEQ ID NO: 730883 - RNA, 22 nt, Human
aacgcccgugguugccaaggua

SEQ ID NO: 730884 - RNA, 22 nt, Human
gagcugagcuuaacuccuugaa

SEQ ID NO: 730885 - RNA, 22 nt, Human
aaagggagcauggcugcaggga

SEQ ID NO: 730886 - RNA, 22 nt, Human
gcccuccaccuggucucucugg

SEQ ID NO: 730887 - RNA, 22 nt, Human
ugauucugccacguacuggcug

SEQ ID NO: 730888 - RNA, 22 nt, Human
ccagcagacacacaggcguggg

SEQ ID NO: 730889 - RNA, 21 nt, Human
uguaugcacgcacaugcacac

SEQ ID NO: 730890 - RNA, 22 nt, Human
uuuggagagaugaaguucugug

SEQ ID NO: 730891 - RNA, 22 nt, Human
ugucccaggccucauguugcca

SEQ ID NO: 730892 - RNA, 22 nt, Human
cagcaucuggauuuccuccacu

SEQ ID NO: 730893 - RNA, 22 nt, Human
aaccaugaauggguucuggugu

SEQ ID NO: 730894 - RNA, 22 nt, Human
auggcaagcaagcugaagagau

SEQ ID NO: 730895 - RNA, 23 nt, Human
uuacaugugugcacacauucugg

SEQ ID NO: 730896 - RNA, 21 nt, Human
ucacuuauaauguauuugcug

SEQ ID NO: 730897 - RNA, 22 nt, Human
uaucaaaggcuaugugauuuuu

SEQ ID NO: 730898 - RNA, 22 nt, Human
uacuuuuaugugaugaaaucug

SEQ ID NO: 730899 - RNA, 22 nt, Human
uggaaagacauucagccgcugg

SEQ ID NO: 730900 - RNA, 22 nt, Human
aaguccagaacuccugugauag

SEQ ID NO: 730901 - RNA, 22 nt, Human
gaaguucaggugggaauugagc

SEQ ID NO: 730902 - RNA, 22 nt, Human
uguguccaucugacaggagagg

SEQ ID NO: 730903 - RNA, 22 nt, Human
cagcuugggaguuugguuuuau

SEQ ID NO: 730904 - RNA, 22 nt, Human
caucauugccuguuucccuugg

SEQ ID NO: 730905 - RNA, 18 nt, Human
cuccuuucccuacaccuc

SEQ ID NO: 730906 - RNA, 22 nt, Human
acaguguccccagcucugugag

SEQ ID NO: 730907 - RNA, 22 nt, Human
cucugugagggucuguacagaa

SEQ ID NO: 730908 - RNA, 22 nt, Human
acaggcagggaccuuggcuaag

SEQ ID NO: 730909 - RNA, 22 nt, Human
aaaggcauggauagugaauuca

SEQ ID NO: 730910 - RNA, 20 nt, Human
ugugaggagcauggccgcug

SEQ ID NO: 730911 - RNA, 17 nt, Human
ugcagcaguucccaucu

SEQ ID NO: 730912 - RNA, 22 nt, Human
uguucucucuccuuuugaagug

SEQ ID NO: 730913 - RNA, 22 nt, Human
cucuuggccagacacagaggca

SEQ ID NO: 730914 - RNA, 22 nt, Human
ugugagaggagaaaugcauuaa

SEQ ID NO: 730915 - RNA, 22 nt, Human
acaggacauguaccaggugguc

SEQ ID NO: 730916 - RNA, 23 nt, Human
uccugagaugagacagugcugcc

SEQ ID NO: 730917 - RNA, 22 nt, Human
ugucauggggaaaauaacagac

SEQ ID NO: 730918 - RNA, 22 nt, Human
agcugggcgcaguggcugguga

SEQ ID NO: 730919 - RNA, 22 nt, Human
ugcuucugauucaugguuauug

SEQ ID NO: 730920 - RNA, 17 nt, Human
gcacugagccacaguuu

SEQ ID NO: 730921 - RNA, 23 nt, Human
aguguguauugcugagggcagcu

SEQ ID NO: 730922 - RNA, 22 nt, Human
agagccugguucaaauuuuacc

SEQ ID NO: 730923 - RNA, 22 nt, Human
ccccagccagcaggaccucuga

SEQ ID NO: 730924 - RNA, 22 nt, Human
aucacaguguagaccuuuuaaa

SEQ ID NO: 730925 - RNA, 22 nt, Human
uggcccucagucuugcuccugc

SEQ ID NO: 730926 - RNA, 20 nt, Human
gcugggggugugcugaguga

SEQ ID NO: 730927 - RNA, 22 nt, Human
ugagacaaccuaauuaaacacc

SEQ ID NO: 730928 - RNA, 22 nt, Human
acuguggggugaggcccaagaa

SEQ ID NO: 730929 - RNA, 22 nt, Human
uagauuaagaugccaguuuuga

SEQ ID NO: 730930 - RNA, 22 nt, Human
uaugugcaaauuaauugcuaga

SEQ ID NO: 730931 - RNA, 22 nt, Human
cccacccugggaagcuaggcag

SEQ ID NO: 730932 - RNA, 22 nt, Human
ucaguguuuauugcggugugua

SEQ ID NO: 730933 - RNA, 22 nt, Human
gcagugaagauuugggcucugg

SEQ ID NO: 730934 - RNA, 22 nt, Human
gauggaggagauggcagggugc

SEQ ID NO: 730935 - RNA, 22 nt, Human
uuaauacacuauaugaucacau

SEQ ID NO: 730936 - RNA, 22 nt, Human
uguuaaaaauucagcucuagau

SEQ ID NO: 730937 - RNA, 22 nt, Human
uuaguucacugcuauaucauca

SEQ ID NO: 730938 - RNA, 22 nt, Human
acaggcuguacuucuaaucauc

SEQ ID NO: 730939 - RNA, 17 nt, Human
acaggccugcuugcacu

SEQ ID NO: 730940 - RNA, 22 nt, Human
cucuucuuggaaugcugacugu

SEQ ID NO: 730941 - RNA, 22 nt, Human
uaaaugaagcucaugggccaca

SEQ ID NO: 730942 - RNA, 23 nt, Human
cccagcagauuguaaagugucca

SEQ ID NO: 730943 - RNA, 22 nt, Human
gcaucuaauccaguccagcauc

SEQ ID NO: 730944 - RNA, 22 nt, Human
aguggcuuuuuaguggcagaug

SEQ ID NO: 730945 - RNA, 22 nt, Human
cuucugggcagaaguuuugaga

SEQ ID NO: 730946 - RNA, 22 nt, Human
cagugguuccuguucuucuggg

SEQ ID NO: 730947 - RNA, 23 nt, Human
ucacuugaagcuagaaucugccc

SEQ ID NO: 730948 - RNA, 22 nt, Human
uucugacaugugagauuuuguu

SEQ ID NO: 730949 - RNA, 22 nt, Human
uauuucauucuuuaucaggagc

SEQ ID NO: 730950 - RNA, 22 nt, Human
uucuucaaaauccagcaugauu

SEQ ID NO: 730951 - RNA, 19 nt, Human
aggauggagcaggcgguga

SEQ ID NO: 730952 - RNA, 22 nt, Human
cuccaggauguuagacguccag

SEQ ID NO: 730953 - RNA, 22 nt, Human
cuagcccaggaaugccguggcc

SEQ ID NO: 730954 - RNA, 22 nt, Human
uauccguuguuaccagauaaga

SEQ ID NO: 730955 - RNA, 22 nt, Human
cauucauacaaguuuguuucau

SEQ ID NO: 730956 - RNA, 22 nt, Human
caggcucugcugcuacagcugu

SEQ ID NO: 730957 - RNA, 22 nt, Human
ggccaggagauggacaccacau

SEQ ID NO: 730958 - RNA, 22 nt, Human
gccggggcuggggagagacaug

SEQ ID NO: 730959 - RNA, 22 nt, Human
uucagagacauguucuagauca

SEQ ID NO: 730960 - RNA, 22 nt, Human
cugugcugcagacgcaguagcu

SEQ ID NO: 730961 - RNA, 22 nt, Human
uaccaccucaaccucaucugac

SEQ ID NO: 730962 - RNA, 22 nt, Human
gcaguaguucgucuguguuccc

SEQ ID NO: 730963 - RNA, 22 nt, Human
uccaagucuuccuucccaaacc

SEQ ID NO: 730964 - RNA, 22 nt, Human
cagagcugguaagugguagagg

SEQ ID NO: 730965 - RNA, 22 nt, Human
uaaggcaggcuuucauccagag

SEQ ID NO: 730966 - RNA, 21 nt, Human
gaaucuuugauuuacauggga

SEQ ID NO: 730967 - RNA, 22 nt, Human
aggaaacugggccucagguuag

SEQ ID NO: 730968 - RNA, 22 nt, Human
ugcucuggcuggagcaaugacu

SEQ ID NO: 730969 - RNA, 19 nt, Human
aggcaggugcagagguccc

SEQ ID NO: 730970 - RNA, 22 nt, Human
auucugucuuuuuaaaauaaua

SEQ ID NO: 730971 - RNA, 22 nt, Human
auuuuguugaugguggaguagc

SEQ ID NO: 730972 - RNA, 22 nt, Human
ugaaggaggaauguggccucca

SEQ ID NO: 730973 - RNA, 22 nt, Human
aauauuguuucaagaucacaga

SEQ ID NO: 730974 - RNA, 21 nt, Human
agccuggcccagggggaggcu

SEQ ID NO: 730975 - RNA, 22 nt, Human
agggggagacauguguguguuu

SEQ ID NO: 730976 - RNA, 18 nt, Human
acuucccagaugagggga

SEQ ID NO: 730977 - RNA, 22 nt, Human
aaaguguugggauuacaggugu

SEQ ID NO: 730978 - RNA, 22 nt, Human
agcuucucucaggguaucuuuc

SEQ ID NO: 730979 - RNA, 22 nt, Human
cagcuggucaacugaaugaaca

SEQ ID NO: 730980 - RNA, 22 nt, Human
agagugguacuucuuuuucuuc

SEQ ID NO: 730981 - RNA, 22 nt, Human
gaugugagugguagcugggauu

SEQ ID NO: 730982 - RNA, 22 nt, Human
uccaggcuggccucgcgugaca

SEQ ID NO: 730983 - RNA, 22 nt, Human
auguggcuaguccucugcggca

SEQ ID NO: 730984 - RNA, 22 nt, Human
agcuacagucggaaggacagac

SEQ ID NO: 730985 - RNA, 22 nt, Human
gagcuggcacagaaggaucuua

SEQ ID NO: 730986 - RNA, 22 nt, Human
uugaggucaaagaagugagugg

SEQ ID NO: 730987 - RNA, 22 nt, Human
aaucucuuuggcucaaggaucc

SEQ ID NO: 730988 - RNA, 22 nt, Human
ccaggcuccgcauagaccccac

SEQ ID NO: 730989 - RNA, 22 nt, Human
guuugcauuuauuagucuucug

SEQ ID NO: 730990 - RNA, 22 nt, Human
auuaacaugcagccagacacac

SEQ ID NO: 730991 - RNA, 22 nt, Human
uggcagcacggcauccacucuc

SEQ ID NO: 730992 - RNA, 22 nt, Human
agggcccucuggcaggccaggc

SEQ ID NO: 730993 - RNA, 22 nt, Human
ugugcagaguaaggcagcuguu

SEQ ID NO: 730994 - RNA, 23 nt, Human
uauuagggccaggacuggcaaau

SEQ ID NO: 730995 - RNA, 22 nt, Human
uuuacuuugugucaagucaaga

SEQ ID NO: 730996 - RNA, 22 nt, Human
aagaaagggcuauuguucucca

SEQ ID NO: 730997 - RNA, 22 nt, Human
ucagugcagacuguaaguugga

SEQ ID NO: 730998 - RNA, 22 nt, Human
uagcucugugcucuggaucugu

SEQ ID NO: 730999 - RNA, 22 nt, Human
uggcaccagcaccuagaugggg

SEQ ID NO: 731000 - RNA, 22 nt, Human
acacacuguugcucauccaggc

SEQ ID NO: 731001 - RNA, 23 nt, Human
ggccacugaauuuucugcaucuu

SEQ ID NO: 731002 - RNA, 23 nt, Human
cugcugugaaacaugguuuuggu

SEQ ID NO: 731003 - RNA, 22 nt, Human
aucuggcuuucuuaaugacuua

SEQ ID NO: 731004 - RNA, 22 nt, Human
ucacuaaugagcuaaggaaaag

SEQ ID NO: 731005 - RNA, 22 nt, Human
cugcccauucaaccagcuacag

SEQ ID NO: 731006 - RNA, 22 nt, Human
ucagaacagaagaaggaacacg

SEQ ID NO: 731007 - RNA, 22 nt, Human
acauaugugucugcacaugccc

SEQ ID NO: 731008 - RNA, 22 nt, Human
ucaauucugguccucaggaacu

SEQ ID NO: 731009 - RNA, 22 nt, Human
ucugagaagcgggagccuguga

SEQ ID NO: 731010 - RNA, 22 nt, Human
ccaaaccauccaucuccaggcu

SEQ ID NO: 731011 - RNA, 22 nt, Human
aaugaucccauuuagaaacaga

SEQ ID NO: 731012 - RNA, 22 nt, Human
uggguccuggcuuugucagggu

SEQ ID NO: 731013 - RNA, 19 nt, Human
aaaaacuuaguccagaaag

SEQ ID NO: 731014 - RNA, 22 nt, Human
ucccuggguuaccuuucaaggu

SEQ ID NO: 731015 - RNA, 22 nt, Human
cugccacuuuggagugcucaga

SEQ ID NO: 731016 - RNA, 22 nt, Human
ccacugagguuuugugguuaug

SEQ ID NO: 731017 - RNA, 22 nt, Human
gggacuguccggcagaagguac

SEQ ID NO: 731018 - RNA, 22 nt, Human
gagaggaaagauauauacuucu

SEQ ID NO: 731019 - RNA, 22 nt, Human
uaguuacagugcauagcaagau

SEQ ID NO: 731020 - RNA, 22 nt, Human
ugaguucaaguccaaguugcug

SEQ ID NO: 731021 - RNA, 22 nt, Human
uccugggugaaagaacaggcag

SEQ ID NO: 731022 - RNA, 22 nt, Human
ccaucccuucaccacagcagua

SEQ ID NO: 731023 - RNA, 22 nt, Human
aaauacagauuccagggucuua

SEQ ID NO: 731024 - RNA, 23 nt, Human
ucagagaaguuguaggcugggga

SEQ ID NO: 731025 - RNA, 22 nt, Human
gaccugcccacucugaggacau

SEQ ID NO: 731026 - RNA, 22 nt, Human
gcaggaguguauuugcauguaa

SEQ ID NO: 731027 - RNA, 22 nt, Human
ggcucuucacacagugauguca

SEQ ID NO: 731028 - RNA, 22 nt, Human
aggaugagaagauuggaaucuu

SEQ ID NO: 731029 - RNA, 22 nt, Human
uccacuuuagcaaugauugaau

SEQ ID NO: 731030 - RNA, 22 nt, Human
uguguucauguauguauacaua

SEQ ID NO: 731031 - RNA, 22 nt, Human
gcugccugaaugaaccuuguuc

SEQ ID NO: 731032 - RNA, 20 nt, Human
caccuggcugacugucucca

SEQ ID NO: 731033 - RNA, 21 nt, Human
gccuggcucucacuggccugg

SEQ ID NO: 731034 - RNA, 22 nt, Human
aggccagaaauuuggaguaugu

SEQ ID NO: 731035 - RNA, 22 nt, Human
acauuugacuguagauacuugc

SEQ ID NO: 731036 - RNA, 17 nt, Human
ggagacagggucuuuaa

SEQ ID NO: 731037 - RNA, 22 nt, Human
ggcccacuugaaauggagcuca

SEQ ID NO: 731038 - RNA, 22 nt, Human
auucaaacaggccaauugaccu

SEQ ID NO: 731039 - RNA, 22 nt, Human
gggcucucgauuagacccuggg

SEQ ID NO: 731040 - RNA, 22 nt, Human
guuucuuagacagacauuaucu

SEQ ID NO: 731041 - RNA, 22 nt, Human
uucacacuuuggaauuccaccu

SEQ ID NO: 731042 - RNA, 22 nt, Human
uacuuugaauuaaauauuucag

SEQ ID NO: 731043 - RNA, 22 nt, Human
uugggagcuuggccgagaugua

SEQ ID NO: 731044 - RNA, 22 nt, Human
cagggaugucucuggaagggag

SEQ ID NO: 731045 - RNA, 22 nt, Human
uaugaauauaccacaauuuagg

SEQ ID NO: 731046 - RNA, 22 nt, Human
uuuguguuguuuuaagccacua

SEQ ID NO: 731047 - RNA, 22 nt, Human
guuugugucaaugacuucugca

SEQ ID NO: 731048 - RNA, 22 nt, Human
acuuuaaaacugaucaucagag

SEQ ID NO: 731049 - RNA, 22 nt, Human
acuguguccuauuuccuugaca

SEQ ID NO: 731050 - RNA, 22 nt, Human
ucugggaaaugcuguuccuugu

SEQ ID NO: 731051 - RNA, 22 nt, Human
cagugguuuaggucaaggggag

SEQ ID NO: 731052 - RNA, 22 nt, Human
ucccacucccaggcaggccucu

SEQ ID NO: 731053 - RNA, 22 nt, Human
uagcugccaaaagggugggcua

SEQ ID NO: 731054 - RNA, 22 nt, Human
uccacagaauguaagauccaca

SEQ ID NO: 731055 - RNA, 22 nt, Human
acagagcauaaugucuagcaca

SEQ ID NO: 731056 - RNA, 22 nt, Human
uucugugaaucuuuuuucccac

SEQ ID NO: 731057 - RNA, 22 nt, Human
gggcguggauggucagugcagg

SEQ ID NO: 731058 - RNA, 22 nt, Human
ggcucugcccgcggcugcccac

SEQ ID NO: 731059 - RNA, 22 nt, Human
cagucagggacaccagcuagga

SEQ ID NO: 731060 - RNA, 22 nt, Human
ggcuuuauuugcagccauuguu

SEQ ID NO: 731061 - RNA, 22 nt, Human
caaagguuucacaguagcccau

SEQ ID NO: 731062 - RNA, 22 nt, Human
gcucuagguuccuagccaaguc

SEQ ID NO: 731063 - RNA, 22 nt, Human
ugaguaauucacaaaacagaug

SEQ ID NO: 731064 - RNA, 22 nt, Human
aggcuggucuauacggagacga

SEQ ID NO: 731065 - RNA, 23 nt, Human
gauaggcugguuaguguaucugu

SEQ ID NO: 731066 - RNA, 23 nt, Human
ggagcccugagcuguccccaugc

SEQ ID NO: 731067 - RNA, 19 nt, Human
uuuucacauacuggauccu

SEQ ID NO: 731068 - RNA, 22 nt, Human
agccaaggcagcuagagcucug

SEQ ID NO: 731069 - RNA, 21 nt, Human
uacacaaagcgugguccagag

SEQ ID NO: 731070 - RNA, 22 nt, Human
aaagucaagguuuagacuagag

SEQ ID NO: 731071 - RNA, 19 nt, Human
ucucugugucucuguuuau

SEQ ID NO: 731072 - RNA, 22 nt, Human
aggagggcuaggaaaaccagga

SEQ ID NO: 731073 - RNA, 22 nt, Human
gucugcuggcacgucacagaua

SEQ ID NO: 731074 - RNA, 22 nt, Human
uuuggggagacauggccagcug

SEQ ID NO: 731075 - RNA, 22 nt, Human
cugaaguucuacaagccucagg

SEQ ID NO: 731076 - RNA, 22 nt, Human
uugcaaaucagaaguauagauu

SEQ ID NO: 731077 - RNA, 22 nt, Human
accagagcagacuacuggaggu

SEQ ID NO: 731078 - RNA, 20 nt, Human
guuuuaaggcacaggccuuu

SEQ ID NO: 731079 - RNA, 22 nt, Human
aggauuuggggaagaaaacacu

SEQ ID NO: 731080 - RNA, 22 nt, Human
cuaguuguuuaauauugauuga

SEQ ID NO: 731081 - RNA, 22 nt, Human
ucugauaacaaccaugucuggc

SEQ ID NO: 731082 - RNA, 22 nt, Human
ccugcagagcaggagaggcauc

SEQ ID NO: 731083 - RNA, 23 nt, Human
cagaaaucugaaaucuagaaaug

SEQ ID NO: 731084 - RNA, 22 nt, Human
uuggccuuugucaucaagauca

SEQ ID NO: 731085 - RNA, 22 nt, Human
agagccagcaagugaauaguga

SEQ ID NO: 731086 - RNA, 22 nt, Human
uucuuuuagucauucagggaag

SEQ ID NO: 731087 - RNA, 22 nt, Human
auguuauuaaaguacagauucu

SEQ ID NO: 731088 - RNA, 22 nt, Human
ucaguugcuaaaugguguagug

SEQ ID NO: 731089 - RNA, 22 nt, Human
uccuggagcuuccuucauggua

SEQ ID NO: 731090 - RNA, 22 nt, Human
gagcugaauugaagcaaggagc

SEQ ID NO: 731091 - RNA, 22 nt, Human
cuuucauuugauaagaaugcca

SEQ ID NO: 731092 - RNA, 22 nt, Human
augggaggaucacuugaggcca

SEQ ID NO: 731093 - RNA, 22 nt, Human
agggcuggcuccguuaccuuga

SEQ ID NO: 731094 - RNA, 22 nt, Human
uagaucaucagugggcucuuau

SEQ ID NO: 731095 - RNA, 22 nt, Human
ucaaauuaguggaauaauaaug

SEQ ID NO: 731096 - RNA, 22 nt, Human
ggucccuggaaggccaagcuug

SEQ ID NO: 731097 - RNA, 22 nt, Human
agaaaguuugagaacuguagau

SEQ ID NO: 731098 - RNA, 18 nt, Human
uucuuuucaugugaucuc

SEQ ID NO: 731099 - RNA, 22 nt, Human
guccaagucuuccuucccaaac

SEQ ID NO: 731100 - RNA, 22 nt, Human
cggcagcaaaggaagccagguc

SEQ ID NO: 731101 - RNA, 22 nt, Human
ggagugggaacaaugacauggu

SEQ ID NO: 731102 - RNA, 22 nt, Human
ggcagaggaaggaugaauucac

SEQ ID NO: 731103 - RNA, 22 nt, Human
uccuguguucuagguauggucu

SEQ ID NO: 731104 - RNA, 22 nt, Human
uuggcagggccaggcucucucu

SEQ ID NO: 731105 - RNA, 22 nt, Human
caggcagagguaccaagauuga

SEQ ID NO: 731106 - RNA, 22 nt, Human
gaucaguaagugaauaaugagu

SEQ ID NO: 731107 - RNA, 18 nt, Human
ugaucuuugaguauaaug

SEQ ID NO: 731108 - RNA, 22 nt, Human
cagagccauccaggugccuguu

SEQ ID NO: 731109 - RNA, 20 nt, Human
aacugagaguucaggaggag

SEQ ID NO: 731110 - RNA, 22 nt, Human
aacaaaguagcugcuguucuua

SEQ ID NO: 731111 - RNA, 22 nt, Human
cugagcuggucuauggacuugg

SEQ ID NO: 731112 - RNA, 22 nt, Human
uaaagccaacacuuuacugcuc

SEQ ID NO: 731113 - RNA, 22 nt, Human
ucacaugccacagaugaggcaa

SEQ ID NO: 731114 - RNA, 22 nt, Human
auuucacaucuaucucagauuu

SEQ ID NO: 731115 - RNA, 22 nt, Human
ggcagacaccuuuaugucuaau

SEQ ID NO: 731116 - RNA, 22 nt, Human
acuuuccuuauggauggggaaa

SEQ ID NO: 731117 - RNA, 23 nt, Human
gugugccuuuaucuucuguacuc

SEQ ID NO: 731118 - RNA, 22 nt, Human
cugaggcagagaaugaguuugu

SEQ ID NO: 731119 - RNA, 22 nt, Human
caggagucuguuccucauuugu

SEQ ID NO: 731120 - RNA, 22 nt, Human
ucugcuuuagaauccaguagcu

SEQ ID NO: 731121 - RNA, 22 nt, Human
caguaugacuacaaacagcuuu

SEQ ID NO: 731122 - RNA, 22 nt, Human
ucgauagaaaagagcugcaggg

SEQ ID NO: 731123 - RNA, 22 nt, Human
uuuuggaaucauuuacagagca

SEQ ID NO: 731124 - RNA, 22 nt, Human
cucuguagaaacagggcagaag

SEQ ID NO: 731125 - RNA, 22 nt, Human
gucucuucuuugccgguccugc

SEQ ID NO: 731126 - RNA, 22 nt, Human
uuaugcuguuaggaaaaucaaa

SEQ ID NO: 731127 - RNA, 22 nt, Human
agccacuccuucagcgucugcu

SEQ ID NO: 731128 - RNA, 22 nt, Human
cuaguggaaacuaacuggaauu

SEQ ID NO: 731129 - RNA, 22 nt, Human
uggcucuguggauguucugacc

SEQ ID NO: 731130 - RNA, 20 nt, Human
ucagacuugauucuaugcua

SEQ ID NO: 731131 - RNA, 22 nt, Human
agugccucuugucuacgguuuu

SEQ ID NO: 731132 - RNA, 22 nt, Human
ugagagcacacagaaauauuuu

SEQ ID NO: 731133 - RNA, 22 nt, Human
auuuucugugugcagauaaaua

SEQ ID NO: 731134 - RNA, 22 nt, Human
gccaccagguucuggguuaagc

SEQ ID NO: 731135 - RNA, 22 nt, Human
ugccaggcccagcuccagagcu

SEQ ID NO: 731136 - RNA, 22 nt, Human
uacauugaauuuuuuagcaugu

SEQ ID NO: 731137 - RNA, 22 nt, Human
cugaagccacgauagcuuccua

SEQ ID NO: 731138 - RNA, 22 nt, Human
aauguguguucggggcccagag

SEQ ID NO: 731139 - RNA, 22 nt, Human
aggcaggcccucuggaaaggua

SEQ ID NO: 731140 - RNA, 22 nt, Human
caucacaugccuaucaugagcu

SEQ ID NO: 731141 - RNA, 22 nt, Human
acuggcaguagagggagcgcau

SEQ ID NO: 731142 - RNA, 22 nt, Human
aaacagcagcuguuuaauuugc

SEQ ID NO: 731143 - RNA, 22 nt, Human
gugucaaugagguuuauuuuug

SEQ ID NO: 731144 - RNA, 17 nt, Human
caggcacaugaagccag

SEQ ID NO: 731145 - RNA, 22 nt, Human
uaaggguucagaaugcaguggu

SEQ ID NO: 731146 - RNA, 22 nt, Human
aggccaggcgagacacccggcu

SEQ ID NO: 731147 - RNA, 22 nt, Human
uuaagagacaggagaaugaugu

SEQ ID NO: 731148 - RNA, 22 nt, Human
uugcuauuuugagagucauagu

SEQ ID NO: 731149 - RNA, 22 nt, Human
agggucccgaaggagacagcaa

SEQ ID NO: 731150 - RNA, 22 nt, Human
acaggucaacgagagcaggcaa

SEQ ID NO: 731151 - RNA, 20 nt, Human
gccugcagagaaggucagag

SEQ ID NO: 731152 - RNA, 19 nt, Human
ggacauuugaguuguuuau

SEQ ID NO: 731153 - RNA, 22 nt, Human
aaggcaucuggauggaggagga

SEQ ID NO: 731154 - RNA, 22 nt, Human
aaagaauagccuuuguccaaau

SEQ ID NO: 731155 - RNA, 22 nt, Human
acauuacauaagauuguaaccu

SEQ ID NO: 731156 - RNA, 22 nt, Human
ugauucaagccaccacauacug

SEQ ID NO: 731157 - RNA, 22 nt, Human
acaguguucaaaccacuaggcu

SEQ ID NO: 731158 - RNA, 21 nt, Human
auccauccaucuuggccuaac

SEQ ID NO: 731159 - RNA, 22 nt, Human
uggaaagagguagaggaucugg

SEQ ID NO: 731160 - RNA, 22 nt, Human
auauagacagaugacagggaua

SEQ ID NO: 731161 - RNA, 22 nt, Human
aauuacaaauguagacucucau

SEQ ID NO: 731162 - RNA, 18 nt, Human
uucucagacuuuggaagu

SEQ ID NO: 731163 - RNA, 22 nt, Human
ugggagagcuucaugccuucag

SEQ ID NO: 731164 - RNA, 22 nt, Human
agcuuugguugaggggagugug

SEQ ID NO: 731165 - RNA, 17 nt, Human
aagaacacucaauagca

SEQ ID NO: 731166 - RNA, 21 nt, Human
gugcagaggaauguagggggc

SEQ ID NO: 731167 - RNA, 22 nt, Human
uauggcuuuaaacaacuuaggu

SEQ ID NO: 731168 - RNA, 22 nt, Human
uuucugccaaccauuuaaacuc

SEQ ID NO: 731169 - RNA, 22 nt, Human
caccccugggcugggcacacag

SEQ ID NO: 731170 - RNA, 22 nt, Human
gacaguaguaaagcuaggacca

SEQ ID NO: 731171 - RNA, 22 nt, Human
cagccacugaacuccuggcuau

SEQ ID NO: 731172 - RNA, 22 nt, Human
caguauagaaaguuuuaaauug

SEQ ID NO: 731173 - RNA, 22 nt, Human
cuccaggagcugugucuuucuu

SEQ ID NO: 731174 - RNA, 20 nt, Human
uucccuggaaggagaagcag

SEQ ID NO: 731175 - RNA, 22 nt, Human
uccuccucacgcuguugcuugu

SEQ ID NO: 731176 - RNA, 22 nt, Human
gacagggccgcagauggagacu

SEQ ID NO: 731177 - RNA, 22 nt, Human
uucuguucuuuauuuaccauau

SEQ ID NO: 731178 - RNA, 22 nt, Human
uugcuguuuaaugaugucuuau

SEQ ID NO: 731179 - RNA, 22 nt, Human
agggacucgguugagugccccu

SEQ ID NO: 731180 - RNA, 22 nt, Human
acugugcauuccccaaccugug

SEQ ID NO: 731181 - RNA, 22 nt, Human
gucucuguuauuuccaggguca

SEQ ID NO: 731182 - RNA, 22 nt, Human
aucugaauaaauuucuuuuagu

SEQ ID NO: 731183 - RNA, 22 nt, Human
auugcuuacagcuauuucugua

SEQ ID NO: 731184 - RNA, 22 nt, Human
cagcucuuccucccaccggaca

SEQ ID NO: 731185 - RNA, 19 nt, Human
gcaggauaggcugagacua

SEQ ID NO: 731186 - RNA, 22 nt, Human
cuggcuuugguccccugugccu

SEQ ID NO: 731187 - RNA, 22 nt, Human
cuaaagcaacugagacacauag

SEQ ID NO: 731188 - RNA, 23 nt, Human
uugaggacaauuuacaugguguu

SEQ ID NO: 731189 - RNA, 22 nt, Human
gggcagcaguugcccuaaucaa

SEQ ID NO: 731190 - RNA, 22 nt, Human
acagugucugacacauuguagc

SEQ ID NO: 731191 - RNA, 22 nt, Human
acagccuguguaccagcuggga

SEQ ID NO: 731192 - RNA, 22 nt, Human
cuggcucucugagauauugagu

SEQ ID NO: 731193 - RNA, 22 nt, Human
auuucuguaguccacauucuuu

SEQ ID NO: 731194 - RNA, 22 nt, Human
auucuggaagcaagcuuuuaaa

SEQ ID NO: 731195 - RNA, 18 nt, Human
guuuccugaggugaaggg

SEQ ID NO: 731196 - RNA, 22 nt, Human
cuuccagagauagggccucaag

SEQ ID NO: 731197 - RNA, 22 nt, Human
aaccugcauguuucuaaaagca

SEQ ID NO: 731198 - RNA, 22 nt, Human
ugguggcagucuccuggcugug

SEQ ID NO: 731199 - RNA, 22 nt, Human
ucaggagcaacaucuuugaauc

SEQ ID NO: 731200 - RNA, 22 nt, Human
ggaaccacagcccccagcaggc

SEQ ID NO: 731201 - RNA, 18 nt, Human
uucaagaguuucucuagg

SEQ ID NO: 731202 - RNA, 22 nt, Human
aaaucuguuucagguauauuug

SEQ ID NO: 731203 - RNA, 22 nt, Human
aaaguuuuagcuguccaguucc

SEQ ID NO: 731204 - RNA, 22 nt, Human
uagugaaauuuaugcacagcua

SEQ ID NO: 731205 - RNA, 22 nt, Human
caagagccuuugggcagaagga

SEQ ID NO: 731206 - RNA, 21 nt, Human
cagcccagcccauugacagug

SEQ ID NO: 731207 - RNA, 22 nt, Human
cuaaccugcauggcagcuagaa

SEQ ID NO: 731208 - RNA, 23 nt, Human
uggcagcuguguaagagaaagca

SEQ ID NO: 731209 - RNA, 22 nt, Human
agcagggcucugccaugggccc

SEQ ID NO: 731210 - RNA, 22 nt, Human
acuauuuacucaaaugagguug

SEQ ID NO: 731211 - RNA, 22 nt, Human
ucugccugugguggaggaaguu

SEQ ID NO: 731212 - RNA, 22 nt, Human
ucucugagcuuaagguguuuca

SEQ ID NO: 731213 - RNA, 22 nt, Human
acaggccuuaggagagaugggg

SEQ ID NO: 731214 - RNA, 22 nt, Human
cgcuguguuuacaucauugcug

SEQ ID NO: 731215 - RNA, 22 nt, Human
gucacauucaugcagaaucaaa

SEQ ID NO: 731216 - RNA, 19 nt, Human
ccaccagugugaucuaaga

SEQ ID NO: 731217 - RNA, 22 nt, Human
ugucgcagcugaaaaucucaau

SEQ ID NO: 731218 - RNA, 22 nt, Human
aggguauaaagagcaagcagaa

SEQ ID NO: 731219 - RNA, 21 nt, Human
cugcaucugagucauuaugcc

SEQ ID NO: 731220 - RNA, 22 nt, Human
agauaauuaugucaauuucuug

SEQ ID NO: 731221 - RNA, 22 nt, Human
cacuaaaacuacauuggaaaca

SEQ ID NO: 731222 - RNA, 22 nt, Human
cugcaugguucaaaugagcuaa

SEQ ID NO: 731223 - RNA, 22 nt, Human
uucugugaggacuucucaagga

SEQ ID NO: 731224 - RNA, 22 nt, Human
ugaagcaucuggucugagaauu

SEQ ID NO: 731225 - RNA, 22 nt, Human
uuucaaagcaacugaaaaggaa

SEQ ID NO: 731226 - RNA, 22 nt, Human
auauuuagcucauuuccagugc

SEQ ID NO: 731227 - RNA, 22 nt, Human
uaguucucaggacgucaagguu

SEQ ID NO: 731228 - RNA, 22 nt, Human
uucuggaaagcauuugaggccc

SEQ ID NO: 731229 - RNA, 22 nt, Human
uguagggagaagagaggcaccu

SEQ ID NO: 731230 - RNA, 22 nt, Human
caggucugagucacauguucau

SEQ ID NO: 731231 - RNA, 22 nt, Human
caguaaaugagaagcuaguaau

SEQ ID NO: 731232 - RNA, 22 nt, Human
uuucugcaucucuacaguuguu

SEQ ID NO: 731233 - RNA, 22 nt, Human
ucuuauaugcacauacauuggg

SEQ ID NO: 731234 - RNA, 22 nt, Human
uccugggcccaggcugccaggg

SEQ ID NO: 731235 - RNA, 22 nt, Human
ucagcagggcugugguguggcu

SEQ ID NO: 731236 - RNA, 20 nt, Human
caggaggcaaggucaagguc

SEQ ID NO: 731237 - RNA, 22 nt, Human
cuuaggaaauauauacuaaacu

SEQ ID NO: 731238 - RNA, 22 nt, Human
uuauagaugccuugaguaaaug

SEQ ID NO: 731239 - RNA, 22 nt, Human
gaaaaugugccuuuggguauug

SEQ ID NO: 731240 - RNA, 22 nt, Human
uggaagaaaauucaaucgaguu

SEQ ID NO: 731241 - RNA, 22 nt, Human
aggguggcaguuacuggagcaa

SEQ ID NO: 731242 - RNA, 22 nt, Human
gaggagcuugaggcuaggagcc

SEQ ID NO: 731243 - RNA, 23 nt, Human
ugccucaguggaaugugagggug

SEQ ID NO: 731244 - RNA, 19 nt, Human
ugaaauggcaguugcuaaa

SEQ ID NO: 731245 - RNA, 22 nt, Human
gcaaggccugaggugggugcuc

SEQ ID NO: 731246 - RNA, 23 nt, Human
ggcugggagcuccgggugcacgu

SEQ ID NO: 731247 - RNA, 22 nt, Human
ucauagaaauaucacgucuuuu

SEQ ID NO: 731248 - RNA, 22 nt, Human
ucugugcucauucagucauuca

SEQ ID NO: 731249 - RNA, 22 nt, Human
aucugaaagcuaggaguucuca

SEQ ID NO: 731250 - RNA, 22 nt, Human
ggaggccaccauggagucacuu

SEQ ID NO: 731251 - RNA, 17 nt, Human
gaggccaaggcaggcgg

SEQ ID NO: 731252 - RNA, 22 nt, Human
uaagacacauugagaaacacaa

SEQ ID NO: 731253 - RNA, 22 nt, Human
uccuggaggagauccaaucuga

SEQ ID NO: 731254 - RNA, 22 nt, Human
gacccucauugucaccgugagc

SEQ ID NO: 731255 - RNA, 22 nt, Human
gcauuuagcuuuaaaauauuuc

SEQ ID NO: 731256 - RNA, 21 nt, Human
gccucuccaaauccugccuuc

SEQ ID NO: 731257 - RNA, 22 nt, Human
ugcuccugaacacagcccuaug

SEQ ID NO: 731258 - RNA, 17 nt, Human
uaucagaauguguuuac

SEQ ID NO: 731259 - RNA, 22 nt, Human
agcagcaaagccaggggauggg

SEQ ID NO: 731260 - RNA, 22 nt, Human
ugcagcucugaacagucaugaa

SEQ ID NO: 731261 - RNA, 22 nt, Human
ucauuauaaacauaugcuaaag

SEQ ID NO: 731262 - RNA, 22 nt, Human
acagccaggaggaacucaguga

SEQ ID NO: 731263 - RNA, 22 nt, Human
guggcucacgucugucaucuca

SEQ ID NO: 731264 - RNA, 22 nt, Human
gcaaaugcuaaaguguagagac

SEQ ID NO: 731265 - RNA, 22 nt, Human
ccaagggaaaccgagaggcugg

SEQ ID NO: 731266 - RNA, 22 nt, Human
ugugggaggaauuagaauggga

SEQ ID NO: 731267 - RNA, 22 nt, Human
gcagcagugcuuuggaauccug

SEQ ID NO: 731268 - RNA, 22 nt, Human
uucacguuguugaagaaaauac

SEQ ID NO: 731269 - RNA, 22 nt, Human
ugggcaggcaagugaauaccuu

SEQ ID NO: 731270 - RNA, 22 nt, Human
uaacaggcaaggucacaccuug

SEQ ID NO: 731271 - RNA, 22 nt, Human
acauuuuuuagagucccacauu

SEQ ID NO: 731272 - RNA, 19 nt, Human
agggccugcagcucaagcu

SEQ ID NO: 731273 - RNA, 22 nt, Human
ggugccacauaaauggagagag

SEQ ID NO: 731274 - RNA, 22 nt, Human
uacaguaguaagaaugccuuau

SEQ ID NO: 731275 - RNA, 22 nt, Human
acagagagggagugauaaaucc

SEQ ID NO: 731276 - RNA, 22 nt, Human
cugggucucuuuagggugccgu

SEQ ID NO: 731277 - RNA, 23 nt, Human
aggauguaggauguauggcagag

SEQ ID NO: 731278 - RNA, 19 nt, Human
agugcauuuuauguuucaa

SEQ ID NO: 731279 - RNA, 22 nt, Human
ugucaaugaagauaugaauaau

SEQ ID NO: 731280 - RNA, 22 nt, Human
cagccagaggggccagagucgg

SEQ ID NO: 731281 - RNA, 19 nt, Human
gagguuucugaagugggcu

SEQ ID NO: 731282 - RNA, 22 nt, Human
cauguaaaccauugugagcauc

SEQ ID NO: 731283 - RNA, 23 nt, Human
uggcuaaaggcucuaguccugcu

SEQ ID NO: 731284 - RNA, 22 nt, Human
guuauucugcgaugcaauccug

SEQ ID NO: 731285 - RNA, 22 nt, Human
aaugagcugcugcuguuccacc

SEQ ID NO: 731286 - RNA, 22 nt, Human
ucucauggcuuguaggagguga

SEQ ID NO: 731287 - RNA, 20 nt, Human
aacacacugguggcaucagg

SEQ ID NO: 731288 - RNA, 22 nt, Human
agugcaaauuauuuaccugauu

SEQ ID NO: 731289 - RNA, 22 nt, Human
acacacuuuaaauuaaaccucu

SEQ ID NO: 731290 - RNA, 22 nt, Human
uauuuggaaauagggcuuugua

SEQ ID NO: 731291 - RNA, 22 nt, Human
ucugagagccucuagccuaagu

SEQ ID NO: 731292 - RNA, 22 nt, Human
gaaggccaagaggcuccaagau

SEQ ID NO: 731293 - RNA, 22 nt, Human
caguacaauguugaaaaggagu

SEQ ID NO: 731294 - RNA, 22 nt, Human
ugcaugaugacuaaggugguga

SEQ ID NO: 731295 - RNA, 22 nt, Human
ccccuccuggccacacugucag

SEQ ID NO: 731296 - RNA, 22 nt, Human
uugcaaaucuuugccagaaggc

SEQ ID NO: 731297 - RNA, 22 nt, Human
cugcauuagucaugcuuugcag

SEQ ID NO: 731298 - RNA, 22 nt, Human
caccccuugucuuuggggucgu

SEQ ID NO: 731299 - RNA, 22 nt, Human
ccuggcacauaauaguggcuca

SEQ ID NO: 731300 - RNA, 22 nt, Human
ucugggcuuuuccaugccugug

SEQ ID NO: 731301 - RNA, 21 nt, Human
ugcaguucaagucaaucuacu

SEQ ID NO: 731302 - RNA, 22 nt, Human
ugugccucauguaucuggauga

SEQ ID NO: 731303 - RNA, 22 nt, Human
aauguuugaacuuugcauauuu

SEQ ID NO: 731304 - RNA, 22 nt, Human
aucuacacuauaacagaaugcu

SEQ ID NO: 731305 - RNA, 22 nt, Human
ggggccagauaucacuaagguu

SEQ ID NO: 731306 - RNA, 19 nt, Human
agcucaggcccaucguccc

SEQ ID NO: 731307 - RNA, 22 nt, Human
ucugugcugcccaacuucucaa

SEQ ID NO: 731308 - RNA, 22 nt, Human
ccuggcucagaguaugucaucg

SEQ ID NO: 731309 - RNA, 22 nt, Human
cugccugcaucccacagugggg

SEQ ID NO: 731310 - RNA, 18 nt, Human
cugaggcuggcaggagcc

SEQ ID NO: 731311 - RNA, 22 nt, Human
gggcuugcuuaaggucacccgg

SEQ ID NO: 731312 - RNA, 22 nt, Human
ugggcaggggcccugcuuccgu

SEQ ID NO: 731313 - RNA, 22 nt, Human
acagucuacuugagcuuguaua

SEQ ID NO: 731314 - RNA, 22 nt, Human
gcagaggagcaagcuggacacc

SEQ ID NO: 731315 - RNA, 21 nt, Human
uucuagaaaaguaugggacug

SEQ ID NO: 731316 - RNA, 19 nt, Human
agaauuguuuuaugucuuc

SEQ ID NO: 731317 - RNA, 21 nt, Human
cccaacccauuuccaguucau

SEQ ID NO: 731318 - RNA, 22 nt, Human
cugaggugagcuucccugggcu

SEQ ID NO: 731319 - RNA, 22 nt, Human
gacuugggagucuucugagaug

SEQ ID NO: 731320 - RNA, 22 nt, Human
uuccugaucccccaggacaaag

SEQ ID NO: 731321 - RNA, 22 nt, Human
uguauuugggucacaagauggg

SEQ ID NO: 731322 - RNA, 22 nt, Human
ugaaucauggauaaauagcuua

SEQ ID NO: 731323 - RNA, 22 nt, Human
ugagauaacucugauuuauguu

SEQ ID NO: 731324 - RNA, 22 nt, Human
uugucugagaaagugaguugcu

SEQ ID NO: 731325 - RNA, 22 nt, Human
gagaaguuucugguuugcauag

SEQ ID NO: 731326 - RNA, 22 nt, Human
uguguacauauacacaaauaca

SEQ ID NO: 731327 - RNA, 22 nt, Human
agucccuucucaaagugugcgg

SEQ ID NO: 731328 - RNA, 22 nt, Human
aagucucagaaaacuagugugg

SEQ ID NO: 731329 - RNA, 22 nt, Human
ccacagaaucgcuaguggagca

SEQ ID NO: 731330 - RNA, 20 nt, Human
uuaaaaagagucacaggaga

SEQ ID NO: 731331 - RNA, 22 nt, Human
uggccacccccaaugucaguag

SEQ ID NO: 731332 - RNA, 22 nt, Human
agcccugggaggccagcuugua

SEQ ID NO: 731333 - RNA, 22 nt, Human
cugaaugucgaucagcuugggu

SEQ ID NO: 731334 - RNA, 22 nt, Human
aggagcugucauuugauucaca

SEQ ID NO: 731335 - RNA, 22 nt, Human
aggagucagauaugggaaaguu

SEQ ID NO: 731336 - RNA, 22 nt, Human
guaugucaugagccuugugcgu

SEQ ID NO: 731337 - RNA, 22 nt, Human
gccagccauaggccagcacugg

SEQ ID NO: 731338 - RNA, 22 nt, Human
uucuccucuguuggccuucccu

SEQ ID NO: 731339 - RNA, 22 nt, Human
agccuuggccguaagguaugcu

SEQ ID NO: 731340 - RNA, 22 nt, Human
cuggucaccuccuucccagcua

SEQ ID NO: 731341 - RNA, 22 nt, Human
uuuaaauuauaguuaaugucug

SEQ ID NO: 731342 - RNA, 22 nt, Human
acaauuugugucuuuugcuuau

SEQ ID NO: 731343 - RNA, 22 nt, Human
uuuggagaaaaguugagaccau

SEQ ID NO: 731344 - RNA, 20 nt, Human
guggccuguccuguuguggg

SEQ ID NO: 731345 - RNA, 22 nt, Human
cuuuuauuuugaauuaagggcu

SEQ ID NO: 731346 - RNA, 22 nt, Human
ugugccaagaucaaacuuuucu

SEQ ID NO: 731347 - RNA, 22 nt, Human
cuccagaaauucaacagcaaau

SEQ ID NO: 731348 - RNA, 22 nt, Human
gacaggaauguguggaugcgga

SEQ ID NO: 731349 - RNA, 22 nt, Human
agagaaaguccugaucucucua

SEQ ID NO: 731350 - RNA, 19 nt, Human
acagccuguugguggggcu

SEQ ID NO: 731351 - RNA, 22 nt, Human
uauauuuaauuaguugcuggau

SEQ ID NO: 731352 - RNA, 22 nt, Human
ugucuauagccugauuuguugg

SEQ ID NO: 731353 - RNA, 22 nt, Human
caggcagcugcuggguucagcc

SEQ ID NO: 731354 - RNA, 22 nt, Human
agcacagagauuauuuacaaga

SEQ ID NO: 731355 - RNA, 22 nt, Human
cuuuccugaggaguauggcugu

SEQ ID NO: 731356 - RNA, 22 nt, Human
ucuaauugcaauucucagagau

SEQ ID NO: 731357 - RNA, 22 nt, Human
uggcagguggcucuggcauucu

SEQ ID NO: 731358 - RNA, 22 nt, Human
cugcuuuacucauaggguuuca

SEQ ID NO: 731359 - RNA, 22 nt, Human
agcaguuugaaucaauggccag

SEQ ID NO: 731360 - RNA, 22 nt, Human
agcccuggcucccagcagcgcu

SEQ ID NO: 731361 - RNA, 22 nt, Human
uccuuacaugcuuccuuauaca

SEQ ID NO: 731362 - RNA, 22 nt, Human
gcccucuggcagccuuggcugg

SEQ ID NO: 731363 - RNA, 22 nt, Human
uuagccauuaauguccugugca

SEQ ID NO: 731364 - RNA, 19 nt, Human
ucuuuucacgcauuuugaa

SEQ ID NO: 731365 - RNA, 22 nt, Human
uggaagacauuuuggaccuugg

SEQ ID NO: 731366 - RNA, 17 nt, Human
gggacucaagauggggu

SEQ ID NO: 731367 - RNA, 22 nt, Human
cuuccuuugcuguucggagguu

SEQ ID NO: 731368 - RNA, 22 nt, Human
ugcuugucucucugugcccacu

SEQ ID NO: 731369 - RNA, 22 nt, Human
cauggcuuuuuuauucugaaug

SEQ ID NO: 731370 - RNA, 22 nt, Human
auugaaaaauucacaauucugg

SEQ ID NO: 731371 - RNA, 22 nt, Human
acacauuaugagcaguugucuu

SEQ ID NO: 731372 - RNA, 22 nt, Human
uuucagaaggggagaaagguca

SEQ ID NO: 731373 - RNA, 22 nt, Human
cagcuuauucaguaagcacaua

SEQ ID NO: 731374 - RNA, 22 nt, Human
gguggccucucaugcaagguag

SEQ ID NO: 731375 - RNA, 22 nt, Human
gaacacagcagggauaaccacu

SEQ ID NO: 731376 - RNA, 22 nt, Human
ugucuaaacuuguuuuaucuca

SEQ ID NO: 731377 - RNA, 22 nt, Human
aacauuucuucugaaacugagu

SEQ ID NO: 731378 - RNA, 22 nt, Human
cucagccagacaugacccaguc

SEQ ID NO: 731379 - RNA, 22 nt, Human
ugcuuauauuuauugggcuuag

SEQ ID NO: 731380 - RNA, 22 nt, Human
acugggccuugccauggcagcc

SEQ ID NO: 731381 - RNA, 21 nt, Human
ccuguggucuggagggagcac

SEQ ID NO: 731382 - RNA, 22 nt, Human
gccuggcuuuugccucauguuc

SEQ ID NO: 731383 - RNA, 20 nt, Human
gacaacagaguaccaggaag

SEQ ID NO: 731384 - RNA, 22 nt, Human
gaacagcugcuagagaucugug

SEQ ID NO: 731385 - RNA, 22 nt, Human
gggcagcauucugugggcaggu

SEQ ID NO: 731386 - RNA, 22 nt, Human
aaaggucaaaaucgugacauug

SEQ ID NO: 731387 - RNA, 22 nt, Human
uaccauuucaguaaaaacuuag

SEQ ID NO: 731388 - RNA, 22 nt, Human
uuuccuuuuggcuaggugugaa

SEQ ID NO: 731389 - RNA, 22 nt, Human
agcagcaguguguggucauguu

SEQ ID NO: 731390 - RNA, 22 nt, Human
ccagccagcugguuggacgccu

SEQ ID NO: 731391 - RNA, 22 nt, Human
aguucacauuccgagguacugg

SEQ ID NO: 731392 - RNA, 23 nt, Human
cuggacucaggggaugugaagga

SEQ ID NO: 731393 - RNA, 22 nt, Human
uucuuauguucacauaauucca

SEQ ID NO: 731394 - RNA, 22 nt, Human
cagcccagcugggaucacacuc

SEQ ID NO: 731395 - RNA, 20 nt, Human
uccccagggcaucaggagca

SEQ ID NO: 731396 - RNA, 22 nt, Human
ccaaggcuccucagcuggucuu

SEQ ID NO: 731397 - RNA, 22 nt, Human
uuuaauugauucacagucugua

SEQ ID NO: 731398 - RNA, 22 nt, Human
caguccuuaaggaaacauuugu

SEQ ID NO: 731399 - RNA, 22 nt, Human
acaguuugaauaauuuagauag

SEQ ID NO: 731400 - RNA, 22 nt, Human
ugcuauuucucugcuguaaaau

SEQ ID NO: 731401 - RNA, 22 nt, Human
cucagaguccauaguuuacagu

SEQ ID NO: 731402 - RNA, 22 nt, Human
agguuccaucaccugcagugga

SEQ ID NO: 731403 - RNA, 22 nt, Human
uugccugcuacggucuucacug

SEQ ID NO: 731404 - RNA, 22 nt, Human
gccaagggaacugagccggagg

SEQ ID NO: 731405 - RNA, 22 nt, Human
auggcccugcugguuugaucgu

SEQ ID NO: 731406 - RNA, 22 nt, Human
cuuaauuuaagccuagaaugca

SEQ ID NO: 731407 - RNA, 20 nt, Human
agaaccuaaguuaaaacaca

SEQ ID NO: 731408 - RNA, 22 nt, Human
ugcuuccugaggccgucuucuc

SEQ ID NO: 731409 - RNA, 22 nt, Human
ugcaccauuuugucaggcuacu

SEQ ID NO: 731410 - RNA, 22 nt, Human
auggaguaauauuaacauguua

SEQ ID NO: 731411 - RNA, 22 nt, Human
uccugcaguuacaucccagcca

SEQ ID NO: 731412 - RNA, 22 nt, Human
ugggagcaggugugcuagggaa

SEQ ID NO: 731413 - RNA, 22 nt, Human
ugugugauugcaggagaugugg

SEQ ID NO: 731414 - RNA, 22 nt, Human
uuauggcauauuccucauugua

SEQ ID NO: 731415 - RNA, 22 nt, Human
cauuucuauggcaaugggaaaa

SEQ ID NO: 731416 - RNA, 22 nt, Human
cuucuuggugauggcuuaccug

SEQ ID NO: 731417 - RNA, 22 nt, Human
agccccugcuggguguagcuca

SEQ ID NO: 731418 - RNA, 22 nt, Human
uucugugugcugucuuggcuuu

SEQ ID NO: 731419 - RNA, 22 nt, Human
ucccagccuuucuuuucugcug

SEQ ID NO: 731420 - RNA, 22 nt, Human
acuuaaaaacagauccagcagg

SEQ ID NO: 731421 - RNA, 22 nt, Human
aguggcaaagucuucagaaguu

SEQ ID NO: 731422 - RNA, 22 nt, Human
aauuauccaccuuugcaugauu

SEQ ID NO: 731423 - RNA, 22 nt, Human
ggugcagugguguggcaaaggg

SEQ ID NO: 731424 - RNA, 22 nt, Human
auuccucauuauuuacugagga

SEQ ID NO: 731425 - RNA, 22 nt, Human
auacagguucucuagggaacag

SEQ ID NO: 731426 - RNA, 22 nt, Human
uugcuucauauuuguggcuugc

SEQ ID NO: 731427 - RNA, 23 nt, Human
gguccacccgagccugcagcuuc

SEQ ID NO: 731428 - RNA, 22 nt, Human
ugucaugccaccguuucccaga

SEQ ID NO: 731429 - RNA, 22 nt, Human
uuuccaggcagaggaguuguga

SEQ ID NO: 731430 - RNA, 22 nt, Human
cacagauaccuagugaaacaua

SEQ ID NO: 731431 - RNA, 22 nt, Human
ccaggguuuagcaagccuacaa

SEQ ID NO: 731432 - RNA, 22 nt, Human
caaaauuagaaaugcagcuguu

SEQ ID NO: 731433 - RNA, 22 nt, Human
ugcaacagacuuuauuaacucu

SEQ ID NO: 731434 - RNA, 22 nt, Human
acuccugccacacagaugcugu

SEQ ID NO: 731435 - RNA, 22 nt, Human
ccugucugcaugaucccugcca

SEQ ID NO: 731436 - RNA, 22 nt, Human
gcucagagaaauuauaggaauu

SEQ ID NO: 731437 - RNA, 22 nt, Human
cugcaggacugaaagaugaggu

SEQ ID NO: 731438 - RNA, 22 nt, Human
uuuuccuuugauucccagaugu

SEQ ID NO: 731439 - RNA, 22 nt, Human
caggcuccagcuuccugcucag

SEQ ID NO: 731440 - RNA, 22 nt, Human
agucuucuggguguuuccagag

SEQ ID NO: 731441 - RNA, 22 nt, Human
acucugcuuauugcugcaggca

SEQ ID NO: 731442 - RNA, 22 nt, Human
acagccaaggaauuaggaaggg

SEQ ID NO: 731443 - RNA, 22 nt, Human
acucuggcgggcgggcgagcca

SEQ ID NO: 731444 - RNA, 22 nt, Human
aucuaagagagagagcaugucu

SEQ ID NO: 731445 - RNA, 22 nt, Human
gggcugugugcccacuucccau

SEQ ID NO: 731446 - RNA, 22 nt, Human
caggaaaauggaaucaccugua

SEQ ID NO: 731447 - RNA, 22 nt, Human
ggaggcggacacagguaguguu

SEQ ID NO: 731448 - RNA, 20 nt, Human
uguggcaggaugagggcgga

SEQ ID NO: 731449 - RNA, 22 nt, Human
uugugucuaaauaaggagaccu

SEQ ID NO: 731450 - RNA, 21 nt, Human
aauuuugaaggaagauuaagg

SEQ ID NO: 731451 - RNA, 22 nt, Human
caggguggugaauagcuauagu

SEQ ID NO: 731452 - RNA, 22 nt, Human
ggcuggacauagacauagccau

SEQ ID NO: 731453 - RNA, 22 nt, Human
caaugcuucucauuagccaaug

SEQ ID NO: 731454 - RNA, 22 nt, Human
aaaacacugccugcuugacuga

SEQ ID NO: 731455 - RNA, 23 nt, Human
ccagggcuacgggcaccguccug

SEQ ID NO: 731456 - RNA, 22 nt, Human
uguugauuugugggcugcaaaa

SEQ ID NO: 731457 - RNA, 17 nt, Human
cugggccucugcccuuu

SEQ ID NO: 731458 - RNA, 20 nt, Human
gaauuuuaugaacacuacca

SEQ ID NO: 731459 - RNA, 22 nt, Human
aaugggaagucacuacuguuac

SEQ ID NO: 731460 - RNA, 20 nt, Human
gcuggcagaugucuugagau

SEQ ID NO: 731461 - RNA, 21 nt, Human
gugcuuuuccuuaauguucuu

SEQ ID NO: 731462 - RNA, 18 nt, Human
cauuguuuccagaagacc

SEQ ID NO: 731463 - RNA, 22 nt, Human
caauugucguugacauccuuca

SEQ ID NO: 731464 - RNA, 22 nt, Human
acacauacauggggaagaugag

SEQ ID NO: 731465 - RNA, 22 nt, Human
cugggccaucagaggggcugga

SEQ ID NO: 731466 - RNA, 22 nt, Human
gcugcagaucccacccauuccc

SEQ ID NO: 731467 - RNA, 22 nt, Human
ugaaacaaaaguauguagcuug

SEQ ID NO: 731468 - RNA, 22 nt, Human
caggcaugaucauaggaguuua

SEQ ID NO: 731469 - RNA, 22 nt, Human
aggaagcugcuaagaaacaaug

SEQ ID NO: 731470 - RNA, 22 nt, Human
aaucuggcauuugagaguagga

SEQ ID NO: 731471 - RNA, 22 nt, Human
agcugcccuuaauaggcauuca

SEQ ID NO: 731472 - RNA, 22 nt, Human
gagacaguguccauccaggggc

SEQ ID NO: 731473 - RNA, 22 nt, Human
ccuggcagaauauuaaagugca

SEQ ID NO: 731474 - RNA, 22 nt, Human
guucauuuuacuguaaauagca

SEQ ID NO: 731475 - RNA, 22 nt, Human
augucaugaaaugcuacuaacu

SEQ ID NO: 731476 - RNA, 22 nt, Human
augcuugggacucccuguagca

SEQ ID NO: 731477 - RNA, 22 nt, Human
auagaaacagggaagcaaagca

SEQ ID NO: 731478 - RNA, 22 nt, Human
ugcuuuauaucucucuucuuag

SEQ ID NO: 731479 - RNA, 21 nt, Human
ccaggucuugguccuuggacu

SEQ ID NO: 731480 - RNA, 22 nt, Human
cuguacaucuuaaauggaaaaa

SEQ ID NO: 731481 - RNA, 22 nt, Human
gagcaacuucaauaguacuauu

SEQ ID NO: 731482 - RNA, 22 nt, Human
uaaaugcaguuaguacuugcca

SEQ ID NO: 731483 - RNA, 22 nt, Human
agugugugcaugcauucgugca

SEQ ID NO: 731484 - RNA, 19 nt, Human
ugggagaggcaacagagua

SEQ ID NO: 731485 - RNA, 22 nt, Human
ugaaacuucuaauaugaauagu

SEQ ID NO: 731486 - RNA, 22 nt, Human
aggcugcguuagccucacuccc

SEQ ID NO: 731487 - RNA, 22 nt, Human
augauucuggcaaauuuauuau

SEQ ID NO: 731488 - RNA, 22 nt, Human
ggcaggcuggcuuuguuccagg

SEQ ID NO: 731489 - RNA, 22 nt, Human
aagcgacugcagguuaaaacaa

SEQ ID NO: 731490 - RNA, 22 nt, Human
ucccagaguauuagcaauugcu

SEQ ID NO: 731491 - RNA, 22 nt, Human
aucaacagguauggaugagauu

SEQ ID NO: 731492 - RNA, 22 nt, Human
cccaugagguggagguugcagu

SEQ ID NO: 731493 - RNA, 22 nt, Human
guggcaggagacuggaagaugg

SEQ ID NO: 731494 - RNA, 22 nt, Human
uggcuucugagcauugaaacgu

SEQ ID NO: 731495 - RNA, 22 nt, Human
uuugaauguaaaugcugcagcu

SEQ ID NO: 731496 - RNA, 22 nt, Human
cucagagucccuucccucgugg

SEQ ID NO: 731497 - RNA, 19 nt, Human
acugccugcagguguuggg

SEQ ID NO: 731498 - RNA, 22 nt, Human
auuuucagagacaucuggacuu

SEQ ID NO: 731499 - RNA, 22 nt, Human
uacaguagacaauguuaguaug

SEQ ID NO: 731500 - RNA, 22 nt, Human
uugcuuccucgaggccagcgug

SEQ ID NO: 731501 - RNA, 22 nt, Human
ggaguggcuauuugugcugguu

SEQ ID NO: 731502 - RNA, 22 nt, Human
aaagcuggccucucaggcuuua

SEQ ID NO: 731503 - RNA, 22 nt, Human
uguaacaaguaauccaugggag

SEQ ID NO: 731504 - RNA, 22 nt, Human
cuagaauugcauucuaugaaua

SEQ ID NO: 731505 - RNA, 22 nt, Human
auuucuccuuguugcaaugcag

SEQ ID NO: 731506 - RNA, 22 nt, Human
gugcuuccccaagccacagccu

SEQ ID NO: 731507 - RNA, 22 nt, Human
uuggaagaaauaucaauagugu

SEQ ID NO: 731508 - RNA, 22 nt, Human
uguaugaagguuuaccugcugu

SEQ ID NO: 731509 - RNA, 22 nt, Human
caguccuuccuugccccuuggg

SEQ ID NO: 731510 - RNA, 22 nt, Human
agaagauguugcaguugaugcg

SEQ ID NO: 731511 - RNA, 21 nt, Human
uccaagccuucaacacauuca

SEQ ID NO: 731512 - RNA, 22 nt, Human
aauuaaauugguuuagagagga

SEQ ID NO: 731513 - RNA, 22 nt, Human
caggaacaggguguccuggcag

SEQ ID NO: 731514 - RNA, 22 nt, Human
ggacaaaaaucagccaucucua

SEQ ID NO: 731515 - RNA, 22 nt, Human
acacugagcaucucuagaggca

SEQ ID NO: 731516 - RNA, 22 nt, Human
gcagcagguccgcaucaucauc

SEQ ID NO: 731517 - RNA, 22 nt, Human
cagaacagggcccaaggggucg

SEQ ID NO: 731518 - RNA, 19 nt, Human
ugggaacuuguuagacaug

SEQ ID NO: 731519 - RNA, 22 nt, Human
uuagacauguuugcuaaaauga

SEQ ID NO: 731520 - RNA, 22 nt, Human
ucucucugugacagcuuugcug

SEQ ID NO: 731521 - RNA, 22 nt, Human
ugccagccuggccugagucuuu

SEQ ID NO: 731522 - RNA, 22 nt, Human
ccacaucauggauacaguuaug

SEQ ID NO: 731523 - RNA, 22 nt, Human
gccaggcugcuccagggaggcc

SEQ ID NO: 731524 - RNA, 22 nt, Human
ucuucagagugaaagucuguga

SEQ ID NO: 731525 - RNA, 20 nt, Human
cccagagguugcggcaggag

SEQ ID NO: 731526 - RNA, 22 nt, Human
aagcauuguaagcagaagaugc

SEQ ID NO: 731527 - RNA, 23 nt, Human
agcagccauagggaagcaauaca

SEQ ID NO: 731528 - RNA, 22 nt, Human
ucccacugagcauaugcagaug

SEQ ID NO: 731529 - RNA, 22 nt, Human
ugaaugauguauaauauugaga

SEQ ID NO: 731530 - RNA, 22 nt, Human
acaggagcaacagacuaagaca

SEQ ID NO: 731531 - RNA, 21 nt, Human
caggcucugcuagaggagccu

SEQ ID NO: 731532 - RNA, 22 nt, Human
aaaugucuacuucccaucugua

SEQ ID NO: 731533 - RNA, 21 nt, Human
cagagcuguccaaacccugac

SEQ ID NO: 731534 - RNA, 22 nt, Human
ccagcugccuaagcaauccaua

SEQ ID NO: 731535 - RNA, 22 nt, Human
aggcuuaaaugcucauaucagu

SEQ ID NO: 731536 - RNA, 22 nt, Human
aacagcuuacucaauggugauu

SEQ ID NO: 731537 - RNA, 22 nt, Human
uucuaaaauaaguuuaucuggu

SEQ ID NO: 731538 - RNA, 22 nt, Human
acaugaaguggucagaucaaac

SEQ ID NO: 731539 - RNA, 22 nt, Human
ugggaguggggcauagaaggua

SEQ ID NO: 731540 - RNA, 22 nt, Human
auguguaaaguuagaugucuga

SEQ ID NO: 731541 - RNA, 22 nt, Human
ucacacuggcagugcugaaggc

SEQ ID NO: 731542 - RNA, 22 nt, Human
gggguggauuucaggcgguguc

SEQ ID NO: 731543 - RNA, 22 nt, Human
acugucuuguguuaaagaacca

SEQ ID NO: 731544 - RNA, 22 nt, Human
uggcagcauguuauguaaggaa

SEQ ID NO: 731545 - RNA, 21 nt, Human
uccagggaacuucucaggaau

SEQ ID NO: 731546 - RNA, 22 nt, Human
gaaaaugagccucagcuacauu

SEQ ID NO: 731547 - RNA, 22 nt, Human
ggucucuucaggagcuugagcg

SEQ ID NO: 731548 - RNA, 22 nt, Human
ugauucaguugguuuuguucag

SEQ ID NO: 731549 - RNA, 22 nt, Human
ggcagcacgacaggaguggaag

SEQ ID NO: 731550 - RNA, 17 nt, Human
aucugcuucacccagca

SEQ ID NO: 731551 - RNA, 22 nt, Human
auggcuguuuugugacuucuca

SEQ ID NO: 731552 - RNA, 22 nt, Human
cugugaaugcuaguaagagugc

SEQ ID NO: 731553 - RNA, 22 nt, Human
acaguaguccuuuauuuugguu

SEQ ID NO: 731554 - RNA, 22 nt, Human
acccucaguaaucgugcaguuu

SEQ ID NO: 731555 - RNA, 23 nt, Human
uggcugagguccagguaguuuca

SEQ ID NO: 731556 - RNA, 22 nt, Human
gcucuggcuacuguggcuaccg

SEQ ID NO: 731557 - RNA, 22 nt, Human
auggccagcuuauaggggcuca

SEQ ID NO: 731558 - RNA, 22 nt, Human
gggaugcagucagagccccugu

SEQ ID NO: 731559 - RNA, 22 nt, Human
uacuguauacuacugcuguucu

SEQ ID NO: 731560 - RNA, 22 nt, Human
uucccaguuagucauuuuuaca

SEQ ID NO: 731561 - RNA, 22 nt, Human
gcacacaugcaugugugcaucc

SEQ ID NO: 731562 - RNA, 22 nt, Human
ugguugugguccuccacaucgc

SEQ ID NO: 731563 - RNA, 20 nt, Human
ggaagccagcauccuugagg

SEQ ID NO: 731564 - RNA, 22 nt, Human
gaggggcucuugggcaugaagg

SEQ ID NO: 731565 - RNA, 22 nt, Human
uuuugguuucccuucuuauggu

SEQ ID NO: 731566 - RNA, 22 nt, Human
ccacaggcggaguggcgggcag

SEQ ID NO: 731567 - RNA, 22 nt, Human
cacucucacaugcccugucagu

SEQ ID NO: 731568 - RNA, 22 nt, Human
caaguuugcugauccuuguuuu

SEQ ID NO: 731569 - RNA, 22 nt, Human
aaacagucaugguugcuguuca

SEQ ID NO: 731570 - RNA, 22 nt, Human
aauuagaagcuguuagcaaaau

SEQ ID NO: 731571 - RNA, 22 nt, Human
agaaugcaguuugaaauaaggu

SEQ ID NO: 731572 - RNA, 22 nt, Human
cuuccugcauggagucugaaug

SEQ ID NO: 731573 - RNA, 22 nt, Human
ugagugccuacggcacaggcgc

SEQ ID NO: 731574 - RNA, 22 nt, Human
acuuggagggagcuggguggaa

SEQ ID NO: 731575 - RNA, 22 nt, Human
guacacauauauuaaaaauugu

SEQ ID NO: 731576 - RNA, 21 nt, Human
ccacugcucuucccuagggcc

SEQ ID NO: 731577 - RNA, 22 nt, Human
uuauucuggaggaagcaaaugg

SEQ ID NO: 731578 - RNA, 22 nt, Human
ucuguguuuaaaagauaugucc

SEQ ID NO: 731579 - RNA, 22 nt, Human
aucaaagguaucuaugcugucu

SEQ ID NO: 731580 - RNA, 22 nt, Human
uucuguaggcauggaacaggga

SEQ ID NO: 731581 - RNA, 22 nt, Human
aggcccugcccagugccacaag

SEQ ID NO: 731582 - RNA, 22 nt, Human
guaaagcaaaauguagagauug

SEQ ID NO: 731583 - RNA, 22 nt, Human
uuggcagaugagaccagggguu

SEQ ID NO: 731584 - RNA, 22 nt, Human
accugggauggggccagguuua

SEQ ID NO: 731585 - RNA, 17 nt, Human
caggucugaggccaggc

SEQ ID NO: 731586 - RNA, 22 nt, Human
agcuccuccugagugucuggga

SEQ ID NO: 731587 - RNA, 20 nt, Human
gagggcacauuguuccgugc

SEQ ID NO: 731588 - RNA, 22 nt, Human
aaggaacugaugcucaaagaau

SEQ ID NO: 731589 - RNA, 22 nt, Human
gccacagccucugggaaaacuc

SEQ ID NO: 731590 - RNA, 22 nt, Human
ccugagagcauuccacacugaa

SEQ ID NO: 731591 - RNA, 23 nt, Human
cuggccaccaucuuucuggcuuc

SEQ ID NO: 731592 - RNA, 20 nt, Human
gccuggcacccggggcuggc

SEQ ID NO: 731593 - RNA, 21 nt, Human
ugaaggggccaucacaaaggc

SEQ ID NO: 731594 - RNA, 22 nt, Human
agcagccagaaauccagaggug

SEQ ID NO: 731595 - RNA, 22 nt, Human
cucucugagugagggacaagcu

SEQ ID NO: 731596 - RNA, 19 nt, Human
cugcuuuaggccuuaaaag

SEQ ID NO: 731597 - RNA, 20 nt, Human
ugggcaccagaugggaugcc

SEQ ID NO: 731598 - RNA, 22 nt, Human
ugagucagugacaugaacuugu

SEQ ID NO: 731599 - RNA, 20 nt, Human
aucagacuugcauuucagga

SEQ ID NO: 731600 - RNA, 22 nt, Human
ugucccagacauaaguggacau

SEQ ID NO: 731601 - RNA, 22 nt, Human
cccuggcacuagcgacggccau

SEQ ID NO: 731602 - RNA, 22 nt, Human
cucugcuuuguaaguugugagg

SEQ ID NO: 731603 - RNA, 22 nt, Human
acuguacaaccucugccccugu

SEQ ID NO: 731604 - RNA, 20 nt, Human
aaagucuguuuaucucugga

SEQ ID NO: 731605 - RNA, 22 nt, Human
ccauuuuuaaagagcuuaagua

SEQ ID NO: 731606 - RNA, 22 nt, Human
ugacagaguucggauugaguuu

SEQ ID NO: 731607 - RNA, 22 nt, Human
aguacauacuucaaauguacuu

SEQ ID NO: 731608 - RNA, 22 nt, Human
uagaaaguagggaagguaggau

SEQ ID NO: 731609 - RNA, 22 nt, Human
cugggucugucacuagauaaau

SEQ ID NO: 731610 - RNA, 22 nt, Human
caggcuccacaggggaauccgg

SEQ ID NO: 731611 - RNA, 22 nt, Human
agcccucucuauggcccucuug

SEQ ID NO: 731612 - RNA, 22 nt, Human
uaaauuguccucccccugguau

SEQ ID NO: 731613 - RNA, 22 nt, Human
aaaauggcuguggucuggcaag

SEQ ID NO: 731614 - RNA, 22 nt, Human
uacaaaugaccauagccacuua

SEQ ID NO: 731615 - RNA, 22 nt, Human
cuguuaaaugagaaagcagacu

SEQ ID NO: 731616 - RNA, 22 nt, Human
aguggcagggcuggcugcugca

SEQ ID NO: 731617 - RNA, 21 nt, Human
ugugugcauaugcauguacau

SEQ ID NO: 731618 - RNA, 22 nt, Human
aguacaaacuguuucaaaguag

SEQ ID NO: 731619 - RNA, 22 nt, Human
gggcugagggguaucucauggg

SEQ ID NO: 731620 - RNA, 22 nt, Human
acacagauggguagaaaacaga

SEQ ID NO: 731621 - RNA, 22 nt, Human
aguuuuauaaaggcaccucagu

SEQ ID NO: 731622 - RNA, 22 nt, Human
acuugcagcagcagcuauuggc

SEQ ID NO: 731623 - RNA, 22 nt, Human
uucuggagacccagcaacaggg

SEQ ID NO: 731624 - RNA, 22 nt, Human
gcucugggauuaccagccuuag

SEQ ID NO: 731625 - RNA, 22 nt, Human
cuuuuuguuguccacacuagga

SEQ ID NO: 731626 - RNA, 22 nt, Human
uuacucagucucccauacauug

SEQ ID NO: 731627 - RNA, 22 nt, Human
gccagcaguccaguccuuagug

SEQ ID NO: 731628 - RNA, 21 nt, Human
uaggacagccccccugcccuc

SEQ ID NO: 731629 - RNA, 22 nt, Human
uccuguaguugcuaaguuuguu

SEQ ID NO: 731630 - RNA, 18 nt, Human
gcgggcggugcagugggc

SEQ ID NO: 731631 - RNA, 22 nt, Human
ccagcugggucccugcuggggc

SEQ ID NO: 731632 - RNA, 22 nt, Human
ugcuuuauuuuaaauaugccau

SEQ ID NO: 731633 - RNA, 22 nt, Human
caaacuuugcaaaacuuacagu

SEQ ID NO: 731634 - RNA, 21 nt, Human
uccuugcuauuuuccucagcu

SEQ ID NO: 731635 - RNA, 22 nt, Human
aggaggcagaugcuuggcugua

SEQ ID NO: 731636 - RNA, 22 nt, Human
gucagcucagcaggugggagug

SEQ ID NO: 731637 - RNA, 22 nt, Human
gaaauugccagaucuaguagau

SEQ ID NO: 731638 - RNA, 22 nt, Human
augugggagauuucaggaggug

SEQ ID NO: 731639 - RNA, 22 nt, Human
cauucauucagcaacuguuauu

SEQ ID NO: 731640 - RNA, 22 nt, Human
cugccuugucuuguuuucaggg

SEQ ID NO: 731641 - RNA, 21 nt, Human
uaggagcugauggggaaguag

SEQ ID NO: 731642 - RNA, 22 nt, Human
cugauuaggcuaagcaagaggg

SEQ ID NO: 731643 - RNA, 22 nt, Human
cagacuggccacaucugcacug

SEQ ID NO: 731644 - RNA, 22 nt, Human
cuaaggaauuggagcauguguu

SEQ ID NO: 731645 - RNA, 22 nt, Human
aguccuucaagaaaucuggaaa

SEQ ID NO: 731646 - RNA, 23 nt, Human
acacaaggguaacugccagccau

SEQ ID NO: 731647 - RNA, 22 nt, Human
accuccccauuaggucacccac

SEQ ID NO: 731648 - RNA, 22 nt, Human
cuagagaggugguguugggugg

SEQ ID NO: 731649 - RNA, 22 nt, Human
gcuggcagccaagugaagaggg

SEQ ID NO: 731650 - RNA, 22 nt, Human
ggcucugcagugacuugagggg

SEQ ID NO: 731651 - RNA, 22 nt, Human
ccugcuguucuguuuagugaac

SEQ ID NO: 731652 - RNA, 22 nt, Human
uguccccagcacucacucucca

SEQ ID NO: 731653 - RNA, 22 nt, Human
agggcagcuaaggugcugacug

SEQ ID NO: 731654 - RNA, 22 nt, Human
gacagggcaagacucugucuaa

SEQ ID NO: 731655 - RNA, 22 nt, Human
uacuaucucuucuaacuucaga

SEQ ID NO: 731656 - RNA, 22 nt, Human
aggcuuggagguucuguagcca

SEQ ID NO: 731657 - RNA, 22 nt, Human
gcagagcuucuguccuucagga

SEQ ID NO: 731658 - RNA, 23 nt, Human
ucagcaucaccugggaacuuacu

SEQ ID NO: 731659 - RNA, 22 nt, Human
gacuugggggcuuuggauaggc

SEQ ID NO: 731660 - RNA, 22 nt, Human
cuggguggcuguccagccagcc

SEQ ID NO: 731661 - RNA, 22 nt, Human
uuuacugaccuccaaucccacu

SEQ ID NO: 731662 - RNA, 20 nt, Human
ggacacuguagauuucaaac

SEQ ID NO: 731663 - RNA, 22 nt, Human
aggagggauagaaaaauacuug

SEQ ID NO: 731664 - RNA, 22 nt, Human
ucugagaaugaguguuuucuua

SEQ ID NO: 731665 - RNA, 22 nt, Human
uggccagauucaugcauguauc

SEQ ID NO: 731666 - RNA, 22 nt, Human
gcuggggaccagcugucucuga

SEQ ID NO: 731667 - RNA, 22 nt, Human
ccagucacucugugagagcuac

SEQ ID NO: 731668 - RNA, 22 nt, Human
caccagggacaaugcuaggggu

SEQ ID NO: 731669 - RNA, 20 nt, Human
auaggaaagggaggggcuuu

SEQ ID NO: 731670 - RNA, 22 nt, Human
gaguagaacugguuaucuaaua

SEQ ID NO: 731671 - RNA, 22 nt, Human
gagcccugacacugagggaguu

SEQ ID NO: 731672 - RNA, 22 nt, Human
acagcagcuaaaggugucuccu

SEQ ID NO: 731673 - RNA, 22 nt, Human
ucucauuugugugcaauucaga

SEQ ID NO: 731674 - RNA, 22 nt, Human
guauuucuuuaucuggucagaa

SEQ ID NO: 731675 - RNA, 22 nt, Human
uggcuggcaguuaucuuuggau

SEQ ID NO: 731676 - RNA, 22 nt, Human
ggaaaugacuuggugcuucguu

SEQ ID NO: 731677 - RNA, 22 nt, Human
auggcagucagagacaggcaga

SEQ ID NO: 731678 - RNA, 22 nt, Human
uacuuucuuguuccuuucauaa

SEQ ID NO: 731679 - RNA, 20 nt, Human
ugcagggcucugcuucucuc

SEQ ID NO: 731680 - RNA, 22 nt, Human
ugaaaugagauaauuuaagugc

SEQ ID NO: 731681 - RNA, 22 nt, Human
agcagcuagacuucagaaucug

SEQ ID NO: 731682 - RNA, 22 nt, Human
cucuucagauauacaguacucu

SEQ ID NO: 731683 - RNA, 22 nt, Human
aagaguaugcaugcauguuugu

SEQ ID NO: 731684 - RNA, 22 nt, Human
ggggaaggaaaguuauuagcag

SEQ ID NO: 731685 - RNA, 22 nt, Human
uauuuauucauucagcaagcau

SEQ ID NO: 731686 - RNA, 22 nt, Human
ugcucugugguccaagauggcu

SEQ ID NO: 731687 - RNA, 22 nt, Human
aggacagguguagugggcucug

SEQ ID NO: 731688 - RNA, 20 nt, Human
uacugggcaagcccacagac

SEQ ID NO: 731689 - RNA, 22 nt, Human
cagcgccuccuggaccuccucu

SEQ ID NO: 731690 - RNA, 22 nt, Human
uccaggccucuagccccuaucu

SEQ ID NO: 731691 - RNA, 22 nt, Human
ugaagguggaagggugguucug

SEQ ID NO: 731692 - RNA, 22 nt, Human
uauuuagaacagacaauagaaa

SEQ ID NO: 731693 - RNA, 22 nt, Human
guggguggaggcgucgagggca

SEQ ID NO: 731694 - RNA, 22 nt, Human
ucuacaaugagaaaugaucagu

SEQ ID NO: 731695 - RNA, 22 nt, Human
caucuuuaauuugugacaacua

SEQ ID NO: 731696 - RNA, 22 nt, Human
uugcagagaucagcagguuuga

SEQ ID NO: 731697 - RNA, 22 nt, Human
cagaguguauucugcaguugca

SEQ ID NO: 731698 - RNA, 22 nt, Human
ggcuuaguguuucugcucagcc

SEQ ID NO: 731699 - RNA, 22 nt, Human
uacagaauuagauuauuagaga

SEQ ID NO: 731700 - RNA, 22 nt, Human
ccucuggcaacuucacagccca

SEQ ID NO: 731701 - RNA, 22 nt, Human
gaggcagagguuguugcaguga

SEQ ID NO: 731702 - RNA, 22 nt, Human
uucucauguaaaugccaucauc

SEQ ID NO: 731703 - RNA, 21 nt, Human
ugaaugagcaucuggacuuuu

SEQ ID NO: 731704 - RNA, 23 nt, Human
uaaccugagauugcaagggagcu

SEQ ID NO: 731705 - RNA, 22 nt, Human
auaugcuagugugcuuauacuu

SEQ ID NO: 731706 - RNA, 22 nt, Human
cugcucugaguauuaacggagg

SEQ ID NO: 731707 - RNA, 22 nt, Human
agcuccagggaaagaguggauc

SEQ ID NO: 731708 - RNA, 20 nt, Human
cucaguguauucugggugcu

SEQ ID NO: 731709 - RNA, 22 nt, Human
gauuucaaggaguuuucacagu

SEQ ID NO: 731710 - RNA, 22 nt, Human
uaggccauucuuggagcuuacu

SEQ ID NO: 731711 - RNA, 22 nt, Human
cucugcaucaggcauuauggau

SEQ ID NO: 731712 - RNA, 22 nt, Human
caaaucaccacuuaauggguua

SEQ ID NO: 731713 - RNA, 22 nt, Human
uguguacacacagauauauaca

SEQ ID NO: 731714 - RNA, 18 nt, Human
ucugaauauuaugcagug

SEQ ID NO: 731715 - RNA, 22 nt, Human
agcuggcagucauccuagugag

SEQ ID NO: 731716 - RNA, 19 nt, Human
ggucacaaggaguugugaa

SEQ ID NO: 731717 - RNA, 22 nt, Human
gcuccuggccagcacagggccc

SEQ ID NO: 731718 - RNA, 22 nt, Human
ccugagauggccagugcuggga

SEQ ID NO: 731719 - RNA, 22 nt, Human
auuucagcccaguaugagcccc

SEQ ID NO: 731720 - RNA, 22 nt, Human
uggaggccauaccuccugacau

SEQ ID NO: 731721 - RNA, 19 nt, Human
cagcugcaccgugaccauc

SEQ ID NO: 731722 - RNA, 22 nt, Human
ucaccucucuggccgucuaccu

SEQ ID NO: 731723 - RNA, 22 nt, Human
gacuguggucuguucuccaggu

SEQ ID NO: 731724 - RNA, 20 nt, Human
uccuucagacgacaagcaag

SEQ ID NO: 731725 - RNA, 22 nt, Human
caguucccuaauguguagaaga

SEQ ID NO: 731726 - RNA, 22 nt, Human
uuuccaaaggcuaaacucaguu

SEQ ID NO: 731727 - RNA, 22 nt, Human
uccuugaagcaacgugcagaca

SEQ ID NO: 731728 - RNA, 22 nt, Human
cagaggcugcucuggguggcau

SEQ ID NO: 731729 - RNA, 22 nt, Human
ggugccauauuauauacaguuu

SEQ ID NO: 731730 - RNA, 22 nt, Human
aaugcagaguaaauauuuaauu

SEQ ID NO: 731731 - RNA, 22 nt, Human
uuaaagagaacucaaugaauga

SEQ ID NO: 731732 - RNA, 22 nt, Human
ucugugccuucucccagacuua

SEQ ID NO: 731733 - RNA, 22 nt, Human
uuaaagcauccugucagucugu

SEQ ID NO: 731734 - RNA, 22 nt, Human
acugcugauauaagaaaagauu

SEQ ID NO: 731735 - RNA, 22 nt, Human
agagagcauggcacagaggggu

SEQ ID NO: 731736 - RNA, 19 nt, Human
uauucaggaugauggcaca

SEQ ID NO: 731737 - RNA, 22 nt, Human
cucaggucacggaucugagcug

SEQ ID NO: 731738 - RNA, 22 nt, Human
uggcagggaauacagauguuua

SEQ ID NO: 731739 - RNA, 22 nt, Human
gcccaggaaagauagggccuca

SEQ ID NO: 731740 - RNA, 22 nt, Human
agcccugccauucucuggagcu

SEQ ID NO: 731741 - RNA, 22 nt, Human
agggaccugcucacugccuggc

SEQ ID NO: 731742 - RNA, 22 nt, Human
ugcagggcccuugggguugaac

SEQ ID NO: 731743 - RNA, 22 nt, Human
gaacuuuaggauuuucacaggu

SEQ ID NO: 731744 - RNA, 19 nt, Human
uccagaagucccugagcgg

SEQ ID NO: 731745 - RNA, 22 nt, Human
cacgagggcacacgugggaggg

SEQ ID NO: 731746 - RNA, 22 nt, Human
auugucacuuaaaagugcaugu

SEQ ID NO: 731747 - RNA, 21 nt, Human
agaagccuggguggagguggg

SEQ ID NO: 731748 - RNA, 22 nt, Human
acccugagaaagucacaugcau

SEQ ID NO: 731749 - RNA, 22 nt, Human
ugcuccacugugcguggccaua

SEQ ID NO: 731750 - RNA, 22 nt, Human
gucugauaucagaaaaaguaaa

SEQ ID NO: 731751 - RNA, 22 nt, Human
ggcugccuggaccuccucuuuc

SEQ ID NO: 731752 - RNA, 22 nt, Human
agauacacagcccugccaucac

SEQ ID NO: 731753 - RNA, 22 nt, Human
aggaaagaaaggaggugcauuu

SEQ ID NO: 731754 - RNA, 22 nt, Human
aaaauucuaacaugcagccaag

SEQ ID NO: 731755 - RNA, 22 nt, Human
gagaggcuggcagugccagguu

SEQ ID NO: 731756 - RNA, 22 nt, Human
uccgggggugguagauuuccuu

SEQ ID NO: 731757 - RNA, 22 nt, Human
ucuguccucuuugaagcugcuc

SEQ ID NO: 731758 - RNA, 22 nt, Human
augugucugaccacuguauugg

SEQ ID NO: 731759 - RNA, 19 nt, Human
agcuacagcauggcgaggu

SEQ ID NO: 731760 - RNA, 19 nt, Human
cucagagaggggcagugcc

SEQ ID NO: 731761 - RNA, 22 nt, Human
guucauguggaaauuuaaaaca

SEQ ID NO: 731762 - RNA, 22 nt, Human
auaugcaagcacauagaauacu

SEQ ID NO: 731763 - RNA, 22 nt, Human
cuugcuuuugcugaugauuaag

SEQ ID NO: 731764 - RNA, 22 nt, Human
cugagagaaacaugacucagga

SEQ ID NO: 731765 - RNA, 19 nt, Human
gaaugcagaagagagugga

SEQ ID NO: 731766 - RNA, 22 nt, Human
ccaugagcuucaacugacacag

SEQ ID NO: 731767 - RNA, 22 nt, Human
ccaggauggggagcagauagaa

SEQ ID NO: 731768 - RNA, 22 nt, Human
cccagcuguggcagaggccggg

SEQ ID NO: 731769 - RNA, 22 nt, Human
aggugccagcucucaggcagga

SEQ ID NO: 731770 - RNA, 22 nt, Human
cggcagagacggcgcuuugaac

SEQ ID NO: 731771 - RNA, 22 nt, Human
aauuucagaugucauaaauaua

SEQ ID NO: 731772 - RNA, 22 nt, Human
ucccugccugacagcacccacc

SEQ ID NO: 731773 - RNA, 22 nt, Human
agcuaacacauuccagcuauuu

SEQ ID NO: 731774 - RNA, 22 nt, Human
uuugcaguuucauugcugaaau

SEQ ID NO: 731775 - RNA, 22 nt, Human
ucuuucuacauuuuauaugcuu

SEQ ID NO: 731776 - RNA, 22 nt, Human
auuaguguggacccuaauuuaa

SEQ ID NO: 731777 - RNA, 22 nt, Human
cacauguguauaugugaggggg

SEQ ID NO: 731778 - RNA, 22 nt, Human
gagaggggaccugugugucuag

SEQ ID NO: 731779 - RNA, 20 nt, Human
cuaagagguccuuccacauc

SEQ ID NO: 731780 - RNA, 22 nt, Human
uuaaacauuuauggaggcagca

SEQ ID NO: 731781 - RNA, 22 nt, Human
uccaucugucuuucccauccac

SEQ ID NO: 731782 - RNA, 22 nt, Human
guguacauagaauugugcuuug

SEQ ID NO: 731783 - RNA, 22 nt, Human
cagucccaggguugguucagcu

SEQ ID NO: 731784 - RNA, 22 nt, Human
ggaaagggcagaggccuuggag

SEQ ID NO: 731785 - RNA, 22 nt, Human
aaugauggucauggcaacuuuu

SEQ ID NO: 731786 - RNA, 22 nt, Human
ucugcauuuggaucuugagcug

SEQ ID NO: 731787 - RNA, 22 nt, Human
ggacauggagcuccauggaggc

SEQ ID NO: 731788 - RNA, 22 nt, Human
aggagcagaacuguuguggagg

SEQ ID NO: 731789 - RNA, 22 nt, Human
augugucauuauccagaauaac

SEQ ID NO: 731790 - RNA, 22 nt, Human
guggaggagaggcgccuugcgg

SEQ ID NO: 731791 - RNA, 22 nt, Human
aacaaauguguggcaguguggg

SEQ ID NO: 731792 - RNA, 22 nt, Human
uuggcaguccaggauuaauaua

SEQ ID NO: 731793 - RNA, 21 nt, Human
uguguucuucuaggucagcua

SEQ ID NO: 731794 - RNA, 19 nt, Human
cccucuugcacaaagcaaa

SEQ ID NO: 731795 - RNA, 22 nt, Human
ggagcgugcagcaugagcucau

SEQ ID NO: 731796 - RNA, 22 nt, Human
ugcucauuggcgaucugaggga

SEQ ID NO: 731797 - RNA, 22 nt, Human
cgcaacagagcagguuugauga

SEQ ID NO: 731798 - RNA, 22 nt, Human
cuuucagucaguuaacucagaa

SEQ ID NO: 731799 - RNA, 22 nt, Human
augugcacacagugucaugcaa

SEQ ID NO: 731800 - RNA, 22 nt, Human
uugcuuuuaaucuuuguacauc

SEQ ID NO: 731801 - RNA, 22 nt, Human
uccuggaggcacucgcuggggc

SEQ ID NO: 731802 - RNA, 22 nt, Human
ucagugcaucacagaacuuugu

SEQ ID NO: 731803 - RNA, 22 nt, Human
uaugaagauauaucugaucucu

SEQ ID NO: 731804 - RNA, 22 nt, Human
uuuuuaagagucuggaaauagu

SEQ ID NO: 731805 - RNA, 22 nt, Human
aaugacaauaaucauuaacuuu

SEQ ID NO: 731806 - RNA, 22 nt, Human
aagcaggcaggguggagaguuu

SEQ ID NO: 731807 - RNA, 22 nt, Human
gcugccuccaaucugugccccg

SEQ ID NO: 731808 - RNA, 17 nt, Human
ggcagccucaggcguuu

SEQ ID NO: 731809 - RNA, 22 nt, Human
gugagggcaaauuagaaucaaa

SEQ ID NO: 731810 - RNA, 22 nt, Human
ccuccccacgggcagccggcgc

SEQ ID NO: 731811 - RNA, 22 nt, Human
ccagcagggcagugcccuggac

SEQ ID NO: 731812 - RNA, 23 nt, Human
cccaggaguuucacugcaaaggu

SEQ ID NO: 731813 - RNA, 23 nt, Human
caaaaugcuaugugcccaaugca

SEQ ID NO: 731814 - RNA, 22 nt, Human
auguagcagauauuugugcaca

SEQ ID NO: 731815 - RNA, 19 nt, Human
gauagcugaugaccaucau

SEQ ID NO: 731816 - RNA, 22 nt, Human
caacaguguugcaaucugaaaa

SEQ ID NO: 731817 - RNA, 22 nt, Human
caggaagugugaggguggugua

SEQ ID NO: 731818 - RNA, 22 nt, Human
uugauucugaugaaaguccauu

SEQ ID NO: 731819 - RNA, 22 nt, Human
gggcuggaguugggaagacaaa

SEQ ID NO: 731820 - RNA, 22 nt, Human
cagcaguggcugcaggcagcug

SEQ ID NO: 731821 - RNA, 22 nt, Human
uuccucagaaaauacuguccaa

SEQ ID NO: 731822 - RNA, 22 nt, Human
uuacaugacucaauagaagggc

SEQ ID NO: 731823 - RNA, 22 nt, Human
caucuugacugggauaagggau

SEQ ID NO: 731824 - RNA, 22 nt, Human
ugcaaauuucuuuaguacauaa

SEQ ID NO: 731825 - RNA, 22 nt, Human
ggccugugagaaucaaggaaaa

SEQ ID NO: 731826 - RNA, 22 nt, Human
agcugcugcgccucacccuggc

SEQ ID NO: 731827 - RNA, 22 nt, Human
uuucuaaggugauccuuucuua

SEQ ID NO: 731828 - RNA, 22 nt, Human
cugggccugguagggcuugaaa

SEQ ID NO: 731829 - RNA, 22 nt, Human
uguauacauguguucaugcaug

SEQ ID NO: 731830 - RNA, 22 nt, Human
agugagacaguggacucugcau

SEQ ID NO: 731831 - RNA, 22 nt, Human
ucugagcuggagcccaucaccu

SEQ ID NO: 731832 - RNA, 21 nt, Human
agaggccaagucaucauuucc

SEQ ID NO: 731833 - RNA, 22 nt, Human
cagaggauauaugguuuguaug

SEQ ID NO: 731834 - RNA, 22 nt, Human
uggggcagaguaggauuuuggc

SEQ ID NO: 731835 - RNA, 22 nt, Human
cuggaggggcuggcaugguagc

SEQ ID NO: 731836 - RNA, 22 nt, Human
accagugcuuccugcuggagcu

SEQ ID NO: 731837 - RNA, 20 nt, Human
gagauuuccaaucaugccca

SEQ ID NO: 731838 - RNA, 22 nt, Human
agccaagaaucaugagcuaaua

SEQ ID NO: 731839 - RNA, 22 nt, Human
ucagauauucucuaagaacaau

SEQ ID NO: 731840 - RNA, 21 nt, Human
ccucuggcuugugcugugccc

SEQ ID NO: 731841 - RNA, 22 nt, Human
gcuuggggucaugaggcugcug

SEQ ID NO: 731842 - RNA, 20 nt, Human
gccaaggaggagaaacaggc

SEQ ID NO: 731843 - RNA, 22 nt, Human
cagagagaaucuuggcagcuga

SEQ ID NO: 731844 - RNA, 21 nt, Human
agcagaggcagaauguaugca

SEQ ID NO: 731845 - RNA, 22 nt, Human
agaguauaauuagugucuucua

SEQ ID NO: 731846 - RNA, 22 nt, Human
caggugagcucuaucuagggag

SEQ ID NO: 731847 - RNA, 22 nt, Human
ugucugaaggccugaccuacau

SEQ ID NO: 731848 - RNA, 22 nt, Human
cccugugccuaguuggccuaaa

SEQ ID NO: 731849 - RNA, 22 nt, Human
ucuuucaaugugaaaccaugua

SEQ ID NO: 731850 - RNA, 22 nt, Human
ucagaggaaaggucagauggcu

SEQ ID NO: 731851 - RNA, 22 nt, Human
gaacaaugaaagacauaaacuc

SEQ ID NO: 731852 - RNA, 22 nt, Human
cugaggccuggugaggugguga

SEQ ID NO: 731853 - RNA, 21 nt, Human
gccuuugguuucuuguccugc

SEQ ID NO: 731854 - RNA, 22 nt, Human
ugggccacuugaaaguggaugu

SEQ ID NO: 731855 - RNA, 20 nt, Human
ggccugagcauggcuggcag

SEQ ID NO: 731856 - RNA, 22 nt, Human
auuuuuccaugauacuuaucug

SEQ ID NO: 731857 - RNA, 22 nt, Human
cugugacuguguuggaugcaca

SEQ ID NO: 731858 - RNA, 22 nt, Human
caaaccugagaacaugugcugu

SEQ ID NO: 731859 - RNA, 22 nt, Human
gguuucaacuaaaucaagaagg

SEQ ID NO: 731860 - RNA, 22 nt, Human
auuugccuuuuaaacucacaau

SEQ ID NO: 731861 - RNA, 20 nt, Human
aggaggcaauguagauaagc

SEQ ID NO: 731862 - RNA, 22 nt, Human
uccuagaauagugugucuggag

SEQ ID NO: 731863 - RNA, 22 nt, Human
cacaugaauucacauguauuuu

SEQ ID NO: 731864 - RNA, 22 nt, Human
uaagcaaauaaugcaucaaggg

SEQ ID NO: 731865 - RNA, 22 nt, Human
ucacaugcccuaccuaaucuua

SEQ ID NO: 731866 - RNA, 22 nt, Human
cuucauuggcuuccauagaugc

SEQ ID NO: 731867 - RNA, 22 nt, Human
cucaguuuccccggccugggcg

SEQ ID NO: 731868 - RNA, 22 nt, Human
cagagacacuuaacaggaaugg

SEQ ID NO: 731869 - RNA, 22 nt, Human
gcuuacaggugaggcagcaaga

SEQ ID NO: 731870 - RNA, 22 nt, Human
ccuguacaagagccaucuggau

SEQ ID NO: 731871 - RNA, 22 nt, Human
uugucugcuuguucagauggaa

SEQ ID NO: 731872 - RNA, 22 nt, Human
guuccccuuguguuguugccca

SEQ ID NO: 731873 - RNA, 21 nt, Human
ucuggggaagacaucuaggau

SEQ ID NO: 731874 - RNA, 22 nt, Human
auuauauaaaauucuggaagcu

SEQ ID NO: 731875 - RNA, 22 nt, Human
cauuucuagagucccaagaggu

SEQ ID NO: 731876 - RNA, 22 nt, Human
aaauugcugacacuugaccauu

SEQ ID NO: 731877 - RNA, 23 nt, Human
cagaagacagucucaagacaagg

SEQ ID NO: 731878 - RNA, 22 nt, Human
gccagcuguaucuuuggccagc

SEQ ID NO: 731879 - RNA, 22 nt, Human
aaggggugcaaguuaaucagca

SEQ ID NO: 731880 - RNA, 22 nt, Human
aaaguaagaccaagugaucauu

SEQ ID NO: 731881 - RNA, 22 nt, Human
gggggccuuauucaucugccag

SEQ ID NO: 731882 - RNA, 22 nt, Human
acagguggaggcuuuaggaggu

SEQ ID NO: 731883 - RNA, 22 nt, Human
agaagcauuauuuaauuuuacu

SEQ ID NO: 731884 - RNA, 22 nt, Human
gcugaggcggaaggauugcuag

SEQ ID NO: 731885 - RNA, 22 nt, Human
ucagguguuagaagaaauuuca

SEQ ID NO: 731886 - RNA, 22 nt, Human
gugcagccugucgccaguggau

SEQ ID NO: 731887 - RNA, 22 nt, Human
agccagggaaggauaacaagaa

SEQ ID NO: 731888 - RNA, 22 nt, Human
aucucuggguccauagaagaga

SEQ ID NO: 731889 - RNA, 22 nt, Human
uccuggagccaaugugcugcug

SEQ ID NO: 731890 - RNA, 22 nt, Human
uguacaccugucuuuacacaua

SEQ ID NO: 731891 - RNA, 22 nt, Human
ugaauaaaucaaagacugcccu

SEQ ID NO: 731892 - RNA, 20 nt, Human
ugugagaggguggcuugccc

SEQ ID NO: 731893 - RNA, 22 nt, Human
cuuuguaucuaaauaucuugaa

SEQ ID NO: 731894 - RNA, 22 nt, Human
gcugcagagggucuuagagagg

SEQ ID NO: 731895 - RNA, 21 nt, Human
ucucuggaauuagaccauguu

SEQ ID NO: 731896 - RNA, 22 nt, Human
gaggagccaggaggucucccug

SEQ ID NO: 731897 - RNA, 22 nt, Human
agcaaggccuacagagaggggc

SEQ ID NO: 731898 - RNA, 22 nt, Human
ucuggcucuaacuaggcaucag

SEQ ID NO: 731899 - RNA, 22 nt, Human
gaggaagaaagcauaggugggg

SEQ ID NO: 731900 - RNA, 22 nt, Human
gugcagauccugauugcaguuc

SEQ ID NO: 731901 - RNA, 22 nt, Human
ucagccauggugagagugagag

SEQ ID NO: 731902 - RNA, 22 nt, Human
gcccugagacugagcauggguu

SEQ ID NO: 731903 - RNA, 22 nt, Human
gccacagguggaauuaagaaau

SEQ ID NO: 731904 - RNA, 22 nt, Human
gggcuggauguuugaugacgaa

SEQ ID NO: 731905 - RNA, 22 nt, Human
ggcugccucccaggagaaucug

SEQ ID NO: 731906 - RNA, 22 nt, Human
agcuccuggaggugcgcacucg

SEQ ID NO: 731907 - RNA, 22 nt, Human
cagggccaagccccuuuggcug

SEQ ID NO: 731908 - RNA, 22 nt, Human
agcauccaacaggagggaaggg

SEQ ID NO: 731909 - RNA, 22 nt, Human
cuccagugagcgcggggcaugg

SEQ ID NO: 731910 - RNA, 21 nt, Human
ugcagaggcacaaacaagccc

SEQ ID NO: 731911 - RNA, 22 nt, Human
ucagagauucacgucaguccca

SEQ ID NO: 731912 - RNA, 22 nt, Human
uccauccaggccagcaguaauc

SEQ ID NO: 731913 - RNA, 22 nt, Human
ggagggcugccagguggagcgg

SEQ ID NO: 731914 - RNA, 22 nt, Human
ucagcaccaguuauccucaggg

SEQ ID NO: 731915 - RNA, 22 nt, Human
agaagcaccugucagcuacaug

SEQ ID NO: 731916 - RNA, 22 nt, Human
aguaacuuaggagauacauggg

SEQ ID NO: 731917 - RNA, 22 nt, Human
agcuucagcuugcagcugugau

SEQ ID NO: 731918 - RNA, 22 nt, Human
aacaugcuuugauaaauaaaag

SEQ ID NO: 731919 - RNA, 22 nt, Human
uguguguaauguuucucucuuc

SEQ ID NO: 731920 - RNA, 22 nt, Human
agggggcucagcauggauggag

SEQ ID NO: 731921 - RNA, 22 nt, Human
cuucuuauuaauccuucucugu

SEQ ID NO: 731922 - RNA, 22 nt, Human
uuaccaaaugaaauagagauuu

SEQ ID NO: 731923 - RNA, 22 nt, Human
aguacaaugucugacacaguag

SEQ ID NO: 731924 - RNA, 22 nt, Human
agcggcugcuccgcaggcuggc

SEQ ID NO: 731925 - RNA, 21 nt, Human
ugccagcugcugcaucugucu

SEQ ID NO: 731926 - RNA, 22 nt, Human
gcagaugaaguuuacaggaaac

SEQ ID NO: 731927 - RNA, 22 nt, Human
uaggugaguuuggggaagauag

SEQ ID NO: 731928 - RNA, 23 nt, Human
cuguuauauucuagggagcugca

SEQ ID NO: 731929 - RNA, 22 nt, Human
ugggauggccuuugaaagccag

SEQ ID NO: 731930 - RNA, 22 nt, Human
ggucaaagggugagauggcagg

SEQ ID NO: 731931 - RNA, 22 nt, Human
acuguacuguguauuguagaau

SEQ ID NO: 731932 - RNA, 22 nt, Human
uauaaucugguuuuauuaagag

SEQ ID NO: 731933 - RNA, 22 nt, Human
caggcccaagacugaugagucu

SEQ ID NO: 731934 - RNA, 22 nt, Human
ccaaaaauuagauacacauaua

SEQ ID NO: 731935 - RNA, 22 nt, Human
aaauaaagguccacuuuagggc

SEQ ID NO: 731936 - RNA, 22 nt, Human
acugugagagagguucuuggua

SEQ ID NO: 731937 - RNA, 23 nt, Human
ccagcccuccaccagcucuaggc

SEQ ID NO: 731938 - RNA, 22 nt, Human
guucacauggcauuuucacauc

SEQ ID NO: 731939 - RNA, 22 nt, Human
uaaagacaauaggaaaguuguu

SEQ ID NO: 731940 - RNA, 23 nt, Human
caggaagcagaugggguagaaga

SEQ ID NO: 731941 - RNA, 22 nt, Human
accauggaccauaguuccuauu

SEQ ID NO: 731942 - RNA, 22 nt, Human
gcugagaguccaggaaaacauc

SEQ ID NO: 731943 - RNA, 22 nt, Human
auuuauuaugggauuuggcaca

SEQ ID NO: 731944 - RNA, 20 nt, Human
ucacaggggaccaggagcag

SEQ ID NO: 731945 - RNA, 22 nt, Human
acuguaaaaugagauauguaua

SEQ ID NO: 731946 - RNA, 22 nt, Human
gggacacagagaaacuggagaa

SEQ ID NO: 731947 - RNA, 22 nt, Human
gagguuucuuaucaagaaagcu

SEQ ID NO: 731948 - RNA, 22 nt, Human
gaagggugcauggagggaaguc

SEQ ID NO: 731949 - RNA, 22 nt, Human
caugcacuuaccugaaauucaa

SEQ ID NO: 731950 - RNA, 17 nt, Human
acagcagggaaguguug

SEQ ID NO: 731951 - RNA, 22 nt, Human
gagacauggcaaaagcacuggu

SEQ ID NO: 731952 - RNA, 22 nt, Human
augaaugugaugauucuguuac

SEQ ID NO: 731953 - RNA, 22 nt, Human
ccaggcagccaagugugugugu

SEQ ID NO: 731954 - RNA, 22 nt, Human
gugaaaucugaggcccaugaug

SEQ ID NO: 731955 - RNA, 22 nt, Human
aggcaccuugagagcaggagcu

SEQ ID NO: 731956 - RNA, 19 nt, Human
aggccugggguuuugcacu

SEQ ID NO: 731957 - RNA, 22 nt, Human
aguuuucugaccccugcucuau

SEQ ID NO: 731958 - RNA, 22 nt, Human
ugagcccugugacugcuuugag

SEQ ID NO: 731959 - RNA, 22 nt, Human
gcagggccuuagcagcggcugc

SEQ ID NO: 731960 - RNA, 22 nt, Human
agccaaggacucagugguaggc

SEQ ID NO: 731961 - RNA, 21 nt, Human
ugaauaaagcugcugucgaua

SEQ ID NO: 731962 - RNA, 22 nt, Human
cuuauuagaaagaaaagacaug

SEQ ID NO: 731963 - RNA, 22 nt, Human
ucccucagcaggaacuggccug

SEQ ID NO: 731964 - RNA, 22 nt, Human
ccugggcucaagugaugguccc

SEQ ID NO: 731965 - RNA, 22 nt, Human
aagcuuaaucagucugguugca

SEQ ID NO: 731966 - RNA, 16 nt, Human
ugaggccagccauuuc

SEQ ID NO: 731967 - RNA, 22 nt, Human
ccauuggagccaagaguuuuac

SEQ ID NO: 731968 - RNA, 22 nt, Human
aggcacugaaggaagcuugcgc

SEQ ID NO: 731969 - RNA, 22 nt, Human
gagcuggccgcagagagggcag

SEQ ID NO: 731970 - RNA, 22 nt, Human
uggacaugucuucuccaagaaa

SEQ ID NO: 731971 - RNA, 22 nt, Human
gcaagcaguuacccaggauucg

SEQ ID NO: 731972 - RNA, 22 nt, Human
uggcaccaaaagcagacguauu

SEQ ID NO: 731973 - RNA, 22 nt, Human
cugcagggcccgccugagcccu

SEQ ID NO: 731974 - RNA, 22 nt, Human
ugucagcaggacauuaaaagcu

SEQ ID NO: 731975 - RNA, 22 nt, Human
caugaagcacagcucucuuuuu

SEQ ID NO: 731976 - RNA, 22 nt, Human
uggauucaaauuucagcucugu

SEQ ID NO: 731977 - RNA, 22 nt, Human
gcuuccucgcugggcagaggca

SEQ ID NO: 731978 - RNA, 22 nt, Human
augcugugccuucucugugcca

SEQ ID NO: 731979 - RNA, 22 nt, Human
accaggccaacagcuaaguuaa

SEQ ID NO: 731980 - RNA, 22 nt, Human
aggaaacauugauauugggaaa

SEQ ID NO: 731981 - RNA, 22 nt, Human
cacacagcuagugacaggagaa

SEQ ID NO: 731982 - RNA, 22 nt, Human
gucacaguggggucacagugug

SEQ ID NO: 731983 - RNA, 22 nt, Human
aaucuguuuuugaaacuuugua

SEQ ID NO: 731984 - RNA, 22 nt, Human
uacuaaaugauuaagcaggaau

SEQ ID NO: 731985 - RNA, 22 nt, Human
aaggcuguuuauuagaaaaagu

SEQ ID NO: 731986 - RNA, 22 nt, Human
auguuucaugacugagcaaaau

SEQ ID NO: 731987 - RNA, 22 nt, Human
uuauuuggguuugaguguggca

SEQ ID NO: 731988 - RNA, 20 nt, Human
cagugcccguggaaaagaug

SEQ ID NO: 731989 - RNA, 22 nt, Human
gccaagaaagaacagcagggaa

SEQ ID NO: 731990 - RNA, 22 nt, Human
cucuccugggcugaccguccga

SEQ ID NO: 731991 - RNA, 22 nt, Human
uauggcuuuuaaggagaucuga

SEQ ID NO: 731992 - RNA, 22 nt, Human
ccccaugaaguagggucucuga

SEQ ID NO: 731993 - RNA, 22 nt, Human
ucugccucuuucaggccuggca

SEQ ID NO: 731994 - RNA, 21 nt, Human
gaacauuuggguuguuucuac

SEQ ID NO: 731995 - RNA, 22 nt, Human
augcacaagaggcuagaaaaga

SEQ ID NO: 731996 - RNA, 22 nt, Human
uucagacuuaaaagaucccagc

SEQ ID NO: 731997 - RNA, 22 nt, Human
uaugacaagaaauacagaggua

SEQ ID NO: 731998 - RNA, 16 nt, Human
ucuuccuuuugauuuu

SEQ ID NO: 731999 - RNA, 22 nt, Human
ccugggaaguuguggcugcagu

SEQ ID NO: 732000 - RNA, 22 nt, Human
agucacaugggauuagaaccca

SEQ ID NO: 732001 - RNA, 22 nt, Human
acauuucuggaguuucucaaca

SEQ ID NO: 732002 - RNA, 22 nt, Human
agcaaggauuauccugggaagg

SEQ ID NO: 732003 - RNA, 22 nt, Human
cugaggucagaguuuagucugg

SEQ ID NO: 732004 - RNA, 21 nt, Human
ggcugcugucaccgcugucac

SEQ ID NO: 732005 - RNA, 22 nt, Human
uuauuuacaacucuucucuucc

SEQ ID NO: 732006 - RNA, 22 nt, Human
agccacagcaacaagugcaauu

SEQ ID NO: 732007 - RNA, 22 nt, Human
cagagcucuauguucauggagg

SEQ ID NO: 732008 - RNA, 22 nt, Human
acacugugauuucuggguucca

SEQ ID NO: 732009 - RNA, 22 nt, Human
ugagcaagacccggccucugcc

SEQ ID NO: 732010 - RNA, 22 nt, Human
gagcaaacaaaacugaugugac

SEQ ID NO: 732011 - RNA, 22 nt, Human
gauauauuuuccauggucugca

SEQ ID NO: 732012 - RNA, 22 nt, Human
uucaugugauaaaugugugacu

SEQ ID NO: 732013 - RNA, 22 nt, Human
uagggcucagcucuagcuccug

SEQ ID NO: 732014 - RNA, 22 nt, Human
cucagggccaaggaugcuguug

SEQ ID NO: 732015 - RNA, 21 nt, Human
gugcugggacacagccaggcu

SEQ ID NO: 732016 - RNA, 22 nt, Human
gcugagcacaccuaggguagag

SEQ ID NO: 732017 - RNA, 20 nt, Human
ucuggugccccuuccugaga

SEQ ID NO: 732018 - RNA, 22 nt, Human
ucccagagccaagcuauggaug

SEQ ID NO: 732019 - RNA, 21 nt, Human
augcauauuuuaaguuguguc

SEQ ID NO: 732020 - RNA, 22 nt, Human
aaaggccaugguuggaguguuu

SEQ ID NO: 732021 - RNA, 22 nt, Human
gggguggcuggcaccuccuggu

SEQ ID NO: 732022 - RNA, 22 nt, Human
gucuuuaugguaugaaaacuga

SEQ ID NO: 732023 - RNA, 22 nt, Human
uugaaaacagcguagauucaca

SEQ ID NO: 732024 - RNA, 22 nt, Human
gcaaggaagagcagguggugcu

SEQ ID NO: 732025 - RNA, 17 nt, Human
uggcagcugaaagcucu

SEQ ID NO: 732026 - RNA, 19 nt, Human
uagacuuuuccagcaggca

SEQ ID NO: 732027 - RNA, 22 nt, Human
uggaccugaagaauaggaagua

SEQ ID NO: 732028 - RNA, 23 nt, Human
uucagcaugaagagugaaggcug

SEQ ID NO: 732029 - RNA, 22 nt, Human
cucuuuuacaccaaaaggccua

SEQ ID NO: 732030 - RNA, 22 nt, Human
gucaggauuuacaaacuucagu

SEQ ID NO: 732031 - RNA, 22 nt, Human
ccacccuuccauucuuccucuu

SEQ ID NO: 732032 - RNA, 22 nt, Human
uccaggccaauguagcaggccc

SEQ ID NO: 732033 - RNA, 22 nt, Human
uaaacauggcuguuucaguuau

SEQ ID NO: 732034 - RNA, 22 nt, Human
auuguccuaucucagugccaug

SEQ ID NO: 732035 - RNA, 22 nt, Human
agucauaucugaggaggaaucc

SEQ ID NO: 732036 - RNA, 22 nt, Human
gucuggaggaaaagguuaaaug

SEQ ID NO: 732037 - RNA, 22 nt, Human
gugaacucagucucucuugcua

SEQ ID NO: 732038 - RNA, 22 nt, Human
uaugcuuuaacauuaaacaaca

SEQ ID NO: 732039 - RNA, 22 nt, Human
cucaagugugaguuuuaaaguc

SEQ ID NO: 732040 - RNA, 22 nt, Human
uugaucuuacaguguucuucca

SEQ ID NO: 732041 - RNA, 22 nt, Human
aggucccaguguuagggugaca

SEQ ID NO: 732042 - RNA, 22 nt, Human
agauacauuaguaguuacuugu

SEQ ID NO: 732043 - RNA, 22 nt, Human
ggaguggugucacugagaggaa

SEQ ID NO: 732044 - RNA, 22 nt, Human
cugcagagagugccgggcagcc

SEQ ID NO: 732045 - RNA, 22 nt, Human
gugagacacccaagagucagau

SEQ ID NO: 732046 - RNA, 22 nt, Human
ugucugagugugccugggcauu

SEQ ID NO: 732047 - RNA, 22 nt, Human
gagucugagagccuaaugaccu

SEQ ID NO: 732048 - RNA, 22 nt, Human
uaaaccugcaacuauagccacc

SEQ ID NO: 732049 - RNA, 20 nt, Human
ucucugcuguccacauuugc

SEQ ID NO: 732050 - RNA, 22 nt, Human
ccugaagcacccggagcuggca

SEQ ID NO: 732051 - RNA, 22 nt, Human
agaacauuugucaaaaagccaa

SEQ ID NO: 732052 - RNA, 22 nt, Human
gcagacagggcuacagagguac

SEQ ID NO: 732053 - RNA, 22 nt, Human
ccucuaggauguggcuggagga

SEQ ID NO: 732054 - RNA, 22 nt, Human
gggcccagcacuggcugggauc

SEQ ID NO: 732055 - RNA, 22 nt, Human
uagugaauuccuaauaggaaga

SEQ ID NO: 732056 - RNA, 22 nt, Human
aggcacuugaauugaugauguu

SEQ ID NO: 732057 - RNA, 22 nt, Human
agacagugagaaugaguugaaa

SEQ ID NO: 732058 - RNA, 22 nt, Human
ugccucuguggaaauggugguc

SEQ ID NO: 732059 - RNA, 21 nt, Human
uccaggccaugguggggaggc

SEQ ID NO: 732060 - RNA, 18 nt, Human
gcagccccucuuccuucc

SEQ ID NO: 732061 - RNA, 21 nt, Human
ugcaggaaguauggugccuau

SEQ ID NO: 732062 - RNA, 22 nt, Human
ucugggaacucugucauuuccc

SEQ ID NO: 732063 - RNA, 22 nt, Human
uggcacagccaucuucuccugc

SEQ ID NO: 732064 - RNA, 22 nt, Human
uaugaacuguacuguacuaagc

SEQ ID NO: 732065 - RNA, 22 nt, Human
cagugggaaugaaguggaggcc

SEQ ID NO: 732066 - RNA, 22 nt, Human
caggagacaauggcuguggggc

SEQ ID NO: 732067 - RNA, 22 nt, Human
uuaaaugugauuucauuuaugu

SEQ ID NO: 732068 - RNA, 23 nt, Human
acagggcuguccagggcuagguc

SEQ ID NO: 732069 - RNA, 22 nt, Human
uuucugcagcagacucagugug

SEQ ID NO: 732070 - RNA, 19 nt, Human
acccucuccccacuggguc

SEQ ID NO: 732071 - RNA, 22 nt, Human
ccauagugccaagucuucagca

SEQ ID NO: 732072 - RNA, 22 nt, Human
acugugggagcgcaguggcagc

SEQ ID NO: 732073 - RNA, 22 nt, Human
uaaaauugcggugaauauuucc

SEQ ID NO: 732074 - RNA, 22 nt, Human
agaaaauaaauugaugguggaa

SEQ ID NO: 732075 - RNA, 18 nt, Human
ggccugaggauuucagca

SEQ ID NO: 732076 - RNA, 22 nt, Human
gcagacagcauguugggcuauu

SEQ ID NO: 732077 - RNA, 22 nt, Human
augacacauaaaacaaggacug

SEQ ID NO: 732078 - RNA, 22 nt, Human
ucagagcccugcuccuccccaa

SEQ ID NO: 732079 - RNA, 22 nt, Human
agcuggguggagggcccacggu

SEQ ID NO: 732080 - RNA, 22 nt, Human
gugcauauaugcacauaugugu

SEQ ID NO: 732081 - RNA, 22 nt, Human
gagcccagggcaggcaaggcag

SEQ ID NO: 732082 - RNA, 22 nt, Human
aggucuggugagagcaggugcu

SEQ ID NO: 732083 - RNA, 22 nt, Human
aucuggcugcugugcuuaagcu

SEQ ID NO: 732084 - RNA, 22 nt, Human
gacacugaggcaugcagagccg

SEQ ID NO: 732085 - RNA, 22 nt, Human
gcaccaggaggcccuucucauc

SEQ ID NO: 732086 - RNA, 22 nt, Human
auccaugauugcccagaggugu

SEQ ID NO: 732087 - RNA, 22 nt, Human
ccugugguuuacaugacaguua

SEQ ID NO: 732088 - RNA, 22 nt, Human
uaggagugcauaaaacuauauu

SEQ ID NO: 732089 - RNA, 22 nt, Human
ggucucugacuuagagauggau

SEQ ID NO: 732090 - RNA, 22 nt, Human
gguuugcaugugauguugggca

SEQ ID NO: 732091 - RNA, 22 nt, Human
agcaaagaaggguucuucauua

SEQ ID NO: 732092 - RNA, 22 nt, Human
agugguggagagaugaggacac

SEQ ID NO: 732093 - RNA, 22 nt, Human
gcuaggugcagcagacagcuua

SEQ ID NO: 732094 - RNA, 22 nt, Human
aaugcaccuaccuugauucugc

SEQ ID NO: 732095 - RNA, 22 nt, Human
acagagcuuaggaugacuccca

SEQ ID NO: 732096 - RNA, 22 nt, Human
ucagugcaaucaagguauguuu

SEQ ID NO: 732097 - RNA, 22 nt, Human
auuucagagcuuugcagcuaau

SEQ ID NO: 732098 - RNA, 22 nt, Human
uggcuggagagggucccaugag

SEQ ID NO: 732099 - RNA, 22 nt, Human
ccacagaaaguugucuagagua

SEQ ID NO: 732100 - RNA, 23 nt, Human
gcagaaauucucacacugaggcc

SEQ ID NO: 732101 - RNA, 22 nt, Human
guucgcaucuugaucauggacu

SEQ ID NO: 732102 - RNA, 22 nt, Human
aggcauccaugguggucgcuga

SEQ ID NO: 732103 - RNA, 22 nt, Human
cugcagaugguauuguucuggu

SEQ ID NO: 732104 - RNA, 22 nt, Human
cugggacuugcagagcaggagg

SEQ ID NO: 732105 - RNA, 22 nt, Human
caauaacuaguaauuauuccgg

SEQ ID NO: 732106 - RNA, 22 nt, Human
uuacacaauauaugguacuugg

SEQ ID NO: 732107 - RNA, 22 nt, Human
agucacugucaaagccacacac

SEQ ID NO: 732108 - RNA, 22 nt, Human
uauuugcuuugguccuccaagc

SEQ ID NO: 732109 - RNA, 20 nt, Human
ucuggggaugaggucuagga

SEQ ID NO: 732110 - RNA, 22 nt, Human
gugccugggcaugagcuuguug

SEQ ID NO: 732111 - RNA, 22 nt, Human
ccugccagugccucccacuggu

SEQ ID NO: 732112 - RNA, 22 nt, Human
uggaacaacaugcuggaaaauu

SEQ ID NO: 732113 - RNA, 22 nt, Human
cacugaguucccugacauuuca

SEQ ID NO: 732114 - RNA, 22 nt, Human
acuguaacacaaugguaucugu

SEQ ID NO: 732115 - RNA, 23 nt, Human
ggucacaugugagauuaaacuug

SEQ ID NO: 732116 - RNA, 22 nt, Human
cuggcagcgugagcagcaucca

SEQ ID NO: 732117 - RNA, 22 nt, Human
uuuccuacccuuccaggcagag

SEQ ID NO: 732118 - RNA, 22 nt, Human
auaaugaaugcagaguuauuuu

SEQ ID NO: 732119 - RNA, 22 nt, Human
cccaggguugccugccucugcu

SEQ ID NO: 732120 - RNA, 22 nt, Human
guggggcuaaaaacugugcagu

SEQ ID NO: 732121 - RNA, 22 nt, Human
ugaguccauugauggauaguga

SEQ ID NO: 732122 - RNA, 22 nt, Human
uccugggaccaggcaccuacug

SEQ ID NO: 732123 - RNA, 22 nt, Human
caccagcuucucauugcggguc

SEQ ID NO: 732124 - RNA, 22 nt, Human
uuaaucacagauauuaaacaug

SEQ ID NO: 732125 - RNA, 22 nt, Human
caaaauucugcauuucuaauaa

SEQ ID NO: 732126 - RNA, 22 nt, Human
cugcagcuuaaaggaguucaau

SEQ ID NO: 732127 - RNA, 22 nt, Human
ucucagaguaauucuuuaaggu

SEQ ID NO: 732128 - RNA, 22 nt, Human
gcacacaguauaugcucauuaa

SEQ ID NO: 732129 - RNA, 22 nt, Human
aacaugagugauaaaauuaccu

SEQ ID NO: 732130 - RNA, 22 nt, Human
aauugcuuguuuucggucauaa

SEQ ID NO: 732131 - RNA, 22 nt, Human
gaaggggaaaguugagcaaaua

SEQ ID NO: 732132 - RNA, 22 nt, Human
ucauccugaagaaccugcuucc

SEQ ID NO: 732133 - RNA, 22 nt, Human
gugguaggcacagagaacaaga

SEQ ID NO: 732134 - RNA, 20 nt, Human
aguuugugugucuaugcgcu

SEQ ID NO: 732135 - RNA, 22 nt, Human
aacucugguuucagacucacuu

SEQ ID NO: 732136 - RNA, 22 nt, Human
gaaauacaaaugccuagauccu

SEQ ID NO: 732137 - RNA, 22 nt, Human
agggcaugugggagaggagccu

SEQ ID NO: 732138 - RNA, 22 nt, Human
ugcugggcuggggccucagacc

SEQ ID NO: 732139 - RNA, 22 nt, Human
caggucuguuuccaucagugcu

SEQ ID NO: 732140 - RNA, 22 nt, Human
acaugucuuguggcuuugaucu

SEQ ID NO: 732141 - RNA, 22 nt, Human
ucuuuuguggaugaagaaaugg

SEQ ID NO: 732142 - RNA, 22 nt, Human
gagacacaagaagacaugcaca

SEQ ID NO: 732143 - RNA, 22 nt, Human
uggcacugggacagaugcucuc

SEQ ID NO: 732144 - RNA, 22 nt, Human
aaggagacauuugcagagcacc

SEQ ID NO: 732145 - RNA, 22 nt, Human
uuccagaauuuuguucugcuug

SEQ ID NO: 732146 - RNA, 22 nt, Human
ugcugggcuagaagcugaggcc

SEQ ID NO: 732147 - RNA, 22 nt, Human
caacaugccagacauuaguuug

SEQ ID NO: 732148 - RNA, 22 nt, Human
gagcuccuauggucgguggcuc

SEQ ID NO: 732149 - RNA, 22 nt, Human
agaugugggugucaggcaguga

SEQ ID NO: 732150 - RNA, 22 nt, Human
gaggcuuucacaagguuaguuc

SEQ ID NO: 732151 - RNA, 22 nt, Human
ggccuuuaagcaauugaaaaga

SEQ ID NO: 732152 - RNA, 22 nt, Human
ucucuauuaauugacaauggcu

SEQ ID NO: 732153 - RNA, 22 nt, Human
ucuugaaaauugagguugaagg

SEQ ID NO: 732154 - RNA, 22 nt, Human
uaauacugaaaggaguaucagc

SEQ ID NO: 732155 - RNA, 22 nt, Human
ccaaaguccauaguuuacauaa

SEQ ID NO: 732156 - RNA, 22 nt, Human
gcuuccuuccuuacauuggugg

SEQ ID NO: 732157 - RNA, 22 nt, Human
ucaagcaaagauacaaauggaa

SEQ ID NO: 732158 - RNA, 22 nt, Human
cuugugaaaugccagauaaucu

SEQ ID NO: 732159 - RNA, 22 nt, Human
ucaggucugggcacaugguaca

SEQ ID NO: 732160 - RNA, 22 nt, Human
aggacacuugagaguccaguca

SEQ ID NO: 732161 - RNA, 22 nt, Human
agucagagcaaacuggacagac

SEQ ID NO: 732162 - RNA, 22 nt, Human
ggcugccugaggcagugagaga

SEQ ID NO: 732163 - RNA, 22 nt, Human
gauggguagccuuucaauagca

SEQ ID NO: 732164 - RNA, 22 nt, Human
aaaguccagggaaagagcgucu

SEQ ID NO: 732165 - RNA, 22 nt, Human
guggucauguuaauuaugaucc

SEQ ID NO: 732166 - RNA, 22 nt, Human
auuauggacguuaauuuuggaa

SEQ ID NO: 732167 - RNA, 22 nt, Human
acagugucuccugguacccagu

SEQ ID NO: 732168 - RNA, 22 nt, Human
gcuggaagaaugagugccucgu

SEQ ID NO: 732169 - RNA, 22 nt, Human
ccaggguuggucucucugaggu

SEQ ID NO: 732170 - RNA, 22 nt, Human
uccugcagcugaagcucaugug

SEQ ID NO: 732171 - RNA, 22 nt, Human
uuggcccagggucagcggcgcu

SEQ ID NO: 732172 - RNA, 22 nt, Human
acacccagcugggccaccucca

SEQ ID NO: 732173 - RNA, 20 nt, Human
aggacagcagcugccacuug

SEQ ID NO: 732174 - RNA, 23 nt, Human
cucuccaccuucccacccaggga

SEQ ID NO: 732175 - RNA, 22 nt, Human
gcauccaucagcagauugacug

SEQ ID NO: 732176 - RNA, 23 nt, Human
uacaaugcaaacuuggcccaugg

SEQ ID NO: 732177 - RNA, 22 nt, Human
ucucugggauaaacugggccag

SEQ ID NO: 732178 - RNA, 22 nt, Human
ggcuggucaggaaacuaggcuc

SEQ ID NO: 732179 - RNA, 22 nt, Human
gagggugggcuccuaucugggu

SEQ ID NO: 732180 - RNA, 22 nt, Human
cuccagagaguccagcucuggg

SEQ ID NO: 732181 - RNA, 22 nt, Human
agagcuggacgucugagcccua

SEQ ID NO: 732182 - RNA, 22 nt, Human
uaugaagcugauaaucacugau

SEQ ID NO: 732183 - RNA, 22 nt, Human
uaaauuauggcuggcagagcag

SEQ ID NO: 732184 - RNA, 17 nt, Human
cugccuggagucccauc

SEQ ID NO: 732185 - RNA, 22 nt, Human
uccucagucucucaaaugaggc

SEQ ID NO: 732186 - RNA, 22 nt, Human
uucugaaggcuccucaggaaag

SEQ ID NO: 732187 - RNA, 22 nt, Human
gugcaaaagcaguugugguuuu

SEQ ID NO: 732188 - RNA, 22 nt, Human
uaggggaacuggcacagggcag

SEQ ID NO: 732189 - RNA, 22 nt, Human
caacuccuggcuguuaggcaca

SEQ ID NO: 732190 - RNA, 18 nt, Human
gcuuucugugcagcggag

SEQ ID NO: 732191 - RNA, 22 nt, Human
gcuggcuggaugguugguucgc

SEQ ID NO: 732192 - RNA, 22 nt, Human
cugguucccagcaggaguguag

SEQ ID NO: 732193 - RNA, 22 nt, Human
cagggggcagcguagaaaauga

SEQ ID NO: 732194 - RNA, 22 nt, Human
guuagaccauagaaagagcauc

SEQ ID NO: 732195 - RNA, 22 nt, Human
caugacacccaggcauagcacc

SEQ ID NO: 732196 - RNA, 23 nt, Human
uguaaauuuuguagucacauuuu

SEQ ID NO: 732197 - RNA, 22 nt, Human
cacuggcugggccagcacuccu

SEQ ID NO: 732198 - RNA, 22 nt, Human
ggucccagaauugguuagcaca

SEQ ID NO: 732199 - RNA, 22 nt, Human
cucugcccgcggaugccacguc

SEQ ID NO: 732200 - RNA, 22 nt, Human
acacuuuguuguggcauauacg

SEQ ID NO: 732201 - RNA, 21 nt, Human
uggaaugaggcugagcagugc

SEQ ID NO: 732202 - RNA, 21 nt, Human
cagcacaguacugggucuugc

SEQ ID NO: 732203 - RNA, 22 nt, Human
auccccaggggcauucaagcuu

SEQ ID NO: 732204 - RNA, 22 nt, Human
uacaacaguucaugaaaugaaa

SEQ ID NO: 732205 - RNA, 22 nt, Human
ucucuuaaaggucuucagcuga

SEQ ID NO: 732206 - RNA, 22 nt, Human
ugcuucuguauugaaauuguua

SEQ ID NO: 732207 - RNA, 22 nt, Human
cugaggugagaggaggccaugu

SEQ ID NO: 732208 - RNA, 22 nt, Human
ccagugugcaaucucuggcuua

SEQ ID NO: 732209 - RNA, 22 nt, Human
gcucagagcacucagacucagc

SEQ ID NO: 732210 - RNA, 22 nt, Human
cuggggcaucugacagauaaau

SEQ ID NO: 732211 - RNA, 22 nt, Human
agucucagcuacuugggaggcu

SEQ ID NO: 732212 - RNA, 22 nt, Human
cuggaguucuaugugcuuguga

SEQ ID NO: 732213 - RNA, 22 nt, Human
uacugucuggaguugccaaagg

SEQ ID NO: 732214 - RNA, 22 nt, Human
aacaaugauauagggauuggca

SEQ ID NO: 732215 - RNA, 22 nt, Human
ugaaauguugguaauuuuauau

SEQ ID NO: 732216 - RNA, 22 nt, Human
uuaugucaaaaugguugagauu

SEQ ID NO: 732217 - RNA, 22 nt, Human
ugugacaucgcugugucuguuu

SEQ ID NO: 732218 - RNA, 22 nt, Human
agacaauauauaauuuuaguug

SEQ ID NO: 732219 - RNA, 22 nt, Human
aacauucuuuggaggauuauuc

SEQ ID NO: 732220 - RNA, 22 nt, Human
cuuucacuuuaaucugacaccu

SEQ ID NO: 732221 - RNA, 22 nt, Human
gaguauauuucucucucuuaag

SEQ ID NO: 732222 - RNA, 22 nt, Human
gagucagaaaguagugugccua

SEQ ID NO: 732223 - RNA, 22 nt, Human
uucaauuucauaauaucuagcu

SEQ ID NO: 732224 - RNA, 22 nt, Human
aggaaauaagggacaagacaaa

SEQ ID NO: 732225 - RNA, 22 nt, Human
cacauuuaugggcugggaggca

SEQ ID NO: 732226 - RNA, 22 nt, Human
uuaaagauucugaggcugauua

SEQ ID NO: 732227 - RNA, 21 nt, Human
ggcauggcaccucugggcagg

SEQ ID NO: 732228 - RNA, 22 nt, Human
cuagagaaaaugauagcaggaa

SEQ ID NO: 732229 - RNA, 23 nt, Human
gagguacagcaccagugaauagg

SEQ ID NO: 732230 - RNA, 22 nt, Human
agagaaaugauuccugggcaga

SEQ ID NO: 732231 - RNA, 22 nt, Human
ggccucucauguccugggcuuc

SEQ ID NO: 732232 - RNA, 22 nt, Human
ucuccuacucacucaaggcuug

SEQ ID NO: 732233 - RNA, 22 nt, Human
cauuugauuacuaaagauaauu

SEQ ID NO: 732234 - RNA, 17 nt, Human
gcugagaaggggaagag

SEQ ID NO: 732235 - RNA, 22 nt, Human
agcugggagcagagccacagcc

SEQ ID NO: 732236 - RNA, 22 nt, Human
ccaggauacugcucucugcugc

SEQ ID NO: 732237 - RNA, 18 nt, Human
ucacagaauauugagugg

SEQ ID NO: 732238 - RNA, 22 nt, Human
ccugccagcgcuuaucucucgg

SEQ ID NO: 732239 - RNA, 22 nt, Human
gcuggcuugacagaggccuggg

SEQ ID NO: 732240 - RNA, 22 nt, Human
gggcaccuggcuagugacagug

SEQ ID NO: 732241 - RNA, 22 nt, Human
accaagcacaaagaugaguaaa

SEQ ID NO: 732242 - RNA, 22 nt, Human
aggacagugguguucuggagug

SEQ ID NO: 732243 - RNA, 22 nt, Human
ggcuucugaaaucucugugcgu

SEQ ID NO: 732244 - RNA, 22 nt, Human
ucaugaguuuaagguuuaggcu

SEQ ID NO: 732245 - RNA, 22 nt, Human
auggguagacugacaaagucaa

SEQ ID NO: 732246 - RNA, 22 nt, Human
agcugacucuggccucuggucc

SEQ ID NO: 732247 - RNA, 22 nt, Human
gcagcucccaucagggcacaga

SEQ ID NO: 732248 - RNA, 22 nt, Human
cucuggcuaucuguuucuaugu

SEQ ID NO: 732249 - RNA, 22 nt, Human
agcugcagugaacuguuuuguc

SEQ ID NO: 732250 - RNA, 22 nt, Human
ggaggccucaguaccuugcuuu

SEQ ID NO: 732251 - RNA, 22 nt, Human
aggccucugcuggaaagaguug

SEQ ID NO: 732252 - RNA, 22 nt, Human
gacaggcacgaaauugggcugg

SEQ ID NO: 732253 - RNA, 22 nt, Human
ccaagugauacacccgccucgg

SEQ ID NO: 732254 - RNA, 22 nt, Human
gggauagguuuggaagaggugg

SEQ ID NO: 732255 - RNA, 22 nt, Human
cuguggcacucaagaagccucc

SEQ ID NO: 732256 - RNA, 19 nt, Human
ugugugcccucaccacaua

SEQ ID NO: 732257 - RNA, 20 nt, Human
uucaugggagcaaagaggcc

SEQ ID NO: 732258 - RNA, 20 nt, Human
uucaaguugggucucuggcu

SEQ ID NO: 732259 - RNA, 22 nt, Human
ucauuuaugucuuugccaucca

SEQ ID NO: 732260 - RNA, 19 nt, Human
ccugaguguuucagagaca

SEQ ID NO: 732261 - RNA, 22 nt, Human
ggacacagccacuuaggguacc

SEQ ID NO: 732262 - RNA, 22 nt, Human
caggccugaguguggaagucuu

SEQ ID NO: 732263 - RNA, 21 nt, Human
gacaggugauucagagcaggg

SEQ ID NO: 732264 - RNA, 22 nt, Human
cgcugcagaugggagcugguug

SEQ ID NO: 732265 - RNA, 22 nt, Human
uguguagcucauauuaguguua

SEQ ID NO: 732266 - RNA, 22 nt, Human
augaggcaaggaucagguaagg

SEQ ID NO: 732267 - RNA, 22 nt, Human
aacuagaacgagaaagcugaac

SEQ ID NO: 732268 - RNA, 22 nt, Human
gaggcaggcagauugcuugagg

SEQ ID NO: 732269 - RNA, 22 nt, Human
uguacaaggccaucuacaugcu

SEQ ID NO: 732270 - RNA, 22 nt, Human
uccuagaauaaucuuugacugc

SEQ ID NO: 732271 - RNA, 22 nt, Human
auuccagaugcuuguauuuaaa

SEQ ID NO: 732272 - RNA, 22 nt, Human
uucaucugcuucuuccuauucc

SEQ ID NO: 732273 - RNA, 22 nt, Human
uuaaugcagaaaucaaacugac

SEQ ID NO: 732274 - RNA, 22 nt, Human
aaucaguucuacaucuuaucca

SEQ ID NO: 732275 - RNA, 22 nt, Human
uguccagguggccucugcugcu

SEQ ID NO: 732276 - RNA, 23 nt, Human
uucucuuuagauuuacauuacuc

SEQ ID NO: 732277 - RNA, 18 nt, Human
caauuuuacccagucccu

SEQ ID NO: 732278 - RNA, 22 nt, Human
acacacaugcaugcuugccauu

SEQ ID NO: 732279 - RNA, 22 nt, Human
gaauuagguaauagaacuagua

SEQ ID NO: 732280 - RNA, 20 nt, Human
uauauuuucucuuuggccuu

SEQ ID NO: 732281 - RNA, 22 nt, Human
gcuggggagaauuggguuaucu

SEQ ID NO: 732282 - RNA, 22 nt, Human
cagagcaguaaaucuggggcac

SEQ ID NO: 732283 - RNA, 22 nt, Human
ggcagccacccugggaggcaga

SEQ ID NO: 732284 - RNA, 22 nt, Human
ucuuuaguauugaguuauggua

SEQ ID NO: 732285 - RNA, 22 nt, Human
caccugcucccucaguuccagc

SEQ ID NO: 732286 - RNA, 22 nt, Human
acagcaugagagaugaacauuc

SEQ ID NO: 732287 - RNA, 22 nt, Human
cugacagcuguugcagugaaug

SEQ ID NO: 732288 - RNA, 22 nt, Human
uuacaggaggugcuagguguuu

SEQ ID NO: 732289 - RNA, 22 nt, Human
ggcugggcugcugggucagagc

SEQ ID NO: 732290 - RNA, 22 nt, Human
ggcucccugggugcuccugcuc

SEQ ID NO: 732291 - RNA, 22 nt, Human
aggcuucugauaccaugagaga

SEQ ID NO: 732292 - RNA, 22 nt, Human
cuagaagcaacuagaucuguuu

SEQ ID NO: 732293 - RNA, 22 nt, Human
aaauauaauuucugccucaaua

SEQ ID NO: 732294 - RNA, 22 nt, Human
acuuggagagauaaucccauau

SEQ ID NO: 732295 - RNA, 22 nt, Human
uaaggcaggaacuggcuguuuu

SEQ ID NO: 732296 - RNA, 22 nt, Human
aaacaugcauucaagaaaaucu

SEQ ID NO: 732297 - RNA, 22 nt, Human
auuuaauuuucucaacagugcu

SEQ ID NO: 732298 - RNA, 22 nt, Human
cagcucuggcagagcccaaccc

SEQ ID NO: 732299 - RNA, 22 nt, Human
uuugcauugccucugacuuaug

SEQ ID NO: 732300 - RNA, 22 nt, Human
caaaguauauuucauagucuca

SEQ ID NO: 732301 - RNA, 22 nt, Human
uuacauauuauccaaaacugcu

SEQ ID NO: 732302 - RNA, 22 nt, Human
aguuuucucuguguucugcuua

SEQ ID NO: 732303 - RNA, 22 nt, Human
uuuauuccaugugucuaugacc

SEQ ID NO: 732304 - RNA, 22 nt, Human
uuuguguauguaugcuuguaca

SEQ ID NO: 732305 - RNA, 22 nt, Human
aauugcauguuaaugacuaagu

SEQ ID NO: 732306 - RNA, 22 nt, Human
ugagcgugcaguaguguuggua

SEQ ID NO: 732307 - RNA, 22 nt, Human
ucccaggcaaaggcagcucauu

SEQ ID NO: 732308 - RNA, 20 nt, Human
augaagacaaauccgacuug

SEQ ID NO: 732309 - RNA, 17 nt, Human
aaaucacugucaguuca

SEQ ID NO: 732310 - RNA, 22 nt, Human
agacagcuaauaaaugagugug

SEQ ID NO: 732311 - RNA, 22 nt, Human
aagucccuuuaaucagugccuu

SEQ ID NO: 732312 - RNA, 22 nt, Human
caugcaugccgggcugacagag

SEQ ID NO: 732313 - RNA, 22 nt, Human
gugguccccagagcuguguaca

SEQ ID NO: 732314 - RNA, 22 nt, Human
uuuuagaaguucaugugggauu

SEQ ID NO: 732315 - RNA, 18 nt, Human
auccuugaugagaggucu

SEQ ID NO: 732316 - RNA, 22 nt, Human
cugggucagucugucccuaggg

SEQ ID NO: 732317 - RNA, 22 nt, Human
gagcccaggcugggguucagag

SEQ ID NO: 732318 - RNA, 22 nt, Human
aguggggacaaugagagcaggu

SEQ ID NO: 732319 - RNA, 22 nt, Human
agcagacaauugccuggaugga

SEQ ID NO: 732320 - RNA, 22 nt, Human
aacuagaaaacaagaugcugau

SEQ ID NO: 732321 - RNA, 22 nt, Human
acacauguuuguguagucaguu

SEQ ID NO: 732322 - RNA, 22 nt, Human
cauauuaaggucuguaaggggu

SEQ ID NO: 732323 - RNA, 22 nt, Human
uuauugacuuguuuguccuggu

SEQ ID NO: 732324 - RNA, 21 nt, Human
aagagcugucaggaaggcugc

SEQ ID NO: 732325 - RNA, 22 nt, Human
uuuuccuuucaucaggacaaag

SEQ ID NO: 732326 - RNA, 22 nt, Human
agggacgccgugcgggaccgug

SEQ ID NO: 732327 - RNA, 22 nt, Human
gggagcuauuuauagaggcuga

SEQ ID NO: 732328 - RNA, 22 nt, Human
acccacuguagccacucugggu

SEQ ID NO: 732329 - RNA, 22 nt, Human
caacaggcuuuauguuuaaagu

SEQ ID NO: 732330 - RNA, 23 nt, Human
ccugcagcugccacgcccugcuc

SEQ ID NO: 732331 - RNA, 22 nt, Human
ucucuucuaacacuagaaauuc

SEQ ID NO: 732332 - RNA, 22 nt, Human
ggaugggcugaaagguagcccc

SEQ ID NO: 732333 - RNA, 22 nt, Human
ggcugcugcuguguaggccugu

SEQ ID NO: 732334 - RNA, 17 nt, Human
aucaguagcauaucaga

SEQ ID NO: 732335 - RNA, 22 nt, Human
caagggcucacggucugcuggg

SEQ ID NO: 732336 - RNA, 22 nt, Human
aaggcagccuuuugaguugauu

SEQ ID NO: 732337 - RNA, 22 nt, Human
aaugaacacauguggucaguuu

SEQ ID NO: 732338 - RNA, 22 nt, Human
agagcugaaaaagcugacccgg

SEQ ID NO: 732339 - RNA, 22 nt, Human
cagguagggauaugauggugau

SEQ ID NO: 732340 - RNA, 22 nt, Human
cagugccaugaugcagagcaau

SEQ ID NO: 732341 - RNA, 22 nt, Human
acaugucuaaguacucaacaaa

SEQ ID NO: 732342 - RNA, 22 nt, Human
ugaggguaaccuggagcugcug

SEQ ID NO: 732343 - RNA, 22 nt, Human
ucgugaggcucugcaucgcaca

SEQ ID NO: 732344 - RNA, 22 nt, Human
ucagaagccuugauuaucuaga

SEQ ID NO: 732345 - RNA, 21 nt, Human
gaagacaaaugggaauagcug

SEQ ID NO: 732346 - RNA, 22 nt, Human
cagggcuucuauaccaauucau

SEQ ID NO: 732347 - RNA, 22 nt, Human
ucuuuggcuuugccacacccaa

SEQ ID NO: 732348 - RNA, 22 nt, Human
aggccugggucucgugccuacc

SEQ ID NO: 732349 - RNA, 22 nt, Human
aacaucuagguucucaucgaua

SEQ ID NO: 732350 - RNA, 22 nt, Human
agcagcaugaugacagagucuc

SEQ ID NO: 732351 - RNA, 22 nt, Human
uuuguguaccuuguacauuugu

SEQ ID NO: 732352 - RNA, 22 nt, Human
ugccagcuuuugacuaucuuag

SEQ ID NO: 732353 - RNA, 22 nt, Human
uggcaaaggcgcucacaugccu

SEQ ID NO: 732354 - RNA, 22 nt, Human
cacuggaauguugaggagacaa

SEQ ID NO: 732355 - RNA, 20 nt, Human
guauaagauuucacacauua

SEQ ID NO: 732356 - RNA, 22 nt, Human
gagacagagagguacucaacau

SEQ ID NO: 732357 - RNA, 23 nt, Human
ucagaagugggauacaaagcuga

SEQ ID NO: 732358 - RNA, 22 nt, Human
ggcucugggcauagaaggaagc

SEQ ID NO: 732359 - RNA, 23 nt, Human
acagacuguauucaaaguaggac

SEQ ID NO: 732360 - RNA, 22 nt, Human
cuguccugcaguugggggcagg

SEQ ID NO: 732361 - RNA, 16 nt, Human
uaaacagcagacaguu

SEQ ID NO: 732362 - RNA, 22 nt, Human
cuggcuuucauuucaagcacgu

SEQ ID NO: 732363 - RNA, 19 nt, Human
cagugcuguucauucagug

SEQ ID NO: 732364 - RNA, 22 nt, Human
gcaaggaagcagaguugcuauc

SEQ ID NO: 732365 - RNA, 19 nt, Human
uaauauacagacccaucug

SEQ ID NO: 732366 - RNA, 22 nt, Human
uccagcacagaauuuccuagcu

SEQ ID NO: 732367 - RNA, 22 nt, Human
ucacagcauugaguguacuaga

SEQ ID NO: 732368 - RNA, 22 nt, Human
acugaauaaggugaaugcucug

SEQ ID NO: 732369 - RNA, 22 nt, Human
acagcuggagcccuauggcugg

SEQ ID NO: 732370 - RNA, 22 nt, Human
aguagggaauacauugggguaa

SEQ ID NO: 732371 - RNA, 22 nt, Human
auccugagguacugcagggccg

SEQ ID NO: 732372 - RNA, 22 nt, Human
ggaaucagaauuaggauuugaa

SEQ ID NO: 732373 - RNA, 22 nt, Human
gugccaggcccagggagcgggg

SEQ ID NO: 732374 - RNA, 22 nt, Human
cugauguguuuuaguuugguaa

SEQ ID NO: 732375 - RNA, 19 nt, Human
gccaugggcuggcagcaga

SEQ ID NO: 732376 - RNA, 22 nt, Human
cagcacuggggggauucggagc

SEQ ID NO: 732377 - RNA, 22 nt, Human
agcaucuggccugguuacuuuu

SEQ ID NO: 732378 - RNA, 17 nt, Human
ucauuuguugugacuag

SEQ ID NO: 732379 - RNA, 22 nt, Human
caucacuacaaauuuaagaaau

SEQ ID NO: 732380 - RNA, 22 nt, Human
cccagagagcauuuggacaaag

SEQ ID NO: 732381 - RNA, 22 nt, Human
ggaugcugacuuuggagcaugg

SEQ ID NO: 732382 - RNA, 22 nt, Human
auuuacacugguucucagagcu

SEQ ID NO: 732383 - RNA, 22 nt, Human
ugcagccuugccuccucccagc

SEQ ID NO: 732384 - RNA, 22 nt, Human
agcuucuccugguacagaacug

SEQ ID NO: 732385 - RNA, 22 nt, Human
caacagagggaauggaucucau

SEQ ID NO: 732386 - RNA, 22 nt, Human
gcaaugggcacagcccagccca

SEQ ID NO: 732387 - RNA, 20 nt, Human
ucagaacaguagaggagcua

SEQ ID NO: 732388 - RNA, 19 nt, Human
cacauuuugagucugagau

SEQ ID NO: 732389 - RNA, 22 nt, Human
gagguauuugauccucugcagu

SEQ ID NO: 732390 - RNA, 22 nt, Human
auggacagugugaagcagauag

SEQ ID NO: 732391 - RNA, 22 nt, Human
aguaagcaccgggauggucaag

SEQ ID NO: 732392 - RNA, 22 nt, Human
uacagcuugaugagagcgcgag

SEQ ID NO: 732393 - RNA, 22 nt, Human
guucuucaguucaggcuguuca

SEQ ID NO: 732394 - RNA, 22 nt, Human
ggcggggguccaggagccugca

SEQ ID NO: 732395 - RNA, 22 nt, Human
aggccaggggugagcacuucug

SEQ ID NO: 732396 - RNA, 19 nt, Human
uaacucuuuccuuuucccc

SEQ ID NO: 732397 - RNA, 22 nt, Human
cacaugcuccauacagaauggg

SEQ ID NO: 732398 - RNA, 22 nt, Human
agagggaaaaacucaugucauu

SEQ ID NO: 732399 - RNA, 22 nt, Human
aaguugguguaugagacagaag

SEQ ID NO: 732400 - RNA, 22 nt, Human
ugcuuuugcacaggugaguucc

SEQ ID NO: 732401 - RNA, 22 nt, Human
gugggccagcauuuugaagagu

SEQ ID NO: 732402 - RNA, 22 nt, Human
agaauacaauuguucaguaaua

SEQ ID NO: 732403 - RNA, 22 nt, Human
ucagugcauuguucauuguagg

SEQ ID NO: 732404 - RNA, 22 nt, Human
agccacagcccacaggacucuu

SEQ ID NO: 732405 - RNA, 22 nt, Human
aaucagaauuuauugaaucuuu

SEQ ID NO: 732406 - RNA, 18 nt, Human
ugucucuccuuucugugu

SEQ ID NO: 732407 - RNA, 18 nt, Human
augagaggugucagaaga

SEQ ID NO: 732408 - RNA, 22 nt, Human
auaaaggccaaaauuugcauuu

SEQ ID NO: 732409 - RNA, 22 nt, Human
aaacuuuucuuggggaccugcc

SEQ ID NO: 732410 - RNA, 22 nt, Human
acuuuguaaauuguugugacuc

SEQ ID NO: 732411 - RNA, 22 nt, Human
uuuugucuaagaacuuugcaaa

SEQ ID NO: 732412 - RNA, 22 nt, Human
caguguggguuugggaggagua

SEQ ID NO: 732413 - RNA, 22 nt, Human
uuuuagcacacuuucuuuagcg

SEQ ID NO: 732414 - RNA, 22 nt, Human
gucagcucauccaucccggugg

SEQ ID NO: 732415 - RNA, 22 nt, Human
ggcagaggagcuggaaacaugg

SEQ ID NO: 732416 - RNA, 22 nt, Human
cagaccugggucccuggccugu

SEQ ID NO: 732417 - RNA, 22 nt, Human
aaucacauuaagcccuguucag

SEQ ID NO: 732418 - RNA, 22 nt, Human
gcauguguuauuuuauguauga

SEQ ID NO: 732419 - RNA, 22 nt, Human
cuuuuccacugagccucacaaa

SEQ ID NO: 732420 - RNA, 22 nt, Human
uucugauaacaaacaccaauuu

SEQ ID NO: 732421 - RNA, 22 nt, Human
acugaaguccacacauguagga

SEQ ID NO: 732422 - RNA, 22 nt, Human
auucaagaggaacaaugaagau

SEQ ID NO: 732423 - RNA, 22 nt, Human
cuguucuggagacacugaugaa

SEQ ID NO: 732424 - RNA, 22 nt, Human
agaaguauaacuauuugcuuuc

SEQ ID NO: 732425 - RNA, 22 nt, Human
agugagcauucguuuggaaccc

SEQ ID NO: 732426 - RNA, 22 nt, Human
acauucuagaagagcuucacuu

SEQ ID NO: 732427 - RNA, 22 nt, Human
aagagauguggaaucauuuaca

SEQ ID NO: 732428 - RNA, 22 nt, Human
aggggccauuguucugcccgcu

SEQ ID NO: 732429 - RNA, 22 nt, Human
ugcagcaguguuccuuggcuug

SEQ ID NO: 732430 - RNA, 22 nt, Human
uaagaacaagauguuccuguuu

SEQ ID NO: 732431 - RNA, 22 nt, Human
agcugaaauucuuuguccucag

SEQ ID NO: 732432 - RNA, 22 nt, Human
guuuccacuuauaugguaccua

SEQ ID NO: 732433 - RNA, 22 nt, Human
guacacagaugcuugagaaucu

SEQ ID NO: 732434 - RNA, 22 nt, Human
cacccaggcauggguugagaug

SEQ ID NO: 732435 - RNA, 22 nt, Human
ugccugugugaccacgggcaag

SEQ ID NO: 732436 - RNA, 22 nt, Human
cacaagauggucacauaagugc

SEQ ID NO: 732437 - RNA, 22 nt, Human
uggcccugugacugaguucuag

SEQ ID NO: 732438 - RNA, 22 nt, Human
uuguagaaaauucucuuggaua

SEQ ID NO: 732439 - RNA, 22 nt, Human
augucucugcugugguuagcuu

SEQ ID NO: 732440 - RNA, 22 nt, Human
ccaagcauuucuagccagucac

SEQ ID NO: 732441 - RNA, 22 nt, Human
caucucauagugcagugcugua

SEQ ID NO: 732442 - RNA, 22 nt, Human
gagguccacugaggcaacaggg

SEQ ID NO: 732443 - RNA, 22 nt, Human
gagagcuguuuaucuucuucaa

SEQ ID NO: 732444 - RNA, 22 nt, Human
auggggagcucaccaccuguuu

SEQ ID NO: 732445 - RNA, 22 nt, Human
acagauauaaacuauaguagug

SEQ ID NO: 732446 - RNA, 22 nt, Human
aaucauggcguguuuagcuuaa

SEQ ID NO: 732447 - RNA, 22 nt, Human
gagguggcugucagcuucacuu

SEQ ID NO: 732448 - RNA, 22 nt, Human
uuuccagugagcaaauguagaa

SEQ ID NO: 732449 - RNA, 22 nt, Human
aucaguauauuccuuggucuuu

SEQ ID NO: 732450 - RNA, 22 nt, Human
uuuuauuaucuuugaaugggac

SEQ ID NO: 732451 - RNA, 22 nt, Human
augagcuguaagguggcuuccu

SEQ ID NO: 732452 - RNA, 20 nt, Human
uccaggccuuguucucagau

SEQ ID NO: 732453 - RNA, 22 nt, Human
agggcagcuagcuguagaaaga

SEQ ID NO: 732454 - RNA, 23 nt, Human
gggggagcuggacuccuagaucc

SEQ ID NO: 732455 - RNA, 22 nt, Human
ccccaccaccaaggcucaguuu

SEQ ID NO: 732456 - RNA, 22 nt, Human
auuucaaggcuacagaaaccuu

SEQ ID NO: 732457 - RNA, 22 nt, Human
uugcaauugcuauggagagcgu

SEQ ID NO: 732458 - RNA, 22 nt, Human
ugagaaaacucaaagacagauc

SEQ ID NO: 732459 - RNA, 22 nt, Human
acuuuacuccccaacauaaaug

SEQ ID NO: 732460 - RNA, 22 nt, Human
aguccugguucugauucugaca

SEQ ID NO: 732461 - RNA, 22 nt, Human
cagagcugcgcuuuuuccuggu

SEQ ID NO: 732462 - RNA, 22 nt, Human
auugaagauuaaaugcuuccuu

SEQ ID NO: 732463 - RNA, 22 nt, Human
gaagcacugccauaauucagac

SEQ ID NO: 732464 - RNA, 22 nt, Human
ggcgcucaguguugccccagag

SEQ ID NO: 732465 - RNA, 22 nt, Human
uuuagcaagguagguccaugga

SEQ ID NO: 732466 - RNA, 22 nt, Human
caacauuucaaggucuuuagga

SEQ ID NO: 732467 - RNA, 22 nt, Human
uaagagcagagguugaauaaau

SEQ ID NO: 732468 - RNA, 22 nt, Human
gcaggcagagguggaggagaca

SEQ ID NO: 732469 - RNA, 22 nt, Human
cagggcuuuuuauuagcugccu

SEQ ID NO: 732470 - RNA, 22 nt, Human
cuauuucuaaaccuauaaguga

SEQ ID NO: 732471 - RNA, 22 nt, Human
aagauguuuagguaaaaaguuu

SEQ ID NO: 732472 - RNA, 18 nt, Human
cugcuugggagacgucag

SEQ ID NO: 732473 - RNA, 22 nt, Human
gcugucuccauagcuguguguc

SEQ ID NO: 732474 - RNA, 22 nt, Human
acacagggucuagaguuaggcc

SEQ ID NO: 732475 - RNA, 22 nt, Human
ggugaguugggguucacagguc

SEQ ID NO: 732476 - RNA, 22 nt, Human
gauuuggcuuggaugauuaaac

SEQ ID NO: 732477 - RNA, 22 nt, Human
augagguuuagguuccuccucu

SEQ ID NO: 732478 - RNA, 22 nt, Human
uuuuagaagugccuauccuaug

SEQ ID NO: 732479 - RNA, 22 nt, Human
uccagagugcugacgcagaccc

SEQ ID NO: 732480 - RNA, 22 nt, Human
ucuuaauugagaacaguguagg

SEQ ID NO: 732481 - RNA, 22 nt, Human
cucugggcaaagaugccucauc

SEQ ID NO: 732482 - RNA, 22 nt, Human
augaucagggcagaagcagaag

SEQ ID NO: 732483 - RNA, 22 nt, Human
uggaggaaguggcuggccagaa

SEQ ID NO: 732484 - RNA, 22 nt, Human
ucccagcagucagagcuaugug

SEQ ID NO: 732485 - RNA, 22 nt, Human
cccugggauggauuggcaggaa

SEQ ID NO: 732486 - RNA, 22 nt, Human
uuucuacauucaaaaacuacca

SEQ ID NO: 732487 - RNA, 22 nt, Human
accucacaagucucugucagcu

SEQ ID NO: 732488 - RNA, 22 nt, Human
aaaauccucuaauucuagaaua

SEQ ID NO: 732489 - RNA, 22 nt, Human
aggcccagggcugcucucugaa

SEQ ID NO: 732490 - RNA, 17 nt, Human
ugaaggccaugaccacg

SEQ ID NO: 732491 - RNA, 22 nt, Human
gaccuggacugaguuagauggc

SEQ ID NO: 732492 - RNA, 19 nt, Human
aaaguguuuucuuuucugu

SEQ ID NO: 732493 - RNA, 22 nt, Human
ucacacuuaucccacucaguca

SEQ ID NO: 732494 - RNA, 22 nt, Human
cagugucuccagaugcuccaau

SEQ ID NO: 732495 - RNA, 22 nt, Human
cacagaaauuauuaggaugcuu

SEQ ID NO: 732496 - RNA, 22 nt, Human
ugcugcuggguuugacagucac

SEQ ID NO: 732497 - RNA, 22 nt, Human
augggcagcugcagcaguggug

SEQ ID NO: 732498 - RNA, 22 nt, Human
auauucuuccaaaacaucauuu

SEQ ID NO: 732499 - RNA, 22 nt, Human
caucugaagugaauugcuuuuu

SEQ ID NO: 732500 - RNA, 22 nt, Human
ccuugguccaacccugcacagc

SEQ ID NO: 732501 - RNA, 22 nt, Human
uacuguaugaauuauguuauuu

SEQ ID NO: 732502 - RNA, 22 nt, Human
aaaaguauuuuggaucucagau

SEQ ID NO: 732503 - RNA, 17 nt, Human
cagugcagagcccuuuc

SEQ ID NO: 732504 - RNA, 22 nt, Human
cuucacauuaguuuggaucaaa

SEQ ID NO: 732505 - RNA, 22 nt, Human
uccuuggagcccaggaguagca

SEQ ID NO: 732506 - RNA, 22 nt, Human
uccucacacuauagaugaggau

SEQ ID NO: 732507 - RNA, 22 nt, Human
gcugggcaggccucgugagggc

SEQ ID NO: 732508 - RNA, 22 nt, Human
aucuaacuuauguuuuaccaaa

SEQ ID NO: 732509 - RNA, 22 nt, Human
aaaagcaauugcaguucuugcc

SEQ ID NO: 732510 - RNA, 22 nt, Human
uauucuuacucucgacugcauu

SEQ ID NO: 732511 - RNA, 23 nt, Human
cugcauauggagguuagcaacuc

SEQ ID NO: 732512 - RNA, 22 nt, Human
accccuucuccuggcuguucca

SEQ ID NO: 732513 - RNA, 22 nt, Human
auggaauuaaaagucaaguaau

SEQ ID NO: 732514 - RNA, 22 nt, Human
gcuuccaggggcugugggcuga

SEQ ID NO: 732515 - RNA, 22 nt, Human
aagagguaaugacugcuugagu

SEQ ID NO: 732516 - RNA, 22 nt, Human
gagggaggcaucaugaauccag

SEQ ID NO: 732517 - RNA, 22 nt, Human
ugaacaacagauguccauuguu

SEQ ID NO: 732518 - RNA, 22 nt, Human
guacauguugguuguuuccagu

SEQ ID NO: 732519 - RNA, 22 nt, Human
cugcugcugcuaucuacccagg

SEQ ID NO: 732520 - RNA, 22 nt, Human
uaggagcuuuuggaguccugug

SEQ ID NO: 732521 - RNA, 22 nt, Human
caggccugucugcacaugaggc

SEQ ID NO: 732522 - RNA, 22 nt, Human
aauccaucucuccgagaaguuu

SEQ ID NO: 732523 - RNA, 22 nt, Human
ucuggagagcagaugccucugg

SEQ ID NO: 732524 - RNA, 22 nt, Human
uccuccuguuucucaggccugg

SEQ ID NO: 732525 - RNA, 22 nt, Human
uuuaucugcuaucugcugugcu

SEQ ID NO: 732526 - RNA, 22 nt, Human
ucuucaugauacccuaagccac

SEQ ID NO: 732527 - RNA, 22 nt, Human
uaaguucagaguucucauuugu

SEQ ID NO: 732528 - RNA, 22 nt, Human
guggcaguuuugacaucacaaa

SEQ ID NO: 732529 - RNA, 22 nt, Human
uagcaguggaaucuuuugucca

SEQ ID NO: 732530 - RNA, 22 nt, Human
guuauucuuuguaugguacauc

SEQ ID NO: 732531 - RNA, 22 nt, Human
ucaaaucccagcucagccucuc

SEQ ID NO: 732532 - RNA, 23 nt, Human
ugagugugaaaauccuggagaug

SEQ ID NO: 732533 - RNA, 22 nt, Human
ugggguagggaaaagaagucga

SEQ ID NO: 732534 - RNA, 22 nt, Human
aagaaagccaaaguucauaccu

SEQ ID NO: 732535 - RNA, 22 nt, Human
auugggcuggauuaggacuguu

SEQ ID NO: 732536 - RNA, 22 nt, Human
gauuaacaaauuucauauccaa

SEQ ID NO: 732537 - RNA, 22 nt, Human
cagcccugagaaggaggaucuc

SEQ ID NO: 732538 - RNA, 20 nt, Human
gcuuccagaggaggccccgu

SEQ ID NO: 732539 - RNA, 22 nt, Human
ggguuaaaacaggaagaucagc

SEQ ID NO: 732540 - RNA, 22 nt, Human
aagauuuuuuuccacagacuca

SEQ ID NO: 732541 - RNA, 20 nt, Human
ucagagaaggagcuuuccug

SEQ ID NO: 732542 - RNA, 22 nt, Human
aguuccagcugugaccagaaaa

SEQ ID NO: 732543 - RNA, 22 nt, Human
uaauacuugcuuuggauguaug

SEQ ID NO: 732544 - RNA, 22 nt, Human
cucaggaugucggugacuauug

SEQ ID NO: 732545 - RNA, 22 nt, Human
uuuaaccucuaauuuaguucuc

SEQ ID NO: 732546 - RNA, 22 nt, Human
cagcugaguuacucugaggucu

SEQ ID NO: 732547 - RNA, 22 nt, Human
cucucaguccugcgcgccucug

SEQ ID NO: 732548 - RNA, 22 nt, Human
cggcagagugugugcgugcaug

SEQ ID NO: 732549 - RNA, 23 nt, Human
uggcaggaaaugagaauguuccu

SEQ ID NO: 732550 - RNA, 22 nt, Human
aaauagaaaccaacaaggucag

SEQ ID NO: 732551 - RNA, 22 nt, Human
agacaauguuuggucuacacuu

SEQ ID NO: 732552 - RNA, 22 nt, Human
caugcugugcaucuugaugacc

SEQ ID NO: 732553 - RNA, 22 nt, Human
uacacagggaaaggucucagag

SEQ ID NO: 732554 - RNA, 22 nt, Human
aaaagaguguuucaacuuuggc

SEQ ID NO: 732555 - RNA, 18 nt, Human
ucauucaaagucuacuga

SEQ ID NO: 732556 - RNA, 22 nt, Human
ccagcccugccagagagagcug

SEQ ID NO: 732557 - RNA, 22 nt, Human
cuccacagccccuccaguggca

SEQ ID NO: 732558 - RNA, 22 nt, Human
uuucugaagggcagcagacucu

SEQ ID NO: 732559 - RNA, 22 nt, Human
cugguucauccccuuccaggaa

SEQ ID NO: 732560 - RNA, 22 nt, Human
acacauccugaccaaguucagg

SEQ ID NO: 732561 - RNA, 22 nt, Human
acagcuguggucuccuuagugu

SEQ ID NO: 732562 - RNA, 22 nt, Human
gagagucacugucugcauuucc

SEQ ID NO: 732563 - RNA, 22 nt, Human
uaaagugcagauugugauucag

SEQ ID NO: 732564 - RNA, 22 nt, Human
augcuggucucauuggguuagg

SEQ ID NO: 732565 - RNA, 22 nt, Human
gaggcacagagcccuaggagcu

SEQ ID NO: 732566 - RNA, 22 nt, Human
aggagccacuuaggugagauaa

SEQ ID NO: 732567 - RNA, 22 nt, Human
aagguuaguaauauuucuauau

SEQ ID NO: 732568 - RNA, 22 nt, Human
auacaacuuuaucuguaaugag

SEQ ID NO: 732569 - RNA, 22 nt, Human
agucagaauucgaucccagguc

SEQ ID NO: 732570 - RNA, 22 nt, Human
uccaggaggacugagggggcug

SEQ ID NO: 732571 - RNA, 22 nt, Human
gaaguuuuuguagagacagggu

SEQ ID NO: 732572 - RNA, 22 nt, Human
ccuggcagcgugccgagcugcg

SEQ ID NO: 732573 - RNA, 22 nt, Human
uguggggaggcugcagugcugc

SEQ ID NO: 732574 - RNA, 22 nt, Human
ucauauauuuaguugugcaaca

SEQ ID NO: 732575 - RNA, 22 nt, Human
uuucagucauggauucacugag

SEQ ID NO: 732576 - RNA, 22 nt, Human
uguuuacaaaaccgugguacug

SEQ ID NO: 732577 - RNA, 22 nt, Human
aaggauaaaaaccacuucuaau

SEQ ID NO: 732578 - RNA, 17 nt, Human
gccuuuauacaugcugc

SEQ ID NO: 732579 - RNA, 22 nt, Human
acaggacaggcugggcuagacu

SEQ ID NO: 732580 - RNA, 22 nt, Human
aaaagguuuugaguacaaauau

SEQ ID NO: 732581 - RNA, 20 nt, Human
cauauauaccuagaagugga

SEQ ID NO: 732582 - RNA, 22 nt, Human
ugcaguucuaaguagacaaguc

SEQ ID NO: 732583 - RNA, 22 nt, Human
ucagauuuugcacgagguuuug

SEQ ID NO: 732584 - RNA, 22 nt, Human
guggaggucccgggcaggagca

SEQ ID NO: 732585 - RNA, 22 nt, Human
ugagcccagagaucugagcuau

SEQ ID NO: 732586 - RNA, 22 nt, Human
gcagaagaccaugguggaaaga

SEQ ID NO: 732587 - RNA, 22 nt, Human
gcccuuggggugucuguaauaa

SEQ ID NO: 732588 - RNA, 22 nt, Human
aucugaguguuggauuuauugu

SEQ ID NO: 732589 - RNA, 18 nt, Human
gcagcugcaguuguagcu

SEQ ID NO: 732590 - RNA, 21 nt, Human
acaguuuauuagaguaagugc

SEQ ID NO: 732591 - RNA, 22 nt, Human
cauuuagaagucuuagaacuau

SEQ ID NO: 732592 - RNA, 22 nt, Human
ugaaucuuuuuggaaauaaaga

SEQ ID NO: 732593 - RNA, 22 nt, Human
caugcuaaaauaucugaagauu

SEQ ID NO: 732594 - RNA, 22 nt, Human
ucaugaaaauagaucagaaauu

SEQ ID NO: 732595 - RNA, 22 nt, Human
ggcaggcaguguggugugaaac

SEQ ID NO: 732596 - RNA, 22 nt, Human
ugauucugaucaucaucauggu

SEQ ID NO: 732597 - RNA, 21 nt, Human
agggagcuauuuauaguaagc

SEQ ID NO: 732598 - RNA, 22 nt, Human
cuggcaggaagaggaaagguca

SEQ ID NO: 732599 - RNA, 17 nt, Human
aggaagcgagcuggccu

SEQ ID NO: 732600 - RNA, 22 nt, Human
uauuagaggaaccaagguggag

SEQ ID NO: 732601 - RNA, 22 nt, Human
ugagacagcagucagggaaaua

SEQ ID NO: 732602 - RNA, 22 nt, Human
acagaguaggugcugucgacug

SEQ ID NO: 732603 - RNA, 22 nt, Human
gccaaaucacagggccaaaagc

SEQ ID NO: 732604 - RNA, 22 nt, Human
gccugagauucccggagccgug

SEQ ID NO: 732605 - RNA, 22 nt, Human
guggaacauguccauauacauu

SEQ ID NO: 732606 - RNA, 22 nt, Human
uggggacagggcucagcaauuu

SEQ ID NO: 732607 - RNA, 22 nt, Human
ccucugcugcuguugagcaccg

SEQ ID NO: 732608 - RNA, 22 nt, Human
agauuucccucuuguauuugca

SEQ ID NO: 732609 - RNA, 22 nt, Human
uauugcagacaaaaugagcuac

SEQ ID NO: 732610 - RNA, 22 nt, Human
ccugagucccauaauguugcca

SEQ ID NO: 732611 - RNA, 22 nt, Human
ccugccuggcuuccagaagaga

SEQ ID NO: 732612 - RNA, 22 nt, Human
ucauggcauuguuaaggguuuu

SEQ ID NO: 732613 - RNA, 22 nt, Human
gcagcacaaaguccccagggac

SEQ ID NO: 732614 - RNA, 22 nt, Human
caggccagcggcccgcgcguuc

SEQ ID NO: 732615 - RNA, 22 nt, Human
uauagcaaaauaguuuccacac

SEQ ID NO: 732616 - RNA, 22 nt, Human
agcuguuggaguaaagcacuua

SEQ ID NO: 732617 - RNA, 22 nt, Human
ugaugaggacccaucaccuggu

SEQ ID NO: 732618 - RNA, 22 nt, Human
cccacgucgaacuugcuccaga

SEQ ID NO: 732619 - RNA, 22 nt, Human
ccuggcuccugccucugcaggg

SEQ ID NO: 732620 - RNA, 22 nt, Human
aaauugcacaauauagacauga

SEQ ID NO: 732621 - RNA, 21 nt, Human
uugcauuuuaaguuuacugcu

SEQ ID NO: 732622 - RNA, 22 nt, Human
cacauugaaccauauauuagug

SEQ ID NO: 732623 - RNA, 22 nt, Human
acaguagucucaggaauaggca

SEQ ID NO: 732624 - RNA, 20 nt, Human
uaacacuugcuuuuugacuu

SEQ ID NO: 732625 - RNA, 22 nt, Human
gacagguaaagaugguggcagg

SEQ ID NO: 732626 - RNA, 22 nt, Human
ggccuggagcagagacuaggga

SEQ ID NO: 732627 - RNA, 22 nt, Human
ccagaggugggagugaucuggu

SEQ ID NO: 732628 - RNA, 21 nt, Human
ucacugaagccuaagauguuu

SEQ ID NO: 732629 - RNA, 22 nt, Human
ggggugcuagaguggggccacu

SEQ ID NO: 732630 - RNA, 22 nt, Human
gcaaacaugcugagaaauaaga

SEQ ID NO: 732631 - RNA, 20 nt, Human
auauagagucaaaauggcuu

SEQ ID NO: 732632 - RNA, 22 nt, Human
uuugcagaagaaaacaugaaca

SEQ ID NO: 732633 - RNA, 22 nt, Human
uugaaacauauacaaaguggug

SEQ ID NO: 732634 - RNA, 22 nt, Human
cagggcauuacuucagguccuu

SEQ ID NO: 732635 - RNA, 22 nt, Human
cuuaagaauauugaaguugugg

SEQ ID NO: 732636 - RNA, 22 nt, Human
aggcccuggacacucaagccgg

SEQ ID NO: 732637 - RNA, 22 nt, Human
cuuucagaagaggaccuuucca

SEQ ID NO: 732638 - RNA, 19 nt, Human
aaugguuugaugaaguaua

SEQ ID NO: 732639 - RNA, 22 nt, Human
ucagugauugguggacugccua

SEQ ID NO: 732640 - RNA, 22 nt, Human
auugaaaggcaaaguaggaagc

SEQ ID NO: 732641 - RNA, 22 nt, Human
ucuggcuuggguagguaguuca

SEQ ID NO: 732642 - RNA, 22 nt, Human
aaugucugugccuuaaaacuuc

SEQ ID NO: 732643 - RNA, 22 nt, Human
ccacucuugaaucaagagcuca

SEQ ID NO: 732644 - RNA, 22 nt, Human
acccugagggguauagcagaag

SEQ ID NO: 732645 - RNA, 22 nt, Human
gagaggcuaugagguucugugu

SEQ ID NO: 732646 - RNA, 22 nt, Human
ggccuuggugccauggccaguu

SEQ ID NO: 732647 - RNA, 22 nt, Human
agcagggacuacgugaaaguga

SEQ ID NO: 732648 - RNA, 22 nt, Human
gaaugcaugugaagcaaagaau

SEQ ID NO: 732649 - RNA, 22 nt, Human
agucccagacuccaguuuucug

SEQ ID NO: 732650 - RNA, 22 nt, Human
agaaauguuguggguuuuguua

SEQ ID NO: 732651 - RNA, 22 nt, Human
gucuucuuguuuugaaggaaau

SEQ ID NO: 732652 - RNA, 22 nt, Human
gagaaauuuugaguggcuuucu

SEQ ID NO: 732653 - RNA, 22 nt, Human
ucccauucugccaaggacauug

SEQ ID NO: 732654 - RNA, 22 nt, Human
aggagccaagauggggcaagua

SEQ ID NO: 732655 - RNA, 22 nt, Human
aacuuuucauaagggcaaauuu

SEQ ID NO: 732656 - RNA, 22 nt, Human
uaggagagcugaacuauugucu

SEQ ID NO: 732657 - RNA, 22 nt, Human
caaugggagcagaaauuguuug

SEQ ID NO: 732658 - RNA, 22 nt, Human
gugcagggcagccgaaugggcu

SEQ ID NO: 732659 - RNA, 22 nt, Human
uucugaaaauugggucauacuu

SEQ ID NO: 732660 - RNA, 22 nt, Human
ccagggcugcugggggaguuga

SEQ ID NO: 732661 - RNA, 22 nt, Human
aggauuuguauagcuuucuuuu

SEQ ID NO: 732662 - RNA, 18 nt, Human
gacaaaaguacagacaga

SEQ ID NO: 732663 - RNA, 23 nt, Human
ccuggcucaccccuuauguccag

SEQ ID NO: 732664 - RNA, 22 nt, Human
uuagaaccagcauuuguccugg

SEQ ID NO: 732665 - RNA, 22 nt, Human
auuaugcugguuuacacauuuu

SEQ ID NO: 732666 - RNA, 22 nt, Human
aggaccagaggccagagucagc

SEQ ID NO: 732667 - RNA, 22 nt, Human
uggcaguguccuacugguuggu

SEQ ID NO: 732668 - RNA, 22 nt, Human
ugauucagaccugucagacuuc

SEQ ID NO: 732669 - RNA, 22 nt, Human
gcuucaugaaaaucacugguca

SEQ ID NO: 732670 - RNA, 22 nt, Human
agacauuuuggaaaguauuacu

SEQ ID NO: 732671 - RNA, 22 nt, Human
augcauaaagaaagcuaucugg

SEQ ID NO: 732672 - RNA, 22 nt, Human
uccuggggcucaugggauuugu

SEQ ID NO: 732673 - RNA, 21 nt, Human
ggccacaguuagggcucagga

SEQ ID NO: 732674 - RNA, 22 nt, Human
aaugcacaugucuuggccucac

SEQ ID NO: 732675 - RNA, 22 nt, Human
gcugcugugaauuuuuuaaaug

SEQ ID NO: 732676 - RNA, 22 nt, Human
caccaucagcagcaggugucaa

SEQ ID NO: 732677 - RNA, 22 nt, Human
agauggaguuguagcagugacu

SEQ ID NO: 732678 - RNA, 22 nt, Human
acauuaccuggcauuugaucuu

SEQ ID NO: 732679 - RNA, 22 nt, Human
ucugagaacaugcuuugaucau

SEQ ID NO: 732680 - RNA, 22 nt, Human
cauuuuauguuuauggagugcu

SEQ ID NO: 732681 - RNA, 22 nt, Human
aagauuuaccacuuuauucaag

SEQ ID NO: 732682 - RNA, 22 nt, Human
uuauuccauugucuuuugacuu

SEQ ID NO: 732683 - RNA, 22 nt, Human
ccagaugagaccacacugcugg

SEQ ID NO: 732684 - RNA, 22 nt, Human
cucaggcucuguacucccuuug

SEQ ID NO: 732685 - RNA, 22 nt, Human
gaaaucugcccagugcacuggu

SEQ ID NO: 732686 - RNA, 22 nt, Human
gaacugucauuggggacaucag

SEQ ID NO: 732687 - RNA, 22 nt, Human
aacugcaaucacuuuugcacca

SEQ ID NO: 732688 - RNA, 19 nt, Human
uggcagugugggguaugaa

SEQ ID NO: 732689 - RNA, 22 nt, Human
uagcagcauuaauuccauuugc

SEQ ID NO: 732690 - RNA, 22 nt, Human
uuagaaacccagacucuuaggu

SEQ ID NO: 732691 - RNA, 22 nt, Human
uuugaaugcaggacauacagaa

SEQ ID NO: 732692 - RNA, 19 nt, Human
uggcuccugccugccuucu

SEQ ID NO: 732693 - RNA, 22 nt, Human
cugcaccuacagccacauuuac

SEQ ID NO: 732694 - RNA, 22 nt, Human
ucugcagaacuuuaugagcaaa

SEQ ID NO: 732695 - RNA, 22 nt, Human
ugagaaguacuacaagagaggg

SEQ ID NO: 732696 - RNA, 22 nt, Human
ucuucaguuguaaaaguguugg

SEQ ID NO: 732697 - RNA, 22 nt, Human
ggccucucugagagcagacguu

SEQ ID NO: 732698 - RNA, 22 nt, Human
aggccuccagcugaguuuugcu

SEQ ID NO: 732699 - RNA, 18 nt, Human
cugcccagagcacuugug

SEQ ID NO: 732700 - RNA, 22 nt, Human
cagggccagcgcccaggcccag

SEQ ID NO: 732701 - RNA, 22 nt, Human
agaauaaauguuggacuuagga

SEQ ID NO: 732702 - RNA, 22 nt, Human
gggccggagcugggucccgcgc

SEQ ID NO: 732703 - RNA, 22 nt, Human
gccuguccuauacaggcggcug

SEQ ID NO: 732704 - RNA, 21 nt, Human
cucaggaucuuauauauuagu

SEQ ID NO: 732705 - RNA, 18 nt, Human
gcauuuuaaucugaggca

SEQ ID NO: 732706 - RNA, 19 nt, Human
cuggccaggccaggggccc

SEQ ID NO: 732707 - RNA, 22 nt, Human
uaugcacaccuggguccuuguc

SEQ ID NO: 732708 - RNA, 22 nt, Human
cgggcucaggaggaaacaggag

SEQ ID NO: 732709 - RNA, 22 nt, Human
agcugaggccugauuucgccgu

SEQ ID NO: 732710 - RNA, 22 nt, Human
ucuuggcuucuguauuuccugu

SEQ ID NO: 732711 - RNA, 22 nt, Human
aggcagcagagguugaggaaag

SEQ ID NO: 732712 - RNA, 17 nt, Human
cuggagcuguguaaccu

SEQ ID NO: 732713 - RNA, 22 nt, Human
ucagggcucagcaucuggcauu

SEQ ID NO: 732714 - RNA, 23 nt, Human
aggcccaacucugugagggcugc

SEQ ID NO: 732715 - RNA, 21 nt, Human
ccugcugugaucuuagugagu

SEQ ID NO: 732716 - RNA, 21 nt, Human
augucuguucuuucuggcagg

SEQ ID NO: 732717 - RNA, 22 nt, Human
gaaaugaacugauuaucauugc

SEQ ID NO: 732718 - RNA, 22 nt, Human
caaagaauagugagaagaugua

SEQ ID NO: 732719 - RNA, 22 nt, Human
gcaggguaggugacagguaguc

SEQ ID NO: 732720 - RNA, 22 nt, Human
uuuacuguuuuauauuguccag

SEQ ID NO: 732721 - RNA, 22 nt, Human
ucauuuguggaagugauugugg

SEQ ID NO: 732722 - RNA, 22 nt, Human
guuaucuucuauuucucauacu

SEQ ID NO: 732723 - RNA, 22 nt, Human
guuuguuuauacaaaagauccu

SEQ ID NO: 732724 - RNA, 18 nt, Human
cuguccaguagacucugc

SEQ ID NO: 732725 - RNA, 22 nt, Human
cugucuuuuuagagaguaggau

SEQ ID NO: 732726 - RNA, 22 nt, Human
uucacagcuaagagcuaaguaa

SEQ ID NO: 732727 - RNA, 22 nt, Human
gugucccaaagauuagaaauca

SEQ ID NO: 732728 - RNA, 22 nt, Human
cccaccucucagagagccuugc

SEQ ID NO: 732729 - RNA, 22 nt, Human
ggugggacagguaggaguggcu

SEQ ID NO: 732730 - RNA, 22 nt, Human
cucaagucagaaauaaaagcau

SEQ ID NO: 732731 - RNA, 22 nt, Human
aauguguauacuggcaauuaag

SEQ ID NO: 732732 - RNA, 22 nt, Human
uauuugaugaagguaaagucuu

SEQ ID NO: 732733 - RNA, 22 nt, Human
gaggaaaagagacagguuauug

SEQ ID NO: 732734 - RNA, 22 nt, Human
cugggaagcauggugaugguau

SEQ ID NO: 732735 - RNA, 22 nt, Human
acugggcuguaaagagaggcaa

SEQ ID NO: 732736 - RNA, 22 nt, Human
agcucuggaacucccggcugcu

SEQ ID NO: 732737 - RNA, 22 nt, Human
uugacacaaacagugauguagu

SEQ ID NO: 732738 - RNA, 22 nt, Human
ugcucagaaacgaggugcagcc

SEQ ID NO: 732739 - RNA, 23 nt, Human
cagggcugguagggaagagcgug

SEQ ID NO: 732740 - RNA, 22 nt, Human
aggaggagguaagaaaagcaua

SEQ ID NO: 732741 - RNA, 22 nt, Human
uggggccacacugaucucccag

SEQ ID NO: 732742 - RNA, 22 nt, Human
cucgggcuugaggcuguuuacc

SEQ ID NO: 732743 - RNA, 22 nt, Human
cacagugugacugaccuucagc

SEQ ID NO: 732744 - RNA, 22 nt, Human
cacuggcaaauggagagaaugu

SEQ ID NO: 732745 - RNA, 23 nt, Human
aggagccaugaguuggauauguu

SEQ ID NO: 732746 - RNA, 22 nt, Human
uuccuucuuccagaggcugccc

SEQ ID NO: 732747 - RNA, 20 nt, Human
uaugaaguguucuucuggua

SEQ ID NO: 732748 - RNA, 23 nt, Human
aagcaaugcugagccaguucuga

SEQ ID NO: 732749 - RNA, 22 nt, Human
cuauuugaaaccaagaaugccg

SEQ ID NO: 732750 - RNA, 22 nt, Human
gaccugggguggaaggaaggca

SEQ ID NO: 732751 - RNA, 22 nt, Human
caucuggacaaaacucugaagg

SEQ ID NO: 732752 - RNA, 22 nt, Human
guugaaaguagaugcuauuugg

SEQ ID NO: 732753 - RNA, 22 nt, Human
ggcuuugcuucuccagaugcuu

SEQ ID NO: 732754 - RNA, 22 nt, Human
uguccugcaacugaaggagaag

SEQ ID NO: 732755 - RNA, 22 nt, Human
guagugcuuucaucuggagugu

SEQ ID NO: 732756 - RNA, 22 nt, Human
uauuuucaccauguaucccugu

SEQ ID NO: 732757 - RNA, 17 nt, Human
cccagggaccacugcuu

SEQ ID NO: 732758 - RNA, 22 nt, Human
uggaggccggacugagaggcau

SEQ ID NO: 732759 - RNA, 22 nt, Human
cauucacaaagcugauugaugg

SEQ ID NO: 732760 - RNA, 22 nt, Human
agugcucccuagaguugugcaa

SEQ ID NO: 732761 - RNA, 20 nt, Human
gagcugaguguggucauggg

SEQ ID NO: 732762 - RNA, 19 nt, Human
uugagcagugcuuagcacc

SEQ ID NO: 732763 - RNA, 22 nt, Human
gucuccagggacacacuagccg

SEQ ID NO: 732764 - RNA, 22 nt, Human
uucauucaaagaggcauccaag

SEQ ID NO: 732765 - RNA, 22 nt, Human
aggcgcacaggguguugaugug

SEQ ID NO: 732766 - RNA, 22 nt, Human
caggcacaugggagcucaucau

SEQ ID NO: 732767 - RNA, 22 nt, Human
ucucucccuuuccuuaucaguu

SEQ ID NO: 732768 - RNA, 22 nt, Human
aaaugcaaguucauauuuuguu

SEQ ID NO: 732769 - RNA, 21 nt, Human
guguaaacggacucaugcagu

SEQ ID NO: 732770 - RNA, 22 nt, Human
ggauucugccuuguugcuucaa

SEQ ID NO: 732771 - RNA, 22 nt, Human
cagcugaggucaaagaagcagg

SEQ ID NO: 732772 - RNA, 22 nt, Human
guuccucaugaguaccccuuaa

SEQ ID NO: 732773 - RNA, 22 nt, Human
ucucaggcacugggugccaacu

SEQ ID NO: 732774 - RNA, 22 nt, Human
ccccaugcugggaucugacacc

SEQ ID NO: 732775 - RNA, 22 nt, Human
cuucucagcaugguuacuguga

SEQ ID NO: 732776 - RNA, 22 nt, Human
gugaggacuaguggguuugugc

SEQ ID NO: 732777 - RNA, 22 nt, Human
guaguuaguuaagaugaguuua

SEQ ID NO: 732778 - RNA, 22 nt, Human
ggagagagaccuccaugcccag

SEQ ID NO: 732779 - RNA, 22 nt, Human
aaacugaaguagauucugaaau

SEQ ID NO: 732780 - RNA, 21 nt, Human
ggaagggcucugaggacggcu

SEQ ID NO: 732781 - RNA, 22 nt, Human
acacacugagugccauaggacc

SEQ ID NO: 732782 - RNA, 22 nt, Human
gaggccugcagcguggucccug

SEQ ID NO: 732783 - RNA, 22 nt, Human
uacuguacugcaguucugcaaa

SEQ ID NO: 732784 - RNA, 22 nt, Human
uucugaaagucuuuuuaaguua

SEQ ID NO: 732785 - RNA, 22 nt, Human
cugggguggagauuggcaaucu

SEQ ID NO: 732786 - RNA, 22 nt, Human
ugagguaugcugaacucuguuu

SEQ ID NO: 732787 - RNA, 22 nt, Human
uucuggaaggcagggagaaccc

SEQ ID NO: 732788 - RNA, 22 nt, Human
gcccugaggauuugcauuuccu

SEQ ID NO: 732789 - RNA, 22 nt, Human
ucacacauacucaugugugagu

SEQ ID NO: 732790 - RNA, 22 nt, Human
cccacuccuggagcuagggcuc

SEQ ID NO: 732791 - RNA, 22 nt, Human
caagcagccccaacaugaggau

SEQ ID NO: 732792 - RNA, 22 nt, Human
gaaugacauugaaaagacauug

SEQ ID NO: 732793 - RNA, 22 nt, Human
gcauucaucuaguaucacucug

SEQ ID NO: 732794 - RNA, 19 nt, Human
gcugucugaugcugagguc

SEQ ID NO: 732795 - RNA, 23 nt, Human
gagcagagcgggcggggguccug

SEQ ID NO: 732796 - RNA, 22 nt, Human
aggcuuuguaccuggggucuua

SEQ ID NO: 732797 - RNA, 22 nt, Human
caggaagauuguggaggugguu

SEQ ID NO: 732798 - RNA, 23 nt, Human
ugaggaccucucaggggccaggc

SEQ ID NO: 732799 - RNA, 22 nt, Human
cacagguucaccucagguaggu

SEQ ID NO: 732800 - RNA, 22 nt, Human
uucaacauuuuugaguuuaggu

SEQ ID NO: 732801 - RNA, 22 nt, Human
ucugggcugcuaugaggcagag

SEQ ID NO: 732802 - RNA, 22 nt, Human
accaggaguaacagugaguggu

SEQ ID NO: 732803 - RNA, 22 nt, Human
caggcaaguucauuuccaggca

SEQ ID NO: 732804 - RNA, 22 nt, Human
ccucaggcuucuaguucaguga

SEQ ID NO: 732805 - RNA, 22 nt, Human
caugucugaguagagugugauu

SEQ ID NO: 732806 - RNA, 22 nt, Human
gaauuaguguugaaaucagggc

SEQ ID NO: 732807 - RNA, 22 nt, Human
uaugguagaaaaacugaguccc

SEQ ID NO: 732808 - RNA, 17 nt, Human
uugcagacuuuuuauua

SEQ ID NO: 732809 - RNA, 22 nt, Human
cagcugccugucuggaggcaau

SEQ ID NO: 732810 - RNA, 22 nt, Human
ccacccacaaccagcuggcugu

SEQ ID NO: 732811 - RNA, 22 nt, Human
agagucaaaauuuaccagaaug

SEQ ID NO: 732812 - RNA, 17 nt, Human
gacaagacagaauucau

SEQ ID NO: 732813 - RNA, 22 nt, Human
ucaggcuguauaucuugcacuc

SEQ ID NO: 732814 - RNA, 22 nt, Human
gccaccagccccaugcgcugug

SEQ ID NO: 732815 - RNA, 22 nt, Human
cacacucauuagucauuucucu

SEQ ID NO: 732816 - RNA, 22 nt, Human
aaggcccuuccaccaguccucg

SEQ ID NO: 732817 - RNA, 22 nt, Human
ugcugcauagcagcuccugaaa

SEQ ID NO: 732818 - RNA, 17 nt, Human
gccuuccagcauguggg

SEQ ID NO: 732819 - RNA, 22 nt, Human
caggcacuggggaugcugggau

SEQ ID NO: 732820 - RNA, 22 nt, Human
gcacccaggcacuuuccuuucu

SEQ ID NO: 732821 - RNA, 22 nt, Human
ucuguuuugugucucucuggug

SEQ ID NO: 732822 - RNA, 22 nt, Human
augggccagcaccauguuaagc

SEQ ID NO: 732823 - RNA, 22 nt, Human
uggcccugcuguaucaucugcu

SEQ ID NO: 732824 - RNA, 22 nt, Human
aaguacauaaaggaauuagcca

SEQ ID NO: 732825 - RNA, 22 nt, Human
auagacagcgcauuaaaaaugu

SEQ ID NO: 732826 - RNA, 23 nt, Human
uugaauuucucuugcaauauuua

SEQ ID NO: 732827 - RNA, 23 nt, Human
aguccccuacauaguuccugggg

SEQ ID NO: 732828 - RNA, 22 nt, Human
uggcccugggcagaggcaacau

SEQ ID NO: 732829 - RNA, 22 nt, Human
auuccacacaguaauacucaau

SEQ ID NO: 732830 - RNA, 22 nt, Human
augcaaagcaccacacuaagau

SEQ ID NO: 732831 - RNA, 22 nt, Human
uuucaucuauuugcuuugugaa

SEQ ID NO: 732832 - RNA, 22 nt, Human
ggcugccauaacugauaccaua

SEQ ID NO: 732833 - RNA, 22 nt, Human
uauugcugccucguccaggcug

SEQ ID NO: 732834 - RNA, 22 nt, Human
auauacaguuuuacaggguuuc

SEQ ID NO: 732835 - RNA, 22 nt, Human
cucugcuuguaucacauuugcu

SEQ ID NO: 732836 - RNA, 22 nt, Human
guucacaucacuucacugaacc

SEQ ID NO: 732837 - RNA, 22 nt, Human
aaaagucuugucaagguuccca

SEQ ID NO: 732838 - RNA, 22 nt, Human
ugaguccauguggaggggaggu

SEQ ID NO: 732839 - RNA, 22 nt, Human
uuuugauaucaugaugaacaga

SEQ ID NO: 732840 - RNA, 22 nt, Human
gggacaucuuucuagucagggu

SEQ ID NO: 732841 - RNA, 22 nt, Human
gcuuccuccagggaggggccug

SEQ ID NO: 732842 - RNA, 22 nt, Human
cccaggcugauguucagcgggu

SEQ ID NO: 732843 - RNA, 22 nt, Human
cagggccagccauccugcuggg

SEQ ID NO: 732844 - RNA, 22 nt, Human
cugugacugggugacaguccuc

SEQ ID NO: 732845 - RNA, 22 nt, Human
uaguuuuaugaauugguauaau

SEQ ID NO: 732846 - RNA, 22 nt, Human
auaucuuucaaagccaaaagua

SEQ ID NO: 732847 - RNA, 22 nt, Human
uagauucaaguauucaguuugg

SEQ ID NO: 732848 - RNA, 22 nt, Human
agucccuuuagucuggagagcu

SEQ ID NO: 732849 - RNA, 22 nt, Human
cucagacauuuguagaaagugc

SEQ ID NO: 732850 - RNA, 22 nt, Human
uucugugaaacuaaagagagga

SEQ ID NO: 732851 - RNA, 22 nt, Human
augggcugacccagucguggca

SEQ ID NO: 732852 - RNA, 22 nt, Human
ugccugggagugaccaagacuc

SEQ ID NO: 732853 - RNA, 19 nt, Human
gccugcagaaaaggcaggg

SEQ ID NO: 732854 - RNA, 22 nt, Human
uugcagacuuacuucgagaaau

SEQ ID NO: 732855 - RNA, 22 nt, Human
gcagcuuuaaucugaauaagua

SEQ ID NO: 732856 - RNA, 22 nt, Human
acccaggguagaaccucagagc

SEQ ID NO: 732857 - RNA, 22 nt, Human
gcaaagucucaagacccaagug

SEQ ID NO: 732858 - RNA, 22 nt, Human
ugcaggcuuggaucacaucucc

SEQ ID NO: 732859 - RNA, 22 nt, Human
guguuuauguuuguguagggga

SEQ ID NO: 732860 - RNA, 22 nt, Human
ccuggcugccgagugugcagcg

SEQ ID NO: 732861 - RNA, 22 nt, Human
acagggcccuugccagcacaag

SEQ ID NO: 732862 - RNA, 22 nt, Human
acccugggucauauacagugug

SEQ ID NO: 732863 - RNA, 22 nt, Human
ucaggaaggcuucacacgagug

SEQ ID NO: 732864 - RNA, 22 nt, Human
caugagagauccuucaugagag

SEQ ID NO: 732865 - RNA, 22 nt, Human
auuucacagcugcuguucaggu

SEQ ID NO: 732866 - RNA, 22 nt, Human
caggugggaccaugauagggca

SEQ ID NO: 732867 - RNA, 22 nt, Human
gaggugaaaguuauucauuuau

SEQ ID NO: 732868 - RNA, 22 nt, Human
cccuggagaggacucaccccug

SEQ ID NO: 732869 - RNA, 22 nt, Human
acaggcaggcuucggccagagc

SEQ ID NO: 732870 - RNA, 22 nt, Human
uucaaugaggauagaacuggau

SEQ ID NO: 732871 - RNA, 22 nt, Human
gauccguuugugugggaguauu

SEQ ID NO: 732872 - RNA, 22 nt, Human
ucuauaaagggccagauaguag

SEQ ID NO: 732873 - RNA, 22 nt, Human
gucaccagucccagcuccugaa

SEQ ID NO: 732874 - RNA, 20 nt, Human
cagagcuguuauggaugaug

SEQ ID NO: 732875 - RNA, 22 nt, Human
uugggccacuuuaguuuccuua

SEQ ID NO: 732876 - RNA, 22 nt, Human
acaggagggacaccuuccugcu

SEQ ID NO: 732877 - RNA, 22 nt, Human
acagaauuaacauuugaugaau

SEQ ID NO: 732878 - RNA, 22 nt, Human
agggcugagugggagagaguug

SEQ ID NO: 732879 - RNA, 22 nt, Human
cagggugcuuccguggagcugu

SEQ ID NO: 732880 - RNA, 22 nt, Human
uggucugaggaacaccagcacu

SEQ ID NO: 732881 - RNA, 22 nt, Human
cccaugccuucugacucacagg

SEQ ID NO: 732882 - RNA, 22 nt, Human
ggcagccuucucucauagguga

SEQ ID NO: 732883 - RNA, 20 nt, Human
gcucagggccugggucugga

SEQ ID NO: 732884 - RNA, 22 nt, Human
ggugaggcccagugaucugugu

SEQ ID NO: 732885 - RNA, 22 nt, Human
ugucagcauugcgucacugagc

SEQ ID NO: 732886 - RNA, 22 nt, Human
aggcccaguagucgacggcgcu

SEQ ID NO: 732887 - RNA, 20 nt, Human
auucuacaagaauaagcaug

SEQ ID NO: 732888 - RNA, 22 nt, Human
cuuuccagcauuuccuugugaa

SEQ ID NO: 732889 - RNA, 22 nt, Human
ugauuuccaugaagcugaaggc

SEQ ID NO: 732890 - RNA, 22 nt, Human
ccacuguuuuucaguuaacuuu

SEQ ID NO: 732891 - RNA, 22 nt, Human
ugauuuccaaaaggcuucuaag

SEQ ID NO: 732892 - RNA, 22 nt, Human
ucugcuuucuugcgcagaugug

SEQ ID NO: 732893 - RNA, 22 nt, Human
aucugggagacccuugcgggaa

SEQ ID NO: 732894 - RNA, 22 nt, Human
gacaugucggauagaaugaguu

SEQ ID NO: 732895 - RNA, 22 nt, Human
ucacauguuaggucgggcaagg

SEQ ID NO: 732896 - RNA, 22 nt, Human
aauuucucaauuguuacaggug

SEQ ID NO: 732897 - RNA, 22 nt, Human
aagcaaagugaauuuugccaag

SEQ ID NO: 732898 - RNA, 22 nt, Human
cuugccuacuugucaaccagca

SEQ ID NO: 732899 - RNA, 22 nt, Human
agcacaggcuuuggugugaggg

SEQ ID NO: 732900 - RNA, 22 nt, Human
cuggcuccaggucaugcacuca

SEQ ID NO: 732901 - RNA, 22 nt, Human
aggcuggucccagggagggaau

SEQ ID NO: 732902 - RNA, 22 nt, Human
agggcugagcccaggcauguag

SEQ ID NO: 732903 - RNA, 22 nt, Human
agggcugcaccggggcuucgcg

SEQ ID NO: 732904 - RNA, 22 nt, Human
gacugugggcucuguuugucuu

SEQ ID NO: 732905 - RNA, 22 nt, Human
uacaugcaugucacagaaugaa

SEQ ID NO: 732906 - RNA, 22 nt, Human
gaaguuuagaagugacagguuu

SEQ ID NO: 732907 - RNA, 16 nt, Human
ccuggaggucacuuca

SEQ ID NO: 732908 - RNA, 22 nt, Human
uggugggcugagucucaucgga

SEQ ID NO: 732909 - RNA, 22 nt, Human
uccaugaggaccaaauucguag

SEQ ID NO: 732910 - RNA, 22 nt, Human
gcuucauuucucucuguagacc

SEQ ID NO: 732911 - RNA, 22 nt, Human
cugacaguuuuugcuguauugu

SEQ ID NO: 732912 - RNA, 21 nt, Human
ccaugucagaugugggcugug

SEQ ID NO: 732913 - RNA, 22 nt, Human
caguacugcuugugggagcaga

SEQ ID NO: 732914 - RNA, 22 nt, Human
cuacagagugaaugcagaaaau

SEQ ID NO: 732915 - RNA, 22 nt, Human
guggcagcugguaugcagacag

SEQ ID NO: 732916 - RNA, 21 nt, Human
uuacauucagaggaguggaag

SEQ ID NO: 732917 - RNA, 21 nt, Human
ugcuguccuagaaccagggcc

SEQ ID NO: 732918 - RNA, 19 nt, Human
agcaggccaggcagguggc

SEQ ID NO: 732919 - RNA, 22 nt, Human
uuuccucuuccgagggggaggc

SEQ ID NO: 732920 - RNA, 22 nt, Human
uuucagacaggacuucauaugu

SEQ ID NO: 732921 - RNA, 22 nt, Human
cugaaggauucaaaauggcagg

SEQ ID NO: 732922 - RNA, 22 nt, Human
cauuucaguguuauucuaauuu

SEQ ID NO: 732923 - RNA, 22 nt, Human
ugccacuggggcuaggacuguu

SEQ ID NO: 732924 - RNA, 22 nt, Human
cuuuuacauuuguugaagagua

SEQ ID NO: 732925 - RNA, 22 nt, Human
aggcagcuggaggcagagacua

SEQ ID NO: 732926 - RNA, 22 nt, Human
ccaaggagaaugacaccaugga

SEQ ID NO: 732927 - RNA, 22 nt, Human
uggcuuccccuaccuuccaauu

SEQ ID NO: 732928 - RNA, 22 nt, Human
agccuuuaacacuucacauuga

SEQ ID NO: 732929 - RNA, 22 nt, Human
aggaaaggccuuugcauuuggu

SEQ ID NO: 732930 - RNA, 22 nt, Human
acauguuagaaaugcagaaucu

SEQ ID NO: 732931 - RNA, 22 nt, Human
cuguccuccagacgacaguccc

SEQ ID NO: 732932 - RNA, 22 nt, Human
ggucccugcugaagccuuggug

SEQ ID NO: 732933 - RNA, 22 nt, Human
aacuccagcucacacagugacc

SEQ ID NO: 732934 - RNA, 22 nt, Human
uucuccaggcuugggccagguc

SEQ ID NO: 732935 - RNA, 22 nt, Human
ucugggcuuuugcacuggccau

SEQ ID NO: 732936 - RNA, 22 nt, Human
caggcuuuacuuucucucugaa

SEQ ID NO: 732937 - RNA, 22 nt, Human
ugacauaaaucuaaaggaaagg

SEQ ID NO: 732938 - RNA, 22 nt, Human
uccaggugagugcaggugcaga

SEQ ID NO: 732939 - RNA, 22 nt, Human
gcuguggcuccaauggugagcc

SEQ ID NO: 732940 - RNA, 21 nt, Human
uuuagggaggauauuuaacuu

SEQ ID NO: 732941 - RNA, 22 nt, Human
cugcuguguuggcauuggauag

SEQ ID NO: 732942 - RNA, 22 nt, Human
cugugcugagugaugugacuua

SEQ ID NO: 732943 - RNA, 22 nt, Human
caaaaugaugugauuuuauugu

SEQ ID NO: 732944 - RNA, 22 nt, Human
aagcaggagagccugggugagc

SEQ ID NO: 732945 - RNA, 22 nt, Human
ugcaggagcuuggcucuguccc

SEQ ID NO: 732946 - RNA, 22 nt, Human
uacagcuuauccagcuugauag

SEQ ID NO: 732947 - RNA, 22 nt, Human
aucuucccaggcuggggagagg

SEQ ID NO: 732948 - RNA, 22 nt, Human
uugggccaaggcagaucuccaa

SEQ ID NO: 732949 - RNA, 22 nt, Human
agucacccuccaacucuccacu

SEQ ID NO: 732950 - RNA, 22 nt, Human
agcugccucugaacuuuaauuc

SEQ ID NO: 732951 - RNA, 22 nt, Human
agguucagacgcauaauaggca

SEQ ID NO: 732952 - RNA, 15 nt, Human
auacacaugagggag

SEQ ID NO: 732953 - RNA, 17 nt, Human
agccugccccaugcugc

SEQ ID NO: 732954 - RNA, 22 nt, Human
aaaguggccauccucugcaucg

SEQ ID NO: 732955 - RNA, 22 nt, Human
gggaagccaugcucagagguac

SEQ ID NO: 732956 - RNA, 22 nt, Human
ugagcugggaagagcagccaga

SEQ ID NO: 732957 - RNA, 22 nt, Human
cgcuggaaauugccguuggcuu

SEQ ID NO: 732958 - RNA, 22 nt, Human
gaggccugguagccgagcccca

SEQ ID NO: 732959 - RNA, 22 nt, Human
uuccagaggcuucagggaagaa

SEQ ID NO: 732960 - RNA, 22 nt, Human
uacuuauaaggaggcacacaaa

SEQ ID NO: 732961 - RNA, 22 nt, Human
ccagcaggagagaacauuuccc

SEQ ID NO: 732962 - RNA, 22 nt, Human
aacacugaaacauugauugaca

SEQ ID NO: 732963 - RNA, 22 nt, Human
gaaaucugcggugaggccugag

SEQ ID NO: 732964 - RNA, 22 nt, Human
cugacagauuagaugugcauau

SEQ ID NO: 732965 - RNA, 22 nt, Human
gcagccagggcuaagcugggga

SEQ ID NO: 732966 - RNA, 19 nt, Human
cccugcccuggugacuggg

SEQ ID NO: 732967 - RNA, 22 nt, Human
cacucuaaccuccaucuuccau

SEQ ID NO: 732968 - RNA, 22 nt, Human
agcugugcugccaaguugcuga

SEQ ID NO: 732969 - RNA, 22 nt, Human
gagcucagcacuaaaaucaugu

SEQ ID NO: 732970 - RNA, 22 nt, Human
aaggcagcaggauuuggugacu

SEQ ID NO: 732971 - RNA, 22 nt, Human
cgacccuacagacagugcugag

SEQ ID NO: 732972 - RNA, 22 nt, Human
uccagagcugggucugugcuca

SEQ ID NO: 732973 - RNA, 22 nt, Human
gaugacaaaagaguaaguaaug

SEQ ID NO: 732974 - RNA, 22 nt, Human
gugucugcucagcuugcuagaa

SEQ ID NO: 732975 - RNA, 22 nt, Human
agaagcauuauaacaugcaagg

SEQ ID NO: 732976 - RNA, 22 nt, Human
uggagaguaaauggcagaauca

SEQ ID NO: 732977 - RNA, 22 nt, Human
aguucacagaauggccagaacu

SEQ ID NO: 732978 - RNA, 22 nt, Human
uuggagagcaguaaaccacacu

SEQ ID NO: 732979 - RNA, 22 nt, Human
ggagcgugcacuccaggcccuu

SEQ ID NO: 732980 - RNA, 22 nt, Human
cuccugggcucauaucauucag

SEQ ID NO: 732981 - RNA, 22 nt, Human
uucucaguuucacugauaacag

SEQ ID NO: 732982 - RNA, 22 nt, Human
agaagaugacuuuggaguugga

SEQ ID NO: 732983 - RNA, 22 nt, Human
guuauaaaggugauaaugguca

SEQ ID NO: 732984 - RNA, 22 nt, Human
ucgugcaaaccugacacagcca

SEQ ID NO: 732985 - RNA, 22 nt, Human
agcugguucaguuucugggccu

SEQ ID NO: 732986 - RNA, 22 nt, Human
accaggaagugugggccaacgu

SEQ ID NO: 732987 - RNA, 22 nt, Human
ucucaugcaugcauaagucuag

SEQ ID NO: 732988 - RNA, 22 nt, Human
gaacaaggauucccaaagaaga

SEQ ID NO: 732989 - RNA, 22 nt, Human
uggcagcugucuguggggucuc

SEQ ID NO: 732990 - RNA, 22 nt, Human
uccagagaacgaugaaagcugg

SEQ ID NO: 732991 - RNA, 22 nt, Human
cugugugugaacacagcccagc

SEQ ID NO: 732992 - RNA, 22 nt, Human
cagauguacaugaagggcaaug

SEQ ID NO: 732993 - RNA, 22 nt, Human
gcucuggacuggggccugagaa

SEQ ID NO: 732994 - RNA, 22 nt, Human
caguuucuuagugacacaaauc

SEQ ID NO: 732995 - RNA, 22 nt, Human
guccaaauuccacagauuucuc

SEQ ID NO: 732996 - RNA, 22 nt, Human
ccaggaaggaucguuugggagu

SEQ ID NO: 732997 - RNA, 22 nt, Human
aguggcaguggaaagcacacgg

SEQ ID NO: 732998 - RNA, 22 nt, Human
uuuagggaugucagaacaggga

SEQ ID NO: 732999 - RNA, 22 nt, Human
ggcuagaaacucaggcaagaaa

SEQ ID NO: 733000 - RNA, 20 nt, Human
uuucuugucggcuguugcug

SEQ ID NO: 733001 - RNA, 22 nt, Human
ucagggugaaccaggcaggaau

SEQ ID NO: 733002 - RNA, 22 nt, Human
ggcucagaaacuaaaggcgcug

SEQ ID NO: 733003 - RNA, 22 nt, Human
aggcugagugcuccccuagaug

SEQ ID NO: 733004 - RNA, 22 nt, Human
auuuugcugcuaugccuugcaa

SEQ ID NO: 733005 - RNA, 22 nt, Human
augcugugauuguagaaauauu

SEQ ID NO: 733006 - RNA, 22 nt, Human
agagaauacaaagaagauaugu

SEQ ID NO: 733007 - RNA, 22 nt, Human
ugugugacacauugauaugugc

SEQ ID NO: 733008 - RNA, 20 nt, Human
agccaccucauuucccuacc

SEQ ID NO: 733009 - RNA, 19 nt, Human
augagcuggcauuucaggu

SEQ ID NO: 733010 - RNA, 22 nt, Human
gcugugugcucuggucuuucuu

SEQ ID NO: 733011 - RNA, 22 nt, Human
agaaagggaacuggcaaagcca

SEQ ID NO: 733012 - RNA, 22 nt, Human
gcugaggcaaauaguuuuaagu

SEQ ID NO: 733013 - RNA, 22 nt, Human
cugaggucaggaguucaagcug

SEQ ID NO: 733014 - RNA, 22 nt, Human
cacccaggagguugggaagggc

SEQ ID NO: 733015 - RNA, 22 nt, Human
ugucugagcaccugugcugaac

SEQ ID NO: 733016 - RNA, 22 nt, Human
cucuguguuaaauuggguuuuu

SEQ ID NO: 733017 - RNA, 22 nt, Human
aggagaggguggcauuaaguuu

SEQ ID NO: 733018 - RNA, 22 nt, Human
ugggcaggaugcguugauucuu

SEQ ID NO: 733019 - RNA, 22 nt, Human
uccugguggcucuuugggaagg

SEQ ID NO: 733020 - RNA, 22 nt, Human
auucagaaaggguugccugguu

SEQ ID NO: 733021 - RNA, 22 nt, Human
agagaacagacagaugcaauga

SEQ ID NO: 733022 - RNA, 20 nt, Human
ugcugcaguuucaugggacu

SEQ ID NO: 733023 - RNA, 22 nt, Human
uuucuagggcucuugucuucug

SEQ ID NO: 733024 - RNA, 22 nt, Human
agugcccugcuggggcaggaga

SEQ ID NO: 733025 - RNA, 22 nt, Human
aaauuuuagaccaggcaaaacu

SEQ ID NO: 733026 - RNA, 22 nt, Human
acagcugugacuuagagaaguu

SEQ ID NO: 733027 - RNA, 22 nt, Human
agauggcugggcucguccgcag

SEQ ID NO: 733028 - RNA, 22 nt, Human
uagcagggccaggcugggaacc

SEQ ID NO: 733029 - RNA, 22 nt, Human
acaaaggcagccaaucaucugc

SEQ ID NO: 733030 - RNA, 22 nt, Human
uuuaugacuucuaaucugaagc

SEQ ID NO: 733031 - RNA, 22 nt, Human
ccuuagugugaggggauacccc

SEQ ID NO: 733032 - RNA, 22 nt, Human
augcaguacugauacaugccac

SEQ ID NO: 733033 - RNA, 22 nt, Human
gcucccuuaguccuugccggga

SEQ ID NO: 733034 - RNA, 22 nt, Human
cuugacacugucacucaggcca

SEQ ID NO: 733035 - RNA, 22 nt, Human
ucagaguuccucauagauccag

SEQ ID NO: 733036 - RNA, 22 nt, Human
uguccuggaguuauaaugccug

SEQ ID NO: 733037 - RNA, 19 nt, Human
acugucacauaaaggaagg

SEQ ID NO: 733038 - RNA, 22 nt, Human
aggucugagagccgcuuucccc

SEQ ID NO: 733039 - RNA, 22 nt, Human
cucaguccgucccgcuaggugc

SEQ ID NO: 733040 - RNA, 22 nt, Human
cucuugggugggcagugggccu

SEQ ID NO: 733041 - RNA, 22 nt, Human
ucauaaagcauuucagcuuuug

SEQ ID NO: 733042 - RNA, 22 nt, Human
cccugggcagucugcacuucag

SEQ ID NO: 733043 - RNA, 22 nt, Human
uccccucccuuccaacagagcu

SEQ ID NO: 733044 - RNA, 22 nt, Human
auacauuagaaucugguacuca

SEQ ID NO: 733045 - RNA, 22 nt, Human
aauguucauuguuuuccauaug

SEQ ID NO: 733046 - RNA, 22 nt, Human
gcugccaauccagcugugggag

SEQ ID NO: 733047 - RNA, 23 nt, Human
cugcagccgcguggggacgugga

SEQ ID NO: 733048 - RNA, 22 nt, Human
acaaagucacaauaauuaaccu

SEQ ID NO: 733049 - RNA, 22 nt, Human
uuuauuuauccuucuggauugc

SEQ ID NO: 733050 - RNA, 22 nt, Human
ccuuggggaacuggacgugcug

SEQ ID NO: 733051 - RNA, 22 nt, Human
ggcuucugagugcucugcuguu

SEQ ID NO: 733052 - RNA, 18 nt, Human
uauuccugauucaucuuu

SEQ ID NO: 733053 - RNA, 22 nt, Human
cagcaguucaauccagugcacg

SEQ ID NO: 733054 - RNA, 22 nt, Human
cccaggccagaacuugguugcu

SEQ ID NO: 733055 - RNA, 21 nt, Human
cuacacagcuuucuauaggaa

SEQ ID NO: 733056 - RNA, 22 nt, Human
aauuaguaaccuaauuccaucu

SEQ ID NO: 733057 - RNA, 19 nt, Human
ugucucugaaagaugagcu

SEQ ID NO: 733058 - RNA, 22 nt, Human
uccaggcuccccugcgugcucc

SEQ ID NO: 733059 - RNA, 22 nt, Human
acuauacugucucuuauagaua

SEQ ID NO: 733060 - RNA, 22 nt, Human
ggcugcagcagagggacucacg

SEQ ID NO: 733061 - RNA, 22 nt, Human
uaguucuguguagcucaagagu

SEQ ID NO: 733062 - RNA, 22 nt, Human
cugcaggggccucgagcacagg

SEQ ID NO: 733063 - RNA, 22 nt, Human
gaggauggaggcaguuagggcc

SEQ ID NO: 733064 - RNA, 22 nt, Human
cugggcaggagaggugguugga

SEQ ID NO: 733065 - RNA, 22 nt, Human
uucaagugaggcugucuuuaga

SEQ ID NO: 733066 - RNA, 22 nt, Human
ugggaccaagucauuucuuuag

SEQ ID NO: 733067 - RNA, 22 nt, Human
uggacauguccggccagacaau

SEQ ID NO: 733068 - RNA, 21 nt, Human
gcaaauguucaggaaaaaaga

SEQ ID NO: 733069 - RNA, 20 nt, Human
agcaggccuuggggagagga

SEQ ID NO: 733070 - RNA, 22 nt, Human
ccagaggagaugccuccucugu

SEQ ID NO: 733071 - RNA, 22 nt, Human
aaaccugguggaacggugaaua

SEQ ID NO: 733072 - RNA, 22 nt, Human
ugcugcuguuuccuacaucuca

SEQ ID NO: 733073 - RNA, 22 nt, Human
cuggagggcugcagcgaggcug

SEQ ID NO: 733074 - RNA, 23 nt, Human
gccaauuuuugacugucaguagg

SEQ ID NO: 733075 - RNA, 22 nt, Human
uuaauuuucucaucugugaaau

SEQ ID NO: 733076 - RNA, 22 nt, Human
gaaaucuuuauggaaauaacaa

SEQ ID NO: 733077 - RNA, 22 nt, Human
acacagugucuuagguaguguc

SEQ ID NO: 733078 - RNA, 20 nt, Human
ccugucugcaauggagguca

SEQ ID NO: 733079 - RNA, 22 nt, Human
uuguaacaggcacucugugcca

SEQ ID NO: 733080 - RNA, 22 nt, Human
uugaacaguccuaagagacccu

SEQ ID NO: 733081 - RNA, 21 nt, Human
gugcugcuagcgggacgggag

SEQ ID NO: 733082 - RNA, 22 nt, Human
aggccagguuccucaaucuuga

SEQ ID NO: 733083 - RNA, 22 nt, Human
aagacccuauacucagugaccc

SEQ ID NO: 733084 - RNA, 22 nt, Human
acaaugaauuuaauaccuuauu

SEQ ID NO: 733085 - RNA, 22 nt, Human
uccucaugccgggucucacgcu

SEQ ID NO: 733086 - RNA, 22 nt, Human
ugaccaaaggugguuuauuugg

SEQ ID NO: 733087 - RNA, 20 nt, Human
gcuuccaccugaagcgcacc

SEQ ID NO: 733088 - RNA, 22 nt, Human
caguaugugaugcaacggaaua

SEQ ID NO: 733089 - RNA, 22 nt, Human
uuaucuugguguuuuaguaauu

SEQ ID NO: 733090 - RNA, 22 nt, Human
cagagcugcucaugguggccag

SEQ ID NO: 733091 - RNA, 22 nt, Human
ugaguucucaugaaaucuaguu

SEQ ID NO: 733092 - RNA, 22 nt, Human
uccaggcucagcacuugcuacu

SEQ ID NO: 733093 - RNA, 22 nt, Human
cuucuggauuuauucauuccuu

SEQ ID NO: 733094 - RNA, 22 nt, Human
cuuaaacaggaaagagccaggu

SEQ ID NO: 733095 - RNA, 22 nt, Human
cagugguuucugaacagugugc

SEQ ID NO: 733096 - RNA, 17 nt, Human
ugaacuuuagguggagc

SEQ ID NO: 733097 - RNA, 22 nt, Human
ccugcagaagaguccagcucau

SEQ ID NO: 733098 - RNA, 22 nt, Human
aauagcugggaccugaauuagc

SEQ ID NO: 733099 - RNA, 22 nt, Human
gcucugagucucagcuaccaca

SEQ ID NO: 733100 - RNA, 22 nt, Human
auuccaguuggguucuaauaca

SEQ ID NO: 733101 - RNA, 22 nt, Human
aagcccugggguugcacaaggc

SEQ ID NO: 733102 - RNA, 22 nt, Human
aagcagugaugcauacagcugu

SEQ ID NO: 733103 - RNA, 22 nt, Human
uauauuaacuugugauccugga

SEQ ID NO: 733104 - RNA, 22 nt, Human
agcugucucucugguguccaua

SEQ ID NO: 733105 - RNA, 22 nt, Human
caguccugggagacuuacccag

SEQ ID NO: 733106 - RNA, 22 nt, Human
aaauugcuaguugcuuuuuuca

SEQ ID NO: 733107 - RNA, 22 nt, Human
auugguuaccacuuuaaaucuu

SEQ ID NO: 733108 - RNA, 22 nt, Human
ucugaaagcccuaguuuguaau

SEQ ID NO: 733109 - RNA, 22 nt, Human
ucccugcauuugggagaguguc

SEQ ID NO: 733110 - RNA, 22 nt, Human
uucauacuaaaguguaagaugu

SEQ ID NO: 733111 - RNA, 22 nt, Human
ccugggucccagccaggcuuug

SEQ ID NO: 733112 - RNA, 21 nt, Human
uggcauggagguagcagugug

SEQ ID NO: 733113 - RNA, 22 nt, Human
uggcucaggcuugaaaauagau

SEQ ID NO: 733114 - RNA, 22 nt, Human
cucccaggcacagggaggagcc

SEQ ID NO: 733115 - RNA, 22 nt, Human
acagugcugucuaucucacuaa

SEQ ID NO: 733116 - RNA, 22 nt, Human
ggcagagugcucugggcagggg

SEQ ID NO: 733117 - RNA, 22 nt, Human
ugucaagugauuagccauaaug

SEQ ID NO: 733118 - RNA, 22 nt, Human
uuucucuggccucaguuuaaca

SEQ ID NO: 733119 - RNA, 22 nt, Human
ucaggccagcaccaucccuauc

SEQ ID NO: 733120 - RNA, 22 nt, Human
guagugcgcauggccuguuugu

SEQ ID NO: 733121 - RNA, 22 nt, Human
augugugcaaugcuauuuuggc

SEQ ID NO: 733122 - RNA, 22 nt, Human
gucacuggaauuacaggcaugc

SEQ ID NO: 733123 - RNA, 22 nt, Human
gccagggcucgcggucccucgu

SEQ ID NO: 733124 - RNA, 22 nt, Human
uacacaggguauggcuugagga

SEQ ID NO: 733125 - RNA, 22 nt, Human
gcagagccccauugcuggcggg

SEQ ID NO: 733126 - RNA, 22 nt, Human
ugcugggcccccagugaccuuc

SEQ ID NO: 733127 - RNA, 22 nt, Human
acaucucaugaaugauaaauca

SEQ ID NO: 733128 - RNA, 22 nt, Human
uuguauuuuuuccuggcggugg

SEQ ID NO: 733129 - RNA, 22 nt, Human
auuggaaguauuucaucaaaag

SEQ ID NO: 733130 - RNA, 21 nt, Human
aucugaaagguuaguguugag

SEQ ID NO: 733131 - RNA, 19 nt, Human
gcagggcucucccagaugc

SEQ ID NO: 733132 - RNA, 22 nt, Human
ggcuucacucauaauuagguuc

SEQ ID NO: 733133 - RNA, 22 nt, Human
ucuggcuccacuuucuucauuu

SEQ ID NO: 733134 - RNA, 20 nt, Human
aguuagugaguaauugagcu

SEQ ID NO: 733135 - RNA, 21 nt, Human
acaugcauagagagauuucug

SEQ ID NO: 733136 - RNA, 22 nt, Human
ugcaugcaugcuacugggaggu

SEQ ID NO: 733137 - RNA, 22 nt, Human
ggcugagcacuuuaggcaggag

SEQ ID NO: 733138 - RNA, 22 nt, Human
uguuucaggaccuaucuuuuag

SEQ ID NO: 733139 - RNA, 22 nt, Human
cccaggccccagggcuugucag

SEQ ID NO: 733140 - RNA, 22 nt, Human
gcaggauggugcccuuucugcc

SEQ ID NO: 733141 - RNA, 22 nt, Human
caaaugcuaugauuuugaguuu

SEQ ID NO: 733142 - RNA, 22 nt, Human
ugaugaauaaacuugagaguca

SEQ ID NO: 733143 - RNA, 22 nt, Human
gaggcagcuuggggcugugggu

SEQ ID NO: 733144 - RNA, 20 nt, Human
accuucaggaacuuaucagc

SEQ ID NO: 733145 - RNA, 22 nt, Human
agugugucugaucacuugugag

SEQ ID NO: 733146 - RNA, 22 nt, Human
ugggccucaccuucuuggcagc

SEQ ID NO: 733147 - RNA, 23 nt, Human
uagcaaaguuguuugggaaauuu

SEQ ID NO: 733148 - RNA, 22 nt, Human
acacauuucuaaauuuuuaccg

SEQ ID NO: 733149 - RNA, 22 nt, Human
ggaucaggcgccaugggaagug

SEQ ID NO: 733150 - RNA, 22 nt, Human
acagcuugcaauggcuuucaac

SEQ ID NO: 733151 - RNA, 22 nt, Human
uccaggcauaagccuugagugu

SEQ ID NO: 733152 - RNA, 22 nt, Human
cugggcuccacucccacagugu

SEQ ID NO: 733153 - RNA, 20 nt, Human
auugucagccuucagaggag

SEQ ID NO: 733154 - RNA, 22 nt, Human
augcaguaaaauaggagguaau

SEQ ID NO: 733155 - RNA, 22 nt, Human
uuugaauaaacgguuaauguuc

SEQ ID NO: 733156 - RNA, 22 nt, Human
gcugcugcaagagccagcucuu

SEQ ID NO: 733157 - RNA, 22 nt, Human
gccagcuguuucagagcccagu

SEQ ID NO: 733158 - RNA, 22 nt, Human
caggagugaaaugaggcccagg

SEQ ID NO: 733159 - RNA, 22 nt, Human
ggcugggcaggucugcacaggg

SEQ ID NO: 733160 - RNA, 22 nt, Human
uauucacauguacauaugcuca

SEQ ID NO: 733161 - RNA, 22 nt, Human
ccagggcugagacuguauuggg

SEQ ID NO: 733162 - RNA, 22 nt, Human
ccaguguucaguaugcauuaag

SEQ ID NO: 733163 - RNA, 22 nt, Human
uuacucugaauguuucuacuga

SEQ ID NO: 733164 - RNA, 22 nt, Human
ugaggcuuagauuugguaacuc

SEQ ID NO: 733165 - RNA, 22 nt, Human
cucuggcugucccgaugagcag

SEQ ID NO: 733166 - RNA, 23 nt, Human
gccagccuugcucuccugcagcc

SEQ ID NO: 733167 - RNA, 22 nt, Human
agccagcacggauuucccagga

SEQ ID NO: 733168 - RNA, 22 nt, Human
aauucagagacaugaagugaca

SEQ ID NO: 733169 - RNA, 23 nt, Human
augaagacccgugguguccccac

SEQ ID NO: 733170 - RNA, 22 nt, Human
cugagcccaggcgggagcugag

SEQ ID NO: 733171 - RNA, 22 nt, Human
cacaugcauaccuauguguaua

SEQ ID NO: 733172 - RNA, 22 nt, Human
gagcugagauuugaagcaaguu

SEQ ID NO: 733173 - RNA, 22 nt, Human
gacacagcuuucugaagagcau

SEQ ID NO: 733174 - RNA, 22 nt, Human
uuugguauugcacacugucuuc

SEQ ID NO: 733175 - RNA, 20 nt, Human
ugccugggaaggcguggagg

SEQ ID NO: 733176 - RNA, 20 nt, Human
ucuccuggucugguccgugc

SEQ ID NO: 733177 - RNA, 22 nt, Human
ggcaugcauacguagugauuuu

SEQ ID NO: 733178 - RNA, 22 nt, Human
uagaaagucaugaauuacacca

SEQ ID NO: 733179 - RNA, 22 nt, Human
gggugagagucaggcagagauu

SEQ ID NO: 733180 - RNA, 22 nt, Human
agaacacugcuaguauaaucac

SEQ ID NO: 733181 - RNA, 22 nt, Human
auggaaaagggucuuucauuuc

SEQ ID NO: 733182 - RNA, 22 nt, Human
agcaggcaagcgugaguucucu

SEQ ID NO: 733183 - RNA, 22 nt, Human
ugcagcauuaguacaagucuca

SEQ ID NO: 733184 - RNA, 21 nt, Human
gcaguuuauguaauaugcacu

SEQ ID NO: 733185 - RNA, 22 nt, Human
cacuggcauuagucacgaggca

SEQ ID NO: 733186 - RNA, 22 nt, Human
cacagaggcggaaaauucugaa

SEQ ID NO: 733187 - RNA, 21 nt, Human
uggcacagaaaggaaaguuca

SEQ ID NO: 733188 - RNA, 22 nt, Human
gggcacugcuggaggcucccug

SEQ ID NO: 733189 - RNA, 22 nt, Human
guccuucaucuggagccugguc

SEQ ID NO: 733190 - RNA, 22 nt, Human
agaggcugucucauauuuugua

SEQ ID NO: 733191 - RNA, 17 nt, Human
uuucaacaucacucagc

SEQ ID NO: 733192 - RNA, 20 nt, Human
gccugcagguuggaugggau

SEQ ID NO: 733193 - RNA, 22 nt, Human
uagcaucuggagaaacaagucc

SEQ ID NO: 733194 - RNA, 22 nt, Human
ggcaggugugagaucgaggcca

SEQ ID NO: 733195 - RNA, 22 nt, Human
ucucagcaaggaaagaggcagg

SEQ ID NO: 733196 - RNA, 22 nt, Human
ugguuucacacugcauggugua

SEQ ID NO: 733197 - RNA, 22 nt, Human
uauuggaguauggggcuggagu

SEQ ID NO: 733198 - RNA, 22 nt, Human
gauccguuuuaacaaugggagu

SEQ ID NO: 733199 - RNA, 22 nt, Human
auacuguaucacuugugaguga

SEQ ID NO: 733200 - RNA, 22 nt, Human
ggccuuggaguccuccacugga

SEQ ID NO: 733201 - RNA, 22 nt, Human
aauuggcauagcauacaauuca

SEQ ID NO: 733202 - RNA, 22 nt, Human
cauagccaucuuuagcuuccag

SEQ ID NO: 733203 - RNA, 22 nt, Human
gugcuucccauuagaacuguga

SEQ ID NO: 733204 - RNA, 21 nt, Human
ugcugacaucaggucugcuau

SEQ ID NO: 733205 - RNA, 22 nt, Human
aaagguucuacuuuuaaagaau

SEQ ID NO: 733206 - RNA, 22 nt, Human
cagugggggugaggccgaggua

SEQ ID NO: 733207 - RNA, 20 nt, Human
ucagaagugcagcugccccu

SEQ ID NO: 733208 - RNA, 22 nt, Human
agaacuuuuggagacuuuuagu

SEQ ID NO: 733209 - RNA, 22 nt, Human
aaagccuuggucaucugguucc

SEQ ID NO: 733210 - RNA, 21 nt, Human
acagacagggccagugucccc

SEQ ID NO: 733211 - RNA, 18 nt, Human
uggaggcagaguucuggc

SEQ ID NO: 733212 - RNA, 22 nt, Human
cucuuaaagaauguuccagcug

SEQ ID NO: 733213 - RNA, 22 nt, Human
uaacaguauagccuaacauuuc

SEQ ID NO: 733214 - RNA, 22 nt, Human
uagcuguuauuuugcuacccau

SEQ ID NO: 733215 - RNA, 22 nt, Human
acacuucucccaucuccuguug

SEQ ID NO: 733216 - RNA, 22 nt, Human
acaugcuacacagagcuccucg

SEQ ID NO: 733217 - RNA, 22 nt, Human
ccaguccugcucccugaccacc

SEQ ID NO: 733218 - RNA, 22 nt, Human
aagugaaacauguaucucuuua

SEQ ID NO: 733219 - RNA, 22 nt, Human
aaagucucaggcaaaccaggac

SEQ ID NO: 733220 - RNA, 22 nt, Human
uuuguagaacuauacuuacauu

SEQ ID NO: 733221 - RNA, 22 nt, Human
acugucugugccagaugcuggg

SEQ ID NO: 733222 - RNA, 22 nt, Human
uggcugccuucccugcuggagg

SEQ ID NO: 733223 - RNA, 22 nt, Human
uauauuuaaauccagguugaaa

SEQ ID NO: 733224 - RNA, 22 nt, Human
cugaggcacugucagcugaggc

SEQ ID NO: 733225 - RNA, 22 nt, Human
ugagauaacaaaauuaucuuca

SEQ ID NO: 733226 - RNA, 22 nt, Human
uccaagggcagccauagaacuu

SEQ ID NO: 733227 - RNA, 22 nt, Human
uagggcuggcgugcucagggaa

SEQ ID NO: 733228 - RNA, 22 nt, Human
gagguggccagagucaagagcc

SEQ ID NO: 733229 - RNA, 22 nt, Human
cacugcauggaugauggcugua

SEQ ID NO: 733230 - RNA, 22 nt, Human
ugccagcacaaguuaagagauc

SEQ ID NO: 733231 - RNA, 22 nt, Human
cuagucacuguaauaaucugcu

SEQ ID NO: 733232 - RNA, 21 nt, Human
ggacagcugcgcgcagggcuc

SEQ ID NO: 733233 - RNA, 22 nt, Human
accuugggcaaccugcuccugc

SEQ ID NO: 733234 - RNA, 17 nt, Human
gggagaugaagggauau

SEQ ID NO: 733235 - RNA, 22 nt, Human
ggaagaaaugcucuucuaugcg

SEQ ID NO: 733236 - RNA, 22 nt, Human
auggugaagcuucauggguguu

SEQ ID NO: 733237 - RNA, 22 nt, Human
acaguagauugguaugauguca

SEQ ID NO: 733238 - RNA, 22 nt, Human
uguccucuuccagugcuccuuc

SEQ ID NO: 733239 - RNA, 22 nt, Human
aggucuggaaacagcagggaga

SEQ ID NO: 733240 - RNA, 22 nt, Human
ugccugugguuccaguuuuuuc

SEQ ID NO: 733241 - RNA, 22 nt, Human
agugacauuugcaccagcugcu

SEQ ID NO: 733242 - RNA, 21 nt, Human
agcuggaaucuggcugugcuu

SEQ ID NO: 733243 - RNA, 22 nt, Human
cucugcucaccagccaugugau

SEQ ID NO: 733244 - RNA, 22 nt, Human
gggcaguagcuucguaggcauc

SEQ ID NO: 733245 - RNA, 22 nt, Human
aggagccaggccccauggggcu

SEQ ID NO: 733246 - RNA, 22 nt, Human
caguauuuccucuucuuaacuu

SEQ ID NO: 733247 - RNA, 22 nt, Human
guggccagaaucuugaggccuu

SEQ ID NO: 733248 - RNA, 22 nt, Human
cacacaugaaucccuaguaccu

SEQ ID NO: 733249 - RNA, 22 nt, Human
aagggaggaggauuuauuguac

SEQ ID NO: 733250 - RNA, 22 nt, Human
ugucaccuugaugauggccuag

SEQ ID NO: 733251 - RNA, 22 nt, Human
aagaggcugaaugagaaaguac

SEQ ID NO: 733252 - RNA, 22 nt, Human
augccuccucaaaucugccaca

SEQ ID NO: 733253 - RNA, 22 nt, Human
cccucacucugccuccuggggu

SEQ ID NO: 733254 - RNA, 22 nt, Human
ugugagacaggaccuguugacu

SEQ ID NO: 733255 - RNA, 22 nt, Human
ucaggaaaauacugcuuaucca

SEQ ID NO: 733256 - RNA, 23 nt, Human
ucugcagacgcuguucuauuguc

SEQ ID NO: 733257 - RNA, 22 nt, Human
gccgcggcauggcgagcaggac

SEQ ID NO: 733258 - RNA, 22 nt, Human
uccucuucaaaaggauuuccuu

SEQ ID NO: 733259 - RNA, 22 nt, Human
uuccaagaagucaacagguagu

SEQ ID NO: 733260 - RNA, 22 nt, Human
ucauucagguugggcaaguguc

SEQ ID NO: 733261 - RNA, 22 nt, Human
accuucugaccaguuaucuuga

SEQ ID NO: 733262 - RNA, 22 nt, Human
aggaugagauuccagggucaau

SEQ ID NO: 733263 - RNA, 22 nt, Human
cugacuguuugcugaaaggucu

SEQ ID NO: 733264 - RNA, 22 nt, Human
cugagacccagacaccugagga

SEQ ID NO: 733265 - RNA, 22 nt, Human
ugucugucugcaagccagaaag

SEQ ID NO: 733266 - RNA, 22 nt, Human
guucucucaaacuuuguguuug

SEQ ID NO: 733267 - RNA, 22 nt, Human
uagcagcuuccagagagggcag

SEQ ID NO: 733268 - RNA, 22 nt, Human
uagguaguuacacagcaaugua

SEQ ID NO: 733269 - RNA, 22 nt, Human
auaugucgcuacaucauuagau

SEQ ID NO: 733270 - RNA, 22 nt, Human
gcagcaggacugccguuaaagu

SEQ ID NO: 733271 - RNA, 22 nt, Human
ggguguugauuuuacacuaaaa

SEQ ID NO: 733272 - RNA, 22 nt, Human
auuauucuuaugucaucauggc

SEQ ID NO: 733273 - RNA, 22 nt, Human
ccccaggaagccucagauuugc

SEQ ID NO: 733274 - RNA, 22 nt, Human
uaaauucagugaguaauuucug

SEQ ID NO: 733275 - RNA, 22 nt, Human
ucaggcucaggaauguguuuau

SEQ ID NO: 733276 - RNA, 22 nt, Human
ugggcucugguuuccuggcugg

SEQ ID NO: 733277 - RNA, 22 nt, Human
agaggguggugaggccugguuc

SEQ ID NO: 733278 - RNA, 22 nt, Human
uauacacauaucuucuaggccu

SEQ ID NO: 733279 - RNA, 22 nt, Human
ugggaauagaacaagauagaga

SEQ ID NO: 733280 - RNA, 22 nt, Human
guggcagagcaggagacaggac

SEQ ID NO: 733281 - RNA, 22 nt, Human
agaacagaggccuuauguuuca

SEQ ID NO: 733282 - RNA, 22 nt, Human
uauugaguuacagaaaauacuu

SEQ ID NO: 733283 - RNA, 22 nt, Human
aaacugaagagcuuuuugacac

SEQ ID NO: 733284 - RNA, 22 nt, Human
cuucuuaaagauuacacaauga

SEQ ID NO: 733285 - RNA, 22 nt, Human
uaaggaaaguacauguuuugac

SEQ ID NO: 733286 - RNA, 22 nt, Human
cucccauugcuucaaagauccu

SEQ ID NO: 733287 - RNA, 23 nt, Human
cuggcccuggcucugugaucaug

SEQ ID NO: 733288 - RNA, 22 nt, Human
cucccaggugucccuucugcca

SEQ ID NO: 733289 - RNA, 22 nt, Human
agucaggaagcuggagcugggg

SEQ ID NO: 733290 - RNA, 21 nt, Human
uuucccagcugaaaauaaaug

SEQ ID NO: 733291 - RNA, 22 nt, Human
ccaggagagcauugcacagagg

SEQ ID NO: 733292 - RNA, 22 nt, Human
agagcacaggcucuggagucua

SEQ ID NO: 733293 - RNA, 22 nt, Human
ucacauuuggagaaagccugcc

SEQ ID NO: 733294 - RNA, 19 nt, Human
aucuuuggguccugaaggg

SEQ ID NO: 733295 - RNA, 22 nt, Human
gccaggcaguucaaguacacca

SEQ ID NO: 733296 - RNA, 22 nt, Human
gcuuuauguaaguccaaaggca

SEQ ID NO: 733297 - RNA, 22 nt, Human
uacuuuaaaaacugauaauuca

SEQ ID NO: 733298 - RNA, 22 nt, Human
uacauacaugguggaaugguua

SEQ ID NO: 733299 - RNA, 22 nt, Human
acugcuuccugagaaaucaaca

SEQ ID NO: 733300 - RNA, 22 nt, Human
ugcuucucaaagaagcauaaug

SEQ ID NO: 733301 - RNA, 19 nt, Human
uugugugucagucagaguu

SEQ ID NO: 733302 - RNA, 22 nt, Human
agucucuuuaaucacagugucu

SEQ ID NO: 733303 - RNA, 22 nt, Human
agccacagucuguagccagcuu

SEQ ID NO: 733304 - RNA, 22 nt, Human
uggucugggcaaauccuucuga

SEQ ID NO: 733305 - RNA, 22 nt, Human
aggaggggcauagaaauguaau

SEQ ID NO: 733306 - RNA, 22 nt, Human
cucugcuuucucaaacccugug

SEQ ID NO: 733307 - RNA, 17 nt, Human
uagcuguguuucagcua

SEQ ID NO: 733308 - RNA, 19 nt, Human
uuuuccuucuccucuuaau

SEQ ID NO: 733309 - RNA, 20 nt, Human
cuguuccugucccaugaagc

SEQ ID NO: 733310 - RNA, 22 nt, Human
ucagcagggccuccuugugcag

SEQ ID NO: 733311 - RNA, 22 nt, Human
gaccaggcuguuccagucuaac

SEQ ID NO: 733312 - RNA, 22 nt, Human
ucagauggguuuugaaggaugu

SEQ ID NO: 733313 - RNA, 23 nt, Human
caggacaugggaggaaguauggc

SEQ ID NO: 733314 - RNA, 22 nt, Human
ugaaugaugguguguucuugcc

SEQ ID NO: 733315 - RNA, 22 nt, Human
uuccauugaguaccuggagaca

SEQ ID NO: 733316 - RNA, 22 nt, Human
cugucaccuguucacugcagca

SEQ ID NO: 733317 - RNA, 22 nt, Human
uucagaaaucccucuucuaccc

SEQ ID NO: 733318 - RNA, 19 nt, Human
aaugacugaguacauuguc

SEQ ID NO: 733319 - RNA, 22 nt, Human
uuuagcauuacuaaaaugaaaa

SEQ ID NO: 733320 - RNA, 22 nt, Human
agaauacaucuagugcugcaug

SEQ ID NO: 733321 - RNA, 22 nt, Human
ucagaggucagcagcuugccca

SEQ ID NO: 733322 - RNA, 22 nt, Human
gaugauuguuggcucucuugau

SEQ ID NO: 733323 - RNA, 22 nt, Human
aggcuguguaaagugcuuuccc

SEQ ID NO: 733324 - RNA, 22 nt, Human
uucuuacaaacaagaucauuga

SEQ ID NO: 733325 - RNA, 22 nt, Human
gugacaauauuagcucaggggc

SEQ ID NO: 733326 - RNA, 22 nt, Human
uacauguacaugcauagguaga

SEQ ID NO: 733327 - RNA, 22 nt, Human
aggacagcagugcuggcacuug

SEQ ID NO: 733328 - RNA, 22 nt, Human
agagcugagcaccaagcauggu

SEQ ID NO: 733329 - RNA, 22 nt, Human
caggcugccuggaagaggacug

SEQ ID NO: 733330 - RNA, 22 nt, Human
uggcuggacagugggcagugga

SEQ ID NO: 733331 - RNA, 22 nt, Human
cugccuggaccggcagcccucc

SEQ ID NO: 733332 - RNA, 22 nt, Human
uacccaguuccacacacugaug

SEQ ID NO: 733333 - RNA, 22 nt, Human
auggaaauguuccauauauuga

SEQ ID NO: 733334 - RNA, 22 nt, Human
agggccaguggguugaaaggca

SEQ ID NO: 733335 - RNA, 22 nt, Human
uuucaagcugugguaacugaga

SEQ ID NO: 733336 - RNA, 22 nt, Human
acccagggcuuaaggcggugca

SEQ ID NO: 733337 - RNA, 22 nt, Human
uauuccuaauuugcagggcaug

SEQ ID NO: 733338 - RNA, 22 nt, Human
gcuggcagaauuucuucuugcu

SEQ ID NO: 733339 - RNA, 22 nt, Human
uuauucuguuguucaggguugg

SEQ ID NO: 733340 - RNA, 22 nt, Human
ugacaguuaagguauacauuca

SEQ ID NO: 733341 - RNA, 22 nt, Human
uucacaguggcccucucugagu

SEQ ID NO: 733342 - RNA, 22 nt, Human
augccuuugccacagauuagga

SEQ ID NO: 733343 - RNA, 22 nt, Human
gcugcaggagauuuugagaguc

SEQ ID NO: 733344 - RNA, 22 nt, Human
ucacuucuucagcuuuccuuga

SEQ ID NO: 733345 - RNA, 22 nt, Human
auacaucuugucagauucaugu

SEQ ID NO: 733346 - RNA, 22 nt, Human
aauagcaucuucccugguaacc

SEQ ID NO: 733347 - RNA, 22 nt, Human
auguucauuuucuuaaugugcc

SEQ ID NO: 733348 - RNA, 23 nt, Human
acugagccagggccugggucagc

SEQ ID NO: 733349 - RNA, 22 nt, Human
agaauuguaauaauaauagcau

SEQ ID NO: 733350 - RNA, 22 nt, Human
uaccaggaauuauuuuacauuu

SEQ ID NO: 733351 - RNA, 22 nt, Human
agaccaugggcucugaagagca

SEQ ID NO: 733352 - RNA, 22 nt, Human
gggugguguauuagagcugcag

SEQ ID NO: 733353 - RNA, 22 nt, Human
uguguacaggccuugcuagacu

SEQ ID NO: 733354 - RNA, 22 nt, Human
uguguugugacauucuuggaug

SEQ ID NO: 733355 - RNA, 22 nt, Human
cuucagcagccucuugcauaaa

SEQ ID NO: 733356 - RNA, 22 nt, Human
gauuuacaaagcucucuagugu

SEQ ID NO: 733357 - RNA, 22 nt, Human
ucacucuuuaucuuuuaugucu

SEQ ID NO: 733358 - RNA, 22 nt, Human
gcaggccacaguggagucucug

SEQ ID NO: 733359 - RNA, 22 nt, Human
cacugccuccccaggcuccaca

SEQ ID NO: 733360 - RNA, 22 nt, Human
cugugaauuuaaagcacacauc

SEQ ID NO: 733361 - RNA, 22 nt, Human
uggcagugcugcagugcccuua

SEQ ID NO: 733362 - RNA, 22 nt, Human
ucucucugagcccugcuuuuuc

SEQ ID NO: 733363 - RNA, 22 nt, Human
gugcugaggauacagcugugaa

SEQ ID NO: 733364 - RNA, 22 nt, Human
uggcuucaggagcaccuggcuu

SEQ ID NO: 733365 - RNA, 22 nt, Human
cuucuagagcuggagcaaaugu

SEQ ID NO: 733366 - RNA, 22 nt, Human
ugggcagaucuuugguggcuag

SEQ ID NO: 733367 - RNA, 22 nt, Human
aaauuuuccugguaaagaugga

SEQ ID NO: 733368 - RNA, 22 nt, Human
ggacauggaaguauggagugga

SEQ ID NO: 733369 - RNA, 22 nt, Human
uuauuuucagcuaggaaagcca

SEQ ID NO: 733370 - RNA, 22 nt, Human
caacauaugauuuuguauauaa

SEQ ID NO: 733371 - RNA, 22 nt, Human
guggcugcagcggcuguggaga

SEQ ID NO: 733372 - RNA, 22 nt, Human
cagcuguucggggcuggcaugu

SEQ ID NO: 733373 - RNA, 22 nt, Human
uuaaguacaggguuagugacgg

SEQ ID NO: 733374 - RNA, 22 nt, Human
ccuggagcacagcccaguccca

SEQ ID NO: 733375 - RNA, 22 nt, Human
gucugcuguggguccccaggag

SEQ ID NO: 733376 - RNA, 22 nt, Human
agaggccagcuagcgggccauc

SEQ ID NO: 733377 - RNA, 22 nt, Human
uuuuuccuuagggguuacucac

SEQ ID NO: 733378 - RNA, 23 nt, Human
cucugggcgggcaggucagccuc

SEQ ID NO: 733379 - RNA, 22 nt, Human
acucugcuugggccauaucugg

SEQ ID NO: 733380 - RNA, 22 nt, Human
agaaaugucaggaaagaagucc

SEQ ID NO: 733381 - RNA, 22 nt, Human
ugggacuucaaugcaaugaggu

SEQ ID NO: 733382 - RNA, 20 nt, Human
agcuggcccacagguguggg

SEQ ID NO: 733383 - RNA, 22 nt, Human
aaaugucuguaugagaaagaga

SEQ ID NO: 733384 - RNA, 22 nt, Human
ugcugggcuaggguggagcucu

SEQ ID NO: 733385 - RNA, 22 nt, Human
cuguggaguccuggggaaugga

SEQ ID NO: 733386 - RNA, 22 nt, Human
ugcugggcauuuaugcagaugg

SEQ ID NO: 733387 - RNA, 22 nt, Human
aggcuguguucugcccucuccc

SEQ ID NO: 733388 - RNA, 22 nt, Human
gaaacagugagaacuuuuccug

SEQ ID NO: 733389 - RNA, 18 nt, Human
gguggcuggggacggaca

SEQ ID NO: 733390 - RNA, 22 nt, Human
auuuucucacaaugcagaagga

SEQ ID NO: 733391 - RNA, 22 nt, Human
accacagaggaauuugaagagg

SEQ ID NO: 733392 - RNA, 22 nt, Human
uggugaucagucaacugucuuc

SEQ ID NO: 733393 - RNA, 22 nt, Human
acuaagaugcaggaaaugcuag

SEQ ID NO: 733394 - RNA, 22 nt, Human
ucccaggacuuccaguuggagg

SEQ ID NO: 733395 - RNA, 21 nt, Human
ucccugaguucucugagcauc

SEQ ID NO: 733396 - RNA, 22 nt, Human
uuugugaauagguuggcuucca

SEQ ID NO: 733397 - RNA, 22 nt, Human
uuuaaugugacaucuuuuagag

SEQ ID NO: 733398 - RNA, 22 nt, Human
ccucugggccagccuggacccu

SEQ ID NO: 733399 - RNA, 22 nt, Human
ggucugaguagagggcuggcga

SEQ ID NO: 733400 - RNA, 22 nt, Human
uaaagugcagacucccggaaac

SEQ ID NO: 733401 - RNA, 22 nt, Human
aaaauaugacugugcuccuuaa

SEQ ID NO: 733402 - RNA, 22 nt, Human
gccagcugacaccuugauuuug

SEQ ID NO: 733403 - RNA, 23 nt, Human
aaacuguugcuucaauguauccu

SEQ ID NO: 733404 - RNA, 22 nt, Human
cuggcugugcugcaggcuuugg

SEQ ID NO: 733405 - RNA, 22 nt, Human
uuucauaauauccagagauuuu

SEQ ID NO: 733406 - RNA, 22 nt, Human
uauucagugacaggguauuaug

SEQ ID NO: 733407 - RNA, 22 nt, Human
ugggcucagucugcuugguccu

SEQ ID NO: 733408 - RNA, 22 nt, Human
gauccccaggacuagggggugg

SEQ ID NO: 733409 - RNA, 22 nt, Human
ugcugcuucaccuguuguacag

SEQ ID NO: 733410 - RNA, 23 nt, Human
gacagagugagaccuugucuuac

SEQ ID NO: 733411 - RNA, 21 nt, Human
augggccagggauacagagag

SEQ ID NO: 733412 - RNA, 22 nt, Human
ccugugggcgcagcuggaguca

SEQ ID NO: 733413 - RNA, 22 nt, Human
ccugccagauccccugagcuga

SEQ ID NO: 733414 - RNA, 22 nt, Human
agagcuguauccccuuaccagu

SEQ ID NO: 733415 - RNA, 22 nt, Human
ugccuggcaccccagucugcac

SEQ ID NO: 733416 - RNA, 22 nt, Human
agugcacagcgugauguauugg

SEQ ID NO: 733417 - RNA, 22 nt, Human
auaacuugauguuauuugucca

SEQ ID NO: 733418 - RNA, 22 nt, Human
gcaaggcugagcacauuugcau

SEQ ID NO: 733419 - RNA, 22 nt, Human
acuggggagagucaugccagca

SEQ ID NO: 733420 - RNA, 22 nt, Human
aaugugagccaaugcccguggg

SEQ ID NO: 733421 - RNA, 22 nt, Human
ucagaugagugcuuucagcugc

SEQ ID NO: 733422 - RNA, 22 nt, Human
ugggggagagaggcauucuuuc

SEQ ID NO: 733423 - RNA, 22 nt, Human
ugcauugagauuuuaaaauuca

SEQ ID NO: 733424 - RNA, 22 nt, Human
guuccgcuucauauuuggaguc

SEQ ID NO: 733425 - RNA, 22 nt, Human
uaggaauugaaaaguggucuga

SEQ ID NO: 733426 - RNA, 22 nt, Human
gcugccugcaguguuuucccag

SEQ ID NO: 733427 - RNA, 22 nt, Human
auucuacaggacuggcaauccc

SEQ ID NO: 733428 - RNA, 19 nt, Human
uccuuccccccagcacaga

SEQ ID NO: 733429 - RNA, 22 nt, Human
ucccagccuuucuuucuccagc

SEQ ID NO: 733430 - RNA, 22 nt, Human
ugggagcaggcugaugauaggu

SEQ ID NO: 733431 - RNA, 22 nt, Human
ugcaggugcuccgggggugccc

SEQ ID NO: 733432 - RNA, 22 nt, Human
cuucaaggccuuccagguugaa

SEQ ID NO: 733433 - RNA, 22 nt, Human
ugcagggaaagggcacugggcu

SEQ ID NO: 733434 - RNA, 22 nt, Human
ggagggagggcuagaccaaaga

SEQ ID NO: 733435 - RNA, 18 nt, Human
ggcugcucgcucuccccg

SEQ ID NO: 733436 - RNA, 22 nt, Human
auuauuguugcggcuguuaccg

SEQ ID NO: 733437 - RNA, 22 nt, Human
auugaaaucccuaccucagagg

SEQ ID NO: 733438 - RNA, 22 nt, Human
cugugagauaugcauaugcucu

SEQ ID NO: 733439 - RNA, 22 nt, Human
gugauaagacaguaggcacaag

SEQ ID NO: 733440 - RNA, 22 nt, Human
uccugcagaccucagucagguc

SEQ ID NO: 733441 - RNA, 22 nt, Human
aaggcagccucugccagccggg

SEQ ID NO: 733442 - RNA, 22 nt, Human
aagcacagaaaaggagcaugga

SEQ ID NO: 733443 - RNA, 22 nt, Human
agucagaagggcccuuccuucc

SEQ ID NO: 733444 - RNA, 22 nt, Human
gaugcuuaagauguugguggca

SEQ ID NO: 733445 - RNA, 18 nt, Human
auacaagcagcagagauu

SEQ ID NO: 733446 - RNA, 22 nt, Human
uauugcuucagcuuccugggcu

SEQ ID NO: 733447 - RNA, 22 nt, Human
agagaagggggaaagaucucac

SEQ ID NO: 733448 - RNA, 22 nt, Human
aagcacaggagacgcacagcca

SEQ ID NO: 733449 - RNA, 22 nt, Human
cagcuggcuuguuuguucuuga

SEQ ID NO: 733450 - RNA, 22 nt, Human
agaccuggguucgaguccuaac

SEQ ID NO: 733451 - RNA, 22 nt, Human
agauuuacaaaggauuugcuuu

SEQ ID NO: 733452 - RNA, 22 nt, Human
gccacagcuuuuaaccucgggg

SEQ ID NO: 733453 - RNA, 22 nt, Human
agguaagguuuggaggcagugg

SEQ ID NO: 733454 - RNA, 22 nt, Human
guugaaaauacagauuccuagg

SEQ ID NO: 733455 - RNA, 22 nt, Human
gccuguuggugacuuucuguug

SEQ ID NO: 733456 - RNA, 22 nt, Human
ggggaguguuuucaugggcuug

SEQ ID NO: 733457 - RNA, 22 nt, Human
aaaucaguuaagaugaggccau

SEQ ID NO: 733458 - RNA, 22 nt, Human
aucagaagcaggaggaaugaag

SEQ ID NO: 733459 - RNA, 22 nt, Human
cuggagcuuauugggagcagaa

SEQ ID NO: 733460 - RNA, 22 nt, Human
cuuauuuaugucugucucuaau

SEQ ID NO: 733461 - RNA, 18 nt, Human
uccagcucacagaugggc

SEQ ID NO: 733462 - RNA, 22 nt, Human
aagcacuuuagugagaauaagg

SEQ ID NO: 733463 - RNA, 22 nt, Human
caugcaaaugguggcuaaaugg

SEQ ID NO: 733464 - RNA, 22 nt, Human
aguggcuguucauuuuacacaa

SEQ ID NO: 733465 - RNA, 22 nt, Human
uggagccaaggccaguucucag

SEQ ID NO: 733466 - RNA, 22 nt, Human
aaauguuccauuauuguguaau

SEQ ID NO: 733467 - RNA, 22 nt, Human
aauggcuuuggcaggaauuuca

SEQ ID NO: 733468 - RNA, 22 nt, Human
auggaauuugcaauaacaggau

SEQ ID NO: 733469 - RNA, 21 nt, Human
uguguguaugcacacacaugc

SEQ ID NO: 733470 - RNA, 22 nt, Human
uggcaagggauuguggagaacu

SEQ ID NO: 733471 - RNA, 22 nt, Human
ucucugagcuggauuuguucuu

SEQ ID NO: 733472 - RNA, 22 nt, Human
gugggccucuugaggguggcua

SEQ ID NO: 733473 - RNA, 22 nt, Human
caacauuugugaugagcaaacu

SEQ ID NO: 733474 - RNA, 22 nt, Human
agagugagggggcacugagacg

SEQ ID NO: 733475 - RNA, 22 nt, Human
uacacaugaucauuuaguagca

SEQ ID NO: 733476 - RNA, 22 nt, Human
aucaguuugauaauaaggcuug

SEQ ID NO: 733477 - RNA, 22 nt, Human
ucacaagauacaguuagaagca

SEQ ID NO: 733478 - RNA, 22 nt, Human
gugaacucugacucucaugccu

SEQ ID NO: 733479 - RNA, 22 nt, Human
agagcugccgagcuggggccau

SEQ ID NO: 733480 - RNA, 22 nt, Human
uacaggauaucacuucauuucu

SEQ ID NO: 733481 - RNA, 22 nt, Human
ugauuacacuauuugggaauag

SEQ ID NO: 733482 - RNA, 22 nt, Human
ugugagugaaugggucugaagu

SEQ ID NO: 733483 - RNA, 22 nt, Human
gagaggauccacaaaccaggaa

SEQ ID NO: 733484 - RNA, 22 nt, Human
ucuggauggucagcucuuccug

SEQ ID NO: 733485 - RNA, 22 nt, Human
gcugaggccccagggugauggg

SEQ ID NO: 733486 - RNA, 22 nt, Human
uuaauugauauaaagaacuuca

SEQ ID NO: 733487 - RNA, 22 nt, Human
cuggcccucgucaguuucacug

SEQ ID NO: 733488 - RNA, 22 nt, Human
aggcucugaucagguggcugug

SEQ ID NO: 733489 - RNA, 22 nt, Human
gaaagaagcuuuagauggcuau

SEQ ID NO: 733490 - RNA, 22 nt, Human
augcuuuuuaaacuuaauugga

SEQ ID NO: 733491 - RNA, 22 nt, Human
agaagccaaucagcucucugcu

SEQ ID NO: 733492 - RNA, 22 nt, Human
ggcuucugccacgagagggaag

SEQ ID NO: 733493 - RNA, 22 nt, Human
uuuaaggcagugaaacuauucu

SEQ ID NO: 733494 - RNA, 18 nt, Human
gcucagguauagacaggg

SEQ ID NO: 733495 - RNA, 18 nt, Human
uagcaaagauguggauug

SEQ ID NO: 733496 - RNA, 19 nt, Human
agacagagacugaaauaga

SEQ ID NO: 733497 - RNA, 22 nt, Human
ggccagagagcagccaggauuc

SEQ ID NO: 733498 - RNA, 22 nt, Human
aacagcagaaacugcaagcuac

SEQ ID NO: 733499 - RNA, 22 nt, Human
gaggcugaguagcuuugugcuc

SEQ ID NO: 733500 - RNA, 22 nt, Human
aaugaacuccgaacauuuacau

SEQ ID NO: 733501 - RNA, 22 nt, Human
uuauaugauugaagugcauaag

SEQ ID NO: 733502 - RNA, 22 nt, Human
ugucaaccagguauuuuggucu

SEQ ID NO: 733503 - RNA, 22 nt, Human
cugccuguuuccucuugcuccc

SEQ ID NO: 733504 - RNA, 21 nt, Human
acacuucaguuuuuaaaggga

SEQ ID NO: 733505 - RNA, 22 nt, Human
cuggccucacagaggcuaagcc

SEQ ID NO: 733506 - RNA, 22 nt, Human
cuaaggaagugacagugggauu

SEQ ID NO: 733507 - RNA, 22 nt, Human
auggcuuucuguguuuccguag

SEQ ID NO: 733508 - RNA, 22 nt, Human
cagcgcugugggaacagggcua

SEQ ID NO: 733509 - RNA, 15 nt, Human
uguuuaagccacauu

SEQ ID NO: 733510 - RNA, 22 nt, Human
acuaaaguguuggagaaugagg

SEQ ID NO: 733511 - RNA, 21 nt, Human
caucuuaauugaaagcagaga

SEQ ID NO: 733512 - RNA, 22 nt, Human
cucauggagggagugcucuucc

SEQ ID NO: 733513 - RNA, 20 nt, Human
aaagucccuuagugggagca

SEQ ID NO: 733514 - RNA, 22 nt, Human
gacagucugggcacacaugaaa

SEQ ID NO: 733515 - RNA, 21 nt, Human
ggacuuggaugguggcaguag

SEQ ID NO: 733516 - RNA, 22 nt, Human
ugcagaaggaggaggaaaucca

SEQ ID NO: 733517 - RNA, 22 nt, Human
agcaguccuucuuuagagagcc

SEQ ID NO: 733518 - RNA, 22 nt, Human
aggcuggccagugcugcagugg

SEQ ID NO: 733519 - RNA, 22 nt, Human
aaggcacauuccugaaaacaau

SEQ ID NO: 733520 - RNA, 22 nt, Human
gccuuuuuuguugcucugucac

SEQ ID NO: 733521 - RNA, 22 nt, Human
ucuguauugagaaagccggaca

SEQ ID NO: 733522 - RNA, 22 nt, Human
acaggcaggagcuccccauucc

SEQ ID NO: 733523 - RNA, 19 nt, Human
uuucccagcccuugcugug

SEQ ID NO: 733524 - RNA, 20 nt, Human
aggaggaaaaaaugacgagc

SEQ ID NO: 733525 - RNA, 22 nt, Human
uucuggaaagaaggcuaagguc

SEQ ID NO: 733526 - RNA, 22 nt, Human
uaaucacugggcguuugguacu

SEQ ID NO: 733527 - RNA, 22 nt, Human
ucacaugaaaugcuguaaagaa

SEQ ID NO: 733528 - RNA, 22 nt, Human
gccauuaaugagaucaagaauc

SEQ ID NO: 733529 - RNA, 22 nt, Human
uggugggacaucugaggagagg

SEQ ID NO: 733530 - RNA, 20 nt, Human
gucagugucuucaguaguga

SEQ ID NO: 733531 - RNA, 22 nt, Human
ugacacugccgaaacuguagag

SEQ ID NO: 733532 - RNA, 22 nt, Human
uccacuguggucccuugcugcc

SEQ ID NO: 733533 - RNA, 22 nt, Human
gccuggagggcucuagagaggc

SEQ ID NO: 733534 - RNA, 22 nt, Human
gaggcuggggucugccuuucug

SEQ ID NO: 733535 - RNA, 22 nt, Human
guggccuggauagacuccaucu

SEQ ID NO: 733536 - RNA, 22 nt, Human
guggcugagcagcagagagcug

SEQ ID NO: 733537 - RNA, 22 nt, Human
gauucaagaccuagcucagcca

SEQ ID NO: 733538 - RNA, 22 nt, Human
aucaggugaugcucugguuccc

SEQ ID NO: 733539 - RNA, 22 nt, Human
ccucacugucaucaguaguuau

SEQ ID NO: 733540 - RNA, 22 nt, Human
ugcauuuguucagugaaauguu

SEQ ID NO: 733541 - RNA, 22 nt, Human
caauguacuacaaagauuguca

SEQ ID NO: 733542 - RNA, 22 nt, Human
uagauucuguaaauaaucaagg

SEQ ID NO: 733543 - RNA, 19 nt, Human
uguggccaugguucagcug

SEQ ID NO: 733544 - RNA, 22 nt, Human
cccuguggaggaggagagcagu

SEQ ID NO: 733545 - RNA, 20 nt, Human
guguuucaugugauacaaug

SEQ ID NO: 733546 - RNA, 20 nt, Human
ggcauuagauuuuaaauguc

SEQ ID NO: 733547 - RNA, 22 nt, Human
gaaauguagaguaucugaggau

SEQ ID NO: 733548 - RNA, 22 nt, Human
uuaauaacauuguguaucaccc

SEQ ID NO: 733549 - RNA, 22 nt, Human
gcagccucugaugauggccgua

SEQ ID NO: 733550 - RNA, 22 nt, Human
cagacacuuauugagcaaguac

SEQ ID NO: 733551 - RNA, 22 nt, Human
uacaagugcuagcagauauugu

SEQ ID NO: 733552 - RNA, 22 nt, Human
agggcccacaguuccuauggcc

SEQ ID NO: 733553 - RNA, 22 nt, Human
gcccaggaaauaaaagugggcu

SEQ ID NO: 733554 - RNA, 22 nt, Human
ggagcacccugcucagccaagc

SEQ ID NO: 733555 - RNA, 19 nt, Human
cagugcccgacgcaggucu

SEQ ID NO: 733556 - RNA, 22 nt, Human
aacuugaaguugcagaaaguac

SEQ ID NO: 733557 - RNA, 22 nt, Human
uuauuauuccccaagucauuau

SEQ ID NO: 733558 - RNA, 22 nt, Human
ucuccuccuuuuuucaacauag

SEQ ID NO: 733559 - RNA, 20 nt, Human
caccagcagcagcugccacc

SEQ ID NO: 733560 - RNA, 23 nt, Human
cacaaagguuccauucucucacc

SEQ ID NO: 733561 - RNA, 22 nt, Human
ugggccacucuucccugggucu

SEQ ID NO: 733562 - RNA, 22 nt, Human
ucacugcucugaaaguacaggg

SEQ ID NO: 733563 - RNA, 22 nt, Human
gcacauacugcaaagauuacua

SEQ ID NO: 733564 - RNA, 22 nt, Human
cauucugugauucuaaaucccu

SEQ ID NO: 733565 - RNA, 22 nt, Human
ggucugaauauagaacuuaagu

SEQ ID NO: 733566 - RNA, 22 nt, Human
cagggcugaggacacaaguaaa

SEQ ID NO: 733567 - RNA, 22 nt, Human
agacauagggaggcauauaaau

SEQ ID NO: 733568 - RNA, 22 nt, Human
accagcacuuccagaggucagg

SEQ ID NO: 733569 - RNA, 22 nt, Human
caaaaguaaucguggcuuuugc

SEQ ID NO: 733570 - RNA, 20 nt, Human
gucuacacgggcaguguaga

SEQ ID NO: 733571 - RNA, 20 nt, Human
cagagaccugucuucacaga

SEQ ID NO: 733572 - RNA, 20 nt, Human
acagucagggaauagaaaaa

SEQ ID NO: 733573 - RNA, 22 nt, Human
gccaggaauggagagguggccu

SEQ ID NO: 733574 - RNA, 22 nt, Human
uccuuaaaugugaucuagauuu

SEQ ID NO: 733575 - RNA, 22 nt, Human
cugugcaagcccaagauaaaac

SEQ ID NO: 733576 - RNA, 22 nt, Human
uagaaacugauagucuugugcu

SEQ ID NO: 733577 - RNA, 22 nt, Human
gcugggcucuuaucaccuguac

SEQ ID NO: 733578 - RNA, 22 nt, Human
cugcccccaggcugcauggcug

SEQ ID NO: 733579 - RNA, 22 nt, Human
ugaaggccagcucuuuaucagc

SEQ ID NO: 733580 - RNA, 22 nt, Human
ccuggucagagcagucaggauc

SEQ ID NO: 733581 - RNA, 18 nt, Human
gggcucacacaggucauc

SEQ ID NO: 733582 - RNA, 23 nt, Human
cagaggcaucggauucaacauca

SEQ ID NO: 733583 - RNA, 22 nt, Human
agcaaacuaauugcaguucugg

SEQ ID NO: 733584 - RNA, 22 nt, Human
agcgauucacacacugggcugu

SEQ ID NO: 733585 - RNA, 22 nt, Human
aucaguuucugugaagaacaca

SEQ ID NO: 733586 - RNA, 22 nt, Human
gggagccacaguuuauagugau

SEQ ID NO: 733587 - RNA, 22 nt, Human
gaggggcucuuuaauaguaaca

SEQ ID NO: 733588 - RNA, 22 nt, Human
gcuucugugagugcagaugcug

SEQ ID NO: 733589 - RNA, 22 nt, Human
cagugcuuuuuuaccuuccaac

SEQ ID NO: 733590 - RNA, 17 nt, Human
uggcucugaggcugaau

SEQ ID NO: 733591 - RNA, 22 nt, Human
cauaacaguggcuucagcaagu

SEQ ID NO: 733592 - RNA, 22 nt, Human
guggggguuucauuaagacaau

SEQ ID NO: 733593 - RNA, 21 nt, Human
uccaggggccagcacccaagc

SEQ ID NO: 733594 - RNA, 22 nt, Human
aaguucaaguguaaucuuuauu

SEQ ID NO: 733595 - RNA, 22 nt, Human
caggcaggucagugaagaagga

SEQ ID NO: 733596 - RNA, 22 nt, Human
cagcaugaaacaauugagccca

SEQ ID NO: 733597 - RNA, 22 nt, Human
augcauauugucauuuaguccu

SEQ ID NO: 733598 - RNA, 22 nt, Human
augucuuucucauacaagccca

SEQ ID NO: 733599 - RNA, 22 nt, Human
uucaccccaaauucccagugga

SEQ ID NO: 733600 - RNA, 22 nt, Human
accuucaaguaugugggcugaa

SEQ ID NO: 733601 - RNA, 22 nt, Human
ugugccugucccgcauucuggu

SEQ ID NO: 733602 - RNA, 21 nt, Human
agaagccauuuguuaggacuu

SEQ ID NO: 733603 - RNA, 22 nt, Human
ucaacauacauacauggucagg

SEQ ID NO: 733604 - RNA, 20 nt, Human
ucuccuggugacaguaccca

SEQ ID NO: 733605 - RNA, 22 nt, Human
uggcccagggaguucauggugu

SEQ ID NO: 733606 - RNA, 22 nt, Human
agugcuuaaaacccugcacuag

SEQ ID NO: 733607 - RNA, 22 nt, Human
cucaguuucugacauuaaaauc

SEQ ID NO: 733608 - RNA, 22 nt, Human
aguccagaucaugcagcaaacc

SEQ ID NO: 733609 - RNA, 22 nt, Human
cucuggcuuugcucaugcaucc

SEQ ID NO: 733610 - RNA, 22 nt, Human
ugcagggcacggugcgcguggg

SEQ ID NO: 733611 - RNA, 22 nt, Human
acaguccuaagauaauugucuc

SEQ ID NO: 733612 - RNA, 22 nt, Human
guccaaguacauguguguacau

SEQ ID NO: 733613 - RNA, 22 nt, Human
uggugggaguccgcugugcugc

SEQ ID NO: 733614 - RNA, 22 nt, Human
gugcagacccacguccagggcc

SEQ ID NO: 733615 - RNA, 22 nt, Human
uuugcuauugugaauagugcca

SEQ ID NO: 733616 - RNA, 22 nt, Human
agccagggugggugaaugcuau

SEQ ID NO: 733617 - RNA, 22 nt, Human
gcacaggcaucaggcuuuuucu

SEQ ID NO: 733618 - RNA, 19 nt, Human
aaugccucaaauugggaga

SEQ ID NO: 733619 - RNA, 22 nt, Human
acaaaaagcuccauuacugucc

SEQ ID NO: 733620 - RNA, 22 nt, Human
gcuuuacaacaaauugaauaug

SEQ ID NO: 733621 - RNA, 22 nt, Human
ugggugaggaugaugaggcagc

SEQ ID NO: 733622 - RNA, 22 nt, Human
uguggcucucaugcacucccag

SEQ ID NO: 733623 - RNA, 22 nt, Human
ggguggaggagaacaggcccca

SEQ ID NO: 733624 - RNA, 22 nt, Human
cacuugaagugaauugcucacc

SEQ ID NO: 733625 - RNA, 22 nt, Human
gcagaggacucaaucaagguau

SEQ ID NO: 733626 - RNA, 22 nt, Human
gauaaagcaaggaugacugaag

SEQ ID NO: 733627 - RNA, 22 nt, Human
ggagagauggaaaaccucccag

SEQ ID NO: 733628 - RNA, 22 nt, Human
cuuguacaucacuggcagaugg

SEQ ID NO: 733629 - RNA, 22 nt, Human
ggacacaaaagugaauaaaaua

SEQ ID NO: 733630 - RNA, 22 nt, Human
ucuggagaacuugcaagaggau

SEQ ID NO: 733631 - RNA, 22 nt, Human
augaaaugcugagaggugcuuc

SEQ ID NO: 733632 - RNA, 22 nt, Human
ugcuuuaguucaacaugccaaa

SEQ ID NO: 733633 - RNA, 22 nt, Human
ucugauaggugguagaaggagg

SEQ ID NO: 733634 - RNA, 22 nt, Human
aacagaaucuuggguucuuuuc

SEQ ID NO: 733635 - RNA, 22 nt, Human
augaacaucucugauccaagca

SEQ ID NO: 733636 - RNA, 22 nt, Human
ucaguguuuguggcaaauguua

SEQ ID NO: 733637 - RNA, 19 nt, Human
guggccucggagcgcgcgg

SEQ ID NO: 733638 - RNA, 22 nt, Human
uucuuuucggccugugagaagg

SEQ ID NO: 733639 - RNA, 22 nt, Human
guagaaaauuaggaugaggcuu

SEQ ID NO: 733640 - RNA, 22 nt, Human
aagccagaguuuuugagaacuu

SEQ ID NO: 733641 - RNA, 22 nt, Human
uaggaaggaggccaucuuggcg

SEQ ID NO: 733642 - RNA, 22 nt, Human
ggacaguugguugggcucuugu

SEQ ID NO: 733643 - RNA, 22 nt, Human
cagcuauugguccacagguaug

SEQ ID NO: 733644 - RNA, 22 nt, Human
uguaacauauagcauguucuug

SEQ ID NO: 733645 - RNA, 21 nt, Human
gggacaccaacuccagggcuu

SEQ ID NO: 733646 - RNA, 22 nt, Human
uuuccucacucaugucaucagu

SEQ ID NO: 733647 - RNA, 22 nt, Human
acaaaguguuuucugaaggccu

SEQ ID NO: 733648 - RNA, 22 nt, Human
ugugcuauuuuugcauaugugu

SEQ ID NO: 733649 - RNA, 22 nt, Human
uaaaauagaggaugucaugcua

SEQ ID NO: 733650 - RNA, 22 nt, Human
auguggcuugucgauauuagca

SEQ ID NO: 733651 - RNA, 22 nt, Human
gucugagggucaugggucucac

SEQ ID NO: 733652 - RNA, 19 nt, Human
ucuuuguacaagucucugc

SEQ ID NO: 733653 - RNA, 22 nt, Human
gacagaggcaagaccagaagcc

SEQ ID NO: 733654 - RNA, 22 nt, Human
uucaacuuuaugcauauguauu

SEQ ID NO: 733655 - RNA, 22 nt, Human
agcagccaaccuuacauucauc

SEQ ID NO: 733656 - RNA, 22 nt, Human
gugaagaugccucaggugaccc

SEQ ID NO: 733657 - RNA, 22 nt, Human
ucauaaauugauuaugugcuuu

SEQ ID NO: 733658 - RNA, 22 nt, Human
auagacauauggcuuuguuucu

SEQ ID NO: 733659 - RNA, 22 nt, Human
uagacauuucugguuauugaca

SEQ ID NO: 733660 - RNA, 18 nt, Human
guucaucuuuuucuaaag

SEQ ID NO: 733661 - RNA, 22 nt, Human
agcugugugaccuagggcaagc

SEQ ID NO: 733662 - RNA, 22 nt, Human
acuuucuuaggcuguauaaaug

SEQ ID NO: 733663 - RNA, 22 nt, Human
gagauguuuugcugagaauggg

SEQ ID NO: 733664 - RNA, 22 nt, Human
aaugucaaaggcuauacauuca

SEQ ID NO: 733665 - RNA, 22 nt, Human
gaggcuucuguaacccuguccu

SEQ ID NO: 733666 - RNA, 22 nt, Human
gugagcaguuguauaaagacuu

SEQ ID NO: 733667 - RNA, 21 nt, Human
uguguuuuaaugauauucugu

SEQ ID NO: 733668 - RNA, 22 nt, Human
ucucagagggaaaggccaauuu

SEQ ID NO: 733669 - RNA, 22 nt, Human
uuuaacuggucuccugcugcuu

SEQ ID NO: 733670 - RNA, 22 nt, Human
aacaucucuguauuuuauagac

SEQ ID NO: 733671 - RNA, 22 nt, Human
aucuuccuuugccaugggauag

SEQ ID NO: 733672 - RNA, 22 nt, Human
acauucucauuuggugaucauu

SEQ ID NO: 733673 - RNA, 21 nt, Human
ggcugcucaccuaggucccaa

SEQ ID NO: 733674 - RNA, 22 nt, Human
ugggcagguuguuauuugacau

SEQ ID NO: 733675 - RNA, 22 nt, Human
agagugucugguagcugcucug

SEQ ID NO: 733676 - RNA, 22 nt, Human
aucaugacagagucugccaucc

SEQ ID NO: 733677 - RNA, 22 nt, Human
aaagcuguuaaaugcauaaugc

SEQ ID NO: 733678 - RNA, 22 nt, Human
gccuucccaagacgccugaguu

SEQ ID NO: 733679 - RNA, 22 nt, Human
uugcucaggcuuagagcuacua

SEQ ID NO: 733680 - RNA, 22 nt, Human
ggcuuccuaucccaucugagug

SEQ ID NO: 733681 - RNA, 21 nt, Human
agaugcagugacccacugggg

SEQ ID NO: 733682 - RNA, 22 nt, Human
agcagccauagauagcaugcaa

SEQ ID NO: 733683 - RNA, 22 nt, Human
agaaauguugaauacaucagga

SEQ ID NO: 733684 - RNA, 22 nt, Human
gaaaugucuuugacaagagagg

SEQ ID NO: 733685 - RNA, 22 nt, Human
agacccugucaguguuaggaaa

SEQ ID NO: 733686 - RNA, 22 nt, Human
ucacagcaacacuggggcagac

SEQ ID NO: 733687 - RNA, 22 nt, Human
gugggcugcuuccuccuuccac

SEQ ID NO: 733688 - RNA, 22 nt, Human
accuccugaugagaguaaagga

SEQ ID NO: 733689 - RNA, 22 nt, Human
ggaggggaacuaaucccgugac

SEQ ID NO: 733690 - RNA, 22 nt, Human
uaaagcauguuucaguaagguu

SEQ ID NO: 733691 - RNA, 22 nt, Human
agcaucagagagaaguuaacua

SEQ ID NO: 733692 - RNA, 22 nt, Human
uuccaaguguugagauuagagg

SEQ ID NO: 733693 - RNA, 22 nt, Human
cagaguaucccuuuagaauuaa

SEQ ID NO: 733694 - RNA, 22 nt, Human
uucugggacaucuggacaguuu

SEQ ID NO: 733695 - RNA, 22 nt, Human
cucagcaccccgacaggacauu

SEQ ID NO: 733696 - RNA, 22 nt, Human
uggacagcaaacauggagagaa

SEQ ID NO: 733697 - RNA, 22 nt, Human
acagcugugggcucugcauaua

SEQ ID NO: 733698 - RNA, 22 nt, Human
ucauuuguugcuguuaccugag

SEQ ID NO: 733699 - RNA, 19 nt, Human
uacuuuuucaggacagagu

SEQ ID NO: 733700 - RNA, 22 nt, Human
gucauauugaagaagacuggca

SEQ ID NO: 733701 - RNA, 22 nt, Human
uauauauaugcacacacaccua

SEQ ID NO: 733702 - RNA, 22 nt, Human
ugaaauuagugaaguuacaguu

SEQ ID NO: 733703 - RNA, 21 nt, Human
auuucagagcacacaaguaaa

SEQ ID NO: 733704 - RNA, 22 nt, Human
acauagaacuucccagugagca

SEQ ID NO: 733705 - RNA, 22 nt, Human
cagcccuggaacagcugacuca

SEQ ID NO: 733706 - RNA, 23 nt, Human
gagaacagccacagagagcugug

SEQ ID NO: 733707 - RNA, 21 nt, Human
gcucaggcucagguucagguu

SEQ ID NO: 733708 - RNA, 21 nt, Human
uagcuuccagcucaagcugag

SEQ ID NO: 733709 - RNA, 22 nt, Human
agugaggggcagcugagugggc

SEQ ID NO: 733710 - RNA, 22 nt, Human
gccucugcccauccaccaucag

SEQ ID NO: 733711 - RNA, 22 nt, Human
augcuuccucccuuccacucaa

SEQ ID NO: 733712 - RNA, 22 nt, Human
cagcaggaggcauggcuucccu

SEQ ID NO: 733713 - RNA, 22 nt, Human
caaccugaugugcaugccacgg

SEQ ID NO: 733714 - RNA, 22 nt, Human
gaaacagccccugugugaagca

SEQ ID NO: 733715 - RNA, 22 nt, Human
augaaaauacugugguugauag

SEQ ID NO: 733716 - RNA, 22 nt, Human
ucuuagaaguuuauggcacgga

SEQ ID NO: 733717 - RNA, 22 nt, Human
aaaaggcauggagguugauagu

SEQ ID NO: 733718 - RNA, 22 nt, Human
ccaagcuucuuuccuacuacag

SEQ ID NO: 733719 - RNA, 22 nt, Human
agcaagauuuuucagguuagua

SEQ ID NO: 733720 - RNA, 22 nt, Human
ugagagggcccagagcacacca

SEQ ID NO: 733721 - RNA, 22 nt, Human
accagcaggccaggggcacugc

SEQ ID NO: 733722 - RNA, 20 nt, Human
gggagucuggaugaaagaug

SEQ ID NO: 733723 - RNA, 22 nt, Human
acaguguucugaaaguugaggg

SEQ ID NO: 733724 - RNA, 22 nt, Human
cuguuuaugaagcugugguuua

SEQ ID NO: 733725 - RNA, 22 nt, Human
aggcagggucuugcuauguugc

SEQ ID NO: 733726 - RNA, 22 nt, Human
guggccaagaaaauagaugcau

SEQ ID NO: 733727 - RNA, 22 nt, Human
uuugugaacuuaggcaauuagg

SEQ ID NO: 733728 - RNA, 22 nt, Human
augcaaauugccauaaaguggg

SEQ ID NO: 733729 - RNA, 22 nt, Human
gagagcacggucuugggcaugg

SEQ ID NO: 733730 - RNA, 22 nt, Human
aagaugauguuguguuuucacu

SEQ ID NO: 733731 - RNA, 22 nt, Human
agggcuuugauguccaugagga

SEQ ID NO: 733732 - RNA, 22 nt, Human
augcaaaaguaguugcaguuuu

SEQ ID NO: 733733 - RNA, 22 nt, Human
agugucugccuauuuuucaagc

SEQ ID NO: 733734 - RNA, 20 nt, Human
ggaacaugaaugugaguggc

SEQ ID NO: 733735 - RNA, 22 nt, Human
uuuacccauauuagcaucaagu

SEQ ID NO: 733736 - RNA, 22 nt, Human
cagauucugaagucuagcugcu

SEQ ID NO: 733737 - RNA, 22 nt, Human
ucuaaacuaggguuaaaggaaa

SEQ ID NO: 733738 - RNA, 22 nt, Human
uccagucugguaugaauccuag

SEQ ID NO: 733739 - RNA, 22 nt, Human
uaaucauauggguaauccaaug

SEQ ID NO: 733740 - RNA, 19 nt, Human
uucauucuuucuacuuacc

SEQ ID NO: 733741 - RNA, 19 nt, Human
ugagaaggcaguggggagc

SEQ ID NO: 733742 - RNA, 22 nt, Human
ccugagcuagggaaggaagacc

SEQ ID NO: 733743 - RNA, 22 nt, Human
acauuucagaaucacacagcuu

SEQ ID NO: 733744 - RNA, 22 nt, Human
auauucuucuuguucagacuau

SEQ ID NO: 733745 - RNA, 19 nt, Human
uggcuguggggaaaugcuu

SEQ ID NO: 733746 - RNA, 19 nt, Human
auucucccuagaauuuuga

SEQ ID NO: 733747 - RNA, 21 nt, Human
agaugcaguuugcaggugggu

SEQ ID NO: 733748 - RNA, 22 nt, Human
ucugggaaugaggcuugggcaa

SEQ ID NO: 733749 - RNA, 22 nt, Human
uuauguguguacaugcauaugu

SEQ ID NO: 733750 - RNA, 22 nt, Human
acagaugagguguuuggagagc

SEQ ID NO: 733751 - RNA, 22 nt, Human
ccagcugcuugggaaaaugucu

SEQ ID NO: 733752 - RNA, 21 nt, Human
ugugagaagaguacugagguc

SEQ ID NO: 733753 - RNA, 22 nt, Human
accuccccugacucgaaaccca

SEQ ID NO: 733754 - RNA, 22 nt, Human
acuucccaggugguguggaguu

SEQ ID NO: 733755 - RNA, 22 nt, Human
ugauaaacauuuuaggaacuaa

SEQ ID NO: 733756 - RNA, 22 nt, Human
uagcugcccaucuuuccuuuag

SEQ ID NO: 733757 - RNA, 23 nt, Human
uccuccagaggcccuccuuggcc

SEQ ID NO: 733758 - RNA, 22 nt, Human
cucuggagguggagguugcagu

SEQ ID NO: 733759 - RNA, 22 nt, Human
uuuaccaagauagcaucugguu

SEQ ID NO: 733760 - RNA, 22 nt, Human
uuugaaugagggaaccacaguu

SEQ ID NO: 733761 - RNA, 22 nt, Human
auugacaaucuacuauguucug

SEQ ID NO: 733762 - RNA, 22 nt, Human
agucauauguggcauuuucuaa

SEQ ID NO: 733763 - RNA, 22 nt, Human
uuaauggaugcggcugcgugac

SEQ ID NO: 733764 - RNA, 22 nt, Human
cagaagaaaguggggagacaag

SEQ ID NO: 733765 - RNA, 22 nt, Human
ggagcugcucagagccaguccc

SEQ ID NO: 733766 - RNA, 21 nt, Human
ggcugagauggcagaaucacc

SEQ ID NO: 733767 - RNA, 22 nt, Human
augaagcugaccuugucuugcu

SEQ ID NO: 733768 - RNA, 22 nt, Human
guauucuugguuaucaaaauac

SEQ ID NO: 733769 - RNA, 22 nt, Human
uaugcaacaucugguagaaauc

SEQ ID NO: 733770 - RNA, 22 nt, Human
ccccacaguccgugaggagcca

SEQ ID NO: 733771 - RNA, 21 nt, Human
uccaggccucaggaagggaug

SEQ ID NO: 733772 - RNA, 22 nt, Human
gugccaccuucaaaucacauug

SEQ ID NO: 733773 - RNA, 22 nt, Human
ucucuuaaaagauuuuaaugac

SEQ ID NO: 733774 - RNA, 22 nt, Human
aggaccuguaccucagcaucua

SEQ ID NO: 733775 - RNA, 22 nt, Human
gggcacaugcuuagggaggaaa

SEQ ID NO: 733776 - RNA, 22 nt, Human
ucaucacaauuuuaugacccuc

SEQ ID NO: 733777 - RNA, 22 nt, Human
gcaguguuaaugcgaguguuca

SEQ ID NO: 733778 - RNA, 22 nt, Human
acacuugauaggucaaaucagu

SEQ ID NO: 733779 - RNA, 22 nt, Human
agcaggcugagcacccaggggg

SEQ ID NO: 733780 - RNA, 22 nt, Human
acacaugcacaacaguucuuuc

SEQ ID NO: 733781 - RNA, 17 nt, Human
cuggggaugugggacuc

SEQ ID NO: 733782 - RNA, 22 nt, Human
agccacugcccuuagccauuug

SEQ ID NO: 733783 - RNA, 22 nt, Human
cagugcaauuagaacuuauuua

SEQ ID NO: 733784 - RNA, 22 nt, Human
caaagaccauguggccugaaaa

SEQ ID NO: 733785 - RNA, 22 nt, Human
uggguaaauauccuuugugaaa

SEQ ID NO: 733786 - RNA, 22 nt, Human
acagggcuauauuccucagagu

SEQ ID NO: 733787 - RNA, 21 nt, Human
ucucuacacuuucacuaggcu

SEQ ID NO: 733788 - RNA, 22 nt, Human
aaauauagugacacuuauaguc

SEQ ID NO: 733789 - RNA, 22 nt, Human
uccaggagugauaaggccacug

SEQ ID NO: 733790 - RNA, 22 nt, Human
aguguuucacagcacuuuuucu

SEQ ID NO: 733791 - RNA, 22 nt, Human
uucugcauggagaaacugaguc

SEQ ID NO: 733792 - RNA, 22 nt, Human
auaucauucugauguauaucuu

SEQ ID NO: 733793 - RNA, 22 nt, Human
cuguuacacggaccuucaaauc

SEQ ID NO: 733794 - RNA, 22 nt, Human
cagcauugaucccaggcugugg

SEQ ID NO: 733795 - RNA, 22 nt, Human
guguguguguaaaaauccagag

SEQ ID NO: 733796 - RNA, 22 nt, Human
cacugggaguacaaagaauggg

SEQ ID NO: 733797 - RNA, 22 nt, Human
ggugucccaggccagcugugug

SEQ ID NO: 733798 - RNA, 22 nt, Human
ucuaaugaaagauguaggaacu

SEQ ID NO: 733799 - RNA, 18 nt, Human
acccuuuccaaacugcag

SEQ ID NO: 733800 - RNA, 22 nt, Human
acaggaacagcuugauggcauc

SEQ ID NO: 733801 - RNA, 22 nt, Human
ugacagagagaugggaaagggc

SEQ ID NO: 733802 - RNA, 22 nt, Human
cagccaucccagccugugguuc

SEQ ID NO: 733803 - RNA, 22 nt, Human
uucuguuuauuccuaggagcuc

SEQ ID NO: 733804 - RNA, 22 nt, Human
ucuuuuaucuguuguguaacaa

SEQ ID NO: 733805 - RNA, 22 nt, Human
aggcuauuuccacucuucucau

SEQ ID NO: 733806 - RNA, 21 nt, Human
acaguucaugauaacuccauc

SEQ ID NO: 733807 - RNA, 22 nt, Human
ggugucuaugauucaguuuaug

SEQ ID NO: 733808 - RNA, 22 nt, Human
agaaguuuugggaaauacugau

SEQ ID NO: 733809 - RNA, 22 nt, Human
uuucagagcugagaugccacag

SEQ ID NO: 733810 - RNA, 22 nt, Human
ucuuaaagagcgcaauuugagg

SEQ ID NO: 733811 - RNA, 20 nt, Human
ucccugccuuuuacugcugg

SEQ ID NO: 733812 - RNA, 22 nt, Human
cacccauguuucccucugucuu

SEQ ID NO: 733813 - RNA, 21 nt, Human
cugcuguggcccccgacaugc

SEQ ID NO: 733814 - RNA, 22 nt, Human
gcugcuggggccuucccucggg

SEQ ID NO: 733815 - RNA, 22 nt, Human
uucaaaaguaaucaguauuaga

SEQ ID NO: 733816 - RNA, 22 nt, Human
ucauuuucacacauaaauagca

SEQ ID NO: 733817 - RNA, 22 nt, Human
uagaguauauaggccuuugugu

SEQ ID NO: 733818 - RNA, 18 nt, Human
uauaaccucuguuacuca

SEQ ID NO: 733819 - RNA, 22 nt, Human
gugagguccaguaacuugucca

SEQ ID NO: 733820 - RNA, 20 nt, Human
ggagcugcccugggcuggag

SEQ ID NO: 733821 - RNA, 22 nt, Human
augcaacacauuugaugagcga

SEQ ID NO: 733822 - RNA, 22 nt, Human
gggcuguguuaggugcgguuac

SEQ ID NO: 733823 - RNA, 22 nt, Human
aguuuagacaaagucuugcauu

SEQ ID NO: 733824 - RNA, 22 nt, Human
cuuugccauguugccugcagaa

SEQ ID NO: 733825 - RNA, 22 nt, Human
caaagacacgggaaacaacguu

SEQ ID NO: 733826 - RNA, 22 nt, Human
uuuuagacuuguauguaaagcc

SEQ ID NO: 733827 - RNA, 23 nt, Human
gcccugcugggaccuccugcuac

SEQ ID NO: 733828 - RNA, 22 nt, Human
uuugcauuuauaaguuggugga

SEQ ID NO: 733829 - RNA, 22 nt, Human
gugcuggcugccaggaggcugc

SEQ ID NO: 733830 - RNA, 19 nt, Human
ggcagcaagcucugaaggc

SEQ ID NO: 733831 - RNA, 22 nt, Human
gcuccuucuggcucccuuuugg

SEQ ID NO: 733832 - RNA, 22 nt, Human
ucaccgccuugcccggccgggc

SEQ ID NO: 733833 - RNA, 22 nt, Human
gugggggcagugggcuucgagc

SEQ ID NO: 733834 - RNA, 22 nt, Human
ucacuuauugcucaucucaugc

SEQ ID NO: 733835 - RNA, 22 nt, Human
uacagaauguguaucauuacca

SEQ ID NO: 733836 - RNA, 22 nt, Human
aggacuucaucaccuguauaaa

SEQ ID NO: 733837 - RNA, 22 nt, Human
uucagcaaccagaaaggcuggg

SEQ ID NO: 733838 - RNA, 22 nt, Human
caguuccuaugggcaaaacaca

SEQ ID NO: 733839 - RNA, 19 nt, Human
gcuggggaauggauauuga

SEQ ID NO: 733840 - RNA, 22 nt, Human
aaaaguauuggccaccauuucu

SEQ ID NO: 733841 - RNA, 18 nt, Human
ucuuggaguaaugaucaa

SEQ ID NO: 733842 - RNA, 22 nt, Human
ggcacagcuacuugcucacucu

SEQ ID NO: 733843 - RNA, 22 nt, Human
cuugggggccauuaaggggccu

SEQ ID NO: 733844 - RNA, 22 nt, Human
aguggcuguuuauaggugggua

SEQ ID NO: 733845 - RNA, 22 nt, Human
accacccccuuggguguggaag

SEQ ID NO: 733846 - RNA, 22 nt, Human
gagaagggcuugggagucaaca

SEQ ID NO: 733847 - RNA, 22 nt, Human
ggucccaguugcccaggucagg

SEQ ID NO: 733848 - RNA, 19 nt, Human
ccagcccacagugacuuuc

SEQ ID NO: 733849 - RNA, 22 nt, Human
uggguggcacuucuggggucca

SEQ ID NO: 733850 - RNA, 22 nt, Human
ugccuggcacagagcagguggc

SEQ ID NO: 733851 - RNA, 22 nt, Human
ggcccuuggagccuccacagug

SEQ ID NO: 733852 - RNA, 22 nt, Human
ugggguggaacccuucugcugg

SEQ ID NO: 733853 - RNA, 22 nt, Human
ucagacagagaaguacaaugag

SEQ ID NO: 733854 - RNA, 22 nt, Human
guuacagugcauguggcuucug

SEQ ID NO: 733855 - RNA, 22 nt, Human
cccagaaggucgaggcugcagu

SEQ ID NO: 733856 - RNA, 22 nt, Human
aaugaccagcgccugcagaggg

SEQ ID NO: 733857 - RNA, 22 nt, Human
agaggcagccguauuucaaagg

SEQ ID NO: 733858 - RNA, 22 nt, Human
uguacaugugucuguauaucuu

SEQ ID NO: 733859 - RNA, 22 nt, Human
cccaggaggucgaagcugcagu

SEQ ID NO: 733860 - RNA, 22 nt, Human
aagagagggguugcauggaaau

SEQ ID NO: 733861 - RNA, 22 nt, Human
aggcagagcugauguucuguga

SEQ ID NO: 733862 - RNA, 22 nt, Human
aagcccuggauagagagaacug

SEQ ID NO: 733863 - RNA, 22 nt, Human
agccuucagcaguucaggugcc

SEQ ID NO: 733864 - RNA, 22 nt, Human
guggcagugugaggauccugcu

SEQ ID NO: 733865 - RNA, 15 nt, Human
agucaaaucuguuuu

SEQ ID NO: 733866 - RNA, 22 nt, Human
acaauguuucucuuuagucauu

SEQ ID NO: 733867 - RNA, 22 nt, Human
ucuguccagaacguacaucuug

SEQ ID NO: 733868 - RNA, 22 nt, Human
gcagggcagcuuagucccuguc

SEQ ID NO: 733869 - RNA, 22 nt, Human
aacuguuacauaguuauagauc

SEQ ID NO: 733870 - RNA, 22 nt, Human
augaaauaucuugaagaaauuc

SEQ ID NO: 733871 - RNA, 22 nt, Human
uugugaaauguuucaaaauagu

SEQ ID NO: 733872 - RNA, 20 nt, Human
acuggcacugguaggugugg

SEQ ID NO: 733873 - RNA, 22 nt, Human
augcauugucugguuucauuuu

SEQ ID NO: 733874 - RNA, 22 nt, Human
uugagcuguaaggugggaugug

SEQ ID NO: 733875 - RNA, 22 nt, Human
uaugagugguugaaugguaaac

SEQ ID NO: 733876 - RNA, 22 nt, Human
gcaugcugcaccagagccucuc

SEQ ID NO: 733877 - RNA, 22 nt, Human
aauguucagugccuuuaaacau

SEQ ID NO: 733878 - RNA, 18 nt, Human
gcuggcugcacuucugcu

SEQ ID NO: 733879 - RNA, 22 nt, Human
aaaagcagagacucuggagcua

SEQ ID NO: 733880 - RNA, 22 nt, Human
uagaugaauuagcaauuaucuu

SEQ ID NO: 733881 - RNA, 22 nt, Human
gaggccagaagucugagaucag

SEQ ID NO: 733882 - RNA, 22 nt, Human
ugggugaaaauuuugguggcac

SEQ ID NO: 733883 - RNA, 21 nt, Human
ucaguucucugccugugcuug

SEQ ID NO: 733884 - RNA, 22 nt, Human
gagggugcaggcaagagcaaaa

SEQ ID NO: 733885 - RNA, 21 nt, Human
agugaaauugcaucagaggga

SEQ ID NO: 733886 - RNA, 22 nt, Human
acagcaggauuuggcgauguug

SEQ ID NO: 733887 - RNA, 22 nt, Human
uguaaagagaaugguauaugga

SEQ ID NO: 733888 - RNA, 22 nt, Human
ggcaguguggcauaacauguag

SEQ ID NO: 733889 - RNA, 22 nt, Human
cccugagcuaccuauguaagca

SEQ ID NO: 733890 - RNA, 22 nt, Human
uacuuguuaucaucuuuuccuu

SEQ ID NO: 733891 - RNA, 22 nt, Human
gcagagaggaaugaagccaucc

SEQ ID NO: 733892 - RNA, 22 nt, Human
auucucauuuuuauagaugaga

SEQ ID NO: 733893 - RNA, 22 nt, Human
uuacaauugagucuauuguaug

SEQ ID NO: 733894 - RNA, 22 nt, Human
agacaaaccuuguuuuaugaug

SEQ ID NO: 733895 - RNA, 22 nt, Human
guuauugagguggagucucacu

SEQ ID NO: 733896 - RNA, 22 nt, Human
aggauggggucugcagccuggu

SEQ ID NO: 733897 - RNA, 22 nt, Human
ucuaauugaaucuaagcauguu

SEQ ID NO: 733898 - RNA, 22 nt, Human
gagugacucuagaaaguuucuu

SEQ ID NO: 733899 - RNA, 22 nt, Human
gcuuuaaaccucuacucugucc

SEQ ID NO: 733900 - RNA, 22 nt, Human
cagagccaaaaccguaacagcc

SEQ ID NO: 733901 - RNA, 22 nt, Human
aucagcagugucuaccucggug

SEQ ID NO: 733902 - RNA, 22 nt, Human
uucugggcucacagagcagcag

SEQ ID NO: 733903 - RNA, 22 nt, Human
uucauauuaugauuugaaaugc

SEQ ID NO: 733904 - RNA, 22 nt, Human
cucugcaggggaggcaugcacu

SEQ ID NO: 733905 - RNA, 22 nt, Human
agagcacagcagaucucugaug

SEQ ID NO: 733906 - RNA, 18 nt, Human
auacaagcucuguuacuu

SEQ ID NO: 733907 - RNA, 22 nt, Human
auguuuaugaccuccauaagga

SEQ ID NO: 733908 - RNA, 22 nt, Human
acauugaaccaguagacacaaa

SEQ ID NO: 733909 - RNA, 22 nt, Human
ucugauguugugacaucacuuc

SEQ ID NO: 733910 - RNA, 22 nt, Human
cugcaauaguuuagaauaauug

SEQ ID NO: 733911 - RNA, 22 nt, Human
ucggagaguuggaaguagcaga

SEQ ID NO: 733912 - RNA, 22 nt, Human
cccuuccucaaggagcuguguu

SEQ ID NO: 733913 - RNA, 22 nt, Human
aucuguguguuauuguuuauca

SEQ ID NO: 733914 - RNA, 22 nt, Human
auucugcauugcucacaaagau

SEQ ID NO: 733915 - RNA, 20 nt, Human
ggggcagguuuuuauggcua

SEQ ID NO: 733916 - RNA, 21 nt, Human
ucuuuucucugcaggauuccu

SEQ ID NO: 733917 - RNA, 22 nt, Human
uuauuugccagaauuucucuug

SEQ ID NO: 733918 - RNA, 22 nt, Human
augggaugaacuugaucugcuu

SEQ ID NO: 733919 - RNA, 22 nt, Human
agcuucucucuuugcacucaca

SEQ ID NO: 733920 - RNA, 22 nt, Human
agaggaagauuuuauuaaccag

SEQ ID NO: 733921 - RNA, 22 nt, Human
uggcugggccgggccuugugcc

SEQ ID NO: 733922 - RNA, 22 nt, Human
cacauuuacuuuuaucccuugg

SEQ ID NO: 733923 - RNA, 22 nt, Human
aucaucuuaagguaucucaagc

SEQ ID NO: 733924 - RNA, 22 nt, Human
uugucugagagauggcagaggu

SEQ ID NO: 733925 - RNA, 22 nt, Human
aagacagugaucucugagagau

SEQ ID NO: 733926 - RNA, 18 nt, Human
gccaggcaggguggggaa

SEQ ID NO: 733927 - RNA, 22 nt, Human
aucaaugacaguugaauucuac

SEQ ID NO: 733928 - RNA, 22 nt, Human
uccagaguuguaaguguugaca

SEQ ID NO: 733929 - RNA, 22 nt, Human
uaauccugcuucuucucccuuu

SEQ ID NO: 733930 - RNA, 22 nt, Human
aucaguguuccuugagacugcc

SEQ ID NO: 733931 - RNA, 22 nt, Human
guauuuucaagagcaguaguau

SEQ ID NO: 733932 - RNA, 22 nt, Human
uaagcacacaauaucuggagag

SEQ ID NO: 733933 - RNA, 22 nt, Human
uuucuucugagaucagggagaa

SEQ ID NO: 733934 - RNA, 22 nt, Human
uagugauuuucauauuacauua

SEQ ID NO: 733935 - RNA, 22 nt, Human
gcccauggcuucccuaggcaca

SEQ ID NO: 733936 - RNA, 22 nt, Human
caggugagaggcgguccugcau

SEQ ID NO: 733937 - RNA, 18 nt, Human
acaggccucaguccugca

SEQ ID NO: 733938 - RNA, 22 nt, Human
uggaagggguuacgcagcagga

SEQ ID NO: 733939 - RNA, 22 nt, Human
agccacagcauguguguaugua

SEQ ID NO: 733940 - RNA, 22 nt, Human
cagguggccaguacucaaggau

SEQ ID NO: 733941 - RNA, 21 nt, Human
gcuggcugucucuuacacggu

SEQ ID NO: 733942 - RNA, 22 nt, Human
gcuuaugauguuuacauaaaag

SEQ ID NO: 733943 - RNA, 22 nt, Human
gcugccuuuugcuccucccacc

SEQ ID NO: 733944 - RNA, 22 nt, Human
uauggguauaaacagguccuaa

SEQ ID NO: 733945 - RNA, 19 nt, Human
uccuucuccggccaccccg

SEQ ID NO: 733946 - RNA, 22 nt, Human
aguggaauguagaaaaaagaug

SEQ ID NO: 733947 - RNA, 19 nt, Human
aucaggaacaaggcugauc

SEQ ID NO: 733948 - RNA, 22 nt, Human
uccuuccucggggacccagauc

SEQ ID NO: 733949 - RNA, 22 nt, Human
guguguauguagaacuauguau

SEQ ID NO: 733950 - RNA, 22 nt, Human
acuguccaagcaugccuggcuu

SEQ ID NO: 733951 - RNA, 22 nt, Human
ucccagcauuaaugccugucag

SEQ ID NO: 733952 - RNA, 22 nt, Human
uuccagaaaguucuggaacugg

SEQ ID NO: 733953 - RNA, 22 nt, Human
aggcagcaaaugucuggaacag

SEQ ID NO: 733954 - RNA, 22 nt, Human
cgaggccaccgugguuuccgag

SEQ ID NO: 733955 - RNA, 22 nt, Human
acuagacaucgagcuacagagu

SEQ ID NO: 733956 - RNA, 22 nt, Human
auuaaggauuauacucuccuuu

SEQ ID NO: 733957 - RNA, 22 nt, Human
aagcagaugcguuggagcaguu

SEQ ID NO: 733958 - RNA, 22 nt, Human
agggccagaguacaucagggcu

SEQ ID NO: 733959 - RNA, 22 nt, Human
uuauuugguuauuguaauuggg

SEQ ID NO: 733960 - RNA, 20 nt, Human
ucuauuuguaaagggcugug

SEQ ID NO: 733961 - RNA, 22 nt, Human
gccacaggaaagcacccuggag

SEQ ID NO: 733962 - RNA, 19 nt, Human
agcuccugggcucugggcc

SEQ ID NO: 733963 - RNA, 22 nt, Human
agaccacuuggauaagaaacag

SEQ ID NO: 733964 - RNA, 22 nt, Human
ugagagguaggaaaugaacaag

SEQ ID NO: 733965 - RNA, 22 nt, Human
cagcugagaguagaaauggagg

SEQ ID NO: 733966 - RNA, 22 nt, Human
gccaggcuccaggcccuccuga

SEQ ID NO: 733967 - RNA, 22 nt, Human
cacuucuguugccuugugcaau

SEQ ID NO: 733968 - RNA, 22 nt, Human
uguccuugugacauucuggcuu

SEQ ID NO: 733969 - RNA, 22 nt, Human
ggccucucuggcauggcugccc

SEQ ID NO: 733970 - RNA, 22 nt, Human
augaagucuauuuaccuaagcu

SEQ ID NO: 733971 - RNA, 22 nt, Human
ucugacuuauuuguccuuggug

SEQ ID NO: 733972 - RNA, 22 nt, Human
agggcucaauggugggcaugua

SEQ ID NO: 733973 - RNA, 22 nt, Human
auggcccuggaaagagcuugag

SEQ ID NO: 733974 - RNA, 22 nt, Human
auuuacagguagaauuuuaagu

SEQ ID NO: 733975 - RNA, 22 nt, Human
gcaguauauggauuuuaaacau

SEQ ID NO: 733976 - RNA, 22 nt, Human
gcaguguuuguguucucacaug

SEQ ID NO: 733977 - RNA, 22 nt, Human
cugugugcuguuagggagcugc

SEQ ID NO: 733978 - RNA, 22 nt, Human
aagaauuaucugaaagcugugu

SEQ ID NO: 733979 - RNA, 22 nt, Human
cagcucugugcaggccugggga

SEQ ID NO: 733980 - RNA, 22 nt, Human
cauauacuuuucuauagcuuuc

SEQ ID NO: 733981 - RNA, 22 nt, Human
auguguaaugugguauuuuaau

SEQ ID NO: 733982 - RNA, 22 nt, Human
gcucaggucuuacccaugccug

SEQ ID NO: 733983 - RNA, 22 nt, Human
cagcagcugccucagcugggga

SEQ ID NO: 733984 - RNA, 22 nt, Human
uguuuauugagugccuacuaua

SEQ ID NO: 733985 - RNA, 21 nt, Human
gggugggguuccagccuuuuc

SEQ ID NO: 733986 - RNA, 22 nt, Human
uccagcucacagauagcguggg

SEQ ID NO: 733987 - RNA, 22 nt, Human
ucaggcaugcauucugcagguu

SEQ ID NO: 733988 - RNA, 22 nt, Human
gagagagaaaaugacuccggac

SEQ ID NO: 733989 - RNA, 22 nt, Human
acaucuguccucugcagagcuc

SEQ ID NO: 733990 - RNA, 22 nt, Human
uccuggcuccacugagcaggcc

SEQ ID NO: 733991 - RNA, 22 nt, Human
uagcaggaaaccuguguugagg

SEQ ID NO: 733992 - RNA, 22 nt, Human
gucugaggcgaggccugagaac

SEQ ID NO: 733993 - RNA, 22 nt, Human
caccccuguggagcaugguggc

SEQ ID NO: 733994 - RNA, 22 nt, Human
aaaugguggcucuuuuaaauug

SEQ ID NO: 733995 - RNA, 19 nt, Human
agucucugaggccuaaguu

SEQ ID NO: 733996 - RNA, 22 nt, Human
gccacugcacuccagcccaggc

SEQ ID NO: 733997 - RNA, 18 nt, Human
gcagugcaggaagaagag

SEQ ID NO: 733998 - RNA, 22 nt, Human
caagaaggcuauaugggccagg

SEQ ID NO: 733999 - RNA, 22 nt, Human
acacuugagguuuuuaggugcg

SEQ ID NO: 734000 - RNA, 22 nt, Human
guuugaaaguggcaaguccuug

SEQ ID NO: 734001 - RNA, 22 nt, Human
aguccaggccuccucuuuuccu

SEQ ID NO: 734002 - RNA, 22 nt, Human
caaagaagagauuuacagagcu

SEQ ID NO: 734003 - RNA, 22 nt, Human
aguuuucauuaccaugcugcaa

SEQ ID NO: 734004 - RNA, 22 nt, Human
uuuucagagagcuuuuaugucc

SEQ ID NO: 734005 - RNA, 22 nt, Human
cgcuuuaacgugagaagaaggg

SEQ ID NO: 734006 - RNA, 22 nt, Human
cagcuugcuaauuuugacuuca

SEQ ID NO: 734007 - RNA, 22 nt, Human
ugcaacucuggaucuucuggua

SEQ ID NO: 734008 - RNA, 21 nt, Human
gaggcccaugggacaggggcu

SEQ ID NO: 734009 - RNA, 22 nt, Human
gguggcugugagcauuauguga

SEQ ID NO: 734010 - RNA, 22 nt, Human
cugugaauugaauaugacuaug

SEQ ID NO: 734011 - RNA, 18 nt, Human
gccuuuggacugcuccca

SEQ ID NO: 734012 - RNA, 22 nt, Human
agagggcuaacugggaagcagg

SEQ ID NO: 734013 - RNA, 22 nt, Human
aucuccaguccugguuuccugg

SEQ ID NO: 734014 - RNA, 22 nt, Human
aaagauuagauaagauagauuu

SEQ ID NO: 734015 - RNA, 22 nt, Human
guccucuccaggaggcucugau

SEQ ID NO: 734016 - RNA, 22 nt, Human
gugcagcaaaguuugagauaua

SEQ ID NO: 734017 - RNA, 22 nt, Human
ccaggcuuuuagcugcauggca

SEQ ID NO: 734018 - RNA, 22 nt, Human
cagcugugauaugccugccuga

SEQ ID NO: 734019 - RNA, 22 nt, Human
auacuguaauaccuaaaugaac

SEQ ID NO: 734020 - RNA, 23 nt, Human
aaagcaaggaauuggcaacagag

SEQ ID NO: 734021 - RNA, 22 nt, Human
cugggccauggaagucucugcc

SEQ ID NO: 734022 - RNA, 22 nt, Human
uccugggaugacuuuugaaaug

SEQ ID NO: 734023 - RNA, 22 nt, Human
aucaguaggccaagcagcuggc

SEQ ID NO: 734024 - RNA, 23 nt, Human
agcucugcucgggcaugcccugc

SEQ ID NO: 734025 - RNA, 23 nt, Human
augaaugaauaaggcaggaaagc

SEQ ID NO: 734026 - RNA, 22 nt, Human
ggcugagccacugcgccuggcu

SEQ ID NO: 734027 - RNA, 22 nt, Human
guuuaugaaauuucaggcauuu

SEQ ID NO: 734028 - RNA, 22 nt, Human
aaggcugagagucacaguccua

SEQ ID NO: 734029 - RNA, 22 nt, Human
cagcaggggugucauuguaguu

SEQ ID NO: 734030 - RNA, 22 nt, Human
uugauucaucuucuaauaccca

SEQ ID NO: 734031 - RNA, 22 nt, Human
auaaggcagaaaugauucuagu

SEQ ID NO: 734032 - RNA, 22 nt, Human
uggcuggauaauauucuguugu

SEQ ID NO: 734033 - RNA, 22 nt, Human
uaucaagagucucuacauuaau

SEQ ID NO: 734034 - RNA, 22 nt, Human
uuaagagcaacauauggugaca

SEQ ID NO: 734035 - RNA, 22 nt, Human
ugucuccauuuucaaguagcag

SEQ ID NO: 734036 - RNA, 22 nt, Human
cuagcaucagaugagaagcugu

SEQ ID NO: 734037 - RNA, 19 nt, Human
cuuugucagaacaugcuuc

SEQ ID NO: 734038 - RNA, 22 nt, Human
uuugacuuugggcucuaacuca

SEQ ID NO: 734039 - RNA, 22 nt, Human
guccucuguguaggcugcagac

SEQ ID NO: 734040 - RNA, 22 nt, Human
ugagcccagucugucugacaug

SEQ ID NO: 734041 - RNA, 22 nt, Human
uuucaaacugggagugagggga

SEQ ID NO: 734042 - RNA, 22 nt, Human
caggacccaaccucccugcucu

SEQ ID NO: 734043 - RNA, 22 nt, Human
cuuagcuagugcucagcuguca

SEQ ID NO: 734044 - RNA, 22 nt, Human
ccagucacagguguguuuauau

SEQ ID NO: 734045 - RNA, 22 nt, Human
auguggcuggugacugccguac

SEQ ID NO: 734046 - RNA, 22 nt, Human
ccaguguuccauggagugauua

SEQ ID NO: 734047 - RNA, 22 nt, Human
acccuggcagccuucuguccug

SEQ ID NO: 734048 - RNA, 20 nt, Human
gcuuucaagcuugucauugu

SEQ ID NO: 734049 - RNA, 22 nt, Human
guggagagcaaauaauuggaau

SEQ ID NO: 734050 - RNA, 22 nt, Human
cucagcaucaugguaucugggg

SEQ ID NO: 734051 - RNA, 22 nt, Human
gagugucuauguuuagucuuuc

SEQ ID NO: 734052 - RNA, 22 nt, Human
ucauggagacuuugagccuguu

SEQ ID NO: 734053 - RNA, 22 nt, Human
gcccccagcucucaagcucaaa

SEQ ID NO: 734054 - RNA, 22 nt, Human
acauugauacugagauacaaag

SEQ ID NO: 734055 - RNA, 22 nt, Human
ugggggcacuucgaggucgccu

SEQ ID NO: 734056 - RNA, 22 nt, Human
aauucuuaaucccauaaaguga

SEQ ID NO: 734057 - RNA, 22 nt, Human
aggugauguccacagcuugcag

SEQ ID NO: 734058 - RNA, 20 nt, Human
ugagacaaggcuggagagac

SEQ ID NO: 734059 - RNA, 19 nt, Human
gcuuuuauugcucaggugc

SEQ ID NO: 734060 - RNA, 22 nt, Human
ucccaggguauccuguaguaaa

SEQ ID NO: 734061 - RNA, 20 nt, Human
cccucccagaugcuucccaa

SEQ ID NO: 734062 - RNA, 22 nt, Human
guacaguagagccagguucagu

SEQ ID NO: 734063 - RNA, 22 nt, Human
uucuaacuaauuggaaauggaa

SEQ ID NO: 734064 - RNA, 22 nt, Human
ugagcccucggcuggggcagag

SEQ ID NO: 734065 - RNA, 20 nt, Human
gacaugucuuucucacacaa

SEQ ID NO: 734066 - RNA, 22 nt, Human
uuucaacucaugcuaaaggaag

SEQ ID NO: 734067 - RNA, 22 nt, Human
accuguuuucagaaaaugcaga

SEQ ID NO: 734068 - RNA, 22 nt, Human
cccaggacucuucacugcagcc

SEQ ID NO: 734069 - RNA, 22 nt, Human
uucugugucuucuuguucugug

SEQ ID NO: 734070 - RNA, 22 nt, Human
gacagucuggccuaaaggguua

SEQ ID NO: 734071 - RNA, 22 nt, Human
augcccugcucucgggaaggga

SEQ ID NO: 734072 - RNA, 22 nt, Human
cucuggaaaaccacuagcagga

SEQ ID NO: 734073 - RNA, 22 nt, Human
ugucccaguuuaucugggacug

SEQ ID NO: 734074 - RNA, 20 nt, Human
uacagccccugcuucuguug

SEQ ID NO: 734075 - RNA, 22 nt, Human
auucuacagaugaaagcggcug

SEQ ID NO: 734076 - RNA, 22 nt, Human
auguccuuaaucugaauguuag

SEQ ID NO: 734077 - RNA, 22 nt, Human
uccuucaacuuuuuacuugccc

SEQ ID NO: 734078 - RNA, 22 nt, Human
uucaugugaucacagauuguaa

SEQ ID NO: 734079 - RNA, 22 nt, Human
agugugagcuaauagcagagcc

SEQ ID NO: 734080 - RNA, 22 nt, Human
ugggcagcagaaccaggccgac

SEQ ID NO: 734081 - RNA, 22 nt, Human
ucagguccuuuugguguauauu

SEQ ID NO: 734082 - RNA, 22 nt, Human
ugagacagucaccaggcaggcc

SEQ ID NO: 734083 - RNA, 22 nt, Human
gagggcagugaauuuugaagcu

SEQ ID NO: 734084 - RNA, 22 nt, Human
ccuggacaaugagaugucaggg

SEQ ID NO: 734085 - RNA, 22 nt, Human
augggcugcuuggcuuccaccc

SEQ ID NO: 734086 - RNA, 22 nt, Human
cuggaagugggguuggcuugaa

SEQ ID NO: 734087 - RNA, 22 nt, Human
agcuugguggcccuccuggcug

SEQ ID NO: 734088 - RNA, 22 nt, Human
aguuuuauuaaauccacagaag

SEQ ID NO: 734089 - RNA, 22 nt, Human
ggguggcacugauaaugagacg

SEQ ID NO: 734090 - RNA, 19 nt, Human
caggaaacaccuacugcua

SEQ ID NO: 734091 - RNA, 22 nt, Human
auguuugacugaguuuggcaga

SEQ ID NO: 734092 - RNA, 22 nt, Human
gacaucauguucugcuaauagu

SEQ ID NO: 734093 - RNA, 22 nt, Human
aauaacuuaagaaauuucccca

SEQ ID NO: 734094 - RNA, 22 nt, Human
uaaguucucaauacauuguagc

SEQ ID NO: 734095 - RNA, 22 nt, Human
ugggcugaacuucaucugauga

SEQ ID NO: 734096 - RNA, 22 nt, Human
gaggccagaagugccucgggcu

SEQ ID NO: 734097 - RNA, 22 nt, Human
gccugcagacguguuuuccuca

SEQ ID NO: 734098 - RNA, 22 nt, Human
agcauuaagccuggcucagagg

SEQ ID NO: 734099 - RNA, 22 nt, Human
gguggccauaggaccagccugg

SEQ ID NO: 734100 - RNA, 20 nt, Human
gaguuccccauuucuccugg

SEQ ID NO: 734101 - RNA, 22 nt, Human
uuccucuuucucugugcuaugu

SEQ ID NO: 734102 - RNA, 23 nt, Human
ucugagguccaccaguuugcaga

SEQ ID NO: 734103 - RNA, 22 nt, Human
auaaaagaucccuucugagcuc

SEQ ID NO: 734104 - RNA, 22 nt, Human
agcuuuauauguuguuucucca

SEQ ID NO: 734105 - RNA, 22 nt, Human
uauuccuggucccuaccacaga

SEQ ID NO: 734106 - RNA, 22 nt, Human
auugcauucauugacauaugag

SEQ ID NO: 734107 - RNA, 22 nt, Human
uucacaucuauaacuuagauaa

SEQ ID NO: 734108 - RNA, 22 nt, Human
agcccagcacugggggcccagc

SEQ ID NO: 734109 - RNA, 22 nt, Human
caaguucacguugcuuuuugag

SEQ ID NO: 734110 - RNA, 22 nt, Human
acauguauacaauguguaauga

SEQ ID NO: 734111 - RNA, 22 nt, Human
ugugcaaaguguacaaauuaau

SEQ ID NO: 734112 - RNA, 22 nt, Human
gcagggaccagggccagaucca

SEQ ID NO: 734113 - RNA, 21 nt, Human
acugcaucugaagucccagga

SEQ ID NO: 734114 - RNA, 19 nt, Human
gcucucccucucaguugag

SEQ ID NO: 734115 - RNA, 17 nt, Human
uacaaugugauucaauc

SEQ ID NO: 734116 - RNA, 22 nt, Human
cacaagagagugcgcguugcaa

SEQ ID NO: 734117 - RNA, 22 nt, Human
cugccccagccuggggccuucu

SEQ ID NO: 734118 - RNA, 22 nt, Human
gcagagccaggcuggggcaggu

SEQ ID NO: 734119 - RNA, 22 nt, Human
gccucugcaucuucgccgcacu

SEQ ID NO: 734120 - RNA, 22 nt, Human
cugcugccugacaauuuagguu

SEQ ID NO: 734121 - RNA, 22 nt, Human
augagacaugacuucaggccuu

SEQ ID NO: 734122 - RNA, 22 nt, Human
uugagggacagaggugcugucu

SEQ ID NO: 734123 - RNA, 22 nt, Human
ucaggugggaccugcuaggaca

SEQ ID NO: 734124 - RNA, 22 nt, Human
uucugaauucaugagauuuggg

SEQ ID NO: 734125 - RNA, 22 nt, Human
cagaggaacguuuggauugauu

SEQ ID NO: 734126 - RNA, 22 nt, Human
caugaagcccucaucagucuga

SEQ ID NO: 734127 - RNA, 22 nt, Human
gcguggugcugcccugcacaca

SEQ ID NO: 734128 - RNA, 22 nt, Human
cauuaugcaaagaacacuugag

SEQ ID NO: 734129 - RNA, 22 nt, Human
ucagccaggcccuaagagauug

SEQ ID NO: 734130 - RNA, 22 nt, Human
ugucagcaucauuuguugaagg

SEQ ID NO: 734131 - RNA, 22 nt, Human
caguccuucauuccuccuuuga

SEQ ID NO: 734132 - RNA, 22 nt, Human
ggucuggagcuaaucuuguugg

SEQ ID NO: 734133 - RNA, 22 nt, Human
uggcagggagccaccggucaug

SEQ ID NO: 734134 - RNA, 22 nt, Human
caggguggccagguagauaaua

SEQ ID NO: 734135 - RNA, 22 nt, Human
uauacauguuuuacauaaguga

SEQ ID NO: 734136 - RNA, 22 nt, Human
uuacacaaaguuagcucuugca

SEQ ID NO: 734137 - RNA, 22 nt, Human
ugucuggacauugacaaucaug

SEQ ID NO: 734138 - RNA, 22 nt, Human
aggcccugcauuguacugaggg

SEQ ID NO: 734139 - RNA, 22 nt, Human
agggagcuuccgaacuacagcu

SEQ ID NO: 734140 - RNA, 22 nt, Human
uaagagcagaacagcaacauau

SEQ ID NO: 734141 - RNA, 22 nt, Human
ugucaauaguuuugaguucucu

SEQ ID NO: 734142 - RNA, 19 nt, Human
aucaccugguguuuccuug

SEQ ID NO: 734143 - RNA, 22 nt, Human
gaguggggaaagccaggacaga

SEQ ID NO: 734144 - RNA, 22 nt, Human
aguggaaggucaggggacagug

SEQ ID NO: 734145 - RNA, 22 nt, Human
aaaauagauucuaggaugucuu

SEQ ID NO: 734146 - RNA, 22 nt, Human
aucauuuuauggcugagaggac

SEQ ID NO: 734147 - RNA, 22 nt, Human
agcagagguguuuauuauggga

SEQ ID NO: 734148 - RNA, 21 nt, Human
aggucaaaggcauccaugagg

SEQ ID NO: 734149 - RNA, 22 nt, Human
ugcucagacaagcugaacagua

SEQ ID NO: 734150 - RNA, 22 nt, Human
uaaaaguuuuaguuguacauaa

SEQ ID NO: 734151 - RNA, 22 nt, Human
ggaggcucugccaucugucaca

SEQ ID NO: 734152 - RNA, 21 nt, Human
aucugcuuagguuuguucaga

SEQ ID NO: 734153 - RNA, 22 nt, Human
cagagaggauggauuccauagc

SEQ ID NO: 734154 - RNA, 22 nt, Human
gaguuagaagacagaauguaaa

SEQ ID NO: 734155 - RNA, 22 nt, Human
gcugggagugggcaagaugaga

SEQ ID NO: 734156 - RNA, 22 nt, Human
ucuaagcagaacugaagcucug

SEQ ID NO: 734157 - RNA, 22 nt, Human
uguucuuugccagugauuuaau

SEQ ID NO: 734158 - RNA, 22 nt, Human
uugauacauuuuuaggauaaac

SEQ ID NO: 734159 - RNA, 22 nt, Human
agccugccaggcgcugccugga

SEQ ID NO: 734160 - RNA, 22 nt, Human
uauacuuaugcuaaaaaauguu

SEQ ID NO: 734161 - RNA, 22 nt, Human
auccccagacuuuagauuucuc

SEQ ID NO: 734162 - RNA, 22 nt, Human
uucagagcuggugucuacagcu

SEQ ID NO: 734163 - RNA, 22 nt, Human
gugcuguacuucuguguugaag

SEQ ID NO: 734164 - RNA, 22 nt, Human
cuguacaucucugaggacagua

SEQ ID NO: 734165 - RNA, 22 nt, Human
gcacugugacccagagcaggug

SEQ ID NO: 734166 - RNA, 22 nt, Human
ugcugaggcauuuggacagagu

SEQ ID NO: 734167 - RNA, 22 nt, Human
ggggauggaauguaguagugau

SEQ ID NO: 734168 - RNA, 20 nt, Human
aguaggggaaugcaagagca

SEQ ID NO: 734169 - RNA, 22 nt, Human
aaguuacuuuaccucuuuagcu

SEQ ID NO: 734170 - RNA, 22 nt, Human
ucaggcagugguaaaugaguua

SEQ ID NO: 734171 - RNA, 22 nt, Human
gacacauugaugugaguacaua

SEQ ID NO: 734172 - RNA, 22 nt, Human
aagacaauuuugaguaugcaca

SEQ ID NO: 734173 - RNA, 22 nt, Human
gagagugaggcaucaggggcag

SEQ ID NO: 734174 - RNA, 22 nt, Human
uuuacauugcauuagguauuau

SEQ ID NO: 734175 - RNA, 22 nt, Human
gccaagaagguggggacaugca

SEQ ID NO: 734176 - RNA, 22 nt, Human
cagggcuggcuguggcaaucuc

SEQ ID NO: 734177 - RNA, 22 nt, Human
gccaauuuccugagguaaagcu

SEQ ID NO: 734178 - RNA, 22 nt, Human
aaggcgacacaggcagcaggcc

SEQ ID NO: 734179 - RNA, 21 nt, Human
uccucugcagugagguggccu

SEQ ID NO: 734180 - RNA, 22 nt, Human
agagcuggcugugggugacuuu

SEQ ID NO: 734181 - RNA, 22 nt, Human
aucccucagccaccuuugagga

SEQ ID NO: 734182 - RNA, 22 nt, Human
ugcugagggagcaucaaagaaa

SEQ ID NO: 734183 - RNA, 22 nt, Human
ucgcuuuaauggucuucacagc

SEQ ID NO: 734184 - RNA, 22 nt, Human
aagagauugguuauaagagauu

SEQ ID NO: 734185 - RNA, 22 nt, Human
augaaugcauacauuugucaag

SEQ ID NO: 734186 - RNA, 21 nt, Human
auucacagguauccucucccu

SEQ ID NO: 734187 - RNA, 22 nt, Human
uuaaaugcucacauaaagguag

SEQ ID NO: 734188 - RNA, 22 nt, Human
ucuauaaaacucaagagcaauu

SEQ ID NO: 734189 - RNA, 22 nt, Human
ugucugaaacuugguccuaugc

SEQ ID NO: 734190 - RNA, 22 nt, Human
uggugcaguucccagggccggg

SEQ ID NO: 734191 - RNA, 22 nt, Human
ugugugucauuuaggguggagc

SEQ ID NO: 734192 - RNA, 22 nt, Human
uccaggaguccugggagugauu

SEQ ID NO: 734193 - RNA, 22 nt, Human
cucuggagucaggcagcccugg

SEQ ID NO: 734194 - RNA, 20 nt, Human
aaaguguaaggcaaaguugu

SEQ ID NO: 734195 - RNA, 22 nt, Human
ucaauucaauugaacaguuacu

SEQ ID NO: 734196 - RNA, 18 nt, Human
uggagcaggaagccuggc

SEQ ID NO: 734197 - RNA, 22 nt, Human
auucauuagccacuaacuagca

SEQ ID NO: 734198 - RNA, 22 nt, Human
acucauuuaaacauuuacugaa

SEQ ID NO: 734199 - RNA, 22 nt, Human
ccagggaaucucugaguguguu

SEQ ID NO: 734200 - RNA, 22 nt, Human
aggaccagugagucuggcaagu

SEQ ID NO: 734201 - RNA, 22 nt, Human
aauguaaacagcaagagaaggg

SEQ ID NO: 734202 - RNA, 22 nt, Human
gaagguuuucaggagccuaguc

SEQ ID NO: 734203 - RNA, 22 nt, Human
gugggcaguuggugauucucgu

SEQ ID NO: 734204 - RNA, 22 nt, Human
cacagaggaaugcaucagcaga

SEQ ID NO: 734205 - RNA, 22 nt, Human
auugagaagaaaaucuaauaua

SEQ ID NO: 734206 - RNA, 22 nt, Human
ggccuuccagggaagacagggc

SEQ ID NO: 734207 - RNA, 22 nt, Human
ucugggguugagucugggucag

SEQ ID NO: 734208 - RNA, 22 nt, Human
cuucuugugcacucucuaugua

SEQ ID NO: 734209 - RNA, 23 nt, Human
uagagcauugcugaggccucccu

SEQ ID NO: 734210 - RNA, 18 nt, Human
agugugugcccuuucagg

SEQ ID NO: 734211 - RNA, 22 nt, Human
aucuucaaggaaaaaauacagu

SEQ ID NO: 734212 - RNA, 22 nt, Human
aggcuccauaccaucuccggag

SEQ ID NO: 734213 - RNA, 22 nt, Human
caagaaguugacagccagguga

SEQ ID NO: 734214 - RNA, 22 nt, Human
gcuuccauuugcuaggggauuu

SEQ ID NO: 734215 - RNA, 22 nt, Human
uagcaauagaaacauauaaagu

SEQ ID NO: 734216 - RNA, 22 nt, Human
auguguuuguaccuuuaaauau

SEQ ID NO: 734217 - RNA, 22 nt, Human
uauauucauauuguugucucuc

SEQ ID NO: 734218 - RNA, 22 nt, Human
ucaguuucacagucugugcaga

SEQ ID NO: 734219 - RNA, 22 nt, Human
ggaagggcaaaagagaugaacu

SEQ ID NO: 734220 - RNA, 22 nt, Human
ugagguguguccccagggaggu

SEQ ID NO: 734221 - RNA, 21 nt, Human
ugcaggcuguuuaagaggcaa

SEQ ID NO: 734222 - RNA, 22 nt, Human
aaauguguuugauaggaauauu

SEQ ID NO: 734223 - RNA, 22 nt, Human
cuggcaggaaguuagaugguaa

SEQ ID NO: 734224 - RNA, 22 nt, Human
ccuggggccccgagccagaagc

SEQ ID NO: 734225 - RNA, 22 nt, Human
cuguggcuaggauuauuccuga

SEQ ID NO: 734226 - RNA, 22 nt, Human
aucacaaucuucaaaucgauuc

SEQ ID NO: 734227 - RNA, 22 nt, Human
cucuguguuccggguugcugcu

SEQ ID NO: 734228 - RNA, 22 nt, Human
agccaaucuccuguugaugcca

SEQ ID NO: 734229 - RNA, 22 nt, Human
gccuacaguuggcugagggccu

SEQ ID NO: 734230 - RNA, 22 nt, Human
ggaaaguggugguggaaagagg

SEQ ID NO: 734231 - RNA, 22 nt, Human
uggaugaggcuggguuaggcag

SEQ ID NO: 734232 - RNA, 22 nt, Human
uguacagaaggcacuaagguca

SEQ ID NO: 734233 - RNA, 22 nt, Human
cuggagucuucagcuugcugcc

SEQ ID NO: 734234 - RNA, 22 nt, Human
ccagagaguaaacauuuuccgg

SEQ ID NO: 734235 - RNA, 22 nt, Human
ggaaagaauagagacuuuauca

SEQ ID NO: 734236 - RNA, 22 nt, Human
auuucugauaaacguaagcugc

SEQ ID NO: 734237 - RNA, 22 nt, Human
accaggcuuaauccuuugcuau

SEQ ID NO: 734238 - RNA, 22 nt, Human
cgggagcacgggaggcggagcu

SEQ ID NO: 734239 - RNA, 22 nt, Human
ggcaggagcucuccaguuugcc

SEQ ID NO: 734240 - RNA, 17 nt, Human
agugacuuggaaagagc

SEQ ID NO: 734241 - RNA, 22 nt, Human
uguuuaauuucacaaaguugac

SEQ ID NO: 734242 - RNA, 22 nt, Human
cagggcauccgugcuccaugcu

SEQ ID NO: 734243 - RNA, 22 nt, Human
ugccuuuaacaagaucuccaga

SEQ ID NO: 734244 - RNA, 19 nt, Human
aaaaggaauauucuuuggg

SEQ ID NO: 734245 - RNA, 22 nt, Human
cauuacauuucaaaauguuucc

SEQ ID NO: 734246 - RNA, 22 nt, Human
agcuuuaugcuuccuacaagcu

SEQ ID NO: 734247 - RNA, 19 nt, Human
agguuuauggggaggguga

SEQ ID NO: 734248 - RNA, 16 nt, Human
uagggcugggaaggag

SEQ ID NO: 734249 - RNA, 22 nt, Human
uuuuccuguccaggcaauuauu

SEQ ID NO: 734250 - RNA, 22 nt, Human
auguauuugaaauuugagacau

SEQ ID NO: 734251 - RNA, 22 nt, Human
gucaagaugagaauucuuuuua

SEQ ID NO: 734252 - RNA, 22 nt, Human
ucccaggauuuuaggcucucag

SEQ ID NO: 734253 - RNA, 22 nt, Human
aaauccgucauuggccugguug

SEQ ID NO: 734254 - RNA, 22 nt, Human
uggcagaguuggagguggaaga

SEQ ID NO: 734255 - RNA, 22 nt, Human
agaguccugaguggaaaaaugg

SEQ ID NO: 734256 - RNA, 22 nt, Human
uugugaauggugccgcaauaaa

SEQ ID NO: 734257 - RNA, 22 nt, Human
uaaugcuuuuccuucaaauaag

SEQ ID NO: 734258 - RNA, 19 nt, Human
ucuguggcaccugggaggg

SEQ ID NO: 734259 - RNA, 22 nt, Human
ugggguggauagaaagugaugu

SEQ ID NO: 734260 - RNA, 21 nt, Human
cugaggcagcacagcuaguca

SEQ ID NO: 734261 - RNA, 22 nt, Human
agaggcaguauacaauccgagc

SEQ ID NO: 734262 - RNA, 22 nt, Human
ucuaauuccauuaaauugaugu

SEQ ID NO: 734263 - RNA, 22 nt, Human
uuuuuaagagauucuccagucu

SEQ ID NO: 734264 - RNA, 21 nt, Human
uucugcauuaagguggagaua

SEQ ID NO: 734265 - RNA, 22 nt, Human
aagcacagacucccucugagug

SEQ ID NO: 734266 - RNA, 22 nt, Human
gaagguggcgagcggauugcug

SEQ ID NO: 734267 - RNA, 22 nt, Human
uccucaggauguggaguagaau

SEQ ID NO: 734268 - RNA, 22 nt, Human
uggagguggcaucugacagcug

SEQ ID NO: 734269 - RNA, 22 nt, Human
acaucucuuauaaacucucuga

SEQ ID NO: 734270 - RNA, 23 nt, Human
uugcacaguguauacacauauuu

SEQ ID NO: 734271 - RNA, 22 nt, Human
aauuuuauuagaaggcaagggg

SEQ ID NO: 734272 - RNA, 22 nt, Human
uugaagauuauucuauuaaaag

SEQ ID NO: 734273 - RNA, 22 nt, Human
cuccccaagccuuggcuucucc

SEQ ID NO: 734274 - RNA, 22 nt, Human
aagcagcauaugacagcaucca

SEQ ID NO: 734275 - RNA, 22 nt, Human
uacagaagcuuuugaaaagaug

SEQ ID NO: 734276 - RNA, 22 nt, Human
gaugucuuugaggcucacugcu

SEQ ID NO: 734277 - RNA, 22 nt, Human
augaaaagggagugauauuugu

SEQ ID NO: 734278 - RNA, 20 nt, Human
uccagggcaacuagagugug

SEQ ID NO: 734279 - RNA, 22 nt, Human
aaagcuuagcauuuucaaaaug

SEQ ID NO: 734280 - RNA, 20 nt, Human
ugauuucucuucuauuccuu

SEQ ID NO: 734281 - RNA, 22 nt, Human
aaaugcagguaguauuuauuuu

SEQ ID NO: 734282 - RNA, 22 nt, Human
aaagcuauuuguuaugagagaa

SEQ ID NO: 734283 - RNA, 22 nt, Human
aacaaauguguuuuguaauuaa

SEQ ID NO: 734284 - RNA, 22 nt, Human
uucaaaguaccguacuuaaugg

SEQ ID NO: 734285 - RNA, 22 nt, Human
gccuuggagaucacugcucaug

SEQ ID NO: 734286 - RNA, 22 nt, Human
agccuguccagaggacagggcu

SEQ ID NO: 734287 - RNA, 22 nt, Human
caggucuggcaucagcugugug

SEQ ID NO: 734288 - RNA, 22 nt, Human
uaguuucuaaagcuuccuaggu

SEQ ID NO: 734289 - RNA, 22 nt, Human
cuggaucugucuuuuggauccc

SEQ ID NO: 734290 - RNA, 22 nt, Human
ccuccuggccugugcagagccc

SEQ ID NO: 734291 - RNA, 22 nt, Human
ggaagugguagagccaugagug

SEQ ID NO: 734292 - RNA, 22 nt, Human
aaauugauguucccaguugaaa

SEQ ID NO: 734293 - RNA, 22 nt, Human
cagugggugaugaguccugggg

SEQ ID NO: 734294 - RNA, 22 nt, Human
aauucugugcaggcagagcuau

SEQ ID NO: 734295 - RNA, 22 nt, Human
ugaaagcagugccaugauuaug

SEQ ID NO: 734296 - RNA, 22 nt, Human
caggaaagguagucacaaugua

SEQ ID NO: 734297 - RNA, 22 nt, Human
ugacauuugagcauacauguaa

SEQ ID NO: 734298 - RNA, 22 nt, Human
aggaaacugauguuuuuuacaa

SEQ ID NO: 734299 - RNA, 22 nt, Human
cuucuucaucuguaaaacuugg

SEQ ID NO: 734300 - RNA, 22 nt, Human
aauggcuugcaaauggguccau

SEQ ID NO: 734301 - RNA, 23 nt, Human
gggaaguggggauuugaagucau

SEQ ID NO: 734302 - RNA, 22 nt, Human
ucuggcucuguguccccaccca

SEQ ID NO: 734303 - RNA, 20 nt, Human
acaaauuggcagaaugacaa

SEQ ID NO: 734304 - RNA, 22 nt, Human
agcuuuaucuucaccugggaau

SEQ ID NO: 734305 - RNA, 17 nt, Human
agacacugagccaagua

SEQ ID NO: 734306 - RNA, 22 nt, Human
agaggcugaaugaugucaucau

SEQ ID NO: 734307 - RNA, 22 nt, Human
uucuacagguacugaaguacau

SEQ ID NO: 734308 - RNA, 22 nt, Human
auuucccaacacauuagaaaau

SEQ ID NO: 734309 - RNA, 22 nt, Human
aagcaguuacuauuuacuauua

SEQ ID NO: 734310 - RNA, 19 nt, Human
aauguuuaagagaaaaagg

SEQ ID NO: 734311 - RNA, 22 nt, Human
uuucuaucugagaagauaucua

SEQ ID NO: 734312 - RNA, 18 nt, Human
cauguguucuacaucagu

SEQ ID NO: 734313 - RNA, 22 nt, Human
uggcacuuccacuguggcugcu

SEQ ID NO: 734314 - RNA, 22 nt, Human
uuuagcaaguucucugagagaa

SEQ ID NO: 734315 - RNA, 22 nt, Human
uagaggugagacuucagugaca

SEQ ID NO: 734316 - RNA, 22 nt, Human
uacacauauguccauuaaucag

SEQ ID NO: 734317 - RNA, 22 nt, Human
ccucugugugaugcgcaaagua

SEQ ID NO: 734318 - RNA, 22 nt, Human
gccagaggaacgcugcgcgccc

SEQ ID NO: 734319 - RNA, 22 nt, Human
acaguaguacacaucuaugucc

SEQ ID NO: 734320 - RNA, 22 nt, Human
ucaauguuuguucaugaaaaua

SEQ ID NO: 734321 - RNA, 22 nt, Human
uggcacagacugggccaaggaa

SEQ ID NO: 734322 - RNA, 22 nt, Human
auggcagaaagaauagaggcua

SEQ ID NO: 734323 - RNA, 22 nt, Human
cucuuagcugcuguucuuugag

SEQ ID NO: 734324 - RNA, 19 nt, Human
gccagcagaaugaugaggc

SEQ ID NO: 734325 - RNA, 21 nt, Human
ucuggcccucacagucacacc

SEQ ID NO: 734326 - RNA, 22 nt, Human
uucccaguauuaccuucaggaa

SEQ ID NO: 734327 - RNA, 22 nt, Human
acuuucuuauccaugaucucac

SEQ ID NO: 734328 - RNA, 22 nt, Human
agagaaaagccaucccagccaa

SEQ ID NO: 734329 - RNA, 22 nt, Human
ucacagcuauucucauguauuu

SEQ ID NO: 734330 - RNA, 22 nt, Human
agacagacuugaaaauguucuu

SEQ ID NO: 734331 - RNA, 22 nt, Human
cauuuauucucagauccuuguc

SEQ ID NO: 734332 - RNA, 19 nt, Human
uuuggcacucugaaguguu

SEQ ID NO: 734333 - RNA, 22 nt, Human
ggguuaguugguaguuaauuga

SEQ ID NO: 734334 - RNA, 22 nt, Human
uuagaguguagcaggaagaggc

SEQ ID NO: 734335 - RNA, 22 nt, Human
aauuucucauggauucaguuau

SEQ ID NO: 734336 - RNA, 19 nt, Human
guuaucaaggggcuacuuu

SEQ ID NO: 734337 - RNA, 22 nt, Human
ccugcugaggucagccacccaa

SEQ ID NO: 734338 - RNA, 22 nt, Human
gucauuuuucacugcauauaga

SEQ ID NO: 734339 - RNA, 22 nt, Human
agcuggagaaaccugggagggu

SEQ ID NO: 734340 - RNA, 22 nt, Human
uccaagaagucaucuaaacugu

SEQ ID NO: 734341 - RNA, 22 nt, Human
aaagaacuaccuguaugauauu

SEQ ID NO: 734342 - RNA, 22 nt, Human
auagcuuucuuaaauauauaaa

SEQ ID NO: 734343 - RNA, 22 nt, Human
cagauccuuaggacaaccaucc

SEQ ID NO: 734344 - RNA, 22 nt, Human
uuuguaagagcauauguaaagg

SEQ ID NO: 734345 - RNA, 22 nt, Human
aggagcugagggagcgcccuug

SEQ ID NO: 734346 - RNA, 22 nt, Human
uauguagauuucucuguuuuuc

SEQ ID NO: 734347 - RNA, 22 nt, Human
cacaguccagacuccuggaguu

SEQ ID NO: 734348 - RNA, 22 nt, Human
uuuucacaaggguccaacuagu

SEQ ID NO: 734349 - RNA, 22 nt, Human
gcaguguuacuuggaguacuaa

SEQ ID NO: 734350 - RNA, 22 nt, Human
ugccucugggugaccaaggagc

SEQ ID NO: 734351 - RNA, 22 nt, Human
cccaggcagaauuaguguuuca

SEQ ID NO: 734352 - RNA, 22 nt, Human
gugcccaguaaaugaaagcuuu

SEQ ID NO: 734353 - RNA, 22 nt, Human
gaguuauagauggacuauuauu

SEQ ID NO: 734354 - RNA, 23 nt, Human
ggcucugugcugggccugcagga

SEQ ID NO: 734355 - RNA, 22 nt, Human
gcugagaauguuccuacuggua

SEQ ID NO: 734356 - RNA, 22 nt, Human
caugaguaugauuauacccagu

SEQ ID NO: 734357 - RNA, 22 nt, Human
aguuuacaacaguagcuaugga

SEQ ID NO: 734358 - RNA, 22 nt, Human
cuaggcacucacguggcuuuag

SEQ ID NO: 734359 - RNA, 19 nt, Human
gguccucagcagagcaugc

SEQ ID NO: 734360 - RNA, 22 nt, Human
gcagacacagggaaggcaagga

SEQ ID NO: 734361 - RNA, 20 nt, Human
aggaaggagaaucugagcaa

SEQ ID NO: 734362 - RNA, 19 nt, Human
uccuggggauguggucacc

SEQ ID NO: 734363 - RNA, 22 nt, Human
ucaggguaaaccuucacuguga

SEQ ID NO: 734364 - RNA, 22 nt, Human
auaaagacaugcuuacuugccc

SEQ ID NO: 734365 - RNA, 22 nt, Human
cucagaguucuccugggaggug

SEQ ID NO: 734366 - RNA, 22 nt, Human
uuuaugagccucaaaucugagu

SEQ ID NO: 734367 - RNA, 22 nt, Human
uacagaauaaagcgugaagcuu

SEQ ID NO: 734368 - RNA, 22 nt, Human
agcugcuccuuuccugcaggcg

SEQ ID NO: 734369 - RNA, 22 nt, Human
ugcccaggcuggaaugcagugg

SEQ ID NO: 734370 - RNA, 22 nt, Human
ucuggcuccugaguccaugcuc

SEQ ID NO: 734371 - RNA, 22 nt, Human
ucuuuggacuuuccaauuuguu

SEQ ID NO: 734372 - RNA, 17 nt, Human
ggugaguguccaggugg

SEQ ID NO: 734373 - RNA, 22 nt, Human
gugggcuuugcuggauccuucc

SEQ ID NO: 734374 - RNA, 22 nt, Human
ugugguagagggcagaugggca

SEQ ID NO: 734375 - RNA, 18 nt, Human
aggaaagacgaagagggc

SEQ ID NO: 734376 - RNA, 22 nt, Human
ucccuucaagauuuggggaaau

SEQ ID NO: 734377 - RNA, 22 nt, Human
acaguauuugcgauacugauga

SEQ ID NO: 734378 - RNA, 22 nt, Human
aucauucugauggucaaugcua

SEQ ID NO: 734379 - RNA, 22 nt, Human
agcucugagaaaguuagaaagu

SEQ ID NO: 734380 - RNA, 22 nt, Human
cagggccuggagcugggccugc

SEQ ID NO: 734381 - RNA, 22 nt, Human
gcugagcagguuugaugcuuuu

SEQ ID NO: 734382 - RNA, 22 nt, Human
uagcaggaauaaaaauguaccc

SEQ ID NO: 734383 - RNA, 20 nt, Human
uacaauacacaugcauauga

SEQ ID NO: 734384 - RNA, 22 nt, Human
ggucuccaaagcugcauugaug

SEQ ID NO: 734385 - RNA, 22 nt, Human
uccuccagaaacugaggcagaa

SEQ ID NO: 734386 - RNA, 22 nt, Human
gaagaagggagugacaaaugca

SEQ ID NO: 734387 - RNA, 22 nt, Human
agccucugguccucccucagcu

SEQ ID NO: 734388 - RNA, 22 nt, Human
gcugcagagggaggggcucgca

SEQ ID NO: 734389 - RNA, 22 nt, Human
uauguggccuuuuaugucugac

SEQ ID NO: 734390 - RNA, 22 nt, Human
cacaguuugguuuugcuguaau

SEQ ID NO: 734391 - RNA, 21 nt, Human
ggucagcucuauccacgccuu

SEQ ID NO: 734392 - RNA, 22 nt, Human
aaagcucuuuuccaaguauuga

SEQ ID NO: 734393 - RNA, 22 nt, Human
aauguucauugauuaaaugaau

SEQ ID NO: 734394 - RNA, 22 nt, Human
augagaaggacauaaauuauag

SEQ ID NO: 734395 - RNA, 21 nt, Human
uuucacaaaaguaugugacaa

SEQ ID NO: 734396 - RNA, 22 nt, Human
acaguguacuagguacauguuc

SEQ ID NO: 734397 - RNA, 22 nt, Human
ccagggcucgggugcuuaguca

SEQ ID NO: 734398 - RNA, 22 nt, Human
agugaggauaccaauguguaga

SEQ ID NO: 734399 - RNA, 22 nt, Human
ccugugcuucagcuggaggagg

SEQ ID NO: 734400 - RNA, 22 nt, Human
auggaaauguaacuucugauuc

SEQ ID NO: 734401 - RNA, 22 nt, Human
auguuucaucaguaagguuuug

SEQ ID NO: 734402 - RNA, 22 nt, Human
cuccucagaacagccuuggcug

SEQ ID NO: 734403 - RNA, 22 nt, Human
gauaauaagcacagcaggaugu

SEQ ID NO: 734404 - RNA, 22 nt, Human
ucugagguggggcuggagcauu

SEQ ID NO: 734405 - RNA, 22 nt, Human
cagucagagucacaguaauuug

SEQ ID NO: 734406 - RNA, 20 nt, Human
auucucugcucaaguggcac

SEQ ID NO: 734407 - RNA, 22 nt, Human
cuuccuggaugagcaggcugau

SEQ ID NO: 734408 - RNA, 23 nt, Human
uaguguauaucaacauuuguccc

SEQ ID NO: 734409 - RNA, 22 nt, Human
acuucucucauucagacauagc

SEQ ID NO: 734410 - RNA, 22 nt, Human
augcuacauuuugguuuauaaa

SEQ ID NO: 734411 - RNA, 22 nt, Human
uccugcagcucugagaagcauc

SEQ ID NO: 734412 - RNA, 22 nt, Human
ccuggcaccuucacagacuacu

SEQ ID NO: 734413 - RNA, 22 nt, Human
ggcuuauguuugucaagcaauc

SEQ ID NO: 734414 - RNA, 18 nt, Human
ccacagcagaguucuuac

SEQ ID NO: 734415 - RNA, 22 nt, Human
cuacaguaugaaaccuuuacuc

SEQ ID NO: 734416 - RNA, 22 nt, Human
agcagaaaugaugguaugggac

SEQ ID NO: 734417 - RNA, 22 nt, Human
cucuccaucugugugaccuccc

SEQ ID NO: 734418 - RNA, 22 nt, Human
ucacaggcuaaauuuaugcagg

SEQ ID NO: 734419 - RNA, 22 nt, Human
uguaugaauauguuggggaggu

SEQ ID NO: 734420 - RNA, 20 nt, Human
uuggaugugcauggccgugc

SEQ ID NO: 734421 - RNA, 22 nt, Human
ggagaggacauggcucccacag

SEQ ID NO: 734422 - RNA, 22 nt, Human
gugagacaagauuuguaggcag

SEQ ID NO: 734423 - RNA, 22 nt, Human
gucccucugugucccugcaguc

SEQ ID NO: 734424 - RNA, 21 nt, Human
ucugauguguuuaaugguggg

SEQ ID NO: 734425 - RNA, 22 nt, Human
gauuucagggugucuuccagcu

SEQ ID NO: 734426 - RNA, 22 nt, Human
ucccagaaguccagccaugggc

SEQ ID NO: 734427 - RNA, 19 nt, Human
uucacauuuugcucugagg

SEQ ID NO: 734428 - RNA, 22 nt, Human
agguagguuaaauuucuuuauc

SEQ ID NO: 734429 - RNA, 22 nt, Human
aggaaaaucaaugucuuuuuaa

SEQ ID NO: 734430 - RNA, 22 nt, Human
gggagugguugauggugaaaau

SEQ ID NO: 734431 - RNA, 22 nt, Human
ugcuggggguagcucugcguag

SEQ ID NO: 734432 - RNA, 22 nt, Human
aaaguguagagacuuuggaacc

SEQ ID NO: 734433 - RNA, 22 nt, Human
gccucaguuuauacaccuguaa

SEQ ID NO: 734434 - RNA, 22 nt, Human
ucccuccuggugagcaggggcu

SEQ ID NO: 734435 - RNA, 22 nt, Human
ggagaggugcaggucaguggca

SEQ ID NO: 734436 - RNA, 22 nt, Human
acaggccucaagacacccaggu

SEQ ID NO: 734437 - RNA, 21 nt, Human
guggcccugccgcagugucca

SEQ ID NO: 734438 - RNA, 22 nt, Human
gcaggaugggagcuucacuuug

SEQ ID NO: 734439 - RNA, 22 nt, Human
uagaaucugaauauucuuauuu

SEQ ID NO: 734440 - RNA, 22 nt, Human
cagcagccuacaaugcacagaa

SEQ ID NO: 734441 - RNA, 19 nt, Human
ggugggugaccuccccacc

SEQ ID NO: 734442 - RNA, 19 nt, Human
uucccagagccaugaguga

SEQ ID NO: 734443 - RNA, 22 nt, Human
ucagucucuggggcuucuguuu

SEQ ID NO: 734444 - RNA, 17 nt, Human
ucccaggaacagggaau

SEQ ID NO: 734445 - RNA, 22 nt, Human
uacagaaguugguuuuaguuua

SEQ ID NO: 734446 - RNA, 19 nt, Human
agaggccucagcagcuggc

SEQ ID NO: 734447 - RNA, 22 nt, Human
aacucuugaauucccuugaaga

SEQ ID NO: 734448 - RNA, 22 nt, Human
gcagugguggagcuuacauauc

SEQ ID NO: 734449 - RNA, 22 nt, Human
uccagagcugagggucaguaga

SEQ ID NO: 734450 - RNA, 22 nt, Human
gcugguuuccuuaucuauaaag

SEQ ID NO: 734451 - RNA, 22 nt, Human
ccugucuggccaccagggcgau

SEQ ID NO: 734452 - RNA, 22 nt, Human
gcucaggaaaacagucuaguaa

SEQ ID NO: 734453 - RNA, 22 nt, Human
uaaugucuucuuuuaauuuggc

SEQ ID NO: 734454 - RNA, 22 nt, Human
ucugagugagggugugagauau

SEQ ID NO: 734455 - RNA, 23 nt, Human
ugcaggugugcagagggcucuug

SEQ ID NO: 734456 - RNA, 22 nt, Human
aaugaaguguuauuuaguuuca

SEQ ID NO: 734457 - RNA, 22 nt, Human
ucagauuuggacacaggaacuu

SEQ ID NO: 734458 - RNA, 22 nt, Human
auguacaaucuaucacaagaag

SEQ ID NO: 734459 - RNA, 22 nt, Human
augggaagugaagucagggagg

SEQ ID NO: 734460 - RNA, 22 nt, Human
uuccagugacuaagcuucugcu

SEQ ID NO: 734461 - RNA, 22 nt, Human
gagggugguggcuuaaggugcu

SEQ ID NO: 734462 - RNA, 21 nt, Human
uaggccacauggguuggagau

SEQ ID NO: 734463 - RNA, 22 nt, Human
agaagcugcguuuauuuaaauc

SEQ ID NO: 734464 - RNA, 22 nt, Human
uguguguguuuacaguuucuca

SEQ ID NO: 734465 - RNA, 22 nt, Human
aaagcugcugccaaucaggcuu

SEQ ID NO: 734466 - RNA, 22 nt, Human
aaggccagauucucucuagggg

SEQ ID NO: 734467 - RNA, 22 nt, Human
aaagauaugucuccaaagagau

SEQ ID NO: 734468 - RNA, 22 nt, Human
cagcugaguggacccuagaggc

SEQ ID NO: 734469 - RNA, 22 nt, Human
ugucucuucccacucagacccc

SEQ ID NO: 734470 - RNA, 21 nt, Human
aggagccagccugucagucua

SEQ ID NO: 734471 - RNA, 22 nt, Human
cauguuaacuaagauuaacuau

SEQ ID NO: 734472 - RNA, 22 nt, Human
acacuagagagcaggcauuccc

SEQ ID NO: 734473 - RNA, 22 nt, Human
agcugaagggaggauauguaca

SEQ ID NO: 734474 - RNA, 22 nt, Human
uucuggaagcuggaaaaggcaa

SEQ ID NO: 734475 - RNA, 22 nt, Human
ucagagagaaauaguuuuugac

SEQ ID NO: 734476 - RNA, 22 nt, Human
uccuggggaggucgaggcugag

SEQ ID NO: 734477 - RNA, 22 nt, Human
augcuucucagcucaaggcaaa

SEQ ID NO: 734478 - RNA, 22 nt, Human
acaggucuggucugggugggac

SEQ ID NO: 734479 - RNA, 22 nt, Human
cacagcuucccaaaguggaccu

SEQ ID NO: 734480 - RNA, 22 nt, Human
cagcugaguguuggcauguuca

SEQ ID NO: 734481 - RNA, 22 nt, Human
acccucaagauggaagcaguuu

SEQ ID NO: 734482 - RNA, 22 nt, Human
gggggcuaccgucucuggagcu

SEQ ID NO: 734483 - RNA, 23 nt, Human
augacacuccugugcgcacccug

SEQ ID NO: 734484 - RNA, 22 nt, Human
auauucaaauuacauuuacuaa

SEQ ID NO: 734485 - RNA, 22 nt, Human
agaugcauguuuaugucuuucc

SEQ ID NO: 734486 - RNA, 19 nt, Human
aagcguuucccacuugcuu

SEQ ID NO: 734487 - RNA, 22 nt, Human
ccagccaggcuggcuguggagg

SEQ ID NO: 734488 - RNA, 18 nt, Human
ggcaggcucucuggguca

SEQ ID NO: 734489 - RNA, 22 nt, Human
gcugcagagugaugaagugggg

SEQ ID NO: 734490 - RNA, 21 nt, Human
ucucccaaggagguccugagg

SEQ ID NO: 734491 - RNA, 22 nt, Human
accagcugcugauugcuaaaug

SEQ ID NO: 734492 - RNA, 22 nt, Human
uuucaauguaugucuuucugag

SEQ ID NO: 734493 - RNA, 22 nt, Human
caggugacccucaguguggacu

SEQ ID NO: 734494 - RNA, 22 nt, Human
aucucugauuuacagcaucucu

SEQ ID NO: 734495 - RNA, 22 nt, Human
ccugugugguagccagcggugc

SEQ ID NO: 734496 - RNA, 22 nt, Human
accagcagggcugggccaaugg

SEQ ID NO: 734497 - RNA, 22 nt, Human
ucugcugagucagaccucuggg

SEQ ID NO: 734498 - RNA, 20 nt, Human
acacaugcauagagagagag

SEQ ID NO: 734499 - RNA, 22 nt, Human
guccucugucccuggggcacgg

SEQ ID NO: 734500 - RNA, 22 nt, Human
acagggaccugugagcuccaua

SEQ ID NO: 734501 - RNA, 23 nt, Human
gagcucugcacuaggcccuggga

SEQ ID NO: 734502 - RNA, 22 nt, Human
ucugaggcauaaccuguucugc

SEQ ID NO: 734503 - RNA, 21 nt, Human
gcuggcuuccugagggcugag

SEQ ID NO: 734504 - RNA, 22 nt, Human
aagccaugguagaaaacucagu

SEQ ID NO: 734505 - RNA, 22 nt, Human
ucacaguacugugacuauugac

SEQ ID NO: 734506 - RNA, 22 nt, Human
agcugcccuggcggagcugcuc

SEQ ID NO: 734507 - RNA, 22 nt, Human
auguuacaugaaacggccuacu

SEQ ID NO: 734508 - RNA, 22 nt, Human
gggacaggcugagacuugagcu

SEQ ID NO: 734509 - RNA, 22 nt, Human
ugucauuuuagugcaucacuca

SEQ ID NO: 734510 - RNA, 22 nt, Human
agugcauucaguauucauaggc

SEQ ID NO: 734511 - RNA, 22 nt, Human
aaacuccugggcucaagcaguu

SEQ ID NO: 734512 - RNA, 20 nt, Human
ucuuuaguuccuggcccuuu

SEQ ID NO: 734513 - RNA, 22 nt, Human
uucaaugucuauguacauuuua

SEQ ID NO: 734514 - RNA, 22 nt, Human
aggugcagcugguggagucugg

SEQ ID NO: 734515 - RNA, 22 nt, Human
ugggggcagccaggcugucaag

SEQ ID NO: 734516 - RNA, 22 nt, Human
agcuggccauugugaguggccu

SEQ ID NO: 734517 - RNA, 20 nt, Human
cagcaucuagugagauuugc

SEQ ID NO: 734518 - RNA, 22 nt, Human
acaggagaauuaucuggaacaa

SEQ ID NO: 734519 - RNA, 22 nt, Human
guauuuggugaugccuccaaac

SEQ ID NO: 734520 - RNA, 22 nt, Human
guuccuuguaauuuguuaagga

SEQ ID NO: 734521 - RNA, 22 nt, Human
gcuuagcagugugugcuuuuga

SEQ ID NO: 734522 - RNA, 22 nt, Human
cagcuugggggcgcuggccuca

SEQ ID NO: 734523 - RNA, 22 nt, Human
guggcgaggggagguccuggcg

SEQ ID NO: 734524 - RNA, 22 nt, Human
agcccagauaaaguacaaccau

SEQ ID NO: 734525 - RNA, 19 nt, Human
uuacaugacauaugaagga

SEQ ID NO: 734526 - RNA, 22 nt, Human
cucuccaggacuuuggcccaau

SEQ ID NO: 734527 - RNA, 21 nt, Human
uggccagcuggagucuccaca

SEQ ID NO: 734528 - RNA, 22 nt, Human
acaugcacaccuauauacaugu

SEQ ID NO: 734529 - RNA, 22 nt, Human
ggaagacaagcaguggcugagc

SEQ ID NO: 734530 - RNA, 22 nt, Human
aggcuguguuuccccuggagcu

SEQ ID NO: 734531 - RNA, 22 nt, Human
gauucuugggccuucugaaguu

SEQ ID NO: 734532 - RNA, 22 nt, Human
gcugcccuaauaucacauguua

SEQ ID NO: 734533 - RNA, 22 nt, Human
cauuugaugacucaacucauaa

SEQ ID NO: 734534 - RNA, 22 nt, Human
cugcacaggggaugagggcagu

SEQ ID NO: 734535 - RNA, 23 nt, Human
acagugaaacacgcaguaagagu

SEQ ID NO: 734536 - RNA, 22 nt, Human
uguggguuuaagaggcagcaug

SEQ ID NO: 734537 - RNA, 22 nt, Human
ugcuccaggccgccuggggcug

SEQ ID NO: 734538 - RNA, 21 nt, Human
ugcauuuaacagaaacaggaa

SEQ ID NO: 734539 - RNA, 20 nt, Human
gagcaucugucugcugugca

SEQ ID NO: 734540 - RNA, 22 nt, Human
caugugucaaaugauguagcug

SEQ ID NO: 734541 - RNA, 22 nt, Human
gugaggccgcacgccccggagu

SEQ ID NO: 734542 - RNA, 23 nt, Human
ccugccuguucuaacuccauuuc

SEQ ID NO: 734543 - RNA, 22 nt, Human
ucuccagguggggucaccuuuu

SEQ ID NO: 734544 - RNA, 23 nt, Human
uuccaagugcuuuacuuaauccu

SEQ ID NO: 734545 - RNA, 22 nt, Human
uaguagugagucuuuauaaaua

SEQ ID NO: 734546 - RNA, 22 nt, Human
cuggguguucacccgaggcgcu

SEQ ID NO: 734547 - RNA, 22 nt, Human
caauguguguguuuuucucaac

SEQ ID NO: 734548 - RNA, 22 nt, Human
gggaucugacuugcuggugggu

SEQ ID NO: 734549 - RNA, 21 nt, Human
uuuuauugaugaauggccacu

SEQ ID NO: 734550 - RNA, 22 nt, Human
aaaugaguagcgaugcacauua

SEQ ID NO: 734551 - RNA, 22 nt, Human
uacccaggagaaacagcagggc

SEQ ID NO: 734552 - RNA, 22 nt, Human
caaggcuuagucagagggugcu

SEQ ID NO: 734553 - RNA, 22 nt, Human
uacacugaaagagaggauugaa

SEQ ID NO: 734554 - RNA, 22 nt, Human
aauuuuaaucaguggugcugag

SEQ ID NO: 734555 - RNA, 22 nt, Human
uuguguguuuguagaaaaucca

SEQ ID NO: 734556 - RNA, 17 nt, Human
ucaggcugggugcagug

SEQ ID NO: 734557 - RNA, 23 nt, Human
agcagcuguggaguuuugcauuu

SEQ ID NO: 734558 - RNA, 22 nt, Human
caaucacaaagagacaaguguc

SEQ ID NO: 734559 - RNA, 18 nt, Human
cccggcuaauuuuuggua

SEQ ID NO: 734560 - RNA, 22 nt, Human
ucagaguuucaggauacaaaua

SEQ ID NO: 734561 - RNA, 22 nt, Human
agccugugagggaugcugcagu

SEQ ID NO: 734562 - RNA, 22 nt, Human
cugagccuuauucaccagcccu

SEQ ID NO: 734563 - RNA, 22 nt, Human
ugagugcucuguaugugccaga

SEQ ID NO: 734564 - RNA, 22 nt, Human
acagaauagucagcuguaggcc

SEQ ID NO: 734565 - RNA, 22 nt, Human
cacacaggaugaagcagcagaa

SEQ ID NO: 734566 - RNA, 22 nt, Human
ccuuccagaguucagucugccc

SEQ ID NO: 734567 - RNA, 22 nt, Human
cuugggaggagaacaaagcucc

SEQ ID NO: 734568 - RNA, 22 nt, Human
uggcaaccgcauggccugcuuc

SEQ ID NO: 734569 - RNA, 22 nt, Human
uuaccaagcucugcauguuaag

SEQ ID NO: 734570 - RNA, 22 nt, Human
ggagucugucaccuguuucucu

SEQ ID NO: 734571 - RNA, 22 nt, Human
aggcuaugauauuauugagaca

SEQ ID NO: 734572 - RNA, 22 nt, Human
cagggucccaggagcugcuuuc

SEQ ID NO: 734573 - RNA, 22 nt, Human
acccuggggucacccuucucug

SEQ ID NO: 734574 - RNA, 21 nt, Human
aguuuuuacucuuaacugugg

SEQ ID NO: 734575 - RNA, 22 nt, Human
aucagcaaucaaauugcagagu

SEQ ID NO: 734576 - RNA, 21 nt, Human
ugcacagccauacccuccuug

SEQ ID NO: 734577 - RNA, 22 nt, Human
cagauaaauagacuuggucaga

SEQ ID NO: 734578 - RNA, 22 nt, Human
ucugugcacuaacauuccuggu

SEQ ID NO: 734579 - RNA, 22 nt, Human
ugagcugucaagguacagugaa

SEQ ID NO: 734580 - RNA, 22 nt, Human
caggggcugugggcggagccuc

SEQ ID NO: 734581 - RNA, 22 nt, Human
cagaggugacccauaguaccuc

SEQ ID NO: 734582 - RNA, 22 nt, Human
ccuucagaaugaaauucuaaug

SEQ ID NO: 734583 - RNA, 22 nt, Human
uacugcaaaccauuuacaguag

SEQ ID NO: 734584 - RNA, 22 nt, Human
ucaguuuuuguuugccagauag

SEQ ID NO: 734585 - RNA, 22 nt, Human
gugcuuuucugcaggguccuau

SEQ ID NO: 734586 - RNA, 22 nt, Human
agaucacaguucucuauucgua

SEQ ID NO: 734587 - RNA, 22 nt, Human
guuaguguauauugccuucaaa

SEQ ID NO: 734588 - RNA, 22 nt, Human
cuguauaauucaugcucuuauu

SEQ ID NO: 734589 - RNA, 20 nt, Human
gcugagguggaggaaggaga

SEQ ID NO: 734590 - RNA, 20 nt, Human
gugccuggagaagaggcugu

SEQ ID NO: 734591 - RNA, 22 nt, Human
acucaugucauguguucuuuac

SEQ ID NO: 734592 - RNA, 22 nt, Human
uauuugcuuuugugccacagau

SEQ ID NO: 734593 - RNA, 22 nt, Human
gcuggagccauuggcuuggccu

SEQ ID NO: 734594 - RNA, 22 nt, Human
guccucugcuucaugcccugau

SEQ ID NO: 734595 - RNA, 19 nt, Human
acacauuugcacaauccac

SEQ ID NO: 734596 - RNA, 22 nt, Human
acuauaaaaggauaaaccagaa

SEQ ID NO: 734597 - RNA, 22 nt, Human
gcaggcucuucuuucugcccag

SEQ ID NO: 734598 - RNA, 22 nt, Human
cauugcuuccuaugucccuucu

SEQ ID NO: 734599 - RNA, 19 nt, Human
uguuaugacuuugccuuuu

SEQ ID NO: 734600 - RNA, 20 nt, Human
auccucacccucaguccuag

SEQ ID NO: 734601 - RNA, 22 nt, Human
cacuucaaauauggcuucauga

SEQ ID NO: 734602 - RNA, 23 nt, Human
ucugagagaacaaugccuccuau

SEQ ID NO: 734603 - RNA, 22 nt, Human
uuugacaggacuaacauauggc

SEQ ID NO: 734604 - RNA, 22 nt, Human
cacauaauacauguuccacuua

SEQ ID NO: 734605 - RNA, 22 nt, Human
caguagucuuuuuccuccuaga

SEQ ID NO: 734606 - RNA, 23 nt, Human
ccaagcuugucccugccugcuuu

SEQ ID NO: 734607 - RNA, 22 nt, Human
uacaguuacgcugagaaacgaa

SEQ ID NO: 734608 - RNA, 22 nt, Human
uuauuauaaugagggauaaaaa

SEQ ID NO: 734609 - RNA, 22 nt, Human
aaagccuugagauccuauaguu

SEQ ID NO: 734610 - RNA, 22 nt, Human
gggaggagcugagugugugugc

SEQ ID NO: 734611 - RNA, 22 nt, Human
aacugcauuguacuaaacuugu

SEQ ID NO: 734612 - RNA, 22 nt, Human
ucucccucucagauuuauucac

SEQ ID NO: 734613 - RNA, 22 nt, Human
uaucuguugucuuuuacaugua

SEQ ID NO: 734614 - RNA, 22 nt, Human
acuguuauaguucacuuuuccc

SEQ ID NO: 734615 - RNA, 22 nt, Human
aaagagaacuuuuacccaagaa

SEQ ID NO: 734616 - RNA, 23 nt, Human
agcuugcuuuucccaguacugca

SEQ ID NO: 734617 - RNA, 22 nt, Human
ccugagucuuucccauugcgcu

SEQ ID NO: 734618 - RNA, 22 nt, Human
cuccccagguucaggagguggg

SEQ ID NO: 734619 - RNA, 21 nt, Human
gaaccugagugaagacuuggg

SEQ ID NO: 734620 - RNA, 19 nt, Human
aggacucuggaggcaugag

SEQ ID NO: 734621 - RNA, 22 nt, Human
uggcucuguucgccaucaggag

SEQ ID NO: 734622 - RNA, 22 nt, Human
ugguuuaugcuguugcagcucu

SEQ ID NO: 734623 - RNA, 22 nt, Human
ucugaggcagcuugccacucua

SEQ ID NO: 734624 - RNA, 22 nt, Human
cauccugagaaaauaaaggaga

SEQ ID NO: 734625 - RNA, 22 nt, Human
ugagggucauuuggaaguggaa

SEQ ID NO: 734626 - RNA, 20 nt, Human
acucauuuccagcaucugau

SEQ ID NO: 734627 - RNA, 22 nt, Human
cccaugcacccucuaagaagga

SEQ ID NO: 734628 - RNA, 22 nt, Human
uucaguuccuugugcgaauucc

SEQ ID NO: 734629 - RNA, 22 nt, Human
cuugggaguagaggcaggagca

SEQ ID NO: 734630 - RNA, 22 nt, Human
ucugggaacacacgucacuuca

SEQ ID NO: 734631 - RNA, 22 nt, Human
augcaguacagauaauucuaca

SEQ ID NO: 734632 - RNA, 20 nt, Human
ccucuguguccugugucaua

SEQ ID NO: 734633 - RNA, 22 nt, Human
uccaggccuugacaggucaguu

SEQ ID NO: 734634 - RNA, 22 nt, Human
aaguggcagccuuagaaggaga

SEQ ID NO: 734635 - RNA, 22 nt, Human
uggcccugcuuaugucucucuu

SEQ ID NO: 734636 - RNA, 22 nt, Human
aguauaucugcuucuggguccc

SEQ ID NO: 734637 - RNA, 22 nt, Human
gaguuaaaggaaaauaacuuua

SEQ ID NO: 734638 - RNA, 20 nt, Human
cgugcugugaccuugagcau

SEQ ID NO: 734639 - RNA, 22 nt, Human
ucaggcugcaguggcaaaagac

SEQ ID NO: 734640 - RNA, 22 nt, Human
gagggguggcguuggcauuuag

SEQ ID NO: 734641 - RNA, 20 nt, Human
ucacaucuggcagcugauga

SEQ ID NO: 734642 - RNA, 22 nt, Human
uccaggcuuuuucaugcugucu

SEQ ID NO: 734643 - RNA, 22 nt, Human
cagugcaggaagugagaugccu

SEQ ID NO: 734644 - RNA, 21 nt, Human
cuuuagugaaaaggggcuaac

SEQ ID NO: 734645 - RNA, 22 nt, Human
uccuggagagugggcgagcaca

SEQ ID NO: 734646 - RNA, 23 nt, Human
uagagcaguagaucaccauggga

SEQ ID NO: 734647 - RNA, 22 nt, Human
caggagugucgggucacuaggu

SEQ ID NO: 734648 - RNA, 22 nt, Human
ugaaugcuuggagucauaaaau

SEQ ID NO: 734649 - RNA, 22 nt, Human
uugaaguuguaguucagugaag

SEQ ID NO: 734650 - RNA, 22 nt, Human
ucuuuaagccaagauauauuua

SEQ ID NO: 734651 - RNA, 19 nt, Human
gauaaguuuccagguaacu

SEQ ID NO: 734652 - RNA, 22 nt, Human
uagggcugcuuuguauucugcu

SEQ ID NO: 734653 - RNA, 22 nt, Human
gcugugcugauucauucccugc

SEQ ID NO: 734654 - RNA, 22 nt, Human
uaugugcauuaucuaguucauu

SEQ ID NO: 734655 - RNA, 22 nt, Human
gaggucucacuauguugcccag

SEQ ID NO: 734656 - RNA, 22 nt, Human
acagaauuaggagauccucuug

SEQ ID NO: 734657 - RNA, 22 nt, Human
gaaauguacuuuaaagccaucc

SEQ ID NO: 734658 - RNA, 22 nt, Human
gacuggagcccccaaggacacc

SEQ ID NO: 734659 - RNA, 22 nt, Human
augucugcuuuccuuuuaauca

SEQ ID NO: 734660 - RNA, 22 nt, Human
agggugccugcugcagguucag

SEQ ID NO: 734661 - RNA, 22 nt, Human
gaaauuuacaacuuucucaugg

SEQ ID NO: 734662 - RNA, 20 nt, Human
gcucagggaauucaggaagc

SEQ ID NO: 734663 - RNA, 22 nt, Human
aagggcugagcacagugagcca

SEQ ID NO: 734664 - RNA, 22 nt, Human
gaaggaggcuccccaaagucug

SEQ ID NO: 734665 - RNA, 22 nt, Human
gaaguauuauagcauauuagcc

SEQ ID NO: 734666 - RNA, 22 nt, Human
ucaggggcagccggggaagcca

SEQ ID NO: 734667 - RNA, 22 nt, Human
uucacaugaaaguaggaaagga

SEQ ID NO: 734668 - RNA, 22 nt, Human
cccaggagaccugugaaaggac

SEQ ID NO: 734669 - RNA, 22 nt, Human
gggcuggaggccugccugguua

SEQ ID NO: 734670 - RNA, 22 nt, Human
cugcccugagucaugccagaug

SEQ ID NO: 734671 - RNA, 22 nt, Human
cugauggagugauggagaaauu

SEQ ID NO: 734672 - RNA, 22 nt, Human
uacaugaaauaggauucuggag

SEQ ID NO: 734673 - RNA, 22 nt, Human
ccugagguugaaguauaaauug

SEQ ID NO: 734674 - RNA, 22 nt, Human
ucuggccccggucuucacagcu

SEQ ID NO: 734675 - RNA, 22 nt, Human
cuuucagagguuacucaggaaa

SEQ ID NO: 734676 - RNA, 22 nt, Human
uauauucacuuguguccaacca

SEQ ID NO: 734677 - RNA, 18 nt, Human
uguaaacacuuucauucu

SEQ ID NO: 734678 - RNA, 22 nt, Human
uuuguacuaugguuuuucacua

SEQ ID NO: 734679 - RNA, 22 nt, Human
uggcugaguuacgaacagagca

SEQ ID NO: 734680 - RNA, 22 nt, Human
acuuaaaaagaaucuuuucacg

SEQ ID NO: 734681 - RNA, 22 nt, Human
ggcuuuauaggguagaggauca

SEQ ID NO: 734682 - RNA, 22 nt, Human
gagguuggugaggggacacggu

SEQ ID NO: 734683 - RNA, 22 nt, Human
gccugagagucugcauuucuaa

SEQ ID NO: 734684 - RNA, 22 nt, Human
uccugagauucugcauuucuaa

SEQ ID NO: 734685 - RNA, 22 nt, Human
auggcugucacgccacugugag

SEQ ID NO: 734686 - RNA, 22 nt, Human
uggcugcagaucugugggacac

SEQ ID NO: 734687 - RNA, 22 nt, Human
uaguccagguuaaucccugccu

SEQ ID NO: 734688 - RNA, 22 nt, Human
ugguggcaauucaaagacagca

SEQ ID NO: 734689 - RNA, 22 nt, Human
aagaugcuuccacugcaguggc

SEQ ID NO: 734690 - RNA, 22 nt, Human
ugagauugugugcuucagaaau

SEQ ID NO: 734691 - RNA, 22 nt, Human
acauuucugcauguaggguaau

SEQ ID NO: 734692 - RNA, 22 nt, Human
auauuauuuucccuggaguugu

SEQ ID NO: 734693 - RNA, 22 nt, Human
uuaaacaguguuucaugugggg

SEQ ID NO: 734694 - RNA, 22 nt, Human
acaagauaaggugucagugugu

SEQ ID NO: 734695 - RNA, 22 nt, Human
aaucacuuagaacccaggaagu

SEQ ID NO: 734696 - RNA, 22 nt, Human
ucaggaagaaauucuguaucuu

SEQ ID NO: 734697 - RNA, 22 nt, Human
gggcagcagcaggaggucucug

SEQ ID NO: 734698 - RNA, 22 nt, Human
aggauauaaaaagacuauuugg

SEQ ID NO: 734699 - RNA, 22 nt, Human
caaaucuauauguugauauucu

SEQ ID NO: 734700 - RNA, 22 nt, Human
ccagccuggacugggucuugug

SEQ ID NO: 734701 - RNA, 22 nt, Human
gcagaagcugggcagcgaggug

SEQ ID NO: 734702 - RNA, 22 nt, Human
aacagaauaucaaaagauuaug

SEQ ID NO: 734703 - RNA, 22 nt, Human
aaagauuauggcauugaaauac

SEQ ID NO: 734704 - RNA, 22 nt, Human
cagugcuggaggggugcuugca

SEQ ID NO: 734705 - RNA, 22 nt, Human
ccuggcucaggcacgcauggcu

SEQ ID NO: 734706 - RNA, 22 nt, Human
aaauucucaagugauccuguug

SEQ ID NO: 734707 - RNA, 22 nt, Human
cgagagauggguuggcaggggc

SEQ ID NO: 734708 - RNA, 19 nt, Human
gguagaagggaaguguuuu

SEQ ID NO: 734709 - RNA, 22 nt, Human
cagagcugagaauguugaugcu

SEQ ID NO: 734710 - RNA, 22 nt, Human
cuagcacuuagggauuguuaug

SEQ ID NO: 734711 - RNA, 22 nt, Human
auuguuaugaaaauaagauguu

SEQ ID NO: 734712 - RNA, 22 nt, Human
ucaggccucaagcugcuuuaag

SEQ ID NO: 734713 - RNA, 22 nt, Human
aagacauuuuagagauagggaa

SEQ ID NO: 734714 - RNA, 22 nt, Human
aguugaauaauuagacauaucu

SEQ ID NO: 734715 - RNA, 22 nt, Human
uuggcauuuuuccucagcugga

SEQ ID NO: 734716 - RNA, 22 nt, Human
guccuucaagaguccccuacug

SEQ ID NO: 734717 - RNA, 22 nt, Human
uguuaaacucguagguuaggcu

SEQ ID NO: 734718 - RNA, 22 nt, Human
agugucugaguaaauuucucau

SEQ ID NO: 734719 - RNA, 22 nt, Human
ccagucaguucugauuaugugg

SEQ ID NO: 734720 - RNA, 22 nt, Human
uagaaagcaguugugggggcuc

SEQ ID NO: 734721 - RNA, 22 nt, Human
ccagcuuuaucaagucugagcu

SEQ ID NO: 734722 - RNA, 22 nt, Human
acaugcacugcucaggguuccg

SEQ ID NO: 734723 - RNA, 22 nt, Human
gcuggcugaggucuagcucuuu

SEQ ID NO: 734724 - RNA, 22 nt, Human
gcucccagggcagcgcagaaga

SEQ ID NO: 734725 - RNA, 22 nt, Human
ugguaaugguucucuugcuaua

SEQ ID NO: 734726 - RNA, 22 nt, Human
aggagacucagagaccuggccg

SEQ ID NO: 734727 - RNA, 22 nt, Human
aucuggggucagacagcccugg

SEQ ID NO: 734728 - RNA, 21 nt, Human
uccugcagggcagcagagugg

SEQ ID NO: 734729 - RNA, 22 nt, Human
ucacuggggagcacugacaugu

SEQ ID NO: 734730 - RNA, 22 nt, Human
agccuggacagcuacggagaac

SEQ ID NO: 734731 - RNA, 22 nt, Human
agucuucuuuguguucucucau

SEQ ID NO: 734732 - RNA, 22 nt, Human
uuucuaaggcuaggucuuaagg

SEQ ID NO: 734733 - RNA, 22 nt, Human
gggcuucaauagcagaggcgug

SEQ ID NO: 734734 - RNA, 22 nt, Human
guggcugggcuccgagcggcuu

SEQ ID NO: 734735 - RNA, 22 nt, Human
uuggacucugggauucuggauu

SEQ ID NO: 734736 - RNA, 22 nt, Human
uuucacaggaugcuguuuuaua

SEQ ID NO: 734737 - RNA, 22 nt, Human
gcuggccauggccugcgccauc

SEQ ID NO: 734738 - RNA, 22 nt, Human
aaggcacugcuuugcugcgccc

SEQ ID NO: 734739 - RNA, 22 nt, Human
cuaagcuuuucaaaaacauguu

SEQ ID NO: 734740 - RNA, 22 nt, Human
cagcauuuagaauuugaagugu

SEQ ID NO: 734741 - RNA, 22 nt, Human
ccacugagcaguagcugcgucg

SEQ ID NO: 734742 - RNA, 22 nt, Human
ggucugaagcccacgugguacc

SEQ ID NO: 734743 - RNA, 22 nt, Human
aaacuuuaggaaggaauuuaca

SEQ ID NO: 734744 - RNA, 22 nt, Human
uaaaucacuguucauuccacac

SEQ ID NO: 734745 - RNA, 22 nt, Human
gcugggaguuacugucuccuuu

SEQ ID NO: 734746 - RNA, 22 nt, Human
acauucuagaagucuuugcaau

SEQ ID NO: 734747 - RNA, 22 nt, Human
auauuuugaaguuaauaaugug

SEQ ID NO: 734748 - RNA, 19 nt, Human
ucagaaggcaggagaggcc

SEQ ID NO: 734749 - RNA, 22 nt, Human
cgcagcuguccauguguggggg

SEQ ID NO: 734750 - RNA, 22 nt, Human
ccuucccuaaagcgucgcuuag

SEQ ID NO: 734751 - RNA, 22 nt, Human
gugccugggacacagcagauac

SEQ ID NO: 734752 - RNA, 22 nt, Human
gcagagguccuagccaggaguc

SEQ ID NO: 734753 - RNA, 22 nt, Human
ugcuccaggcugcugaagaucu

SEQ ID NO: 734754 - RNA, 22 nt, Human
uggcuucagagucugaguucuu

SEQ ID NO: 734755 - RNA, 22 nt, Human
aggucacaggguugaaguacuu

SEQ ID NO: 734756 - RNA, 22 nt, Human
uuuaucuguauaucucaagugu

SEQ ID NO: 734757 - RNA, 22 nt, Human
ucccuucacagaugcgauguuu

SEQ ID NO: 734758 - RNA, 22 nt, Human
aaggaagaagacucuuuacucc

SEQ ID NO: 734759 - RNA, 22 nt, Human
caaugcaugauggaauugccuu

SEQ ID NO: 734760 - RNA, 22 nt, Human
ucucucagaggccaggguccug

SEQ ID NO: 734761 - RNA, 22 nt, Human
gccccacuguggaaccuaaguc

SEQ ID NO: 734762 - RNA, 22 nt, Human
uggagcaggaagucuauggcug

SEQ ID NO: 734763 - RNA, 22 nt, Human
ucaccaguuaaaauaacaguaa

SEQ ID NO: 734764 - RNA, 22 nt, Human
agaacacuuuuaaauggcuugu

SEQ ID NO: 734765 - RNA, 22 nt, Human
gggcugcugccaaucacagccu

SEQ ID NO: 734766 - RNA, 22 nt, Human
agcaggugccagguguacccgc

SEQ ID NO: 734767 - RNA, 22 nt, Human
cuauuaaauacucuucaaauug

SEQ ID NO: 734768 - RNA, 22 nt, Human
auuugguuucaggauucucagg

SEQ ID NO: 734769 - RNA, 22 nt, Human
gguaacugcaccuuuggccuga

SEQ ID NO: 734770 - RNA, 22 nt, Human
uggagaugaauauguguaccug

SEQ ID NO: 734771 - RNA, 22 nt, Human
agcugccuccauggucaaagau

SEQ ID NO: 734772 - RNA, 22 nt, Human
aaguccagcucuaaauaucuga

SEQ ID NO: 734773 - RNA, 22 nt, Human
uucagaacaaccaugguuagau

SEQ ID NO: 734774 - RNA, 22 nt, Human
ucugaggucuaugacuuugcuu

SEQ ID NO: 734775 - RNA, 22 nt, Human
gccugagaaggauaggaagcga

SEQ ID NO: 734776 - RNA, 22 nt, Human
cuuuuuacaaagccugucuucu

SEQ ID NO: 734777 - RNA, 22 nt, Human
auacuagacuguucuguuauca

SEQ ID NO: 734778 - RNA, 22 nt, Human
gagcauuugguuauaguaauuu

SEQ ID NO: 734779 - RNA, 22 nt, Human
aacaaugaggaucuguucugag

SEQ ID NO: 734780 - RNA, 20 nt, Human
aggggcaccugcgacggggc

SEQ ID NO: 734781 - RNA, 22 nt, Human
ccagggcaacgcugucucagag

SEQ ID NO: 734782 - RNA, 22 nt, Human
cuccacggcccauugggcagga

SEQ ID NO: 734783 - RNA, 22 nt, Human
caacauauauaaggauuuacua

SEQ ID NO: 734784 - RNA, 22 nt, Human
uccaggaccucccaggcuagag

SEQ ID NO: 734785 - RNA, 22 nt, Human
aggcagcaaagaaaugaugcug

SEQ ID NO: 734786 - RNA, 22 nt, Human
agcacuuaacugacaguacuau

SEQ ID NO: 734787 - RNA, 19 nt, Human
acuguguggaagugugauu

SEQ ID NO: 734788 - RNA, 22 nt, Human
guucuucagcauuagaagucau

SEQ ID NO: 734789 - RNA, 22 nt, Human
aaacacagguacugcagaagug

SEQ ID NO: 734790 - RNA, 22 nt, Human
cagcagccuagaagcucuacca

SEQ ID NO: 734791 - RNA, 23 nt, Human
ggagaucagagacuagggcaguu

SEQ ID NO: 734792 - RNA, 22 nt, Human
acauguaacauauauguagcau

SEQ ID NO: 734793 - RNA, 22 nt, Human
ucugaggaaagagagugggaug

SEQ ID NO: 734794 - RNA, 22 nt, Human
agagcuggguggacuuguaguu

SEQ ID NO: 734795 - RNA, 22 nt, Human
ggguccaggcacuaugcuaagu

SEQ ID NO: 734796 - RNA, 22 nt, Human
ugacaggcuugcuaagacauag

SEQ ID NO: 734797 - RNA, 22 nt, Human
cugagaguguggcuuccaggcc

SEQ ID NO: 734798 - RNA, 22 nt, Human
caggaaauuuauguucuacuua

SEQ ID NO: 734799 - RNA, 20 nt, Human
agucccuuuggucagguauu

SEQ ID NO: 734800 - RNA, 21 nt, Human
uguuucaugcuauuuucuugu

SEQ ID NO: 734801 - RNA, 22 nt, Human
uccauggggcccaggaugagag

SEQ ID NO: 734802 - RNA, 18 nt, Human
agcaaauauuaagugcau

SEQ ID NO: 734803 - RNA, 19 nt, Human
agccuggagggcuggucac

SEQ ID NO: 734804 - RNA, 22 nt, Human
agcuggcuccagaaggagucgu

SEQ ID NO: 734805 - RNA, 22 nt, Human
cuuucucugugugguaaagggc

SEQ ID NO: 734806 - RNA, 22 nt, Human
uucauuaaguauaaaauguggu

SEQ ID NO: 734807 - RNA, 20 nt, Human
ggggcaguggcucaugccug

SEQ ID NO: 734808 - RNA, 22 nt, Human
uugauucuacuuaaaacauaug

SEQ ID NO: 734809 - RNA, 22 nt, Human
gauuuccucacuaacauccauc

SEQ ID NO: 734810 - RNA, 22 nt, Human
acucucugguguagaaagaccu

SEQ ID NO: 734811 - RNA, 22 nt, Human
gaugcuggccuggccaucuggg

SEQ ID NO: 734812 - RNA, 22 nt, Human
aguggggacuuaugccagcauu

SEQ ID NO: 734813 - RNA, 22 nt, Human
uuucaugauccauuuacaaaau

SEQ ID NO: 734814 - RNA, 22 nt, Human
ucaggagagaguuggguaggcu

SEQ ID NO: 734815 - RNA, 22 nt, Human
caagauuuauauuuucacacaa

SEQ ID NO: 734816 - RNA, 22 nt, Human
agaucggcuuugcagaccucau

SEQ ID NO: 734817 - RNA, 22 nt, Human
uguuacagaaugaauuuccgga

SEQ ID NO: 734818 - RNA, 22 nt, Human
aaggucuguucuaggugagggu

SEQ ID NO: 734819 - RNA, 22 nt, Human
aggaacauucucauuuccugcc

SEQ ID NO: 734820 - RNA, 22 nt, Human
agaaggccaauagggugcacug

SEQ ID NO: 734821 - RNA, 22 nt, Human
gagcugaggugauguggucguu

SEQ ID NO: 734822 - RNA, 22 nt, Human
uccccagguccugucggcuccu

SEQ ID NO: 734823 - RNA, 22 nt, Human
gucucagauucagacaucuaca

SEQ ID NO: 734824 - RNA, 22 nt, Human
cagaaacuucuggugucaaaua

SEQ ID NO: 734825 - RNA, 22 nt, Human
ucagagucugugcauucugcua

SEQ ID NO: 734826 - RNA, 22 nt, Human
aggaagguaaugaacugaggag

SEQ ID NO: 734827 - RNA, 22 nt, Human
agccacugugagaggaccaggg

SEQ ID NO: 734828 - RNA, 22 nt, Human
aggcaagauuaggaccagaaga

SEQ ID NO: 734829 - RNA, 22 nt, Human
gagccuucaucgcagccuuguu

SEQ ID NO: 734830 - RNA, 22 nt, Human
aucugcuugaguuugaagucag

SEQ ID NO: 734831 - RNA, 22 nt, Human
uugccugugaggauucugguug

SEQ ID NO: 734832 - RNA, 22 nt, Human
cuuguauacaguguacacauug

SEQ ID NO: 734833 - RNA, 22 nt, Human
caaaggcuucaucucagagcag

SEQ ID NO: 734834 - RNA, 22 nt, Human
cauaucauaggucuuggauaau

SEQ ID NO: 734835 - RNA, 22 nt, Human
cuggcugugugucuucauucag

SEQ ID NO: 734836 - RNA, 22 nt, Human
caagauaagaucauuuacacua

SEQ ID NO: 734837 - RNA, 20 nt, Human
cuucuucagccuaugcuuca

SEQ ID NO: 734838 - RNA, 22 nt, Human
acaaagauaagucagaaaguca

SEQ ID NO: 734839 - RNA, 22 nt, Human
gggaccagugucugugagaaaa

SEQ ID NO: 734840 - RNA, 22 nt, Human
uuauacacugcagaaccagcau

SEQ ID NO: 734841 - RNA, 22 nt, Human
aaagguuuuauucugagcucug

SEQ ID NO: 734842 - RNA, 22 nt, Human
agcagugugcuucguuucauga

SEQ ID NO: 734843 - RNA, 22 nt, Human
acaucaguaacuguaaaacagg

SEQ ID NO: 734844 - RNA, 23 nt, Human
aagaacugcgaauggagaaagua

SEQ ID NO: 734845 - RNA, 22 nt, Human
ucugcuugugucuguccagccu

SEQ ID NO: 734846 - RNA, 22 nt, Human
ugcaauaaagugcuauaaaucc

SEQ ID NO: 734847 - RNA, 22 nt, Human
accaguccgcggagcuccgggg

SEQ ID NO: 734848 - RNA, 22 nt, Human
ucagaacagcucucagauaucc

SEQ ID NO: 734849 - RNA, 22 nt, Human
uauuuuacuuuaaagcgagaga

SEQ ID NO: 734850 - RNA, 22 nt, Human
cugggcucaaauccuggcccug

SEQ ID NO: 734851 - RNA, 22 nt, Human
uugcuuuccgucaugugcuaau

SEQ ID NO: 734852 - RNA, 22 nt, Human
agcagcaguguucuggaauucu

SEQ ID NO: 734853 - RNA, 22 nt, Human
aucugucaagauagacucugca

SEQ ID NO: 734854 - RNA, 21 nt, Human
gacuuuaauuugagagcaaaa

SEQ ID NO: 734855 - RNA, 22 nt, Human
acuuauuuauucauucagcuca

SEQ ID NO: 734856 - RNA, 22 nt, Human
uaaaucagccuuugcuauuuua

SEQ ID NO: 734857 - RNA, 23 nt, Human
aguucaaaaucaaccaggacacu

SEQ ID NO: 734858 - RNA, 22 nt, Human
ucagugcacccaauucucucca

SEQ ID NO: 734859 - RNA, 20 nt, Human
uggaguuguucugcuagguc

SEQ ID NO: 734860 - RNA, 22 nt, Human
agcaaugugaccccugacagca

SEQ ID NO: 734861 - RNA, 22 nt, Human
ccucaggauccgcaggugcagu

SEQ ID NO: 734862 - RNA, 22 nt, Human
caugagaagguuuuggcauaua

SEQ ID NO: 734863 - RNA, 22 nt, Human
uugucacuagugaagaaucagg

SEQ ID NO: 734864 - RNA, 22 nt, Human
ugaagcuauauaaguuacagca

SEQ ID NO: 734865 - RNA, 22 nt, Human
uacaguauggaaaauguauagu

SEQ ID NO: 734866 - RNA, 22 nt, Human
cugaauccacacaaggugaugg

SEQ ID NO: 734867 - RNA, 22 nt, Human
caucaaagggccuguggugcag

SEQ ID NO: 734868 - RNA, 22 nt, Human
agcuucuucuuggucuuuccca

SEQ ID NO: 734869 - RNA, 19 nt, Human
caguggccuggaggucucu

SEQ ID NO: 734870 - RNA, 22 nt, Human
uggcacugacagggugcucaag

SEQ ID NO: 734871 - RNA, 19 nt, Human
ccuggccagacuucugccc

SEQ ID NO: 734872 - RNA, 20 nt, Human
ugagccagucaagcuacauu

SEQ ID NO: 734873 - RNA, 22 nt, Human
gcacaugacuuugaggaaacca

SEQ ID NO: 734874 - RNA, 22 nt, Human
gaggagcuggcugucgggaggc

SEQ ID NO: 734875 - RNA, 22 nt, Human
cacagagacagaagcacuuaug

SEQ ID NO: 734876 - RNA, 22 nt, Human
ucuuauuuagagaggacuagag

SEQ ID NO: 734877 - RNA, 22 nt, Human
ucacuggaaaugcacagcugua

SEQ ID NO: 734878 - RNA, 23 nt, Human
gggaccagcuagggcugugaccu

SEQ ID NO: 734879 - RNA, 22 nt, Human
cucaacagcucugccauacucc

SEQ ID NO: 734880 - RNA, 22 nt, Human
accuccccucaccaaucugguu

SEQ ID NO: 734881 - RNA, 22 nt, Human
agaaaguucacugguauauuuu

SEQ ID NO: 734882 - RNA, 22 nt, Human
agcacuuuccuggcaaaugugg

SEQ ID NO: 734883 - RNA, 22 nt, Human
ugcuugcuggaggcagacagaa

SEQ ID NO: 734884 - RNA, 21 nt, Human
cacagaggcgcuguauggcug

SEQ ID NO: 734885 - RNA, 22 nt, Human
gcagcccacaccacucugcuca

SEQ ID NO: 734886 - RNA, 22 nt, Human
aggcuagcugauugccuuagaa

SEQ ID NO: 734887 - RNA, 22 nt, Human
ucagagaauuguuuaauggaau

SEQ ID NO: 734888 - RNA, 23 nt, Human
ggggacaguucccacuggggucu

SEQ ID NO: 734889 - RNA, 21 nt, Human
uguuuauggaaaagagacaaa

SEQ ID NO: 734890 - RNA, 21 nt, Human
cagcccagagcaguggggcca

SEQ ID NO: 734891 - RNA, 23 nt, Human
cuucuggcucuauaucagaauuc

SEQ ID NO: 734892 - RNA, 22 nt, Human
uccugcaggccuguucccagua

SEQ ID NO: 734893 - RNA, 22 nt, Human
agccacccauucccgagcccua

SEQ ID NO: 734894 - RNA, 21 nt, Human
gcuuucagaagucucauaguu

SEQ ID NO: 734895 - RNA, 22 nt, Human
acauucuacaguuaaccauuag

SEQ ID NO: 734896 - RNA, 22 nt, Human
aucagagucagaggcuagagcu

SEQ ID NO: 734897 - RNA, 23 nt, Human
augauguuuuugguagucaaaug

SEQ ID NO: 734898 - RNA, 22 nt, Human
gcugaggaaaggcuggaaggga

SEQ ID NO: 734899 - RNA, 22 nt, Human
gcacagagcuuguuuacauuug

SEQ ID NO: 734900 - RNA, 22 nt, Human
agggcagagcugucuaaauggc

SEQ ID NO: 734901 - RNA, 22 nt, Human
ugucacaaacauacauuauaga

SEQ ID NO: 734902 - RNA, 22 nt, Human
gaauauauuauucagcuuuuca

SEQ ID NO: 734903 - RNA, 22 nt, Human
cagagacccuaggcaggugaca

SEQ ID NO: 734904 - RNA, 21 nt, Human
agcacagcauauccaauguca

SEQ ID NO: 734905 - RNA, 20 nt, Human
auuccucagccccagccuca

SEQ ID NO: 734906 - RNA, 22 nt, Human
cuccuggaguccuuuccuauuc

SEQ ID NO: 734907 - RNA, 22 nt, Human
aguuacuuucugaucagugugu

SEQ ID NO: 734908 - RNA, 22 nt, Human
aagugcugagacuacaggcaug

SEQ ID NO: 734909 - RNA, 22 nt, Human
gggacgugagugaagaaggucu

SEQ ID NO: 734910 - RNA, 22 nt, Human
guaaacaagucuaccauuagaa

SEQ ID NO: 734911 - RNA, 22 nt, Human
aggcuggagacccgccaagaaa

SEQ ID NO: 734912 - RNA, 22 nt, Human
cagggcuucuuggcauuugcug

SEQ ID NO: 734913 - RNA, 22 nt, Human
auugcacaaagagggaaacuga

SEQ ID NO: 734914 - RNA, 22 nt, Human
cuucuggguguggagugaggac

SEQ ID NO: 734915 - RNA, 20 nt, Human
gccuggaggcagagauaaag

SEQ ID NO: 734916 - RNA, 22 nt, Human
uuccaggaagacaucucaggaa

SEQ ID NO: 734917 - RNA, 22 nt, Human
ugucacaugaagccaacauagc

SEQ ID NO: 734918 - RNA, 22 nt, Human
aagucacuugauuguugacaga

SEQ ID NO: 734919 - RNA, 22 nt, Human
ccuggcacacgguggcauucaa

SEQ ID NO: 734920 - RNA, 19 nt, Human
acugggcuuguccucgugg

SEQ ID NO: 734921 - RNA, 22 nt, Human
uaacacugguauuucauuuagu

SEQ ID NO: 734922 - RNA, 22 nt, Human
ucuggcaggucaaucauucuuu

SEQ ID NO: 734923 - RNA, 22 nt, Human
aguggccacugacuuggaaauc

SEQ ID NO: 734924 - RNA, 22 nt, Human
ugcagggaaucuguggcuggac

SEQ ID NO: 734925 - RNA, 22 nt, Human
aaguuuggggagaauuucauuu

SEQ ID NO: 734926 - RNA, 22 nt, Human
uuccaacuuugaaaauguuaug

SEQ ID NO: 734927 - RNA, 22 nt, Human
aagcaauauacugauaugauua

SEQ ID NO: 734928 - RNA, 22 nt, Human
uccagcagguguuugccaacuu

SEQ ID NO: 734929 - RNA, 22 nt, Human
uugcagcaaggucaugaaaugu

SEQ ID NO: 734930 - RNA, 22 nt, Human
caucagagguacuuaaugaaug

SEQ ID NO: 734931 - RNA, 20 nt, Human
uggcaggagccacuggaagc

SEQ ID NO: 734932 - RNA, 22 nt, Human
ggcaagucaggaaguugacauu

SEQ ID NO: 734933 - RNA, 22 nt, Human
uuuauuucuuaguuugccacag

SEQ ID NO: 734934 - RNA, 22 nt, Human
cuaggcugugcauugcaugaca

SEQ ID NO: 734935 - RNA, 22 nt, Human
uaaaaccaggucuugggauuua

SEQ ID NO: 734936 - RNA, 22 nt, Human
acagugcagggugggaagaagg

SEQ ID NO: 734937 - RNA, 22 nt, Human
agcaugaagacuucagagcuag

SEQ ID NO: 734938 - RNA, 22 nt, Human
ugcacguauggcaguggagccc

SEQ ID NO: 734939 - RNA, 22 nt, Human
ugcaaaugcccauuuauuuucu

SEQ ID NO: 734940 - RNA, 22 nt, Human
ccaaucuuguuuucuacaucca

SEQ ID NO: 734941 - RNA, 22 nt, Human
ccugcagguccccggaugcgca

SEQ ID NO: 734942 - RNA, 22 nt, Human
gucuccagcccacucuagauau

SEQ ID NO: 734943 - RNA, 22 nt, Human
auugaaaaaugacuauugcuua

SEQ ID NO: 734944 - RNA, 22 nt, Human
ugagccaggcacugcuccugga

SEQ ID NO: 734945 - RNA, 22 nt, Human
ugcuucuggaguaacaggguga

SEQ ID NO: 734946 - RNA, 22 nt, Human
auguguauuacccuuucauucc

SEQ ID NO: 734947 - RNA, 22 nt, Human
ucaggagcugugaauacaaagg

SEQ ID NO: 734948 - RNA, 22 nt, Human
agaguuaucacuccaugcagcu

SEQ ID NO: 734949 - RNA, 21 nt, Human
agcagacacuugugaccuucc

SEQ ID NO: 734950 - RNA, 22 nt, Human
ucccagggacaccaagcuguuu

SEQ ID NO: 734951 - RNA, 22 nt, Human
agaauaauacugaaaugcugaa

SEQ ID NO: 734952 - RNA, 22 nt, Human
ccaggaggaucauccuguuuuc

SEQ ID NO: 734953 - RNA, 22 nt, Human
uuugaaaucuaaucaaggaaca

SEQ ID NO: 734954 - RNA, 19 nt, Human
ggacaucacucuaagccuu

SEQ ID NO: 734955 - RNA, 22 nt, Human
ugcacagaugggcuuguucaua

SEQ ID NO: 734956 - RNA, 21 nt, Human
ccagcucugccuccaguuggu

SEQ ID NO: 734957 - RNA, 22 nt, Human
gaauauuaguaucaguuauacc

SEQ ID NO: 734958 - RNA, 22 nt, Human
agcuguguccugaagacacugc

SEQ ID NO: 734959 - RNA, 22 nt, Human
agaaauuccuaagguacacaag

SEQ ID NO: 734960 - RNA, 22 nt, Human
ggguccagagccucagcccaga

SEQ ID NO: 734961 - RNA, 22 nt, Human
agucaagguggaccagaaaaau

SEQ ID NO: 734962 - RNA, 22 nt, Human
caggacagugcagguccauccu

SEQ ID NO: 734963 - RNA, 22 nt, Human
ggacagagcccugguggccuaa

SEQ ID NO: 734964 - RNA, 22 nt, Human
gcauggccuugcuguaguggua

SEQ ID NO: 734965 - RNA, 22 nt, Human
gagcacagaacuaaaugcuggu

SEQ ID NO: 734966 - RNA, 22 nt, Human
ggcccugagcacagcuccucuc

SEQ ID NO: 734967 - RNA, 22 nt, Human
ggaagccaggcccagagaugcu

SEQ ID NO: 734968 - RNA, 22 nt, Human
ugccaaguuucucucagggacu

SEQ ID NO: 734969 - RNA, 17 nt, Human
ucuccaggacgagcuca

SEQ ID NO: 734970 - RNA, 22 nt, Human
uguguauagaaaguaggaaagg

SEQ ID NO: 734971 - RNA, 22 nt, Human
uggcagcaauuugugauguuga

SEQ ID NO: 734972 - RNA, 18 nt, Human
ugaucuuucaugauucca

SEQ ID NO: 734973 - RNA, 22 nt, Human
uacaguuuguuacauuguuagu

SEQ ID NO: 734974 - RNA, 22 nt, Human
agccaagguaucaugagaggca

SEQ ID NO: 734975 - RNA, 22 nt, Human
aagaauuuuccagcaugucagu

SEQ ID NO: 734976 - RNA, 22 nt, Human
uccacgugagcuucgugugcag

SEQ ID NO: 734977 - RNA, 22 nt, Human
cucuuuggucgcaucauccauu

SEQ ID NO: 734978 - RNA, 22 nt, Human
uucuggagucauuggggcugau

SEQ ID NO: 734979 - RNA, 22 nt, Human
aaucagcaggcuucuaaauuuu

SEQ ID NO: 734980 - RNA, 22 nt, Human
agcccugggcagccaaggaagc

SEQ ID NO: 734981 - RNA, 22 nt, Human
gggacaggccccucgcuagcuu

SEQ ID NO: 734982 - RNA, 22 nt, Human
aaaagcaaggcagucugucuga

SEQ ID NO: 734983 - RNA, 22 nt, Human
agcaccuguugcacuucauaau

SEQ ID NO: 734984 - RNA, 22 nt, Human
cuccagggggcauccacacagc

SEQ ID NO: 734985 - RNA, 20 nt, Human
cagcacagagcuuggcucua

SEQ ID NO: 734986 - RNA, 22 nt, Human
aaaagggaaagcagaaugacuu

SEQ ID NO: 734987 - RNA, 22 nt, Human
acuccagggaggugagugugcg

SEQ ID NO: 734988 - RNA, 22 nt, Human
caagggugguauugggagcaua

SEQ ID NO: 734989 - RNA, 19 nt, Human
ggaggccuggguauuugcc

SEQ ID NO: 734990 - RNA, 22 nt, Human
ugggcagagaucuggaucaaac

SEQ ID NO: 734991 - RNA, 22 nt, Human
agggcaguguggugggacugac

SEQ ID NO: 734992 - RNA, 22 nt, Human
ucuucaaaaaauauccaucagu

SEQ ID NO: 734993 - RNA, 22 nt, Human
uugccagauaggcaugaaaagu

SEQ ID NO: 734994 - RNA, 22 nt, Human
aguaucuuuacuuaaauaguca

SEQ ID NO: 734995 - RNA, 22 nt, Human
gcccugugcgcugaguucaggg

SEQ ID NO: 734996 - RNA, 22 nt, Human
acaggugucuaaggcagacagc

SEQ ID NO: 734997 - RNA, 22 nt, Human
agcaccaucagaugcaauaucu

SEQ ID NO: 734998 - RNA, 22 nt, Human
aauuaacaaauguagcugugau

SEQ ID NO: 734999 - RNA, 22 nt, Human
ucagcugcucuguugagcugaa

SEQ ID NO: 735000 - RNA, 22 nt, Human
gaggcuccuugaaagggggacu

SEQ ID NO: 735001 - RNA, 22 nt, Human
uccaagaaucagucucuuuugg

SEQ ID NO: 735002 - RNA, 22 nt, Human
aagagcuggaagugaagauaac

SEQ ID NO: 735003 - RNA, 22 nt, Human
ccaggagugcagggaugguauc

SEQ ID NO: 735004 - RNA, 22 nt, Human
auggcugggauuuccuuugcgu

SEQ ID NO: 735005 - RNA, 19 nt, Human
cuugaaaugagacugaagg

SEQ ID NO: 735006 - RNA, 22 nt, Human
uugcuuuugugugcucucugga

SEQ ID NO: 735007 - RNA, 22 nt, Human
agucccagccuaggcugugcug

SEQ ID NO: 735008 - RNA, 22 nt, Human
aaagagcauggaaaguucagga

SEQ ID NO: 735009 - RNA, 22 nt, Human
ugucugcugcccuggagccugg

SEQ ID NO: 735010 - RNA, 22 nt, Human
ucaggagguaggacauacuggu

SEQ ID NO: 735011 - RNA, 22 nt, Human
ucuaaguuuggugauuaccaau

SEQ ID NO: 735012 - RNA, 22 nt, Human
cugccaaaaggugcaccugcug

SEQ ID NO: 735013 - RNA, 22 nt, Human
agcaaagccgagacagccagug

SEQ ID NO: 735014 - RNA, 22 nt, Human
ggagagggggcucccugcuugg

SEQ ID NO: 735015 - RNA, 22 nt, Human
cugccugccuggagacagaugg

SEQ ID NO: 735016 - RNA, 22 nt, Human
aggcugaggcagguggaucauu

SEQ ID NO: 735017 - RNA, 22 nt, Human
uuacacaaaaauaagauauggc

SEQ ID NO: 735018 - RNA, 22 nt, Human
cugcagcaaauguuaagugacu

SEQ ID NO: 735019 - RNA, 17 nt, Human
gggcagggacuccuggg

SEQ ID NO: 735020 - RNA, 22 nt, Human
uauuuugcaaaccugaguuuga

SEQ ID NO: 735021 - RNA, 22 nt, Human
auggcucugcugggcaaagcaa

SEQ ID NO: 735022 - RNA, 22 nt, Human
uugugaucuguguugauggccu

SEQ ID NO: 735023 - RNA, 22 nt, Human
caguagcagggauuauuuuagg

SEQ ID NO: 735024 - RNA, 22 nt, Human
acauucaaaauuagguuaguug

SEQ ID NO: 735025 - RNA, 22 nt, Human
ucuuaaugaaagugaaauauca

SEQ ID NO: 735026 - RNA, 22 nt, Human
agugaaccaggcugcgucccug

SEQ ID NO: 735027 - RNA, 18 nt, Human
ccuggaggucuucggggu

SEQ ID NO: 735028 - RNA, 22 nt, Human
gugagagaauuugaguuaaauu

SEQ ID NO: 735029 - RNA, 20 nt, Human
gaagugucuuguuucuggau

SEQ ID NO: 735030 - RNA, 22 nt, Human
gcugccugccuaguuccacagu

SEQ ID NO: 735031 - RNA, 18 nt, Human
aaaaagugcucaggccua

SEQ ID NO: 735032 - RNA, 22 nt, Human
ugcuucugaugugagcagcccc

SEQ ID NO: 735033 - RNA, 22 nt, Human
uggagccacucacuaucugagu

SEQ ID NO: 735034 - RNA, 22 nt, Human
aaaugugauacuguucuuuuua

SEQ ID NO: 735035 - RNA, 22 nt, Human
gcauguggccuucaggcuggaa

SEQ ID NO: 735036 - RNA, 22 nt, Human
ugaggacaugagugggacagag

SEQ ID NO: 735037 - RNA, 22 nt, Human
aauaaugagacagcuuauuuaa

SEQ ID NO: 735038 - RNA, 22 nt, Human
uuagcuuucaugaaccuggucg

SEQ ID NO: 735039 - RNA, 22 nt, Human
ugcuggaggggaugccuucacu

SEQ ID NO: 735040 - RNA, 22 nt, Human
uagauucugugagagucaaagu

SEQ ID NO: 735041 - RNA, 22 nt, Human
ccacuccccacgugcugucaga

SEQ ID NO: 735042 - RNA, 22 nt, Human
aagcauuuugccacuugaaguu

SEQ ID NO: 735043 - RNA, 22 nt, Human
ucagcuaugagguggugguucu

SEQ ID NO: 735044 - RNA, 22 nt, Human
accaggcacuccugaggucuga

SEQ ID NO: 735045 - RNA, 22 nt, Human
caggcagcauuuacucugauga

SEQ ID NO: 735046 - RNA, 22 nt, Human
cuaaucaucuuucucuuaaagc

SEQ ID NO: 735047 - RNA, 22 nt, Human
uacuuccuguuuccaugucugu

SEQ ID NO: 735048 - RNA, 22 nt, Human
uacuuuacaguauuagauaauu

SEQ ID NO: 735049 - RNA, 18 nt, Human
gagcucugccucccaguc

SEQ ID NO: 735050 - RNA, 22 nt, Human
ucuggaguguuucuaauuacug

SEQ ID NO: 735051 - RNA, 22 nt, Human
ggcuucucuccaguaugcauuc

SEQ ID NO: 735052 - RNA, 22 nt, Human
uuauggaauuugcaaaagguua

SEQ ID NO: 735053 - RNA, 22 nt, Human
ccucuuccacugggccccaucc

SEQ ID NO: 735054 - RNA, 21 nt, Human
agaggaagugauuggucuggc

SEQ ID NO: 735055 - RNA, 20 nt, Human
cugcugcccugucagccucu

SEQ ID NO: 735056 - RNA, 22 nt, Human
cucuacucuuaacacagcuagg

SEQ ID NO: 735057 - RNA, 22 nt, Human
uuuaauuuuccugguaggccug

SEQ ID NO: 735058 - RNA, 22 nt, Human
uuuuugcuaauccccagccacu

SEQ ID NO: 735059 - RNA, 21 nt, Human
auggcugaugauauugaacau

SEQ ID NO: 735060 - RNA, 22 nt, Human
guaagcauucauugucuguaua

SEQ ID NO: 735061 - RNA, 22 nt, Human
gcaguguugagugguggcugaa

SEQ ID NO: 735062 - RNA, 22 nt, Human
cuguggaccugcucuuagagac

SEQ ID NO: 735063 - RNA, 22 nt, Human
uuucauauuguccagucagcgc

SEQ ID NO: 735064 - RNA, 22 nt, Human
ccucaagucaauucugucucgc

SEQ ID NO: 735065 - RNA, 22 nt, Human
ugcagaguccucuggagggacu

SEQ ID NO: 735066 - RNA, 22 nt, Human
ucaaaauuucagcacuagcccu

SEQ ID NO: 735067 - RNA, 22 nt, Human
aaacuguaaauacuaguaagug

SEQ ID NO: 735068 - RNA, 22 nt, Human
auaaggcauauagucacuuuuu

SEQ ID NO: 735069 - RNA, 22 nt, Human
ggaggcucccacgcagcucaca

SEQ ID NO: 735070 - RNA, 22 nt, Human
uuggcuaacacgcguuuuguuc

SEQ ID NO: 735071 - RNA, 22 nt, Human
uguuuguucccucucuuuccug

SEQ ID NO: 735072 - RNA, 22 nt, Human
acuuccagaauuagaauuuaag

SEQ ID NO: 735073 - RNA, 22 nt, Human
cugaacaaagaaauagucaugg

SEQ ID NO: 735074 - RNA, 20 nt, Human
ugagacccgcugacaaguuc

SEQ ID NO: 735075 - RNA, 22 nt, Human
uuccugagcuuuuaaccuaguc

SEQ ID NO: 735076 - RNA, 22 nt, Human
caugggagguuggcuuggcaug

SEQ ID NO: 735077 - RNA, 22 nt, Human
gaacagaguugaaacaaggcug

SEQ ID NO: 735078 - RNA, 22 nt, Human
caaugcuugcugacucccuguc

SEQ ID NO: 735079 - RNA, 22 nt, Human
gcauagucaguaggauucucaa

SEQ ID NO: 735080 - RNA, 22 nt, Human
ucuggccauggcaagccgagug

SEQ ID NO: 735081 - RNA, 22 nt, Human
gcuucagauuccucuucuguaa

SEQ ID NO: 735082 - RNA, 22 nt, Human
agacauaaacuuacugaaauac

SEQ ID NO: 735083 - RNA, 22 nt, Human
ucaaacuugguaagagaaauac

SEQ ID NO: 735084 - RNA, 22 nt, Human
cagaugagaguggccaggguuc

SEQ ID NO: 735085 - RNA, 22 nt, Human
acugggaaaaacugcuuugagg

SEQ ID NO: 735086 - RNA, 22 nt, Human
aaacaaauagugcaugggaauu

SEQ ID NO: 735087 - RNA, 19 nt, Human
acucuguuguacuugaggg

SEQ ID NO: 735088 - RNA, 22 nt, Human
aaaugcuauuugggaacaacau

SEQ ID NO: 735089 - RNA, 22 nt, Human
auacagaacaagccucaccucc

SEQ ID NO: 735090 - RNA, 17 nt, Human
ggaggcaacagacaggg

SEQ ID NO: 735091 - RNA, 22 nt, Human
cuuugaaagcucccaggacuua

SEQ ID NO: 735092 - RNA, 22 nt, Human
ggugggugagcccugggagcug

SEQ ID NO: 735093 - RNA, 22 nt, Human
gggagaaggaggacugugcugu

SEQ ID NO: 735094 - RNA, 22 nt, Human
uguaggcugaagaugaagugga

SEQ ID NO: 735095 - RNA, 22 nt, Human
aggaccauccuaagguaggcaa

SEQ ID NO: 735096 - RNA, 22 nt, Human
auaugaguuucccacuucugga

SEQ ID NO: 735097 - RNA, 21 nt, Human
gugguucuagagaaacagaau

SEQ ID NO: 735098 - RNA, 22 nt, Human
gaggccagaguuccccgaguca

SEQ ID NO: 735099 - RNA, 22 nt, Human
agagggaacggaucccagcgcg

SEQ ID NO: 735100 - RNA, 21 nt, Human
gcagagccugagguucuugag

SEQ ID NO: 735101 - RNA, 22 nt, Human
auggaaauccaagucaccguag

SEQ ID NO: 735102 - RNA, 22 nt, Human
ggccaagguggagaaggcacug

SEQ ID NO: 735103 - RNA, 21 nt, Human
gcucuguuauuuucuaugcag

SEQ ID NO: 735104 - RNA, 22 nt, Human
agacaaugucaaggugaucauc

SEQ ID NO: 735105 - RNA, 22 nt, Human
aguguuuacauugaagcuugua

SEQ ID NO: 735106 - RNA, 22 nt, Human
acaacuguuggaggaacacagg

SEQ ID NO: 735107 - RNA, 22 nt, Human
agguaguguagcugagugggau

SEQ ID NO: 735108 - RNA, 22 nt, Human
guggcagugggaugcuaucagg

SEQ ID NO: 735109 - RNA, 22 nt, Human
guugaaaguggagaaccugguu

SEQ ID NO: 735110 - RNA, 22 nt, Human
agaccuguuggguucauuggcu

SEQ ID NO: 735111 - RNA, 22 nt, Human
cuguccucaucugccccaaggg

SEQ ID NO: 735112 - RNA, 22 nt, Human
aucugcuugcaggcuggcccuu

SEQ ID NO: 735113 - RNA, 22 nt, Human
gguggaaggccuggaaggaggc

SEQ ID NO: 735114 - RNA, 22 nt, Human
aagucagugcuagcuaauggcu

SEQ ID NO: 735115 - RNA, 23 nt, Human
gaggucaaggcugcagugauugc

SEQ ID NO: 735116 - RNA, 22 nt, Human
uuugguccaaguuuuacucuuu

SEQ ID NO: 735117 - RNA, 21 nt, Human
agcagagugcuuugacuuugu

SEQ ID NO: 735118 - RNA, 22 nt, Human
aagaauugaugugaauugcagc

SEQ ID NO: 735119 - RNA, 22 nt, Human
ucagugugacugauggcuuuau

SEQ ID NO: 735120 - RNA, 22 nt, Human
aagcuucaucugaugccgaacu

SEQ ID NO: 735121 - RNA, 22 nt, Human
cugaaguuauuguacaaauuug

SEQ ID NO: 735122 - RNA, 22 nt, Human
ugaaaucuucacuaagucucuu

SEQ ID NO: 735123 - RNA, 22 nt, Human
accuuuuuguucuguucucagc

SEQ ID NO: 735124 - RNA, 17 nt, Human
aacaguaagcccuguuu

SEQ ID NO: 735125 - RNA, 22 nt, Human
cugguugggagguuggcuuuca

SEQ ID NO: 735126 - RNA, 22 nt, Human
auaugaagaauuccaauuugga

SEQ ID NO: 735127 - RNA, 22 nt, Human
ucuggaaucaguggcuuacccu

SEQ ID NO: 735128 - RNA, 22 nt, Human
aggcuaggggaacacuagaauc

SEQ ID NO: 735129 - RNA, 22 nt, Human
caauuauucagugacuuaagag

SEQ ID NO: 735130 - RNA, 22 nt, Human
aaagaauaguuaaguuuagggc

SEQ ID NO: 735131 - RNA, 22 nt, Human
aaggccagacaggaccacaucu

SEQ ID NO: 735132 - RNA, 22 nt, Human
aauguugcagagugauugucca

SEQ ID NO: 735133 - RNA, 22 nt, Human
cugggcugaaaguguuccuuga

SEQ ID NO: 735134 - RNA, 22 nt, Human
ccauccagaaacuuccaucccc

SEQ ID NO: 735135 - RNA, 17 nt, Human
ugcauguccuuuguucc

SEQ ID NO: 735136 - RNA, 19 nt, Human
uggcagaggacaaggacuu

SEQ ID NO: 735137 - RNA, 22 nt, Human
ugagcuggucuugaguguagcu

SEQ ID NO: 735138 - RNA, 22 nt, Human
gggucagggaggccccaccaug

SEQ ID NO: 735139 - RNA, 22 nt, Human
ucaagaugcauggguggcauaa

SEQ ID NO: 735140 - RNA, 22 nt, Human
cagcuguuaugagguguacaug

SEQ ID NO: 735141 - RNA, 22 nt, Human
gccuggagaagauggaacuagc

SEQ ID NO: 735142 - RNA, 22 nt, Human
cucaaauccccguuccucauuc

SEQ ID NO: 735143 - RNA, 22 nt, Human
ggcuguguccccaccugagcag

SEQ ID NO: 735144 - RNA, 22 nt, Human
acagacacaggcguggagucgc

SEQ ID NO: 735145 - RNA, 22 nt, Human
gagcugaaauaugaagccaauu

SEQ ID NO: 735146 - RNA, 22 nt, Human
aggugcagugaaggaaaaggaa

SEQ ID NO: 735147 - RNA, 22 nt, Human
aggagccaugagcaggaggcaa

SEQ ID NO: 735148 - RNA, 22 nt, Human
aaauggcaguagaaaagaaucc

SEQ ID NO: 735149 - RNA, 22 nt, Human
uaaaguguggauaugauuagua

SEQ ID NO: 735150 - RNA, 22 nt, Human
agcuuugggccacuggcuggau

SEQ ID NO: 735151 - RNA, 22 nt, Human
uuucagagccuuuaucucucua

SEQ ID NO: 735152 - RNA, 22 nt, Human
cauugcugugggcauuugcugc

SEQ ID NO: 735153 - RNA, 22 nt, Human
gucuugcacuuaccuaagaacu

SEQ ID NO: 735154 - RNA, 22 nt, Human
ugccaaauugcccuauaaauga

SEQ ID NO: 735155 - RNA, 22 nt, Human
ugcgccucuaaucucgggcguc

SEQ ID NO: 735156 - RNA, 18 nt, Human
acaaauguagugucuuaa

SEQ ID NO: 735157 - RNA, 22 nt, Human
aucauugaguaaaaugaauaca

SEQ ID NO: 735158 - RNA, 22 nt, Human
ucugcugaauggagccaaccuc

SEQ ID NO: 735159 - RNA, 22 nt, Human
caaugucuaguuucccaaaucc

SEQ ID NO: 735160 - RNA, 22 nt, Human
ugauucugugaauuaguugggu

SEQ ID NO: 735161 - RNA, 22 nt, Human
cagguucuggagaugcagagau

SEQ ID NO: 735162 - RNA, 22 nt, Human
augaagauuucccagagacaug

SEQ ID NO: 735163 - RNA, 22 nt, Human
cuuugcaaacugucacacuuuc

SEQ ID NO: 735164 - RNA, 22 nt, Human
cuguugcugggaacgcauguca

SEQ ID NO: 735165 - RNA, 22 nt, Human
uuggucagucagagaauggagu

SEQ ID NO: 735166 - RNA, 22 nt, Human
gcucccugcauuucccacccuu

SEQ ID NO: 735167 - RNA, 22 nt, Human
ugaauagauggugacaguauga

SEQ ID NO: 735168 - RNA, 22 nt, Human
uuuauugcccuguaguacagga

SEQ ID NO: 735169 - RNA, 22 nt, Human
ucccuguccugggcaaucccag

SEQ ID NO: 735170 - RNA, 22 nt, Human
cucaggcacuuuugucacagac

SEQ ID NO: 735171 - RNA, 22 nt, Human
aaucuuucauucauucauacau

SEQ ID NO: 735172 - RNA, 22 nt, Human
agggagcugagcugugagcagc

SEQ ID NO: 735173 - RNA, 22 nt, Human
uagcccaggcuguagugcagug

SEQ ID NO: 735174 - RNA, 22 nt, Human
gagcugaauuacggugagucau

SEQ ID NO: 735175 - RNA, 22 nt, Human
guauuaggaggaacacaggccu

SEQ ID NO: 735176 - RNA, 23 nt, Human
ugcuuaauuccucugcuucaccu

SEQ ID NO: 735177 - RNA, 22 nt, Human
ugauuuaugaccaaguuagaau

SEQ ID NO: 735178 - RNA, 22 nt, Human
gcaugagacuagcucaugagca

SEQ ID NO: 735179 - RNA, 23 nt, Human
gaguggggagaaauugguuaaac

SEQ ID NO: 735180 - RNA, 22 nt, Human
cugcuuuaaucccugccuggaa

SEQ ID NO: 735181 - RNA, 22 nt, Human
ugcuuuaaaauggacuguuuug

SEQ ID NO: 735182 - RNA, 22 nt, Human
ggccaggcugcugggaccccgc

SEQ ID NO: 735183 - RNA, 22 nt, Human
ugucugcugguugggagcuuaa

SEQ ID NO: 735184 - RNA, 22 nt, Human
gaacaucagucauaauuuaacg

SEQ ID NO: 735185 - RNA, 22 nt, Human
ccuggccagccagggcuggggu

SEQ ID NO: 735186 - RNA, 22 nt, Human
ucaagcaggguagcaagcuggu

SEQ ID NO: 735187 - RNA, 22 nt, Human
agagcccuguggacugucaagu

SEQ ID NO: 735188 - RNA, 22 nt, Human
uuugaagacauuugaauacuuu

SEQ ID NO: 735189 - RNA, 22 nt, Human
gggagaaggagcuaguucuuga

SEQ ID NO: 735190 - RNA, 20 nt, Human
gcugaggucccugugguuuu

SEQ ID NO: 735191 - RNA, 22 nt, Human
guucuucagauuccauuucagu

SEQ ID NO: 735192 - RNA, 22 nt, Human
aaaugacacuaggcuuuuugca

SEQ ID NO: 735193 - RNA, 22 nt, Human
uggagaguucuguagauaucua

SEQ ID NO: 735194 - RNA, 22 nt, Human
guuugccuuuuagauaggaaug

SEQ ID NO: 735195 - RNA, 22 nt, Human
ugggcucucuggcaggaaggcu

SEQ ID NO: 735196 - RNA, 22 nt, Human
guuuuaugagaccucaggaaua

SEQ ID NO: 735197 - RNA, 22 nt, Human
gaggacagcuuagggcuuccug

SEQ ID NO: 735198 - RNA, 22 nt, Human
guuuaugaauugcauucccuuu

SEQ ID NO: 735199 - RNA, 22 nt, Human
caagugacugugcuggcaacau

SEQ ID NO: 735200 - RNA, 22 nt, Human
acagccagaggugguccugggu

SEQ ID NO: 735201 - RNA, 22 nt, Human
uugaucagguugcuguggugua

SEQ ID NO: 735202 - RNA, 22 nt, Human
ucauaaaaugcuccugauauug

SEQ ID NO: 735203 - RNA, 22 nt, Human
guuugcugcccucuccuguccg

SEQ ID NO: 735204 - RNA, 22 nt, Human
ggcugccuacuuucccagaguu

SEQ ID NO: 735205 - RNA, 22 nt, Human
uaugaguucaguuaucuuaagu

SEQ ID NO: 735206 - RNA, 22 nt, Human
uuccuccuacgcuuaucacuuu

SEQ ID NO: 735207 - RNA, 22 nt, Human
uuuggaagggaaccaaaacaug

SEQ ID NO: 735208 - RNA, 22 nt, Human
ggucugggcuugaguccuuuug

SEQ ID NO: 735209 - RNA, 21 nt, Human
ucugggggugagccuagaaau

SEQ ID NO: 735210 - RNA, 20 nt, Human
cucugggucgagacagacuu

SEQ ID NO: 735211 - RNA, 22 nt, Human
aggcagauauuucaguucacau

SEQ ID NO: 735212 - RNA, 22 nt, Human
aaagcaugacucaagaauuacu

SEQ ID NO: 735213 - RNA, 22 nt, Human
cucuguuuuucaauaguucuug

SEQ ID NO: 735214 - RNA, 22 nt, Human
uguuuuaucaagauggcauguc

SEQ ID NO: 735215 - RNA, 22 nt, Human
aggcaagcagucagucuaugag

SEQ ID NO: 735216 - RNA, 22 nt, Human
ucugaagggcugaguggaggag

SEQ ID NO: 735217 - RNA, 22 nt, Human
cagguggcagugccugcauucu

SEQ ID NO: 735218 - RNA, 22 nt, Human
ggugcugauaguaacaauaaua

SEQ ID NO: 735219 - RNA, 22 nt, Human
ugccuauucaauauaugcauuu

SEQ ID NO: 735220 - RNA, 22 nt, Human
cagacaggguccuguccgucac

SEQ ID NO: 735221 - RNA, 22 nt, Human
ucucuuuaaagacucagagauu

SEQ ID NO: 735222 - RNA, 22 nt, Human
uuagcauucucauuugcauaaa

SEQ ID NO: 735223 - RNA, 22 nt, Human
cuuggaacuuaguaauaugaca

SEQ ID NO: 735224 - RNA, 22 nt, Human
aagagguuauuguucccagcuu

SEQ ID NO: 735225 - RNA, 22 nt, Human
uuuauauugggagucguuuuga

SEQ ID NO: 735226 - RNA, 22 nt, Human
uguccugcaagcccuaaugaau

SEQ ID NO: 735227 - RNA, 22 nt, Human
ggggugaguuagcgucggcuug

SEQ ID NO: 735228 - RNA, 22 nt, Human
auguauaugaagcuaguauuuu

SEQ ID NO: 735229 - RNA, 22 nt, Human
uacacacuuacuggagaugaag

SEQ ID NO: 735230 - RNA, 22 nt, Human
uaaaugugucuauggacccgcc

SEQ ID NO: 735231 - RNA, 22 nt, Human
aggauuuacaaugauucuaggu

SEQ ID NO: 735232 - RNA, 22 nt, Human
uacaacauuguguugcuucaua

SEQ ID NO: 735233 - RNA, 22 nt, Human
gcugaaggucucuggagagguc

SEQ ID NO: 735234 - RNA, 22 nt, Human
auuauguaacugugguucagca

SEQ ID NO: 735235 - RNA, 22 nt, Human
cuggcuuuuuucccauuaugca

SEQ ID NO: 735236 - RNA, 20 nt, Human
ugaugguucuuuccggguug

SEQ ID NO: 735237 - RNA, 22 nt, Human
uuccuuuucuuaaacauaugug

SEQ ID NO: 735238 - RNA, 22 nt, Human
acagagucugacagguaggcgc

SEQ ID NO: 735239 - RNA, 22 nt, Human
agugggcuuacugagggagugu

SEQ ID NO: 735240 - RNA, 22 nt, Human
gaugcugagagguggagggaac

SEQ ID NO: 735241 - RNA, 22 nt, Human
guuuaugaggaaaaguuaugau

SEQ ID NO: 735242 - RNA, 22 nt, Human
aguggcugucuuccaaaaucug

SEQ ID NO: 735243 - RNA, 22 nt, Human
uuggcagaggggccaccugccc

SEQ ID NO: 735244 - RNA, 22 nt, Human
cacagggcuuugauggcugagu

SEQ ID NO: 735245 - RNA, 22 nt, Human
guacccuguggccagccagcca

SEQ ID NO: 735246 - RNA, 22 nt, Human
cacacacuguuaauguaggagu

SEQ ID NO: 735247 - RNA, 22 nt, Human
gagucagauugcagacagggcu

SEQ ID NO: 735248 - RNA, 22 nt, Human
cagaaggcuuuguggaguagac

SEQ ID NO: 735249 - RNA, 17 nt, Human
ugacaaugacaagcacu

SEQ ID NO: 735250 - RNA, 21 nt, Human
ggccugaaaaagugaaugcuu

SEQ ID NO: 735251 - RNA, 22 nt, Human
cuggagcagcagguggccaggg

SEQ ID NO: 735252 - RNA, 22 nt, Human
cauuuuauccucugggaagcua

SEQ ID NO: 735253 - RNA, 22 nt, Human
uggcaguggugucugcacaggc

SEQ ID NO: 735254 - RNA, 22 nt, Human
ugcugaguauuuguuugaauaa

SEQ ID NO: 735255 - RNA, 22 nt, Human
cgccccucagcgacccaccagc

SEQ ID NO: 735256 - RNA, 22 nt, Human
gagcagagaauccagcuaagug

SEQ ID NO: 735257 - RNA, 22 nt, Human
gugcaaaaguaauugugguuuu

SEQ ID NO: 735258 - RNA, 22 nt, Human
ggauguucugggguucucuugu

SEQ ID NO: 735259 - RNA, 22 nt, Human
uugcauuucccauugaguaaug

SEQ ID NO: 735260 - RNA, 22 nt, Human
ccaggcccguucccuucuccag

SEQ ID NO: 735261 - RNA, 22 nt, Human
ucuagggaacaugggucaagcu

SEQ ID NO: 735262 - RNA, 22 nt, Human
agugggggcuggcucugucugu

SEQ ID NO: 735263 - RNA, 22 nt, Human
ugcugccuguuguggggccacg

SEQ ID NO: 735264 - RNA, 22 nt, Human
gaugcagggaacuuagugggcu

SEQ ID NO: 735265 - RNA, 22 nt, Human
ggaacuuuaggauccuggcuca

SEQ ID NO: 735266 - RNA, 22 nt, Human
accagcauugcuuuggguuaua

SEQ ID NO: 735267 - RNA, 22 nt, Human
uacaaaguuugagaaugcuuuc

SEQ ID NO: 735268 - RNA, 21 nt, Human
uaacuuuugugccuaucuugu

SEQ ID NO: 735269 - RNA, 22 nt, Human
ugagaagauugggcagagugga

SEQ ID NO: 735270 - RNA, 22 nt, Human
agcuccagauuaauuguaggag

SEQ ID NO: 735271 - RNA, 20 nt, Human
uccugggguaagccaugguc

SEQ ID NO: 735272 - RNA, 22 nt, Human
ccaguccauauuuauacugccg

SEQ ID NO: 735273 - RNA, 22 nt, Human
uccaucaccauuucugcgagcu

SEQ ID NO: 735274 - RNA, 22 nt, Human
uuugucauguccuuaacugucu

SEQ ID NO: 735275 - RNA, 22 nt, Human
agaauuguugggguaauaaaag

SEQ ID NO: 735276 - RNA, 22 nt, Human
gaccuggaaugaagggucccuc

SEQ ID NO: 735277 - RNA, 22 nt, Human
cagugcaaacucccugaggugg

SEQ ID NO: 735278 - RNA, 20 nt, Human
gccucagccaacccaugggg

SEQ ID NO: 735279 - RNA, 22 nt, Human
uucacagaagaggucacauuuc

SEQ ID NO: 735280 - RNA, 22 nt, Human
cccagggguauccauggagaag

SEQ ID NO: 735281 - RNA, 21 nt, Human
ggugggcacaggagagcagag

SEQ ID NO: 735282 - RNA, 20 nt, Human
uuccacaucuuugcacaugc

SEQ ID NO: 735283 - RNA, 22 nt, Human
acacaacagaagagcaauugca

SEQ ID NO: 735284 - RNA, 22 nt, Human
uccacaugacuucuaauaacug

SEQ ID NO: 735285 - RNA, 22 nt, Human
aauuccaaaucaacuagucuag

SEQ ID NO: 735286 - RNA, 22 nt, Human
acuuccuuuucaaccauacagc

SEQ ID NO: 735287 - RNA, 18 nt, Human
cuccaaggucucuggcuu

SEQ ID NO: 735288 - RNA, 22 nt, Human
ccagagggcccuggucucagcu

SEQ ID NO: 735289 - RNA, 22 nt, Human
gugcagagaaggagcaguaguu

SEQ ID NO: 735290 - RNA, 22 nt, Human
uggcuucaaaaucuaguggucu

SEQ ID NO: 735291 - RNA, 19 nt, Human
ggcagcuggacgcuguuca

SEQ ID NO: 735292 - RNA, 19 nt, Human
ggccagcacagggcucugu

SEQ ID NO: 735293 - RNA, 22 nt, Human
ugagcugugaggguacagauau

SEQ ID NO: 735294 - RNA, 21 nt, Human
ucugccugagacuuugcuggu

SEQ ID NO: 735295 - RNA, 22 nt, Human
aagggcagaauagagaagaugg

SEQ ID NO: 735296 - RNA, 22 nt, Human
aucuaagauuuugcuaagauca

SEQ ID NO: 735297 - RNA, 22 nt, Human
agaggcaccgucugcagcgugc

SEQ ID NO: 735298 - RNA, 22 nt, Human
auccuguguugcuacuggagga

SEQ ID NO: 735299 - RNA, 22 nt, Human
gcauguguggaggagaugugcu

SEQ ID NO: 735300 - RNA, 22 nt, Human
guggcagcggcccaggccgucu

SEQ ID NO: 735301 - RNA, 22 nt, Human
acagcaguuacugaaauaaagu

SEQ ID NO: 735302 - RNA, 19 nt, Human
augugcuugggccaugcua

SEQ ID NO: 735303 - RNA, 22 nt, Human
ugucaccacuggcugaaacacc

SEQ ID NO: 735304 - RNA, 22 nt, Human
guggaauguccuugaucauaag

SEQ ID NO: 735305 - RNA, 22 nt, Human
uagauucuugaaccagugccuc

SEQ ID NO: 735306 - RNA, 22 nt, Human
gaucuauuuacucuuuuccuag

SEQ ID NO: 735307 - RNA, 22 nt, Human
ugucugaacugcauuugcuccu

SEQ ID NO: 735308 - RNA, 22 nt, Human
agcagggcuuugucucugugaa

SEQ ID NO: 735309 - RNA, 23 nt, Human
cacugggcccaggguguggaggc

SEQ ID NO: 735310 - RNA, 22 nt, Human
aaacaaguuuagaauaaugaau

SEQ ID NO: 735311 - RNA, 22 nt, Human
aagcccugaccugagaguccgu

SEQ ID NO: 735312 - RNA, 22 nt, Human
guucauucaucaaauauuuacu

SEQ ID NO: 735313 - RNA, 22 nt, Human
ugccugccucaggccgagugcu

SEQ ID NO: 735314 - RNA, 22 nt, Human
uuaaagccaucuagauuuugag

SEQ ID NO: 735315 - RNA, 22 nt, Human
gugggcuuguuuugaugagauc

SEQ ID NO: 735316 - RNA, 22 nt, Human
cugaaggacacgugaggagcca

SEQ ID NO: 735317 - RNA, 22 nt, Human
ucccagccuuaucuccccuggc

SEQ ID NO: 735318 - RNA, 22 nt, Human
cuccuccagcuuccaguggcuc

SEQ ID NO: 735319 - RNA, 22 nt, Human
guuugcauuucuugaacuauau

SEQ ID NO: 735320 - RNA, 22 nt, Human
agaguguuucagucuuccuaga

SEQ ID NO: 735321 - RNA, 22 nt, Human
uuuugccugugaauacuaucuu

SEQ ID NO: 735322 - RNA, 22 nt, Human
uacauuccacaagcauugcuuu

SEQ ID NO: 735323 - RNA, 22 nt, Human
auuucagauucagaaauguagg

SEQ ID NO: 735324 - RNA, 18 nt, Human
augcauauuuuaaguugu

SEQ ID NO: 735325 - RNA, 22 nt, Human
uggagucacuuucucuuccagu

SEQ ID NO: 735326 - RNA, 22 nt, Human
cacccugcucugcugugcggcc

SEQ ID NO: 735327 - RNA, 22 nt, Human
ggagguggagcuggaaguucca

SEQ ID NO: 735328 - RNA, 22 nt, Human
ucucuuccuugaccuauuguaa

SEQ ID NO: 735329 - RNA, 22 nt, Human
gaaugcacuuccaacaucuauu

SEQ ID NO: 735330 - RNA, 22 nt, Human
augcuaaauggccaguaccaaa

SEQ ID NO: 735331 - RNA, 19 nt, Human
uuuggacagaguguccagg

SEQ ID NO: 735332 - RNA, 22 nt, Human
uuuuaguaccaaccagaagaug

SEQ ID NO: 735333 - RNA, 22 nt, Human
gcuguauuuauaugaaggcaug

SEQ ID NO: 735334 - RNA, 22 nt, Human
uauggcuucuauaaggaagcuu

SEQ ID NO: 735335 - RNA, 22 nt, Human
ggcagcaugagccuggugaauu

SEQ ID NO: 735336 - RNA, 22 nt, Human
caauuucauggauaaaagaugu

SEQ ID NO: 735337 - RNA, 22 nt, Human
cagcccugggaucuuagugccu

SEQ ID NO: 735338 - RNA, 18 nt, Human
uuucacagauucaugacu

SEQ ID NO: 735339 - RNA, 22 nt, Human
uacaaucaggcucuagcuucuc

SEQ ID NO: 735340 - RNA, 21 nt, Human
uggggaggggaccugauuaug

SEQ ID NO: 735341 - RNA, 21 nt, Human
uacuguauagauguguucuug

SEQ ID NO: 735342 - RNA, 22 nt, Human
uuucagagggcagaucuggggc

SEQ ID NO: 735343 - RNA, 22 nt, Human
uagcagcacaaauggacuauga

SEQ ID NO: 735344 - RNA, 22 nt, Human
uauuuuguauuuaugcaagaaa

SEQ ID NO: 735345 - RNA, 22 nt, Human
agaagucauuuauguuagauga

SEQ ID NO: 735346 - RNA, 22 nt, Human
ccagugggugcugggcucugcc

SEQ ID NO: 735347 - RNA, 19 nt, Human
uguuuacauguuucuucag

SEQ ID NO: 735348 - RNA, 22 nt, Human
uuucuuuauccuccuuugcaca

SEQ ID NO: 735349 - RNA, 20 nt, Human
uuuuucugggcuuccauagc

SEQ ID NO: 735350 - RNA, 22 nt, Human
auggaagggacagaagggcaag

SEQ ID NO: 735351 - RNA, 22 nt, Human
gguuuaaugggugaaggcauga

SEQ ID NO: 735352 - RNA, 22 nt, Human
uauuucagcaagaagaaugugg

SEQ ID NO: 735353 - RNA, 22 nt, Human
ugaagaugucagcagggguggu

SEQ ID NO: 735354 - RNA, 22 nt, Human
uucaaacaggggucagggagau

SEQ ID NO: 735355 - RNA, 22 nt, Human
gccaccuguaagccauuaggcc

SEQ ID NO: 735356 - RNA, 20 nt, Human
cugggcugcccagcuauggg

SEQ ID NO: 735357 - RNA, 23 nt, Human
augcaagaguuucucaaacugga

SEQ ID NO: 735358 - RNA, 22 nt, Human
gaaagcaguaaaugggucccau

SEQ ID NO: 735359 - RNA, 22 nt, Human
gaugcagggcuggcaggagcuu

SEQ ID NO: 735360 - RNA, 22 nt, Human
gaguggggcuuuaaaggcucag

SEQ ID NO: 735361 - RNA, 22 nt, Human
gcucugcuaauauuguaguacc

SEQ ID NO: 735362 - RNA, 22 nt, Human
uguagaacugacauuuuggacu

SEQ ID NO: 735363 - RNA, 22 nt, Human
gaauaguucuauggcugcaggg

SEQ ID NO: 735364 - RNA, 22 nt, Human
ucacuguagugagcagaauaua

SEQ ID NO: 735365 - RNA, 22 nt, Human
ugcauuaugcuacccagaagcu

SEQ ID NO: 735366 - RNA, 22 nt, Human
uuuggagagcagcuaggcccuu

SEQ ID NO: 735367 - RNA, 22 nt, Human
ucaggcagaauuaucaaaagau

SEQ ID NO: 735368 - RNA, 22 nt, Human
ggccagcauauagagugaagua

SEQ ID NO: 735369 - RNA, 21 nt, Human
ccuuggcuggcaucuagcacc

SEQ ID NO: 735370 - RNA, 22 nt, Human
cagggauggagagacuacuggc

SEQ ID NO: 735371 - RNA, 22 nt, Human
uauugcauccccauugugcccc

SEQ ID NO: 735372 - RNA, 22 nt, Human
ucaauguccgggccccauucca

SEQ ID NO: 735373 - RNA, 22 nt, Human
gagauucuguagucaggcaucu

SEQ ID NO: 735374 - RNA, 22 nt, Human
ucugugagaaccagugccaggg

SEQ ID NO: 735375 - RNA, 22 nt, Human
uaagagcauaggcuugaaaaua

SEQ ID NO: 735376 - RNA, 22 nt, Human
uuuagguuaaucaacaaacauu

SEQ ID NO: 735377 - RNA, 22 nt, Human
ugggccuggggcagcccaaauc

SEQ ID NO: 735378 - RNA, 22 nt, Human
ggcaaggaagaagccaugaugu

SEQ ID NO: 735379 - RNA, 22 nt, Human
gaccugaaagagauuaaaugac

SEQ ID NO: 735380 - RNA, 22 nt, Human
ucugacagucacaguggaggau

SEQ ID NO: 735381 - RNA, 22 nt, Human
ugugugugugcgcgcacgcaua

SEQ ID NO: 735382 - RNA, 22 nt, Human
ucagccugcgucauggugacac

SEQ ID NO: 735383 - RNA, 22 nt, Human
uaucuguuugcucacagguguu

SEQ ID NO: 735384 - RNA, 20 nt, Human
uccuucaggcagggccuagu

SEQ ID NO: 735385 - RNA, 22 nt, Human
uugcagagcaguaggaauauag

SEQ ID NO: 735386 - RNA, 22 nt, Human
uuugacaacugugcaguuugua

SEQ ID NO: 735387 - RNA, 22 nt, Human
gcagagauuaugccauggaaag

SEQ ID NO: 735388 - RNA, 22 nt, Human
ugauucuguaaacaugucuuua

SEQ ID NO: 735389 - RNA, 22 nt, Human
gauggcagucaaccaggugagg

SEQ ID NO: 735390 - RNA, 22 nt, Human
aaguagugugcuccagcgguga

SEQ ID NO: 735391 - RNA, 22 nt, Human
ggcuggaaugcaacuguguguu

SEQ ID NO: 735392 - RNA, 22 nt, Human
uucaaagcugcagacuccuggg

SEQ ID NO: 735393 - RNA, 22 nt, Human
cccaggcaguagaaagaagagg

SEQ ID NO: 735394 - RNA, 22 nt, Human
augugcuugaagccucagagaa

SEQ ID NO: 735395 - RNA, 18 nt, Human
gagcccugagucugcaca

SEQ ID NO: 735396 - RNA, 22 nt, Human
uauuucaugugcaccauaauuc

SEQ ID NO: 735397 - RNA, 21 nt, Human
auacuuugaauuacagccuug

SEQ ID NO: 735398 - RNA, 22 nt, Human
ugcaaauagccuauauuuauag

SEQ ID NO: 735399 - RNA, 22 nt, Human
ccuccagguguuacauaugacu

SEQ ID NO: 735400 - RNA, 22 nt, Human
cucucccuagguuagcggucag

SEQ ID NO: 735401 - RNA, 22 nt, Human
cauacagagaaggauaauaaag

SEQ ID NO: 735402 - RNA, 22 nt, Human
cucaggaaaggccaugcaaggg

SEQ ID NO: 735403 - RNA, 22 nt, Human
agacugugccacacaugggagu

SEQ ID NO: 735404 - RNA, 22 nt, Human
guguaucaaagcacagacuuca

SEQ ID NO: 735405 - RNA, 22 nt, Human
uuaggaaauuaugguuucagau

SEQ ID NO: 735406 - RNA, 23 nt, Human
gucucccauagcgcucccaggcu

SEQ ID NO: 735407 - RNA, 22 nt, Human
gaguccagcagaaugagccaag

SEQ ID NO: 735408 - RNA, 22 nt, Human
agauggagucucacucuuguug

SEQ ID NO: 735409 - RNA, 22 nt, Human
ugugggaggaacacagccagaa

SEQ ID NO: 735410 - RNA, 22 nt, Human
ugagccguggucucugagggug

SEQ ID NO: 735411 - RNA, 22 nt, Human
aggcaccuugcgguccagugaa

SEQ ID NO: 735412 - RNA, 22 nt, Human
agcaggcagccauuuggaaggc

SEQ ID NO: 735413 - RNA, 22 nt, Human
ggcaauaguuguggguucuuua

SEQ ID NO: 735414 - RNA, 22 nt, Human
gaugucuuugccaugcaugugu

SEQ ID NO: 735415 - RNA, 22 nt, Human
auauaaagaaguggaaaaugag

SEQ ID NO: 735416 - RNA, 22 nt, Human
auguuucugaguguauauacau

SEQ ID NO: 735417 - RNA, 22 nt, Human
ggugggcacauucagucucugu

SEQ ID NO: 735418 - RNA, 19 nt, Human
gcugugugaccuugggcaa

SEQ ID NO: 735419 - RNA, 20 nt, Human
aggcugggguguuuugccca

SEQ ID NO: 735420 - RNA, 22 nt, Human
agaaaacuggagccugggguug

SEQ ID NO: 735421 - RNA, 22 nt, Human
gaacacagucaagggcugcugu

SEQ ID NO: 735422 - RNA, 22 nt, Human
gcucagagguuguucuuggguu

SEQ ID NO: 735423 - RNA, 22 nt, Human
aaauugcuguugggugacucuu

SEQ ID NO: 735424 - RNA, 22 nt, Human
ucacucuguguuugaacucaag

SEQ ID NO: 735425 - RNA, 22 nt, Human
cuggaagaccccccaggacuca

SEQ ID NO: 735426 - RNA, 22 nt, Human
ugugcauguauugauuuguacc

SEQ ID NO: 735427 - RNA, 22 nt, Human
guagcagagcugagaguggaac

SEQ ID NO: 735428 - RNA, 22 nt, Human
agcugcuuauaagauuugggag

SEQ ID NO: 735429 - RNA, 21 nt, Human
uaucagaagagaaagaaugau

SEQ ID NO: 735430 - RNA, 22 nt, Human
aagggagacccaccguccugga

SEQ ID NO: 735431 - RNA, 22 nt, Human
caguagcaggcacucagcacgu

SEQ ID NO: 735432 - RNA, 22 nt, Human
uguaucaaaccaaauuaauucu

SEQ ID NO: 735433 - RNA, 22 nt, Human
uuucucugugggcuuuaugcau

SEQ ID NO: 735434 - RNA, 22 nt, Human
uugcugauuuguuucuauucca

SEQ ID NO: 735435 - RNA, 22 nt, Human
gcuggguauuuuaagaaaggaa

SEQ ID NO: 735436 - RNA, 22 nt, Human
uuaacauuucuuuuccacucau

SEQ ID NO: 735437 - RNA, 22 nt, Human
cuaggccaguuaggaagagaag

SEQ ID NO: 735438 - RNA, 22 nt, Human
uggauugauaaaaugggauguu

SEQ ID NO: 735439 - RNA, 22 nt, Human
aaugagggggaugggaaagugu

SEQ ID NO: 735440 - RNA, 22 nt, Human
gggcuggggcucaauaauuugu

SEQ ID NO: 735441 - RNA, 22 nt, Human
cagaggcucaccagccuuucac

SEQ ID NO: 735442 - RNA, 22 nt, Human
acaaugcaccuauuuuaaaacu

SEQ ID NO: 735443 - RNA, 22 nt, Human
uaggugugggcucaggaaugug

SEQ ID NO: 735444 - RNA, 22 nt, Human
guccucuguuuccaucugacuu

SEQ ID NO: 735445 - RNA, 22 nt, Human
gggcuucucuuuagugagcuga

SEQ ID NO: 735446 - RNA, 19 nt, Human
gaucuuugccaauuuaagc

SEQ ID NO: 735447 - RNA, 22 nt, Human
guggcugcaguaguguaggguc

SEQ ID NO: 735448 - RNA, 22 nt, Human
cagugcaguggcugagcuggag

SEQ ID NO: 735449 - RNA, 22 nt, Human
uagaaucauugagaauaacagg

SEQ ID NO: 735450 - RNA, 22 nt, Human
ugcucuguauucuauggcaguu

SEQ ID NO: 735451 - RNA, 22 nt, Human
ccagugcacagccaggcaggug

SEQ ID NO: 735452 - RNA, 22 nt, Human
cccauggcaauaaggucacagg

SEQ ID NO: 735453 - RNA, 22 nt, Human
uuucuuggaugugaaacuaggg

SEQ ID NO: 735454 - RNA, 20 nt, Human
uucacauuucuguagugauu

SEQ ID NO: 735455 - RNA, 22 nt, Human
cugaaugccugcagagccagag

SEQ ID NO: 735456 - RNA, 22 nt, Human
gacauuuaauaguauuguggga

SEQ ID NO: 735457 - RNA, 22 nt, Human
ucuuccuugcuccuugucacuu

SEQ ID NO: 735458 - RNA, 22 nt, Human
gaaccaaguaggauacaaggag

SEQ ID NO: 735459 - RNA, 22 nt, Human
ugaagaauguugcagugagcau

SEQ ID NO: 735460 - RNA, 22 nt, Human
acaacugggggcauuacuggca

SEQ ID NO: 735461 - RNA, 22 nt, Human
cccacugcugcucuccauggca

SEQ ID NO: 735462 - RNA, 22 nt, Human
aagucagacagcugagcugccu

SEQ ID NO: 735463 - RNA, 22 nt, Human
ccuuuggcauuuugaggaugcg

SEQ ID NO: 735464 - RNA, 22 nt, Human
agacugggauucucccugauca

SEQ ID NO: 735465 - RNA, 22 nt, Human
uggucaaaagcuacuaugaaug

SEQ ID NO: 735466 - RNA, 22 nt, Human
ugucccaguuuugcagguuaga

SEQ ID NO: 735467 - RNA, 22 nt, Human
gcuccagcucuguucuggggaa

SEQ ID NO: 735468 - RNA, 22 nt, Human
auccauuuguaaauguuagagu

SEQ ID NO: 735469 - RNA, 22 nt, Human
cuugcuuguuuaguucacagau

SEQ ID NO: 735470 - RNA, 22 nt, Human
gaugugugugcccugggccugc

SEQ ID NO: 735471 - RNA, 22 nt, Human
ucaguuuucucaucugugaaau

SEQ ID NO: 735472 - RNA, 22 nt, Human
cauucacaauaguugaaaggug

SEQ ID NO: 735473 - RNA, 22 nt, Human
acaagucuuuuucaugucuucu

SEQ ID NO: 735474 - RNA, 22 nt, Human
ucauuguuauguuuugcugucu

SEQ ID NO: 735475 - RNA, 22 nt, Human
cccaggagguggaguucacagu

SEQ ID NO: 735476 - RNA, 22 nt, Human
gagaguuccaguaaguggauuc

SEQ ID NO: 735477 - RNA, 21 nt, Human
agcagacugaauacauucuua

SEQ ID NO: 735478 - RNA, 22 nt, Human
ggugccagugggucucaggaua

SEQ ID NO: 735479 - RNA, 19 nt, Human
cacauacagaaaagaguaa

SEQ ID NO: 735480 - RNA, 20 nt, Human
cccugagacaaaggaggggc

SEQ ID NO: 735481 - RNA, 22 nt, Human
uccaggcucucaggugucagca

SEQ ID NO: 735482 - RNA, 22 nt, Human
gaggucugccuucaggagaguu

SEQ ID NO: 735483 - RNA, 22 nt, Human
aggucugaguagagaaaaggca

SEQ ID NO: 735484 - RNA, 22 nt, Human
agcagcacauggggcuggcaac

SEQ ID NO: 735485 - RNA, 22 nt, Human
guguggcaaggugagaaguggg

SEQ ID NO: 735486 - RNA, 22 nt, Human
uggcagcacuagguacugagcu

SEQ ID NO: 735487 - RNA, 22 nt, Human
agccucugucaagcuuuucaaa

SEQ ID NO: 735488 - RNA, 22 nt, Human
aguguuuagggaaucaaggggu

SEQ ID NO: 735489 - RNA, 22 nt, Human
uuucucucuauuuagacaggua

SEQ ID NO: 735490 - RNA, 22 nt, Human
gcucauucagccagggcccggu

SEQ ID NO: 735491 - RNA, 22 nt, Human
accagcugaacugcagcccagg

SEQ ID NO: 735492 - RNA, 22 nt, Human
gucugaaugaugagugggacuc

SEQ ID NO: 735493 - RNA, 22 nt, Human
gucccagaggcuuuggccacag

SEQ ID NO: 735494 - RNA, 22 nt, Human
agcaggcauagaguagcacuca

SEQ ID NO: 735495 - RNA, 22 nt, Human
uuggaaggauuuagagaugucu

SEQ ID NO: 735496 - RNA, 22 nt, Human
uucauugauuccaggcucuucu

SEQ ID NO: 735497 - RNA, 23 nt, Human
cccagcugcagacaagggagggu

SEQ ID NO: 735498 - RNA, 22 nt, Human
aguuccaccauuuaggaucugu

SEQ ID NO: 735499 - RNA, 22 nt, Human
ugugugcauucacaugcaugcc

SEQ ID NO: 735500 - RNA, 22 nt, Human
aaagauguuuuacauagcaccu

SEQ ID NO: 735501 - RNA, 22 nt, Human
auguaaacuacugacuacacua

SEQ ID NO: 735502 - RNA, 22 nt, Human
uaaaccauucagacugaaccac

SEQ ID NO: 735503 - RNA, 22 nt, Human
acacaauacagggcucaaaaua

SEQ ID NO: 735504 - RNA, 22 nt, Human
uuucacauuggcuucuauuucu

SEQ ID NO: 735505 - RNA, 22 nt, Human
auuugucuaaugaguguguacu

SEQ ID NO: 735506 - RNA, 22 nt, Human
guuuccaggcuuugguaugguu

SEQ ID NO: 735507 - RNA, 22 nt, Human
gaagcugaugaggaccagauug

SEQ ID NO: 735508 - RNA, 22 nt, Human
gggagguguucugccaacgcgg

SEQ ID NO: 735509 - RNA, 22 nt, Human
accagaaggaccagaggcaagg

SEQ ID NO: 735510 - RNA, 22 nt, Human
ugcuuuuauuuaauaucuugca

SEQ ID NO: 735511 - RNA, 22 nt, Human
uucucuuuauguauuuaguggg

SEQ ID NO: 735512 - RNA, 22 nt, Human
uggcucagugacauuccuccca

SEQ ID NO: 735513 - RNA, 22 nt, Human
gggcuguguaaugugcucuuuu

SEQ ID NO: 735514 - RNA, 22 nt, Human
cagcaccagcauauuccagggc

SEQ ID NO: 735515 - RNA, 22 nt, Human
uucuggaaaugcacaacuaauu

SEQ ID NO: 735516 - RNA, 22 nt, Human
auggcaggauacccaguccggc

SEQ ID NO: 735517 - RNA, 22 nt, Human
ccugagcauuagacauccauca

SEQ ID NO: 735518 - RNA, 22 nt, Human
cuauauucuggaauguccauuu

SEQ ID NO: 735519 - RNA, 22 nt, Human
ucaacacuggcuacaguuaugc

SEQ ID NO: 735520 - RNA, 22 nt, Human
ugcccugccaagacucaguggu

SEQ ID NO: 735521 - RNA, 22 nt, Human
aaauuguaggaucacaugaccu

SEQ ID NO: 735522 - RNA, 22 nt, Human
gcaaagacggacucaggagugc

SEQ ID NO: 735523 - RNA, 22 nt, Human
uccagucucuacucugagauaa

SEQ ID NO: 735524 - RNA, 22 nt, Human
ugagcugcagugagcugagaug

SEQ ID NO: 735525 - RNA, 22 nt, Human
cagcaggugggcuuugcggaug

SEQ ID NO: 735526 - RNA, 22 nt, Human
auugucaucgauguuagccagu

SEQ ID NO: 735527 - RNA, 22 nt, Human
agcagggcccacuaggggagau

SEQ ID NO: 735528 - RNA, 22 nt, Human
gauggguggguucugugagagg

SEQ ID NO: 735529 - RNA, 21 nt, Human
gcaaggccuaucauggcagcu

SEQ ID NO: 735530 - RNA, 22 nt, Human
uuauuuguggcauaugagacga

SEQ ID NO: 735531 - RNA, 22 nt, Human
ugggaaugugagcauucauuca

SEQ ID NO: 735532 - RNA, 22 nt, Human
cuauuugucaguuuggcuuuaa

SEQ ID NO: 735533 - RNA, 22 nt, Human
aggcucugcagugcuggaggac

SEQ ID NO: 735534 - RNA, 22 nt, Human
uucagcagucguccaggaaaag

SEQ ID NO: 735535 - RNA, 16 nt, Human
ccucuggcaauuagau

SEQ ID NO: 735536 - RNA, 22 nt, Human
ggcugccacgucgaggguccaa

SEQ ID NO: 735537 - RNA, 22 nt, Human
uauguacaagcacacaugugac

SEQ ID NO: 735538 - RNA, 22 nt, Human
cuccguuuuugaccggcacuga

SEQ ID NO: 735539 - RNA, 22 nt, Human
agcaggaaggcuuuggggguuc

SEQ ID NO: 735540 - RNA, 22 nt, Human
auugaagagaagcuaaauagag

SEQ ID NO: 735541 - RNA, 22 nt, Human
auaugugugcacauauguauuu

SEQ ID NO: 735542 - RNA, 22 nt, Human
cagggacagagacugcaccuug

SEQ ID NO: 735543 - RNA, 22 nt, Human
ggggagcaggcugggcugucug

SEQ ID NO: 735544 - RNA, 21 nt, Human
uucaguuucuuccucaucuau

SEQ ID NO: 735545 - RNA, 22 nt, Human
aagcacuuagaagagugccugc

SEQ ID NO: 735546 - RNA, 22 nt, Human
cuucauaucucuguagaguuuu

SEQ ID NO: 735547 - RNA, 22 nt, Human
gcaccacuagaguagagauggu

SEQ ID NO: 735548 - RNA, 23 nt, Human
guggagccacaucacaggcuccu

SEQ ID NO: 735549 - RNA, 22 nt, Human
ugcacuccaggcugggugacag

SEQ ID NO: 735550 - RNA, 22 nt, Human
ugcacaccucuccaccacucuc

SEQ ID NO: 735551 - RNA, 22 nt, Human
gcuggcucaagugugcuuccca

SEQ ID NO: 735552 - RNA, 22 nt, Human
uggaagccucaguuugccuucu

SEQ ID NO: 735553 - RNA, 22 nt, Human
aggaaucugugguuuuaacagg

SEQ ID NO: 735554 - RNA, 22 nt, Human
acuugccccagaauugcugcug

SEQ ID NO: 735555 - RNA, 22 nt, Human
uuuucauugagcaccugaguaa

SEQ ID NO: 735556 - RNA, 22 nt, Human
aguaauaauuuauauuagggag

SEQ ID NO: 735557 - RNA, 22 nt, Human
aguuucuuuagauagaaaguuc

SEQ ID NO: 735558 - RNA, 22 nt, Human
gaaggcugagcagacaggccaa

SEQ ID NO: 735559 - RNA, 22 nt, Human
agagacuguguccaucgugccu

SEQ ID NO: 735560 - RNA, 22 nt, Human
caguuaccagaucgcaggaggu

SEQ ID NO: 735561 - RNA, 22 nt, Human
cuguuuaaugagguguaacaac

SEQ ID NO: 735562 - RNA, 22 nt, Human
agaggcucuaauccccuccaca

SEQ ID NO: 735563 - RNA, 22 nt, Human
aaaugcauuaagucagaacaau

SEQ ID NO: 735564 - RNA, 22 nt, Human
auuucuauaggaggacaguauu

SEQ ID NO: 735565 - RNA, 22 nt, Human
ucaggaaauggaauucuugugu

SEQ ID NO: 735566 - RNA, 22 nt, Human
aggaaagugaauguuauuuugc

SEQ ID NO: 735567 - RNA, 22 nt, Human
uuguguuaaggugcaucuagug

SEQ ID NO: 735568 - RNA, 22 nt, Human
guaggccagugugaaaccuggu

SEQ ID NO: 735569 - RNA, 22 nt, Human
cagaggggauaacagguguaga

SEQ ID NO: 735570 - RNA, 22 nt, Human
cuaaacauguagcuuuuguggu

SEQ ID NO: 735571 - RNA, 22 nt, Human
ugucgauucagcucuucagaga

SEQ ID NO: 735572 - RNA, 22 nt, Human
gacugagggauagaggugcuuc

SEQ ID NO: 735573 - RNA, 22 nt, Human
aaacugaggaacaaggaaggau

SEQ ID NO: 735574 - RNA, 22 nt, Human
ucaggcuguuccuguccaaaau

SEQ ID NO: 735575 - RNA, 19 nt, Human
uuuagaaguugaaacucug

SEQ ID NO: 735576 - RNA, 22 nt, Human
uggaggcaggggauacagguca

SEQ ID NO: 735577 - RNA, 22 nt, Human
ucugagaguccaucuccaagcc

SEQ ID NO: 735578 - RNA, 22 nt, Human
agggcucagaaaugucuacggg

SEQ ID NO: 735579 - RNA, 22 nt, Human
aaagucaggcuguguaccuaac

SEQ ID NO: 735580 - RNA, 22 nt, Human
ugagcugguucuugaggcauga

SEQ ID NO: 735581 - RNA, 22 nt, Human
ucccugaggaagggguguggug

SEQ ID NO: 735582 - RNA, 22 nt, Human
gccacagggcagaugcgcagag

SEQ ID NO: 735583 - RNA, 22 nt, Human
cagacacacacccuggccuagc

SEQ ID NO: 735584 - RNA, 23 nt, Human
ggcugagaagucccaugauaggu

SEQ ID NO: 735585 - RNA, 22 nt, Human
aacaugugucuugcauuucuug

SEQ ID NO: 735586 - RNA, 22 nt, Human
uggccucaaccguccuaagcac

SEQ ID NO: 735587 - RNA, 22 nt, Human
cagagggcacucggagugacau

SEQ ID NO: 735588 - RNA, 20 nt, Human
auuuguuucuacucucugac

SEQ ID NO: 735589 - RNA, 22 nt, Human
uauacaauggcugaaucaucca

SEQ ID NO: 735590 - RNA, 22 nt, Human
uuuuucucuaugccaggggccu

SEQ ID NO: 735591 - RNA, 22 nt, Human
uuuaagcuguggcauuaauucu

SEQ ID NO: 735592 - RNA, 22 nt, Human
agggggaggcugugcugcgucu

SEQ ID NO: 735593 - RNA, 22 nt, Human
gaguuauauccugagucauauu

SEQ ID NO: 735594 - RNA, 19 nt, Human
agugaaauggaguauucaa

SEQ ID NO: 735595 - RNA, 22 nt, Human
aaacuacaucucauggaugagg

SEQ ID NO: 735596 - RNA, 22 nt, Human
uugcaauuaacauaugucaacu

SEQ ID NO: 735597 - RNA, 22 nt, Human
aucuuguuauaagagauaaugg

SEQ ID NO: 735598 - RNA, 22 nt, Human
cccagugugaugagguugcuaa

SEQ ID NO: 735599 - RNA, 22 nt, Human
agaccacuggccuccugcagac

SEQ ID NO: 735600 - RNA, 22 nt, Human
aauuagggagagguagcuaggu

SEQ ID NO: 735601 - RNA, 22 nt, Human
guuaaugucuuccuauucuaca

SEQ ID NO: 735602 - RNA, 22 nt, Human
agggccugucuguagaacugaa

SEQ ID NO: 735603 - RNA, 21 nt, Human
gaugguagccucauagaagua

SEQ ID NO: 735604 - RNA, 22 nt, Human
acucugccccgaguucugggaa

SEQ ID NO: 735605 - RNA, 22 nt, Human
uauucucagcaacacacaugga

SEQ ID NO: 735606 - RNA, 22 nt, Human
aagaggcuucagauccuucaga

SEQ ID NO: 735607 - RNA, 22 nt, Human
uuccuuacauucauauggcuuc

SEQ ID NO: 735608 - RNA, 22 nt, Human
caagaugggcaccccagcaccu

SEQ ID NO: 735609 - RNA, 22 nt, Human
ugcacagcgggugucugucagg

SEQ ID NO: 735610 - RNA, 22 nt, Human
uagagaugaauucugcagucuu

SEQ ID NO: 735611 - RNA, 22 nt, Human
uuacaguuguucuaucagcaug

SEQ ID NO: 735612 - RNA, 22 nt, Human
gcugucaggccaugugggccuu

SEQ ID NO: 735613 - RNA, 22 nt, Human
cagacaggguggguuucugggc

SEQ ID NO: 735614 - RNA, 22 nt, Human
gggaagggagggccuccaguca

SEQ ID NO: 735615 - RNA, 22 nt, Human
uugauuacaaaguagauacauu

SEQ ID NO: 735616 - RNA, 22 nt, Human
caguccugcccaggcugacaga

SEQ ID NO: 735617 - RNA, 22 nt, Human
uaagugaauccuugagaagaaa

SEQ ID NO: 735618 - RNA, 17 nt, Human
acagagcacaucaagau

SEQ ID NO: 735619 - RNA, 22 nt, Human
ggcuccaguuuccccuuggggc

SEQ ID NO: 735620 - RNA, 22 nt, Human
uucugacacauuacuacaugga

SEQ ID NO: 735621 - RNA, 22 nt, Human
uggcccucagcacugagaccuu

SEQ ID NO: 735622 - RNA, 22 nt, Human
acugggaaaagcuauggcaaau

SEQ ID NO: 735623 - RNA, 22 nt, Human
gcuggucacucugggagcugcu

SEQ ID NO: 735624 - RNA, 22 nt, Human
cuguacaaguccuucaucaggg

SEQ ID NO: 735625 - RNA, 22 nt, Human
ucaaaaccuaggcucucugcuu

SEQ ID NO: 735626 - RNA, 22 nt, Human
agcuuuagagagccaagacuca

SEQ ID NO: 735627 - RNA, 22 nt, Human
uugucugauguucccucaugau

SEQ ID NO: 735628 - RNA, 22 nt, Human
cgucugccuaaggacugccuuc

SEQ ID NO: 735629 - RNA, 22 nt, Human
uguacaguauauuucaaagcca

SEQ ID NO: 735630 - RNA, 22 nt, Human
gccugagcccaggugugcagag

SEQ ID NO: 735631 - RNA, 20 nt, Human
ucccaagggcugagaggauc

SEQ ID NO: 735632 - RNA, 21 nt, Human
uacagcaccgaguaggcccuc

SEQ ID NO: 735633 - RNA, 22 nt, Human
gggcauggggcggaccugguuc

SEQ ID NO: 735634 - RNA, 22 nt, Human
ucuggcaucacucgcaagagca

SEQ ID NO: 735635 - RNA, 22 nt, Human
uagcaacauaagaaacauuuug

SEQ ID NO: 735636 - RNA, 22 nt, Human
uuuagucagguaagaugcaggg

SEQ ID NO: 735637 - RNA, 22 nt, Human
cccccugcgcccggcacgucau

SEQ ID NO: 735638 - RNA, 22 nt, Human
cagagugauaaauauagaaauu

SEQ ID NO: 735639 - RNA, 22 nt, Human
cagcagcucagucucucaguag

SEQ ID NO: 735640 - RNA, 22 nt, Human
gucccugggucuaaggcaguaa

SEQ ID NO: 735641 - RNA, 18 nt, Human
uugagaaauaagcacuaa

SEQ ID NO: 735642 - RNA, 22 nt, Human
gugcuuaauacaugucaauaac

SEQ ID NO: 735643 - RNA, 22 nt, Human
ugauucagucucuucaggagaa

SEQ ID NO: 735644 - RNA, 22 nt, Human
cuuuuacacucaucugggaggg

SEQ ID NO: 735645 - RNA, 22 nt, Human
uaauacagacaacuugccaaau

SEQ ID NO: 735646 - RNA, 22 nt, Human
ggacaggcccggggagccugga

SEQ ID NO: 735647 - RNA, 22 nt, Human
gcucugugcaguucagggacac

SEQ ID NO: 735648 - RNA, 22 nt, Human
ggcugguccuuucucuguccua

SEQ ID NO: 735649 - RNA, 22 nt, Human
uggcucugguaacauuggguag

SEQ ID NO: 735650 - RNA, 22 nt, Human
acucccuuuucccguaaucuau

SEQ ID NO: 735651 - RNA, 22 nt, Human
agucacugucuugcaaagguca

SEQ ID NO: 735652 - RNA, 22 nt, Human
cuggagcugggcuaggguagga

SEQ ID NO: 735653 - RNA, 22 nt, Human
ggagccugcgggagcucccauu

SEQ ID NO: 735654 - RNA, 22 nt, Human
gagcagcuugcgcugucuucac

SEQ ID NO: 735655 - RNA, 22 nt, Human
acuuggcugggagaguugaaga

SEQ ID NO: 735656 - RNA, 18 nt, Human
gaauaucuagcacauagu

SEQ ID NO: 735657 - RNA, 20 nt, Human
uccugagccuccaccauguc

SEQ ID NO: 735658 - RNA, 22 nt, Human
gugggccacugggaggcaaggg

SEQ ID NO: 735659 - RNA, 22 nt, Human
cagggcuggcucaugaaaaguu

SEQ ID NO: 735660 - RNA, 22 nt, Human
ucaguguucagggaccaggucc

SEQ ID NO: 735661 - RNA, 22 nt, Human
agcaaaucuaugaauguauauu

SEQ ID NO: 735662 - RNA, 22 nt, Human
cuggaaggugacugucuugaau

SEQ ID NO: 735663 - RNA, 22 nt, Human
uuucauggcuaggacuagagug

SEQ ID NO: 735664 - RNA, 22 nt, Human
acugagaagcucgcagugaugc

SEQ ID NO: 735665 - RNA, 22 nt, Human
auguccuguuuuggcuugcucu

SEQ ID NO: 735666 - RNA, 22 nt, Human
ucagggcuggcuuuugcagagc

SEQ ID NO: 735667 - RNA, 22 nt, Human
cuccugugguacucccagggcc

SEQ ID NO: 735668 - RNA, 22 nt, Human
cacuguccaauagauacauaau

SEQ ID NO: 735669 - RNA, 22 nt, Human
ucacaaaugaggaaaucgagca

SEQ ID NO: 735670 - RNA, 23 nt, Human
caucagagguugccacucccugg

SEQ ID NO: 735671 - RNA, 22 nt, Human
gaguccucaacggggagaggcg

SEQ ID NO: 735672 - RNA, 22 nt, Human
ucagccagggcucuggccucag

SEQ ID NO: 735673 - RNA, 22 nt, Human
ucaaguucacagucuggucgcu

SEQ ID NO: 735674 - RNA, 22 nt, Human
aggcccuggucaggucuggcug

SEQ ID NO: 735675 - RNA, 22 nt, Human
ggcugcugaguuggccaggaga

SEQ ID NO: 735676 - RNA, 22 nt, Human
cugcugguaccaguggccguca

SEQ ID NO: 735677 - RNA, 22 nt, Human
gagggccuacuggacaugucag

SEQ ID NO: 735678 - RNA, 22 nt, Human
auguagugcccuuugucaucua

SEQ ID NO: 735679 - RNA, 19 nt, Human
auggaaaauuguacucaau

SEQ ID NO: 735680 - RNA, 22 nt, Human
gggagcacugagaggcagguag

SEQ ID NO: 735681 - RNA, 22 nt, Human
uuuccacaucaccaugagguga

SEQ ID NO: 735682 - RNA, 22 nt, Human
cagaccucaaagcugcagugcu

SEQ ID NO: 735683 - RNA, 22 nt, Human
ucuagcugccccgaggcagggu

SEQ ID NO: 735684 - RNA, 22 nt, Human
ggcuccacugcugaccacucca

SEQ ID NO: 735685 - RNA, 22 nt, Human
gggcucugugcaccccagcacc

SEQ ID NO: 735686 - RNA, 22 nt, Human
cugcaguucucaauuucuauug

SEQ ID NO: 735687 - RNA, 22 nt, Human
agcugccugcuuaugagcucca

SEQ ID NO: 735688 - RNA, 22 nt, Human
aggcuagauagagggucaucuu

SEQ ID NO: 735689 - RNA, 22 nt, Human
gcugaguggagcagucagcgcu

SEQ ID NO: 735690 - RNA, 20 nt, Human
ugcauuaaguggcauugagc

SEQ ID NO: 735691 - RNA, 22 nt, Human
agugaaaugauucugagcaaga

SEQ ID NO: 735692 - RNA, 23 nt, Human
ugacacauuuccuuuccacugca

SEQ ID NO: 735693 - RNA, 22 nt, Human
uagcugggacuacuggcccugc

SEQ ID NO: 735694 - RNA, 22 nt, Human
cacuggaaguucauucucagaa

SEQ ID NO: 735695 - RNA, 22 nt, Human
agggaugaucaggguagaggcu

SEQ ID NO: 735696 - RNA, 22 nt, Human
ggaggacaggggcugcagcaca

SEQ ID NO: 735697 - RNA, 19 nt, Human
uaugaagaauguggcaaag

SEQ ID NO: 735698 - RNA, 21 nt, Human
accuucaguguucucagcugc

SEQ ID NO: 735699 - RNA, 22 nt, Human
aucauucagucucugggacagu

SEQ ID NO: 735700 - RNA, 22 nt, Human
cacaauacuauuuuuaggucuu

SEQ ID NO: 735701 - RNA, 22 nt, Human
acauuaaaauggagaauuuuga

SEQ ID NO: 735702 - RNA, 22 nt, Human
cgggcagcggcguggccauggu

SEQ ID NO: 735703 - RNA, 22 nt, Human
aagauuucuuacuuauugaugc

SEQ ID NO: 735704 - RNA, 22 nt, Human
auuuagagaauaagacauaaau

SEQ ID NO: 735705 - RNA, 22 nt, Human
aaccaguacuuuacacagcucu

SEQ ID NO: 735706 - RNA, 21 nt, Human
uuccacaguccugaggauuca

SEQ ID NO: 735707 - RNA, 22 nt, Human
ugggaaggggagcuggaaagga

SEQ ID NO: 735708 - RNA, 22 nt, Human
uauguaaaguagauggcaggua

SEQ ID NO: 735709 - RNA, 22 nt, Human
ucuuugauuugacaauaucuug

SEQ ID NO: 735710 - RNA, 22 nt, Human
gagcaacaggugauggggcugu

SEQ ID NO: 735711 - RNA, 22 nt, Human
aaacugcaauuacuuuugcacc

SEQ ID NO: 735712 - RNA, 22 nt, Human
ggcuuggaccagucacaguggu

SEQ ID NO: 735713 - RNA, 22 nt, Human
acuuuggaucugauguaaucag

SEQ ID NO: 735714 - RNA, 23 nt, Human
uuacuuuugcaccaaccuaauau

SEQ ID NO: 735715 - RNA, 22 nt, Human
uucucaguaugugacgaggacc

SEQ ID NO: 735716 - RNA, 22 nt, Human
uccguugagucagcuucggacc

SEQ ID NO: 735717 - RNA, 22 nt, Human
aaucaagaggcgauggauggaa

SEQ ID NO: 735718 - RNA, 22 nt, Human
cugugccuccaaguggucucug

SEQ ID NO: 735719 - RNA, 22 nt, Human
aagguacagaaauuaacaagga

SEQ ID NO: 735720 - RNA, 22 nt, Human
gccagcugcuucuccagaauuu

SEQ ID NO: 735721 - RNA, 22 nt, Human
ucagaagguacugaagacaugg

SEQ ID NO: 735722 - RNA, 22 nt, Human
caucacagauguuguguggagu

SEQ ID NO: 735723 - RNA, 22 nt, Human
uuuuguuguaauauaccuaucc

SEQ ID NO: 735724 - RNA, 22 nt, Human
gugcuuuuccuuauuuggugcu

SEQ ID NO: 735725 - RNA, 22 nt, Human
caucugaauuugccuuaguuuc

SEQ ID NO: 735726 - RNA, 18 nt, Human
cacaggaaggggaauauc

SEQ ID NO: 735727 - RNA, 17 nt, Human
ucuguucaagugagagg

SEQ ID NO: 735728 - RNA, 22 nt, Human
uuucucuuugacaggaaucaga

SEQ ID NO: 735729 - RNA, 22 nt, Human
agaucauuaaccaccuguucug

SEQ ID NO: 735730 - RNA, 22 nt, Human
agggugucagccacggaauggg

SEQ ID NO: 735731 - RNA, 22 nt, Human
aagagacuguaaaggcgugagu

SEQ ID NO: 735732 - RNA, 22 nt, Human
uggauggcuggggaagagcagg

SEQ ID NO: 735733 - RNA, 20 nt, Human
ucaaagacaagcucucaucc

SEQ ID NO: 735734 - RNA, 22 nt, Human
ugggaggagcccucugggaagg

SEQ ID NO: 735735 - RNA, 22 nt, Human
aaguuugugguuauacuugauu

SEQ ID NO: 735736 - RNA, 20 nt, Human
gcugaagauucccaugcaag

SEQ ID NO: 735737 - RNA, 22 nt, Human
auugacaaaaacaggugguuga

SEQ ID NO: 735738 - RNA, 22 nt, Human
uggcuucucagaauacucugga

SEQ ID NO: 735739 - RNA, 22 nt, Human
agccacagagguugaugugguu

SEQ ID NO: 735740 - RNA, 22 nt, Human
gaauuuugcuuuuaugucaagu

SEQ ID NO: 735741 - RNA, 22 nt, Human
agggggcucagcaggcucugga

SEQ ID NO: 735742 - RNA, 22 nt, Human
cccagcucaucaggagccgccc

SEQ ID NO: 735743 - RNA, 23 nt, Human
ucugugcuacaaaucgcgucugu

SEQ ID NO: 735744 - RNA, 22 nt, Human
ucagaggccuugguuaugguau

SEQ ID NO: 735745 - RNA, 22 nt, Human
caggcucuuuugguggcaagga

SEQ ID NO: 735746 - RNA, 22 nt, Human
ugugugugcaggagagcaggug

SEQ ID NO: 735747 - RNA, 22 nt, Human
ccagcagggaaaaacccaccaa

SEQ ID NO: 735748 - RNA, 22 nt, Human
ugacagggacaguggagaugga

SEQ ID NO: 735749 - RNA, 22 nt, Human
cccagcucgccgccgaugugcg

SEQ ID NO: 735750 - RNA, 22 nt, Human
cagcagaaguccgacuccaguc

SEQ ID NO: 735751 - RNA, 22 nt, Human
aggaaaaagaguugcugccuuc

SEQ ID NO: 735752 - RNA, 22 nt, Human
uaggaagaugaguaucaacuug

SEQ ID NO: 735753 - RNA, 22 nt, Human
uuggcccugaggaggcagcugc

SEQ ID NO: 735754 - RNA, 22 nt, Human
cacugaggcugggggagaaggu

SEQ ID NO: 735755 - RNA, 20 nt, Human
ucagauuaaauguucugucu

SEQ ID NO: 735756 - RNA, 22 nt, Human
agaacagugcugauaaaucaua

SEQ ID NO: 735757 - RNA, 22 nt, Human
gcagcaggcauggccgcccugg

SEQ ID NO: 735758 - RNA, 22 nt, Human
ggcugugcccucacauggggca

SEQ ID NO: 735759 - RNA, 22 nt, Human
aaaaccugugaauaguuaacuc

SEQ ID NO: 735760 - RNA, 22 nt, Human
uauuauguagaguaaggguuaa

SEQ ID NO: 735761 - RNA, 22 nt, Human
aggcugugaggggcccgcaugc

SEQ ID NO: 735762 - RNA, 22 nt, Human
aaaauucauuccucagacugcc

SEQ ID NO: 735763 - RNA, 22 nt, Human
cagcagagcugggcuuugaauu

SEQ ID NO: 735764 - RNA, 22 nt, Human
gaaaagagaacaucugaggauc

SEQ ID NO: 735765 - RNA, 22 nt, Human
ccaguacaucgcauggugacca

SEQ ID NO: 735766 - RNA, 22 nt, Human
uggcagcugccauguccacgug

SEQ ID NO: 735767 - RNA, 22 nt, Human
cugggagugucccucugguaau

SEQ ID NO: 735768 - RNA, 22 nt, Human
gcagaaguggauucuacaauuu

SEQ ID NO: 735769 - RNA, 20 nt, Human
ucugagguaugauagggucu

SEQ ID NO: 735770 - RNA, 22 nt, Human
gaguuuguaaacuauucacuaa

SEQ ID NO: 735771 - RNA, 22 nt, Human
uaugauuuguagacauuugauu

SEQ ID NO: 735772 - RNA, 17 nt, Human
cccagagaugcugccuu

SEQ ID NO: 735773 - RNA, 22 nt, Human
ccagcuccagguagaugggcag

SEQ ID NO: 735774 - RNA, 22 nt, Human
cacucucucaggcuuuccuugu

SEQ ID NO: 735775 - RNA, 19 nt, Human
ugguggaggccccauguuc

SEQ ID NO: 735776 - RNA, 22 nt, Human
augaggccuuucuucacccuuu

SEQ ID NO: 735777 - RNA, 22 nt, Human
gcugcccagggcugaguguccu

SEQ ID NO: 735778 - RNA, 22 nt, Human
ggcugcagguugguuggcagcu

SEQ ID NO: 735779 - RNA, 22 nt, Human
ccaggucugucuucuuagcuca

SEQ ID NO: 735780 - RNA, 22 nt, Human
aagcccagaaucaagucuacug

SEQ ID NO: 735781 - RNA, 22 nt, Human
gccaaggccugcagcaccucau

SEQ ID NO: 735782 - RNA, 21 nt, Human
agcagccauuucacagagacu

SEQ ID NO: 735783 - RNA, 22 nt, Human
aauugcuagacuauacuguaau

SEQ ID NO: 735784 - RNA, 22 nt, Human
aauaaucucccuuuuuguaugu

SEQ ID NO: 735785 - RNA, 22 nt, Human
uucccacagagauuacauugaa

SEQ ID NO: 735786 - RNA, 22 nt, Human
cuuaaaguagaauacaagaccu

SEQ ID NO: 735787 - RNA, 22 nt, Human
cugucagguuucccaucugcaa

SEQ ID NO: 735788 - RNA, 22 nt, Human
uguguguguuucugcucauaca

SEQ ID NO: 735789 - RNA, 22 nt, Human
aaugcuuugacuauaucuauaa

SEQ ID NO: 735790 - RNA, 22 nt, Human
uucuccucacugcagccuuuca

SEQ ID NO: 735791 - RNA, 22 nt, Human
ugugccaugaggcucugauaug

SEQ ID NO: 735792 - RNA, 22 nt, Human
cugcuacaccggaauagugaca

SEQ ID NO: 735793 - RNA, 22 nt, Human
agcagggagaccaucucuuccu

SEQ ID NO: 735794 - RNA, 22 nt, Human
auauuguuaguaauauuucgaa

SEQ ID NO: 735795 - RNA, 22 nt, Human
uucccaugccuggccccuaucc

SEQ ID NO: 735796 - RNA, 19 nt, Human
aguauagaguauugaggag

SEQ ID NO: 735797 - RNA, 22 nt, Human
uuugaauggacugagaaucuug

SEQ ID NO: 735798 - RNA, 22 nt, Human
uguuuucaagucaaggccaaau

SEQ ID NO: 735799 - RNA, 22 nt, Human
aguguuuuggagugggaaggca

SEQ ID NO: 735800 - RNA, 22 nt, Human
aaacaauuuccaccucuccuga

SEQ ID NO: 735801 - RNA, 22 nt, Human
ucuuaaaaguaugccaauugga

SEQ ID NO: 735802 - RNA, 22 nt, Human
agaaagauuuucaacaggaggu

SEQ ID NO: 735803 - RNA, 22 nt, Human
aggcagcccugugcuggaugcu

SEQ ID NO: 735804 - RNA, 22 nt, Human
guggcagagguuccucagugug

SEQ ID NO: 735805 - RNA, 21 nt, Human
uccuugggcagugcccagcuu

SEQ ID NO: 735806 - RNA, 22 nt, Human
ugaaagguguccaauauuucuc

SEQ ID NO: 735807 - RNA, 22 nt, Human
uucaauaggaugcaugauauaa

SEQ ID NO: 735808 - RNA, 22 nt, Human
ugcagcugaaccuagagucugu

SEQ ID NO: 735809 - RNA, 22 nt, Human
aggggagccgaggggcaucugu

SEQ ID NO: 735810 - RNA, 22 nt, Human
cuucacugaugggacagcucaa

SEQ ID NO: 735811 - RNA, 22 nt, Human
gcuuuugagguccugcucagcc

SEQ ID NO: 735812 - RNA, 22 nt, Human
ugcuuccgcuaaaaauuaaucc

SEQ ID NO: 735813 - RNA, 22 nt, Human
ggccggggccuccccgcgucgc

SEQ ID NO: 735814 - RNA, 22 nt, Human
cucugagaggauccugcccggg

SEQ ID NO: 735815 - RNA, 22 nt, Human
cauuuguacauguugucuucuu

SEQ ID NO: 735816 - RNA, 22 nt, Human
cuuuauauccagauguuuggug

SEQ ID NO: 735817 - RNA, 22 nt, Human
guguccuuuccgggccuggagg

SEQ ID NO: 735818 - RNA, 19 nt, Human
cuggcugcaaugccagggu

SEQ ID NO: 735819 - RNA, 21 nt, Human
uguggcagauguugggaggca

SEQ ID NO: 735820 - RNA, 22 nt, Human
ucuuguuaaagugaagauacug

SEQ ID NO: 735821 - RNA, 22 nt, Human
gugcuggcuggacauggagcac

SEQ ID NO: 735822 - RNA, 22 nt, Human
agauacuauggaauuuuaugag

SEQ ID NO: 735823 - RNA, 22 nt, Human
ggaugggcccgggacggcgcug

SEQ ID NO: 735824 - RNA, 22 nt, Human
guggaugagauaacuguagaag

SEQ ID NO: 735825 - RNA, 22 nt, Human
cucuuccucucaugcggucaua

SEQ ID NO: 735826 - RNA, 22 nt, Human
aagaauguggguggauaugaug

SEQ ID NO: 735827 - RNA, 22 nt, Human
gucucugagcucugagcuggcu

SEQ ID NO: 735828 - RNA, 22 nt, Human
uggccagaguugaggggguuuc

SEQ ID NO: 735829 - RNA, 22 nt, Human
uaagaaacugucacaguacuau

SEQ ID NO: 735830 - RNA, 22 nt, Human
agugcucucuccccagugcuac

SEQ ID NO: 735831 - RNA, 22 nt, Human
agccagcaucuugcuucuugag

SEQ ID NO: 735832 - RNA, 22 nt, Human
ugcugguggagaaaguggaggu

SEQ ID NO: 735833 - RNA, 22 nt, Human
uguguggccuccauaggguacu

SEQ ID NO: 735834 - RNA, 22 nt, Human
ggcugcucuucuuggcgaccuc

SEQ ID NO: 735835 - RNA, 22 nt, Human
agacacuggcacuggggaagcc

SEQ ID NO: 735836 - RNA, 22 nt, Human
caugggagcuaucuccaucacu

SEQ ID NO: 735837 - RNA, 22 nt, Human
cagcccagaacucacgucucca

SEQ ID NO: 735838 - RNA, 22 nt, Human
acacaggaagucagcacugaug

SEQ ID NO: 735839 - RNA, 22 nt, Human
ucugaaaucuguaagcacuagc

SEQ ID NO: 735840 - RNA, 22 nt, Human
ugucccacugacuucacaucca

SEQ ID NO: 735841 - RNA, 22 nt, Human
gcagagcaggggcugaaccugg

SEQ ID NO: 735842 - RNA, 22 nt, Human
uccuguggagaggacuggaggu

SEQ ID NO: 735843 - RNA, 22 nt, Human
ggcugcugcccaccccugcaug

SEQ ID NO: 735844 - RNA, 22 nt, Human
ccagauguauguaugagugcau

SEQ ID NO: 735845 - RNA, 22 nt, Human
acugucaucuuguaagcaaugu

SEQ ID NO: 735846 - RNA, 20 nt, Human
ucucuucuggggagauaaaa

SEQ ID NO: 735847 - RNA, 19 nt, Human
ggcaggcuggauagagagg

SEQ ID NO: 735848 - RNA, 22 nt, Human
gagcuucagcugccaugacugu

SEQ ID NO: 735849 - RNA, 22 nt, Human
uuuauucagcagcagcaguggu

SEQ ID NO: 735850 - RNA, 22 nt, Human
augugucucuaccaaugcaauu

SEQ ID NO: 735851 - RNA, 22 nt, Human
cagaauugagagaggcuguucu

SEQ ID NO: 735852 - RNA, 22 nt, Human
uauuucagucacuucuucucug

SEQ ID NO: 735853 - RNA, 21 nt, Human
uguggcagagacaaugcuagu

SEQ ID NO: 735854 - RNA, 22 nt, Human
uauaggacugaucacauuuuca

SEQ ID NO: 735855 - RNA, 22 nt, Human
acucauuuuuacugcaauugag

SEQ ID NO: 735856 - RNA, 22 nt, Human
ugucauuucacaauaucacuca

SEQ ID NO: 735857 - RNA, 22 nt, Human
gagccaagcaauauacccaacc

SEQ ID NO: 735858 - RNA, 22 nt, Human
caccucucauuucuacagauuc

SEQ ID NO: 735859 - RNA, 22 nt, Human
agugcagauuuuuagucagcuu

SEQ ID NO: 735860 - RNA, 22 nt, Human
agggucugugcaagaacacgcc

SEQ ID NO: 735861 - RNA, 22 nt, Human
caucuuaauuucuaacaggcac

SEQ ID NO: 735862 - RNA, 22 nt, Human
gcuguggcuguacagagaccau

SEQ ID NO: 735863 - RNA, 22 nt, Human
ugcaaacuagcaucaacuagua

SEQ ID NO: 735864 - RNA, 18 nt, Human
uagaagugugcuauacaa

SEQ ID NO: 735865 - RNA, 22 nt, Human
agggcucauugacauggaaaag

SEQ ID NO: 735866 - RNA, 22 nt, Human
guaagcaaacagcaaaugauuu

SEQ ID NO: 735867 - RNA, 22 nt, Human
agcuccugcaccaggggccccu

SEQ ID NO: 735868 - RNA, 21 nt, Human
ucagcagaaggaccacuaggg

SEQ ID NO: 735869 - RNA, 22 nt, Human
agcaggugacccaagcaggcug

SEQ ID NO: 735870 - RNA, 22 nt, Human
guuuacaacaugccaacugggc

SEQ ID NO: 735871 - RNA, 22 nt, Human
augcuaaauaacugguuugacu

SEQ ID NO: 735872 - RNA, 23 nt, Human
uaauuuuagccuuacaggacccu

SEQ ID NO: 735873 - RNA, 22 nt, Human
uuuguaugggcagaaauuagau

SEQ ID NO: 735874 - RNA, 22 nt, Human
ggucacauucugagguauuagg

SEQ ID NO: 735875 - RNA, 22 nt, Human
guucugaguccuccuuugaagg

SEQ ID NO: 735876 - RNA, 22 nt, Human
uccuggagaacugauucgcggg

SEQ ID NO: 735877 - RNA, 22 nt, Human
cagaaagcuugguacaauaugc

SEQ ID NO: 735878 - RNA, 22 nt, Human
ugagcagcaacuguccauggca

SEQ ID NO: 735879 - RNA, 22 nt, Human
uacaugaccuagacuugcuaaa

SEQ ID NO: 735880 - RNA, 22 nt, Human
ugcaaaaacugcaauugcuuuu

SEQ ID NO: 735881 - RNA, 22 nt, Human
ucagagugcagggaguagcagc

SEQ ID NO: 735882 - RNA, 22 nt, Human
accaaggagccacauacaaccu

SEQ ID NO: 735883 - RNA, 22 nt, Human
aacauuuguuucguuaugugaa

SEQ ID NO: 735884 - RNA, 22 nt, Human
uuuucucaggugcuuaucuaag

SEQ ID NO: 735885 - RNA, 22 nt, Human
auccugagcuacaccugcuccu

SEQ ID NO: 735886 - RNA, 22 nt, Human
aacauuuccggccuuuuguucu

SEQ ID NO: 735887 - RNA, 22 nt, Human
aaugaccucagagcacccagaa

SEQ ID NO: 735888 - RNA, 23 nt, Human
aggcaaggguguaaaggaaauga

SEQ ID NO: 735889 - RNA, 22 nt, Human
agcagcucugagaggccagcac

SEQ ID NO: 735890 - RNA, 22 nt, Human
uacauguauguguuaauaucug

SEQ ID NO: 735891 - RNA, 22 nt, Human
ugcagcauuauucacaguagcc

SEQ ID NO: 735892 - RNA, 22 nt, Human
aaugauuggcacuagauacaca

SEQ ID NO: 735893 - RNA, 22 nt, Human
ggcuggugaguucagagaaccc

SEQ ID NO: 735894 - RNA, 22 nt, Human
ucaaauguucccuguacuggcc

SEQ ID NO: 735895 - RNA, 20 nt, Human
cugcuugggacacugccaga

SEQ ID NO: 735896 - RNA, 22 nt, Human
gggggcaggucuggaacuuuga

SEQ ID NO: 735897 - RNA, 22 nt, Human
aagcagauuggggauuuccaug

SEQ ID NO: 735898 - RNA, 22 nt, Human
uuaaacagagucugaaauguaa

SEQ ID NO: 735899 - RNA, 16 nt, Human
cagaguguaaacagga

SEQ ID NO: 735900 - RNA, 22 nt, Human
caguauguacucuuaucaugua

SEQ ID NO: 735901 - RNA, 21 nt, Human
ccuacagauggauauauauuc

SEQ ID NO: 735902 - RNA, 22 nt, Human
cuauggucuggaccgagguccu

SEQ ID NO: 735903 - RNA, 19 nt, Human
ccacagagacuagaagaca

SEQ ID NO: 735904 - RNA, 22 nt, Human
cuguggcucauaucuguaaucu

SEQ ID NO: 735905 - RNA, 20 nt, Human
gggcucuuagguagcagggg

SEQ ID NO: 735906 - RNA, 22 nt, Human
ucuagacaucuuggcugcaauu

SEQ ID NO: 735907 - RNA, 22 nt, Human
gggacagcagaaagaaggcaag

SEQ ID NO: 735908 - RNA, 22 nt, Human
uacaagauaagaauuggcaagg

SEQ ID NO: 735909 - RNA, 22 nt, Human
uuuauugggccuggaggaucua

SEQ ID NO: 735910 - RNA, 22 nt, Human
ucaggcgaggcuuaauccaagg

SEQ ID NO: 735911 - RNA, 22 nt, Human
ucugccuugagguccucagcuc

SEQ ID NO: 735912 - RNA, 22 nt, Human
uggucagacaaaggagaauguu

SEQ ID NO: 735913 - RNA, 22 nt, Human
ucauggaugauagcuucauugc

SEQ ID NO: 735914 - RNA, 22 nt, Human
acugggcaccaucaugagauag

SEQ ID NO: 735915 - RNA, 22 nt, Human
gccugguguccagaggcgagug

SEQ ID NO: 735916 - RNA, 22 nt, Human
gucucaguaagaaaggcuccug

SEQ ID NO: 735917 - RNA, 22 nt, Human
aggccugcagcaggagcaaacc

SEQ ID NO: 735918 - RNA, 22 nt, Human
cuucacaaauggccuagaguuc

SEQ ID NO: 735919 - RNA, 22 nt, Human
agcaccuucacaggcucucagg

SEQ ID NO: 735920 - RNA, 22 nt, Human
ugucucuucugccuccagcugu

SEQ ID NO: 735921 - RNA, 22 nt, Human
cauuagggccaccauaacaaaa

SEQ ID NO: 735922 - RNA, 22 nt, Human
augguguagcugucagucauaa

SEQ ID NO: 735923 - RNA, 22 nt, Human
aaacugugcuucccaaaugccc

SEQ ID NO: 735924 - RNA, 22 nt, Human
aggagcuucagagagaaccugg

SEQ ID NO: 735925 - RNA, 19 nt, Human
cgccuggcaggcccugcgc

SEQ ID NO: 735926 - RNA, 22 nt, Human
uccacauucucuguuacagaua

SEQ ID NO: 735927 - RNA, 22 nt, Human
cacuuaucucauuuaaucacca

SEQ ID NO: 735928 - RNA, 23 nt, Human
acccaucucuccugucaugcaga

SEQ ID NO: 735929 - RNA, 22 nt, Human
gccagagagacugauacaugcu

SEQ ID NO: 735930 - RNA, 22 nt, Human
auuagcuguugugaaaggggug

SEQ ID NO: 735931 - RNA, 22 nt, Human
gcagcuguucagcuggccagau

SEQ ID NO: 735932 - RNA, 21 nt, Human
uggcuaaacccuaguaaauua

SEQ ID NO: 735933 - RNA, 23 nt, Human
ccacaggcacagaggcuugcauc

SEQ ID NO: 735934 - RNA, 22 nt, Human
ccccacaccugccgggcagcag

SEQ ID NO: 735935 - RNA, 22 nt, Human
accucccuggccuucugauucc

SEQ ID NO: 735936 - RNA, 22 nt, Human
ucacaggagaauguacuuacca

SEQ ID NO: 735937 - RNA, 22 nt, Human
ucagcaagaagcugugggcuuc

SEQ ID NO: 735938 - RNA, 22 nt, Human
aucagaaaguucaucauguuug

SEQ ID NO: 735939 - RNA, 22 nt, Human
gacuccccugggccccauccag

SEQ ID NO: 735940 - RNA, 22 nt, Human
ugauuaacugucuauuaaucau

SEQ ID NO: 735941 - RNA, 22 nt, Human
ggagacagcaggaagaaauauc

SEQ ID NO: 735942 - RNA, 22 nt, Human
aaggccugcucagcugucugug

SEQ ID NO: 735943 - RNA, 22 nt, Human
gcaaggcugcugccacccaucu

SEQ ID NO: 735944 - RNA, 22 nt, Human
uucacaggugacuggggauaac

SEQ ID NO: 735945 - RNA, 22 nt, Human
ggcauggccuguaagacggaga

SEQ ID NO: 735946 - RNA, 22 nt, Human
gggauggcuuuguggcugacuc

SEQ ID NO: 735947 - RNA, 22 nt, Human
uugaggucaucugaaguacuag

SEQ ID NO: 735948 - RNA, 18 nt, Human
gggagcugggaagcuggu

SEQ ID NO: 735949 - RNA, 22 nt, Human
aaaugcagauuuugaugcagca

SEQ ID NO: 735950 - RNA, 22 nt, Human
ugcuccagugagcuggccaucc

SEQ ID NO: 735951 - RNA, 22 nt, Human
agcugucuuuggagagggagag

SEQ ID NO: 735952 - RNA, 22 nt, Human
ugucacaucagggguguugaca

SEQ ID NO: 735953 - RNA, 17 nt, Human
agcuucugcccuuucuu

SEQ ID NO: 735954 - RNA, 22 nt, Human
acaagauuuuaugacucuuuuu

SEQ ID NO: 735955 - RNA, 22 nt, Human
gggacaugaggccauagugauu

SEQ ID NO: 735956 - RNA, 22 nt, Human
uuguauuuccuauaaccuuucu

SEQ ID NO: 735957 - RNA, 19 nt, Human
auuucaagagguuuauugg

SEQ ID NO: 735958 - RNA, 22 nt, Human
cauagaauaugugugauuguua

SEQ ID NO: 735959 - RNA, 22 nt, Human
acuaguguccuuauauaagagg

SEQ ID NO: 735960 - RNA, 23 nt, Human
gcauugucuccccacuucugggc

SEQ ID NO: 735961 - RNA, 20 nt, Human
uguguauaaauauauguuuc

SEQ ID NO: 735962 - RNA, 22 nt, Human
aggcuccaggcaaaauuucgga

SEQ ID NO: 735963 - RNA, 22 nt, Human
uguaaacaguaggacuaaagag

SEQ ID NO: 735964 - RNA, 22 nt, Human
ugcagaaaggaggggugggaau

SEQ ID NO: 735965 - RNA, 22 nt, Human
uucauugauaguuuuauguaug

SEQ ID NO: 735966 - RNA, 22 nt, Human
ugucugccugcgggccggcaca

SEQ ID NO: 735967 - RNA, 22 nt, Human
ccugagcuggcagugaccugga

SEQ ID NO: 735968 - RNA, 22 nt, Human
guaaagaaguuuuugaaugcau

SEQ ID NO: 735969 - RNA, 22 nt, Human
caaaaccaagaacauucauuuc

SEQ ID NO: 735970 - RNA, 22 nt, Human
ucaaaggguagcccagggaaga

SEQ ID NO: 735971 - RNA, 22 nt, Human
caggaaacauaugugcuugagg

SEQ ID NO: 735972 - RNA, 22 nt, Human
ccagagucuuuauauuccugaa

SEQ ID NO: 735973 - RNA, 22 nt, Human
uuggaauuugagaccaagaaaa

SEQ ID NO: 735974 - RNA, 22 nt, Human
ucuucacaguccuggucagugg

SEQ ID NO: 735975 - RNA, 22 nt, Human
agggaagugaaugacagauauc

SEQ ID NO: 735976 - RNA, 22 nt, Human
gggcagcucuggcugugggaag

SEQ ID NO: 735977 - RNA, 22 nt, Human
ccuggagcuuuuccauccugga

SEQ ID NO: 735978 - RNA, 22 nt, Human
auagauccagaaaauuuauuau

SEQ ID NO: 735979 - RNA, 19 nt, Human
gcuugcuuuaugaaggggg

SEQ ID NO: 735980 - RNA, 22 nt, Human
ucacuugagauguaccacaaac

SEQ ID NO: 735981 - RNA, 22 nt, Human
gggaaagaagaagagccauuuu

SEQ ID NO: 735982 - RNA, 23 nt, Human
auucagaauuguguguuuguaua

SEQ ID NO: 735983 - RNA, 22 nt, Human
agagggcuuugauucucaguuc

SEQ ID NO: 735984 - RNA, 22 nt, Human
uacugacacaaagccaaucccu

SEQ ID NO: 735985 - RNA, 22 nt, Human
uuuacaaggaucaagggaucuc

SEQ ID NO: 735986 - RNA, 22 nt, Human
aaaugacuaaugauccugggca

SEQ ID NO: 735987 - RNA, 22 nt, Human
agaagcaguuauuuuuugcaca

SEQ ID NO: 735988 - RNA, 18 nt, Human
cuagagaagguuacuaug

SEQ ID NO: 735989 - RNA, 22 nt, Human
uguauuuaagcuuuaccuaaaa

SEQ ID NO: 735990 - RNA, 22 nt, Human
cuccagugcgucuuaguaaacc

SEQ ID NO: 735991 - RNA, 22 nt, Human
guucugcagacuuggaaggugg

SEQ ID NO: 735992 - RNA, 23 nt, Human
ucaguccuguaggggcuccaggu

SEQ ID NO: 735993 - RNA, 22 nt, Human
acacauguucaagaauguucag

SEQ ID NO: 735994 - RNA, 22 nt, Human
cccacuguguugcagucuagug

SEQ ID NO: 735995 - RNA, 22 nt, Human
gaaugucccugcaguugcugcc

SEQ ID NO: 735996 - RNA, 22 nt, Human
cagcagcaaggugaggguggag

SEQ ID NO: 735997 - RNA, 22 nt, Human
gcugcccuguccggcucuccug

SEQ ID NO: 735998 - RNA, 19 nt, Human
cagaccuguccagccugug

SEQ ID NO: 735999 - RNA, 22 nt, Human
acucugggccccagguggagcu

SEQ ID NO: 736000 - RNA, 22 nt, Human
gccaguggucacugaggaagaa

SEQ ID NO: 736001 - RNA, 22 nt, Human
uuuucaagggcagggaaaucau

SEQ ID NO: 736002 - RNA, 22 nt, Human
cagcugcucugguggucucucc

SEQ ID NO: 736003 - RNA, 22 nt, Human
gucuccacuaaaaacuuucacg

SEQ ID NO: 736004 - RNA, 18 nt, Human
aggcuucuuggcucaguc

SEQ ID NO: 736005 - RNA, 22 nt, Human
acaaaccagcuuaagcaagaug

SEQ ID NO: 736006 - RNA, 22 nt, Human
ugcauuguuuagaacucuuugg

SEQ ID NO: 736007 - RNA, 22 nt, Human
uguaacuguggucuagggacug

SEQ ID NO: 736008 - RNA, 22 nt, Human
ccagggcugcugugggacucca

SEQ ID NO: 736009 - RNA, 22 nt, Human
cucuggcuucuaccuugcaguu

SEQ ID NO: 736010 - RNA, 22 nt, Human
agcccugcgugccaggggacug

SEQ ID NO: 736011 - RNA, 22 nt, Human
cugcuuuguggaaucacacugg

SEQ ID NO: 736012 - RNA, 22 nt, Human
ugcagggcagcuagggagcuuu

SEQ ID NO: 736013 - RNA, 22 nt, Human
ugugaggauaaaaaggaaggag

SEQ ID NO: 736014 - RNA, 22 nt, Human
uagagcauuaugacaaccccau

SEQ ID NO: 736015 - RNA, 22 nt, Human
aucucugcaucccucaagguug

SEQ ID NO: 736016 - RNA, 22 nt, Human
ucagguucagacuagucccagu

SEQ ID NO: 736017 - RNA, 22 nt, Human
cuacugccauugucucugccau

SEQ ID NO: 736018 - RNA, 22 nt, Human
caaggucacauaacuugucaaa

SEQ ID NO: 736019 - RNA, 21 nt, Human
uaagaacauuaucuucuuccu

SEQ ID NO: 736020 - RNA, 22 nt, Human
ugguauuuaagacuucacuccu

SEQ ID NO: 736021 - RNA, 22 nt, Human
aauaaacaaaucuuuccugugg

SEQ ID NO: 736022 - RNA, 22 nt, Human
uaaggcaguagugucuguaggg

SEQ ID NO: 736023 - RNA, 22 nt, Human
cugcugcucgaccagucccagg

SEQ ID NO: 736024 - RNA, 22 nt, Human
auggccagggccaaaagagaug

SEQ ID NO: 736025 - RNA, 22 nt, Human
aagcuggagaguuucacagaug

SEQ ID NO: 736026 - RNA, 22 nt, Human
uaaaguguguggguucuaaauu

SEQ ID NO: 736027 - RNA, 22 nt, Human
auggcccugcuaccacuuuucu

SEQ ID NO: 736028 - RNA, 22 nt, Human
aguugaagguuggcugauccau

SEQ ID NO: 736029 - RNA, 20 nt, Human
aggcugucauuucuggcagg

SEQ ID NO: 736030 - RNA, 22 nt, Human
uuucuucauucaccuucacccc

SEQ ID NO: 736031 - RNA, 22 nt, Human
uucucauagagacaugauuaua

SEQ ID NO: 736032 - RNA, 20 nt, Human
uucugaaagcagcagaggga

SEQ ID NO: 736033 - RNA, 22 nt, Human
uacaaugaccauauuauguaag

SEQ ID NO: 736034 - RNA, 20 nt, Human
gauuacaaaaugaaaugcau

SEQ ID NO: 736035 - RNA, 22 nt, Human
cccugagaugugaauuucagag

SEQ ID NO: 736036 - RNA, 22 nt, Human
auacaugacucacacauucugc

SEQ ID NO: 736037 - RNA, 22 nt, Human
aaggcucaauuaacuaagaagu

SEQ ID NO: 736038 - RNA, 22 nt, Human
uuaacuuuuauuucugcucgcc

SEQ ID NO: 736039 - RNA, 22 nt, Human
gcucugggaaguccuuuaccau

SEQ ID NO: 736040 - RNA, 22 nt, Human
cugucaaauucauaacacuuau

SEQ ID NO: 736041 - RNA, 22 nt, Human
ucugggcacugcugagccugua

SEQ ID NO: 736042 - RNA, 22 nt, Human
ucugggauagggccagaacaug

SEQ ID NO: 736043 - RNA, 22 nt, Human
uggcagagcuggcugcggauga

SEQ ID NO: 736044 - RNA, 22 nt, Human
ggcugaauguuggacacuuacg

SEQ ID NO: 736045 - RNA, 21 nt, Human
ugucacuuuaagcuagcucua

SEQ ID NO: 736046 - RNA, 22 nt, Human
uccugaaaaauuacauguucag

SEQ ID NO: 736047 - RNA, 22 nt, Human
uccagcucuaaggcugauagcc

SEQ ID NO: 736048 - RNA, 22 nt, Human
gcuuuacacagaugaauauuuc

SEQ ID NO: 736049 - RNA, 22 nt, Human
acaucuucacugguuucuggaa

SEQ ID NO: 736050 - RNA, 22 nt, Human
gccuagguaccagcagagagcc

SEQ ID NO: 736051 - RNA, 22 nt, Human
gaauggcauugucagccuuuau

SEQ ID NO: 736052 - RNA, 22 nt, Human
uccucugccaaagggaguugcc

SEQ ID NO: 736053 - RNA, 22 nt, Human
aaauagcuuuucauaauucuca

SEQ ID NO: 736054 - RNA, 22 nt, Human
ugcagggcacacgcacgggugu

SEQ ID NO: 736055 - RNA, 22 nt, Human
ucugagccaauuucugugucca

SEQ ID NO: 736056 - RNA, 22 nt, Human
gcagggcuagauauuugcaagu

SEQ ID NO: 736057 - RNA, 23 nt, Human
gaggaaagaauauagaugcaauc

SEQ ID NO: 736058 - RNA, 22 nt, Human
uuagugcaauucagagaacaau

SEQ ID NO: 736059 - RNA, 22 nt, Human
caaagccucugauuucacuugu

SEQ ID NO: 736060 - RNA, 22 nt, Human
cuuguggcccauggcuuccugc

SEQ ID NO: 736061 - RNA, 22 nt, Human
aagacuaaauguguucuaaagu

SEQ ID NO: 736062 - RNA, 22 nt, Human
aaaauuacuauuguuccugggc

SEQ ID NO: 736063 - RNA, 18 nt, Human
gaaagaugaacuuuuuuc

SEQ ID NO: 736064 - RNA, 22 nt, Human
cuucacuggaaucuguaauagu

SEQ ID NO: 736065 - RNA, 22 nt, Human
uuccaugacaccgagggaaguc

SEQ ID NO: 736066 - RNA, 22 nt, Human
aaguaaucuggaauuugguuuu

SEQ ID NO: 736067 - RNA, 22 nt, Human
cuucuucuuuuaauaaaugucu

SEQ ID NO: 736068 - RNA, 22 nt, Human
aauaauacaugagauuaauguu

SEQ ID NO: 736069 - RNA, 22 nt, Human
cugcagaaaccuuuccugauuu

SEQ ID NO: 736070 - RNA, 22 nt, Human
uaaccaugcaugucucuaguuu

SEQ ID NO: 736071 - RNA, 23 nt, Human
acuuuauccuauaucuuuguucu

SEQ ID NO: 736072 - RNA, 22 nt, Human
acuggcagaauugaauaguugu

SEQ ID NO: 736073 - RNA, 22 nt, Human
uucugucucuguguuuacauua

SEQ ID NO: 736074 - RNA, 22 nt, Human
uuguacacacaggaacaaacgu

SEQ ID NO: 736075 - RNA, 22 nt, Human
cugcagaugucucaauuuuauu

SEQ ID NO: 736076 - RNA, 22 nt, Human
uggucuuuaagguagcugucau

SEQ ID NO: 736077 - RNA, 22 nt, Human
cucccucagaggagcaccuguu

SEQ ID NO: 736078 - RNA, 22 nt, Human
augccugguaugaagcaaggaa

SEQ ID NO: 736079 - RNA, 22 nt, Human
ugaaacaaaccaguaauuuugu

SEQ ID NO: 736080 - RNA, 22 nt, Human
auugacaagcaguaugucuuag

SEQ ID NO: 736081 - RNA, 22 nt, Human
uauuucagguauggugugaaau

SEQ ID NO: 736082 - RNA, 22 nt, Human
cagagcaucgcgcagagagccu

SEQ ID NO: 736083 - RNA, 22 nt, Human
cucaugugucugguaggagcuu

SEQ ID NO: 736084 - RNA, 22 nt, Human
ggugaggggagagugaaagaaa

SEQ ID NO: 736085 - RNA, 22 nt, Human
agagcacaugguuccugugucc

SEQ ID NO: 736086 - RNA, 18 nt, Human
uucuuuaauucaguuuga

SEQ ID NO: 736087 - RNA, 22 nt, Human
gaguguucccacaccccaguug

SEQ ID NO: 736088 - RNA, 22 nt, Human
uagcuguucauguggcuuuaug

SEQ ID NO: 736089 - RNA, 22 nt, Human
caggcuggcaaugcgucaagca

SEQ ID NO: 736090 - RNA, 22 nt, Human
agggccugggguagcuuacugc

SEQ ID NO: 736091 - RNA, 22 nt, Human
gcagccaguauccucugagauu

SEQ ID NO: 736092 - RNA, 22 nt, Human
uccaggcuagaagucacaggcc

SEQ ID NO: 736093 - RNA, 22 nt, Human
guugggcucauuacagccugcu

SEQ ID NO: 736094 - RNA, 22 nt, Human
ccugugugcugaugacgacaga

SEQ ID NO: 736095 - RNA, 22 nt, Human
ugauugaaguguucuguuccag

SEQ ID NO: 736096 - RNA, 22 nt, Human
uggagucagcuagaccuguguu

SEQ ID NO: 736097 - RNA, 22 nt, Human
cccuugcaucccauguguggcc

SEQ ID NO: 736098 - RNA, 22 nt, Human
ucaaaggcugcuugucuucugg

SEQ ID NO: 736099 - RNA, 22 nt, Human
uucucaaagaaagcugucauua

SEQ ID NO: 736100 - RNA, 19 nt, Human
gcaggcccagucgggcugg

SEQ ID NO: 736101 - RNA, 22 nt, Human
uuuucacaugcuuggggacuua

SEQ ID NO: 736102 - RNA, 22 nt, Human
acaaacagcuaacauauguuaa

SEQ ID NO: 736103 - RNA, 22 nt, Human
ugucaaacaccaacauuucucc

SEQ ID NO: 736104 - RNA, 22 nt, Human
aaccuguucccugguccuugac

SEQ ID NO: 736105 - RNA, 22 nt, Human
ucugaaauucacaguugaguca

SEQ ID NO: 736106 - RNA, 22 nt, Human
gggaaauuaaugacugguugga

SEQ ID NO: 736107 - RNA, 22 nt, Human
acucagacgaaaacaugaacau

SEQ ID NO: 736108 - RNA, 22 nt, Human
ggcccucugcucacuuccuauu

SEQ ID NO: 736109 - RNA, 22 nt, Human
agcaacaggaauauuauggcaa

SEQ ID NO: 736110 - RNA, 22 nt, Human
ucugaaauaaaugcacuguuag

SEQ ID NO: 736111 - RNA, 22 nt, Human
uaguacuuaucucugucauugu

SEQ ID NO: 736112 - RNA, 22 nt, Human
aguuucacagucugucauuguu

SEQ ID NO: 736113 - RNA, 22 nt, Human
uaugaacuguaacccucaccgc

SEQ ID NO: 736114 - RNA, 22 nt, Human
uacacuuuuuacuacagauucu

SEQ ID NO: 736115 - RNA, 22 nt, Human
cagcagcuguuuacggaacacc

SEQ ID NO: 736116 - RNA, 22 nt, Human
agcaacagaagauagagugaau

SEQ ID NO: 736117 - RNA, 22 nt, Human
ucaaucaaugguuuccaaauuu

SEQ ID NO: 736118 - RNA, 22 nt, Human
ucccagggauuaggacauggau

SEQ ID NO: 736119 - RNA, 20 nt, Human
uggagccacagucagguucc

SEQ ID NO: 736120 - RNA, 22 nt, Human
cuggcuuccaugcuguaguggc

SEQ ID NO: 736121 - RNA, 17 nt, Human
ccagugccuguggcaac

SEQ ID NO: 736122 - RNA, 22 nt, Human
ucaaccagaguuuuucuuaaua

SEQ ID NO: 736123 - RNA, 22 nt, Human
auguagaagugggcauuauaga

SEQ ID NO: 736124 - RNA, 22 nt, Human
augucaacaggccuuuaaacau

SEQ ID NO: 736125 - RNA, 22 nt, Human
ugcuggccugguuagaaagggg

SEQ ID NO: 736126 - RNA, 22 nt, Human
acaaagcuuagaccuaagagau

SEQ ID NO: 736127 - RNA, 22 nt, Human
uugcugaaaacaguggguauug

SEQ ID NO: 736128 - RNA, 22 nt, Human
uaugcccagcuuaaaguacaca

SEQ ID NO: 736129 - RNA, 22 nt, Human
uuucuaaguaagauuaacuucu

SEQ ID NO: 736130 - RNA, 22 nt, Human
uucugaaaggcagguuguuugc

SEQ ID NO: 736131 - RNA, 22 nt, Human
auaugcacauacauacauaggu

SEQ ID NO: 736132 - RNA, 22 nt, Human
gcacacaugcguguauaugggu

SEQ ID NO: 736133 - RNA, 22 nt, Human
ccucuggggcaucagacaaagg

SEQ ID NO: 736134 - RNA, 22 nt, Human
gggagaugacucagugaccucg

SEQ ID NO: 736135 - RNA, 22 nt, Human
aacacugagaacaauacagagu

SEQ ID NO: 736136 - RNA, 22 nt, Human
ccuggcucccggaacagggucu

SEQ ID NO: 736137 - RNA, 22 nt, Human
uggcagggaguucguucacaac

SEQ ID NO: 736138 - RNA, 22 nt, Human
agaaaacugggaggagagcuuc

SEQ ID NO: 736139 - RNA, 22 nt, Human
gaggcaguuccugagugacaag

SEQ ID NO: 736140 - RNA, 22 nt, Human
uuacugcacgugggacauauau

SEQ ID NO: 736141 - RNA, 22 nt, Human
aaaggauuaaauaaaugugcug

SEQ ID NO: 736142 - RNA, 22 nt, Human
acaguuuacagggauuugagcu

SEQ ID NO: 736143 - RNA, 18 nt, Human
auuugcaggcaugcaggc

SEQ ID NO: 736144 - RNA, 22 nt, Human
ggacagaaaccauaugagugua

SEQ ID NO: 736145 - RNA, 22 nt, Human
uccaggaguuugagacugcagu

SEQ ID NO: 736146 - RNA, 22 nt, Human
aagggagaggagggucuuguug

SEQ ID NO: 736147 - RNA, 22 nt, Human
ggcagcagaacuggcccuguau

SEQ ID NO: 736148 - RNA, 22 nt, Human
caguggguaguggggauuagca

SEQ ID NO: 736149 - RNA, 22 nt, Human
uuguccuguuacuuguuuggau

SEQ ID NO: 736150 - RNA, 22 nt, Human
caacauuugaguaaagaaaugg

SEQ ID NO: 736151 - RNA, 22 nt, Human
acacuguagacuguugaaguac

SEQ ID NO: 736152 - RNA, 22 nt, Human
uaaaucuucuacaucaucauaa

SEQ ID NO: 736153 - RNA, 22 nt, Human
aacagaauugcugcugccaaug

SEQ ID NO: 736154 - RNA, 22 nt, Human
ggucugcccuggguggaggcgc

SEQ ID NO: 736155 - RNA, 22 nt, Human
agcaggugcauggcgagcgcgg

SEQ ID NO: 736156 - RNA, 22 nt, Human
agugugcugcuuaaacaguugu

SEQ ID NO: 736157 - RNA, 22 nt, Human
guucuucaaagugacaacuaaa

SEQ ID NO: 736158 - RNA, 22 nt, Human
aaacuagaugaaacgaguaaag

SEQ ID NO: 736159 - RNA, 19 nt, Human
gggcucuggccucaguggg

SEQ ID NO: 736160 - RNA, 22 nt, Human
gccaggccacucccggguccug

SEQ ID NO: 736161 - RNA, 22 nt, Human
cuggguguucaggagcugggcu

SEQ ID NO: 736162 - RNA, 22 nt, Human
aaauggauggaauugacauuua

SEQ ID NO: 736163 - RNA, 22 nt, Human
uccucaggcugccuggaagacu

SEQ ID NO: 736164 - RNA, 22 nt, Human
ucagcuuucucucgccaucagg

SEQ ID NO: 736165 - RNA, 22 nt, Human
ucuugaagucuuaugguuuaaa

SEQ ID NO: 736166 - RNA, 18 nt, Human
uccugguggagaaguggu

SEQ ID NO: 736167 - RNA, 22 nt, Human
uucauugaaauacagucuugac

SEQ ID NO: 736168 - RNA, 22 nt, Human
ccucccucuguuagagcugucu

SEQ ID NO: 736169 - RNA, 21 nt, Human
aucuggaaauucugccagaga

SEQ ID NO: 736170 - RNA, 22 nt, Human
ucugcugcagagcugcgggugc

SEQ ID NO: 736171 - RNA, 22 nt, Human
ggcccagucuggggcccuguga

SEQ ID NO: 736172 - RNA, 22 nt, Human
gacacagaauuuacucccgaua

SEQ ID NO: 736173 - RNA, 22 nt, Human
ccuggggcucaagauggcgccg

SEQ ID NO: 736174 - RNA, 22 nt, Human
gucucagaguccuacuuauucc

SEQ ID NO: 736175 - RNA, 19 nt, Human
ugcauauaucuaugaaaga

SEQ ID NO: 736176 - RNA, 22 nt, Human
caguucuaucauuuuagagaug

SEQ ID NO: 736177 - RNA, 22 nt, Human
agugauguugauuuuaccacuu

SEQ ID NO: 736178 - RNA, 22 nt, Human
uguaucuguaaucccagaucaa

SEQ ID NO: 736179 - RNA, 22 nt, Human
ucagagcuuaucucuugcugga

SEQ ID NO: 736180 - RNA, 22 nt, Human
gaugaaaaaagacgagcauaua

SEQ ID NO: 736181 - RNA, 22 nt, Human
guuucaaaaugaugcuguaacu

SEQ ID NO: 736182 - RNA, 22 nt, Human
caggcagagacccucuccuaaa

SEQ ID NO: 736183 - RNA, 22 nt, Human
uagagauggggucuugcuauga

SEQ ID NO: 736184 - RNA, 22 nt, Human
uuuuacaguuccaugcaaagcg

SEQ ID NO: 736185 - RNA, 22 nt, Human
caggccugacccugagcuucac

SEQ ID NO: 736186 - RNA, 20 nt, Human
ucucagcauaagaacccuuc

SEQ ID NO: 736187 - RNA, 22 nt, Human
uuugaauaaucacugggcauua

SEQ ID NO: 736188 - RNA, 22 nt, Human
cuuccucugccucccgugcuca

SEQ ID NO: 736189 - RNA, 22 nt, Human
cagaggccaccuguggccacug

SEQ ID NO: 736190 - RNA, 22 nt, Human
agaguucugaaauuaucuuuac

SEQ ID NO: 736191 - RNA, 22 nt, Human
uuuuacaggugaaaaaugaaga

SEQ ID NO: 736192 - RNA, 22 nt, Human
cuacagaagaaacuaucacuau

SEQ ID NO: 736193 - RNA, 22 nt, Human
gagacacacacaggagguggca

SEQ ID NO: 736194 - RNA, 22 nt, Human
gcuggagucuggaggugugcca

SEQ ID NO: 736195 - RNA, 22 nt, Human
agcuccugauucucagagauag

SEQ ID NO: 736196 - RNA, 22 nt, Human
cauuccaaggccaagucuaaga

SEQ ID NO: 736197 - RNA, 22 nt, Human
aagauaauauucauuaacuaga

SEQ ID NO: 736198 - RNA, 22 nt, Human
aaaugcauggcuguuuuaaagc

SEQ ID NO: 736199 - RNA, 22 nt, Human
gagcugccuguugcauagcaac

SEQ ID NO: 736200 - RNA, 22 nt, Human
auacacugguuuaugauauugu

SEQ ID NO: 736201 - RNA, 22 nt, Human
ggaggccaguccuggccgggcu

SEQ ID NO: 736202 - RNA, 22 nt, Human
aagguuaguaaguaucuuaugu

SEQ ID NO: 736203 - RNA, 22 nt, Human
ugcagcugccuagggcuggcuu

SEQ ID NO: 736204 - RNA, 19 nt, Human
ccucugcgcuguccugcuc

SEQ ID NO: 736205 - RNA, 22 nt, Human
gccucuggaagugggaaggggu

SEQ ID NO: 736206 - RNA, 22 nt, Human
gacacauaugcguauaguuuag

SEQ ID NO: 736207 - RNA, 22 nt, Human
cagagccaggucuaggagucuc

SEQ ID NO: 736208 - RNA, 23 nt, Human
aguaugaauucauuguuuuaguu

SEQ ID NO: 736209 - RNA, 22 nt, Human
uaauaucuggcauucaaacaug

SEQ ID NO: 736210 - RNA, 22 nt, Human
cauucuaaaguguuuuauaccu

SEQ ID NO: 736211 - RNA, 22 nt, Human
aaagucauguaaugauaugauu

SEQ ID NO: 736212 - RNA, 19 nt, Human
acauggcaucccaggaggu

SEQ ID NO: 736213 - RNA, 22 nt, Human
gauggcuucucucuagcuuggu

SEQ ID NO: 736214 - RNA, 22 nt, Human
aaacaauguacacaugaauguu

SEQ ID NO: 736215 - RNA, 22 nt, Human
uuucaucuuccuuggcauaggu

SEQ ID NO: 736216 - RNA, 23 nt, Human
cuucacaaucaaaaucaguucug

SEQ ID NO: 736217 - RNA, 22 nt, Human
gaagagcuuaguuguccuagaa

SEQ ID NO: 736218 - RNA, 22 nt, Human
gccaggcucucagugacugccc

SEQ ID NO: 736219 - RNA, 22 nt, Human
uuuaucuguccuuugccaguga

SEQ ID NO: 736220 - RNA, 22 nt, Human
gagagaaaggcuugcaggcugu

SEQ ID NO: 736221 - RNA, 20 nt, Human
uuucagugguuugugccuag

SEQ ID NO: 736222 - RNA, 22 nt, Human
gauuucaaaaguagauccauca

SEQ ID NO: 736223 - RNA, 22 nt, Human
ugauuacauugguaauguuuau

SEQ ID NO: 736224 - RNA, 22 nt, Human
uccugggccuguacuccauccg

SEQ ID NO: 736225 - RNA, 22 nt, Human
ucuggccuccuccaccagggaa

SEQ ID NO: 736226 - RNA, 18 nt, Human
ccucuggguuuuguuccc

SEQ ID NO: 736227 - RNA, 22 nt, Human
ucugcacauagguaggcuggaa

SEQ ID NO: 736228 - RNA, 22 nt, Human
ccuuggaguucuguuuggcuua

SEQ ID NO: 736229 - RNA, 22 nt, Human
aggcuccugauccuggggucug

SEQ ID NO: 736230 - RNA, 22 nt, Human
acaguuuacuggccuugccguu

SEQ ID NO: 736231 - RNA, 22 nt, Human
guagggacuguucucaccugag

SEQ ID NO: 736232 - RNA, 22 nt, Human
ccaggugggcgugucuucaccu

SEQ ID NO: 736233 - RNA, 22 nt, Human
ucagaaaagagaaaaucuuaua

SEQ ID NO: 736234 - RNA, 22 nt, Human
cuucuugucagugauuucuucc

SEQ ID NO: 736235 - RNA, 22 nt, Human
agugaaaugacugaaucagaua

SEQ ID NO: 736236 - RNA, 22 nt, Human
uaggcugggagccugaggcuag

SEQ ID NO: 736237 - RNA, 22 nt, Human
uagauaacuugcaccuacagga

SEQ ID NO: 736238 - RNA, 22 nt, Human
gccaggcagauaugugagcuua

SEQ ID NO: 736239 - RNA, 23 nt, Human
gugauuucagggaacagaaucag

SEQ ID NO: 736240 - RNA, 22 nt, Human
ccaugcagugcuggagcugauu

SEQ ID NO: 736241 - RNA, 22 nt, Human
auguacauuauucgagugaugg

SEQ ID NO: 736242 - RNA, 20 nt, Human
agucugccugcuccuucucc

SEQ ID NO: 736243 - RNA, 22 nt, Human
aaauuauuacaagcuaguuggc

SEQ ID NO: 736244 - RNA, 21 nt, Human
cacacagugaucuauccacau

SEQ ID NO: 736245 - RNA, 22 nt, Human
uguccuggaucaugccucugaa

SEQ ID NO: 736246 - RNA, 22 nt, Human
cagacacuaugcuaagguacua

SEQ ID NO: 736247 - RNA, 22 nt, Human
cagaaaugacaaaguaagagga

SEQ ID NO: 736248 - RNA, 22 nt, Human
uggcccuguggaggucagugag

SEQ ID NO: 736249 - RNA, 22 nt, Human
aacucucucuggcucccagcaa

SEQ ID NO: 736250 - RNA, 17 nt, Human
gcugcagcgguaggcag

SEQ ID NO: 736251 - RNA, 22 nt, Human
uuaguugauguucuggagguag

SEQ ID NO: 736252 - RNA, 22 nt, Human
gagcugugugccuggauggucu

SEQ ID NO: 736253 - RNA, 22 nt, Human
ucuccagggcccccgagcguug

SEQ ID NO: 736254 - RNA, 22 nt, Human
uguauguaaaggucuucauguu

SEQ ID NO: 736255 - RNA, 19 nt, Human
cuccuggcucugucauuuu

SEQ ID NO: 736256 - RNA, 22 nt, Human
uuuauagcugugagaccuuggg

SEQ ID NO: 736257 - RNA, 22 nt, Human
aggagucauugagagggguccu

SEQ ID NO: 736258 - RNA, 22 nt, Human
cuuaggaaaguuggcugauuuc

SEQ ID NO: 736259 - RNA, 22 nt, Human
ucuuucuucuuucauaguguga

SEQ ID NO: 736260 - RNA, 22 nt, Human
acuucucuuuaguacuaaaugu

SEQ ID NO: 736261 - RNA, 22 nt, Human
cagcauuuggaggagaggcuuu

SEQ ID NO: 736262 - RNA, 22 nt, Human
ucucagugcuauccauauucca

SEQ ID NO: 736263 - RNA, 22 nt, Human
aaauuuuguauucuaguucuag

SEQ ID NO: 736264 - RNA, 22 nt, Human
aguguggcaggaaugacuagaa

SEQ ID NO: 736265 - RNA, 22 nt, Human
aacagaaaagguagguggcuuu

SEQ ID NO: 736266 - RNA, 22 nt, Human
gcucaaaugucauggggagccu

SEQ ID NO: 736267 - RNA, 17 nt, Human
uccuucagugccucugc

SEQ ID NO: 736268 - RNA, 22 nt, Human
gggcuccaaggaggccagccug

SEQ ID NO: 736269 - RNA, 22 nt, Human
cagcugguuaucagagaggccu

SEQ ID NO: 736270 - RNA, 22 nt, Human
gcccccucuuuggagccagcca

SEQ ID NO: 736271 - RNA, 22 nt, Human
aaaauugagaguuauagauggu

SEQ ID NO: 736272 - RNA, 22 nt, Human
accauugauauaacucagucuc

SEQ ID NO: 736273 - RNA, 22 nt, Human
gggggagaagauucugcugcuu

SEQ ID NO: 736274 - RNA, 22 nt, Human
aacuuguuucuuccauucaaca

SEQ ID NO: 736275 - RNA, 22 nt, Human
aggagaggcaucaagaaaaucg

SEQ ID NO: 736276 - RNA, 22 nt, Human
ggagcacagccuugccaguacc

SEQ ID NO: 736277 - RNA, 22 nt, Human
gcccacacagcagauccuuugg

SEQ ID NO: 736278 - RNA, 22 nt, Human
gagagugauucccucccauaga

SEQ ID NO: 736279 - RNA, 22 nt, Human
uuguuaaaaugaggucauucug

SEQ ID NO: 736280 - RNA, 17 nt, Human
gagugcugguggagcuc

SEQ ID NO: 736281 - RNA, 22 nt, Human
gggcauggccaggugagggguc

SEQ ID NO: 736282 - RNA, 22 nt, Human
acagaaguuggaauuagauacu

SEQ ID NO: 736283 - RNA, 22 nt, Human
agauuuagacugccuuaaucau

SEQ ID NO: 736284 - RNA, 21 nt, Human
gcccagcaaggugagaaggcc

SEQ ID NO: 736285 - RNA, 22 nt, Human
auccacucuaagaucuguggug

SEQ ID NO: 736286 - RNA, 22 nt, Human
ugcugcugcuucuguacagccu

SEQ ID NO: 736287 - RNA, 22 nt, Human
ucuguuccuggucucuggagcu

SEQ ID NO: 736288 - RNA, 22 nt, Human
gcagacaauuuauuagcagauu

SEQ ID NO: 736289 - RNA, 22 nt, Human
aacaaauguaaaaugcagaugc

SEQ ID NO: 736290 - RNA, 22 nt, Human
caaagaugcugauguuggauca

SEQ ID NO: 736291 - RNA, 22 nt, Human
aggaggcacucacucucagggu

SEQ ID NO: 736292 - RNA, 19 nt, Human
gcuggcuggaggagggaca

SEQ ID NO: 736293 - RNA, 22 nt, Human
ugcagcugacccacuccagucc

SEQ ID NO: 736294 - RNA, 22 nt, Human
ugcacacaccgugcuucacuga

SEQ ID NO: 736295 - RNA, 22 nt, Human
cacaauuuccaagucauguuau

SEQ ID NO: 736296 - RNA, 22 nt, Human
caggaugggugucggccagcac

SEQ ID NO: 736297 - RNA, 22 nt, Human
ccagucgugacaaccaaaaaua

SEQ ID NO: 736298 - RNA, 22 nt, Human
ucagugcuuccuggaggaagcc

SEQ ID NO: 736299 - RNA, 22 nt, Human
acuguuuuccuaaugagcaaga

SEQ ID NO: 736300 - RNA, 22 nt, Human
acuaaaguccuguuguagcaua

SEQ ID NO: 736301 - RNA, 22 nt, Human
cauggcuuucccucaagagcaa

SEQ ID NO: 736302 - RNA, 22 nt, Human
ggaggggugcucagcugucacg

SEQ ID NO: 736303 - RNA, 22 nt, Human
agacauuuauucacacauuuau

SEQ ID NO: 736304 - RNA, 17 nt, Human
uggucuggaagaacuga

SEQ ID NO: 736305 - RNA, 21 nt, Human
gaggaaaugcucugguguuca

SEQ ID NO: 736306 - RNA, 22 nt, Human
uccaggagagguagaggguucc

SEQ ID NO: 736307 - RNA, 22 nt, Human
gcccagcaaggaccaagggccg

SEQ ID NO: 736308 - RNA, 21 nt, Human
acuuggccaggcccccaccug

SEQ ID NO: 736309 - RNA, 22 nt, Human
acaccaugguucccaaacugug

SEQ ID NO: 736310 - RNA, 22 nt, Human
ucucaaguuuucucauaaucuc

SEQ ID NO: 736311 - RNA, 22 nt, Human
gaccagcugauaaggcauauaa

SEQ ID NO: 736312 - RNA, 21 nt, Human
uagccauguuccuuaugguuc

SEQ ID NO: 736313 - RNA, 22 nt, Human
ucugagguuaauccugcugcau

SEQ ID NO: 736314 - RNA, 22 nt, Human
ugccuaacuccaccaggcaggu

SEQ ID NO: 736315 - RNA, 20 nt, Human
gugucugcauauagcaggug

SEQ ID NO: 736316 - RNA, 22 nt, Human
gaggcccaaggacucugucccg

SEQ ID NO: 736317 - RNA, 19 nt, Human
ugaagguguaugugcuggg

SEQ ID NO: 736318 - RNA, 22 nt, Human
aguuuggaagaauuuggucugu

SEQ ID NO: 736319 - RNA, 23 nt, Human
uuucaguuccagaaaaggggagc

SEQ ID NO: 736320 - RNA, 21 nt, Human
ugccaggccugagcugggguc

SEQ ID NO: 736321 - RNA, 19 nt, Human
cgcaggagccgaggugacc

SEQ ID NO: 736322 - RNA, 22 nt, Human
gcuccccagcuuagcccuggcu

SEQ ID NO: 736323 - RNA, 22 nt, Human
aauugacagaaaguuuacgagg

SEQ ID NO: 736324 - RNA, 22 nt, Human
accugcccacuucccaugacau

SEQ ID NO: 736325 - RNA, 22 nt, Human
cugcacagagcagggcagacac

SEQ ID NO: 736326 - RNA, 22 nt, Human
uucagauaaacuacaaauaauu

SEQ ID NO: 736327 - RNA, 22 nt, Human
aaagaaggggucuacauccaau

SEQ ID NO: 736328 - RNA, 22 nt, Human
uugaggucuugaguacugggga

SEQ ID NO: 736329 - RNA, 22 nt, Human
ucaaggcuauuaauucugugag

SEQ ID NO: 736330 - RNA, 22 nt, Human
agugucaucgugaaaacauagc

SEQ ID NO: 736331 - RNA, 22 nt, Human
ugcauguggaccccuggugccu

SEQ ID NO: 736332 - RNA, 22 nt, Human
ucagcagugugcuuggaaugga

SEQ ID NO: 736333 - RNA, 22 nt, Human
aucuggggagguaucuguaguc

SEQ ID NO: 736334 - RNA, 22 nt, Human
uuggaaggagucaaccagcuga

SEQ ID NO: 736335 - RNA, 22 nt, Human
ugguuccuucugcauuuucagc

SEQ ID NO: 736336 - RNA, 22 nt, Human
ccugguggagaggggcggagcg

SEQ ID NO: 736337 - RNA, 22 nt, Human
uucacagacauugcagacugaa

SEQ ID NO: 736338 - RNA, 22 nt, Human
aggucucuaaaauagucaaacu

SEQ ID NO: 736339 - RNA, 22 nt, Human
gagauaaagcuaccauguugau

SEQ ID NO: 736340 - RNA, 22 nt, Human
agauggagaaugacaauuaagg

SEQ ID NO: 736341 - RNA, 22 nt, Human
uacaguaauaaaaugagcuaca

SEQ ID NO: 736342 - RNA, 22 nt, Human
ccagcuuguuugaagcucguca

SEQ ID NO: 736343 - RNA, 22 nt, Human
cagcucugcuuccuuguacagg

SEQ ID NO: 736344 - RNA, 22 nt, Human
ggagacugaucugagugauaac

SEQ ID NO: 736345 - RNA, 22 nt, Human
ucuggccucuugggaugcuccc

SEQ ID NO: 736346 - RNA, 22 nt, Human
auuuccaaucucugcauauggg

SEQ ID NO: 736347 - RNA, 23 nt, Human
gugcugugagccccuuggccucc

SEQ ID NO: 736348 - RNA, 22 nt, Human
agccaggggagucagcugcugg

SEQ ID NO: 736349 - RNA, 22 nt, Human
aggcuacagccucaagagugca

SEQ ID NO: 736350 - RNA, 22 nt, Human
acuguguggaccacucugaggc

SEQ ID NO: 736351 - RNA, 21 nt, Human
cauuagggcagaagcaggaag

SEQ ID NO: 736352 - RNA, 22 nt, Human
uuucugcuuucuauccuuguca

SEQ ID NO: 736353 - RNA, 23 nt, Human
aucugggcaucuggagugguccu

SEQ ID NO: 736354 - RNA, 22 nt, Human
guauuagaagaaauuauaggua

SEQ ID NO: 736355 - RNA, 22 nt, Human
ccucucccagggagagccugag

SEQ ID NO: 736356 - RNA, 22 nt, Human
ucaguguuauuagaugagguuu

SEQ ID NO: 736357 - RNA, 22 nt, Human
aaguguguauuuuucuucagug

SEQ ID NO: 736358 - RNA, 22 nt, Human
gagccugccccuccaccaggau

SEQ ID NO: 736359 - RNA, 22 nt, Human
ccacugcuaacuugcugcagcu

SEQ ID NO: 736360 - RNA, 22 nt, Human
aacaggacacugggauggcuac

SEQ ID NO: 736361 - RNA, 22 nt, Human
caaguuuucuggguucagagca

SEQ ID NO: 736362 - RNA, 22 nt, Human
aaugcauacguguuuguggcaa

SEQ ID NO: 736363 - RNA, 22 nt, Human
caucacaucagugugaacaguu

SEQ ID NO: 736364 - RNA, 22 nt, Human
gugggacucuucuuuggcagug

SEQ ID NO: 736365 - RNA, 22 nt, Human
ucagggaagaaaugggacuuua

SEQ ID NO: 736366 - RNA, 20 nt, Human
gugggcagaugugugcaugg

SEQ ID NO: 736367 - RNA, 22 nt, Human
gccagccugugcuuggccaggc

SEQ ID NO: 736368 - RNA, 22 nt, Human
cugcagagcuugucuggaugug

SEQ ID NO: 736369 - RNA, 22 nt, Human
aaauagcaaugugaaaagagga

SEQ ID NO: 736370 - RNA, 21 nt, Human
cuuuuacauucagucaugaug

SEQ ID NO: 736371 - RNA, 22 nt, Human
cauuugcaaaccaacaagauga

SEQ ID NO: 736372 - RNA, 21 nt, Human
ugggccucaggcagcugugac

SEQ ID NO: 736373 - RNA, 22 nt, Human
cuggcagcucugagucccuucu

SEQ ID NO: 736374 - RNA, 22 nt, Human
ugaagcuuuaggauggguucau

SEQ ID NO: 736375 - RNA, 22 nt, Human
cuugggccagcccagggggcau

SEQ ID NO: 736376 - RNA, 22 nt, Human
aagugucuaacugguuacuucu

SEQ ID NO: 736377 - RNA, 19 nt, Human
ucagggggcugauaggagg

SEQ ID NO: 736378 - RNA, 22 nt, Human
gcacucugccaggucuccugau

SEQ ID NO: 736379 - RNA, 22 nt, Human
ugucaccagcugcuccucagga

SEQ ID NO: 736380 - RNA, 22 nt, Human
ugucugugggcaacgccuccca

SEQ ID NO: 736381 - RNA, 21 nt, Human
ugaucacaugaaaaccaugca

SEQ ID NO: 736382 - RNA, 22 nt, Human
uuuugccugagagugaaaauaa

SEQ ID NO: 736383 - RNA, 22 nt, Human
gccuuggacuaccacucccaca

SEQ ID NO: 736384 - RNA, 23 nt, Human
gcaguggaaugucucuguuugga

SEQ ID NO: 736385 - RNA, 22 nt, Human
uagaagcacagguuaaaggcau

SEQ ID NO: 736386 - RNA, 22 nt, Human
agguaacacuacuuaguauacu

SEQ ID NO: 736387 - RNA, 22 nt, Human
guggcaggggcgggcuguuccg

SEQ ID NO: 736388 - RNA, 22 nt, Human
aggcagcagggccacuggcuga

SEQ ID NO: 736389 - RNA, 22 nt, Human
uuggacugguuuacauuucaag

SEQ ID NO: 736390 - RNA, 22 nt, Human
gggcacugugcugggugcuuua

SEQ ID NO: 736391 - RNA, 22 nt, Human
ucucaucuucauugucucccau

SEQ ID NO: 736392 - RNA, 22 nt, Human
gagcggaggcuuggaggccagc

SEQ ID NO: 736393 - RNA, 22 nt, Human
uacugugugauuccauuuacgu

SEQ ID NO: 736394 - RNA, 22 nt, Human
accauuuuggguauuuucagag

SEQ ID NO: 736395 - RNA, 22 nt, Human
ggaagggguuaggggucccuga

SEQ ID NO: 736396 - RNA, 22 nt, Human
cagucucuuuauccaccaagcc

SEQ ID NO: 736397 - RNA, 22 nt, Human
auggcccugaccuugaugaccu

SEQ ID NO: 736398 - RNA, 22 nt, Human
gacaggugagaugaggaacacc

SEQ ID NO: 736399 - RNA, 22 nt, Human
agaucacauaauuuccugugac

SEQ ID NO: 736400 - RNA, 22 nt, Human
caaauugcuugucuguagugga

SEQ ID NO: 736401 - RNA, 22 nt, Human
cucuucuuauggccguggcuga

SEQ ID NO: 736402 - RNA, 22 nt, Human
aguguauggaauuagcucccuu

SEQ ID NO: 736403 - RNA, 22 nt, Human
uugaaauauuugggaguguuug

SEQ ID NO: 736404 - RNA, 22 nt, Human
cuuccaaagcacuuuauggacc

SEQ ID NO: 736405 - RNA, 22 nt, Human
ccuccugggagagcacggaggg

SEQ ID NO: 736406 - RNA, 22 nt, Human
aagcccugagcacugcagagaa

SEQ ID NO: 736407 - RNA, 23 nt, Human
uggcucugugucacauacaggau

SEQ ID NO: 736408 - RNA, 22 nt, Human
ugccagugcuugugucugagca

SEQ ID NO: 736409 - RNA, 22 nt, Human
uguacauacauagauauacaca

SEQ ID NO: 736410 - RNA, 22 nt, Human
aacaugauguauuuucuugucu

SEQ ID NO: 736411 - RNA, 22 nt, Human
gaagcagcagcuggggacaguu

SEQ ID NO: 736412 - RNA, 22 nt, Human
ccagucagagaaaauguccacu

SEQ ID NO: 736413 - RNA, 22 nt, Human
ugcaaacuauugguagagaugg

SEQ ID NO: 736414 - RNA, 22 nt, Human
ugaucagacaguuaugugcaug

SEQ ID NO: 736415 - RNA, 22 nt, Human
uuauuuaggagaaggaacccug

SEQ ID NO: 736416 - RNA, 22 nt, Human
gucccucaguagugcacagugg

SEQ ID NO: 736417 - RNA, 22 nt, Human
ucuucagugcaccugaugucuu

SEQ ID NO: 736418 - RNA, 22 nt, Human
aagugguguguuggaagaaauc

SEQ ID NO: 736419 - RNA, 22 nt, Human
ucagagcauucgggugacaaau

SEQ ID NO: 736420 - RNA, 22 nt, Human
gaggcugcugccaucauuaggu

SEQ ID NO: 736421 - RNA, 22 nt, Human
uuacauguaaucuaaaauaauu

SEQ ID NO: 736422 - RNA, 20 nt, Human
gaacauggcagguggagggg

SEQ ID NO: 736423 - RNA, 22 nt, Human
uuugaacuucuccauucugaug

SEQ ID NO: 736424 - RNA, 21 nt, Human
uacaagaccggauucgggccc

SEQ ID NO: 736425 - RNA, 22 nt, Human
cugggucacccaaaagggccag

SEQ ID NO: 736426 - RNA, 22 nt, Human
uuuaggcauacuuuugggagaa

SEQ ID NO: 736427 - RNA, 22 nt, Human
acagaaauauagaagguaggaa

SEQ ID NO: 736428 - RNA, 22 nt, Human
uggcuucauggcaagucuuagu

SEQ ID NO: 736429 - RNA, 22 nt, Human
uucacaaaacacuauuuucugg

SEQ ID NO: 736430 - RNA, 22 nt, Human
cuggcugugcuggaguugagga

SEQ ID NO: 736431 - RNA, 22 nt, Human
gaggugaguggggucuccaggg

SEQ ID NO: 736432 - RNA, 22 nt, Human
guuauugcaguauagaggucua

SEQ ID NO: 736433 - RNA, 22 nt, Human
auucugagaggcacaaugugga

SEQ ID NO: 736434 - RNA, 22 nt, Human
uagacauuuggcaugguuuuca

SEQ ID NO: 736435 - RNA, 22 nt, Human
aaucaaaaccuacagagguaau

SEQ ID NO: 736436 - RNA, 22 nt, Human
accaggcugugaagugagacua

SEQ ID NO: 736437 - RNA, 22 nt, Human
ggcauuugacucagugacuggg

SEQ ID NO: 736438 - RNA, 22 nt, Human
ugugugcaggcacugugccaga

SEQ ID NO: 736439 - RNA, 22 nt, Human
gcuggugauugccucaggaggc

SEQ ID NO: 736440 - RNA, 22 nt, Human
ccagugcaccaagaggccuaga

SEQ ID NO: 736441 - RNA, 22 nt, Human
gcuuguuucuauuuaucaagua

SEQ ID NO: 736442 - RNA, 22 nt, Human
auuugcugugugcuuuagagac

SEQ ID NO: 736443 - RNA, 18 nt, Human
gccagagggaagcaggug

SEQ ID NO: 736444 - RNA, 22 nt, Human
aaguaaauaucuguagucuuua

SEQ ID NO: 736445 - RNA, 21 nt, Human
ugacugaggcuucuucacaca

SEQ ID NO: 736446 - RNA, 22 nt, Human
cagaaaaggaagagcuauguaa

SEQ ID NO: 736447 - RNA, 22 nt, Human
gauccuggcacagguugguccc

SEQ ID NO: 736448 - RNA, 22 nt, Human
ugugacuuagggcaggugagau

SEQ ID NO: 736449 - RNA, 22 nt, Human
guggccguguaacuugaguaca

SEQ ID NO: 736450 - RNA, 22 nt, Human
ugcuacagagccaggaagagug

SEQ ID NO: 736451 - RNA, 22 nt, Human
augcuauuccagaauguaaauu

SEQ ID NO: 736452 - RNA, 22 nt, Human
ugucuguaagguguuuauguua

SEQ ID NO: 736453 - RNA, 22 nt, Human
uccagaauacucugaaaucauu

SEQ ID NO: 736454 - RNA, 22 nt, Human
agaggcaggagguugacuugag

SEQ ID NO: 736455 - RNA, 22 nt, Human
uggaaauguuucuugagcucag

SEQ ID NO: 736456 - RNA, 16 nt, Human
uccaggcauaucugag

SEQ ID NO: 736457 - RNA, 22 nt, Human
acacagcaacuugcaguaugga

SEQ ID NO: 736458 - RNA, 22 nt, Human
uaugcacugguacuauucgugu

SEQ ID NO: 736459 - RNA, 22 nt, Human
ccagagggaacugggccucauu

SEQ ID NO: 736460 - RNA, 22 nt, Human
ucaggaguaaggguaacccaga

SEQ ID NO: 736461 - RNA, 22 nt, Human
aagaaaucagaaaagcauucgu

SEQ ID NO: 736462 - RNA, 22 nt, Human
cacauuaaaauccuaacuucca

SEQ ID NO: 736463 - RNA, 19 nt, Human
guccacuccacucggucuc

SEQ ID NO: 736464 - RNA, 22 nt, Human
gauauuuaacucucacaggucc

SEQ ID NO: 736465 - RNA, 22 nt, Human
uagcaauguaagauguuaacac

SEQ ID NO: 736466 - RNA, 22 nt, Human
uucagggacuuugauguaucag

SEQ ID NO: 736467 - RNA, 22 nt, Human
uaugagaacgggggcguguggg

SEQ ID NO: 736468 - RNA, 22 nt, Human
uaugauauucuaaauugacacc

SEQ ID NO: 736469 - RNA, 22 nt, Human
gcucagggaguuucacagugua

SEQ ID NO: 736470 - RNA, 22 nt, Human
agccucugcacgggcacgggug

SEQ ID NO: 736471 - RNA, 22 nt, Human
ugugugauugcacuuauaugag

SEQ ID NO: 736472 - RNA, 22 nt, Human
gaauugcuugcugagauuaaag

SEQ ID NO: 736473 - RNA, 23 nt, Human
gugagcagcccacuaggaaugcc

SEQ ID NO: 736474 - RNA, 22 nt, Human
acaggacaaaaaucuggauggc

SEQ ID NO: 736475 - RNA, 22 nt, Human
cacagcaggugcuuaaugauua

SEQ ID NO: 736476 - RNA, 22 nt, Human
ugcagccuuuagaaguucagau

SEQ ID NO: 736477 - RNA, 22 nt, Human
augcuuuauuauuuugcaggga

SEQ ID NO: 736478 - RNA, 22 nt, Human
cugcaguuugaccuuguuuucu

SEQ ID NO: 736479 - RNA, 22 nt, Human
cuaaggcagguccauuccagga

SEQ ID NO: 736480 - RNA, 22 nt, Human
gugugccaccacugacaggauu

SEQ ID NO: 736481 - RNA, 22 nt, Human
ccucuggguaucuguggaagua

SEQ ID NO: 736482 - RNA, 22 nt, Human
cagggcuugccuugccccggcg

SEQ ID NO: 736483 - RNA, 22 nt, Human
aguccaagaccaaggugucacc

SEQ ID NO: 736484 - RNA, 22 nt, Human
acaguguuguauuuaguuugau

SEQ ID NO: 736485 - RNA, 22 nt, Human
cugaaucaugccauuuugcuua

SEQ ID NO: 736486 - RNA, 22 nt, Human
guccagagggcugcaggaugcu

SEQ ID NO: 736487 - RNA, 22 nt, Human
ucucugaauucugaugcaagug

SEQ ID NO: 736488 - RNA, 22 nt, Human
uuucaugaggggcaaaaucuca

SEQ ID NO: 736489 - RNA, 22 nt, Human
gccuggagugguccugcugccc

SEQ ID NO: 736490 - RNA, 22 nt, Human
gaaugaacaaaugugguggaga

SEQ ID NO: 736491 - RNA, 22 nt, Human
gggcagcugccccucucugggc

SEQ ID NO: 736492 - RNA, 21 nt, Human
uccagcucuuauguucaugaa

SEQ ID NO: 736493 - RNA, 22 nt, Human
gaauguaauagucaguagaaca

SEQ ID NO: 736494 - RNA, 22 nt, Human
gaggaucauuugagccuaggag

SEQ ID NO: 736495 - RNA, 22 nt, Human
uaauaagcguagaagguauauc

SEQ ID NO: 736496 - RNA, 22 nt, Human
agccucugauggcucccaagga

SEQ ID NO: 736497 - RNA, 22 nt, Human
ucacaguacaugauucaguggu

SEQ ID NO: 736498 - RNA, 22 nt, Human
aacagcuaguggucuagacuuu

SEQ ID NO: 736499 - RNA, 22 nt, Human
uuauuugacuucuugcuaugcu

SEQ ID NO: 736500 - RNA, 22 nt, Human
auaugggucaugugauguucaa

SEQ ID NO: 736501 - RNA, 18 nt, Human
caggucagccuggccuca

SEQ ID NO: 736502 - RNA, 22 nt, Human
aggcuacagauacagaggcuac

SEQ ID NO: 736503 - RNA, 22 nt, Human
uuccuggcacauaguuagugcu

SEQ ID NO: 736504 - RNA, 22 nt, Human
ucagcaggcucugguugaccau

SEQ ID NO: 736505 - RNA, 22 nt, Human
auccugcuuguuacuuauagag

SEQ ID NO: 736506 - RNA, 22 nt, Human
acugaacagccuuucaaacuua

SEQ ID NO: 736507 - RNA, 22 nt, Human
aauuuauuuccugccaguacac

SEQ ID NO: 736508 - RNA, 22 nt, Human
uaaugucuccaggguugaccua

SEQ ID NO: 736509 - RNA, 22 nt, Human
gcugccaguuccuucuuacucc

SEQ ID NO: 736510 - RNA, 22 nt, Human
ugaaugugaugcuaaacauaug

SEQ ID NO: 736511 - RNA, 22 nt, Human
ccagggaaacuuuggaguggag

SEQ ID NO: 736512 - RNA, 23 nt, Human
agggagcuaaaaggcuggagcag

SEQ ID NO: 736513 - RNA, 22 nt, Human
gcuggcuuaauagggaugggcu

SEQ ID NO: 736514 - RNA, 22 nt, Human
acgcagaagggccuggcgugcc

SEQ ID NO: 736515 - RNA, 22 nt, Human
cugcacauguucaucaugacaa

SEQ ID NO: 736516 - RNA, 22 nt, Human
aaggcaguggcuggaaaaccug

SEQ ID NO: 736517 - RNA, 22 nt, Human
cuuuuucuaaucauaauugucu

SEQ ID NO: 736518 - RNA, 22 nt, Human
cauguaauccuggggagaugaa

SEQ ID NO: 736519 - RNA, 22 nt, Human
ugaagacaaagucaggcccaga

SEQ ID NO: 736520 - RNA, 22 nt, Human
uuuguguguauauccuuccaga

SEQ ID NO: 736521 - RNA, 22 nt, Human
uggguucuuucacuucucaguu

SEQ ID NO: 736522 - RNA, 22 nt, Human
uugugaaaucguguuuggaagc

SEQ ID NO: 736523 - RNA, 22 nt, Human
acagcauaaucacuucuuucuu

SEQ ID NO: 736524 - RNA, 22 nt, Human
gcagggcaucccugagcgggug

SEQ ID NO: 736525 - RNA, 18 nt, Human
cagggcuguggggucacu

SEQ ID NO: 736526 - RNA, 21 nt, Human
cugagcuggggugaagguugc

SEQ ID NO: 736527 - RNA, 22 nt, Human
agucuuuccugcuugacuguuc

SEQ ID NO: 736528 - RNA, 22 nt, Human
aagcugcuggugacugggcuga

SEQ ID NO: 736529 - RNA, 22 nt, Human
caugucacaauucuuaauggga

SEQ ID NO: 736530 - RNA, 22 nt, Human
uagaagauucauuuccucugaa

SEQ ID NO: 736531 - RNA, 22 nt, Human
uuucccacacaguccacugcag

SEQ ID NO: 736532 - RNA, 23 nt, Human
aucuaauuucuccaaaucucuac

SEQ ID NO: 736533 - RNA, 22 nt, Human
uuacgaguuugcaauuuuaaau

SEQ ID NO: 736534 - RNA, 22 nt, Human
ugguggcagcaggagggccccu

SEQ ID NO: 736535 - RNA, 22 nt, Human
agagccagccuucucagcuuac

SEQ ID NO: 736536 - RNA, 18 nt, Human
acauugauggcuuuaagc

SEQ ID NO: 736537 - RNA, 22 nt, Human
cuggccagugacugcucacccg

SEQ ID NO: 736538 - RNA, 22 nt, Human
cagcaagggauaaagaguuacu

SEQ ID NO: 736539 - RNA, 22 nt, Human
auuucuucaggucagaaauaga

SEQ ID NO: 736540 - RNA, 22 nt, Human
ccacugccaugggcuaggcaug

SEQ ID NO: 736541 - RNA, 22 nt, Human
gaggcuggacgugcauuucuac

SEQ ID NO: 736542 - RNA, 22 nt, Human
cacauaauaaauguuccugaug

SEQ ID NO: 736543 - RNA, 22 nt, Human
auguaucagauaaagcaugugg

SEQ ID NO: 736544 - RNA, 22 nt, Human
cugugcauggccaucagugccc

SEQ ID NO: 736545 - RNA, 22 nt, Human
ccuucagaccuagacaggaauc

SEQ ID NO: 736546 - RNA, 22 nt, Human
caggcagaaauuuuguuucauu

SEQ ID NO: 736547 - RNA, 22 nt, Human
acaaggacaugcaauuuggauu

SEQ ID NO: 736548 - RNA, 19 nt, Human
ucccuuccugucgggcucc

SEQ ID NO: 736549 - RNA, 22 nt, Human
aucacgugcugagaguguuauu

SEQ ID NO: 736550 - RNA, 22 nt, Human
aaacaguuuauaacaugauacu

SEQ ID NO: 736551 - RNA, 22 nt, Human
ucucuucccggauaaaguaagu

SEQ ID NO: 736552 - RNA, 22 nt, Human
ucagcaguuuuauaugcagcuu

SEQ ID NO: 736553 - RNA, 22 nt, Human
ugagacaguuggugaaaucuaa

SEQ ID NO: 736554 - RNA, 22 nt, Human
ucuucucuacaccagcagcccc

SEQ ID NO: 736555 - RNA, 22 nt, Human
agaaguuucacaauggguuuua

SEQ ID NO: 736556 - RNA, 22 nt, Human
aagccaggccauucucugguuc

SEQ ID NO: 736557 - RNA, 22 nt, Human
cugggccuagaggaagcugaca

SEQ ID NO: 736558 - RNA, 22 nt, Human
aguggcagaacuaccuuuuuau

SEQ ID NO: 736559 - RNA, 23 nt, Human
cucagagguguuuuucacuuacu

SEQ ID NO: 736560 - RNA, 22 nt, Human
auguguuugguuauaugguauu

SEQ ID NO: 736561 - RNA, 22 nt, Human
uggcuucugagucuccugacau

SEQ ID NO: 736562 - RNA, 22 nt, Human
uucaaaggaaaggcagugucaa

SEQ ID NO: 736563 - RNA, 22 nt, Human
caggcagcucaaccuugggagc

SEQ ID NO: 736564 - RNA, 22 nt, Human
auccaugaucaauuuauuacua

SEQ ID NO: 736565 - RNA, 22 nt, Human
gccacccccaaguagguggucu

SEQ ID NO: 736566 - RNA, 19 nt, Human
ugagugggccccugcagac

SEQ ID NO: 736567 - RNA, 23 nt, Human
cccuggaguaaauucuuggaagg

SEQ ID NO: 736568 - RNA, 22 nt, Human
gucaagucaugacucaaaggaa

SEQ ID NO: 736569 - RNA, 22 nt, Human
gccagcugagaaaucauugaua

SEQ ID NO: 736570 - RNA, 22 nt, Human
uccugcugagcgucugucauuu

SEQ ID NO: 736571 - RNA, 22 nt, Human
uauuucucagcauuuuacaucc

SEQ ID NO: 736572 - RNA, 22 nt, Human
gccagcugcccucugcuggucc

SEQ ID NO: 736573 - RNA, 22 nt, Human
gagcaggcaaagaugaaaggag

SEQ ID NO: 736574 - RNA, 22 nt, Human
aggcaggcaaguucauaugagg

SEQ ID NO: 736575 - RNA, 22 nt, Human
gacggggcagccagcugguggc

SEQ ID NO: 736576 - RNA, 19 nt, Human
uccugggcugcgucuugcc

SEQ ID NO: 736577 - RNA, 21 nt, Human
ccagcuuucccaagucccuuu

SEQ ID NO: 736578 - RNA, 23 nt, Human
uuuuagugacuccuuuaucugcc

SEQ ID NO: 736579 - RNA, 22 nt, Human
ucugucauaagugcugaaguau

SEQ ID NO: 736580 - RNA, 21 nt, Human
uguguauguccaaugcccuac

SEQ ID NO: 736581 - RNA, 22 nt, Human
cccucugaccuccugccacagu

SEQ ID NO: 736582 - RNA, 22 nt, Human
cccaaccccaacuuccuauguu

SEQ ID NO: 736583 - RNA, 22 nt, Human
gcagggcggcccagagcaggcc

SEQ ID NO: 736584 - RNA, 22 nt, Human
aaggggugggcauuagagcagu

SEQ ID NO: 736585 - RNA, 22 nt, Human
aucagaccauccagcguggaug

SEQ ID NO: 736586 - RNA, 22 nt, Human
uaucuauuauguucuauguguc

SEQ ID NO: 736587 - RNA, 22 nt, Human
uucuccucuguuaccuugcaaa

SEQ ID NO: 736588 - RNA, 22 nt, Human
agucuccacacuggcagaugcc

SEQ ID NO: 736589 - RNA, 22 nt, Human
uuccugugugaccgagacagug

SEQ ID NO: 736590 - RNA, 22 nt, Human
ccugagagcgaguggccucaug

SEQ ID NO: 736591 - RNA, 22 nt, Human
agcaagcacacuucaugugaac

SEQ ID NO: 736592 - RNA, 22 nt, Human
ucacaacucacagccaccggug

SEQ ID NO: 736593 - RNA, 22 nt, Human
ccuggcagaaagaguuacaccu

SEQ ID NO: 736594 - RNA, 22 nt, Human
uaaacucuucuguagaaucaga

SEQ ID NO: 736595 - RNA, 22 nt, Human
uugccguccuuacuccagcgga

SEQ ID NO: 736596 - RNA, 22 nt, Human
gaauuguacgcuuuacauaggu

SEQ ID NO: 736597 - RNA, 22 nt, Human
agggcuguguuugcacccucug

SEQ ID NO: 736598 - RNA, 22 nt, Human
uuccaugacugaagcaggggcg

SEQ ID NO: 736599 - RNA, 22 nt, Human
cagaggcugggaccucaggcau

SEQ ID NO: 736600 - RNA, 22 nt, Human
uagaggugagaggaacuuugga

SEQ ID NO: 736601 - RNA, 22 nt, Human
ugccugccccacaagggguugc

SEQ ID NO: 736602 - RNA, 22 nt, Human
cugggacuugaugaaaugacug

SEQ ID NO: 736603 - RNA, 22 nt, Human
aggcacugugcagucccaagca

SEQ ID NO: 736604 - RNA, 22 nt, Human
cuauucaguugugggcaacaau

SEQ ID NO: 736605 - RNA, 22 nt, Human
ccaggugcuagcaaucacuguc

SEQ ID NO: 736606 - RNA, 22 nt, Human
gaggaaggagggaaagcgcgcg

SEQ ID NO: 736607 - RNA, 22 nt, Human
agaggaauaugggugcacuaga

SEQ ID NO: 736608 - RNA, 22 nt, Human
gcucugcucccucaaaugacau

SEQ ID NO: 736609 - RNA, 22 nt, Human
ucagugcugaguagcgugcacc

SEQ ID NO: 736610 - RNA, 22 nt, Human
uggcuggcuggaccacaccugc

SEQ ID NO: 736611 - RNA, 22 nt, Human
ucagcuggcagguucugggaag

SEQ ID NO: 736612 - RNA, 22 nt, Human
ugcaggcagggccagcgugagg

SEQ ID NO: 736613 - RNA, 22 nt, Human
agaagccaaaggggccagauau

SEQ ID NO: 736614 - RNA, 22 nt, Human
cacacagcaacaagaauagcca

SEQ ID NO: 736615 - RNA, 22 nt, Human
acagcuaucugacuuugacuca

SEQ ID NO: 736616 - RNA, 22 nt, Human
uagagaauggccuugaaguagu

SEQ ID NO: 736617 - RNA, 22 nt, Human
gucuccugcuagcaagcaccac

SEQ ID NO: 736618 - RNA, 23 nt, Human
uuguauuuuuaguagagacaggg

SEQ ID NO: 736619 - RNA, 22 nt, Human
cagggaugagcagauggagcaa

SEQ ID NO: 736620 - RNA, 22 nt, Human
cuuuggcuuuuagauauccauu

SEQ ID NO: 736621 - RNA, 22 nt, Human
augaugaaaacugaagguuagg

SEQ ID NO: 736622 - RNA, 22 nt, Human
uuauucugucuuuggucucaau

SEQ ID NO: 736623 - RNA, 22 nt, Human
aagaggcuuauagucuuccugu

SEQ ID NO: 736624 - RNA, 22 nt, Human
cuguggcucauucuugguggca

SEQ ID NO: 736625 - RNA, 22 nt, Human
ugggacacaaaccagaccagga

SEQ ID NO: 736626 - RNA, 22 nt, Human
ccagaagcuucaaggagauucu

SEQ ID NO: 736627 - RNA, 22 nt, Human
ugauaaacuuagaaagaauguu

SEQ ID NO: 736628 - RNA, 22 nt, Human
uaguuuguaaugaggagaagua

SEQ ID NO: 736629 - RNA, 22 nt, Human
uccaagcauguggucaggagcc

SEQ ID NO: 736630 - RNA, 22 nt, Human
caggugcccagcuccugcugug

SEQ ID NO: 736631 - RNA, 22 nt, Human
auuauuaggacuacugggguug

SEQ ID NO: 736632 - RNA, 22 nt, Human
aaauugcgcacauuucuccguu

SEQ ID NO: 736633 - RNA, 22 nt, Human
ggcccugugguuuugcaaaguc

SEQ ID NO: 736634 - RNA, 22 nt, Human
cuuuggcacagucucauuugau

SEQ ID NO: 736635 - RNA, 22 nt, Human
ucuggggaugagguccagugau

SEQ ID NO: 736636 - RNA, 22 nt, Human
uggggucgaggguucucuggca

SEQ ID NO: 736637 - RNA, 20 nt, Human
caaauggcuuuuauuuccuu

SEQ ID NO: 736638 - RNA, 22 nt, Human
ggcagcugcugcauuacguugu

SEQ ID NO: 736639 - RNA, 22 nt, Human
aagagcuggagcugcuacagga

SEQ ID NO: 736640 - RNA, 22 nt, Human
gggcucuguguucuagcucucg

SEQ ID NO: 736641 - RNA, 22 nt, Human
ccaguguuuucauccucccuug

SEQ ID NO: 736642 - RNA, 22 nt, Human
ugagggaauauugauagauccg

SEQ ID NO: 736643 - RNA, 22 nt, Human
auuaauacauuauagggauugu

SEQ ID NO: 736644 - RNA, 22 nt, Human
uuuuagauaguuuaacugcacu

SEQ ID NO: 736645 - RNA, 22 nt, Human
gggcugagcacauacugacagc

SEQ ID NO: 736646 - RNA, 22 nt, Human
ugcacccucaucagucaaaugg

SEQ ID NO: 736647 - RNA, 22 nt, Human
ggucaaagugaggagucagguu

SEQ ID NO: 736648 - RNA, 22 nt, Human
ugcacaggaggcuguggagaag

SEQ ID NO: 736649 - RNA, 22 nt, Human
ccugggcuugguuguugagaac

SEQ ID NO: 736650 - RNA, 22 nt, Human
aacagugucugugguuaaaggu

SEQ ID NO: 736651 - RNA, 22 nt, Human
ugagaccugccucugcacuagg

SEQ ID NO: 736652 - RNA, 22 nt, Human
auuagggaaggauuuggccuga

SEQ ID NO: 736653 - RNA, 22 nt, Human
ggcaagcauaaccuguacagcc

SEQ ID NO: 736654 - RNA, 22 nt, Human
ccacugcucugccaggagcugg

SEQ ID NO: 736655 - RNA, 22 nt, Human
gaagaaggugccagaggcuuac

SEQ ID NO: 736656 - RNA, 22 nt, Human
cuggguguuggguacugaccgu

SEQ ID NO: 736657 - RNA, 17 nt, Human
uauggcuguguuugugc

SEQ ID NO: 736658 - RNA, 22 nt, Human
uggcagugguaccggcucucag

SEQ ID NO: 736659 - RNA, 22 nt, Human
cuuuggcugacagguuucuggu

SEQ ID NO: 736660 - RNA, 22 nt, Human
acauuuauauuuaguggggaau

SEQ ID NO: 736661 - RNA, 22 nt, Human
gcaggcaccgcggcggcagguu

SEQ ID NO: 736662 - RNA, 22 nt, Human
ugcugaggucauuuccaaguga

SEQ ID NO: 736663 - RNA, 22 nt, Human
ugggagcaccuugagggcagaa

SEQ ID NO: 736664 - RNA, 22 nt, Human
guguuuauaggagugaaugcug

SEQ ID NO: 736665 - RNA, 22 nt, Human
auaguuugaaggcuguucuacu

SEQ ID NO: 736666 - RNA, 22 nt, Human
caggaugagaggcccagggaag

SEQ ID NO: 736667 - RNA, 23 nt, Human
ggaaaaacacugugucuuggcag

SEQ ID NO: 736668 - RNA, 22 nt, Human
gccugggaagacuaagugggag

SEQ ID NO: 736669 - RNA, 23 nt, Human
uagcagcauuuuuagccucuguc

SEQ ID NO: 736670 - RNA, 22 nt, Human
gaauccuugguuuuaagcaaua

SEQ ID NO: 736671 - RNA, 22 nt, Human
uguguacacaugacaggcaccc

SEQ ID NO: 736672 - RNA, 21 nt, Human
aguucacaggaacaagcaggg

SEQ ID NO: 736673 - RNA, 22 nt, Human
auccugaguucucagagucucc

SEQ ID NO: 736674 - RNA, 20 nt, Human
cucugcuuuccaccuuucag

SEQ ID NO: 736675 - RNA, 22 nt, Human
gacuugggcugagggccagcag

SEQ ID NO: 736676 - RNA, 21 nt, Human
agcagacagaugcacgcacac

SEQ ID NO: 736677 - RNA, 22 nt, Human
uuuaaaugcagacguugauuca

SEQ ID NO: 736678 - RNA, 22 nt, Human
ggacugggauucuggaucugcu

SEQ ID NO: 736679 - RNA, 22 nt, Human
uauuugaagggagaaagugcca

SEQ ID NO: 736680 - RNA, 21 nt, Human
aaguugucucuuuugguuccu

SEQ ID NO: 736681 - RNA, 22 nt, Human
auuaagaucauuguagaagauu

SEQ ID NO: 736682 - RNA, 20 nt, Human
cacaagagaauacacacugg

SEQ ID NO: 736683 - RNA, 22 nt, Human
aacuuucugaaaagcuugauca

SEQ ID NO: 736684 - RNA, 22 nt, Human
uaccaugauguuugaguuacua

SEQ ID NO: 736685 - RNA, 18 nt, Human
acagaaauagcugugccu

SEQ ID NO: 736686 - RNA, 21 nt, Human
gcuggcucucugacgugcuuu

SEQ ID NO: 736687 - RNA, 22 nt, Human
aagaugcagcuuccacuuuugc

SEQ ID NO: 736688 - RNA, 22 nt, Human
augauuuaaagucauugugaac

SEQ ID NO: 736689 - RNA, 22 nt, Human
cccaggaggugugcccaacucg

SEQ ID NO: 736690 - RNA, 22 nt, Human
acugcacagauuaaguuagauu

SEQ ID NO: 736691 - RNA, 23 nt, Human
ugagcugguauuguccaucucca

SEQ ID NO: 736692 - RNA, 22 nt, Human
uguacaaagaguauagcuuuga

SEQ ID NO: 736693 - RNA, 22 nt, Human
uccuggccucugagucaagaac

SEQ ID NO: 736694 - RNA, 22 nt, Human
agggaagccaagccuuagagaa

SEQ ID NO: 736695 - RNA, 22 nt, Human
gugaagaaggcaauacaaagaa

SEQ ID NO: 736696 - RNA, 22 nt, Human
auuucucaguaaucucagcaau

SEQ ID NO: 736697 - RNA, 23 nt, Human
augagguaaagaucagcuuuaaa

SEQ ID NO: 736698 - RNA, 22 nt, Human
ucucucagucagaugcuaaaga

SEQ ID NO: 736699 - RNA, 22 nt, Human
ggcacacagcggaauuugcucu

SEQ ID NO: 736700 - RNA, 22 nt, Human
uuucugcacauuucuaaaguug

SEQ ID NO: 736701 - RNA, 22 nt, Human
agccccuguccucucugaugac

SEQ ID NO: 736702 - RNA, 22 nt, Human
caacaguuuauaguguuaucuu

SEQ ID NO: 736703 - RNA, 19 nt, Human
ugugugcaugcgcacgugu

SEQ ID NO: 736704 - RNA, 22 nt, Human
aagucucuuuaccucuccaggc

SEQ ID NO: 736705 - RNA, 22 nt, Human
cuggcagauagccacgccuguc

SEQ ID NO: 736706 - RNA, 23 nt, Human
uggcugagcccacuaucuuggcc

SEQ ID NO: 736707 - RNA, 22 nt, Human
ugagaccauuugacauacagug

SEQ ID NO: 736708 - RNA, 22 nt, Human
ugugggaggucuggaaggcucc

SEQ ID NO: 736709 - RNA, 22 nt, Human
gaccugggguaagcuuggcaac

SEQ ID NO: 736710 - RNA, 22 nt, Human
ugggccaguccagccccaggga

SEQ ID NO: 736711 - RNA, 22 nt, Human
cucugagauaguuucuaucaau

SEQ ID NO: 736712 - RNA, 21 nt, Human
auauuguagguaaagugcagg

SEQ ID NO: 736713 - RNA, 23 nt, Human
uggaggcaggaugcuaaggaguc

SEQ ID NO: 736714 - RNA, 22 nt, Human
cuggacucagggugcuccagcg

SEQ ID NO: 736715 - RNA, 22 nt, Human
gugaaggaggggccacagauau

SEQ ID NO: 736716 - RNA, 22 nt, Human
ugcuggaaagaauuuucuguua

SEQ ID NO: 736717 - RNA, 22 nt, Human
cacauucacauuuuucccucua

SEQ ID NO: 736718 - RNA, 22 nt, Human
ugaaacaaauuuggaaaaucua

SEQ ID NO: 736719 - RNA, 22 nt, Human
ccucugcaccauagccuucagc

SEQ ID NO: 736720 - RNA, 22 nt, Human
ugugugaaggagccacuguuca

SEQ ID NO: 736721 - RNA, 22 nt, Human
agcagggcuuugcagacuuggg

SEQ ID NO: 736722 - RNA, 22 nt, Human
uguguucaaugacuucaucuuu

SEQ ID NO: 736723 - RNA, 22 nt, Human
uagagacaccaguaccauucug

SEQ ID NO: 736724 - RNA, 22 nt, Human
gcagcuuucuaagcuuuauugc

SEQ ID NO: 736725 - RNA, 22 nt, Human
caaagagguuuugagggcagcu

SEQ ID NO: 736726 - RNA, 22 nt, Human
cugcuccacaccuccauuuccu

SEQ ID NO: 736727 - RNA, 22 nt, Human
ucauauuaacaaugaaacucag

SEQ ID NO: 736728 - RNA, 22 nt, Human
aucacaaaggguuuucucugag

SEQ ID NO: 736729 - RNA, 22 nt, Human
gguccuggaaguguaaguggca

SEQ ID NO: 736730 - RNA, 21 nt, Human
aguguaggucauuagcuguug

SEQ ID NO: 736731 - RNA, 22 nt, Human
gauugaaaggaaaaccagagug

SEQ ID NO: 736732 - RNA, 20 nt, Human
agagcagcaguuggugaggu

SEQ ID NO: 736733 - RNA, 22 nt, Human
agguauauguucauguaugugu

SEQ ID NO: 736734 - RNA, 21 nt, Human
ugaguuaaaaugucagugcca

SEQ ID NO: 736735 - RNA, 22 nt, Human
uggcccugcccucuucaucuuu

SEQ ID NO: 736736 - RNA, 22 nt, Human
caaagguauaaguuaauauaca

SEQ ID NO: 736737 - RNA, 22 nt, Human
ggcagccaugugggcagcgagu

SEQ ID NO: 736738 - RNA, 20 nt, Human
cugcauguuggagguguacc

SEQ ID NO: 736739 - RNA, 22 nt, Human
agcccccaaaagugcuuaugau

SEQ ID NO: 736740 - RNA, 22 nt, Human
aggccacauagcuugcauguag

SEQ ID NO: 736741 - RNA, 22 nt, Human
uucuccaacacaagcaugaugu

SEQ ID NO: 736742 - RNA, 22 nt, Human
gcaugcaggaaguuuuuuggga

SEQ ID NO: 736743 - RNA, 22 nt, Human
uuaguaauguguuaauaugaau

SEQ ID NO: 736744 - RNA, 22 nt, Human
gucaacauuuacugcccuggcc

SEQ ID NO: 736745 - RNA, 17 nt, Human
guccuacccauggucua

SEQ ID NO: 736746 - RNA, 22 nt, Human
aauaguauuuauuuggaaaaag

SEQ ID NO: 736747 - RNA, 22 nt, Human
agggacaugaggaugaucuaga

SEQ ID NO: 736748 - RNA, 22 nt, Human
ugagcccugaggaucuguucgg

SEQ ID NO: 736749 - RNA, 22 nt, Human
aaucuucacucuuaacugugca

SEQ ID NO: 736750 - RNA, 22 nt, Human
aauauuuauauuucucuucccu

SEQ ID NO: 736751 - RNA, 20 nt, Human
ccauggccacaucugugcug

SEQ ID NO: 736752 - RNA, 17 nt, Human
cuggccaguguacuugg

SEQ ID NO: 736753 - RNA, 22 nt, Human
ugugucuguguauacacggcau

SEQ ID NO: 736754 - RNA, 22 nt, Human
ggaaaucucuacuuugucauuu

SEQ ID NO: 736755 - RNA, 22 nt, Human
aacaggcaacaguugacucuga

SEQ ID NO: 736756 - RNA, 22 nt, Human
augcuuccaauauucucccuuu

SEQ ID NO: 736757 - RNA, 22 nt, Human
cgauggagagguccugauaguu

SEQ ID NO: 736758 - RNA, 22 nt, Human
agaaacugaacacaagagucgg

SEQ ID NO: 736759 - RNA, 22 nt, Human
ucaaggaaggucuguugcucca

SEQ ID NO: 736760 - RNA, 22 nt, Human
aauguucaaacagaucacuuag

SEQ ID NO: 736761 - RNA, 22 nt, Human
uccuucagcuacucaguuucca

SEQ ID NO: 736762 - RNA, 22 nt, Human
uggggaugaaacccaggcaucu

SEQ ID NO: 736763 - RNA, 22 nt, Human
aauauguuccacuuaaagcugg

SEQ ID NO: 736764 - RNA, 22 nt, Human
agaguacugccucaguuaugaa

SEQ ID NO: 736765 - RNA, 22 nt, Human
ucuguucaguugauuagacaga

SEQ ID NO: 736766 - RNA, 22 nt, Human
uguuugugcugccuggugggca

SEQ ID NO: 736767 - RNA, 22 nt, Human
cccguuuaauuacucgagcugu

SEQ ID NO: 736768 - RNA, 22 nt, Human
guucacauguggucaugcuguc

SEQ ID NO: 736769 - RNA, 22 nt, Human
acaggaagugcuggcacuuaca

SEQ ID NO: 736770 - RNA, 22 nt, Human
cagcaagauggugaaugagacg

SEQ ID NO: 736771 - RNA, 17 nt, Human
accaccucucaccagca

SEQ ID NO: 736772 - RNA, 22 nt, Human
gcaaggaacaaaugcucugcuu

SEQ ID NO: 736773 - RNA, 22 nt, Human
ucagugcugcuuuaugacaguu

SEQ ID NO: 736774 - RNA, 22 nt, Human
cagggaugggauggagucaguu

SEQ ID NO: 736775 - RNA, 22 nt, Human
caucuaauaccucauuuaaucu

SEQ ID NO: 736776 - RNA, 20 nt, Human
gcugaccccugcugucaugc

SEQ ID NO: 736777 - RNA, 22 nt, Human
gaagcacauuagaugugucuuc

SEQ ID NO: 736778 - RNA, 22 nt, Human
ucagaggaauaaugcugcauuu

SEQ ID NO: 736779 - RNA, 22 nt, Human
uuucaugauuaacuuagugaau

SEQ ID NO: 736780 - RNA, 22 nt, Human
uuccuccuuguccuaguuacug

SEQ ID NO: 736781 - RNA, 22 nt, Human
aauguuuucauuauccuaacug

SEQ ID NO: 736782 - RNA, 22 nt, Human
gguguagaaaagggaaggguuu

SEQ ID NO: 736783 - RNA, 22 nt, Human
guccaucuguaggagggacaca

SEQ ID NO: 736784 - RNA, 22 nt, Human
uggcgcaguuucucugcugccu

SEQ ID NO: 736785 - RNA, 22 nt, Human
aacaucucauggacuacauucu

SEQ ID NO: 736786 - RNA, 22 nt, Human
ccagcugugcuguuggcuuguc

SEQ ID NO: 736787 - RNA, 22 nt, Human
ucuggcuucuccuagagcaaug

SEQ ID NO: 736788 - RNA, 22 nt, Human
cagugucaggaucaguauauuu

SEQ ID NO: 736789 - RNA, 22 nt, Human
gagcaggacagcagcuuccugg

SEQ ID NO: 736790 - RNA, 22 nt, Human
agaaggccagauggacggggcu

SEQ ID NO: 736791 - RNA, 22 nt, Human
uggcuguggacucagauggcuc

SEQ ID NO: 736792 - RNA, 22 nt, Human
cauggcuuuccaguccuccacu

SEQ ID NO: 736793 - RNA, 22 nt, Human
cagacuuucugacucccuugcc

SEQ ID NO: 736794 - RNA, 22 nt, Human
uuggcuguuuuaucuccuggug

SEQ ID NO: 736795 - RNA, 19 nt, Human
aacuguaaagaucuguagc

SEQ ID NO: 736796 - RNA, 22 nt, Human
gaagcggcaucaggaggcugcc

SEQ ID NO: 736797 - RNA, 22 nt, Human
uggcuaccugauuucuuuucag

SEQ ID NO: 736798 - RNA, 22 nt, Human
cccagcucaagcagagagcuaa

SEQ ID NO: 736799 - RNA, 22 nt, Human
uggagggauacaaagaugaaaa

SEQ ID NO: 736800 - RNA, 22 nt, Human
aagaugccuguagcaggaagau

SEQ ID NO: 736801 - RNA, 22 nt, Human
cuuccagguaggccuaaggcag

SEQ ID NO: 736802 - RNA, 22 nt, Human
uuucucauggaacaucguuuag

SEQ ID NO: 736803 - RNA, 20 nt, Human
auuuuguuuauguuccucuc

SEQ ID NO: 736804 - RNA, 22 nt, Human
auguaucaauuaucugucugca

SEQ ID NO: 736805 - RNA, 22 nt, Human
gugguaauagagcuccaaacua

SEQ ID NO: 736806 - RNA, 22 nt, Human
auuuaugcaucccagcauguga

SEQ ID NO: 736807 - RNA, 22 nt, Human
agauccaguuaauagcuucauu

SEQ ID NO: 736808 - RNA, 22 nt, Human
agugggaauuucagugcuaaaa

SEQ ID NO: 736809 - RNA, 22 nt, Human
uuugacaugugcuuauaacuuu

SEQ ID NO: 736810 - RNA, 22 nt, Human
guggagggugauugccggcugu

SEQ ID NO: 736811 - RNA, 22 nt, Human
agucuggaaaaugcauguuuca

SEQ ID NO: 736812 - RNA, 22 nt, Human
uagaaauggagaacagauuaau

SEQ ID NO: 736813 - RNA, 22 nt, Human
cccuuucccuucuggcucaggg

SEQ ID NO: 736814 - RNA, 22 nt, Human
caucacauuuaauuaaaauguc

SEQ ID NO: 736815 - RNA, 22 nt, Human
uagucuuuugagaaguauaucu

SEQ ID NO: 736816 - RNA, 22 nt, Human
gagaggaagccuucuguacuug

SEQ ID NO: 736817 - RNA, 22 nt, Human
caggggcaggugugagaucauc

SEQ ID NO: 736818 - RNA, 22 nt, Human
agcagauggagaauggagucag

SEQ ID NO: 736819 - RNA, 22 nt, Human
ggcagaaggccucccagcuccu

SEQ ID NO: 736820 - RNA, 22 nt, Human
cugggccacaaaaaacuccugu

SEQ ID NO: 736821 - RNA, 22 nt, Human
uauugcuugggguacaagguau

SEQ ID NO: 736822 - RNA, 22 nt, Human
uaaaugcaguacaaauuguucu

SEQ ID NO: 736823 - RNA, 22 nt, Human
ggcacagcaggagcuaugugaa

SEQ ID NO: 736824 - RNA, 22 nt, Human
ccuggcucugaaguccacauca

SEQ ID NO: 736825 - RNA, 22 nt, Human
augagaaaguuaaucaucauga

SEQ ID NO: 736826 - RNA, 22 nt, Human
gcaagcagacugggccccugug

SEQ ID NO: 736827 - RNA, 23 nt, Human
aaauuauugcucuucaauugccu

SEQ ID NO: 736828 - RNA, 22 nt, Human
gccugcagaacugugaggcaau

SEQ ID NO: 736829 - RNA, 22 nt, Human
aggcaccagguugugguuuguc

SEQ ID NO: 736830 - RNA, 22 nt, Human
cagcaucuugaaggguaaacca

SEQ ID NO: 736831 - RNA, 22 nt, Human
guaucuuuuacaccaggaaauu

SEQ ID NO: 736832 - RNA, 22 nt, Human
uaggauuuaauaaaagaauaga

SEQ ID NO: 736833 - RNA, 22 nt, Human
uaggggcagaagcggcggucca

SEQ ID NO: 736834 - RNA, 22 nt, Human
uucuuaaguuuagcaacuugug

SEQ ID NO: 736835 - RNA, 20 nt, Human
gcucagguuugggcuuugug

SEQ ID NO: 736836 - RNA, 22 nt, Human
auuuagacuucccagcacugug

SEQ ID NO: 736837 - RNA, 22 nt, Human
acuccagguuuuuucacugaag

SEQ ID NO: 736838 - RNA, 22 nt, Human
ucugugugguaguuucagugaa

SEQ ID NO: 736839 - RNA, 22 nt, Human
ucugccuguugcuagaauguca

SEQ ID NO: 736840 - RNA, 22 nt, Human
ccugccugguguaagucuaagg

SEQ ID NO: 736841 - RNA, 22 nt, Human
acaguacaagcaaugcauuuuu

SEQ ID NO: 736842 - RNA, 22 nt, Human
uaacacauaucuacaacaugug

SEQ ID NO: 736843 - RNA, 22 nt, Human
acaucacacgccuuccaggagg

SEQ ID NO: 736844 - RNA, 22 nt, Human
acagcagaucuggcuacagguu

SEQ ID NO: 736845 - RNA, 22 nt, Human
cacaucugcucugggcagcacu

SEQ ID NO: 736846 - RNA, 22 nt, Human
ggguguccugugccaagcuggg

SEQ ID NO: 736847 - RNA, 22 nt, Human
cuguuuccaccuucauggcuaa

SEQ ID NO: 736848 - RNA, 22 nt, Human
acaggugcaugcuaccaugucu

SEQ ID NO: 736849 - RNA, 22 nt, Human
ccaucagcuccaguaucuucug

SEQ ID NO: 736850 - RNA, 22 nt, Human
gaguccugcuuucaauucuuuu

SEQ ID NO: 736851 - RNA, 22 nt, Human
uucuuucucuccacaaggcuug

SEQ ID NO: 736852 - RNA, 22 nt, Human
uccuggccugucuggaguagcu

SEQ ID NO: 736853 - RNA, 22 nt, Human
cuugucugugucggauaaaacu

SEQ ID NO: 736854 - RNA, 22 nt, Human
ucccagauucuucugugugggc

SEQ ID NO: 736855 - RNA, 22 nt, Human
gcagcagcucccuauccaggcu

SEQ ID NO: 736856 - RNA, 22 nt, Human
agcccuccuuuguucaugcugc

SEQ ID NO: 736857 - RNA, 22 nt, Human
agugcuuucccugaaaccuucc

SEQ ID NO: 736858 - RNA, 22 nt, Human
ggcucuggagcacagacgucug

SEQ ID NO: 736859 - RNA, 22 nt, Human
uggccacagccucugccaguuc

SEQ ID NO: 736860 - RNA, 20 nt, Human
caacacugcccauuguuugc

SEQ ID NO: 736861 - RNA, 23 nt, Human
cugagguaaaauauucugaagga

SEQ ID NO: 736862 - RNA, 22 nt, Human
gcacaguuaaagggucauguga

SEQ ID NO: 736863 - RNA, 22 nt, Human
ggacugaaggacaaucugguuc

SEQ ID NO: 736864 - RNA, 22 nt, Human
acaagcuccuuauucagcuggg

SEQ ID NO: 736865 - RNA, 20 nt, Human
gaugacauacucacuuaggg

SEQ ID NO: 736866 - RNA, 22 nt, Human
gauguagagggaagauuuuaaa

SEQ ID NO: 736867 - RNA, 22 nt, Human
ccuaggaguucgaagcugcagu

SEQ ID NO: 736868 - RNA, 22 nt, Human
acgggcagacagagcuacucgc

SEQ ID NO: 736869 - RNA, 22 nt, Human
acaacauucuuaaauacacuga

SEQ ID NO: 736870 - RNA, 22 nt, Human
uguguaaauggcaucucucagc

SEQ ID NO: 736871 - RNA, 22 nt, Human
aguggcuagaucaugagugagc

SEQ ID NO: 736872 - RNA, 22 nt, Human
uucugccuuggcaggguggucc

SEQ ID NO: 736873 - RNA, 22 nt, Human
uagaagcagcaggaguaaaggc

SEQ ID NO: 736874 - RNA, 22 nt, Human
uacuucauuauucuaguuuuga

SEQ ID NO: 736875 - RNA, 22 nt, Human
aagcauguacaaugagugucuc

SEQ ID NO: 736876 - RNA, 22 nt, Human
ccaagggaaggauguauaugau

SEQ ID NO: 736877 - RNA, 22 nt, Human
cacuucaacaguuauuucuuag

SEQ ID NO: 736878 - RNA, 22 nt, Human
cuccguuuugugggacacggau

SEQ ID NO: 736879 - RNA, 22 nt, Human
agcaucuggcagaaagucagaa

SEQ ID NO: 736880 - RNA, 22 nt, Human
gcucagggcgcgagggacgugg

SEQ ID NO: 736881 - RNA, 22 nt, Human
ucuguuauucugucuauugcca

SEQ ID NO: 736882 - RNA, 23 nt, Human
aagauacagguguggaaugguuu

SEQ ID NO: 736883 - RNA, 22 nt, Human
uggucuggaacuccuggcuuca

SEQ ID NO: 736884 - RNA, 20 nt, Human
aggcagcugggaaaugaggg

SEQ ID NO: 736885 - RNA, 22 nt, Human
gguuugcauucugaaaggcuca

SEQ ID NO: 736886 - RNA, 22 nt, Human
aaauggaauguguuuauaauuc

SEQ ID NO: 736887 - RNA, 22 nt, Human
ggucuuccgagaggccugugcu

SEQ ID NO: 736888 - RNA, 21 nt, Human
ugcauauauaagugcauacac

SEQ ID NO: 736889 - RNA, 22 nt, Human
uacaggaacugggcaggacauu

SEQ ID NO: 736890 - RNA, 22 nt, Human
gggcagugguuacacagcugag

SEQ ID NO: 736891 - RNA, 22 nt, Human
gggaggugauuaggaccaugua

SEQ ID NO: 736892 - RNA, 22 nt, Human
aguaacacuauuuucauaugua

SEQ ID NO: 736893 - RNA, 22 nt, Human
uuggcuucccagagcuuacgcu

SEQ ID NO: 736894 - RNA, 22 nt, Human
auaaagaccaguaucuuauguu

SEQ ID NO: 736895 - RNA, 22 nt, Human
gggcugcacguauucugcucac

SEQ ID NO: 736896 - RNA, 19 nt, Human
ucccucagucugccaggcc

SEQ ID NO: 736897 - RNA, 22 nt, Human
ugcuagaauuagguuaaacaaa

SEQ ID NO: 736898 - RNA, 22 nt, Human
uaaaguuauaaauuaccuguca

SEQ ID NO: 736899 - RNA, 22 nt, Human
ugucagacacagccagagacug

SEQ ID NO: 736900 - RNA, 22 nt, Human
cugcaucauuuucagacaaugg

SEQ ID NO: 736901 - RNA, 22 nt, Human
ucucaggcuuccuggugcugug

SEQ ID NO: 736902 - RNA, 22 nt, Human
cuugugcauuucauuccucagg

SEQ ID NO: 736903 - RNA, 21 nt, Human
acacacuacacauuccuaguu

SEQ ID NO: 736904 - RNA, 22 nt, Human
ucagcagggaggcucugugccc

SEQ ID NO: 736905 - RNA, 22 nt, Human
uuuguucaugccuauauucuca

SEQ ID NO: 736906 - RNA, 22 nt, Human
agugucugugcuuugcagcaaa

SEQ ID NO: 736907 - RNA, 22 nt, Human
ucuucaauuagauuuaccaauu

SEQ ID NO: 736908 - RNA, 22 nt, Human
ugugaaagucaaauuaauugaa

SEQ ID NO: 736909 - RNA, 22 nt, Human
uccuucagggcugaccacaggc

SEQ ID NO: 736910 - RNA, 22 nt, Human
uauacaguuaaguuucuucagu

SEQ ID NO: 736911 - RNA, 22 nt, Human
aaaagucugcucucauuucaga

SEQ ID NO: 736912 - RNA, 22 nt, Human
cagagcauuuggaagccacgug

SEQ ID NO: 736913 - RNA, 22 nt, Human
auucugcuucuuauuucacgug

SEQ ID NO: 736914 - RNA, 22 nt, Human
uggaacacuguggaugagaaga

SEQ ID NO: 736915 - RNA, 22 nt, Human
gcugccuucccaggccuuugcu

SEQ ID NO: 736916 - RNA, 22 nt, Human
cagcuccagccugacaccaaga

SEQ ID NO: 736917 - RNA, 22 nt, Human
aagccuucaguccguugcagag

SEQ ID NO: 736918 - RNA, 22 nt, Human
uccuucagccaugggcucucca

SEQ ID NO: 736919 - RNA, 22 nt, Human
guuaaugugguagugcauaucu

SEQ ID NO: 736920 - RNA, 22 nt, Human
uuucuuguaaaagcugugggaa

SEQ ID NO: 736921 - RNA, 22 nt, Human
uaccuggauguuuagauuggca

SEQ ID NO: 736922 - RNA, 22 nt, Human
aaucuuacuuaugauuuuucgg

SEQ ID NO: 736923 - RNA, 22 nt, Human
ugaaaugaaugugauucgauag

SEQ ID NO: 736924 - RNA, 22 nt, Human
aagcuuuaagugucagucagcc

SEQ ID NO: 736925 - RNA, 22 nt, Human
ccuggcuccugcacagaucuuu

SEQ ID NO: 736926 - RNA, 22 nt, Human
gccauguuuugguaaauaccau

SEQ ID NO: 736927 - RNA, 22 nt, Human
gaagacaucguguggacuaaca

SEQ ID NO: 736928 - RNA, 22 nt, Human
gggagggcuuggacccagaugu

SEQ ID NO: 736929 - RNA, 22 nt, Human
uuccaggaccaggaagagggga

SEQ ID NO: 736930 - RNA, 22 nt, Human
caacuacauccacacuuuguua

SEQ ID NO: 736931 - RNA, 22 nt, Human
ugacuuuuggaccucacugucc

SEQ ID NO: 736932 - RNA, 20 nt, Human
ccacuccaggugauucugau

SEQ ID NO: 736933 - RNA, 22 nt, Human
aucccucucugcaugacugugu

SEQ ID NO: 736934 - RNA, 22 nt, Human
aagaaaagaaaccugaggcuuu

SEQ ID NO: 736935 - RNA, 22 nt, Human
guuuugcagagugcaauaaauc

SEQ ID NO: 736936 - RNA, 22 nt, Human
gcaguguucuuguugcuuuuau

SEQ ID NO: 736937 - RNA, 22 nt, Human
uugagaaaggggucaauaucuc

SEQ ID NO: 736938 - RNA, 22 nt, Human
gcagauguuguugcugggaguu

SEQ ID NO: 736939 - RNA, 22 nt, Human
ucagggauugcaaaauucaucc

SEQ ID NO: 736940 - RNA, 22 nt, Human
auuuagcaccuccaucucaaca

SEQ ID NO: 736941 - RNA, 22 nt, Human
uugaaacugcuuauugaauuug

SEQ ID NO: 736942 - RNA, 22 nt, Human
ccccuucuguguccugucagcc

SEQ ID NO: 736943 - RNA, 22 nt, Human
cucaggaaccgcggcagcagcc

SEQ ID NO: 736944 - RNA, 22 nt, Human
aauuaggaaauucagccauuuu

SEQ ID NO: 736945 - RNA, 22 nt, Human
ucaguugcuaugagaaauaaau

SEQ ID NO: 736946 - RNA, 20 nt, Human
acacuguucuucacacauuu

SEQ ID NO: 736947 - RNA, 22 nt, Human
cagggagaucuuggcuccuggu

SEQ ID NO: 736948 - RNA, 22 nt, Human
cuucagaggggacucaaaguca

SEQ ID NO: 736949 - RNA, 22 nt, Human
uagauacacacacagucaugug

SEQ ID NO: 736950 - RNA, 22 nt, Human
gggguccucggagccugggucu

SEQ ID NO: 736951 - RNA, 22 nt, Human
acauuuaaauaccuauguuucu

SEQ ID NO: 736952 - RNA, 19 nt, Human
agggcgugguggcacaugu

SEQ ID NO: 736953 - RNA, 22 nt, Human
ucauaguuauggagauuaagga

SEQ ID NO: 736954 - RNA, 22 nt, Human
agcagcacgaguccacaaaucc

SEQ ID NO: 736955 - RNA, 22 nt, Human
cuggacucauccauagagguga

SEQ ID NO: 736956 - RNA, 22 nt, Human
ugcucuccggcuuccguggccu

SEQ ID NO: 736957 - RNA, 22 nt, Human
agcaaggcugggucuaaugggg

SEQ ID NO: 736958 - RNA, 22 nt, Human
uuucauuacguguuugacuugu

SEQ ID NO: 736959 - RNA, 22 nt, Human
ggcccagguccagcgaguaccu

SEQ ID NO: 736960 - RNA, 22 nt, Human
ccaaagugcugggguuacaggc

SEQ ID NO: 736961 - RNA, 22 nt, Human
aaaaaccauugucuucagucuc

SEQ ID NO: 736962 - RNA, 18 nt, Human
cugugacuccuagaucuc

SEQ ID NO: 736963 - RNA, 22 nt, Human
cuggcacacagcaggcucucag

SEQ ID NO: 736964 - RNA, 18 nt, Human
uaaaccagaugacaguug

SEQ ID NO: 736965 - RNA, 22 nt, Human
agcaaaguagcugcuguucuua

SEQ ID NO: 736966 - RNA, 22 nt, Human
acaggccagccugggguaaggu

SEQ ID NO: 736967 - RNA, 22 nt, Human
augcauugaggaugacaugagu

SEQ ID NO: 736968 - RNA, 22 nt, Human
ugcauucugacuuaguuaauau

SEQ ID NO: 736969 - RNA, 22 nt, Human
gaggacacaugacuccagcagg

SEQ ID NO: 736970 - RNA, 22 nt, Human
gaagagagccgcgggacaucag

SEQ ID NO: 736971 - RNA, 22 nt, Human
gggagcuguaguccagauaccg

SEQ ID NO: 736972 - RNA, 19 nt, Human
ccuggcccugcugcgcggg

SEQ ID NO: 736973 - RNA, 22 nt, Human
ugaguuauggagaauaaaguca

SEQ ID NO: 736974 - RNA, 22 nt, Human
ucauaaaaauagacucuaaagu

SEQ ID NO: 736975 - RNA, 22 nt, Human
auuuugaagggaauugaaguuc

SEQ ID NO: 736976 - RNA, 22 nt, Human
aaccuuugaggggagcucuuuc

SEQ ID NO: 736977 - RNA, 22 nt, Human
agcuucauaauuccuugacuca

SEQ ID NO: 736978 - RNA, 22 nt, Human
aucaggaucugggagccugaaa

SEQ ID NO: 736979 - RNA, 22 nt, Human
acaggucugcaguaacugggaa

SEQ ID NO: 736980 - RNA, 22 nt, Human
accugcccggggacauuccuuu

SEQ ID NO: 736981 - RNA, 22 nt, Human
uucaaaccuaucuaagaaauag

SEQ ID NO: 736982 - RNA, 22 nt, Human
ugcuugucuucaggauuauggu

SEQ ID NO: 736983 - RNA, 21 nt, Human
guguuuccuguuuauggcuug

SEQ ID NO: 736984 - RNA, 21 nt, Human
auuauuauuucuguguccagc

SEQ ID NO: 736985 - RNA, 22 nt, Human
gcaugcagucaaccaguaaggg

SEQ ID NO: 736986 - RNA, 21 nt, Human
ugaguuaaaauggagagucuu

SEQ ID NO: 736987 - RNA, 22 nt, Human
agggccagaguggcaaaagccu

SEQ ID NO: 736988 - RNA, 22 nt, Human
aggcuaaaagagaaucauuuag

SEQ ID NO: 736989 - RNA, 22 nt, Human
gugagggagguagauuucauca

SEQ ID NO: 736990 - RNA, 22 nt, Human
agugucuucaugauguggcagc

SEQ ID NO: 736991 - RNA, 22 nt, Human
ugccgccugguuucuccgcccc

SEQ ID NO: 736992 - RNA, 22 nt, Human
aaugcuuugagggaagaugaaa

SEQ ID NO: 736993 - RNA, 22 nt, Human
acagccaggagccaugggcagg

SEQ ID NO: 736994 - RNA, 22 nt, Human
uguauaagccuagugaaauuuc

SEQ ID NO: 736995 - RNA, 22 nt, Human
uuugauaacagugaauaucaug

SEQ ID NO: 736996 - RNA, 22 nt, Human
ucuuugaaaagauauuccuccu

SEQ ID NO: 736997 - RNA, 20 nt, Human
agccccacccuuguccuggc

SEQ ID NO: 736998 - RNA, 22 nt, Human
aaaugcaguuuccugagaccca

SEQ ID NO: 736999 - RNA, 22 nt, Human
cuugccuguggcuaguuggcuc

SEQ ID NO: 737000 - RNA, 22 nt, Human
ucuugauuuguaaaagaaggau

SEQ ID NO: 737001 - RNA, 22 nt, Human
cugugccuuuguagcugugccu

SEQ ID NO: 737002 - RNA, 20 nt, Human
uuuuccugugguuugauaug

SEQ ID NO: 737003 - RNA, 22 nt, Human
ccucagaagaaguggaauugau

SEQ ID NO: 737004 - RNA, 22 nt, Human
uccugaggucugaaaaaggagc

SEQ ID NO: 737005 - RNA, 22 nt, Human
uuaauuaugagaaagggaaaag

SEQ ID NO: 737006 - RNA, 22 nt, Human
acagguguggggcugugguacu

SEQ ID NO: 737007 - RNA, 22 nt, Human
agguuacagucaucucagaauc

SEQ ID NO: 737008 - RNA, 22 nt, Human
uaggcagaguuuaaugguuaag

SEQ ID NO: 737009 - RNA, 22 nt, Human
uggggcuggggaucuugagccu

SEQ ID NO: 737010 - RNA, 22 nt, Human
uuucacagcugucuuccgucuc

SEQ ID NO: 737011 - RNA, 22 nt, Human
cccagagggcugaggauaugaa

SEQ ID NO: 737012 - RNA, 22 nt, Human
uucacauuccgcggcuauuuuc

SEQ ID NO: 737013 - RNA, 22 nt, Human
aucugucaggagcaaggacuac

SEQ ID NO: 737014 - RNA, 22 nt, Human
guacaaauugauacagauuuga

SEQ ID NO: 737015 - RNA, 22 nt, Human
ggagcucaguggggggacugug

SEQ ID NO: 737016 - RNA, 22 nt, Human
auuacaguuaauuuaccuucuu

SEQ ID NO: 737017 - RNA, 22 nt, Human
agauaaaaugguucaaaggcua

SEQ ID NO: 737018 - RNA, 22 nt, Human
aacagcuuugugcucagauuug

SEQ ID NO: 737019 - RNA, 22 nt, Human
cugccuuccaaccccagacucc

SEQ ID NO: 737020 - RNA, 22 nt, Human
uucuccuugaaaagcugcaucu

SEQ ID NO: 737021 - RNA, 22 nt, Human
cagagacagggcagggagugug

SEQ ID NO: 737022 - RNA, 22 nt, Human
gaggggagaggcuuauggauca

SEQ ID NO: 737023 - RNA, 22 nt, Human
ccacugaggcaggcaguaucua

SEQ ID NO: 737024 - RNA, 22 nt, Human
ucaauauucuucuuuaguagga

SEQ ID NO: 737025 - RNA, 22 nt, Human
uguccaggaauugacccugcaa

SEQ ID NO: 737026 - RNA, 21 nt, Human
uagugucuuaagagccuugca

SEQ ID NO: 737027 - RNA, 22 nt, Human
cucuagggaagaaugagagccc

SEQ ID NO: 737028 - RNA, 19 nt, Human
auaaauaaaaagugggaga

SEQ ID NO: 737029 - RNA, 22 nt, Human
agucuucucauuucacaugcuu

SEQ ID NO: 737030 - RNA, 22 nt, Human
augggcugugggacccuggacc

SEQ ID NO: 737031 - RNA, 22 nt, Human
uuuccuuuuauaaggcuugagg

SEQ ID NO: 737032 - RNA, 22 nt, Human
acacauuauaggcaaucaaaag

SEQ ID NO: 737033 - RNA, 22 nt, Human
aggccucuugucuuccucacau

SEQ ID NO: 737034 - RNA, 23 nt, Human
ugagcagcuaaaggugaugcggg

SEQ ID NO: 737035 - RNA, 22 nt, Human
gauuauggauggacaguggagc

SEQ ID NO: 737036 - RNA, 22 nt, Human
aaaaugaugcuguaauuuggca

SEQ ID NO: 737037 - RNA, 22 nt, Human
uggggcacuuaugaugugccac

SEQ ID NO: 737038 - RNA, 20 nt, Human
uugagcaaucaguaaaggau

SEQ ID NO: 737039 - RNA, 22 nt, Human
acucugggaauccucaccuucc

SEQ ID NO: 737040 - RNA, 22 nt, Human
cagugcaguugguggcaggggu

SEQ ID NO: 737041 - RNA, 17 nt, Human
aauugucagcaguagcu

SEQ ID NO: 737042 - RNA, 22 nt, Human
gagcucagagccuauaguuggu

SEQ ID NO: 737043 - RNA, 22 nt, Human
uagaggcuuucagcgguagguc

SEQ ID NO: 737044 - RNA, 22 nt, Human
cucagggaauugaaucuccuug

SEQ ID NO: 737045 - RNA, 22 nt, Human
ucauucaucaguugguagagau

SEQ ID NO: 737046 - RNA, 22 nt, Human
aggcuucauuacagugguucaa

SEQ ID NO: 737047 - RNA, 22 nt, Human
ucuugaaggggggcaguguuga

SEQ ID NO: 737048 - RNA, 22 nt, Human
ucacugcagguuuuucaggagg

SEQ ID NO: 737049 - RNA, 21 nt, Human
gcugcugugggccagggaggc

SEQ ID NO: 737050 - RNA, 22 nt, Human
gcuacaggugacagccucugca

SEQ ID NO: 737051 - RNA, 22 nt, Human
aaguccaugaucaagauguggc

SEQ ID NO: 737052 - RNA, 22 nt, Human
uccuggcugcaccagugacccu

SEQ ID NO: 737053 - RNA, 22 nt, Human
ucucuuccaguggcuuugauuu

SEQ ID NO: 737054 - RNA, 22 nt, Human
cauguacaguuuuucuguccug

SEQ ID NO: 737055 - RNA, 22 nt, Human
augcuucuccugaacaucccug

SEQ ID NO: 737056 - RNA, 22 nt, Human
auagaauuugcacuaaaucugc

SEQ ID NO: 737057 - RNA, 22 nt, Human
cagggacaaagugagaaaggaa

SEQ ID NO: 737058 - RNA, 22 nt, Human
gcagcuguggguuccaagucua

SEQ ID NO: 737059 - RNA, 22 nt, Human
ugagccaagcagcuucccaggg

SEQ ID NO: 737060 - RNA, 22 nt, Human
uaggaagguccaugucuuaucu

SEQ ID NO: 737061 - RNA, 22 nt, Human
cuuuguaaucauucccuugguu

SEQ ID NO: 737062 - RNA, 22 nt, Human
guggccugccagcagauggcgc

SEQ ID NO: 737063 - RNA, 22 nt, Human
guguaugcuuagccagagauuu

SEQ ID NO: 737064 - RNA, 22 nt, Human
uuguagaacaugcagcacaaug

SEQ ID NO: 737065 - RNA, 22 nt, Human
uuauuagggugguuuauguucu

SEQ ID NO: 737066 - RNA, 22 nt, Human
ccucuggguuaguuuagggagc

SEQ ID NO: 737067 - RNA, 22 nt, Human
uguggcaggcauucugaggcug

SEQ ID NO: 737068 - RNA, 22 nt, Human
ccugagcacaagggagcuuuga

SEQ ID NO: 737069 - RNA, 22 nt, Human
ccugcugcuuaggccauauuuc

SEQ ID NO: 737070 - RNA, 22 nt, Human
agcuacaguggacaagugaacu

SEQ ID NO: 737071 - RNA, 22 nt, Human
gcagggaaacaggugcuaagga

SEQ ID NO: 737072 - RNA, 19 nt, Human
gacuuuggaaaugcuguuu

SEQ ID NO: 737073 - RNA, 22 nt, Human
gaccugaaagugugggcgaccu

SEQ ID NO: 737074 - RNA, 22 nt, Human
uaggcaugcaaauaaaugugca

SEQ ID NO: 737075 - RNA, 22 nt, Human
cauguuaaaauauacauucuga

SEQ ID NO: 737076 - RNA, 22 nt, Human
uuuugguagaaucaacaaugua

SEQ ID NO: 737077 - RNA, 22 nt, Human
uggagaaggccggccaggagug

SEQ ID NO: 737078 - RNA, 22 nt, Human
gagugcagaugaacagaagauu

SEQ ID NO: 737079 - RNA, 20 nt, Human
ggccucaguguccuuguuug

SEQ ID NO: 737080 - RNA, 22 nt, Human
aaaucacuguuauugaucuuaa

SEQ ID NO: 737081 - RNA, 17 nt, Human
auguuaauuucacauuu

SEQ ID NO: 737082 - RNA, 22 nt, Human
ugcuccaugcgcucggccggcg

SEQ ID NO: 737083 - RNA, 22 nt, Human
uccaggaauagaucagagauuu

SEQ ID NO: 737084 - RNA, 22 nt, Human
uccaggcuggcucuucaaaauu

SEQ ID NO: 737085 - RNA, 22 nt, Human
cugcuuuagacaacugcuggga

SEQ ID NO: 737086 - RNA, 22 nt, Human
agcauuauguccaugcuaaauu

SEQ ID NO: 737087 - RNA, 22 nt, Human
gcagccucagggcacucagaug

SEQ ID NO: 737088 - RNA, 22 nt, Human
gcaggcagguggcaucuuguga

SEQ ID NO: 737089 - RNA, 22 nt, Human
uugggugcugucauggggcacg

SEQ ID NO: 737090 - RNA, 22 nt, Human
ggccagaggaccucucauagcc

SEQ ID NO: 737091 - RNA, 22 nt, Human
uaugaggcacuucauuagcugg

SEQ ID NO: 737092 - RNA, 22 nt, Human
cauaauuuuuuuaagucagaac

SEQ ID NO: 737093 - RNA, 22 nt, Human
augaggcagcugcuggagaacg

SEQ ID NO: 737094 - RNA, 22 nt, Human
ggaaggcagugaaggggcugau

SEQ ID NO: 737095 - RNA, 22 nt, Human
aggcaggccuacacaaugggag

SEQ ID NO: 737096 - RNA, 22 nt, Human
uuuccaaaggaggaaccaguuu

SEQ ID NO: 737097 - RNA, 17 nt, Human
auaaaggcaaguauuau

SEQ ID NO: 737098 - RNA, 22 nt, Human
gcucugcugcuuacuagauggu

SEQ ID NO: 737099 - RNA, 22 nt, Human
gacuauuuauuuacagaaagcu

SEQ ID NO: 737100 - RNA, 22 nt, Human
ccaguugguuucaaugggacag

SEQ ID NO: 737101 - RNA, 22 nt, Human
cauagaggcuaaaauuauuugg

SEQ ID NO: 737102 - RNA, 22 nt, Human
uccauacauacagauaugcauu

SEQ ID NO: 737103 - RNA, 22 nt, Human
cuuuagacauacagaauuucca

SEQ ID NO: 737104 - RNA, 22 nt, Human
uugauucacaauuaccaagacu

SEQ ID NO: 737105 - RNA, 22 nt, Human
ugauuucccucaucauaacaga

SEQ ID NO: 737106 - RNA, 22 nt, Human
gacuguuagaauguaaaauaua

SEQ ID NO: 737107 - RNA, 22 nt, Human
cacaggccugucucuuucuaac

SEQ ID NO: 737108 - RNA, 22 nt, Human
ucccuuaaaacucauguguugu

SEQ ID NO: 737109 - RNA, 22 nt, Human
auggauucauuaaugacuucuc

SEQ ID NO: 737110 - RNA, 22 nt, Human
cagugaggaguccagggcagag

SEQ ID NO: 737111 - RNA, 22 nt, Human
ccaaagugugggagaagaggua

SEQ ID NO: 737112 - RNA, 22 nt, Human
cuguugcucugaacaggucuug

SEQ ID NO: 737113 - RNA, 22 nt, Human
uagcacacuaaagauauuaaca

SEQ ID NO: 737114 - RNA, 22 nt, Human
ggacugaggacaugugaggcau

SEQ ID NO: 737115 - RNA, 22 nt, Human
agaagggaacucagagaugauu

SEQ ID NO: 737116 - RNA, 22 nt, Human
ucugggccucaccugcugcuca

SEQ ID NO: 737117 - RNA, 22 nt, Human
gaaaagcuaggccaguucagcu

SEQ ID NO: 737118 - RNA, 22 nt, Human
uguaugcaccauuguauuaccu

SEQ ID NO: 737119 - RNA, 22 nt, Human
gaaauuaaccaccuuuggcuuu

SEQ ID NO: 737120 - RNA, 22 nt, Human
aaggcucuuggagugaaugcag

SEQ ID NO: 737121 - RNA, 22 nt, Human
uggcagauucugguugauacuu

SEQ ID NO: 737122 - RNA, 22 nt, Human
gcugggcacugucccauaggcu

SEQ ID NO: 737123 - RNA, 22 nt, Human
ugcugccuaauaagucgagggu

SEQ ID NO: 737124 - RNA, 22 nt, Human
ucuccugguacccuuccuagca

SEQ ID NO: 737125 - RNA, 22 nt, Human
auuaaacugagcaaauuaacau

SEQ ID NO: 737126 - RNA, 17 nt, Human
gcucugccccagccucu

SEQ ID NO: 737127 - RNA, 22 nt, Human
cauuuguuggucagauuguagu

SEQ ID NO: 737128 - RNA, 22 nt, Human
cugccuagaaaaccaggcuccu

SEQ ID NO: 737129 - RNA, 21 nt, Human
aucagcaaaugccugucuccc

SEQ ID NO: 737130 - RNA, 22 nt, Human
gaaagaggaaggagauguauua

SEQ ID NO: 737131 - RNA, 22 nt, Human
gugggagcugcggaggccuggg

SEQ ID NO: 737132 - RNA, 22 nt, Human
acagaaguguguguguaggaau

SEQ ID NO: 737133 - RNA, 22 nt, Human
cagggggugguccaggcugcgc

SEQ ID NO: 737134 - RNA, 22 nt, Human
ggacuggacucucaggcucaca

SEQ ID NO: 737135 - RNA, 22 nt, Human
cuauggcuguguucaugcuaca

SEQ ID NO: 737136 - RNA, 23 nt, Human
ucucagugccgauugcauacaca

SEQ ID NO: 737137 - RNA, 22 nt, Human
uuucuuagcgaugcuugauaaa

SEQ ID NO: 737138 - RNA, 22 nt, Human
ucagugugcacucugugaccca

SEQ ID NO: 737139 - RNA, 22 nt, Human
ugggccaccugcuuuuuugcau

SEQ ID NO: 737140 - RNA, 22 nt, Human
gaauagcuuccuuuuuuccaaa

SEQ ID NO: 737141 - RNA, 22 nt, Human
acugggaaagugcugccugcag

SEQ ID NO: 737142 - RNA, 22 nt, Human
gccugagccgccugagcggcgg

SEQ ID NO: 737143 - RNA, 22 nt, Human
aagagcacuaacagagcugaua

SEQ ID NO: 737144 - RNA, 22 nt, Human
ucaguaucuacuaucuugauga

SEQ ID NO: 737145 - RNA, 22 nt, Human
gagucugaggggagagcugggu

SEQ ID NO: 737146 - RNA, 22 nt, Human
cugcucugacccuuucaccuuc

SEQ ID NO: 737147 - RNA, 22 nt, Human
gaaguagauucguugcaucuug

SEQ ID NO: 737148 - RNA, 22 nt, Human
ucacugaauuucaagcuagugg

SEQ ID NO: 737149 - RNA, 22 nt, Human
ggagauccaggcaaggccgcag

SEQ ID NO: 737150 - RNA, 22 nt, Human
agcagcauggaugggccucagc

SEQ ID NO: 737151 - RNA, 23 nt, Human
cauuucugggagauuuauaaaau

SEQ ID NO: 737152 - RNA, 22 nt, Human
ggcuuugcaaacucauuccaca

SEQ ID NO: 737153 - RNA, 22 nt, Human
cuguaugauauccaaauugaua

SEQ ID NO: 737154 - RNA, 22 nt, Human
cuggcucccggggaucgagcac

SEQ ID NO: 737155 - RNA, 22 nt, Human
gcaguaguuuauggcuaaaccu

SEQ ID NO: 737156 - RNA, 22 nt, Human
uggagagcacaguuccugcuuc

SEQ ID NO: 737157 - RNA, 22 nt, Human
cuguccugaaguuuucaugaga

SEQ ID NO: 737158 - RNA, 22 nt, Human
aggaaagauggaaggaggauaa

SEQ ID NO: 737159 - RNA, 22 nt, Human
ccaagcuggauuuagcugcaca

SEQ ID NO: 737160 - RNA, 22 nt, Human
uugcagcuucgagucuaucugu

SEQ ID NO: 737161 - RNA, 22 nt, Human
aguugcuucccuauucuuagca

SEQ ID NO: 737162 - RNA, 22 nt, Human
uacagugugacauuucuacaaa

SEQ ID NO: 737163 - RNA, 22 nt, Human
aggcagcagucaugaggaaaga

SEQ ID NO: 737164 - RNA, 22 nt, Human
uugaucuuggacuuuccagccu

SEQ ID NO: 737165 - RNA, 22 nt, Human
cugaggccucucuccugggcuu

SEQ ID NO: 737166 - RNA, 22 nt, Human
cuuucuugguccugaagauggc

SEQ ID NO: 737167 - RNA, 22 nt, Human
cagcccugagagaaccaucuau

SEQ ID NO: 737168 - RNA, 22 nt, Human
uggagcaggugcucaggguaau

SEQ ID NO: 737169 - RNA, 22 nt, Human
uggagggcaucuguggucaggc

SEQ ID NO: 737170 - RNA, 22 nt, Human
cucuuuggauagaauuacaaag

SEQ ID NO: 737171 - RNA, 22 nt, Human
ucugaaauuuuaguuauagaaa

SEQ ID NO: 737172 - RNA, 22 nt, Human
uauggaaagggaguuuaauuug

SEQ ID NO: 737173 - RNA, 22 nt, Human
gcugagagcaaggacaaagcau

SEQ ID NO: 737174 - RNA, 22 nt, Human
cugcccugugcacaggaaacug

SEQ ID NO: 737175 - RNA, 23 nt, Human
aagaaugcuucugaagagcugcc

SEQ ID NO: 737176 - RNA, 22 nt, Human
agguggggccaaaugcuacagu

SEQ ID NO: 737177 - RNA, 22 nt, Human
uauauucaacaggcuaauguca

SEQ ID NO: 737178 - RNA, 22 nt, Human
gauccugggacugaaugggugc

SEQ ID NO: 737179 - RNA, 22 nt, Human
ggagacauauuccagagcuggg

SEQ ID NO: 737180 - RNA, 22 nt, Human
uuccagggcuaauuccugugga

SEQ ID NO: 737181 - RNA, 22 nt, Human
gcguuuguuuugcuggcgccag

SEQ ID NO: 737182 - RNA, 22 nt, Human
uucaugagguaccugugaucau

SEQ ID NO: 737183 - RNA, 22 nt, Human
ggcagcuguuuguccuccuguu

SEQ ID NO: 737184 - RNA, 22 nt, Human
agcuuccuugaauucuguagaa

SEQ ID NO: 737185 - RNA, 22 nt, Human
auuuacauuuauuugagaaggu

SEQ ID NO: 737186 - RNA, 22 nt, Human
aaauggcaauuuaguuuauuua

SEQ ID NO: 737187 - RNA, 22 nt, Human
gacagccaggucugaugaccca

SEQ ID NO: 737188 - RNA, 22 nt, Human
uuucaugcacaaaugagcaagg

SEQ ID NO: 737189 - RNA, 22 nt, Human
uacagcauugcauuuuccuuug

SEQ ID NO: 737190 - RNA, 22 nt, Human
aagcugugaagagcaagugagg

SEQ ID NO: 737191 - RNA, 22 nt, Human
ggcaccagccaccuauuucuag

SEQ ID NO: 737192 - RNA, 22 nt, Human
agccccaguccgcugcgggcgg

SEQ ID NO: 737193 - RNA, 22 nt, Human
uuacaacaccaggcaguauccu

SEQ ID NO: 737194 - RNA, 22 nt, Human
acauuuugaaagggaaauuguu

SEQ ID NO: 737195 - RNA, 22 nt, Human
uucaggaaucaaccaagucauu

SEQ ID NO: 737196 - RNA, 22 nt, Human
acagaaaaaugagggagcugga

SEQ ID NO: 737197 - RNA, 22 nt, Human
uuuauugcugagaaggauucca

SEQ ID NO: 737198 - RNA, 22 nt, Human
accaccaggggauuuucagaac

SEQ ID NO: 737199 - RNA, 22 nt, Human
uuucacaggccuuuuguagccc

SEQ ID NO: 737200 - RNA, 22 nt, Human
cuugacaacuggcagauauaua

SEQ ID NO: 737201 - RNA, 22 nt, Human
uccuggguuaauuaugauucac

SEQ ID NO: 737202 - RNA, 22 nt, Human
aaacaugaauagauauuaaaca

SEQ ID NO: 737203 - RNA, 22 nt, Human
aaaugcuguagaucagugaguu

SEQ ID NO: 737204 - RNA, 22 nt, Human
uauucacagcugccgcacucag

SEQ ID NO: 737205 - RNA, 22 nt, Human
ucuggcuucgcagcucccagcc

SEQ ID NO: 737206 - RNA, 22 nt, Human
auugagaaugcaaucuacuaug

SEQ ID NO: 737207 - RNA, 22 nt, Human
ggaaggaaagcagcuuggcccu

SEQ ID NO: 737208 - RNA, 22 nt, Human
uagauucagauauuuaggacaa

SEQ ID NO: 737209 - RNA, 22 nt, Human
cacuguaaagcgucacagggac

SEQ ID NO: 737210 - RNA, 22 nt, Human
aguaacaugaguuuuucuaaug

SEQ ID NO: 737211 - RNA, 22 nt, Human
gccagagcaugcacugccugca

SEQ ID NO: 737212 - RNA, 22 nt, Human
guauauaugugugaacauguau

SEQ ID NO: 737213 - RNA, 22 nt, Human
ugcugcugacauuuggggcuug

SEQ ID NO: 737214 - RNA, 18 nt, Human
ggccagagggaggguccc

SEQ ID NO: 737215 - RNA, 22 nt, Human
guucucaguggggagcaggguu

SEQ ID NO: 737216 - RNA, 22 nt, Human
guccuucaaaggcacgcaguua

SEQ ID NO: 737217 - RNA, 22 nt, Human
gugaggagggcuggucccaggc

SEQ ID NO: 737218 - RNA, 22 nt, Human
guuugauucaagaacaaagagu

SEQ ID NO: 737219 - RNA, 22 nt, Human
gccguggccagagcccagucuc

SEQ ID NO: 737220 - RNA, 22 nt, Human
agaacagaagggaggaaggccu

SEQ ID NO: 737221 - RNA, 22 nt, Human
acagauggaauguguuauggga

SEQ ID NO: 737222 - RNA, 22 nt, Human
auagauuauuugcucauuacuu

SEQ ID NO: 737223 - RNA, 22 nt, Human
ggcaaggguugaagauaaggua

SEQ ID NO: 737224 - RNA, 22 nt, Human
cacauuuauuugaggcuaauug

SEQ ID NO: 737225 - RNA, 22 nt, Human
aggcuccaugguucucccucag

SEQ ID NO: 737226 - RNA, 22 nt, Human
uuuuaagaacuguucugugcuu

SEQ ID NO: 737227 - RNA, 22 nt, Human
cacagucccgugcuuaccaugu

SEQ ID NO: 737228 - RNA, 22 nt, Human
agacuuugagcucuuagagaag

SEQ ID NO: 737229 - RNA, 23 nt, Human
cugugucuaugcagccauaucca

SEQ ID NO: 737230 - RNA, 22 nt, Human
ucuacaggguaaggggcuugcc

SEQ ID NO: 737231 - RNA, 22 nt, Human
cuccuaggacgccgcugcuccu

SEQ ID NO: 737232 - RNA, 22 nt, Human
aaguuuauguugguaagauauc

SEQ ID NO: 737233 - RNA, 22 nt, Human
aacaacugcuaagguguguccu

SEQ ID NO: 737234 - RNA, 22 nt, Human
uguggcacauacacaggagggc

SEQ ID NO: 737235 - RNA, 21 nt, Human
cagcagaagcaucuauggaag

SEQ ID NO: 737236 - RNA, 22 nt, Human
uaggccacagaugagacauaag

SEQ ID NO: 737237 - RNA, 22 nt, Human
acagugauaaaauuucacaugu

SEQ ID NO: 737238 - RNA, 22 nt, Human
gucucaguuugaagugaugcca

SEQ ID NO: 737239 - RNA, 22 nt, Human
cuugaaaugacaggagcacauc

SEQ ID NO: 737240 - RNA, 22 nt, Human
aagucacuucuuaggaaaggag

SEQ ID NO: 737241 - RNA, 22 nt, Human
aggcacagugccuggaaucaaa

SEQ ID NO: 737242 - RNA, 22 nt, Human
ccucugggggcuuccuuacccu

SEQ ID NO: 737243 - RNA, 18 nt, Human
cugagggcaacagaggcu

SEQ ID NO: 737244 - RNA, 22 nt, Human
aaagaaugucugaacagcuggc

SEQ ID NO: 737245 - RNA, 22 nt, Human
uaucacacgccuugcuucauuu

SEQ ID NO: 737246 - RNA, 22 nt, Human
aaauucuucagguaauuuugau

SEQ ID NO: 737247 - RNA, 22 nt, Human
aaacacacagaaaugaaugagg

SEQ ID NO: 737248 - RNA, 22 nt, Human
uuaaggaaggugaauuucuugg

SEQ ID NO: 737249 - RNA, 21 nt, Human
aaugcauuaacauaaagcuga

SEQ ID NO: 737250 - RNA, 22 nt, Human
acagaacugggaaaugcacaua

SEQ ID NO: 737251 - RNA, 23 nt, Human
ucagcccacaucuagucauuagc

SEQ ID NO: 737252 - RNA, 22 nt, Human
agucucaggcagaggaaggcua

SEQ ID NO: 737253 - RNA, 18 nt, Human
aagaggaggagcagguug

SEQ ID NO: 737254 - RNA, 22 nt, Human
gcuuuacaugagaugaggacaa

SEQ ID NO: 737255 - RNA, 22 nt, Human
auuuuguugagguaauugucaa

SEQ ID NO: 737256 - RNA, 22 nt, Human
gcaaaucaccaccuagcuggau

SEQ ID NO: 737257 - RNA, 22 nt, Human
caggagccagcugucccaacca

SEQ ID NO: 737258 - RNA, 20 nt, Human
uacagucagggcacaggcag

SEQ ID NO: 737259 - RNA, 22 nt, Human
ugcccagcacugugccagucac

SEQ ID NO: 737260 - RNA, 22 nt, Human
acagagaugcaaguguguauuu

SEQ ID NO: 737261 - RNA, 22 nt, Human
acagagacaggcagacagucuu

SEQ ID NO: 737262 - RNA, 22 nt, Human
gcugggagcaaagccaugcaua

SEQ ID NO: 737263 - RNA, 22 nt, Human
gcacacugugaauuugcauaug

SEQ ID NO: 737264 - RNA, 22 nt, Human
ucacuuugaugacauuguagcu

SEQ ID NO: 737265 - RNA, 22 nt, Human
uggguaggaccagaaaugcacu

SEQ ID NO: 737266 - RNA, 22 nt, Human
cuguuuuccuggguuccaugag

SEQ ID NO: 737267 - RNA, 22 nt, Human
caagaacauugugaucacuuca

SEQ ID NO: 737268 - RNA, 22 nt, Human
cccaguguuccuugaggggcug

SEQ ID NO: 737269 - RNA, 22 nt, Human
aaacacaccuuuggaacuguga

SEQ ID NO: 737270 - RNA, 22 nt, Human
ccuuaaagaauaagucuuaucu

SEQ ID NO: 737271 - RNA, 22 nt, Human
gaguccuggcguccaauuuccu

SEQ ID NO: 737272 - RNA, 22 nt, Human
uuuagagacccucugcuauuuu

SEQ ID NO: 737273 - RNA, 22 nt, Human
gauuuccuagacauggggcaga

SEQ ID NO: 737274 - RNA, 22 nt, Human
acuauucacagauucaguguuc

SEQ ID NO: 737275 - RNA, 18 nt, Human
caaagcaggugacagugu

SEQ ID NO: 737276 - RNA, 22 nt, Human
ccaggaguuugaggcugcagug

SEQ ID NO: 737277 - RNA, 22 nt, Human
ggggcugauggaacucaggccu

SEQ ID NO: 737278 - RNA, 22 nt, Human
uguaugaggcauacaucaggca

SEQ ID NO: 737279 - RNA, 22 nt, Human
gcuccuguuuguuuguuccuga

SEQ ID NO: 737280 - RNA, 20 nt, Human
uuucaagucagcaauucuca

SEQ ID NO: 737281 - RNA, 22 nt, Human
ugaggcccagccgcccugagag

SEQ ID NO: 737282 - RNA, 22 nt, Human
agcaaguguaagaaugcagaau

SEQ ID NO: 737283 - RNA, 22 nt, Human
agcaggcaggaggcuacuaagg

SEQ ID NO: 737284 - RNA, 22 nt, Human
aggcagaugggagcuggaaguu

SEQ ID NO: 737285 - RNA, 22 nt, Human
aacugcaacuuguuugauucuu

SEQ ID NO: 737286 - RNA, 22 nt, Human
gacagcaguuuuucucuagggu

SEQ ID NO: 737287 - RNA, 22 nt, Human
uacagguaaaauuaucagaaac

SEQ ID NO: 737288 - RNA, 22 nt, Human
cauucucucuacuuguuuucaa

SEQ ID NO: 737289 - RNA, 22 nt, Human
caguccuguguuaaacaagagc

SEQ ID NO: 737290 - RNA, 21 nt, Human
ugagaaguaugucuucagcca

SEQ ID NO: 737291 - RNA, 22 nt, Human
aagccuuccugagugcaaggcc

SEQ ID NO: 737292 - RNA, 23 nt, Human
ucuccagugucucuucauugagu

SEQ ID NO: 737293 - RNA, 22 nt, Human
ggagugugggauggagcucagg

SEQ ID NO: 737294 - RNA, 22 nt, Human
uggccuuggcagugagaagagu

SEQ ID NO: 737295 - RNA, 21 nt, Human
uuucagaccuaucuuugaagg

SEQ ID NO: 737296 - RNA, 22 nt, Human
auauaaaguguuuagaaagcug

SEQ ID NO: 737297 - RNA, 23 nt, Human
augaaacaucacaaugguaccau

SEQ ID NO: 737298 - RNA, 22 nt, Human
ugugccuguugguguagacaua

SEQ ID NO: 737299 - RNA, 22 nt, Human
cuauggaaaccuaaucaggaga

SEQ ID NO: 737300 - RNA, 22 nt, Human
gcugccuggagaggcagggaug

SEQ ID NO: 737301 - RNA, 22 nt, Human
ugccugcugauuggaguugaau

SEQ ID NO: 737302 - RNA, 22 nt, Human
ugcugcugaggcuaaaguauag

SEQ ID NO: 737303 - RNA, 22 nt, Human
aaagcugguuauucugaggcag

SEQ ID NO: 737304 - RNA, 22 nt, Human
caagaauuaagaauuuugaugu

SEQ ID NO: 737305 - RNA, 22 nt, Human
cauacauaugcauguguguaua

SEQ ID NO: 737306 - RNA, 22 nt, Human
cagggccagccgcagcauccac

SEQ ID NO: 737307 - RNA, 22 nt, Human
gcaguguuaaacaacugcugcu

SEQ ID NO: 737308 - RNA, 22 nt, Human
acugcaucugaacugugaaugg

SEQ ID NO: 737309 - RNA, 22 nt, Human
acaaggagaagaaauuggucau

SEQ ID NO: 737310 - RNA, 22 nt, Human
uagaagagacauagccuguggu

SEQ ID NO: 737311 - RNA, 22 nt, Human
uggcucaguagcagugugguca

SEQ ID NO: 737312 - RNA, 22 nt, Human
auucacugucagcuugcauggg

SEQ ID NO: 737313 - RNA, 22 nt, Human
cccagcaguaaccaguggaaau

SEQ ID NO: 737314 - RNA, 22 nt, Human
uucaguuucuaaaugcuccucu

SEQ ID NO: 737315 - RNA, 22 nt, Human
agucuguggggucccuggggca

SEQ ID NO: 737316 - RNA, 22 nt, Human
ccugugguuuacucuguggcua

SEQ ID NO: 737317 - RNA, 22 nt, Human
ugacuuuacagauauguuuccu

SEQ ID NO: 737318 - RNA, 22 nt, Human
ucuggcuuucugacucuacaac

SEQ ID NO: 737319 - RNA, 22 nt, Human
cugagcacagaaauaagauauu

SEQ ID NO: 737320 - RNA, 22 nt, Human
acaaucuuauuaguaguauaga

SEQ ID NO: 737321 - RNA, 22 nt, Human
aggcuccugcaggugaggugcu

SEQ ID NO: 737322 - RNA, 22 nt, Human
aagccacagaucguucugucac

SEQ ID NO: 737323 - RNA, 22 nt, Human
acugagaugaauagauggcaag

SEQ ID NO: 737324 - RNA, 19 nt, Human
cugggccagaaucagcuca

SEQ ID NO: 737325 - RNA, 22 nt, Human
acauagaguaucauacuggaug

SEQ ID NO: 737326 - RNA, 22 nt, Human
gagcuuccugcaggucacugug

SEQ ID NO: 737327 - RNA, 22 nt, Human
uuacaaaguguuaugauaaaca

SEQ ID NO: 737328 - RNA, 22 nt, Human
acaguauagggcuuauauugua

SEQ ID NO: 737329 - RNA, 22 nt, Human
aauguacaaggguuccaguuuu

SEQ ID NO: 737330 - RNA, 22 nt, Human
uauaagucuggcauauguaugc

SEQ ID NO: 737331 - RNA, 22 nt, Human
ucagaggccuaugucuacaacu

SEQ ID NO: 737332 - RNA, 22 nt, Human
gcagccagggagagaaccaggg

SEQ ID NO: 737333 - RNA, 22 nt, Human
gauuucuucaggagcagaggag

SEQ ID NO: 737334 - RNA, 23 nt, Human
uccagccucuugcucucacaugc

SEQ ID NO: 737335 - RNA, 22 nt, Human
aaacugucaccuaauguauuuu

SEQ ID NO: 737336 - RNA, 22 nt, Human
uagcacuguucuagcauguuuu

SEQ ID NO: 737337 - RNA, 22 nt, Human
ucagcagguggugggcagguga

SEQ ID NO: 737338 - RNA, 22 nt, Human
gugggugugagugacggcgucc

SEQ ID NO: 737339 - RNA, 22 nt, Human
cuuuucucuuacauuccacugg

SEQ ID NO: 737340 - RNA, 16 nt, Human
gaaggagauucagaaa

SEQ ID NO: 737341 - RNA, 22 nt, Human
uuaggaauauuuucugaguagu

SEQ ID NO: 737342 - RNA, 22 nt, Human
ucacucaauaucccaguggggc

SEQ ID NO: 737343 - RNA, 22 nt, Human
gauggcuucugaaucagggccu

SEQ ID NO: 737344 - RNA, 22 nt, Human
uuugacaaauccuucagcaaug

SEQ ID NO: 737345 - RNA, 22 nt, Human
agcugacugaugaagaggccuu

SEQ ID NO: 737346 - RNA, 22 nt, Human
ugggcugcuucucaaaugucuc

SEQ ID NO: 737347 - RNA, 22 nt, Human
acuaaggaauaugacaaacuca

SEQ ID NO: 737348 - RNA, 21 nt, Human
gauuuauaagccuuaagccua

SEQ ID NO: 737349 - RNA, 22 nt, Human
ccacagcugaccgcaggugagc

SEQ ID NO: 737350 - RNA, 22 nt, Human
uggcccagaucucugaccuuga

SEQ ID NO: 737351 - RNA, 22 nt, Human
aagaguggagcuggaaaguggg

SEQ ID NO: 737352 - RNA, 22 nt, Human
ggguagcaugugucagaguuug

SEQ ID NO: 737353 - RNA, 22 nt, Human
cccaggcuccuagaggcccaga

SEQ ID NO: 737354 - RNA, 22 nt, Human
ccccuggguccaggcuucucug

SEQ ID NO: 737355 - RNA, 22 nt, Human
ggacuuggcuucuuucagagac

SEQ ID NO: 737356 - RNA, 22 nt, Human
uuaagacauuuuuggagauuau

SEQ ID NO: 737357 - RNA, 22 nt, Human
augaaugggucauuauuugauc

SEQ ID NO: 737358 - RNA, 22 nt, Human
caggaaggcgcggcugugccug

SEQ ID NO: 737359 - RNA, 22 nt, Human
ggggaggcaagaugaagugagg

SEQ ID NO: 737360 - RNA, 22 nt, Human
aucuguggcgcaaacaaaggcu

SEQ ID NO: 737361 - RNA, 22 nt, Human
auugcuuaucuaucuuuaaguc

SEQ ID NO: 737362 - RNA, 22 nt, Human
agaguucugcucuucucaguga

SEQ ID NO: 737363 - RNA, 22 nt, Human
aacagcuucaucacauggcaua

SEQ ID NO: 737364 - RNA, 22 nt, Human
cagcuggcgggcagagccgcca

SEQ ID NO: 737365 - RNA, 22 nt, Human
ugcaggagagcuggucuggccc

SEQ ID NO: 737366 - RNA, 22 nt, Human
caacuuggcucucuggcuaucc

SEQ ID NO: 737367 - RNA, 22 nt, Human
aauaguccugauuuaaucuggg

SEQ ID NO: 737368 - RNA, 22 nt, Human
gaagaagagauaauggggagca

SEQ ID NO: 737369 - RNA, 22 nt, Human
gcaaaugaagguggugcuacag

SEQ ID NO: 737370 - RNA, 21 nt, Human
uuggauguauuuauguuuuag

SEQ ID NO: 737371 - RNA, 22 nt, Human
uauauuaaccauaggguucuag

SEQ ID NO: 737372 - RNA, 21 nt, Human
uaagagcuauuauugcaaacc

SEQ ID NO: 737373 - RNA, 22 nt, Human
cccagaggugaaggagguggga

SEQ ID NO: 737374 - RNA, 22 nt, Human
ugagacaauaaggcugagaagc

SEQ ID NO: 737375 - RNA, 22 nt, Human
gcuggcuucccuaccugcaccu

SEQ ID NO: 737376 - RNA, 22 nt, Human
auuauuauauagggaaaguccc

SEQ ID NO: 737377 - RNA, 20 nt, Human
cugcuguguuauuguagaac

SEQ ID NO: 737378 - RNA, 22 nt, Human
uccuucuuugacaaguggcaga

SEQ ID NO: 737379 - RNA, 22 nt, Human
ucagcacugucuuuuauuugaa

SEQ ID NO: 737380 - RNA, 22 nt, Human
uauuucacagcagcucauuuaa

SEQ ID NO: 737381 - RNA, 22 nt, Human
ggccagcuccuuggcagugccu

SEQ ID NO: 737382 - RNA, 22 nt, Human
uccuggacaagcccuucacccu

SEQ ID NO: 737383 - RNA, 19 nt, Human
gcucaacagcucggguccu

SEQ ID NO: 737384 - RNA, 22 nt, Human
uuaguugaugcuaagggauccc

SEQ ID NO: 737385 - RNA, 22 nt, Human
caggugcucugcugcagguaag

SEQ ID NO: 737386 - RNA, 22 nt, Human
cagaguucaaagccugcuggga

SEQ ID NO: 737387 - RNA, 22 nt, Human
agcauuuaauuacaguuuaauu

SEQ ID NO: 737388 - RNA, 21 nt, Human
uuuuacagaugaggggaaggg

SEQ ID NO: 737389 - RNA, 22 nt, Human
aggggccauguaaguguaucac

SEQ ID NO: 737390 - RNA, 22 nt, Human
ggcuagaauaauugacuucauu

SEQ ID NO: 737391 - RNA, 22 nt, Human
cacucugagaaguacaagcucc

SEQ ID NO: 737392 - RNA, 22 nt, Human
gaguagaacuagaauucuucaa

SEQ ID NO: 737393 - RNA, 22 nt, Human
aagcaugguuucugacgucaug

SEQ ID NO: 737394 - RNA, 22 nt, Human
auuaaauuagcaaacugugaaa

SEQ ID NO: 737395 - RNA, 22 nt, Human
cucaguuugagggguagguguu

SEQ ID NO: 737396 - RNA, 23 nt, Human
cuguuauuccaggcugaugggug

SEQ ID NO: 737397 - RNA, 22 nt, Human
cuuauuugagagaaaagaaacu

SEQ ID NO: 737398 - RNA, 22 nt, Human
ucccacaggggcucuguggguu

SEQ ID NO: 737399 - RNA, 22 nt, Human
gccucugggugacgaaagguga

SEQ ID NO: 737400 - RNA, 23 nt, Human
uguacaaguacgaccucucccuc

SEQ ID NO: 737401 - RNA, 18 nt, Human
aaggccuagucccucucu

SEQ ID NO: 737402 - RNA, 22 nt, Human
aagaaaacguuuugaggaguuu

SEQ ID NO: 737403 - RNA, 22 nt, Human
cauuuauucaugaucuguagcu

SEQ ID NO: 737404 - RNA, 22 nt, Human
augccaaagggagcacuuuggg

SEQ ID NO: 737405 - RNA, 22 nt, Human
ccagggcagccaacccagaugc

SEQ ID NO: 737406 - RNA, 22 nt, Human
gccuggaguguugguauuucuc

SEQ ID NO: 737407 - RNA, 22 nt, Human
uucauugugaacacauucugcc

SEQ ID NO: 737408 - RNA, 22 nt, Human
acaaauucuacaaucauaugau

SEQ ID NO: 737409 - RNA, 22 nt, Human
uaguuuagccauuuaggaauug

SEQ ID NO: 737410 - RNA, 22 nt, Human
gggcugaggcuaccacuggucu

SEQ ID NO: 737411 - RNA, 22 nt, Human
agaagugccgaaaggaagacag

SEQ ID NO: 737412 - RNA, 22 nt, Human
ugacauuuacuauuccugguua

SEQ ID NO: 737413 - RNA, 22 nt, Human
cugccuuuucaucugagcugga

SEQ ID NO: 737414 - RNA, 22 nt, Human
aggaauuuuacaucucagagag

SEQ ID NO: 737415 - RNA, 21 nt, Human
aaaugaaugugguagugcaag

SEQ ID NO: 737416 - RNA, 22 nt, Human
ugagcuguaaggcugucacuga

SEQ ID NO: 737417 - RNA, 22 nt, Human
uggaguuagauaaaccugggua

SEQ ID NO: 737418 - RNA, 22 nt, Human
uucacacacagcuuccuauugu

SEQ ID NO: 737419 - RNA, 22 nt, Human
uguucaaaaauaucuucugcaa

SEQ ID NO: 737420 - RNA, 22 nt, Human
auggacaggaacucccuuggca

SEQ ID NO: 737421 - RNA, 22 nt, Human
uggcucuggggacaguaagucc

SEQ ID NO: 737422 - RNA, 22 nt, Human
ucucaggggcagugauccuaag

SEQ ID NO: 737423 - RNA, 22 nt, Human
uuuuagaaggaaugcuauggug

SEQ ID NO: 737424 - RNA, 22 nt, Human
agcaacaggaaauagcugauua

SEQ ID NO: 737425 - RNA, 22 nt, Human
aucaucuuaucugacucauuuu

SEQ ID NO: 737426 - RNA, 22 nt, Human
gcaauuguacuagaaaacaaua

SEQ ID NO: 737427 - RNA, 19 nt, Human
caauucugcaacacugucc

SEQ ID NO: 737428 - RNA, 22 nt, Human
gcuuuuuugggaugccugccuu

SEQ ID NO: 737429 - RNA, 22 nt, Human
gggucagcgauuucaggggcag

SEQ ID NO: 737430 - RNA, 19 nt, Human
gguaaaagugagcuucagg

SEQ ID NO: 737431 - RNA, 19 nt, Human
gagggcuugauggacccga

SEQ ID NO: 737432 - RNA, 22 nt, Human
ggcagggucuggacugaaagcu

SEQ ID NO: 737433 - RNA, 22 nt, Human
uucuuguacuggagauacauga

SEQ ID NO: 737434 - RNA, 18 nt, Human
augugucuuucuuguuug

SEQ ID NO: 737435 - RNA, 22 nt, Human
cuccccagcauucugacuuccu

SEQ ID NO: 737436 - RNA, 22 nt, Human
guuagaaacacauucuuauuga

SEQ ID NO: 737437 - RNA, 22 nt, Human
uugaggucaauucuguuuccug

SEQ ID NO: 737438 - RNA, 22 nt, Human
cuuugucauuuugucucucagu

SEQ ID NO: 737439 - RNA, 22 nt, Human
ucuuuuagaaaaguugaaugua

SEQ ID NO: 737440 - RNA, 22 nt, Human
uuagugugcauggaucugugga

SEQ ID NO: 737441 - RNA, 22 nt, Human
auauaacauacauacagaaaag

SEQ ID NO: 737442 - RNA, 22 nt, Human
ucuuggcuacuuuccugucugc

SEQ ID NO: 737443 - RNA, 22 nt, Human
aaauguguuucuuugugaaugg

SEQ ID NO: 737444 - RNA, 22 nt, Human
cucugguguccuuuagaauuua

SEQ ID NO: 737445 - RNA, 22 nt, Human
caucugcuguaauuaacaagcc

SEQ ID NO: 737446 - RNA, 22 nt, Human
acccagcucuuugauggucuug

SEQ ID NO: 737447 - RNA, 22 nt, Human
cuggcuccacucccugccugac

SEQ ID NO: 737448 - RNA, 22 nt, Human
gggacuggcacagggcugggag

SEQ ID NO: 737449 - RNA, 21 nt, Human
ugauucugcauuucuaacagg

SEQ ID NO: 737450 - RNA, 22 nt, Human
uuaauuuauacauaaucacagg

SEQ ID NO: 737451 - RNA, 22 nt, Human
agcugucuggaaguuccucaug

SEQ ID NO: 737452 - RNA, 23 nt, Human
ggauacaaagauuaauaguagag

SEQ ID NO: 737453 - RNA, 22 nt, Human
aguuaucaucccuuacacuuug

SEQ ID NO: 737454 - RNA, 23 nt, Human
aggauccugguacaggagcagag

SEQ ID NO: 737455 - RNA, 18 nt, Human
uaagcaaugacauugcaa

SEQ ID NO: 737456 - RNA, 22 nt, Human
ggcuggcacccuuggggauagg

SEQ ID NO: 737457 - RNA, 22 nt, Human
gugucuguuauacagaggagac

SEQ ID NO: 737458 - RNA, 23 nt, Human
ugauucugcuuugagaaucaugg

SEQ ID NO: 737459 - RNA, 22 nt, Human
cccugcuaguccuuccuuggcu

SEQ ID NO: 737460 - RNA, 22 nt, Human
acaguuauauacauguagcugu

SEQ ID NO: 737461 - RNA, 22 nt, Human
ugucauuuucuaaucuguuguc

SEQ ID NO: 737462 - RNA, 22 nt, Human
uugcagcuucuugcaucagaaa

SEQ ID NO: 737463 - RNA, 22 nt, Human
uacagcugcaaggguuucuggg

SEQ ID NO: 737464 - RNA, 22 nt, Human
gcugugugacugagagccuggc

SEQ ID NO: 737465 - RNA, 22 nt, Human
uaacauguucagacuaccugug

SEQ ID NO: 737466 - RNA, 22 nt, Human
aggauacaagucucagaaugcu

SEQ ID NO: 737467 - RNA, 22 nt, Human
uuggagggacugagcuucaguc

SEQ ID NO: 737468 - RNA, 22 nt, Human
uggaaugugcuagggcuguggc

SEQ ID NO: 737469 - RNA, 22 nt, Human
uuuggagauggagagagggcau

SEQ ID NO: 737470 - RNA, 22 nt, Human
gagguucaguccugcucuguca

SEQ ID NO: 737471 - RNA, 22 nt, Human
auaaacuuuagcggaaggagga

SEQ ID NO: 737472 - RNA, 22 nt, Human
aaacuuuuuauucuaaugucua

SEQ ID NO: 737473 - RNA, 22 nt, Human
gcuggggcugggcugaggaaga

SEQ ID NO: 737474 - RNA, 22 nt, Human
uaaaagauaucuuagggauuug

SEQ ID NO: 737475 - RNA, 22 nt, Human
ggcugcugacaaacaugaucau

SEQ ID NO: 737476 - RNA, 22 nt, Human
gcucugaggcugggagcacucu

SEQ ID NO: 737477 - RNA, 22 nt, Human
aguucacaccaaaguuagguag

SEQ ID NO: 737478 - RNA, 22 nt, Human
caugcugagcacauucuguauu

SEQ ID NO: 737479 - RNA, 22 nt, Human
acacacuguaaggacuaucacu

SEQ ID NO: 737480 - RNA, 23 nt, Human
ucauggaacugggcaaucuugaa

SEQ ID NO: 737481 - RNA, 22 nt, Human
cagaggcacaagaaagcaaggc

SEQ ID NO: 737482 - RNA, 18 nt, Human
ugcuuucuagcuucagau

SEQ ID NO: 737483 - RNA, 22 nt, Human
ucaguguuuuccagggucuacu

SEQ ID NO: 737484 - RNA, 22 nt, Human
gaggcaccagacauggccucau

SEQ ID NO: 737485 - RNA, 22 nt, Human
acauaugucuauuucauguaaa

SEQ ID NO: 737486 - RNA, 22 nt, Human
aacagcaucaccccauaacauu

SEQ ID NO: 737487 - RNA, 20 nt, Human
uggaaggucccagaggaauu

SEQ ID NO: 737488 - RNA, 22 nt, Human
uaggaacauaugcagugcuuuu

SEQ ID NO: 737489 - RNA, 22 nt, Human
gcuggacaggccacauggagga

SEQ ID NO: 737490 - RNA, 22 nt, Human
aggaaacaugaaucugccuuga

SEQ ID NO: 737491 - RNA, 22 nt, Human
gggcaguugauggaggucugga

SEQ ID NO: 737492 - RNA, 22 nt, Human
ugaguaucaauuacauaguugu

SEQ ID NO: 737493 - RNA, 22 nt, Human
ugauggaaacuuggguaaguca

SEQ ID NO: 737494 - RNA, 22 nt, Human
cuucucuuccuuugucaacuga

SEQ ID NO: 737495 - RNA, 22 nt, Human
caguaucuccacauguaaagug

SEQ ID NO: 737496 - RNA, 22 nt, Human
ucccagagugagccaggggcag

SEQ ID NO: 737497 - RNA, 22 nt, Human
aaauccuaaugacaaguuuagu

SEQ ID NO: 737498 - RNA, 22 nt, Human
gcugccugugcacuuucucgua

SEQ ID NO: 737499 - RNA, 23 nt, Human
auuugagaaaguauuuuuaagac

SEQ ID NO: 737500 - RNA, 22 nt, Human
uuccaacuuugucauauauuau

SEQ ID NO: 737501 - RNA, 22 nt, Human
caagcauacucauuccagacuc

SEQ ID NO: 737502 - RNA, 21 nt, Human
gggccacaccuucugcagacc

SEQ ID NO: 737503 - RNA, 22 nt, Human
gcucaguguuucugguagaaaa

SEQ ID NO: 737504 - RNA, 22 nt, Human
cucagaaagcaaucuggugagg

SEQ ID NO: 737505 - RNA, 22 nt, Human
auggaaaugauggaacauuaaa

SEQ ID NO: 737506 - RNA, 22 nt, Human
gugcugagaacaaaaguggaca

SEQ ID NO: 737507 - RNA, 22 nt, Human
cacugcccaggaccugccaccc

SEQ ID NO: 737508 - RNA, 22 nt, Human
cugaggagcccccucucagcau

SEQ ID NO: 737509 - RNA, 22 nt, Human
ugccaggccacguagcuucaag

SEQ ID NO: 737510 - RNA, 22 nt, Human
ugaggcuccuuguagagagugg

SEQ ID NO: 737511 - RNA, 22 nt, Human
uccagggcaccagcgucccccu

SEQ ID NO: 737512 - RNA, 18 nt, Human
gcaguaggcgcgcaggac

SEQ ID NO: 737513 - RNA, 22 nt, Human
cuggagcaaaagugacuccucu

SEQ ID NO: 737514 - RNA, 22 nt, Human
guggcagagccaggcuuugaac

SEQ ID NO: 737515 - RNA, 17 nt, Human
ccaggugggaggugggg

SEQ ID NO: 737516 - RNA, 22 nt, Human
cauuuuacgacauagggcaggc

SEQ ID NO: 737517 - RNA, 22 nt, Human
gcuucacagaaucaauaguugg

SEQ ID NO: 737518 - RNA, 22 nt, Human
uuugaauguuggauugacuuag

SEQ ID NO: 737519 - RNA, 21 nt, Human
ugggcaaguuuggggguccuc

SEQ ID NO: 737520 - RNA, 22 nt, Human
uuguauuaauugaaaugaaugc

SEQ ID NO: 737521 - RNA, 22 nt, Human
cagaagaaaucauuaucuggac

SEQ ID NO: 737522 - RNA, 22 nt, Human
uuacuuuguucucaagauaugu

SEQ ID NO: 737523 - RNA, 22 nt, Human
cugagcacugggcacauagcug

SEQ ID NO: 737524 - RNA, 22 nt, Human
ucucagcucauggcagccuuga

SEQ ID NO: 737525 - RNA, 22 nt, Human
caggccagcuuccugacauccu

SEQ ID NO: 737526 - RNA, 22 nt, Human
uuuucuuacugucugugauccu

SEQ ID NO: 737527 - RNA, 21 nt, Human
ucacaugcuuauuccuggaau

SEQ ID NO: 737528 - RNA, 22 nt, Human
caucuuuaaaggggagacaccc

SEQ ID NO: 737529 - RNA, 22 nt, Human
uccaucuguuuacuauaaagau

SEQ ID NO: 737530 - RNA, 22 nt, Human
aaugacaugcuuuuuaauuaua

SEQ ID NO: 737531 - RNA, 22 nt, Human
agguucuuuuggccaaccucau

SEQ ID NO: 737532 - RNA, 22 nt, Human
aaaggccacacugcucuuucuc

SEQ ID NO: 737533 - RNA, 22 nt, Human
cucuggcuuuaaggaugccaca

SEQ ID NO: 737534 - RNA, 22 nt, Human
uccacagguauuucuccuugcu

SEQ ID NO: 737535 - RNA, 20 nt, Human
ggagucacauucuuuacugc

SEQ ID NO: 737536 - RNA, 22 nt, Human
gagccuggccuccugccucagc

SEQ ID NO: 737537 - RNA, 22 nt, Human
cugagcugcucccgcugcagcg

SEQ ID NO: 737538 - RNA, 22 nt, Human
agugcaggccccaggccaggcc

SEQ ID NO: 737539 - RNA, 22 nt, Human
uucuucuuuccaauuacauggu

SEQ ID NO: 737540 - RNA, 22 nt, Human
auccacagagaggaagaauagu

SEQ ID NO: 737541 - RNA, 22 nt, Human
gagagcaggcucucgggggcca

SEQ ID NO: 737542 - RNA, 22 nt, Human
ucaaacauguuagcagucugug

SEQ ID NO: 737543 - RNA, 22 nt, Human
cuguauaaccccaugcgacugu

SEQ ID NO: 737544 - RNA, 21 nt, Human
uacagaaugcgcuucagucug

SEQ ID NO: 737545 - RNA, 18 nt, Human
ggcaccucucuugccuua

SEQ ID NO: 737546 - RNA, 22 nt, Human
aggagaucagccucccugcaac

SEQ ID NO: 737547 - RNA, 22 nt, Human
ucuguggcgcauaguugucucu

SEQ ID NO: 737548 - RNA, 22 nt, Human
caaacauuuuaaauaagggaua

SEQ ID NO: 737549 - RNA, 22 nt, Human
gcuuccuggaacaacuguugcu

SEQ ID NO: 737550 - RNA, 22 nt, Human
cuggccuucagacucggacuga

SEQ ID NO: 737551 - RNA, 22 nt, Human
aaguacauuauaugagcagaau

SEQ ID NO: 737552 - RNA, 22 nt, Human
ugucccagcacuuugggagucu

SEQ ID NO: 737553 - RNA, 22 nt, Human
guuacaaaggucauaaaagugu

SEQ ID NO: 737554 - RNA, 18 nt, Human
caguggcauaguugagua

SEQ ID NO: 737555 - RNA, 22 nt, Human
ucuaaagauuuggauucauuug

SEQ ID NO: 737556 - RNA, 22 nt, Human
guuuagauuucaugaagacacu

SEQ ID NO: 737557 - RNA, 22 nt, Human
ccugugucugaccaugcacaug

SEQ ID NO: 737558 - RNA, 22 nt, Human
uucugcauccuaugaucgcaua

SEQ ID NO: 737559 - RNA, 22 nt, Human
guguccagagaaacucacagcu

SEQ ID NO: 737560 - RNA, 22 nt, Human
uuucaaaugcaugucuuuccuc

SEQ ID NO: 737561 - RNA, 22 nt, Human
agguaaauauaaaucuuacucu

SEQ ID NO: 737562 - RNA, 22 nt, Human
ccugggaaagugaggucauuau

SEQ ID NO: 737563 - RNA, 22 nt, Human
uuguuuuuagagaagcccugaa

SEQ ID NO: 737564 - RNA, 22 nt, Human
aagagagaacucccuucgccag

SEQ ID NO: 737565 - RNA, 22 nt, Human
caacuccuccccagcaugccaa

SEQ ID NO: 737566 - RNA, 22 nt, Human
auacuuaugauaaauaauugcu

SEQ ID NO: 737567 - RNA, 22 nt, Human
cccagagaagugaagugacuug

SEQ ID NO: 737568 - RNA, 22 nt, Human
gcaccugcuggaaucagucugu

SEQ ID NO: 737569 - RNA, 22 nt, Human
gugcaugucggggugcauguca

SEQ ID NO: 737570 - RNA, 22 nt, Human
uauaaaucuuuguuccuagaau

SEQ ID NO: 737571 - RNA, 22 nt, Human
uguagcacguuaguguuagagc

SEQ ID NO: 737572 - RNA, 22 nt, Human
uaaauguaccuucugccuuacu

SEQ ID NO: 737573 - RNA, 22 nt, Human
gauuccacggcucagccucaac

SEQ ID NO: 737574 - RNA, 22 nt, Human
aaccagcuccucaccccauugu

SEQ ID NO: 737575 - RNA, 22 nt, Human
ucugugccaagcuuauaucugu

SEQ ID NO: 737576 - RNA, 22 nt, Human
acagaugaauuuuaauuguguu

SEQ ID NO: 737577 - RNA, 22 nt, Human
ugagggguugugagaaauguag

SEQ ID NO: 737578 - RNA, 22 nt, Human
ugaugaccgccaacguuuaggu

SEQ ID NO: 737579 - RNA, 22 nt, Human
ggagaugcuuuccaguggggau

SEQ ID NO: 737580 - RNA, 22 nt, Human
cuuuggcucaugguuuuaucca

SEQ ID NO: 737581 - RNA, 22 nt, Human
ugcuucucuuuauuuguagguu

SEQ ID NO: 737582 - RNA, 22 nt, Human
acucugggagaggacaaacaaa

SEQ ID NO: 737583 - RNA, 22 nt, Human
cugggagucccuggaauagcuc

SEQ ID NO: 737584 - RNA, 22 nt, Human
gccaguggcccucuggagaagg

SEQ ID NO: 737585 - RNA, 22 nt, Human
uugauacaggccuucuagauga

SEQ ID NO: 737586 - RNA, 22 nt, Human
ucggccacgggguuuccuccaa

SEQ ID NO: 737587 - RNA, 22 nt, Human
gaggcugcccaacuggagugga

SEQ ID NO: 737588 - RNA, 22 nt, Human
acucuucaguacaauaauaucu

SEQ ID NO: 737589 - RNA, 22 nt, Human
agcauagauacauugagccaca

SEQ ID NO: 737590 - RNA, 22 nt, Human
ucccugugggaugaggacucug

SEQ ID NO: 737591 - RNA, 22 nt, Human
ugggagaaucuugcucugcuac

SEQ ID NO: 737592 - RNA, 17 nt, Human
ugggccaguagaaggga

SEQ ID NO: 737593 - RNA, 21 nt, Human
ucugggugcuaguguuugcuu

SEQ ID NO: 737594 - RNA, 22 nt, Human
cuuaucagauuaucugggcugu

SEQ ID NO: 737595 - RNA, 22 nt, Human
gcuguuuccccuucacaguggc

SEQ ID NO: 737596 - RNA, 22 nt, Human
ccaggaagcucugcuccacggg

SEQ ID NO: 737597 - RNA, 22 nt, Human
cugccuagggucugguaccaca

SEQ ID NO: 737598 - RNA, 22 nt, Human
ugaggcugccuugggaagaggg

SEQ ID NO: 737599 - RNA, 22 nt, Human
uaggggagcucgggugcaaucg

SEQ ID NO: 737600 - RNA, 22 nt, Human
aauuuggagcuuuguuucuaga

SEQ ID NO: 737601 - RNA, 22 nt, Human
uacaaagccugguagauaucug

SEQ ID NO: 737602 - RNA, 22 nt, Human
gugaacaguucauuuuaucaug

SEQ ID NO: 737603 - RNA, 22 nt, Human
ccuggagcccaaggcagugaga

SEQ ID NO: 737604 - RNA, 22 nt, Human
uacauugaggcaguagcuggag

SEQ ID NO: 737605 - RNA, 22 nt, Human
auccugggcaaaguaugcuguc

SEQ ID NO: 737606 - RNA, 22 nt, Human
cuccaggcuggggugcagguug

SEQ ID NO: 737607 - RNA, 22 nt, Human
acugucacugugauguuagaga

SEQ ID NO: 737608 - RNA, 22 nt, Human
ucccuccugcaugaggcucggc

SEQ ID NO: 737609 - RNA, 22 nt, Human
guuucuuagguaaauucuuuga

SEQ ID NO: 737610 - RNA, 22 nt, Human
uggcugaggcuuuucuuaaaga

SEQ ID NO: 737611 - RNA, 22 nt, Human
ucacaguuacuccuucagauga

SEQ ID NO: 737612 - RNA, 22 nt, Human
caugauacuugacauuugcgau

SEQ ID NO: 737613 - RNA, 22 nt, Human
ggcugcaggcagaggcugucug

SEQ ID NO: 737614 - RNA, 22 nt, Human
cccagggcccuggacagcuaca

SEQ ID NO: 737615 - RNA, 22 nt, Human
uguucauucgcuauugucuaug

SEQ ID NO: 737616 - RNA, 22 nt, Human
cgacagcagaagaagcaagcca

SEQ ID NO: 737617 - RNA, 22 nt, Human
ucaucugaccacuuuaucucuc

SEQ ID NO: 737618 - RNA, 22 nt, Human
uaaagccauacugaaagccacu

SEQ ID NO: 737619 - RNA, 22 nt, Human
ggacagggcucuuggcacuccu

SEQ ID NO: 737620 - RNA, 22 nt, Human
uggggccacacaucucuuucua

SEQ ID NO: 737621 - RNA, 22 nt, Human
ggccagaaguuggaaaagagcc

SEQ ID NO: 737622 - RNA, 22 nt, Human
aucacagagcucccuuccacug

SEQ ID NO: 737623 - RNA, 22 nt, Human
cauaagaaauuuaacagaacuu

SEQ ID NO: 737624 - RNA, 22 nt, Human
gguccugaguaccuauguuuau

SEQ ID NO: 737625 - RNA, 22 nt, Human
ucaggcagaaaaaucacuaauu

SEQ ID NO: 737626 - RNA, 22 nt, Human
aggcaggcuggucugaagagug

SEQ ID NO: 737627 - RNA, 22 nt, Human
acugcagagguggggugcagag

SEQ ID NO: 737628 - RNA, 22 nt, Human
ggcaggagaaaggucucuucuu

SEQ ID NO: 737629 - RNA, 22 nt, Human
aauugcuuacuguuuuucaccu

SEQ ID NO: 737630 - RNA, 20 nt, Human
ccacaguggagacuggagac

SEQ ID NO: 737631 - RNA, 22 nt, Human
ucccuugguaauucuguuccuu

SEQ ID NO: 737632 - RNA, 22 nt, Human
acacauaugcagaucccccaca

SEQ ID NO: 737633 - RNA, 22 nt, Human
uuaaguauauccauuugacugg

SEQ ID NO: 737634 - RNA, 22 nt, Human
cucugaaagcaaaacuagagaa

SEQ ID NO: 737635 - RNA, 22 nt, Human
gcuguggaaaugccuaacauga

SEQ ID NO: 737636 - RNA, 22 nt, Human
auggcccuaucaccuuugcuuc

SEQ ID NO: 737637 - RNA, 22 nt, Human
uguuugcuaggguugguauuua

SEQ ID NO: 737638 - RNA, 19 nt, Human
cuggagauagggccuuuaa

SEQ ID NO: 737639 - RNA, 17 nt, Human
acacaguacuuuuuugc

SEQ ID NO: 737640 - RNA, 22 nt, Human
augcaguuuucaaagacuauuc

SEQ ID NO: 737641 - RNA, 22 nt, Human
cggagcugcgccgggacacggg

SEQ ID NO: 737642 - RNA, 22 nt, Human
uugaaggaggcgaaaauugguc

SEQ ID NO: 737643 - RNA, 22 nt, Human
ccaaggcuggagugcaguggcg

SEQ ID NO: 737644 - RNA, 22 nt, Human
gcucaaggcaggcagacaugag

SEQ ID NO: 737645 - RNA, 22 nt, Human
gccaggggacgcggagcgacga

SEQ ID NO: 737646 - RNA, 22 nt, Human
agaaacaacuuguuucucuugc

SEQ ID NO: 737647 - RNA, 22 nt, Human
cuggaugauaacagcaauauuu

SEQ ID NO: 737648 - RNA, 22 nt, Human
auaacagacugauuuuuaaaug

SEQ ID NO: 737649 - RNA, 22 nt, Human
ucugcaaacccccaucuaucau

SEQ ID NO: 737650 - RNA, 22 nt, Human
ugcugcugauggcaccuaggca

SEQ ID NO: 737651 - RNA, 22 nt, Human
cugucacugaugggcucaccag

SEQ ID NO: 737652 - RNA, 22 nt, Human
uacaaagaguuuggucucuaga

SEQ ID NO: 737653 - RNA, 22 nt, Human
uaccuuggguugaguucauucu

SEQ ID NO: 737654 - RNA, 22 nt, Human
auaguguguaaagugcagugau

SEQ ID NO: 737655 - RNA, 22 nt, Human
cccuccaggccugucauguucc

SEQ ID NO: 737656 - RNA, 22 nt, Human
gaagaugugggcccacuccaga

SEQ ID NO: 737657 - RNA, 22 nt, Human
ucccaggacccaggcauucaca

SEQ ID NO: 737658 - RNA, 22 nt, Human
gacauuuguaucuuaggggaaa

SEQ ID NO: 737659 - RNA, 22 nt, Human
agggaacagugaaaggcaucag

SEQ ID NO: 737660 - RNA, 22 nt, Human
gaagaggcuuuccuagggcaag

SEQ ID NO: 737661 - RNA, 22 nt, Human
cauuacaugguccaggauauau

SEQ ID NO: 737662 - RNA, 22 nt, Human
ggcuucacauagcaaugugagc

SEQ ID NO: 737663 - RNA, 22 nt, Human
aguucacagggaagguuauugu

SEQ ID NO: 737664 - RNA, 22 nt, Human
agucaggauaugccuugugggc

SEQ ID NO: 737665 - RNA, 18 nt, Human
cugcugugucgucugggc

SEQ ID NO: 737666 - RNA, 22 nt, Human
aagaauaagaggauuuagaaca

SEQ ID NO: 737667 - RNA, 22 nt, Human
ucucuggcccuguuuucuaucu

SEQ ID NO: 737668 - RNA, 22 nt, Human
uccagccccuccugagccaagc

SEQ ID NO: 737669 - RNA, 22 nt, Human
uugcagggaaaucagugaggau

SEQ ID NO: 737670 - RNA, 22 nt, Human
uacacaugcauguacuccagga

SEQ ID NO: 737671 - RNA, 22 nt, Human
ccaggcccugccugugguuccu

SEQ ID NO: 737672 - RNA, 22 nt, Human
ugaucaaagugcuggaauuaca

SEQ ID NO: 737673 - RNA, 22 nt, Human
uggcucaggggucuggcucugu

SEQ ID NO: 737674 - RNA, 20 nt, Human
uguccccuagaucccagcuc

SEQ ID NO: 737675 - RNA, 22 nt, Human
ucccagaggcuccagucucuau

SEQ ID NO: 737676 - RNA, 22 nt, Human
acuaggaauucaaguagacaga

SEQ ID NO: 737677 - RNA, 22 nt, Human
uguacaguauugguguuaguag

SEQ ID NO: 737678 - RNA, 22 nt, Human
ugggcagaggcucugaagucca

SEQ ID NO: 737679 - RNA, 23 nt, Human
caugucugcuuucaugcuacaac

SEQ ID NO: 737680 - RNA, 18 nt, Human
aguccuggcucuaccacc

SEQ ID NO: 737681 - RNA, 22 nt, Human
acccagagucauguuuauuccc

SEQ ID NO: 737682 - RNA, 22 nt, Human
aaaugcagaaugauuucaucua

SEQ ID NO: 737683 - RNA, 22 nt, Human
ccacuuucugagggaacagcag

SEQ ID NO: 737684 - RNA, 22 nt, Human
uuccucaggcuucccuuugucc

SEQ ID NO: 737685 - RNA, 22 nt, Human
agugcagccgagaucaggugcu

SEQ ID NO: 737686 - RNA, 22 nt, Human
aucuuucuauuucuaaaaacua

SEQ ID NO: 737687 - RNA, 22 nt, Human
caggcagacuuugagaaugaug

SEQ ID NO: 737688 - RNA, 22 nt, Human
aaggcagcagugcacgacugau

SEQ ID NO: 737689 - RNA, 20 nt, Human
cuguuugcuaucaugagcug

SEQ ID NO: 737690 - RNA, 22 nt, Human
uauggcuuguggagaguuguag

SEQ ID NO: 737691 - RNA, 22 nt, Human
aggcaggaggaucauggaugca

SEQ ID NO: 737692 - RNA, 22 nt, Human
cuguuuaucauguacauuucca

SEQ ID NO: 737693 - RNA, 22 nt, Human
cucagggcggcgggcagcccag

SEQ ID NO: 737694 - RNA, 22 nt, Human
gauuuaguggcccuugguacac

SEQ ID NO: 737695 - RNA, 22 nt, Human
uccugguggugccagcugcagg

SEQ ID NO: 737696 - RNA, 22 nt, Human
gcccagcagcuccacuuggcuu

SEQ ID NO: 737697 - RNA, 22 nt, Human
ggaagcuguuccuguguggcca

SEQ ID NO: 737698 - RNA, 18 nt, Human
ggcuguggacaagauuag

SEQ ID NO: 737699 - RNA, 22 nt, Human
uugaauaggacucagcagugau

SEQ ID NO: 737700 - RNA, 22 nt, Human
gccuaacuuggcuuuguucacc

SEQ ID NO: 737701 - RNA, 22 nt, Human
ucuuuauuuuaugcuugugcaa

SEQ ID NO: 737702 - RNA, 22 nt, Human
cuggaaagugcauguaaugagg

SEQ ID NO: 737703 - RNA, 21 nt, Human
ucucuacaaauuauguuaggu

SEQ ID NO: 737704 - RNA, 22 nt, Human
ccaggcaggcuagaauguaaau

SEQ ID NO: 737705 - RNA, 22 nt, Human
aggucacacaacugucagaggc

SEQ ID NO: 737706 - RNA, 22 nt, Human
agugccauggaggaacagaugc

SEQ ID NO: 737707 - RNA, 22 nt, Human
gggauggggucgggacccugcu

SEQ ID NO: 737708 - RNA, 22 nt, Human
caucagcuuuggcgcugagcau

SEQ ID NO: 737709 - RNA, 22 nt, Human
auucugcucaugagcucccggg

SEQ ID NO: 737710 - RNA, 22 nt, Human
uggaggcugugugcaugagacc

SEQ ID NO: 737711 - RNA, 22 nt, Human
uagccucuggaauccuuucucu

SEQ ID NO: 737712 - RNA, 22 nt, Human
aggugggcccagugggcuccag

SEQ ID NO: 737713 - RNA, 22 nt, Human
gccuuggaaagcuggagcaguu

SEQ ID NO: 737714 - RNA, 22 nt, Human
ucucagaaggguggugcuggag

SEQ ID NO: 737715 - RNA, 22 nt, Human
auauuuuguaacuuggaauagg

SEQ ID NO: 737716 - RNA, 22 nt, Human
ucagagaagcugccaggcgagc

SEQ ID NO: 737717 - RNA, 22 nt, Human
gcccaggaguugguggcugcag

SEQ ID NO: 737718 - RNA, 22 nt, Human
uagaaacccaggauuuguauuu

SEQ ID NO: 737719 - RNA, 22 nt, Human
uguuaugaguccucauauacua

SEQ ID NO: 737720 - RNA, 22 nt, Human
agcugagguuaguauaaaugug

SEQ ID NO: 737721 - RNA, 22 nt, Human
acagcagagccuagcuuaaucu

SEQ ID NO: 737722 - RNA, 22 nt, Human
ugggagcaggaagcaggaagua

SEQ ID NO: 737723 - RNA, 22 nt, Human
uccagccugaacuuuguccaga

SEQ ID NO: 737724 - RNA, 22 nt, Human
ccauucugagucuuaugucuuu

SEQ ID NO: 737725 - RNA, 22 nt, Human
gggaacagcauaucugaagggu

SEQ ID NO: 737726 - RNA, 22 nt, Human
uccucccuugacuccugcuuuu

SEQ ID NO: 737727 - RNA, 22 nt, Human
uauuuccauguuagaacuaagu

SEQ ID NO: 737728 - RNA, 22 nt, Human
aacugauuguuggaugauagug

SEQ ID NO: 737729 - RNA, 22 nt, Human
aaugucauuuuuaaaugugaga

SEQ ID NO: 737730 - RNA, 18 nt, Human
aagugacuggcaggccaa

SEQ ID NO: 737731 - RNA, 22 nt, Human
cuuuaguuguuauuucuucaca

SEQ ID NO: 737732 - RNA, 22 nt, Human
aacaggcucuucauuuccagag

SEQ ID NO: 737733 - RNA, 22 nt, Human
auuaggauuugguauggucaua

SEQ ID NO: 737734 - RNA, 22 nt, Human
gagcacaggcuuugguggacac

SEQ ID NO: 737735 - RNA, 22 nt, Human
augcaugaugaacuugcuuuca

SEQ ID NO: 737736 - RNA, 21 nt, Human
aagagacauuucucaucagca

SEQ ID NO: 737737 - RNA, 21 nt, Human
gggcuggacaugguggcucau

SEQ ID NO: 737738 - RNA, 23 nt, Human
uggcaaggaaugggauggagacu

SEQ ID NO: 737739 - RNA, 22 nt, Human
cuugaaagaagggucuuuuaau

SEQ ID NO: 737740 - RNA, 22 nt, Human
aggcucagccugggccuagagc

SEQ ID NO: 737741 - RNA, 22 nt, Human
ccagagcugaggagaugggcuu

SEQ ID NO: 737742 - RNA, 22 nt, Human
aaaggcuuugagaaguccugca

SEQ ID NO: 737743 - RNA, 22 nt, Human
ugggcagaguugugaugaacug

SEQ ID NO: 737744 - RNA, 22 nt, Human
aaacaugaugucauauaugcca

SEQ ID NO: 737745 - RNA, 22 nt, Human
ucuacuuucacucauacuuauu

SEQ ID NO: 737746 - RNA, 22 nt, Human
cuccuuccccuacucagcaucc

SEQ ID NO: 737747 - RNA, 22 nt, Human
acacaguaggauaguuugagga

SEQ ID NO: 737748 - RNA, 22 nt, Human
ugcuguauuacuuuuacaaacu

SEQ ID NO: 737749 - RNA, 22 nt, Human
uucacaggaauguaggggucuu

SEQ ID NO: 737750 - RNA, 22 nt, Human
ucuguuucuauaaagacaagag

SEQ ID NO: 737751 - RNA, 22 nt, Human
ucgaacucauagucguagcugu

SEQ ID NO: 737752 - RNA, 22 nt, Human
uuacaaagaguguucuuuucca

SEQ ID NO: 737753 - RNA, 22 nt, Human
uugaagacacagacauauagag

SEQ ID NO: 737754 - RNA, 22 nt, Human
cccaggaguuggaggcuacggu

SEQ ID NO: 737755 - RNA, 22 nt, Human
uuacaguuuaagaggaaacaaa

SEQ ID NO: 737756 - RNA, 22 nt, Human
ugaggcagaguaagauacauga

SEQ ID NO: 737757 - RNA, 22 nt, Human
cugugagggucacagccaugcc

SEQ ID NO: 737758 - RNA, 22 nt, Human
aguacacuaugguaacuggagu

SEQ ID NO: 737759 - RNA, 22 nt, Human
acaggcagcaaaaucagccuca

SEQ ID NO: 737760 - RNA, 22 nt, Human
cugguuggugccacaugguggc

SEQ ID NO: 737761 - RNA, 22 nt, Human
guuaguagcauuucaugacaug

SEQ ID NO: 737762 - RNA, 22 nt, Human
gggagcugucaucaguguuguc

SEQ ID NO: 737763 - RNA, 22 nt, Human
gaaaccagcuagaggcagaggg

SEQ ID NO: 737764 - RNA, 22 nt, Human
caaaacauucucugcagcaggg

SEQ ID NO: 737765 - RNA, 22 nt, Human
gaucuggaaucugaaggcugag

SEQ ID NO: 737766 - RNA, 22 nt, Human
gguggccuuuuaugagcagggu

SEQ ID NO: 737767 - RNA, 22 nt, Human
augugcaguugguggccaggag

SEQ ID NO: 737768 - RNA, 22 nt, Human
gagaggccugagaggcugcgga

SEQ ID NO: 737769 - RNA, 22 nt, Human
uaauuucaccguugcuagaaau

SEQ ID NO: 737770 - RNA, 22 nt, Human
ccaggagggaccgcggcauccc

SEQ ID NO: 737771 - RNA, 22 nt, Human
aguggcaggcggagauguagga

SEQ ID NO: 737772 - RNA, 20 nt, Human
auacaaagagauugauguau

SEQ ID NO: 737773 - RNA, 22 nt, Human
agagccaggugcugcuguuuga

SEQ ID NO: 737774 - RNA, 18 nt, Human
cuuguucuucucuuggcg

SEQ ID NO: 737775 - RNA, 22 nt, Human
ucugcugcugagcacacuccua

SEQ ID NO: 737776 - RNA, 22 nt, Human
gucugggcaagggagauggcgc

SEQ ID NO: 737777 - RNA, 22 nt, Human
ggaucaggcugaagcuaggacu

SEQ ID NO: 737778 - RNA, 22 nt, Human
ugcaucaugcggaacuggcuuu

SEQ ID NO: 737779 - RNA, 22 nt, Human
ucucuggguucucacucagcac

SEQ ID NO: 737780 - RNA, 22 nt, Human
acagagcaauucuuggguguuu

SEQ ID NO: 737781 - RNA, 22 nt, Human
ggucuccaaagcuuaggacuac

SEQ ID NO: 737782 - RNA, 22 nt, Human
cuucuaacauccuacaaugcaa

SEQ ID NO: 737783 - RNA, 22 nt, Human
cccagcuccaagggacagcgaa

SEQ ID NO: 737784 - RNA, 22 nt, Human
acuguaacgccagcuuuaaaug

SEQ ID NO: 737785 - RNA, 22 nt, Human
uucauuccuucccuaagcaacu

SEQ ID NO: 737786 - RNA, 22 nt, Human
caggagcaguuagaagcccacu

SEQ ID NO: 737787 - RNA, 22 nt, Human
ggcaugaguggcagugggcagu

SEQ ID NO: 737788 - RNA, 19 nt, Human
cuggcucuuggguggagga

SEQ ID NO: 737789 - RNA, 22 nt, Human
gaaggagcuaccaagacugaau

SEQ ID NO: 737790 - RNA, 22 nt, Human
agcaggaacucagggaguucuc

SEQ ID NO: 737791 - RNA, 22 nt, Human
cacagagcugaaccugggucau

SEQ ID NO: 737792 - RNA, 22 nt, Human
gcacaugaggcugucuuugucu

SEQ ID NO: 737793 - RNA, 22 nt, Human
gcacagagccugguaccgagaa

SEQ ID NO: 737794 - RNA, 22 nt, Human
uaaagacaugcaaagucuaauu

SEQ ID NO: 737795 - RNA, 22 nt, Human
uaacagcuggcguuauaggaau

SEQ ID NO: 737796 - RNA, 22 nt, Human
cagggccaccguguuugcugcu

SEQ ID NO: 737797 - RNA, 22 nt, Human
ccauauuugcuucuugcugaua

SEQ ID NO: 737798 - RNA, 22 nt, Human
cccagccucagcuuuacuucca

SEQ ID NO: 737799 - RNA, 22 nt, Human
gcccugcagugcggagguggca

SEQ ID NO: 737800 - RNA, 20 nt, Human
ugggcucugcuuccuggagu

SEQ ID NO: 737801 - RNA, 22 nt, Human
uccacaugaccauugugcuccu

SEQ ID NO: 737802 - RNA, 22 nt, Human
uaguuuagcuuagccuucuggu

SEQ ID NO: 737803 - RNA, 22 nt, Human
acauugcaauaauaauucucuu

SEQ ID NO: 737804 - RNA, 22 nt, Human
ccuccucugugcagcugugggu

SEQ ID NO: 737805 - RNA, 22 nt, Human
aacuuuacacugcuuuacauga

SEQ ID NO: 737806 - RNA, 22 nt, Human
uuuuccucuguaugcgugagau

SEQ ID NO: 737807 - RNA, 22 nt, Human
guugggguaccuugaggcuggg

SEQ ID NO: 737808 - RNA, 22 nt, Human
cuccuguggucaagggugggac

SEQ ID NO: 737809 - RNA, 19 nt, Human
acccagagcccuuugcagg

SEQ ID NO: 737810 - RNA, 21 nt, Human
ucauggauuuucucugcuuuu

SEQ ID NO: 737811 - RNA, 22 nt, Human
ccccucuuggcauugagugcca

SEQ ID NO: 737812 - RNA, 22 nt, Human
uuugaaaacuuaauuuggucgu

SEQ ID NO: 737813 - RNA, 22 nt, Human
gggaucagacucugggauguag

SEQ ID NO: 737814 - RNA, 22 nt, Human
gccucugggguuaauagaguuu

SEQ ID NO: 737815 - RNA, 19 nt, Human
aagcuguccuguuggcccu

SEQ ID NO: 737816 - RNA, 22 nt, Human
ucccgauaggcagggcucuggc

SEQ ID NO: 737817 - RNA, 22 nt, Human
uuggaagguucuggucaugguu

SEQ ID NO: 737818 - RNA, 22 nt, Human
acacaucuaucucuacacaagg

SEQ ID NO: 737819 - RNA, 22 nt, Human
ucuuugaaagcuguucuagagu

SEQ ID NO: 737820 - RNA, 22 nt, Human
gagccaggagauaccuaagggg

SEQ ID NO: 737821 - RNA, 22 nt, Human
agcuuucuaguuuagccaucuu

SEQ ID NO: 737822 - RNA, 22 nt, Human
cuggcucuuuccuagcuaggcu

SEQ ID NO: 737823 - RNA, 22 nt, Human
gugugagaagggaauguaaagc

SEQ ID NO: 737824 - RNA, 22 nt, Human
ugcagcaccuauggacacuugu

SEQ ID NO: 737825 - RNA, 22 nt, Human
uucuggaaccagccugccuggg

SEQ ID NO: 737826 - RNA, 22 nt, Human
ugcuggcaggcaccuccugggg

SEQ ID NO: 737827 - RNA, 22 nt, Human
ggcugcuguuucagagacuguu

SEQ ID NO: 737828 - RNA, 22 nt, Human
aacuguugcuuguaauaugugc

SEQ ID NO: 737829 - RNA, 22 nt, Human
aggaguguugcuucagggaagc

SEQ ID NO: 737830 - RNA, 22 nt, Human
uuugcaaacuuuccucuggacc

SEQ ID NO: 737831 - RNA, 22 nt, Human
aucuaaagugucauaaguagcu

SEQ ID NO: 737832 - RNA, 22 nt, Human
gggcuggaucuccugcaggcag

SEQ ID NO: 737833 - RNA, 22 nt, Human
gagagucugguagagcagcaag

SEQ ID NO: 737834 - RNA, 22 nt, Human
aaagugcuuuaggauauuugga

SEQ ID NO: 737835 - RNA, 22 nt, Human
ucucagagugguggucccucug

SEQ ID NO: 737836 - RNA, 22 nt, Human
ggcuguccuuggccaaggcacu

SEQ ID NO: 737837 - RNA, 22 nt, Human
cugaugccucucuucuuggcuu

SEQ ID NO: 737838 - RNA, 22 nt, Human
auuugccuuucgaaucaacagg

SEQ ID NO: 737839 - RNA, 22 nt, Human
gagcuuccugaugccgaccagu

SEQ ID NO: 737840 - RNA, 22 nt, Human
caaggccuaugcacaccuagga

SEQ ID NO: 737841 - RNA, 22 nt, Human
agcagcaguugcugacguucua

SEQ ID NO: 737842 - RNA, 19 nt, Human
uccuuugaauaucaguuga

SEQ ID NO: 737843 - RNA, 20 nt, Human
cccaggagugagcagcuuua

SEQ ID NO: 737844 - RNA, 22 nt, Human
uucuccaagguucauauuuauc

SEQ ID NO: 737845 - RNA, 22 nt, Human
cucaguuuccucuucuguugaa

SEQ ID NO: 737846 - RNA, 22 nt, Human
agcacaguaaagcagugucaca

SEQ ID NO: 737847 - RNA, 22 nt, Human
ccugagaguaggugucucuuua

SEQ ID NO: 737848 - RNA, 22 nt, Human
acccaggcuggagugcaguagc

SEQ ID NO: 737849 - RNA, 22 nt, Human
aguaaauuucugcauguguacu

SEQ ID NO: 737850 - RNA, 22 nt, Human
agccagacauggcuccugcucc

SEQ ID NO: 737851 - RNA, 22 nt, Human
uaaggccaaacuauuauaguuc

SEQ ID NO: 737852 - RNA, 22 nt, Human
caggagguuguaagagcaggcc

SEQ ID NO: 737853 - RNA, 22 nt, Human
gacuguggcguagaugcuggga

SEQ ID NO: 737854 - RNA, 22 nt, Human
gcccagggugcuuagaacccau

SEQ ID NO: 737855 - RNA, 23 nt, Human
agcugaggugcagauccaaagaa

SEQ ID NO: 737856 - RNA, 22 nt, Human
ugaacaacugcaaaaaucucca

SEQ ID NO: 737857 - RNA, 22 nt, Human
acaaaaauuagcugggcauggu

SEQ ID NO: 737858 - RNA, 22 nt, Human
uuuuacagucagucaaacucag

SEQ ID NO: 737859 - RNA, 22 nt, Human
gaauuguaugcaguuacuugga

SEQ ID NO: 737860 - RNA, 22 nt, Human
ggggucccugcaccagcauguc

SEQ ID NO: 737861 - RNA, 22 nt, Human
ucuguuggcuuuuuaaaguugu

SEQ ID NO: 737862 - RNA, 22 nt, Human
ucaggggacuuaggagagaagu

SEQ ID NO: 737863 - RNA, 22 nt, Human
ucucugggaauucacaagcccu

SEQ ID NO: 737864 - RNA, 22 nt, Human
auguguauuaguuaguuuaaug

SEQ ID NO: 737865 - RNA, 22 nt, Human
aaugcauaaugguuugugacaa

SEQ ID NO: 737866 - RNA, 22 nt, Human
cagcucaggcucuccaugcucc

SEQ ID NO: 737867 - RNA, 22 nt, Human
gcugggaagugcaagaucaagg

SEQ ID NO: 737868 - RNA, 22 nt, Human
uuuuucugagaauaugagagga

SEQ ID NO: 737869 - RNA, 22 nt, Human
cuugaaugggccauaagacggu

SEQ ID NO: 737870 - RNA, 22 nt, Human
ucuuacaagaaggaaaagggag

SEQ ID NO: 737871 - RNA, 22 nt, Human
acagcagggucacauucccucu

SEQ ID NO: 737872 - RNA, 22 nt, Human
cacuccuauaauuaaagaugca

SEQ ID NO: 737873 - RNA, 22 nt, Human
auauggaacuauucuguguaga

SEQ ID NO: 737874 - RNA, 22 nt, Human
gaggccucaugaggugagcauu

SEQ ID NO: 737875 - RNA, 22 nt, Human
ugauuacagucugacagauguu

SEQ ID NO: 737876 - RNA, 22 nt, Human
gggccugcuccccaucgcugcu

SEQ ID NO: 737877 - RNA, 22 nt, Human
acagcucugggugcaggaggug

SEQ ID NO: 737878 - RNA, 22 nt, Human
cugagccacugcuuguucagug

SEQ ID NO: 737879 - RNA, 22 nt, Human
auguacaugugaauuuaggcaa

SEQ ID NO: 737880 - RNA, 22 nt, Human
uuccaaagugcuggaauuacau

SEQ ID NO: 737881 - RNA, 22 nt, Human
gcagcuuuaaaggaggcucuga

SEQ ID NO: 737882 - RNA, 22 nt, Human
acucugggaugagaaaaggguu

SEQ ID NO: 737883 - RNA, 22 nt, Human
caaaggaagcuccuugauggcg

SEQ ID NO: 737884 - RNA, 22 nt, Human
ggccaauuccaggagccggcgg

SEQ ID NO: 737885 - RNA, 22 nt, Human
ucccauugccauagauaggaca

SEQ ID NO: 737886 - RNA, 22 nt, Human
aggagcucugggcagggccucc

SEQ ID NO: 737887 - RNA, 22 nt, Human
cuuuucucugcgggucuuucau

SEQ ID NO: 737888 - RNA, 22 nt, Human
gcacuagaaucccuucaagaag

SEQ ID NO: 737889 - RNA, 22 nt, Human
ggcucauguaugaaagggugug

SEQ ID NO: 737890 - RNA, 20 nt, Human
ugguccucacagguccuccc

SEQ ID NO: 737891 - RNA, 22 nt, Human
aagccaaugagagaggccucag

SEQ ID NO: 737892 - RNA, 22 nt, Human
aguuagugagcucuugggaccu

SEQ ID NO: 737893 - RNA, 22 nt, Human
caccagggccccaggcugugcc

SEQ ID NO: 737894 - RNA, 22 nt, Human
aaagugcugugauuacaggcau

SEQ ID NO: 737895 - RNA, 22 nt, Human
ugcugcagaaauucugugagga

SEQ ID NO: 737896 - RNA, 22 nt, Human
gcugggcuccacccucaacugu

SEQ ID NO: 737897 - RNA, 20 nt, Human
auaugcugagugaaggcaga

SEQ ID NO: 737898 - RNA, 22 nt, Human
guggccaggacauugccaggca

SEQ ID NO: 737899 - RNA, 22 nt, Human
agcugucuuuaagugagcuuug

SEQ ID NO: 737900 - RNA, 22 nt, Human
aacacauaggcagagcaugaca

SEQ ID NO: 737901 - RNA, 22 nt, Human
gugcugacaggagccuggcggu

SEQ ID NO: 737902 - RNA, 22 nt, Human
uugggguaaguuugucaagcug

SEQ ID NO: 737903 - RNA, 22 nt, Human
auacaaucaucauuauauuccc

SEQ ID NO: 737904 - RNA, 22 nt, Human
aggcugccgcagccaaugguug

SEQ ID NO: 737905 - RNA, 22 nt, Human
gcaggggaguggaugauggauu

SEQ ID NO: 737906 - RNA, 22 nt, Human
auacagauguuaaagcaauuuc

SEQ ID NO: 737907 - RNA, 19 nt, Human
agccagcaggccucugagc

SEQ ID NO: 737908 - RNA, 22 nt, Human
gaaguagaaagccucguaaaua

SEQ ID NO: 737909 - RNA, 23 nt, Human
agcaaaguuguugcuaaccucau

SEQ ID NO: 737910 - RNA, 16 nt, Human
uacuguggagcaaggc

SEQ ID NO: 737911 - RNA, 22 nt, Human
ucccucuguucuguuccaagug

SEQ ID NO: 737912 - RNA, 22 nt, Human
ugaguuuuuucaacauaugaag

SEQ ID NO: 737913 - RNA, 22 nt, Human
ugucaguuuaguugaagaaaga

SEQ ID NO: 737914 - RNA, 22 nt, Human
aaggggccucacagaugggcuu

SEQ ID NO: 737915 - RNA, 22 nt, Human
uauuuguuccagagauaaaaau

SEQ ID NO: 737916 - RNA, 20 nt, Human
uaguauuugcauaaggauag

SEQ ID NO: 737917 - RNA, 22 nt, Human
gugggcagugguuugcgcgguc

SEQ ID NO: 737918 - RNA, 17 nt, Human
agccagguacaagucca

SEQ ID NO: 737919 - RNA, 22 nt, Human
uucucaggguuugugcaggcuu

SEQ ID NO: 737920 - RNA, 22 nt, Human
uaaggcaauggcauucuugaca

SEQ ID NO: 737921 - RNA, 22 nt, Human
gagggcucaacuacuacuaggc

SEQ ID NO: 737922 - RNA, 22 nt, Human
uguccuuauaagaaaaggaaau

SEQ ID NO: 737923 - RNA, 22 nt, Human
uaugagaacaagaacaaucucc

SEQ ID NO: 737924 - RNA, 22 nt, Human
gugaggaagucugagagccaca

SEQ ID NO: 737925 - RNA, 22 nt, Human
uguggcaggaagagcuucugag

SEQ ID NO: 737926 - RNA, 21 nt, Human
ugagcaggugcagggaagugg

SEQ ID NO: 737927 - RNA, 22 nt, Human
ugcugaggaaaaaugugacucu

SEQ ID NO: 737928 - RNA, 22 nt, Human
uuagaaaacauaagugguaaag

SEQ ID NO: 737929 - RNA, 22 nt, Human
augaagcagcguuguagaguga

SEQ ID NO: 737930 - RNA, 20 nt, Human
agcaggugacggggccugcu

SEQ ID NO: 737931 - RNA, 22 nt, Human
guuggccugaauggucaagagg

SEQ ID NO: 737932 - RNA, 22 nt, Human
gcuguagguaaggauggcaaag

SEQ ID NO: 737933 - RNA, 22 nt, Human
cuaggccacagggcaaaaagga

SEQ ID NO: 737934 - RNA, 19 nt, Human
gcccugaccuuggcugcuc

SEQ ID NO: 737935 - RNA, 22 nt, Human
cuagcagcaucacaggaagacu

SEQ ID NO: 737936 - RNA, 22 nt, Human
aagccaaucgugugaacuuagu

SEQ ID NO: 737937 - RNA, 22 nt, Human
cucugggcuuccuuuguggguu

SEQ ID NO: 737938 - RNA, 22 nt, Human
ccagagcuaaacacacaggcug

SEQ ID NO: 737939 - RNA, 22 nt, Human
cagcagcagccccaggaagguu

SEQ ID NO: 737940 - RNA, 22 nt, Human
uggcccuuuugugaaguggcca

SEQ ID NO: 737941 - RNA, 22 nt, Human
agcagcccgaggaucauguguc

SEQ ID NO: 737942 - RNA, 20 nt, Human
aggcucugcauuucugagug

SEQ ID NO: 737943 - RNA, 20 nt, Human
agcauuugaaauaugacuau

SEQ ID NO: 737944 - RNA, 22 nt, Human
auacauauccacaggagauaaa

SEQ ID NO: 737945 - RNA, 22 nt, Human
gugaacuaaggauucaaacuuc

SEQ ID NO: 737946 - RNA, 22 nt, Human
agauacauauagaaaacaucaa

SEQ ID NO: 737947 - RNA, 17 nt, Human
uuccuccucaccauguu

SEQ ID NO: 737948 - RNA, 22 nt, Human
ggaggugggagccuccaguggu

SEQ ID NO: 737949 - RNA, 22 nt, Human
ccaguguucaauacauauuugu

SEQ ID NO: 737950 - RNA, 22 nt, Human
gugguccuuuagaggauguaau

SEQ ID NO: 737951 - RNA, 22 nt, Human
gcuuacaagaucgugcuccagu

SEQ ID NO: 737952 - RNA, 22 nt, Human
caacauauuuuccaagagugaa

SEQ ID NO: 737953 - RNA, 22 nt, Human
gaggcagcauucgcauagacag

SEQ ID NO: 737954 - RNA, 22 nt, Human
ugcagcugcugguggcugaaag

SEQ ID NO: 737955 - RNA, 22 nt, Human
cacuuuuaacaggagaauuccc

SEQ ID NO: 737956 - RNA, 18 nt, Human
uccuguggcccagaguuu

SEQ ID NO: 737957 - RNA, 22 nt, Human
acaaacagaguugaaaaauagg

SEQ ID NO: 737958 - RNA, 23 nt, Human
gcacagagcaguuaggggaagau

SEQ ID NO: 737959 - RNA, 22 nt, Human
augaaauugaucuugaacuuuu

SEQ ID NO: 737960 - RNA, 22 nt, Human
uuacagaucaucaagguauaau

SEQ ID NO: 737961 - RNA, 22 nt, Human
acuaaauggaaugauuacuaua

SEQ ID NO: 737962 - RNA, 22 nt, Human
acagggcagguggcuacugguc

SEQ ID NO: 737963 - RNA, 22 nt, Human
accugcccacauauauauguau

SEQ ID NO: 737964 - RNA, 18 nt, Human
ccugcagcccaggaggcc

SEQ ID NO: 737965 - RNA, 22 nt, Human
aggagcacugagccagcauggg

SEQ ID NO: 737966 - RNA, 22 nt, Human
gaggaggcuaucagcaaucagg

SEQ ID NO: 737967 - RNA, 22 nt, Human
ggccaggugcgguggcucacac

SEQ ID NO: 737968 - RNA, 22 nt, Human
gggcugcuugcuggagacagac

SEQ ID NO: 737969 - RNA, 22 nt, Human
accugcccacacuuccuuccca

SEQ ID NO: 737970 - RNA, 22 nt, Human
guuuccuggaaacauuaggaga

SEQ ID NO: 737971 - RNA, 22 nt, Human
aaugguuuucuagaacaugaaa

SEQ ID NO: 737972 - RNA, 22 nt, Human
ggagcaggcagggccgugucug

SEQ ID NO: 737973 - RNA, 22 nt, Human
cuggaagguggauggcgaggcc

SEQ ID NO: 737974 - RNA, 22 nt, Human
gucuucuguaagaugagguccc

SEQ ID NO: 737975 - RNA, 22 nt, Human
ucaguugcuagaagggggaacc

SEQ ID NO: 737976 - RNA, 22 nt, Human
aggauaauaauaaucucguuua

SEQ ID NO: 737977 - RNA, 22 nt, Human
agagaguucuuucuaguugaag

SEQ ID NO: 737978 - RNA, 19 nt, Human
ucugaauuauuuauguacc

SEQ ID NO: 737979 - RNA, 22 nt, Human
ucagaggagggacucagaccca

SEQ ID NO: 737980 - RNA, 22 nt, Human
acaaccaugucaguucaaacca

SEQ ID NO: 737981 - RNA, 22 nt, Human
gggcaggucugggucagccuga

SEQ ID NO: 737982 - RNA, 22 nt, Human
auucugcuccacacugauucau

SEQ ID NO: 737983 - RNA, 22 nt, Human
agaucuggaaaaucacaggugc

SEQ ID NO: 737984 - RNA, 22 nt, Human
gaugacagcagcuguggcucac

SEQ ID NO: 737985 - RNA, 22 nt, Human
gugcauuaguuuccuauugcug

SEQ ID NO: 737986 - RNA, 22 nt, Human
cuguuauuccccuugcuguggu

SEQ ID NO: 737987 - RNA, 22 nt, Human
auuauucaaucauauuaaaagu

SEQ ID NO: 737988 - RNA, 22 nt, Human
ccagcagagcauggggaggaag

SEQ ID NO: 737989 - RNA, 21 nt, Human
uucaggacaggaaaaacaggg

SEQ ID NO: 737990 - RNA, 21 nt, Human
uucuucaaagaagaaggcaca

SEQ ID NO: 737991 - RNA, 21 nt, Human
ggcagcugugguuaauugaac

SEQ ID NO: 737992 - RNA, 20 nt, Human
caggacagcgcaaucggagg

SEQ ID NO: 737993 - RNA, 22 nt, Human
aauuugcaugaugagaacaaua

SEQ ID NO: 737994 - RNA, 23 nt, Human
acacagaagaagacccaaggaag

SEQ ID NO: 737995 - RNA, 22 nt, Human
uuguuucauggggauguuuauu

SEQ ID NO: 737996 - RNA, 22 nt, Human
cccaggcaucccauuaaggagc

SEQ ID NO: 737997 - RNA, 22 nt, Human
aaauuuuagacuccugggucua

SEQ ID NO: 737998 - RNA, 20 nt, Human
agagaugggguaucaccgua

SEQ ID NO: 737999 - RNA, 22 nt, Human
ugcaaaaagagcgaggagcccu

SEQ ID NO: 738000 - RNA, 22 nt, Human
ugcugucuuuuucccuuccuaa

SEQ ID NO: 738001 - RNA, 22 nt, Human
uuguuuaaaauguagcaagaaa

SEQ ID NO: 738002 - RNA, 19 nt, Human
ucuucccuggcugucaguc

SEQ ID NO: 738003 - RNA, 22 nt, Human
auacagauugcuauacuuacaa

SEQ ID NO: 738004 - RNA, 22 nt, Human
gagguuagaggucagugcaguc

SEQ ID NO: 738005 - RNA, 22 nt, Human
uggaaugcagugggagcuuacc

SEQ ID NO: 738006 - RNA, 22 nt, Human
gaaagccauagcccagcuuuac

SEQ ID NO: 738007 - RNA, 22 nt, Human
ggagaggcuuggcccagccugg

SEQ ID NO: 738008 - RNA, 22 nt, Human
caacuucaccaggguuccuaga

SEQ ID NO: 738009 - RNA, 22 nt, Human
uugcacuagucucagaggcaaa

SEQ ID NO: 738010 - RNA, 20 nt, Human
acuugcugggcuuuguuacc

SEQ ID NO: 738011 - RNA, 22 nt, Human
agaaggcugagacugggaugaa

SEQ ID NO: 738012 - RNA, 22 nt, Human
uggaguccgcuccaaguucucu

SEQ ID NO: 738013 - RNA, 22 nt, Human
acuguauuuccaacagacaaau

SEQ ID NO: 738014 - RNA, 22 nt, Human
aggagcucccgugaggagacca

SEQ ID NO: 738015 - RNA, 20 nt, Human
agacccuguguccuguggcc

SEQ ID NO: 738016 - RNA, 22 nt, Human
uauuccaacuucacuauugucu

SEQ ID NO: 738017 - RNA, 22 nt, Human
ggacacuguauaaguuagagua

SEQ ID NO: 738018 - RNA, 22 nt, Human
caggauguugcucccauguccc

SEQ ID NO: 738019 - RNA, 22 nt, Human
ggugcggagacuccaugaggcc

SEQ ID NO: 738020 - RNA, 20 nt, Human
ggacuacaauuugcagugug

SEQ ID NO: 738021 - RNA, 21 nt, Human
cucaggcuggcagcaggcuag

SEQ ID NO: 738022 - RNA, 20 nt, Human
gccuguccugagugucaugg

SEQ ID NO: 738023 - RNA, 22 nt, Human
cagcccagguggcggagguugc

SEQ ID NO: 738024 - RNA, 22 nt, Human
gaggagggagcuggaagcucuu

SEQ ID NO: 738025 - RNA, 22 nt, Human
cacagaaauauugugucccuug

SEQ ID NO: 738026 - RNA, 22 nt, Human
guuauuguuuauccugcacccc

SEQ ID NO: 738027 - RNA, 22 nt, Human
uaucauuuagaguauuucuuca

SEQ ID NO: 738028 - RNA, 22 nt, Human
cugacaaacuuaauuuucugaa

SEQ ID NO: 738029 - RNA, 22 nt, Human
ccaggcucugagaggaauguga

SEQ ID NO: 738030 - RNA, 22 nt, Human
aggcagaucacuugaggccagg

SEQ ID NO: 738031 - RNA, 22 nt, Human
acugaaggcuuucccaagguca

SEQ ID NO: 738032 - RNA, 22 nt, Human
uauucaaagugcgaggucaggg

SEQ ID NO: 738033 - RNA, 22 nt, Human
caguaacaugucuguuaagaaa

SEQ ID NO: 738034 - RNA, 22 nt, Human
gccucaguggcuuuaggaguuc

SEQ ID NO: 738035 - RNA, 22 nt, Human
uuuuuucagccugucugugcca

SEQ ID NO: 738036 - RNA, 22 nt, Human
aauguugaggauaucagaaaau

SEQ ID NO: 738037 - RNA, 22 nt, Human
ugcccagcugucaaaguagaua

SEQ ID NO: 738038 - RNA, 18 nt, Human
ggagggcuuuggggacug

SEQ ID NO: 738039 - RNA, 22 nt, Human
uggaaucccgcaauggaggauu

SEQ ID NO: 738040 - RNA, 22 nt, Human
ugucugucagauauuaaguuuc

SEQ ID NO: 738041 - RNA, 22 nt, Human
cauggccagcccugagguucag

SEQ ID NO: 738042 - RNA, 23 nt, Human
aggugcccagggcagguuuacug

SEQ ID NO: 738043 - RNA, 22 nt, Human
uuugaaaagaaccaucgccuua

SEQ ID NO: 738044 - RNA, 22 nt, Human
uacuuauuguugaacugaauca

SEQ ID NO: 738045 - RNA, 22 nt, Human
auuuagucaucacucauguguu

SEQ ID NO: 738046 - RNA, 19 nt, Human
uccaauuuguauguuuuca

SEQ ID NO: 738047 - RNA, 22 nt, Human
aaauguguuccuuugcuacaga

SEQ ID NO: 738048 - RNA, 22 nt, Human
agggcuguuuuuggcaccuggg

SEQ ID NO: 738049 - RNA, 22 nt, Human
gagcuuggcuggaccucacgga

SEQ ID NO: 738050 - RNA, 19 nt, Human
acagcagguguggggauaa

SEQ ID NO: 738051 - RNA, 22 nt, Human
uaacagaaauaguaggugaggg

SEQ ID NO: 738052 - RNA, 22 nt, Human
ucuggguaaucagggcugggag

SEQ ID NO: 738053 - RNA, 22 nt, Human
aaggaaaggaugagcaugcauu

SEQ ID NO: 738054 - RNA, 22 nt, Human
uccaauaaccacaaucagauag

SEQ ID NO: 738055 - RNA, 22 nt, Human
cacuuacacuucugaaagccua

SEQ ID NO: 738056 - RNA, 18 nt, Human
agucuucugauccauuuu

SEQ ID NO: 738057 - RNA, 22 nt, Human
aggaaacuuucuuuugcuucau

SEQ ID NO: 738058 - RNA, 22 nt, Human
gcccaaagccagugugcucucc

SEQ ID NO: 738059 - RNA, 22 nt, Human
agauuuaaagcaguauucgcaa

SEQ ID NO: 738060 - RNA, 22 nt, Human
gcugccuguccugaggaguccg

SEQ ID NO: 738061 - RNA, 23 nt, Human
augcaaagugcugucauguagac

SEQ ID NO: 738062 - RNA, 22 nt, Human
ucugucuuuagaggccugugcu

SEQ ID NO: 738063 - RNA, 20 nt, Human
auugaaauuuuucugagauu

SEQ ID NO: 738064 - RNA, 22 nt, Human
cuccagagucacacugccuggg

SEQ ID NO: 738065 - RNA, 19 nt, Human
caucucugcaaggagcugc

SEQ ID NO: 738066 - RNA, 22 nt, Human
gagagagacauguaaacgcggu

SEQ ID NO: 738067 - RNA, 22 nt, Human
cugggaaguggugagggccuga

SEQ ID NO: 738068 - RNA, 23 nt, Human
agucacaucuuagcagccagguc

SEQ ID NO: 738069 - RNA, 22 nt, Human
aacaccuaaaaaucauuguuga

SEQ ID NO: 738070 - RNA, 22 nt, Human
cccacagaaugccaaugagacc

SEQ ID NO: 738071 - RNA, 22 nt, Human
gauuucuaguaagucaugaagg

SEQ ID NO: 738072 - RNA, 22 nt, Human
cauuuccugucuggaggucaaa

SEQ ID NO: 738073 - RNA, 22 nt, Human
gaaaugcagaaccugagaccau

SEQ ID NO: 738074 - RNA, 22 nt, Human
ucccagggcacucacccucccu

SEQ ID NO: 738075 - RNA, 22 nt, Human
cagagcugggcauggugaaagg

SEQ ID NO: 738076 - RNA, 22 nt, Human
ggcugcuggcagauguaguuua

SEQ ID NO: 738077 - RNA, 22 nt, Human
ugucuuuucuacuguaagcaua

SEQ ID NO: 738078 - RNA, 22 nt, Human
uuuggaaaguugucacuuuaga

SEQ ID NO: 738079 - RNA, 22 nt, Human
ucacaagacagaaaacauuuag

SEQ ID NO: 738080 - RNA, 22 nt, Human
cacacuaauuuuucaagaguuu

SEQ ID NO: 738081 - RNA, 22 nt, Human
aauacaagauuuauaguuguuu

SEQ ID NO: 738082 - RNA, 22 nt, Human
ggcagaugacagaccaguaugu

SEQ ID NO: 738083 - RNA, 22 nt, Human
ugacacaaacaagauauuugcc

SEQ ID NO: 738084 - RNA, 22 nt, Human
uggcuggcuagugggcaggauu

SEQ ID NO: 738085 - RNA, 22 nt, Human
ggccugagaaccauggggccaa

SEQ ID NO: 738086 - RNA, 22 nt, Human
gguucacucucaagucugccua

SEQ ID NO: 738087 - RNA, 22 nt, Human
aagcuggaacaucuugaggaag

SEQ ID NO: 738088 - RNA, 22 nt, Human
uuuugucagugagaacagaguu

SEQ ID NO: 738089 - RNA, 22 nt, Human
acauuaacacuggugcuggugu

SEQ ID NO: 738090 - RNA, 22 nt, Human
ccaggcccaggguacugaccaa

SEQ ID NO: 738091 - RNA, 22 nt, Human
uguggaaagucaaguuccagga

SEQ ID NO: 738092 - RNA, 22 nt, Human
caaaugaugcauggcuagugag

SEQ ID NO: 738093 - RNA, 22 nt, Human
ucugucuuagcaucuuugcuca

SEQ ID NO: 738094 - RNA, 22 nt, Human
ccugacgaaaggcgugcuggag

SEQ ID NO: 738095 - RNA, 22 nt, Human
aggaaacuccccuacaucucaa

SEQ ID NO: 738096 - RNA, 22 nt, Human
agugggagccagcagcuugggg

SEQ ID NO: 738097 - RNA, 22 nt, Human
uaacauguuuguacacugaaac

SEQ ID NO: 738098 - RNA, 22 nt, Human
gccagcugaaauuucaguucug

SEQ ID NO: 738099 - RNA, 22 nt, Human
uggcuuccuguguaaugaggug

SEQ ID NO: 738100 - RNA, 22 nt, Human
uuucuagacucaaagaggauau

SEQ ID NO: 738101 - RNA, 22 nt, Human
ggccacuccgcugcuacuggaa

SEQ ID NO: 738102 - RNA, 22 nt, Human
ccugugugcacacgaggccaug

SEQ ID NO: 738103 - RNA, 23 nt, Human
auccccugccuugggugaguccc

SEQ ID NO: 738104 - RNA, 22 nt, Human
ucugcuguacuuuuggucuguu

SEQ ID NO: 738105 - RNA, 22 nt, Human
ugauacagucagcucacaauug

SEQ ID NO: 738106 - RNA, 22 nt, Human
gccagcugcuggaacagcgcga

SEQ ID NO: 738107 - RNA, 22 nt, Human
ugaaaucaauaauuggugauug

SEQ ID NO: 738108 - RNA, 22 nt, Human
cagcccaggacugcagguguuu

SEQ ID NO: 738109 - RNA, 22 nt, Human
aaggccacagagccucagagag

SEQ ID NO: 738110 - RNA, 22 nt, Human
ccugaggcccuggcugugcuga

SEQ ID NO: 738111 - RNA, 22 nt, Human
aaggcaaggccaagccaucagu

SEQ ID NO: 738112 - RNA, 20 nt, Human
accuuucaaaugauucagca

SEQ ID NO: 738113 - RNA, 18 nt, Human
gggaagaggaucuggccc

SEQ ID NO: 738114 - RNA, 22 nt, Human
caggaagccuuccuugucugcu

SEQ ID NO: 738115 - RNA, 22 nt, Human
ccccucagguacccgugcagca

SEQ ID NO: 738116 - RNA, 22 nt, Human
gccaggcuggccagcaccuucu

SEQ ID NO: 738117 - RNA, 22 nt, Human
uggcaaagaugguucucaccau

SEQ ID NO: 738118 - RNA, 22 nt, Human
gugccuuugagaaguuucucug

SEQ ID NO: 738119 - RNA, 22 nt, Human
agucaguggcuccgagccuggu

SEQ ID NO: 738120 - RNA, 22 nt, Human
ugcauuaucgucuugauccucu

SEQ ID NO: 738121 - RNA, 22 nt, Human
ugccucugugggccuuccuggc

SEQ ID NO: 738122 - RNA, 22 nt, Human
agccucugacugucagcaaggu

SEQ ID NO: 738123 - RNA, 22 nt, Human
aaauagaauuaacuagcuacug

SEQ ID NO: 738124 - RNA, 22 nt, Human
acuguaaaacugcuuuggaaac

SEQ ID NO: 738125 - RNA, 20 nt, Human
aggagaaauucgggacaccu

SEQ ID NO: 738126 - RNA, 22 nt, Human
gaggcaugcagagcuggagcag

SEQ ID NO: 738127 - RNA, 22 nt, Human
ugucuuauguagauacugagaa

SEQ ID NO: 738128 - RNA, 22 nt, Human
cauuugaaaauacucuuuucca

SEQ ID NO: 738129 - RNA, 17 nt, Human
uucugcaugugaagaug

SEQ ID NO: 738130 - RNA, 22 nt, Human
caguaucuugcuuauagacaca

SEQ ID NO: 738131 - RNA, 22 nt, Human
auaguuaugcucuagacaagaa

SEQ ID NO: 738132 - RNA, 22 nt, Human
gucccuggaucugggacagcug

SEQ ID NO: 738133 - RNA, 22 nt, Human
agugaccaacaaugcugagaag

SEQ ID NO: 738134 - RNA, 20 nt, Human
cacccucccagcaccuaugc

SEQ ID NO: 738135 - RNA, 22 nt, Human
uauuacacuuucuucuucaagc

SEQ ID NO: 738136 - RNA, 22 nt, Human
cagaagcauugacuccuugcuc

SEQ ID NO: 738137 - RNA, 22 nt, Human
ccucugccuuuagugaaaguug

SEQ ID NO: 738138 - RNA, 22 nt, Human
uuuggaaaauauugaacugguu

SEQ ID NO: 738139 - RNA, 22 nt, Human
ggcuucaccgcgggguugcagg

SEQ ID NO: 738140 - RNA, 22 nt, Human
uucugcauugacuuuuauuucc

SEQ ID NO: 738141 - RNA, 22 nt, Human
gugaggggucuggacgcacagu

SEQ ID NO: 738142 - RNA, 22 nt, Human
ccuuagcauuagaagcuguggg

SEQ ID NO: 738143 - RNA, 22 nt, Human
gcuuccagagagccccgccugg

SEQ ID NO: 738144 - RNA, 22 nt, Human
cccuggagaaggggacgcggag

SEQ ID NO: 738145 - RNA, 22 nt, Human
ugaggcuguucuaccagggcca

SEQ ID NO: 738146 - RNA, 22 nt, Human
cugggccugggaggccaggucu

SEQ ID NO: 738147 - RNA, 18 nt, Human
uggaucuuuaugaggcug

SEQ ID NO: 738148 - RNA, 22 nt, Human
gaggcugggggcugccuuccuc

SEQ ID NO: 738149 - RNA, 22 nt, Human
ucuccugccacugcuucccauu

SEQ ID NO: 738150 - RNA, 19 nt, Human
acccagcccaggaguggca

SEQ ID NO: 738151 - RNA, 22 nt, Human
cagcuuuauuaaugauugucuu

SEQ ID NO: 738152 - RNA, 22 nt, Human
ccugcuggacguggaggagggg

SEQ ID NO: 738153 - RNA, 22 nt, Human
uuucucccuccacuacaggcuc

SEQ ID NO: 738154 - RNA, 22 nt, Human
aaaaugcugggaaaguuggaau

SEQ ID NO: 738155 - RNA, 22 nt, Human
ugcucugggcucaauggcagcu

SEQ ID NO: 738156 - RNA, 22 nt, Human
gcucuggagagccauaggcccu

SEQ ID NO: 738157 - RNA, 22 nt, Human
ugugggagaaggaagcaagcug

SEQ ID NO: 738158 - RNA, 22 nt, Human
uccaucaggcucgugggcucuc

SEQ ID NO: 738159 - RNA, 22 nt, Human
gagauggggucagcugggacau

SEQ ID NO: 738160 - RNA, 22 nt, Human
aggcuucuuuuagaggggaugg

SEQ ID NO: 738161 - RNA, 22 nt, Human
uuccacagauguaugaaguggu

SEQ ID NO: 738162 - RNA, 22 nt, Human
agggaguuccgaucugugcacc

SEQ ID NO: 738163 - RNA, 21 nt, Human
uguguaaaguugaaauccugu

SEQ ID NO: 738164 - RNA, 22 nt, Human
gcagaggagcaaguugcuacag

SEQ ID NO: 738165 - RNA, 22 nt, Human
ggcacacauagaucugcacugg

SEQ ID NO: 738166 - RNA, 22 nt, Human
uagacaggagucaggcuagaau

SEQ ID NO: 738167 - RNA, 22 nt, Human
gccuugccaaggggcagcagag

SEQ ID NO: 738168 - RNA, 17 nt, Human
ugacuuaacagcaaggc

SEQ ID NO: 738169 - RNA, 22 nt, Human
uucuacaugagaaaauguauuu

SEQ ID NO: 738170 - RNA, 22 nt, Human
ccucaggccucugccucauugg

SEQ ID NO: 738171 - RNA, 22 nt, Human
uuucuacacuucgugguguuuu

SEQ ID NO: 738172 - RNA, 20 nt, Human
aggcugccaggucucacauc

SEQ ID NO: 738173 - RNA, 22 nt, Human
uccagcuggggcaguggcuggg

SEQ ID NO: 738174 - RNA, 22 nt, Human
ccuggcagcccagagcgccgcu

SEQ ID NO: 738175 - RNA, 20 nt, Human
agcaaggcuaaaucaugauu

SEQ ID NO: 738176 - RNA, 22 nt, Human
uuuaacuccuaguguguauuag

SEQ ID NO: 738177 - RNA, 22 nt, Human
agucauuuugccagucuucagg

SEQ ID NO: 738178 - RNA, 22 nt, Human
gauugcuuauacacaagaugaa

SEQ ID NO: 738179 - RNA, 20 nt, Human
aaagugcacagauacagcuc

SEQ ID NO: 738180 - RNA, 22 nt, Human
agagcuggaaucagaccucagg

SEQ ID NO: 738181 - RNA, 22 nt, Human
gcauacagagaggauguggcau

SEQ ID NO: 738182 - RNA, 22 nt, Human
uauuuggaggccacuguugagu

SEQ ID NO: 738183 - RNA, 22 nt, Human
acccuguuaugguguaacauuu

SEQ ID NO: 738184 - RNA, 22 nt, Human
caaggcugcaaaacuacauggg

SEQ ID NO: 738185 - RNA, 22 nt, Human
acaguuacauuaaacaaaagga

SEQ ID NO: 738186 - RNA, 22 nt, Human
ucaaggaaugacuauaugagga

SEQ ID NO: 738187 - RNA, 22 nt, Human
aggcuucaguagggagcauguc

SEQ ID NO: 738188 - RNA, 22 nt, Human
ucagcagucacauguuguccca

SEQ ID NO: 738189 - RNA, 22 nt, Human
ccagcugcugugcagggaggcu

SEQ ID NO: 738190 - RNA, 22 nt, Human
acaaagucuuuuacaacaguca

SEQ ID NO: 738191 - RNA, 22 nt, Human
aggugacaugaaaaauguugag

SEQ ID NO: 738192 - RNA, 22 nt, Human
acaaggcugugggagaaccucu

SEQ ID NO: 738193 - RNA, 20 nt, Human
guauuaggagguaaauguaa

SEQ ID NO: 738194 - RNA, 22 nt, Human
auggcuuccaaggcccuccgug

SEQ ID NO: 738195 - RNA, 19 nt, Human
cccuggcaggcaagccugg

SEQ ID NO: 738196 - RNA, 22 nt, Human
ugaauuaucuuguaauuuugaa

SEQ ID NO: 738197 - RNA, 22 nt, Human
uucaaguacuguagauuucagg

SEQ ID NO: 738198 - RNA, 22 nt, Human
aaacaguuucauuuucaugacc

SEQ ID NO: 738199 - RNA, 22 nt, Human
uguccagaucaaugcccacaug

SEQ ID NO: 738200 - RNA, 22 nt, Human
auugcuuuuaagcaccaccuaa

SEQ ID NO: 738201 - RNA, 22 nt, Human
acaggcuucucacagaaaaggg

SEQ ID NO: 738202 - RNA, 22 nt, Human
gcaguguuuacauauuagaaac

SEQ ID NO: 738203 - RNA, 22 nt, Human
aauaaagaauggaugagaucgu

SEQ ID NO: 738204 - RNA, 22 nt, Human
cuucugugcaauuguggaggag

SEQ ID NO: 738205 - RNA, 22 nt, Human
uguuaucugagcaacgucgacg

SEQ ID NO: 738206 - RNA, 22 nt, Human
ucuuccuggcauugaugcugca

SEQ ID NO: 738207 - RNA, 22 nt, Human
gcuuggcugugagcuuugcugu

SEQ ID NO: 738208 - RNA, 22 nt, Human
uugaaacagacaaguaaauguc

SEQ ID NO: 738209 - RNA, 22 nt, Human
uuagcacuggauuucaucagaa

SEQ ID NO: 738210 - RNA, 20 nt, Human
uccuggccuucucgggcagu

SEQ ID NO: 738211 - RNA, 22 nt, Human
caugcauuuggaguuuucaagu

SEQ ID NO: 738212 - RNA, 22 nt, Human
acagagccaaaaggacauagua

SEQ ID NO: 738213 - RNA, 22 nt, Human
uaaagauggagaugaccuagga

SEQ ID NO: 738214 - RNA, 22 nt, Human
gugaggucauauagcgaacucc

SEQ ID NO: 738215 - RNA, 22 nt, Human
agcagugaaacagcugcauaug

SEQ ID NO: 738216 - RNA, 22 nt, Human
gucagaaaacuucccuuugagu

SEQ ID NO: 738217 - RNA, 22 nt, Human
uacaaugcauucauuuuugagg

SEQ ID NO: 738218 - RNA, 22 nt, Human
uagauuucucauucauagauug

SEQ ID NO: 738219 - RNA, 22 nt, Human
gucuaaagcccuuagaauagua

SEQ ID NO: 738220 - RNA, 23 nt, Human
aucuguguguggguagggaugau

SEQ ID NO: 738221 - RNA, 22 nt, Human
cucucuguauguguauauuuau

SEQ ID NO: 738222 - RNA, 22 nt, Human
aucagagaaauggagggcgcuu

SEQ ID NO: 738223 - RNA, 22 nt, Human
guguggccucaacgggaugcaa

SEQ ID NO: 738224 - RNA, 22 nt, Human
cucucaaaguaagguguauaca

SEQ ID NO: 738225 - RNA, 18 nt, Human
cucugggagaggcauaca

SEQ ID NO: 738226 - RNA, 22 nt, Human
uucacauuaagccuccuccuac

SEQ ID NO: 738227 - RNA, 22 nt, Human
gcucccuuaggccuugccggga

SEQ ID NO: 738228 - RNA, 22 nt, Human
cauuucugauuacagaauacua

SEQ ID NO: 738229 - RNA, 22 nt, Human
gaaggccacaagagaaguuaag

SEQ ID NO: 738230 - RNA, 22 nt, Human
auaggucugaaaguguauccug

SEQ ID NO: 738231 - RNA, 21 nt, Human
ucccacucuaaauggacugaa

SEQ ID NO: 738232 - RNA, 22 nt, Human
agcaaucaccaccucuauauuu

SEQ ID NO: 738233 - RNA, 22 nt, Human
cauccugacuggguaaagcuua

SEQ ID NO: 738234 - RNA, 22 nt, Human
acagcagcugccuucaggcucu

SEQ ID NO: 738235 - RNA, 22 nt, Human
uauuugaaaguguacaaaaacu

SEQ ID NO: 738236 - RNA, 22 nt, Human
uugaaugaccaugaugcaaggg

SEQ ID NO: 738237 - RNA, 22 nt, Human
ucuggaauaacccugcuuccaa

SEQ ID NO: 738238 - RNA, 22 nt, Human
gcaguccucucauuggccuccu

SEQ ID NO: 738239 - RNA, 22 nt, Human
gagcaauggaagauagauaaca

SEQ ID NO: 738240 - RNA, 22 nt, Human
uugauguaaagugauucauggg

SEQ ID NO: 738241 - RNA, 22 nt, Human
gaauuauaggcaaagcagucau

SEQ ID NO: 738242 - RNA, 22 nt, Human
ugcccacaccugggggaggcug

SEQ ID NO: 738243 - RNA, 22 nt, Human
ucugaacauccagcaaugcaca

SEQ ID NO: 738244 - RNA, 22 nt, Human
uucucuugugccaaguuguugc

SEQ ID NO: 738245 - RNA, 22 nt, Human
uugaaugaagucccuuuuuacu

SEQ ID NO: 738246 - RNA, 21 nt, Human
cucuugugucagagccagagg

SEQ ID NO: 738247 - RNA, 22 nt, Human
aacagcauaccaauguacauau

SEQ ID NO: 738248 - RNA, 22 nt, Human
auacagcuuacaguucuaaugc

SEQ ID NO: 738249 - RNA, 22 nt, Human
augaauuguaaauuccuugaaa

SEQ ID NO: 738250 - RNA, 22 nt, Human
uuuaauuguuguggguacauag

SEQ ID NO: 738251 - RNA, 20 nt, Human
ucaaggaaugucauuuuguu

SEQ ID NO: 738252 - RNA, 22 nt, Human
uuaccugcaacucccaugguga

SEQ ID NO: 738253 - RNA, 17 nt, Human
acacagggagagggagc

SEQ ID NO: 738254 - RNA, 22 nt, Human
gaggaggucuccuccgcagggg

SEQ ID NO: 738255 - RNA, 22 nt, Human
ugagagugaaaugucacauguc

SEQ ID NO: 738256 - RNA, 22 nt, Human
uggcucuuaaggucccugugcu

SEQ ID NO: 738257 - RNA, 22 nt, Human
agggaggucuuugaggggcuua

SEQ ID NO: 738258 - RNA, 23 nt, Human
agagggugcaacauggggaucua

SEQ ID NO: 738259 - RNA, 22 nt, Human
aggcccuggguuagggcccacu

SEQ ID NO: 738260 - RNA, 22 nt, Human
ugggccacagagugagaaaugu

SEQ ID NO: 738261 - RNA, 22 nt, Human
uucuugcucaaugucuguuuaa

SEQ ID NO: 738262 - RNA, 22 nt, Human
uuaauaaaguaugaauuggaaa

SEQ ID NO: 738263 - RNA, 21 nt, Human
gcuuugaugcugccuugcucc

SEQ ID NO: 738264 - RNA, 22 nt, Human
ugcacuuugcaggcauggaaac

SEQ ID NO: 738265 - RNA, 22 nt, Human
accaugaugcauccuuaaggaa

SEQ ID NO: 738266 - RNA, 23 nt, Human
cccagcugagacuuccugaacuc

SEQ ID NO: 738267 - RNA, 22 nt, Human
uuugacaauucaugacauuuau

SEQ ID NO: 738268 - RNA, 22 nt, Human
cuuucccugcuuagaaggauuu

SEQ ID NO: 738269 - RNA, 22 nt, Human
gacuggcuuauuucacuuagca

SEQ ID NO: 738270 - RNA, 21 nt, Human
gcuaugaauguagaaaauuau

SEQ ID NO: 738271 - RNA, 22 nt, Human
uacaguuuguauggucaggaau

SEQ ID NO: 738272 - RNA, 22 nt, Human
cagcugucugcugaaggaagcu

SEQ ID NO: 738273 - RNA, 21 nt, Human
ggcugggucaugcagcuggcc

SEQ ID NO: 738274 - RNA, 22 nt, Human
cuguggagcuuguggcaguggg

SEQ ID NO: 738275 - RNA, 22 nt, Human
cagagauuuuuaugcacaccaa

SEQ ID NO: 738276 - RNA, 23 nt, Human
cuugccuggccucucugcccaga

SEQ ID NO: 738277 - RNA, 22 nt, Human
aggcuucugugagcucauacaa

SEQ ID NO: 738278 - RNA, 22 nt, Human
augcuccagugugaugcuucau

SEQ ID NO: 738279 - RNA, 22 nt, Human
uuauggagcagacagcugguca

SEQ ID NO: 738280 - RNA, 22 nt, Human
cacagcuggaaugggguaccug

SEQ ID NO: 738281 - RNA, 22 nt, Human
gugcuuuccauccucccugcug

SEQ ID NO: 738282 - RNA, 22 nt, Human
acagcaagaccccuagcauggu

SEQ ID NO: 738283 - RNA, 22 nt, Human
ucaguguagcagacuuguagcc

SEQ ID NO: 738284 - RNA, 22 nt, Human
acaacuguuagacacuucuaag

SEQ ID NO: 738285 - RNA, 22 nt, Human
auggcagggcagccucucagag

SEQ ID NO: 738286 - RNA, 22 nt, Human
cucuggcucuguugagauuugu

SEQ ID NO: 738287 - RNA, 22 nt, Human
auggaucuucccucauuucuga

SEQ ID NO: 738288 - RNA, 22 nt, Human
uguguacacaaguauauauaca

SEQ ID NO: 738289 - RNA, 22 nt, Human
ugcaugcauaaauguacacaca

SEQ ID NO: 738290 - RNA, 22 nt, Human
gcccagcacagcuggaagaguc

SEQ ID NO: 738291 - RNA, 22 nt, Human
aaguuuugaaauacugaagugu

SEQ ID NO: 738292 - RNA, 22 nt, Human
acuucuuucacaauguuucuag

SEQ ID NO: 738293 - RNA, 22 nt, Human
ucugggaaggcucugcagauau

SEQ ID NO: 738294 - RNA, 22 nt, Human
cugagggcccugaagcuuggca

SEQ ID NO: 738295 - RNA, 22 nt, Human
gcaccaggcuuagagccccagg

SEQ ID NO: 738296 - RNA, 22 nt, Human
cagaguuucgguaagcauagaa

SEQ ID NO: 738297 - RNA, 22 nt, Human
gacagggaggaaagagacugcu

SEQ ID NO: 738298 - RNA, 22 nt, Human
cugaggccgucugggucugcag

SEQ ID NO: 738299 - RNA, 22 nt, Human
uuccaguugguagaauguaagg

SEQ ID NO: 738300 - RNA, 22 nt, Human
cuuuauguucaguacaaugcuu

SEQ ID NO: 738301 - RNA, 16 nt, Human
uggcugagagaggguu

SEQ ID NO: 738302 - RNA, 22 nt, Human
ccuggggagaagagcuuccccc

SEQ ID NO: 738303 - RNA, 20 nt, Human
aacacugagggcuacucuuc

SEQ ID NO: 738304 - RNA, 22 nt, Human
ucagccagugugcaccuggagu

SEQ ID NO: 738305 - RNA, 22 nt, Human
gagcacagcuggagguagcauu

SEQ ID NO: 738306 - RNA, 23 nt, Human
aguguugguugggaagccaagca

SEQ ID NO: 738307 - RNA, 18 nt, Human
gggcagcacagcagccuc

SEQ ID NO: 738308 - RNA, 22 nt, Human
ucccuucuggcagcagugugag

SEQ ID NO: 738309 - RNA, 22 nt, Human
aaaauugucgaacaguaguaac

SEQ ID NO: 738310 - RNA, 22 nt, Human
ccuggggcucugcacagagcag

SEQ ID NO: 738311 - RNA, 22 nt, Human
ugcugaaggcaggggagguggc

SEQ ID NO: 738312 - RNA, 22 nt, Human
uucagaacugucuguccuuuuc

SEQ ID NO: 738313 - RNA, 22 nt, Human
uuaacagauguuuauggagcau

SEQ ID NO: 738314 - RNA, 22 nt, Human
gacuggggaaggacccgagacc

SEQ ID NO: 738315 - RNA, 22 nt, Human
cugggagaggaaccucgagggu

SEQ ID NO: 738316 - RNA, 22 nt, Human
ucuggagaaaguugaguuugug

SEQ ID NO: 738317 - RNA, 22 nt, Human
cuuguuuuggcuaguaugaugu

SEQ ID NO: 738318 - RNA, 22 nt, Human
ucagaacagcgagaauauucac

SEQ ID NO: 738319 - RNA, 22 nt, Human
aguaaaaaguucagaaugguug

SEQ ID NO: 738320 - RNA, 21 nt, Human
acacugugucauaaugcuuaa

SEQ ID NO: 738321 - RNA, 22 nt, Human
augugaagcuugugcuaacaua

SEQ ID NO: 738322 - RNA, 22 nt, Human
uugucugaaucuggagcucucu

SEQ ID NO: 738323 - RNA, 22 nt, Human
acugagcaggguuccgcaugga

SEQ ID NO: 738324 - RNA, 22 nt, Human
auguuaccucuauuagaauauu

SEQ ID NO: 738325 - RNA, 22 nt, Human
uaauugcugaacuacuaucccu

SEQ ID NO: 738326 - RNA, 23 nt, Human
agcagcaggagguauugauaagg

SEQ ID NO: 738327 - RNA, 22 nt, Human
acaguugagaugcaacuuuggg

SEQ ID NO: 738328 - RNA, 22 nt, Human
agcuggggguuggauaagggua

SEQ ID NO: 738329 - RNA, 22 nt, Human
agaaaugcucuuccugaccaga

SEQ ID NO: 738330 - RNA, 22 nt, Human
cuccuggcccugagcucccagg

SEQ ID NO: 738331 - RNA, 22 nt, Human
ucaguuuugauuccugguucuc

SEQ ID NO: 738332 - RNA, 22 nt, Human
uucagccagucaucagucuugu

SEQ ID NO: 738333 - RNA, 19 nt, Human
caggaugaucccaugacac

SEQ ID NO: 738334 - RNA, 22 nt, Human
aguugaacaguauuugcuucug

SEQ ID NO: 738335 - RNA, 22 nt, Human
cagguccuuuaguguccagaac

SEQ ID NO: 738336 - RNA, 22 nt, Human
ugaccaauacuguggaugccag

SEQ ID NO: 738337 - RNA, 22 nt, Human
cagaacugggcagggagcagag

SEQ ID NO: 738338 - RNA, 22 nt, Human
ugcugugcaucauaguguuugg

SEQ ID NO: 738339 - RNA, 22 nt, Human
cuuucagcaucccugggauuac

SEQ ID NO: 738340 - RNA, 22 nt, Human
uacuuaaugccacugaauugua

SEQ ID NO: 738341 - RNA, 22 nt, Human
cuuuucagagcugagaucaccg

SEQ ID NO: 738342 - RNA, 20 nt, Human
ugggguccuggaggggaucc

SEQ ID NO: 738343 - RNA, 22 nt, Human
ggaaagcuuuguacuugaaaac

SEQ ID NO: 738344 - RNA, 22 nt, Human
uacauucugguggagaaaguaa

SEQ ID NO: 738345 - RNA, 22 nt, Human
ggucucagguagggccuaggaa

SEQ ID NO: 738346 - RNA, 22 nt, Human
uuauggcuaaauuucaauauua

SEQ ID NO: 738347 - RNA, 18 nt, Human
ugacccuuucucccugug

SEQ ID NO: 738348 - RNA, 22 nt, Human
gagguggguguaucacagguca

SEQ ID NO: 738349 - RNA, 20 nt, Human
gccagaggccggcaggggcu

SEQ ID NO: 738350 - RNA, 22 nt, Human
aauguuuucugacugcuaacuu

SEQ ID NO: 738351 - RNA, 22 nt, Human
gaagagcuguagccugcucuuu

SEQ ID NO: 738352 - RNA, 22 nt, Human
agggugguauuuaacaacugga

SEQ ID NO: 738353 - RNA, 22 nt, Human
ucuggaggcucugagggugagu

SEQ ID NO: 738354 - RNA, 17 nt, Human
aggcaggagauuggaga

SEQ ID NO: 738355 - RNA, 19 nt, Human
acagaugcuuuugcugccc

SEQ ID NO: 738356 - RNA, 22 nt, Human
cuggcuggaacgccgaggcggc

SEQ ID NO: 738357 - RNA, 22 nt, Human
uuucaaagucaagaaggauacu

SEQ ID NO: 738358 - RNA, 20 nt, Human
ugaagcagccuugauucugu

SEQ ID NO: 738359 - RNA, 22 nt, Human
uuccugguuugccuggaaucca

SEQ ID NO: 738360 - RNA, 22 nt, Human
uacaacagacaggaauaagauu

SEQ ID NO: 738361 - RNA, 22 nt, Human
ucacauuuuuuacuggacuuaa

SEQ ID NO: 738362 - RNA, 22 nt, Human
ucucuucuauuugagacuauuu

SEQ ID NO: 738363 - RNA, 22 nt, Human
aaugguuuugucucaucaaugu

SEQ ID NO: 738364 - RNA, 22 nt, Human
aagcagaauuuaauagaaaggu

SEQ ID NO: 738365 - RNA, 22 nt, Human
ggccagagcucaaacagucgca

SEQ ID NO: 738366 - RNA, 22 nt, Human
auugcagggacucaauaagaau

SEQ ID NO: 738367 - RNA, 22 nt, Human
aaucuuggcaaauguagcuucc

SEQ ID NO: 738368 - RNA, 22 nt, Human
cagucaaacuuauaggcacauu

SEQ ID NO: 738369 - RNA, 22 nt, Human
gccacuggacccagaaagggaa

SEQ ID NO: 738370 - RNA, 22 nt, Human
ccugguucagucuuucuaugcu

SEQ ID NO: 738371 - RNA, 21 nt, Human
uucaaagagugggcauuguca

SEQ ID NO: 738372 - RNA, 17 nt, Human
agugugugaaauggugg

SEQ ID NO: 738373 - RNA, 22 nt, Human
guuucacagaugguguucauau

SEQ ID NO: 738374 - RNA, 22 nt, Human
uaggcagaauucauugugcugc

SEQ ID NO: 738375 - RNA, 22 nt, Human
caucuguugcuuccuaacaagu

SEQ ID NO: 738376 - RNA, 19 nt, Human
uucucugugcuagacucug

SEQ ID NO: 738377 - RNA, 22 nt, Human
aagacuguacauuuuccagucu

SEQ ID NO: 738378 - RNA, 22 nt, Human
ggcagcaacucauuauuccugu

SEQ ID NO: 738379 - RNA, 22 nt, Human
ucaggcaccccuugaguagggg

SEQ ID NO: 738380 - RNA, 22 nt, Human
acugaaauauuuagaagugaag

SEQ ID NO: 738381 - RNA, 22 nt, Human
ucuuuguacuuucuggcugucc

SEQ ID NO: 738382 - RNA, 22 nt, Human
cucuggagagguucccauggga

SEQ ID NO: 738383 - RNA, 22 nt, Human
gagccuggagcuggaacgaagc

SEQ ID NO: 738384 - RNA, 22 nt, Human
uccagguaauuuggaugcuagu

SEQ ID NO: 738385 - RNA, 22 nt, Human
cuucuugagcauggguaguacu

SEQ ID NO: 738386 - RNA, 18 nt, Human
guguggcugagaugaggc

SEQ ID NO: 738387 - RNA, 22 nt, Human
uagaaaugugauaauagcuuaa

SEQ ID NO: 738388 - RNA, 22 nt, Human
aaggcagguauugaugccacag

SEQ ID NO: 738389 - RNA, 22 nt, Human
gaggccagaaugagcugaaugc

SEQ ID NO: 738390 - RNA, 22 nt, Human
cccacauuuuugagucuucauc

SEQ ID NO: 738391 - RNA, 22 nt, Human
cuucucccuggcuucugcacac

SEQ ID NO: 738392 - RNA, 22 nt, Human
cacagcauuaacugggacagcu

SEQ ID NO: 738393 - RNA, 22 nt, Human
uuguacuuuggggaaauguuga

SEQ ID NO: 738394 - RNA, 21 nt, Human
ugguggagugugcugagcaug

SEQ ID NO: 738395 - RNA, 22 nt, Human
aaccuaggacuauagauaucau

SEQ ID NO: 738396 - RNA, 22 nt, Human
uuucauuaaagucaaaucuggu

SEQ ID NO: 738397 - RNA, 22 nt, Human
gcagugugcauggcuuuuggcc

SEQ ID NO: 738398 - RNA, 22 nt, Human
caacuauauagaaauugauugu

SEQ ID NO: 738399 - RNA, 22 nt, Human
aagguauuauugucuauguacu

SEQ ID NO: 738400 - RNA, 22 nt, Human
cuggcccucagacucaugggca

SEQ ID NO: 738401 - RNA, 22 nt, Human
aggggcgucuguaggcaguggg

SEQ ID NO: 738402 - RNA, 22 nt, Human
agccacaggccaugagauacca

SEQ ID NO: 738403 - RNA, 22 nt, Human
ugugaaggcagcagcucugucc

SEQ ID NO: 738404 - RNA, 20 nt, Human
cacagcuugccuuuuaugac

SEQ ID NO: 738405 - RNA, 22 nt, Human
gcugaagauaagugaagaggcu

SEQ ID NO: 738406 - RNA, 22 nt, Human
ccugggagagccaucuguggcc

SEQ ID NO: 738407 - RNA, 23 nt, Human
uucuggcuguggguggcgucucu

SEQ ID NO: 738408 - RNA, 22 nt, Human
cuugccugggacugaggcauuu

SEQ ID NO: 738409 - RNA, 22 nt, Human
agcuagggcaaauaugagauac

SEQ ID NO: 738410 - RNA, 22 nt, Human
aggcuccaggcccuucaccagc

SEQ ID NO: 738411 - RNA, 22 nt, Human
aauaacaggguugauuugcaau

SEQ ID NO: 738412 - RNA, 22 nt, Human
ccucucuccaagggaaauccua

SEQ ID NO: 738413 - RNA, 22 nt, Human
aauuucucacucucuugaucac

SEQ ID NO: 738414 - RNA, 22 nt, Human
uuaagacaguguauuuguuuuc

SEQ ID NO: 738415 - RNA, 22 nt, Human
gccagagccuguggauuuaacc

SEQ ID NO: 738416 - RNA, 22 nt, Human
ccagagccggcucccucagcuu

SEQ ID NO: 738417 - RNA, 22 nt, Human
aguacacacaguagaauagagu

SEQ ID NO: 738418 - RNA, 22 nt, Human
accagcucuggacaggcauuuc

SEQ ID NO: 738419 - RNA, 22 nt, Human
uugcuuccuggaugugacuuug

SEQ ID NO: 738420 - RNA, 22 nt, Human
uggccucuccuggcagcaucca

SEQ ID NO: 738421 - RNA, 22 nt, Human
cuagucugugugggaccagggc

SEQ ID NO: 738422 - RNA, 22 nt, Human
aggaaaugcugaugcuccugga

SEQ ID NO: 738423 - RNA, 22 nt, Human
cccagggaagggcuaccugagg

SEQ ID NO: 738424 - RNA, 22 nt, Human
gaucugaagauaugaaauauuu

SEQ ID NO: 738425 - RNA, 22 nt, Human
ugaauagauuuuuaacauauaa

SEQ ID NO: 738426 - RNA, 22 nt, Human
gaagggugugauuugccugaga

SEQ ID NO: 738427 - RNA, 22 nt, Human
uccuuugacuucuugcagucca

SEQ ID NO: 738428 - RNA, 19 nt, Human
uaaggccaaaaguaagugu

SEQ ID NO: 738429 - RNA, 22 nt, Human
ggaaugcucaguucuuggugcu

SEQ ID NO: 738430 - RNA, 22 nt, Human
aagcugccuuccaugugaggaa

SEQ ID NO: 738431 - RNA, 22 nt, Human
cuuuccaggcugaguuugcuug

SEQ ID NO: 738432 - RNA, 22 nt, Human
aaauagauugcugaggcauuac

SEQ ID NO: 738433 - RNA, 22 nt, Human
uggcacuggaaucguagccuug

SEQ ID NO: 738434 - RNA, 22 nt, Human
acuuccugcuaugagcuucugu

SEQ ID NO: 738435 - RNA, 22 nt, Human
ccuuuggcccugagagaugauu

SEQ ID NO: 738436 - RNA, 22 nt, Human
aucaaauuaugugcuacaagaa

SEQ ID NO: 738437 - RNA, 22 nt, Human
aaaaacacugggcugggaguca

SEQ ID NO: 738438 - RNA, 22 nt, Human
uaaaucaguuucucuuauuggu

SEQ ID NO: 738439 - RNA, 22 nt, Human
uuauucuucuucucuugccagg

SEQ ID NO: 738440 - RNA, 22 nt, Human
gaaauagaagcugccaauuucu

SEQ ID NO: 738441 - RNA, 22 nt, Human
agaugucuguaauucuaagcau

SEQ ID NO: 738442 - RNA, 20 nt, Human
ugucaugcauuagaugaaga

SEQ ID NO: 738443 - RNA, 20 nt, Human
cuguacaucaccaaggugac

SEQ ID NO: 738444 - RNA, 22 nt, Human
aaauggcauagaggugaaggua

SEQ ID NO: 738445 - RNA, 22 nt, Human
uggcugagugaacauguccauu

SEQ ID NO: 738446 - RNA, 22 nt, Human
ggaggccuagaaaagugguucu

SEQ ID NO: 738447 - RNA, 23 nt, Human
accaugaugggagugcaaauaag

SEQ ID NO: 738448 - RNA, 19 nt, Human
cccaggcuacauggagagg

SEQ ID NO: 738449 - RNA, 20 nt, Human
ugcugucguguuuucugcuu

SEQ ID NO: 738450 - RNA, 22 nt, Human
uuuguccuauaauccucuuaca

SEQ ID NO: 738451 - RNA, 22 nt, Human
cucggcagguggagguuguagu

SEQ ID NO: 738452 - RNA, 22 nt, Human
caggugaaucacuugaguccag

SEQ ID NO: 738453 - RNA, 22 nt, Human
cuucucagucaccugugagucu

SEQ ID NO: 738454 - RNA, 22 nt, Human
gggaccuggacaugugugugcu

SEQ ID NO: 738455 - RNA, 22 nt, Human
cugucaguucuuccagauagag

SEQ ID NO: 738456 - RNA, 22 nt, Human
agggagaguuugauguuuccuc

SEQ ID NO: 738457 - RNA, 23 nt, Human
ggagagcuccucgugacucacug

SEQ ID NO: 738458 - RNA, 22 nt, Human
agcuuuaucccuugcccaucga

SEQ ID NO: 738459 - RNA, 22 nt, Human
agguggcaugagacuguaccag

SEQ ID NO: 738460 - RNA, 22 nt, Human
augugugcucuugagccuucac

SEQ ID NO: 738461 - RNA, 22 nt, Human
ggccagcucugcacagcagcug

SEQ ID NO: 738462 - RNA, 22 nt, Human
gagugagugcugggcugaggcu

SEQ ID NO: 738463 - RNA, 20 nt, Human
uguggaaaaacagaagcaga

SEQ ID NO: 738464 - RNA, 22 nt, Human
gcccucuggcacagagaugcag

SEQ ID NO: 738465 - RNA, 22 nt, Human
acuaauugagugcaugaucuuu

SEQ ID NO: 738466 - RNA, 22 nt, Human
gcucccaccuccagccugaguu

SEQ ID NO: 738467 - RNA, 22 nt, Human
acugucuuuauuagaaucuuau

SEQ ID NO: 738468 - RNA, 22 nt, Human
cagcaacauauaugaaacugug

SEQ ID NO: 738469 - RNA, 21 nt, Human
ucucuccucaagcucgacccc

SEQ ID NO: 738470 - RNA, 22 nt, Human
aaguaaaacacacaguccaccg

SEQ ID NO: 738471 - RNA, 20 nt, Human
ccaaggacacuggcuccugg

SEQ ID NO: 738472 - RNA, 22 nt, Human
gggcagcugcagggauggugac

SEQ ID NO: 738473 - RNA, 22 nt, Human
uaggggugaggccaggcaucag

SEQ ID NO: 738474 - RNA, 22 nt, Human
cuuucucuucacugucaugauc

SEQ ID NO: 738475 - RNA, 22 nt, Human
ggaaggggagcuggaaagggua

SEQ ID NO: 738476 - RNA, 20 nt, Human
gcagcagacagacaggggac

SEQ ID NO: 738477 - RNA, 22 nt, Human
acacagagcuucucaacuggga

SEQ ID NO: 738478 - RNA, 22 nt, Human
cuaacugucaugcacauguguu

SEQ ID NO: 738479 - RNA, 22 nt, Human
ggccagcuuugagcugcaggaa

SEQ ID NO: 738480 - RNA, 22 nt, Human
uugaagcugccguuuuucucca

SEQ ID NO: 738481 - RNA, 22 nt, Human
uucuguacccaacauuuuuacu

SEQ ID NO: 738482 - RNA, 17 nt, Human
gaauuucuuggucaaaa

SEQ ID NO: 738483 - RNA, 22 nt, Human
ccagcugggauuaagggaaaau

SEQ ID NO: 738484 - RNA, 22 nt, Human
gugccugguauguagguagcgg

SEQ ID NO: 738485 - RNA, 22 nt, Human
ccugagcaucagcgccuccuua

SEQ ID NO: 738486 - RNA, 23 nt, Human
gguuggcuguacccaggcucccu

SEQ ID NO: 738487 - RNA, 22 nt, Human
uagaaucagaagauuugacugu

SEQ ID NO: 738488 - RNA, 22 nt, Human
ugcaauaacccaguaucuguga

SEQ ID NO: 738489 - RNA, 22 nt, Human
uucagggcguuguggcugacug

SEQ ID NO: 738490 - RNA, 22 nt, Human
cuucaaaucccccugaguuuga

SEQ ID NO: 738491 - RNA, 22 nt, Human
auggcuggucucccauggaaaa

SEQ ID NO: 738492 - RNA, 22 nt, Human
cagcccaggccgacaguuccuc

SEQ ID NO: 738493 - RNA, 22 nt, Human
gcugucuucacuuccugguuuc

SEQ ID NO: 738494 - RNA, 22 nt, Human
cugaggagcagcuggcccgcua

SEQ ID NO: 738495 - RNA, 22 nt, Human
ugaaacagaguggauacaguga

SEQ ID NO: 738496 - RNA, 16 nt, Human
uggagcaggcaggaug

SEQ ID NO: 738497 - RNA, 22 nt, Human
ucagcuucccuaucugaccaua

SEQ ID NO: 738498 - RNA, 22 nt, Human
auuugcuucauagaucugugga

SEQ ID NO: 738499 - RNA, 22 nt, Human
ugggcugcacccucagccucug

SEQ ID NO: 738500 - RNA, 22 nt, Human
agucugaagacucaugucugaa

SEQ ID NO: 738501 - RNA, 22 nt, Human
ggcuuugggauucagcaugaga

SEQ ID NO: 738502 - RNA, 22 nt, Human
cagccagcuucagauccaagcc

SEQ ID NO: 738503 - RNA, 22 nt, Human
aauugcauaaaauucaacucug

SEQ ID NO: 738504 - RNA, 22 nt, Human
uugaaggaggcuccuuuuuaaa

SEQ ID NO: 738505 - RNA, 22 nt, Human
aagugaccucaugguuucuccu

SEQ ID NO: 738506 - RNA, 22 nt, Human
gacacagcuugaugagggcuuu

SEQ ID NO: 738507 - RNA, 19 nt, Human
caguuuguccagaggggac

SEQ ID NO: 738508 - RNA, 22 nt, Human
gccuugggcacaggcagggccc

SEQ ID NO: 738509 - RNA, 22 nt, Human
cacucugcagcugaagggcugg

SEQ ID NO: 738510 - RNA, 22 nt, Human
cagcagcaaaucuagaagagga

SEQ ID NO: 738511 - RNA, 22 nt, Human
acaggugaccugcucauaugaa

SEQ ID NO: 738512 - RNA, 22 nt, Human
ccugcacuucucacagcugcug

SEQ ID NO: 738513 - RNA, 22 nt, Human
ucagaaucuaaauaggcuccag

SEQ ID NO: 738514 - RNA, 22 nt, Human
acagaauacuacagacugguua

SEQ ID NO: 738515 - RNA, 22 nt, Human
agauggcugggagcucuguuug

SEQ ID NO: 738516 - RNA, 21 nt, Human
ugaggcucuguugugccugca

SEQ ID NO: 738517 - RNA, 22 nt, Human
ggugugugaggagucacuuagu

SEQ ID NO: 738518 - RNA, 21 nt, Human
gcucaggcucuugacagagca

SEQ ID NO: 738519 - RNA, 22 nt, Human
acccuggcccauugcugugccu

SEQ ID NO: 738520 - RNA, 22 nt, Human
cagcuuuggcccagucgggagg

SEQ ID NO: 738521 - RNA, 22 nt, Human
caggaggugcccucuaguggca

SEQ ID NO: 738522 - RNA, 20 nt, Human
gaaaugugaccucuucugug

SEQ ID NO: 738523 - RNA, 17 nt, Human
ucagcaggggccaagcu

SEQ ID NO: 738524 - RNA, 22 nt, Human
aagaauucacugguagagucaa

SEQ ID NO: 738525 - RNA, 19 nt, Human
aguccaugaauggaggaug

SEQ ID NO: 738526 - RNA, 22 nt, Human
gacauacagcccucucccuggu

SEQ ID NO: 738527 - RNA, 22 nt, Human
cccugagcacaccuggcagaca

SEQ ID NO: 738528 - RNA, 20 nt, Human
ggggcccaagcccucuugcc

SEQ ID NO: 738529 - RNA, 22 nt, Human
cuucaagauauuucuagaauca

SEQ ID NO: 738530 - RNA, 21 nt, Human
ggacagaggagaaggcacccu

SEQ ID NO: 738531 - RNA, 22 nt, Human
gccugcuuccuuuucauagaug

SEQ ID NO: 738532 - RNA, 22 nt, Human
aggcuucuugggcuucauucug

SEQ ID NO: 738533 - RNA, 22 nt, Human
cccuggaguccggagcucaccu

SEQ ID NO: 738534 - RNA, 22 nt, Human
agugucugcgggcagaggagcg

SEQ ID NO: 738535 - RNA, 22 nt, Human
aaggaccuauauugucagagga

SEQ ID NO: 738536 - RNA, 22 nt, Human
aacaggagaguaaauauaugau

SEQ ID NO: 738537 - RNA, 21 nt, Human
ggaggaaaaaggaaugacuug

SEQ ID NO: 738538 - RNA, 22 nt, Human
agcaggcuuuccacagaaggag

SEQ ID NO: 738539 - RNA, 22 nt, Human
caaugucugggagaccugugau

SEQ ID NO: 738540 - RNA, 22 nt, Human
agggaugauggaaagaagcagg

SEQ ID NO: 738541 - RNA, 22 nt, Human
gguggccucagcaaggcuggca

SEQ ID NO: 738542 - RNA, 22 nt, Human
uuccuucuccagaacuucuagg

SEQ ID NO: 738543 - RNA, 22 nt, Human
gaaggcuggaaggcaaguagga

SEQ ID NO: 738544 - RNA, 22 nt, Human
cucccagguuacaucugagccu

SEQ ID NO: 738545 - RNA, 22 nt, Human
uuguauuucuccacuuucuguu

SEQ ID NO: 738546 - RNA, 22 nt, Human
gcuuuuggaccucugauguuuc

SEQ ID NO: 738547 - RNA, 22 nt, Human
accagguaauguaaagcagggu

SEQ ID NO: 738548 - RNA, 22 nt, Human
cuuaaucucaccugcaaagucc

SEQ ID NO: 738549 - RNA, 22 nt, Human
ugaggcagugauguuuaagcac

SEQ ID NO: 738550 - RNA, 22 nt, Human
gcagugggaagguuggcacaug

SEQ ID NO: 738551 - RNA, 22 nt, Human
uccacgcugugugaccuugggc

SEQ ID NO: 738552 - RNA, 22 nt, Human
cccuucaagcucucuggguuuu

SEQ ID NO: 738553 - RNA, 22 nt, Human
aguggcucuugggucacugggc

SEQ ID NO: 738554 - RNA, 22 nt, Human
ucaggaagaaagaagggagugu

SEQ ID NO: 738555 - RNA, 22 nt, Human
ucagggcaaagggcagaguuug

SEQ ID NO: 738556 - RNA, 22 nt, Human
gcagccauugagcgaaaaaauc

SEQ ID NO: 738557 - RNA, 22 nt, Human
accuggacuugaauccugacuu

SEQ ID NO: 738558 - RNA, 23 nt, Human
aacugcaagguugcugggaagua

SEQ ID NO: 738559 - RNA, 17 nt, Human
cucugcagugcauggcu

SEQ ID NO: 738560 - RNA, 22 nt, Human
aaaguuguucaguaagaaacuc

SEQ ID NO: 738561 - RNA, 20 nt, Human
cagggcacacugcagccucg

SEQ ID NO: 738562 - RNA, 22 nt, Human
ccuguucacccuccaugcacag

SEQ ID NO: 738563 - RNA, 22 nt, Human
ugcauauuauguguaucugucu

SEQ ID NO: 738564 - RNA, 22 nt, Human
aacugcucauuugagaguaugc

SEQ ID NO: 738565 - RNA, 22 nt, Human
caccagcuaauuaaaacagcag

SEQ ID NO: 738566 - RNA, 22 nt, Human
uuaaagcaucacacuauuaauu

SEQ ID NO: 738567 - RNA, 22 nt, Human
aucauguuggcucugacaaaaa

SEQ ID NO: 738568 - RNA, 22 nt, Human
uuguaaauaguaguaagaugcc

SEQ ID NO: 738569 - RNA, 22 nt, Human
gagaacaggcucuggagucaga

SEQ ID NO: 738570 - RNA, 22 nt, Human
ugcuucugaaguggaugggugc

SEQ ID NO: 738571 - RNA, 22 nt, Human
ugcuuuauucgacaucugguag

SEQ ID NO: 738572 - RNA, 22 nt, Human
ccucugggcugccugcacgggu

SEQ ID NO: 738573 - RNA, 22 nt, Human
gcucagagaaucagcagacacc

SEQ ID NO: 738574 - RNA, 22 nt, Human
cugggacuggaccucugccugg

SEQ ID NO: 738575 - RNA, 22 nt, Human
uccaggagugugugcuaauggg

SEQ ID NO: 738576 - RNA, 22 nt, Human
uguauuuaguccagucucucau

SEQ ID NO: 738577 - RNA, 22 nt, Human
ucuguucauaguaguguauaug

SEQ ID NO: 738578 - RNA, 22 nt, Human
uucugaggcauagaggaugaga

SEQ ID NO: 738579 - RNA, 22 nt, Human
ucugggcugucuacagguuggc

SEQ ID NO: 738580 - RNA, 22 nt, Human
agcuccagagucugaacuauuc

SEQ ID NO: 738581 - RNA, 22 nt, Human
gagcaacaguggcagugguggg

SEQ ID NO: 738582 - RNA, 22 nt, Human
agguaggcccugagugcuguug

SEQ ID NO: 738583 - RNA, 22 nt, Human
uguaagauaugaguacauguaa

SEQ ID NO: 738584 - RNA, 22 nt, Human
cacagaaucauauugucaguuu

SEQ ID NO: 738585 - RNA, 19 nt, Human
gcugggugaggucguugga

SEQ ID NO: 738586 - RNA, 22 nt, Human
gugacauuuuuacugaugagag

SEQ ID NO: 738587 - RNA, 22 nt, Human
ugcauuaaaaugugccucucuu

SEQ ID NO: 738588 - RNA, 22 nt, Human
ucacaggagggagagacaccca

SEQ ID NO: 738589 - RNA, 22 nt, Human
ugugguggggucugguauucca

SEQ ID NO: 738590 - RNA, 22 nt, Human
aauuaugauuggucuaaaccag

SEQ ID NO: 738591 - RNA, 22 nt, Human
gagguccucucggaaccccuuu

SEQ ID NO: 738592 - RNA, 22 nt, Human
aucaggaugcugucaguuacca

SEQ ID NO: 738593 - RNA, 22 nt, Human
aagucugacuagaaucucuccc

SEQ ID NO: 738594 - RNA, 22 nt, Human
uguuggcagauugucuaggguu

SEQ ID NO: 738595 - RNA, 22 nt, Human
gcuucauagcauucauugccug

SEQ ID NO: 738596 - RNA, 22 nt, Human
guuccuaaccagcagagaaaca

SEQ ID NO: 738597 - RNA, 22 nt, Human
ugcuuaaacauacuauuuauau

SEQ ID NO: 738598 - RNA, 22 nt, Human
aggaaguuaguaaauuaugugc

SEQ ID NO: 738599 - RNA, 22 nt, Human
augguggauuugugauucagcu

SEQ ID NO: 738600 - RNA, 22 nt, Human
aggacugggugcagagggcauc

SEQ ID NO: 738601 - RNA, 20 nt, Human
cugggucacuuggcugcucu

SEQ ID NO: 738602 - RNA, 22 nt, Human
ugagcaauaugugaauuuucuu

SEQ ID NO: 738603 - RNA, 22 nt, Human
cugugcccaggcuggagugcag

SEQ ID NO: 738604 - RNA, 22 nt, Human
acacauaugguugguaggaguu

SEQ ID NO: 738605 - RNA, 22 nt, Human
aagagcaaguggguagugaagc

SEQ ID NO: 738606 - RNA, 22 nt, Human
uauuguauuaaggauucaagua

SEQ ID NO: 738607 - RNA, 22 nt, Human
uggcuggcugucaguaggcugu

SEQ ID NO: 738608 - RNA, 22 nt, Human
uagcagcaggggaaacagcugu

SEQ ID NO: 738609 - RNA, 22 nt, Human
aagucagaccuuguugauagcu

SEQ ID NO: 738610 - RNA, 22 nt, Human
uccuucagucuucugagccaua

SEQ ID NO: 738611 - RNA, 22 nt, Human
agugaauucuccacccaguagg

SEQ ID NO: 738612 - RNA, 22 nt, Human
aggcccaguagugcugccuuua

SEQ ID NO: 738613 - RNA, 22 nt, Human
acacaguucuuucacuguuggu

SEQ ID NO: 738614 - RNA, 23 nt, Human
accuagaaauacguuuuacaugg

SEQ ID NO: 738615 - RNA, 22 nt, Human
agugucugcucagacagcuaca

SEQ ID NO: 738616 - RNA, 20 nt, Human
augugaaguaggaagggugu

SEQ ID NO: 738617 - RNA, 22 nt, Human
auacauuccuacugacuagcua

SEQ ID NO: 738618 - RNA, 22 nt, Human
ccagaagucaaugcagauguga

SEQ ID NO: 738619 - RNA, 22 nt, Human
agucaaagaugaccgaguuccu

SEQ ID NO: 738620 - RNA, 22 nt, Human
guggucuggggucaggccugag

SEQ ID NO: 738621 - RNA, 22 nt, Human
aaggaagggaaauagugauguc

SEQ ID NO: 738622 - RNA, 22 nt, Human
gcuucuuuggcaacccugacau

SEQ ID NO: 738623 - RNA, 22 nt, Human
ccacagauuauuucuaaacagg

SEQ ID NO: 738624 - RNA, 23 nt, Human
gggagccauggguggucauggag

SEQ ID NO: 738625 - RNA, 17 nt, Human
uuucaucugggaccacc

SEQ ID NO: 738626 - RNA, 22 nt, Human
gaagagcuaaaggcacaggcuu

SEQ ID NO: 738627 - RNA, 19 nt, Human
cuggaccuggaggcccgga

SEQ ID NO: 738628 - RNA, 22 nt, Human
aaaugcacucugcuucugugac

SEQ ID NO: 738629 - RNA, 22 nt, Human
uggcauguauacuugaguagga

SEQ ID NO: 738630 - RNA, 22 nt, Human
gugcugcucaagggacaggaca

SEQ ID NO: 738631 - RNA, 22 nt, Human
cuaaauuaucaugagaauuaug

SEQ ID NO: 738632 - RNA, 22 nt, Human
agugugagccuacaggccaaag

SEQ ID NO: 738633 - RNA, 22 nt, Human
auacacacgugcacgugggaaa

SEQ ID NO: 738634 - RNA, 20 nt, Human
uugcuuuaucagacaugaua

SEQ ID NO: 738635 - RNA, 22 nt, Human
ucucuucacauuccuggcaaac

SEQ ID NO: 738636 - RNA, 22 nt, Human
uccuagaauaaguaacaggaca

SEQ ID NO: 738637 - RNA, 22 nt, Human
agaaggcagaugggacggagca

SEQ ID NO: 738638 - RNA, 20 nt, Human
accucccucuguggguggga

SEQ ID NO: 738639 - RNA, 22 nt, Human
gagaggcaggcgcugcaauggu

SEQ ID NO: 738640 - RNA, 22 nt, Human
aggcaguggaugucaggaaugg

SEQ ID NO: 738641 - RNA, 22 nt, Human
cauucauuugcccaguaaguca

SEQ ID NO: 738642 - RNA, 22 nt, Human
ccauuaaaauugugacauagga

SEQ ID NO: 738643 - RNA, 21 nt, Human
ugggccugauucccaggguca

SEQ ID NO: 738644 - RNA, 22 nt, Human
uugggaaagaaugagaagguga

SEQ ID NO: 738645 - RNA, 22 nt, Human
aucacaaaggcugcuucaugau

SEQ ID NO: 738646 - RNA, 22 nt, Human
ccugaagcaaggguaggcaggu

SEQ ID NO: 738647 - RNA, 23 nt, Human
ugggagcucaagggaggcugccc

SEQ ID NO: 738648 - RNA, 22 nt, Human
uucagaaaaaacuucaauaagu

SEQ ID NO: 738649 - RNA, 21 nt, Human
uuacaaagcaagugcuguguc

SEQ ID NO: 738650 - RNA, 22 nt, Human
agcagcugaucaaagcacuuau

SEQ ID NO: 738651 - RNA, 22 nt, Human
ucaaaggcaccaaggucacugc

SEQ ID NO: 738652 - RNA, 19 nt, Human
augcacacauugaagagga

SEQ ID NO: 738653 - RNA, 22 nt, Human
cagaagcagaacacuagauuua

SEQ ID NO: 738654 - RNA, 22 nt, Human
ugggaccugcucuuggaaugag

SEQ ID NO: 738655 - RNA, 22 nt, Human
gaggaggggcacuugucuccua

SEQ ID NO: 738656 - RNA, 22 nt, Human
ggacccugggcuugcuccuggg

SEQ ID NO: 738657 - RNA, 22 nt, Human
gagccaggguuugaaacuagac

SEQ ID NO: 738658 - RNA, 22 nt, Human
ccuggcuuccauauggcacaua

SEQ ID NO: 738659 - RNA, 22 nt, Human
cugauuccugauucaugcucuu

SEQ ID NO: 738660 - RNA, 22 nt, Human
agguggcugaagagugggugag

SEQ ID NO: 738661 - RNA, 22 nt, Human
uggcaguggcucagagugcaga

SEQ ID NO: 738662 - RNA, 16 nt, Human
cuuuuucuccccucuu

SEQ ID NO: 738663 - RNA, 22 nt, Human
uagaaaugauugagcuguaaua

SEQ ID NO: 738664 - RNA, 19 nt, Human
cucugcuugguccauaugc

SEQ ID NO: 738665 - RNA, 22 nt, Human
ucccaagugucuuggaccaggg

SEQ ID NO: 738666 - RNA, 22 nt, Human
ggcaguggaggacccugugucu

SEQ ID NO: 738667 - RNA, 22 nt, Human
cuggcuggucaugucaugagcc

SEQ ID NO: 738668 - RNA, 22 nt, Human
cucuucuugucucugguuagaa

SEQ ID NO: 738669 - RNA, 22 nt, Human
gaacauucuuggaggaaauaac

SEQ ID NO: 738670 - RNA, 22 nt, Human
acuguuauguuauuacccaugu

SEQ ID NO: 738671 - RNA, 22 nt, Human
agcagccuugugacuccggggu

SEQ ID NO: 738672 - RNA, 22 nt, Human
cauuguaagcuguugaauccuc

SEQ ID NO: 738673 - RNA, 22 nt, Human
ugacacagggaaagcggaucca

SEQ ID NO: 738674 - RNA, 22 nt, Human
uuugcauuauauuuauagaaga

SEQ ID NO: 738675 - RNA, 22 nt, Human
gaagauaauuccuacuuauaac

SEQ ID NO: 738676 - RNA, 22 nt, Human
uaugcauauauuuucccaucuu

SEQ ID NO: 738677 - RNA, 22 nt, Human
uuuagacagcggcucugaacca

SEQ ID NO: 738678 - RNA, 20 nt, Human
cagcaacuuuggacugaguu

SEQ ID NO: 738679 - RNA, 22 nt, Human
ucucuccucuagucaggguggu

SEQ ID NO: 738680 - RNA, 22 nt, Human
agcuguguggugucugacagcu

SEQ ID NO: 738681 - RNA, 22 nt, Human
cugcugucgccgagcugcaugc

SEQ ID NO: 738682 - RNA, 22 nt, Human
gccugagcaggcguggaccaug

SEQ ID NO: 738683 - RNA, 22 nt, Human
caauguuucuuguaaccaguga

SEQ ID NO: 738684 - RNA, 22 nt, Human
caggcagauauguucgcuuuaa

SEQ ID NO: 738685 - RNA, 22 nt, Human
agaggaggcuggguccagauaa

SEQ ID NO: 738686 - RNA, 22 nt, Human
cuggcuuucugcaaaucuccau

SEQ ID NO: 738687 - RNA, 22 nt, Human
auucccagguaaaaguagagcu

SEQ ID NO: 738688 - RNA, 22 nt, Human
gagaggcuccaugaccccggca

SEQ ID NO: 738689 - RNA, 23 nt, Human
ugccuccaccgagggccaggcau

SEQ ID NO: 738690 - RNA, 22 nt, Human
gacaucauggagaggauaaaua

SEQ ID NO: 738691 - RNA, 22 nt, Human
gucucuaucauagcugaacccu

SEQ ID NO: 738692 - RNA, 22 nt, Human
aguuaacuaaacugugaguaaa

SEQ ID NO: 738693 - RNA, 22 nt, Human
gcuuuccuggcccugucccugc

SEQ ID NO: 738694 - RNA, 22 nt, Human
cacugcccaccaaguggcuggu

SEQ ID NO: 738695 - RNA, 22 nt, Human
aucaggaaagaguggaacucug

SEQ ID NO: 738696 - RNA, 22 nt, Human
acagggccucagcugauucugg

SEQ ID NO: 738697 - RNA, 22 nt, Human
uccagucauuuccauuguuccc

SEQ ID NO: 738698 - RNA, 19 nt, Human
aggagaagacucucucccc

SEQ ID NO: 738699 - RNA, 22 nt, Human
acagaauucuaguauguggcuu

SEQ ID NO: 738700 - RNA, 22 nt, Human
gcuuuuuugcuauugaaguggu

SEQ ID NO: 738701 - RNA, 22 nt, Human
gaggaggcuuccgggaggcacg

SEQ ID NO: 738702 - RNA, 22 nt, Human
ucucaggcuaguaaaagauggg

SEQ ID NO: 738703 - RNA, 22 nt, Human
ugagccaggcccagugggguca

SEQ ID NO: 738704 - RNA, 22 nt, Human
ccuggcagcuccguggccuucc

SEQ ID NO: 738705 - RNA, 22 nt, Human
ugcauuggaaaacuauggcuca

SEQ ID NO: 738706 - RNA, 22 nt, Human
cugggagcuggaaugggagaag

SEQ ID NO: 738707 - RNA, 22 nt, Human
cggucugagagcaggagaaggg

SEQ ID NO: 738708 - RNA, 22 nt, Human
acaacuuuucuaucauguggaa

SEQ ID NO: 738709 - RNA, 22 nt, Human
auggcuguugugaggaucaaau

SEQ ID NO: 738710 - RNA, 22 nt, Human
gcacagugcaccacuuugaaaa

SEQ ID NO: 738711 - RNA, 22 nt, Human
cagggaguguacaccaugugua

SEQ ID NO: 738712 - RNA, 22 nt, Human
ugacaucuuugaucucauuuag

SEQ ID NO: 738713 - RNA, 22 nt, Human
ugaaaauucaucucauagcaga

SEQ ID NO: 738714 - RNA, 22 nt, Human
cauggcuggcacacagcaacca

SEQ ID NO: 738715 - RNA, 22 nt, Human
uggagaaagcugcauauggaaa

SEQ ID NO: 738716 - RNA, 22 nt, Human
acaguccuguacaggccauauc

SEQ ID NO: 738717 - RNA, 22 nt, Human
uggcagguagaguucugagaug

SEQ ID NO: 738718 - RNA, 22 nt, Human
agcugaggcauggacaggcugc

SEQ ID NO: 738719 - RNA, 22 nt, Human
uuccaggcugaugggccacagg

SEQ ID NO: 738720 - RNA, 22 nt, Human
acaccagggccuagccagggcg

SEQ ID NO: 738721 - RNA, 22 nt, Human
gaagcaauuuagaaucagaagc

SEQ ID NO: 738722 - RNA, 22 nt, Human
agcacaggaacauggagauggg

SEQ ID NO: 738723 - RNA, 22 nt, Human
aaauaugagggugaugcccaga

SEQ ID NO: 738724 - RNA, 22 nt, Human
gcucucugccuuucucaaugac

SEQ ID NO: 738725 - RNA, 22 nt, Human
ugccucaggcaccuggcagguu

SEQ ID NO: 738726 - RNA, 20 nt, Human
ucucaggccccaguuuucuu

SEQ ID NO: 738727 - RNA, 22 nt, Human
ucacagcaggguaacaggaaga

SEQ ID NO: 738728 - RNA, 22 nt, Human
ccaggcaauucugaaagcauuu

SEQ ID NO: 738729 - RNA, 22 nt, Human
acaacaguaggaaaacaugucu

SEQ ID NO: 738730 - RNA, 22 nt, Human
ucaaggcuaaacuuucagagua

SEQ ID NO: 738731 - RNA, 22 nt, Human
ugugccuggaucucugugacaa

SEQ ID NO: 738732 - RNA, 22 nt, Human
cucugagaagccuugaugggga

SEQ ID NO: 738733 - RNA, 22 nt, Human
acuguaauaugguucuuuugau

SEQ ID NO: 738734 - RNA, 22 nt, Human
ucuaaccuuugaaacugcuuuc

SEQ ID NO: 738735 - RNA, 22 nt, Human
gucccuuggcucacaaacagcu

SEQ ID NO: 738736 - RNA, 22 nt, Human
uuauguuuuaaguguguaucuu

SEQ ID NO: 738737 - RNA, 22 nt, Human
gccaggcauuuauugauugaau

SEQ ID NO: 738738 - RNA, 22 nt, Human
ucuguuuucauuugucuugaga

SEQ ID NO: 738739 - RNA, 22 nt, Human
ucugcugcagggaaagacuuuc

SEQ ID NO: 738740 - RNA, 22 nt, Human
gggagcuggagcuggaagacuc

SEQ ID NO: 738741 - RNA, 22 nt, Human
uuucauaaccucaagcuacagu

SEQ ID NO: 738742 - RNA, 22 nt, Human
cuuaaggaaaagucucuuuuaa

SEQ ID NO: 738743 - RNA, 20 nt, Human
ugcagcagaagcccaugcuc

SEQ ID NO: 738744 - RNA, 22 nt, Human
acagagcugggaucugaaccca

SEQ ID NO: 738745 - RNA, 22 nt, Human
uucuuggagauaaauucuuaca

SEQ ID NO: 738746 - RNA, 22 nt, Human
uuauugccauccuggaaccuag

SEQ ID NO: 738747 - RNA, 22 nt, Human
gugccuccaucagugccuccaa

SEQ ID NO: 738748 - RNA, 22 nt, Human
ucugccuuucccaggcuacugu

SEQ ID NO: 738749 - RNA, 22 nt, Human
uuaggaauuuaucacagacugg

SEQ ID NO: 738750 - RNA, 22 nt, Human
ggagcugugcugggugaucagg

SEQ ID NO: 738751 - RNA, 22 nt, Human
ucucuagagcaugugcugggca

SEQ ID NO: 738752 - RNA, 22 nt, Human
uuuuaauuuuagcccuucuggu

SEQ ID NO: 738753 - RNA, 20 nt, Human
ggggggcuucagggccugug

SEQ ID NO: 738754 - RNA, 22 nt, Human
gcaaaaaccacaauuacuuuug

SEQ ID NO: 738755 - RNA, 20 nt, Human
gcaugaggaaucauugcagc

SEQ ID NO: 738756 - RNA, 22 nt, Human
aucugccaaugccaugagaaga

SEQ ID NO: 738757 - RNA, 22 nt, Human
uaugcaaacaguucaggugaca

SEQ ID NO: 738758 - RNA, 22 nt, Human
ucauuuauagaagugggcagua

SEQ ID NO: 738759 - RNA, 22 nt, Human
gaaaucauuagcaaagauaugu

SEQ ID NO: 738760 - RNA, 17 nt, Human
ggcagagcugacagggc

SEQ ID NO: 738761 - RNA, 18 nt, Human
uuuguuggguugccuuua

SEQ ID NO: 738762 - RNA, 22 nt, Human
gcucuaaagaacccagaggagu

SEQ ID NO: 738763 - RNA, 22 nt, Human
cagaguguaucuguguaagcau

SEQ ID NO: 738764 - RNA, 22 nt, Human
gaaagguuguaacaagacucuu

SEQ ID NO: 738765 - RNA, 22 nt, Human
acaggcagagucagguuggguu

SEQ ID NO: 738766 - RNA, 22 nt, Human
cuucacaucucccuaaaacagc

SEQ ID NO: 738767 - RNA, 22 nt, Human
aggcagguuucccggcugucaa

SEQ ID NO: 738768 - RNA, 22 nt, Human
uuuucucccgcuggcugcucuu

SEQ ID NO: 738769 - RNA, 22 nt, Human
cuccaaggcucuggugcugagg

SEQ ID NO: 738770 - RNA, 22 nt, Human
guucugcuguaauaucucugcu

SEQ ID NO: 738771 - RNA, 22 nt, Human
gccugcuuuaagucuguugccu

SEQ ID NO: 738772 - RNA, 22 nt, Human
cauaugaagaugucuuuuugua

SEQ ID NO: 738773 - RNA, 22 nt, Human
uccagcuguuccaucagcucuu

SEQ ID NO: 738774 - RNA, 22 nt, Human
agcugauacauuucuuguagcc

SEQ ID NO: 738775 - RNA, 22 nt, Human
ucucuggggguagaacucaggc

SEQ ID NO: 738776 - RNA, 22 nt, Human
ccugggucuccuccugcuggcu

SEQ ID NO: 738777 - RNA, 22 nt, Human
ucucugggugauggcagggcac

SEQ ID NO: 738778 - RNA, 20 nt, Human
agguuccagccacaaccagc

SEQ ID NO: 738779 - RNA, 20 nt, Human
uccagcccagguccugccug

SEQ ID NO: 738780 - RNA, 22 nt, Human
ccccuucucugcaagccugcuc

SEQ ID NO: 738781 - RNA, 22 nt, Human
cugggguggaggagcuccccug

SEQ ID NO: 738782 - RNA, 22 nt, Human
gaaaaggauugguaaaauaucu

SEQ ID NO: 738783 - RNA, 22 nt, Human
ugugcagggaagggcaugcuau

SEQ ID NO: 738784 - RNA, 22 nt, Human
cauugcuuugugcauauuuaaa

SEQ ID NO: 738785 - RNA, 22 nt, Human
cuguggcuuucucugccuccuu

SEQ ID NO: 738786 - RNA, 22 nt, Human
gggcugcaucagcaggacccgg

SEQ ID NO: 738787 - RNA, 22 nt, Human
cugugacuggaaucuggcucuu

SEQ ID NO: 738788 - RNA, 22 nt, Human
guuucccauaucuagggagagg

SEQ ID NO: 738789 - RNA, 22 nt, Human
auaggcaaauuaauaagucaua

SEQ ID NO: 738790 - RNA, 21 nt, Human
cagcuuugucugucuucgggg

SEQ ID NO: 738791 - RNA, 22 nt, Human
uaccacugcucccugccuguga

SEQ ID NO: 738792 - RNA, 22 nt, Human
cuuacaaaggagaggagauagg

SEQ ID NO: 738793 - RNA, 22 nt, Human
uccugagggacugguuccucgc

SEQ ID NO: 738794 - RNA, 22 nt, Human
acaggaggagcagcugugugcc

SEQ ID NO: 738795 - RNA, 22 nt, Human
aaggcaguacuuuauguccaua

SEQ ID NO: 738796 - RNA, 19 nt, Human
agucuuguauuuuucaagc

SEQ ID NO: 738797 - RNA, 22 nt, Human
acacagggcugcgccugacccc

SEQ ID NO: 738798 - RNA, 19 nt, Human
uguugccagguaucauguu

SEQ ID NO: 738799 - RNA, 22 nt, Human
ugagagcuguccaccuguggga

SEQ ID NO: 738800 - RNA, 22 nt, Human
ucccuguacacuaacuugagac

SEQ ID NO: 738801 - RNA, 21 nt, Human
uccagcucucauaguguucca

SEQ ID NO: 738802 - RNA, 22 nt, Human
ucauuucuccuaagugaaauau

SEQ ID NO: 738803 - RNA, 22 nt, Human
ggcgccccauauaguucuuaau

SEQ ID NO: 738804 - RNA, 23 nt, Human
gcucagccucagcaggcccagga

SEQ ID NO: 738805 - RNA, 22 nt, Human
acauuaagaaacgagagagcaa

SEQ ID NO: 738806 - RNA, 20 nt, Human
aaaggcacagcaacagagcu

SEQ ID NO: 738807 - RNA, 22 nt, Human
aaaugaacucuuccugcauccc

SEQ ID NO: 738808 - RNA, 18 nt, Human
auaugcuugagcuaagga

SEQ ID NO: 738809 - RNA, 22 nt, Human
cagcaugaugagugcaguuugg

SEQ ID NO: 738810 - RNA, 22 nt, Human
acaauuccacauggcaugcagg

SEQ ID NO: 738811 - RNA, 19 nt, Human
aagcaucuuugaaacuggg

SEQ ID NO: 738812 - RNA, 22 nt, Human
uucuuguuuauuaagauauaaa

SEQ ID NO: 738813 - RNA, 22 nt, Human
uucauucaucucuaaaaugccu

SEQ ID NO: 738814 - RNA, 22 nt, Human
acuuucuguuagaugaauggau

SEQ ID NO: 738815 - RNA, 22 nt, Human
aggggucuuuaggaacgucggg

SEQ ID NO: 738816 - RNA, 22 nt, Human
acauccauuuuguucaaaagca

SEQ ID NO: 738817 - RNA, 22 nt, Human
accaguggaugaaugcuggacc

SEQ ID NO: 738818 - RNA, 22 nt, Human
ggagacaauggaggccaaaaga

SEQ ID NO: 738819 - RNA, 22 nt, Human
ugacaacauugaguuaugugca

SEQ ID NO: 738820 - RNA, 22 nt, Human
aggaugagccgcgcaagcugac

SEQ ID NO: 738821 - RNA, 23 nt, Human
gcuaggugcuuccacacgugcug

SEQ ID NO: 738822 - RNA, 22 nt, Human
guucaagguuuuacagagugua

SEQ ID NO: 738823 - RNA, 21 nt, Human
uugagggguauugcuuuucuc

SEQ ID NO: 738824 - RNA, 22 nt, Human
guaagagcacugucuccugcug

SEQ ID NO: 738825 - RNA, 22 nt, Human
acgugugugacauugggaacgu

SEQ ID NO: 738826 - RNA, 22 nt, Human
agggcugacaguggcguggcgu

SEQ ID NO: 738827 - RNA, 22 nt, Human
accuuuggagcaugcauuuucu

SEQ ID NO: 738828 - RNA, 22 nt, Human
aucagacucagaaaugacgugg

SEQ ID NO: 738829 - RNA, 22 nt, Human
ccaggcuucccugagaggcugc

SEQ ID NO: 738830 - RNA, 22 nt, Human
ggaagcacugaggcagagaggg

SEQ ID NO: 738831 - RNA, 22 nt, Human
gacuucuucaugucuuuuccac

SEQ ID NO: 738832 - RNA, 22 nt, Human
aacaugcaaugucugaaaaucc

SEQ ID NO: 738833 - RNA, 22 nt, Human
agggagcuguggucagcucagu

SEQ ID NO: 738834 - RNA, 22 nt, Human
cugggacaguucagguagggca

SEQ ID NO: 738835 - RNA, 22 nt, Human
uuccuggucugugccauucaga

SEQ ID NO: 738836 - RNA, 22 nt, Human
uaacacaugaaagcaccuucuu

SEQ ID NO: 738837 - RNA, 18 nt, Human
cugccauguccuacuguc

SEQ ID NO: 738838 - RNA, 22 nt, Human
aagugaauggggcagacuucag

SEQ ID NO: 738839 - RNA, 22 nt, Human
aauacaaucaaauucacuagca

SEQ ID NO: 738840 - RNA, 22 nt, Human
aggaggguugaggaggauacuu

SEQ ID NO: 738841 - RNA, 22 nt, Human
uuugugaucuccucccucuaga

SEQ ID NO: 738842 - RNA, 22 nt, Human
augcaguauaaaucauuucugg

SEQ ID NO: 738843 - RNA, 22 nt, Human
uguauuuuuagaccuuuagacc

SEQ ID NO: 738844 - RNA, 22 nt, Human
acagggccaggugagaggugcu

SEQ ID NO: 738845 - RNA, 22 nt, Human
auuguacuuuuauuacauguag

SEQ ID NO: 738846 - RNA, 20 nt, Human
agcauucuacuagacuuuuc

SEQ ID NO: 738847 - RNA, 22 nt, Human
gagcacagauccuggagccaca

SEQ ID NO: 738848 - RNA, 22 nt, Human
agacauuuuagacauaaaagau

SEQ ID NO: 738849 - RNA, 22 nt, Human
uucagaaaugucagccaucaga

SEQ ID NO: 738850 - RNA, 22 nt, Human
uuccuccagccuggagcacuuc

SEQ ID NO: 738851 - RNA, 22 nt, Human
uguuucaugaagucuggauauc

SEQ ID NO: 738852 - RNA, 19 nt, Human
cccaggagucuggcugguu

SEQ ID NO: 738853 - RNA, 22 nt, Human
ucucagcaacgauccggaguaa

SEQ ID NO: 738854 - RNA, 22 nt, Human
gcuggccacacugcugauggag

SEQ ID NO: 738855 - RNA, 22 nt, Human
auggccagcccuucccgcagcu

SEQ ID NO: 738856 - RNA, 22 nt, Human
gaguggagaucgugccacugca

SEQ ID NO: 738857 - RNA, 22 nt, Human
uuagaacacugagaaagugaug

SEQ ID NO: 738858 - RNA, 22 nt, Human
gccagcaaagcaaguugucagc

SEQ ID NO: 738859 - RNA, 22 nt, Human
uaggcuccugaguccacagcac

SEQ ID NO: 738860 - RNA, 22 nt, Human
gaggugauuuucaaaagaacuu

SEQ ID NO: 738861 - RNA, 22 nt, Human
ggaaggagggcggcaaugauga

SEQ ID NO: 738862 - RNA, 22 nt, Human
cuucauuucaggcugaagaaua

SEQ ID NO: 738863 - RNA, 22 nt, Human
gucuuuauuugagauugucauu

SEQ ID NO: 738864 - RNA, 22 nt, Human
aauguacaaaccuucuuuguag

SEQ ID NO: 738865 - RNA, 22 nt, Human
aggcuucaguauucaccgcaug

SEQ ID NO: 738866 - RNA, 22 nt, Human
acugcuuuuagaaaucuauaga

SEQ ID NO: 738867 - RNA, 22 nt, Human
cuguuguaaagcuauucauuug

SEQ ID NO: 738868 - RNA, 22 nt, Human
gaaugaaucuguaagugacaag

SEQ ID NO: 738869 - RNA, 22 nt, Human
guuucacagggccauggaggaa

SEQ ID NO: 738870 - RNA, 22 nt, Human
uauuagcaguuguaugugucug

SEQ ID NO: 738871 - RNA, 22 nt, Human
ucacagggauggaauagaaaua

SEQ ID NO: 738872 - RNA, 22 nt, Human
guucucucagcgauagugaugg

SEQ ID NO: 738873 - RNA, 22 nt, Human
uagaaucauaccucuaggaaca

SEQ ID NO: 738874 - RNA, 22 nt, Human
aaggaaagcugugguucugaga

SEQ ID NO: 738875 - RNA, 18 nt, Human
ggcugccuguuccugaag

SEQ ID NO: 738876 - RNA, 23 nt, Human
aguuuuucugcaugguucuguau

SEQ ID NO: 738877 - RNA, 22 nt, Human
auucaagguuuauucaguuuag

SEQ ID NO: 738878 - RNA, 22 nt, Human
ggugcugagugagcuagaggcu

SEQ ID NO: 738879 - RNA, 22 nt, Human
ucaggcugugucuuuaaacaau

SEQ ID NO: 738880 - RNA, 22 nt, Human
agacaaggcccccuugggcucu

SEQ ID NO: 738881 - RNA, 22 nt, Human
aaauauguauggaguucaugaa

SEQ ID NO: 738882 - RNA, 19 nt, Human
agugugaguaauuggaguu

SEQ ID NO: 738883 - RNA, 22 nt, Human
uauagcaucuaggaugauugca

SEQ ID NO: 738884 - RNA, 22 nt, Human
ccuccacucuggccucucaggu

SEQ ID NO: 738885 - RNA, 22 nt, Human
uucucaaagugugcucccugga

SEQ ID NO: 738886 - RNA, 22 nt, Human
uaggccaacguggaagggucca

SEQ ID NO: 738887 - RNA, 22 nt, Human
uucucuaagaguuauaugaauu

SEQ ID NO: 738888 - RNA, 22 nt, Human
cguguaugauaaauguuaauaa

SEQ ID NO: 738889 - RNA, 22 nt, Human
cacugcccuuacaugcccugca

SEQ ID NO: 738890 - RNA, 20 nt, Human
auuccauaguuggcacuuuu

SEQ ID NO: 738891 - RNA, 22 nt, Human
ccaggcucugcaaaaucaggcu

SEQ ID NO: 738892 - RNA, 22 nt, Human
uuucuauuuacagugcuaggua

SEQ ID NO: 738893 - RNA, 22 nt, Human
auacaaugauugguucucaccc

SEQ ID NO: 738894 - RNA, 22 nt, Human
accauuaagaaucugguuuccu

SEQ ID NO: 738895 - RNA, 22 nt, Human
ugugaugucagugguaucaaag

SEQ ID NO: 738896 - RNA, 22 nt, Human
ugggauguggccaugguucucu

SEQ ID NO: 738897 - RNA, 22 nt, Human
uggcugcuuaaaauugcugcaa

SEQ ID NO: 738898 - RNA, 22 nt, Human
ucaaggacuauugcaugacucc

SEQ ID NO: 738899 - RNA, 21 nt, Human
ccugccaggaaacugaguguc

SEQ ID NO: 738900 - RNA, 22 nt, Human
cagcaucuccauggcuuuggag

SEQ ID NO: 738901 - RNA, 22 nt, Human
uaaaguauauuuuuucucaaua

SEQ ID NO: 738902 - RNA, 22 nt, Human
ucugcaugaugaacaaaugagc

SEQ ID NO: 738903 - RNA, 20 nt, Human
aacagggcagaagcggagac

SEQ ID NO: 738904 - RNA, 22 nt, Human
gagcucccuggagguucagaua

SEQ ID NO: 738905 - RNA, 22 nt, Human
acaguaagcgggguuggagggc

SEQ ID NO: 738906 - RNA, 22 nt, Human
ucuggcuuuccuggagcaagaa

SEQ ID NO: 738907 - RNA, 22 nt, Human
auacaugucaucauauguuugu

SEQ ID NO: 738908 - RNA, 22 nt, Human
ucaguguuuacaugcauccuug

SEQ ID NO: 738909 - RNA, 22 nt, Human
auuuucagaacauucauucacu

SEQ ID NO: 738910 - RNA, 22 nt, Human
uggacucaccuugaguuagcca

SEQ ID NO: 738911 - RNA, 22 nt, Human
gggcugggauugcuugcuguga

SEQ ID NO: 738912 - RNA, 22 nt, Human
guggcagcugugggacacuggu

SEQ ID NO: 738913 - RNA, 22 nt, Human
uggcuucaucugcagcacugcc

SEQ ID NO: 738914 - RNA, 22 nt, Human
acagaauuugcuugggcaaugg

SEQ ID NO: 738915 - RNA, 22 nt, Human
ccuggcuuagagguugccuuuc

SEQ ID NO: 738916 - RNA, 22 nt, Human
cucggaauggaacaacagcggu

SEQ ID NO: 738917 - RNA, 22 nt, Human
gacauuucaaucucauuauggg

SEQ ID NO: 738918 - RNA, 18 nt, Human
ggcuccagucuucagugg

SEQ ID NO: 738919 - RNA, 22 nt, Human
ccaggcuuucccagccucucca

SEQ ID NO: 738920 - RNA, 22 nt, Human
augcaucauggaaaacucaguu

SEQ ID NO: 738921 - RNA, 22 nt, Human
acagggcaugugcaagagacau

SEQ ID NO: 738922 - RNA, 22 nt, Human
acaggcugaggaugauugcauc

SEQ ID NO: 738923 - RNA, 22 nt, Human
gacacagagggcaccagauaug

SEQ ID NO: 738924 - RNA, 22 nt, Human
ucagggaauaaguagaugagug

SEQ ID NO: 738925 - RNA, 22 nt, Human
acagcaguggauuagaggaugg

SEQ ID NO: 738926 - RNA, 18 nt, Human
cucaggccuuucccugug

SEQ ID NO: 738927 - RNA, 22 nt, Human
gaaucaaaucaaguucuuuuga

SEQ ID NO: 738928 - RNA, 22 nt, Human
gaaagcaauuuguguaaucugu

SEQ ID NO: 738929 - RNA, 22 nt, Human
cuucugaggacucuaaagagga

SEQ ID NO: 738930 - RNA, 23 nt, Human
acauuacacgcaguaauugcccc

SEQ ID NO: 738931 - RNA, 22 nt, Human
agcaggaggagagccuggcggu

SEQ ID NO: 738932 - RNA, 23 nt, Human
ccaggcaguagcuauugaaguga

SEQ ID NO: 738933 - RNA, 19 nt, Human
uuccccuccccagggauag

SEQ ID NO: 738934 - RNA, 22 nt, Human
aucaguuuaacugucaagagcc

SEQ ID NO: 738935 - RNA, 22 nt, Human
ugggagcagcugggaacacagc

SEQ ID NO: 738936 - RNA, 19 nt, Human
ugugaaagcuaguguucuu

SEQ ID NO: 738937 - RNA, 22 nt, Human
cagagcccugugugccauguga

SEQ ID NO: 738938 - RNA, 22 nt, Human
caguggccugagccaggcuucc

SEQ ID NO: 738939 - RNA, 22 nt, Human
cugccugugccaaugcuccuuu

SEQ ID NO: 738940 - RNA, 18 nt, Human
gagggaguagcugagguu

SEQ ID NO: 738941 - RNA, 19 nt, Human
ucagacugaaaguuuagau

SEQ ID NO: 738942 - RNA, 22 nt, Human
gggguggccaaggacucugacc

SEQ ID NO: 738943 - RNA, 21 nt, Human
aaaaugugagcgugaugcuua

SEQ ID NO: 738944 - RNA, 22 nt, Human
uauuucaagaacuucuauccau

SEQ ID NO: 738945 - RNA, 20 nt, Human
ggcugaaaguagaaaguauu

SEQ ID NO: 738946 - RNA, 22 nt, Human
cucagagagggcaccagggcca

SEQ ID NO: 738947 - RNA, 22 nt, Human
aagaugcacaauguggcaauua

SEQ ID NO: 738948 - RNA, 22 nt, Human
ucucacaccgucccuaaaccau

SEQ ID NO: 738949 - RNA, 22 nt, Human
uuugggcaauucagugggaccu

SEQ ID NO: 738950 - RNA, 22 nt, Human
ucucugaaggcuguguugaugg

SEQ ID NO: 738951 - RNA, 18 nt, Human
aggcacuggaauuaaggg

SEQ ID NO: 738952 - RNA, 22 nt, Human
gcuaggagauugagcucugaag

SEQ ID NO: 738953 - RNA, 21 nt, Human
agagagaaggccauauggucc

SEQ ID NO: 738954 - RNA, 22 nt, Human
ugggggagcgacagacauaauu

SEQ ID NO: 738955 - RNA, 22 nt, Human
aggcagugagugugacuucaca

SEQ ID NO: 738956 - RNA, 22 nt, Human
aagucuguuugagugucacacu

SEQ ID NO: 738957 - RNA, 22 nt, Human
aaagcucaucauuaggaggcua

SEQ ID NO: 738958 - RNA, 22 nt, Human
uugcugaugcccuuguccaggc

SEQ ID NO: 738959 - RNA, 22 nt, Human
ucuggcuuggcgcugcccucug

SEQ ID NO: 738960 - RNA, 22 nt, Human
guggcagagggugagcuggacu

SEQ ID NO: 738961 - RNA, 22 nt, Human
uaaggcacacaguugcugcaug

SEQ ID NO: 738962 - RNA, 22 nt, Human
uaaagucaucuuuacaucuuug

SEQ ID NO: 738963 - RNA, 22 nt, Human
cugagcugggagccuggcacca

SEQ ID NO: 738964 - RNA, 22 nt, Human
uaggaaacaaaguaaugcaacu

SEQ ID NO: 738965 - RNA, 22 nt, Human
ccugcccacagagagggugcau

SEQ ID NO: 738966 - RNA, 22 nt, Human
agcuucauuccagccacuguga

SEQ ID NO: 738967 - RNA, 22 nt, Human
ucugaggucucaugacuugcau

SEQ ID NO: 738968 - RNA, 22 nt, Human
ccugccaggccagugagcuucc

SEQ ID NO: 738969 - RNA, 20 nt, Human
cuggcaggagcgagucuacc

SEQ ID NO: 738970 - RNA, 22 nt, Human
ggacuuuagcagcuggagagga

SEQ ID NO: 738971 - RNA, 22 nt, Human
ucuuccagcccuucuaauggua

SEQ ID NO: 738972 - RNA, 22 nt, Human
ugucacauaggcaaaauguuuu

SEQ ID NO: 738973 - RNA, 22 nt, Human
uugaaucuauaauuucaguauu

SEQ ID NO: 738974 - RNA, 22 nt, Human
ccugccucaggacucugcauau

SEQ ID NO: 738975 - RNA, 22 nt, Human
uuuguguuuaugaaguuauucu

SEQ ID NO: 738976 - RNA, 22 nt, Human
agcacuagcuuuaagcauucug

SEQ ID NO: 738977 - RNA, 20 nt, Human
guuaaaagaguaauuugagg

SEQ ID NO: 738978 - RNA, 22 nt, Human
uucugugaauggccaugacaag

SEQ ID NO: 738979 - RNA, 22 nt, Human
uucugcaucugaauuuaaguac

SEQ ID NO: 738980 - RNA, 23 nt, Human
aaguucaagucacagccugucuu

SEQ ID NO: 738981 - RNA, 22 nt, Human
caggaaggaaaggguguggaga

SEQ ID NO: 738982 - RNA, 22 nt, Human
ugccacaggguccucaggccag

SEQ ID NO: 738983 - RNA, 22 nt, Human
acagugucaugucguguucccc

SEQ ID NO: 738984 - RNA, 22 nt, Human
uucuuugaguuaguacagucca

SEQ ID NO: 738985 - RNA, 22 nt, Human
uggccuuggacagagcgcuccu

SEQ ID NO: 738986 - RNA, 23 nt, Human
cuuugccacccagagccugacag

SEQ ID NO: 738987 - RNA, 22 nt, Human
cugccucuuaaguggauggagu

SEQ ID NO: 738988 - RNA, 22 nt, Human
caguuaauguccuauacaauag

SEQ ID NO: 738989 - RNA, 22 nt, Human
agcagcucggccagucaccagg

SEQ ID NO: 738990 - RNA, 22 nt, Human
uggcuggcccugggagugcaga

SEQ ID NO: 738991 - RNA, 22 nt, Human
agggagcagcagccacaggaug

SEQ ID NO: 738992 - RNA, 22 nt, Human
ggagcagagcugggcuuggcug

SEQ ID NO: 738993 - RNA, 22 nt, Human
ucacaggccuggggcagagggc

SEQ ID NO: 738994 - RNA, 22 nt, Human
gauuuacagguuagguccugua

SEQ ID NO: 738995 - RNA, 22 nt, Human
gggugaggagcugccagucaug

SEQ ID NO: 738996 - RNA, 22 nt, Human
acagagcuguacuacuuacuga

SEQ ID NO: 738997 - RNA, 22 nt, Human
gcacccugucaaaauggaccaa

SEQ ID NO: 738998 - RNA, 20 nt, Human
aggcacuguugucuguaucc

SEQ ID NO: 738999 - RNA, 22 nt, Human
agaugguugucgcaaaugaaug

SEQ ID NO: 739000 - RNA, 22 nt, Human
agugucugccagcugccaggug

SEQ ID NO: 739001 - RNA, 22 nt, Human
gagcaguuuuauuucaugagac

SEQ ID NO: 739002 - RNA, 22 nt, Human
ccucagagacugcaucuucccu

SEQ ID NO: 739003 - RNA, 22 nt, Human
ugucugaagcagccagugcugu

SEQ ID NO: 739004 - RNA, 22 nt, Human
aggucagguaucagcagguauu

SEQ ID NO: 739005 - RNA, 22 nt, Human
aucuuugucacucuacugucua

SEQ ID NO: 739006 - RNA, 22 nt, Human
acauuacagcaaguuuacguua

SEQ ID NO: 739007 - RNA, 22 nt, Human
aaggaggaaaauauuguugcug

SEQ ID NO: 739008 - RNA, 22 nt, Human
gggccaggaguggagauauggg

SEQ ID NO: 739009 - RNA, 22 nt, Human
ccacugucuuuuccaggcugaa

SEQ ID NO: 739010 - RNA, 22 nt, Human
aaucaguuaaauauugaguaca

SEQ ID NO: 739011 - RNA, 22 nt, Human
ggccaugcaggucagagguggg

SEQ ID NO: 739012 - RNA, 22 nt, Human
cccccaccguguuccugcucgg

SEQ ID NO: 739013 - RNA, 22 nt, Human
gucuuuggagaggugccauuuc

SEQ ID NO: 739014 - RNA, 21 nt, Human
uccagccaguaaaugcucagc

SEQ ID NO: 739015 - RNA, 22 nt, Human
cuuggggcuuuguguguaggau

SEQ ID NO: 739016 - RNA, 22 nt, Human
aaccucucugugcccugacuuu

SEQ ID NO: 739017 - RNA, 22 nt, Human
ugaucaaaacauuacuccacca

SEQ ID NO: 739018 - RNA, 22 nt, Human
cagaauaaagguacaauugagu

SEQ ID NO: 739019 - RNA, 22 nt, Human
ggcuccagaaacuucaguccau

SEQ ID NO: 739020 - RNA, 23 nt, Human
ugggucagcugccuccaggacaa

SEQ ID NO: 739021 - RNA, 22 nt, Human
uggcaguccagacccuggacuc

SEQ ID NO: 739022 - RNA, 22 nt, Human
gaggccacagugucugggggcc

SEQ ID NO: 739023 - RNA, 22 nt, Human
ucuuggcugcugccaauuuacu

SEQ ID NO: 739024 - RNA, 22 nt, Human
ucuggcauuucaggcaucuaua

SEQ ID NO: 739025 - RNA, 19 nt, Human
ugcuauuuagaacgccugg

SEQ ID NO: 739026 - RNA, 22 nt, Human
agcugccuucccucucauuagg

SEQ ID NO: 739027 - RNA, 22 nt, Human
agcauacuugacacuucucuau

SEQ ID NO: 739028 - RNA, 22 nt, Human
uauuugcugugcuuauuccauu

SEQ ID NO: 739029 - RNA, 22 nt, Human
agcauagaaaagauucccagag

SEQ ID NO: 739030 - RNA, 22 nt, Human
acccugcuuuaugccguccucu

SEQ ID NO: 739031 - RNA, 22 nt, Human
acaugggggcugcugccagcga

SEQ ID NO: 739032 - RNA, 23 nt, Human
auggacaggguuucagggucaca

SEQ ID NO: 739033 - RNA, 22 nt, Human
gaagcccagcaaacugugauca

SEQ ID NO: 739034 - RNA, 22 nt, Human
uggaggagaacucccuggcuac

SEQ ID NO: 739035 - RNA, 22 nt, Human
ccagaugugagcagagccuuga

SEQ ID NO: 739036 - RNA, 22 nt, Human
acacacuugcagagaggaggga

SEQ ID NO: 739037 - RNA, 22 nt, Human
cacagagacagaucuauuuugc

SEQ ID NO: 739038 - RNA, 22 nt, Human
auuucuuaaaacuucagggaga

SEQ ID NO: 739039 - RNA, 22 nt, Human
gaacacuguuucuucgugaaca

SEQ ID NO: 739040 - RNA, 22 nt, Human
cuucaaauacaaguagauuaug

SEQ ID NO: 739041 - RNA, 22 nt, Human
aggucaaaagcaaggccagguu

SEQ ID NO: 739042 - RNA, 22 nt, Human
gcccagugguaaaagcaggccu

SEQ ID NO: 739043 - RNA, 22 nt, Human
ccugggcuuuggaacaguacuu

SEQ ID NO: 739044 - RNA, 22 nt, Human
agccaggccagacucacacccu

SEQ ID NO: 739045 - RNA, 22 nt, Human
agcugugugguuugggcaaauu

SEQ ID NO: 739046 - RNA, 22 nt, Human
cagaguaaggagcugucaaacg

SEQ ID NO: 739047 - RNA, 22 nt, Human
ccuguuccauucauauccuauu

SEQ ID NO: 739048 - RNA, 22 nt, Human
ugucucuggcccaugagcagag

SEQ ID NO: 739049 - RNA, 22 nt, Human
agggaaaucuuucaacacuuca

SEQ ID NO: 739050 - RNA, 22 nt, Human
ggccccaguucacuccuggccg

SEQ ID NO: 739051 - RNA, 22 nt, Human
auuuguaacacgugacagguug

SEQ ID NO: 739052 - RNA, 22 nt, Human
auagcauauaaguuauaaaacu

SEQ ID NO: 739053 - RNA, 22 nt, Human
gagguggucgaggagggguacc

SEQ ID NO: 739054 - RNA, 22 nt, Human
aaaauacuacugucuucuuccc

SEQ ID NO: 739055 - RNA, 22 nt, Human
uccaauuuguuugaugauggaa

SEQ ID NO: 739056 - RNA, 22 nt, Human
aacuagucagugauucucagaa

SEQ ID NO: 739057 - RNA, 22 nt, Human
ggaggcauuauggggaagacuu

SEQ ID NO: 739058 - RNA, 20 nt, Human
accugggaaaaccuuuuccu

SEQ ID NO: 739059 - RNA, 22 nt, Human
uagaaaguaaacacgaagucuc

SEQ ID NO: 739060 - RNA, 22 nt, Human
ucucacugggucacagcagagg

SEQ ID NO: 739061 - RNA, 22 nt, Human
cccagcagccuggauguucuuu

SEQ ID NO: 739062 - RNA, 22 nt, Human
cugcuccaggauuucaggccag

SEQ ID NO: 739063 - RNA, 22 nt, Human
ugcguuauugugucuggcuaug

SEQ ID NO: 739064 - RNA, 22 nt, Human
uugauuucuuacucuuccaagg

SEQ ID NO: 739065 - RNA, 22 nt, Human
ucuaccacuaagugugcuuuga

SEQ ID NO: 739066 - RNA, 22 nt, Human
augcacagcagugaguucagug

SEQ ID NO: 739067 - RNA, 21 nt, Human
uuggaauuugggagcuaugug

SEQ ID NO: 739068 - RNA, 22 nt, Human
agagccugugauugucaucacc

SEQ ID NO: 739069 - RNA, 22 nt, Human
caaagagcuguucagugucgcu

SEQ ID NO: 739070 - RNA, 22 nt, Human
uggcuccaugauaguucuuaca

SEQ ID NO: 739071 - RNA, 22 nt, Human
cagggcccauggcucagguagg

SEQ ID NO: 739072 - RNA, 22 nt, Human
uauguacaguccuuaacuuaaa

SEQ ID NO: 739073 - RNA, 22 nt, Human
uagcuaucuguguccagaucca

SEQ ID NO: 739074 - RNA, 22 nt, Human
uccucuccaugucucacgccac

SEQ ID NO: 739075 - RNA, 22 nt, Human
auggaaugugaacaugauggca

SEQ ID NO: 739076 - RNA, 22 nt, Human
aaacaguuuugccaaaaggaca

SEQ ID NO: 739077 - RNA, 22 nt, Human
cccagcaugcacgcugacacuc

SEQ ID NO: 739078 - RNA, 22 nt, Human
ugcugggggcuuucuggauacc

SEQ ID NO: 739079 - RNA, 22 nt, Human
ucagagugugacuuggucauga

SEQ ID NO: 739080 - RNA, 22 nt, Human
cagggcuggguuaaaagcaggg

SEQ ID NO: 739081 - RNA, 22 nt, Human
uaggguaguaccaugcugccag

SEQ ID NO: 739082 - RNA, 19 nt, Human
uccaauuucuauucauguu

SEQ ID NO: 739083 - RNA, 22 nt, Human
agcugggcaccccgcugcgucu

SEQ ID NO: 739084 - RNA, 22 nt, Human
gcuuacaaucauuucaguuuag

SEQ ID NO: 739085 - RNA, 20 nt, Human
ccucugccuuucuagucuga

SEQ ID NO: 739086 - RNA, 22 nt, Human
ccagagacaaggagcuggaguc

SEQ ID NO: 739087 - RNA, 22 nt, Human
uguccugugucuaggggucuuc

SEQ ID NO: 739088 - RNA, 22 nt, Human
aaacaagagcuuacauggcugc

SEQ ID NO: 739089 - RNA, 22 nt, Human
uaacacaugguucugucaggaa

SEQ ID NO: 739090 - RNA, 22 nt, Human
ggucagaacaagcaaauaauag

SEQ ID NO: 739091 - RNA, 22 nt, Human
uccaggaggaggaaggcugcca

SEQ ID NO: 739092 - RNA, 22 nt, Human
ucauaaugacaaacauacucag

SEQ ID NO: 739093 - RNA, 22 nt, Human
gccacccuugcgucacugacau

SEQ ID NO: 739094 - RNA, 22 nt, Human
acucuuuuaugcauuccuucag

SEQ ID NO: 739095 - RNA, 22 nt, Human
uauguggccauucuguuugugu

SEQ ID NO: 739096 - RNA, 22 nt, Human
uacauucagcaaaagaaugguu

SEQ ID NO: 739097 - RNA, 22 nt, Human
uggaggaggaacuucuuaucuc

SEQ ID NO: 739098 - RNA, 22 nt, Human
uuauaagacuguagugaguauu

SEQ ID NO: 739099 - RNA, 22 nt, Human
ucaguuuccucaucuacaaaag

SEQ ID NO: 739100 - RNA, 22 nt, Human
cuggccaguugccuuccugggu

SEQ ID NO: 739101 - RNA, 22 nt, Human
auagaacagggcacugucauga

SEQ ID NO: 739102 - RNA, 22 nt, Human
aagugcuugaucauaguucuca

SEQ ID NO: 739103 - RNA, 22 nt, Human
agaagccauguuuaguaggaug

SEQ ID NO: 739104 - RNA, 22 nt, Human
uucauuacugcgguagucacac

SEQ ID NO: 739105 - RNA, 22 nt, Human
aagggcuccauccuuauaaaug

SEQ ID NO: 739106 - RNA, 22 nt, Human
cccugcagaccaaugccauaga

SEQ ID NO: 739107 - RNA, 22 nt, Human
caguuucccugcuugaaaacgu

SEQ ID NO: 739108 - RNA, 22 nt, Human
agaauuacauaaauacaugaau

SEQ ID NO: 739109 - RNA, 22 nt, Human
agguccugugguuuggguaaaa

SEQ ID NO: 739110 - RNA, 22 nt, Human
cccaggguccggauaacccugg

SEQ ID NO: 739111 - RNA, 22 nt, Human
uugccuagaguugcacaucugg

SEQ ID NO: 739112 - RNA, 21 nt, Human
cagcucugagauuucuacuag

SEQ ID NO: 739113 - RNA, 22 nt, Human
ccuccugggccuugcucuguga

SEQ ID NO: 739114 - RNA, 22 nt, Human
ucuccaggugacucugauguau

SEQ ID NO: 739115 - RNA, 22 nt, Human
ucugugcggucuguguuaugaa

SEQ ID NO: 739116 - RNA, 17 nt, Human
cucagcugaaccccaga

SEQ ID NO: 739117 - RNA, 22 nt, Human
acuggcccuugauugcaucagc

SEQ ID NO: 739118 - RNA, 22 nt, Human
uaucugucaccuguaggguagg

SEQ ID NO: 739119 - RNA, 22 nt, Human
agcccuggagcaaaggugucuu

SEQ ID NO: 739120 - RNA, 22 nt, Human
uuggaagaguagaguugaauaa

SEQ ID NO: 739121 - RNA, 22 nt, Human
uuugcaaaguuauuuagacuca

SEQ ID NO: 739122 - RNA, 22 nt, Human
ugcugggcacugucuagguacu

SEQ ID NO: 739123 - RNA, 22 nt, Human
caaaccuugcagaacugggcag

SEQ ID NO: 739124 - RNA, 23 nt, Human
acuucauggcacugucuuagagg

SEQ ID NO: 739125 - RNA, 22 nt, Human
cugugucuucugcuuacagucu

SEQ ID NO: 739126 - RNA, 23 nt, Human
uucuaaccuuaaagcccuuugga

SEQ ID NO: 739127 - RNA, 22 nt, Human
gcugcaccagcuccaccagggc

SEQ ID NO: 739128 - RNA, 22 nt, Human
caggaaccaggagagucccuga

SEQ ID NO: 739129 - RNA, 22 nt, Human
cuagggaaugagagacuggauc

SEQ ID NO: 739130 - RNA, 22 nt, Human
uggggacaggagacuuacagcu

SEQ ID NO: 739131 - RNA, 22 nt, Human
uggaaacaucucugccuuuauu

SEQ ID NO: 739132 - RNA, 21 nt, Human
uuucuggguggcugcauagug

SEQ ID NO: 739133 - RNA, 22 nt, Human
accagcuccaggccccugcuga

SEQ ID NO: 739134 - RNA, 22 nt, Human
aguucuuuguaaaaggucucua

SEQ ID NO: 739135 - RNA, 22 nt, Human
uuagcuuucuuuggcagacgug

SEQ ID NO: 739136 - RNA, 22 nt, Human
ucuuugaccaaauuauccuguu

SEQ ID NO: 739137 - RNA, 22 nt, Human
aacaguaaugugguguuggguu

SEQ ID NO: 739138 - RNA, 22 nt, Human
gcacauccaaugauuguuuuga

SEQ ID NO: 739139 - RNA, 23 nt, Human
gcugccucuguuggucuucaguu

SEQ ID NO: 739140 - RNA, 22 nt, Human
cagugaguugugcugaggacca

SEQ ID NO: 739141 - RNA, 22 nt, Human
gagaaaccgauucugcauguca

SEQ ID NO: 739142 - RNA, 22 nt, Human
cuaaacuuuguuuauacucuga

SEQ ID NO: 739143 - RNA, 22 nt, Human
ggaaggggucaccuccugauga

SEQ ID NO: 739144 - RNA, 22 nt, Human
aguguaagugaucauugauagu

SEQ ID NO: 739145 - RNA, 15 nt, Human
uucaggauaugacuc

SEQ ID NO: 739146 - RNA, 22 nt, Human
uguuuaaugaagaugguuuuuc

SEQ ID NO: 739147 - RNA, 22 nt, Human
aagauuuccuucaguagagcua

SEQ ID NO: 739148 - RNA, 22 nt, Human
uaauuguacucccugugggaaa

SEQ ID NO: 739149 - RNA, 22 nt, Human
cugcuuuagcuagugcucuuag

SEQ ID NO: 739150 - RNA, 22 nt, Human
uauggcuuuaaacuuuucauuu

SEQ ID NO: 739151 - RNA, 22 nt, Human
uuccacucuacacacugcuggc

SEQ ID NO: 739152 - RNA, 17 nt, Human
cagugaggccuuuccuc

SEQ ID NO: 739153 - RNA, 19 nt, Human
ccaggccaucccaguuccc

SEQ ID NO: 739154 - RNA, 22 nt, Human
gaaagccagagagaaagggcuc

SEQ ID NO: 739155 - RNA, 22 nt, Human
guuuccaggcgauaucagcugc

SEQ ID NO: 739156 - RNA, 22 nt, Human
ggacauuuagaacagaguauuu

SEQ ID NO: 739157 - RNA, 22 nt, Human
uauguagguaaacacagacaua

SEQ ID NO: 739158 - RNA, 21 nt, Human
uagaaaucagcuggugccucu

SEQ ID NO: 739159 - RNA, 22 nt, Human
ucucuaaagccuggaagaggag

SEQ ID NO: 739160 - RNA, 22 nt, Human
aaagaucuccccuucaaagagu

SEQ ID NO: 739161 - RNA, 22 nt, Human
gucuauauauugcuugaauaau

SEQ ID NO: 739162 - RNA, 22 nt, Human
aacuacaguaguuugcccuucu

SEQ ID NO: 739163 - RNA, 22 nt, Human
aauacugucuuucacagauauu

SEQ ID NO: 739164 - RNA, 22 nt, Human
gcugcccaggagagguggggcu

SEQ ID NO: 739165 - RNA, 22 nt, Human
ugcauugggagucagugcugaa

SEQ ID NO: 739166 - RNA, 22 nt, Human
acagaggcagugugagauacug

SEQ ID NO: 739167 - RNA, 22 nt, Human
augaaggauagggcaaaauuuu

SEQ ID NO: 739168 - RNA, 22 nt, Human
agccacagcuccuugguggaga

SEQ ID NO: 739169 - RNA, 22 nt, Human
agagcacugcugauuuacaguc

SEQ ID NO: 739170 - RNA, 22 nt, Human
aaacuuuuauaaagcugcagau

SEQ ID NO: 739171 - RNA, 22 nt, Human
aacccuggagaaggcuuuggau

SEQ ID NO: 739172 - RNA, 22 nt, Human
ugaacccugaccucuggaagga

SEQ ID NO: 739173 - RNA, 22 nt, Human
gaaacauucagucaacaguguu

SEQ ID NO: 739174 - RNA, 23 nt, Human
cagugcugguucugccugugggg

SEQ ID NO: 739175 - RNA, 22 nt, Human
cagaaacuguggauucauuaaa

SEQ ID NO: 739176 - RNA, 22 nt, Human
cacuuaaauguuccuacagcag

SEQ ID NO: 739177 - RNA, 22 nt, Human
ucuuuguaagaaauucuuccgu

SEQ ID NO: 739178 - RNA, 22 nt, Human
uauguucugacucuacauggga

SEQ ID NO: 739179 - RNA, 22 nt, Human
guguaacuugcuggaaaaacua

SEQ ID NO: 739180 - RNA, 22 nt, Human
cuguagcugggccucggcagug

SEQ ID NO: 739181 - RNA, 22 nt, Human
ucucccaggcugcccuguggac

SEQ ID NO: 739182 - RNA, 22 nt, Human
ucucugggcccagaccuuccuu

SEQ ID NO: 739183 - RNA, 22 nt, Human
uaccugagaagaaacccguguu

SEQ ID NO: 739184 - RNA, 22 nt, Human
uuggagagauuuaggucucagu

SEQ ID NO: 739185 - RNA, 22 nt, Human
aguugcagccuucaggagaccc

SEQ ID NO: 739186 - RNA, 22 nt, Human
caggcucuagguuaguaggaga

SEQ ID NO: 739187 - RNA, 22 nt, Human
cuggccacugcaccucuuccuu

SEQ ID NO: 739188 - RNA, 22 nt, Human
ggcugaguucucuugcugaauc

SEQ ID NO: 739189 - RNA, 22 nt, Human
agcaagcugucaagagagcuga

SEQ ID NO: 739190 - RNA, 20 nt, Human
auguagcagugugcugggaa

SEQ ID NO: 739191 - RNA, 22 nt, Human
uucauucuuuuacaugugaaua

SEQ ID NO: 739192 - RNA, 22 nt, Human
cugagcugguggaagcaugcag

SEQ ID NO: 739193 - RNA, 21 nt, Human
ggccccagcccauggguucuc

SEQ ID NO: 739194 - RNA, 22 nt, Human
aaauuaucaugauuauugugua

SEQ ID NO: 739195 - RNA, 22 nt, Human
uaacucuuccaacacuccuucc

SEQ ID NO: 739196 - RNA, 22 nt, Human
ugcagggaacuuggacagcuag

SEQ ID NO: 739197 - RNA, 22 nt, Human
aggcaaaauaagccucuccugu

SEQ ID NO: 739198 - RNA, 22 nt, Human
gccaugggcaaaugcagagcug

SEQ ID NO: 739199 - RNA, 20 nt, Human
agaagaggauacaaccaggc

SEQ ID NO: 739200 - RNA, 22 nt, Human
uggguccuugcuggcuucaaag

SEQ ID NO: 739201 - RNA, 22 nt, Human
aacacugaguaucagaguuggg

SEQ ID NO: 739202 - RNA, 22 nt, Human
uccacagcuguccuguaacagg

SEQ ID NO: 739203 - RNA, 22 nt, Human
cuguggcugcgccaucgaaaac

SEQ ID NO: 739204 - RNA, 22 nt, Human
aggccagcuaugacucugcucc

SEQ ID NO: 739205 - RNA, 22 nt, Human
ggagggcucaauugacuccuga

SEQ ID NO: 739206 - RNA, 22 nt, Human
uuucuagacauuucuauguaca

SEQ ID NO: 739207 - RNA, 22 nt, Human
augccagccucuaagcacuuua

SEQ ID NO: 739208 - RNA, 22 nt, Human
uauguguuugacacccugcaag

SEQ ID NO: 739209 - RNA, 22 nt, Human
ccugaaauccauaguuuacacu

SEQ ID NO: 739210 - RNA, 22 nt, Human
aaaauuauggaguaucccaaag

SEQ ID NO: 739211 - RNA, 22 nt, Human
uuauccuggauuauauauguga

SEQ ID NO: 739212 - RNA, 22 nt, Human
gaggagagggcugcgggcccac

SEQ ID NO: 739213 - RNA, 22 nt, Human
uacacauucuagggcacaguua

SEQ ID NO: 739214 - RNA, 22 nt, Human
gcuggcagguccaagauagagc

SEQ ID NO: 739215 - RNA, 22 nt, Human
cugaggcaguuuaauuuuugaa

SEQ ID NO: 739216 - RNA, 22 nt, Human
uuuauuguguugaaacugaauu

SEQ ID NO: 739217 - RNA, 22 nt, Human
uucucugguuugcuguuucuga

SEQ ID NO: 739218 - RNA, 22 nt, Human
uggcaggagccugcggggaggu

SEQ ID NO: 739219 - RNA, 22 nt, Human
auauguguauuugguuagccua

SEQ ID NO: 739220 - RNA, 20 nt, Human
aggguggcaaguuagugaca

SEQ ID NO: 739221 - RNA, 22 nt, Human
agcuuugggauucaggcaggaa

SEQ ID NO: 739222 - RNA, 22 nt, Human
uuuacagugucuuguugacugu

SEQ ID NO: 739223 - RNA, 22 nt, Human
cuaacuuuagcuuagauuauca

SEQ ID NO: 739224 - RNA, 22 nt, Human
cucuggggaagcagccagcugg

SEQ ID NO: 739225 - RNA, 22 nt, Human
gaggcccacagggaguaccaag

SEQ ID NO: 739226 - RNA, 22 nt, Human
gcagauggcucagacacugggg

SEQ ID NO: 739227 - RNA, 22 nt, Human
ucuccaggcacuaccuggguaa

SEQ ID NO: 739228 - RNA, 22 nt, Human
agucucuuacccaagcagaaug

SEQ ID NO: 739229 - RNA, 22 nt, Human
uaugcauacaaugagauauucc

SEQ ID NO: 739230 - RNA, 22 nt, Human
uagaaauguaggcuuccugaca

SEQ ID NO: 739231 - RNA, 22 nt, Human
gcuggauuggagcaauagaguc

SEQ ID NO: 739232 - RNA, 22 nt, Human
ucuggguuggguuccuggaauu

SEQ ID NO: 739233 - RNA, 22 nt, Human
uaguggaguagaaaccaaagaa

SEQ ID NO: 739234 - RNA, 16 nt, Human
auuuccagauuaugca

SEQ ID NO: 739235 - RNA, 19 nt, Human
gccacaggaugaaguuugg

SEQ ID NO: 739236 - RNA, 22 nt, Human
ucccagcccagauuugugugac

SEQ ID NO: 739237 - RNA, 22 nt, Human
cuaggugauccacugcucucuu

SEQ ID NO: 739238 - RNA, 22 nt, Human
cacaugugugcugaggacugug

SEQ ID NO: 739239 - RNA, 22 nt, Human
gcaggccacugucuccucuggg

SEQ ID NO: 739240 - RNA, 22 nt, Human
cagcuuccccccgggcuugaga

SEQ ID NO: 739241 - RNA, 22 nt, Human
ucccaggaaugucugaaaguga

SEQ ID NO: 739242 - RNA, 22 nt, Human
gaguggguaaaggugcuuggcu

SEQ ID NO: 739243 - RNA, 22 nt, Human
uaugacagugaaaaaaaucaga

SEQ ID NO: 739244 - RNA, 22 nt, Human
gauuucuucauuuguggugaau

SEQ ID NO: 739245 - RNA, 19 nt, Human
uuugucucugaauaauauu

SEQ ID NO: 739246 - RNA, 22 nt, Human
ucacugcaaccucugccuuccg

SEQ ID NO: 739247 - RNA, 22 nt, Human
cugguggagaugccuggccccu

SEQ ID NO: 739248 - RNA, 22 nt, Human
acacugugcagauucccuguga

SEQ ID NO: 739249 - RNA, 22 nt, Human
agcugucuaccugcagaguccu

SEQ ID NO: 739250 - RNA, 22 nt, Human
gccagagaggcaaauccuagca

SEQ ID NO: 739251 - RNA, 22 nt, Human
uacacuuuucugguuacucuug

SEQ ID NO: 739252 - RNA, 22 nt, Human
caagaauuguacaaacugggug

SEQ ID NO: 739253 - RNA, 22 nt, Human
ccugccagcccccauagagaca

SEQ ID NO: 739254 - RNA, 22 nt, Human
aaaauaguuaacguucagagua

SEQ ID NO: 739255 - RNA, 22 nt, Human
agcugccaaguuucucaguuua

SEQ ID NO: 739256 - RNA, 22 nt, Human
gccaggcuggcaaaaggaaacc

SEQ ID NO: 739257 - RNA, 22 nt, Human
ugacacaguagaaagaugauga

SEQ ID NO: 739258 - RNA, 22 nt, Human
uuccucuggggccaggccaaca

SEQ ID NO: 739259 - RNA, 22 nt, Human
ugugaagauagcuguuacaucu

SEQ ID NO: 739260 - RNA, 22 nt, Human
aaauugaauuugggaaacauug

SEQ ID NO: 739261 - RNA, 22 nt, Human
gccugcuuugugccugaucuuu

SEQ ID NO: 739262 - RNA, 22 nt, Human
agcaggcuaagggaccuguuua

SEQ ID NO: 739263 - RNA, 22 nt, Human
ucaggcugcuggccagcaggcu

SEQ ID NO: 739264 - RNA, 22 nt, Human
uuucugauaauuuugugaaauc

SEQ ID NO: 739265 - RNA, 22 nt, Human
gcucuggcagcugauauuagga

SEQ ID NO: 739266 - RNA, 22 nt, Human
gcugggcagccuggccgcugcc

SEQ ID NO: 739267 - RNA, 22 nt, Human
ucaggagacaaagggugcggag

SEQ ID NO: 739268 - RNA, 22 nt, Human
acuucacauuagcuaaaaggga

SEQ ID NO: 739269 - RNA, 22 nt, Human
auagacaaugguuugccaagaa

SEQ ID NO: 739270 - RNA, 18 nt, Human
gagcccugggagaucucu

SEQ ID NO: 739271 - RNA, 22 nt, Human
uuggaaaagugaaacuagaugc

SEQ ID NO: 739272 - RNA, 22 nt, Human
aggcagguuggugagaagacug

SEQ ID NO: 739273 - RNA, 22 nt, Human
gacacugucccacagaauucga

SEQ ID NO: 739274 - RNA, 22 nt, Human
gcucagagaguuucacaaguuu

SEQ ID NO: 739275 - RNA, 22 nt, Human
cuuaaaguauugguuuaaccaa

SEQ ID NO: 739276 - RNA, 22 nt, Human
uuccugguuuauaccuguauca

SEQ ID NO: 739277 - RNA, 22 nt, Human
agaaacuauccugaguagcaaa

SEQ ID NO: 739278 - RNA, 22 nt, Human
aaauuagauaugugugagacuc

SEQ ID NO: 739279 - RNA, 22 nt, Human
cccucagcucaagccccugugc

SEQ ID NO: 739280 - RNA, 22 nt, Human
ucagccaugucaggggaaugac

SEQ ID NO: 739281 - RNA, 22 nt, Human
agcugcaggagucgccuaggau

SEQ ID NO: 739282 - RNA, 22 nt, Human
auuuagacaccagcuuguaagg

SEQ ID NO: 739283 - RNA, 22 nt, Human
ucaugggguuuggcuggauguc

SEQ ID NO: 739284 - RNA, 22 nt, Human
caugcauuguaauuuuuagucu

SEQ ID NO: 739285 - RNA, 22 nt, Human
gagauucugagaaguuaagucc

SEQ ID NO: 739286 - RNA, 22 nt, Human
gcuuuagaucugacuuucugug

SEQ ID NO: 739287 - RNA, 22 nt, Human
cacauuuaauccuuuauaagua

SEQ ID NO: 739288 - RNA, 22 nt, Human
caucagcucuucauucuugauu

SEQ ID NO: 739289 - RNA, 22 nt, Human
cucaggagaugacagaagguau

SEQ ID NO: 739290 - RNA, 17 nt, Human
gcuccagaauucuaguc

SEQ ID NO: 739291 - RNA, 22 nt, Human
uccuggugcugacacccauagc

SEQ ID NO: 739292 - RNA, 22 nt, Human
aagcauuuggcaugaaacucuu

SEQ ID NO: 739293 - RNA, 22 nt, Human
ggaggccagggacccagucagc

SEQ ID NO: 739294 - RNA, 20 nt, Human
ucuggcucuuugcuccuccc

SEQ ID NO: 739295 - RNA, 22 nt, Human
ucaggcagucugacuccggagg

SEQ ID NO: 739296 - RNA, 22 nt, Human
uaaccuuuguucaauguaagau

SEQ ID NO: 739297 - RNA, 22 nt, Human
ugcaccuuuaaauucagcagua

SEQ ID NO: 739298 - RNA, 22 nt, Human
cugcccugccuggccagugugg

SEQ ID NO: 739299 - RNA, 22 nt, Human
agucacagggggccccugcaac

SEQ ID NO: 739300 - RNA, 22 nt, Human
cuccagguugacuucagucaau

SEQ ID NO: 739301 - RNA, 23 nt, Human
uguaacaauuucauauacaugca

SEQ ID NO: 739302 - RNA, 18 nt, Human
ucacauuauaauguaaca

SEQ ID NO: 739303 - RNA, 22 nt, Human
uagaacuucuuacagcuaaguu

SEQ ID NO: 739304 - RNA, 19 nt, Human
ugaagcagcaaacucucag

SEQ ID NO: 739305 - RNA, 22 nt, Human
acagcugugagggucacuugua

SEQ ID NO: 739306 - RNA, 22 nt, Human
uguggccagggggccauguccc

SEQ ID NO: 739307 - RNA, 22 nt, Human
gccaggcacaguucuaggugcu

SEQ ID NO: 739308 - RNA, 22 nt, Human
uucuagcacaagauaugaaagu

SEQ ID NO: 739309 - RNA, 23 nt, Human
aggcacugaaugugucagugagu

SEQ ID NO: 739310 - RNA, 22 nt, Human
uccagcacccaauguggcuaag

SEQ ID NO: 739311 - RNA, 22 nt, Human
uguacauuuucucagaguuuau

SEQ ID NO: 739312 - RNA, 18 nt, Human
guggaggguucucagaau

SEQ ID NO: 739313 - RNA, 22 nt, Human
uuauuuauggcccucaccugau

SEQ ID NO: 739314 - RNA, 22 nt, Human
uauuacagaaucaggcauaacu

SEQ ID NO: 739315 - RNA, 22 nt, Human
agaccaugggcuccugggacau

SEQ ID NO: 739316 - RNA, 22 nt, Human
ucuguagagacgaauguguuau

SEQ ID NO: 739317 - RNA, 22 nt, Human
ugauuacacagcaguaauuuca

SEQ ID NO: 739318 - RNA, 22 nt, Human
acauuccucagugccaguugag

SEQ ID NO: 739319 - RNA, 18 nt, Human
ggccugcagugaagcaag

SEQ ID NO: 739320 - RNA, 22 nt, Human
ccuuuuucccuggagggacagc

SEQ ID NO: 739321 - RNA, 22 nt, Human
gagggcacuggguuucaauguc

SEQ ID NO: 739322 - RNA, 22 nt, Human
uauaucugggaaccaaaggggg

SEQ ID NO: 739323 - RNA, 22 nt, Human
cagguccucacgccucacccuu

SEQ ID NO: 739324 - RNA, 22 nt, Human
auguacauucuucucaccgaag

SEQ ID NO: 739325 - RNA, 22 nt, Human
cauucccuuggggaguucaugc

SEQ ID NO: 739326 - RNA, 22 nt, Human
cuuuauuagauguagacuuucu

SEQ ID NO: 739327 - RNA, 17 nt, Human
cagacaggcugucaccc

SEQ ID NO: 739328 - RNA, 22 nt, Human
cacuugaaguuugggggacucu

SEQ ID NO: 739329 - RNA, 22 nt, Human
cugccaucugagccaaaagugc

SEQ ID NO: 739330 - RNA, 22 nt, Human
aaacacugugggacaucuuacu

SEQ ID NO: 739331 - RNA, 22 nt, Human
aucagcaaggcaaucacugcag

SEQ ID NO: 739332 - RNA, 22 nt, Human
aggucugagaacuaccuauagg

SEQ ID NO: 739333 - RNA, 22 nt, Human
ugagaacaguuggaagcaguca

SEQ ID NO: 739334 - RNA, 22 nt, Human
uuccauaauaggcuuaagugaa

SEQ ID NO: 739335 - RNA, 22 nt, Human
uuguccuggagguuaauagagu

SEQ ID NO: 739336 - RNA, 20 nt, Human
caugauacuuggaagggcuu

SEQ ID NO: 739337 - RNA, 22 nt, Human
agagacugauggagcucacucu

SEQ ID NO: 739338 - RNA, 22 nt, Human
aguggacccggaacagaggccc

SEQ ID NO: 739339 - RNA, 22 nt, Human
cagcuucauugccugaugucuu

SEQ ID NO: 739340 - RNA, 22 nt, Human
acaauguucugucugacuuguc

SEQ ID NO: 739341 - RNA, 22 nt, Human
gcuggcucugcacccaggccuc

SEQ ID NO: 739342 - RNA, 22 nt, Human
agugggccaaauggaggcaagu

SEQ ID NO: 739343 - RNA, 22 nt, Human
gugugccaggaacuggcugcug

SEQ ID NO: 739344 - RNA, 22 nt, Human
agggcagugggaaagccugcuc

SEQ ID NO: 739345 - RNA, 22 nt, Human
aaugcuuauaacguuagaaugu

SEQ ID NO: 739346 - RNA, 22 nt, Human
gcgagugccgagagggcagggc

SEQ ID NO: 739347 - RNA, 22 nt, Human
cucaaggaaagucuggagaaga

SEQ ID NO: 739348 - RNA, 22 nt, Human
ccacaggaaguuaugaguacua

SEQ ID NO: 739349 - RNA, 22 nt, Human
ucaggaggccgugugcucagug

SEQ ID NO: 739350 - RNA, 22 nt, Human
ccuuuucuggccaccaagcgcu

SEQ ID NO: 739351 - RNA, 22 nt, Human
cccaggaugucgaggcugcagu

SEQ ID NO: 739352 - RNA, 22 nt, Human
acauggagaccagauggaagua

SEQ ID NO: 739353 - RNA, 22 nt, Human
aaguucaagucuccugaguaua

SEQ ID NO: 739354 - RNA, 22 nt, Human
agggcagaggcggacacggaag

SEQ ID NO: 739355 - RNA, 22 nt, Human
augaaugagaaacaggugagau

SEQ ID NO: 739356 - RNA, 22 nt, Human
ugcaaauauuccaugcuguuca

SEQ ID NO: 739357 - RNA, 22 nt, Human
cucaagacugaucgcaguggaa

SEQ ID NO: 739358 - RNA, 22 nt, Human
uuauuucauugauuucuaagac

SEQ ID NO: 739359 - RNA, 22 nt, Human
uuucagaaagcaucaucaaagu

SEQ ID NO: 739360 - RNA, 22 nt, Human
aacaauugacacuucauuguga

SEQ ID NO: 739361 - RNA, 22 nt, Human
caaauagacucuagaauuuauu

SEQ ID NO: 739362 - RNA, 23 nt, Human
uuugacagcgugguuucuguggg

SEQ ID NO: 739363 - RNA, 20 nt, Human
agagagagguaaauugagca

SEQ ID NO: 739364 - RNA, 22 nt, Human
cugcccaguuugggagccuuuc

SEQ ID NO: 739365 - RNA, 23 nt, Human
ucacaguaucucuggagccauag

SEQ ID NO: 739366 - RNA, 22 nt, Human
uggccccugaggagcgucagcc

SEQ ID NO: 739367 - RNA, 22 nt, Human
agggagcaugggugaagcaggc

SEQ ID NO: 739368 - RNA, 22 nt, Human
acuuucauguuggugaaggguu

SEQ ID NO: 739369 - RNA, 22 nt, Human
agaaacaucgcuuaguccucau

SEQ ID NO: 739370 - RNA, 22 nt, Human
aauuuagaauucgcuagcuaau

SEQ ID NO: 739371 - RNA, 22 nt, Human
cccugcugucccucaguccugc

SEQ ID NO: 739372 - RNA, 22 nt, Human
caauuucuaacauuccauggau

SEQ ID NO: 739373 - RNA, 22 nt, Human
aagaugugcugucuugccacuc

SEQ ID NO: 739374 - RNA, 22 nt, Human
ccacaagaugcaaacucuaaca

SEQ ID NO: 739375 - RNA, 22 nt, Human
agucaggauuuuggauuauucg

SEQ ID NO: 739376 - RNA, 17 nt, Human
ccagguggaaucgugga

SEQ ID NO: 739377 - RNA, 22 nt, Human
gagaggucaucucccaucagca

SEQ ID NO: 739378 - RNA, 22 nt, Human
gugcagugacccuggagagcug

SEQ ID NO: 739379 - RNA, 22 nt, Human
uaggacuuggugacucucaaug

SEQ ID NO: 739380 - RNA, 19 nt, Human
uccugggcugggccagguc

SEQ ID NO: 739381 - RNA, 22 nt, Human
cagcauccuuugcugguuuccc

SEQ ID NO: 739382 - RNA, 22 nt, Human
agagcugcaauuucauguggug

SEQ ID NO: 739383 - RNA, 22 nt, Human
acugggagggucuugaagaggg

SEQ ID NO: 739384 - RNA, 23 nt, Human
cugaagcaguucccucucugccc

SEQ ID NO: 739385 - RNA, 22 nt, Human
ccuuuggugguuuucagagauc

SEQ ID NO: 739386 - RNA, 17 nt, Human
gcuucuggagcuucugu

SEQ ID NO: 739387 - RNA, 22 nt, Human
gagaaagauuguccuucagggg

SEQ ID NO: 739388 - RNA, 21 nt, Human
caaauacuuagaaacuuaaga

SEQ ID NO: 739389 - RNA, 22 nt, Human
gcagggagguuugcugaccugg

SEQ ID NO: 739390 - RNA, 22 nt, Human
ucuuauucagugggcucugcca

SEQ ID NO: 739391 - RNA, 22 nt, Human
ggcugcuccuuuacccuggcag

SEQ ID NO: 739392 - RNA, 22 nt, Human
aauggcugccagggcaggaggu

SEQ ID NO: 739393 - RNA, 22 nt, Human
cagagccaucccagccuguggu

SEQ ID NO: 739394 - RNA, 22 nt, Human
gcccagggcgauggucggggcc

SEQ ID NO: 739395 - RNA, 22 nt, Human
ucaccagggagcuuguccucug

SEQ ID NO: 739396 - RNA, 20 nt, Human
agagguucagucuggagaag

SEQ ID NO: 739397 - RNA, 22 nt, Human
ugcaaauaaauuucuguucauu

SEQ ID NO: 739398 - RNA, 22 nt, Human
ccuuccagggagcaggcagugu

SEQ ID NO: 739399 - RNA, 22 nt, Human
auacaaaggaacacaggcaugu

SEQ ID NO: 739400 - RNA, 22 nt, Human
gagacacucaacaaagauauga

SEQ ID NO: 739401 - RNA, 22 nt, Human
ucauggaagauguagggucagg

SEQ ID NO: 739402 - RNA, 22 nt, Human
ccccacagccgccagcagggag

SEQ ID NO: 739403 - RNA, 22 nt, Human
ccagcucccugaagccuggucu

SEQ ID NO: 739404 - RNA, 21 nt, Human
cuuugguuucugacuugcaua

SEQ ID NO: 739405 - RNA, 22 nt, Human
guaucuuuugguggaaaaauaa

SEQ ID NO: 739406 - RNA, 22 nt, Human
cagcucccagaacugaccaugu

SEQ ID NO: 739407 - RNA, 22 nt, Human
aaaguguggagauugaacuaaa

SEQ ID NO: 739408 - RNA, 22 nt, Human
gcucuggcucaaaccaccggcu

SEQ ID NO: 739409 - RNA, 22 nt, Human
gugggccaggacccgcuguccg

SEQ ID NO: 739410 - RNA, 22 nt, Human
aagucacuaagugaaccacugg

SEQ ID NO: 739411 - RNA, 22 nt, Human
gccaaaucuugcacacucuugu

SEQ ID NO: 739412 - RNA, 22 nt, Human
accaucagucauugucaguggg

SEQ ID NO: 739413 - RNA, 22 nt, Human
cagcagcagagauacugguuuc

SEQ ID NO: 739414 - RNA, 22 nt, Human
agagcuggggcucuggguuuaa

SEQ ID NO: 739415 - RNA, 22 nt, Human
cacagagcuggaaaggcugggc

SEQ ID NO: 739416 - RNA, 22 nt, Human
gauauuuacauuaagcacauug

SEQ ID NO: 739417 - RNA, 22 nt, Human
uugggaaggcguggaagcagaa

SEQ ID NO: 739418 - RNA, 22 nt, Human
uuacaacucugucaguauagcu

SEQ ID NO: 739419 - RNA, 22 nt, Human
uggaaggcuaggugcuaggccc

SEQ ID NO: 739420 - RNA, 22 nt, Human
uguuuaaccaccauucuauucu

SEQ ID NO: 739421 - RNA, 17 nt, Human
gagcagggaugcgguuc

SEQ ID NO: 739422 - RNA, 22 nt, Human
cagcuucaugacaaacaguuuu

SEQ ID NO: 739423 - RNA, 22 nt, Human
cuguaagaugggauaagacuuu

SEQ ID NO: 739424 - RNA, 22 nt, Human
uucaggauucuuucagacuggg

SEQ ID NO: 739425 - RNA, 21 nt, Human
gccuccagccagauggccucc

SEQ ID NO: 739426 - RNA, 22 nt, Human
accuuuaucgccaucauugugc

SEQ ID NO: 739427 - RNA, 22 nt, Human
cugccuggguucaaguccuguu

SEQ ID NO: 739428 - RNA, 22 nt, Human
ccagucccgcaugguccagaau

SEQ ID NO: 739429 - RNA, 17 nt, Human
uucucuuccuggauagu

SEQ ID NO: 739430 - RNA, 22 nt, Human
gaagcugacccaggagcgugug

SEQ ID NO: 739431 - RNA, 20 nt, Human
cccuaggaacgcagcaggag

SEQ ID NO: 739432 - RNA, 22 nt, Human
aaugucuuuugauacaaguuac

SEQ ID NO: 739433 - RNA, 22 nt, Human
aagauccuucucacugcagugu

SEQ ID NO: 739434 - RNA, 22 nt, Human
uuaacugugacaguuucucaga

SEQ ID NO: 739435 - RNA, 22 nt, Human
gccugugucauguaguagcuuc

SEQ ID NO: 739436 - RNA, 22 nt, Human
cacagguauauguguauauacu

SEQ ID NO: 739437 - RNA, 22 nt, Human
ggcaaaaaccauaauuacuuuu

SEQ ID NO: 739438 - RNA, 22 nt, Human
acacugcagcaucagcuacgga

SEQ ID NO: 739439 - RNA, 22 nt, Human
cagauagcaaauggguaagcua

SEQ ID NO: 739440 - RNA, 22 nt, Human
gcucucuuuuuccagugguggu

SEQ ID NO: 739441 - RNA, 22 nt, Human
ugcagcauugcaaagcagucuu

SEQ ID NO: 739442 - RNA, 22 nt, Human
aaacaguaaguucuaguauuau

SEQ ID NO: 739443 - RNA, 22 nt, Human
ucuccucuauuucuguauguau

SEQ ID NO: 739444 - RNA, 22 nt, Human
cugagcugguguuucaggguca

SEQ ID NO: 739445 - RNA, 22 nt, Human
uaaucuguguaccuucaucgga

SEQ ID NO: 739446 - RNA, 22 nt, Human
agcaggugucggcgagggucuu

SEQ ID NO: 739447 - RNA, 22 nt, Human
agaagcacuacgauaggugguc

SEQ ID NO: 739448 - RNA, 22 nt, Human
aagccagauagaagaacucauu

SEQ ID NO: 739449 - RNA, 23 nt, Human
cugcuuccuugcuucauugcugg

SEQ ID NO: 739450 - RNA, 22 nt, Human
ugcauugguaaaauacauacac

SEQ ID NO: 739451 - RNA, 22 nt, Human
uaugcacauauaaccugcacug

SEQ ID NO: 739452 - RNA, 22 nt, Human
uccauaaaccagaaaaucaaga

SEQ ID NO: 739453 - RNA, 22 nt, Human
agggaugggucuaacccagaac

SEQ ID NO: 739454 - RNA, 22 nt, Human
gugggggcaggcagugcuagga

SEQ ID NO: 739455 - RNA, 22 nt, Human
gaagcaugcuaaggauucucag

SEQ ID NO: 739456 - RNA, 22 nt, Human
cuacauuuacacaguuaggcuu

SEQ ID NO: 739457 - RNA, 22 nt, Human
cugcagagcagccaguccccca

SEQ ID NO: 739458 - RNA, 22 nt, Human
aaguguagauuauggagugucu

SEQ ID NO: 739459 - RNA, 22 nt, Human
uggggagaagcaauagacucua

SEQ ID NO: 739460 - RNA, 23 nt, Human
agaugagccaacaccuccaugcc

SEQ ID NO: 739461 - RNA, 22 nt, Human
aggcagcugugaggacuggauu

SEQ ID NO: 739462 - RNA, 22 nt, Human
guuuuuauuguguaaauguggg

SEQ ID NO: 739463 - RNA, 22 nt, Human
gucagcauugcagauauauggc

SEQ ID NO: 739464 - RNA, 22 nt, Human
agucccagcuucccccaugcag

SEQ ID NO: 739465 - RNA, 22 nt, Human
uuccucugaaauggcuuggaaa

SEQ ID NO: 739466 - RNA, 22 nt, Human
uuauuagcugggcuucagggug

SEQ ID NO: 739467 - RNA, 23 nt, Human
aggcuuuaugguagaaaguuugc

SEQ ID NO: 739468 - RNA, 22 nt, Human
uagauacaggcucucugagccu

SEQ ID NO: 739469 - RNA, 22 nt, Human
ggcugcugguggaaugguaggc

SEQ ID NO: 739470 - RNA, 22 nt, Human
aauucacagcauuugcccaucu

SEQ ID NO: 739471 - RNA, 22 nt, Human
auugcuucaacuguucaauggg

SEQ ID NO: 739472 - RNA, 22 nt, Human
auucaguucuggcugccuuccu

SEQ ID NO: 739473 - RNA, 22 nt, Human
aaauaguuagcccugcauauau

SEQ ID NO: 739474 - RNA, 22 nt, Human
uggaugagucugagauugggca

SEQ ID NO: 739475 - RNA, 22 nt, Human
gagccaccuucaacucaggaau

SEQ ID NO: 739476 - RNA, 20 nt, Human
cuagaagcagaauugcugau

SEQ ID NO: 739477 - RNA, 22 nt, Human
aaggacugucuaaggccuccaa

SEQ ID NO: 739478 - RNA, 22 nt, Human
uagcagaaccagcagucaauuu

SEQ ID NO: 739479 - RNA, 22 nt, Human
gggagacaguucagauaguuuc

SEQ ID NO: 739480 - RNA, 20 nt, Human
acaguggaaauugaugucug

SEQ ID NO: 739481 - RNA, 22 nt, Human
uccaccauguaacaagcucugu

SEQ ID NO: 739482 - RNA, 22 nt, Human
gaaugcauucucuuagcaucua

SEQ ID NO: 739483 - RNA, 23 nt, Human
gggagccaggaccucgcgcccca

SEQ ID NO: 739484 - RNA, 22 nt, Human
aaaggcuggggacugaggaagg

SEQ ID NO: 739485 - RNA, 22 nt, Human
cuucuucaguugcauguauugg

SEQ ID NO: 739486 - RNA, 22 nt, Human
aacauguaaauaucauuguacu

SEQ ID NO: 739487 - RNA, 22 nt, Human
ugcagcucuguaugcugauuau

SEQ ID NO: 739488 - RNA, 22 nt, Human
aggccuguuccaggccccuuuu

SEQ ID NO: 739489 - RNA, 22 nt, Human
auguggcugaucgcagagcucu

SEQ ID NO: 739490 - RNA, 22 nt, Human
uucucugaagguuguggaacua

SEQ ID NO: 739491 - RNA, 22 nt, Human
ggagccaggggaccuucacaga

SEQ ID NO: 739492 - RNA, 22 nt, Human
acugcaaucuggauccuagaag

SEQ ID NO: 739493 - RNA, 22 nt, Human
accaggaaauuuggcaacaaag

SEQ ID NO: 739494 - RNA, 22 nt, Human
acuuagcaaaucuuuuggauuc

SEQ ID NO: 739495 - RNA, 22 nt, Human
cuccagggagcuguggagguuu

SEQ ID NO: 739496 - RNA, 22 nt, Human
ugucacaugacacaaauaucua

SEQ ID NO: 739497 - RNA, 22 nt, Human
uuucaauuccaccaaagcgccc

SEQ ID NO: 739498 - RNA, 22 nt, Human
uugggggaagaggauagacagu

SEQ ID NO: 739499 - RNA, 22 nt, Human
ugcagcugguaucccauggauu

SEQ ID NO: 739500 - RNA, 22 nt, Human
cgggcuggcugcagcugcugga

SEQ ID NO: 739501 - RNA, 22 nt, Human
gaggcgagaagcuggagauggu

SEQ ID NO: 739502 - RNA, 22 nt, Human
ucucaggacuccucuggccaua

SEQ ID NO: 739503 - RNA, 17 nt, Human
uggccagagcaggcccc

SEQ ID NO: 739504 - RNA, 22 nt, Human
aggaauuuagacagggcauaaa

SEQ ID NO: 739505 - RNA, 22 nt, Human
gcuccucccugugcagacccag

SEQ ID NO: 739506 - RNA, 22 nt, Human
aggaaagguucagugauugaaa

SEQ ID NO: 739507 - RNA, 22 nt, Human
cuggugagacgguugacaggag

SEQ ID NO: 739508 - RNA, 22 nt, Human
acaggucuacuggcaagcagug

SEQ ID NO: 739509 - RNA, 22 nt, Human
ugagccuguggggugacaacca

SEQ ID NO: 739510 - RNA, 19 nt, Human
cacaugagggcugagggac

SEQ ID NO: 739511 - RNA, 22 nt, Human
gcuggggugugguggauaagcu

SEQ ID NO: 739512 - RNA, 22 nt, Human
caguguacuuggaauguaacag

SEQ ID NO: 739513 - RNA, 22 nt, Human
gcagugcuuuagucuguccuuu

SEQ ID NO: 739514 - RNA, 22 nt, Human
gaaagcugggaaauaaauauua

SEQ ID NO: 739515 - RNA, 22 nt, Human
aaggcagcaccgccuccugaaa

SEQ ID NO: 739516 - RNA, 22 nt, Human
gugugcaggugucagugcagcu

SEQ ID NO: 739517 - RNA, 22 nt, Human
gcaggaguucaauugcccauga

SEQ ID NO: 739518 - RNA, 22 nt, Human
cugaggcugaagagggccuacg

SEQ ID NO: 739519 - RNA, 22 nt, Human
gcaggcaauuuuggaaggucag

SEQ ID NO: 739520 - RNA, 22 nt, Human
ucagcccagaccaccucauugc

SEQ ID NO: 739521 - RNA, 22 nt, Human
cuuaguuugcaugauuauggag

SEQ ID NO: 739522 - RNA, 22 nt, Human
uagguagauacauguguuggcu

SEQ ID NO: 739523 - RNA, 22 nt, Human
auaaagauuucuuuuucucuac

SEQ ID NO: 739524 - RNA, 22 nt, Human
gaucugguuucaucauggacuu

SEQ ID NO: 739525 - RNA, 22 nt, Human
aaggagaagucuguugagauug

SEQ ID NO: 739526 - RNA, 22 nt, Human
uagaggcuccuguguguagguu

SEQ ID NO: 739527 - RNA, 22 nt, Human
uauauugagauuugagcauugu

SEQ ID NO: 739528 - RNA, 22 nt, Human
aggagggcaggcuggcugccua

SEQ ID NO: 739529 - RNA, 22 nt, Human
cuguggcuaggaagcuguggga

SEQ ID NO: 739530 - RNA, 22 nt, Human
gcugagacuuccacugccaucu

SEQ ID NO: 739531 - RNA, 22 nt, Human
uugagguccagucuccacccac

SEQ ID NO: 739532 - RNA, 22 nt, Human
guggcccacuuacgucaugugu

SEQ ID NO: 739533 - RNA, 22 nt, Human
uagcuggcuuauauaaaagggc

SEQ ID NO: 739534 - RNA, 22 nt, Human
ccuggcucuucugugucagccc

SEQ ID NO: 739535 - RNA, 20 nt, Human
agcauuuuaugguaggaaac

SEQ ID NO: 739536 - RNA, 22 nt, Human
cccacucccuacgacacgcucc

SEQ ID NO: 739537 - RNA, 22 nt, Human
acagggcucgucgggcccucgg

SEQ ID NO: 739538 - RNA, 22 nt, Human
ugaucccaaucuuuccugcucc

SEQ ID NO: 739539 - RNA, 22 nt, Human
auaagugauauuuagcuauaga

SEQ ID NO: 739540 - RNA, 22 nt, Human
agaagucaauaguuguuugaug

SEQ ID NO: 739541 - RNA, 22 nt, Human
aggcuucaaggaccugagggaa

SEQ ID NO: 739542 - RNA, 22 nt, Human
aaaucaguuggaacacaagcag

SEQ ID NO: 739543 - RNA, 22 nt, Human
uauuaaagagagaaucaucauc

SEQ ID NO: 739544 - RNA, 22 nt, Human
guuccacagagucucacuauga

SEQ ID NO: 739545 - RNA, 22 nt, Human
auguuucaggaaaucagcuaga

SEQ ID NO: 739546 - RNA, 22 nt, Human
agcagggaauagcggaaagaau

SEQ ID NO: 739547 - RNA, 22 nt, Human
cuucuuaaugcauaaacugugu

SEQ ID NO: 739548 - RNA, 22 nt, Human
ucaggaauuuuguucuguaucc

SEQ ID NO: 739549 - RNA, 22 nt, Human
ccugggcagggagaccaggcuc

SEQ ID NO: 739550 - RNA, 22 nt, Human
ccucccuuuguugcaagggaaa

SEQ ID NO: 739551 - RNA, 22 nt, Human
uuuuccuacugauaaacaguua

SEQ ID NO: 739552 - RNA, 22 nt, Human
ucuaccagggucacagaggccc

SEQ ID NO: 739553 - RNA, 22 nt, Human
agaaagagcucgggauuaacag

SEQ ID NO: 739554 - RNA, 22 nt, Human
aauuaaaggucauguuaaaggg

SEQ ID NO: 739555 - RNA, 22 nt, Human
gcuuucuugguucugcaggggc

SEQ ID NO: 739556 - RNA, 21 nt, Human
ggaagcaguggcggcaacucc

SEQ ID NO: 739557 - RNA, 20 nt, Human
aaaugcuguaauguuuggga

SEQ ID NO: 739558 - RNA, 22 nt, Human
auauguuucaguauucaaguca

SEQ ID NO: 739559 - RNA, 22 nt, Human
gagaggcuuaagggcugugaag

SEQ ID NO: 739560 - RNA, 22 nt, Human
ugucuucaggaguaaauaucau

SEQ ID NO: 739561 - RNA, 22 nt, Human
uuguggcagaccaugagucuaa

SEQ ID NO: 739562 - RNA, 22 nt, Human
uccaucagauucccuccugaga

SEQ ID NO: 739563 - RNA, 22 nt, Human
ugcauugagucauuucaguaug

SEQ ID NO: 739564 - RNA, 22 nt, Human
cagcugaagagaggugcugagu

SEQ ID NO: 739565 - RNA, 22 nt, Human
uuagccauauagaaaaagagcu

SEQ ID NO: 739566 - RNA, 22 nt, Human
gcccucagcuugauguuguucu

SEQ ID NO: 739567 - RNA, 22 nt, Human
gaggcuggagauauuccaaucu

SEQ ID NO: 739568 - RNA, 22 nt, Human
ugaaauuaugcauuguuguacc

SEQ ID NO: 739569 - RNA, 22 nt, Human
ucagggcugcauacaggagaua

SEQ ID NO: 739570 - RNA, 22 nt, Human
ucagggagagugacccauccac

SEQ ID NO: 739571 - RNA, 22 nt, Human
uaagaugucauccacauagagu

SEQ ID NO: 739572 - RNA, 22 nt, Human
uuugacaagagggcaucuucag

SEQ ID NO: 739573 - RNA, 22 nt, Human
agggcuuugagaauaguggaac

SEQ ID NO: 739574 - RNA, 22 nt, Human
gcacccagauagcaaggauuag

SEQ ID NO: 739575 - RNA, 22 nt, Human
gagaguccuuaguuugcaggua

SEQ ID NO: 739576 - RNA, 22 nt, Human
ccagugauggugaucagauguu

SEQ ID NO: 739577 - RNA, 22 nt, Human
gcugauggcuugcuggcugaca

SEQ ID NO: 739578 - RNA, 22 nt, Human
gaagcgcggcgucggcgugggu

SEQ ID NO: 739579 - RNA, 16 nt, Human
agaggccacagacaga

SEQ ID NO: 739580 - RNA, 22 nt, Human
aaggaaaucuuuguaacaucuu

SEQ ID NO: 739581 - RNA, 22 nt, Human
agaggauguucuaggcacucau

SEQ ID NO: 739582 - RNA, 22 nt, Human
uccuggagggcucacaggcggc

SEQ ID NO: 739583 - RNA, 22 nt, Human
gacucagagaucccuggagguc

SEQ ID NO: 739584 - RNA, 22 nt, Human
uggaggcauugugacugcugaa

SEQ ID NO: 739585 - RNA, 22 nt, Human
gcaggagcugcucuccugacga

SEQ ID NO: 739586 - RNA, 22 nt, Human
gaaauguauuugacaguccuug

SEQ ID NO: 739587 - RNA, 22 nt, Human
gccgaggcucugcccagcugcu

SEQ ID NO: 739588 - RNA, 22 nt, Human
cucuggcugccucucaggccug

SEQ ID NO: 739589 - RNA, 23 nt, Human
ugcagacuucgaggagggggaua

SEQ ID NO: 739590 - RNA, 23 nt, Human
uguaacuugauggaaugagcuau

SEQ ID NO: 739591 - RNA, 22 nt, Human
aguaccaugcuuccugacuggu

SEQ ID NO: 739592 - RNA, 22 nt, Human
ugagaacauugggaaagcuaug

SEQ ID NO: 739593 - RNA, 22 nt, Human
gugccagagcaaucaggcucug

SEQ ID NO: 739594 - RNA, 22 nt, Human
gcuggugucuaaccuggcucuu

SEQ ID NO: 739595 - RNA, 22 nt, Human
ccugggucuugguucaugcucu

SEQ ID NO: 739596 - RNA, 22 nt, Human
auucuguauggaaaagcacuau

SEQ ID NO: 739597 - RNA, 22 nt, Human
ggggagcagaagcagcaacaac

SEQ ID NO: 739598 - RNA, 22 nt, Human
uuugaaagcuacuuucggguca

SEQ ID NO: 739599 - RNA, 22 nt, Human
ugugugccugagccgugccugg

SEQ ID NO: 739600 - RNA, 22 nt, Human
uuacaacugaagcuaaugugcu

SEQ ID NO: 739601 - RNA, 18 nt, Human
aggcacagagcauacaua

SEQ ID NO: 739602 - RNA, 22 nt, Human
aaggcaagguucaccgugcuau

SEQ ID NO: 739603 - RNA, 21 nt, Human
ugacagcauagagcagggagg

SEQ ID NO: 739604 - RNA, 22 nt, Human
ucugagcuuuagcugggauuuu

SEQ ID NO: 739605 - RNA, 22 nt, Human
gccccuccauccaucaccgggg

SEQ ID NO: 739606 - RNA, 22 nt, Human
ggaaacaaaccacucauggugg

SEQ ID NO: 739607 - RNA, 22 nt, Human
ugguggcagagcaagagcugga

SEQ ID NO: 739608 - RNA, 21 nt, Human
aaguaaaucagagaaauaacc

SEQ ID NO: 739609 - RNA, 22 nt, Human
uuaaagcaguuuguauacaugg

SEQ ID NO: 739610 - RNA, 22 nt, Human
agcuguuguuaauuaacucauu

SEQ ID NO: 739611 - RNA, 22 nt, Human
agaaagcagucccuuccgaccg

SEQ ID NO: 739612 - RNA, 20 nt, Human
ucagcaugcuccucagacau

SEQ ID NO: 739613 - RNA, 18 nt, Human
ucucuucuuggcagucaa

SEQ ID NO: 739614 - RNA, 22 nt, Human
agcauuuagucuuuauugcagc

SEQ ID NO: 739615 - RNA, 22 nt, Human
guuucagagguguucauuuuca

SEQ ID NO: 739616 - RNA, 18 nt, Human
accaggaagcuucuuguc

SEQ ID NO: 739617 - RNA, 22 nt, Human
uaugacagcaaauauccaugag

SEQ ID NO: 739618 - RNA, 22 nt, Human
uaaugaauaaacuugagaguca

SEQ ID NO: 739619 - RNA, 22 nt, Human
acacuguguuuacauagagaau

SEQ ID NO: 739620 - RNA, 22 nt, Human
agauuucaaugugagcauuagu

SEQ ID NO: 739621 - RNA, 16 nt, Human
ccccaggacuuggcac

SEQ ID NO: 739622 - RNA, 22 nt, Human
gccucugucauagcucauguga

SEQ ID NO: 739623 - RNA, 22 nt, Human
uugcaaauaauagccugaaacu

SEQ ID NO: 739624 - RNA, 22 nt, Human
accucgaguucuuucaauucac

SEQ ID NO: 739625 - RNA, 23 nt, Human
aggcauggcauggaugguggcuc

SEQ ID NO: 739626 - RNA, 22 nt, Human
ucccugggcaaguuuacucuuc

SEQ ID NO: 739627 - RNA, 22 nt, Human
acauuucucuugaugucucuau

SEQ ID NO: 739628 - RNA, 22 nt, Human
agcugggugaaggcagauggcu

SEQ ID NO: 739629 - RNA, 22 nt, Human
ugaguccaauaggggccuggaa

SEQ ID NO: 739630 - RNA, 22 nt, Human
uugaaugauuaaagucaucuga

SEQ ID NO: 739631 - RNA, 22 nt, Human
aaguaacaugggaacaucugaa

SEQ ID NO: 739632 - RNA, 22 nt, Human
ugccugggugcuggcuggucac

SEQ ID NO: 739633 - RNA, 22 nt, Human
ugaaggaagaauaggcaguguu

SEQ ID NO: 739634 - RNA, 22 nt, Human
ggcagauguuauaugaucugag

SEQ ID NO: 739635 - RNA, 22 nt, Human
aauaucuguggccauacaauuu

SEQ ID NO: 739636 - RNA, 22 nt, Human
agaaaggaggaagaaugaccuc

SEQ ID NO: 739637 - RNA, 23 nt, Human
aaugcauuaauuugggagaguac

SEQ ID NO: 739638 - RNA, 22 nt, Human
ccagcaucgacuuccugccuga

SEQ ID NO: 739639 - RNA, 22 nt, Human
gucaggcugccagucuuuauug

SEQ ID NO: 739640 - RNA, 22 nt, Human
gggccagcucugugauguaggg

SEQ ID NO: 739641 - RNA, 22 nt, Human
uuuauucuagcucagaauaguu

SEQ ID NO: 739642 - RNA, 22 nt, Human
gccaggcuggucuugaacuccu

SEQ ID NO: 739643 - RNA, 22 nt, Human
ggagagcugaagcauggacagg

SEQ ID NO: 739644 - RNA, 22 nt, Human
ugagggugugcggcccagacag

SEQ ID NO: 739645 - RNA, 22 nt, Human
uccagggcucauucccucugca

SEQ ID NO: 739646 - RNA, 22 nt, Human
gggcagcaugaggacccucauc

SEQ ID NO: 739647 - RNA, 22 nt, Human
uuugguuugaaugagcauaaga

SEQ ID NO: 739648 - RNA, 23 nt, Human
ggccucuguguucugcccacaug

SEQ ID NO: 739649 - RNA, 23 nt, Human
aguaacaugcaaauaacagucug

SEQ ID NO: 739650 - RNA, 22 nt, Human
gagaaggagcucaaauauggcu

SEQ ID NO: 739651 - RNA, 22 nt, Human
cauuauggaagacaguguggug

SEQ ID NO: 739652 - RNA, 22 nt, Human
caguugcuggaugugcagcucu

SEQ ID NO: 739653 - RNA, 22 nt, Human
uaaaugcuccauacauacacca

SEQ ID NO: 739654 - RNA, 23 nt, Human
ucaucaaaggaaguacgugucac

SEQ ID NO: 739655 - RNA, 22 nt, Human
acagggaccuuggaagcuggaa

SEQ ID NO: 739656 - RNA, 22 nt, Human
caggcagagugagaagcccuug

SEQ ID NO: 739657 - RNA, 22 nt, Human
uuccaagugggggaagcugagu

SEQ ID NO: 739658 - RNA, 22 nt, Human
guaugugagguugguuuccagg

SEQ ID NO: 739659 - RNA, 22 nt, Human
gacaugcaguucucaaggguag

SEQ ID NO: 739660 - RNA, 22 nt, Human
cuguuucccuccagggggugga

SEQ ID NO: 739661 - RNA, 22 nt, Human
ucuggcuguguaagguagcacc

SEQ ID NO: 739662 - RNA, 22 nt, Human
ucagaacaucccagauaguaga

SEQ ID NO: 739663 - RNA, 22 nt, Human
uggguaaaaugaguuaggagaa

SEQ ID NO: 739664 - RNA, 21 nt, Human
agcuggcucucucuggagaga

SEQ ID NO: 739665 - RNA, 22 nt, Human
aguggcagcugucaugcccuag

SEQ ID NO: 739666 - RNA, 19 nt, Human
ggcagugagaagacuccug

SEQ ID NO: 739667 - RNA, 18 nt, Human
auguucauauuuuuaggg

SEQ ID NO: 739668 - RNA, 22 nt, Human
cacaauuagcagcucuuuauuu

SEQ ID NO: 739669 - RNA, 22 nt, Human
cucucugggguuccagacgugg

SEQ ID NO: 739670 - RNA, 22 nt, Human
cugagugaggggagcuugaugg

SEQ ID NO: 739671 - RNA, 22 nt, Human
agagaaacaggucagcugggag

SEQ ID NO: 739672 - RNA, 22 nt, Human
gaacagcucugaagcaguaaau

SEQ ID NO: 739673 - RNA, 22 nt, Human
gcaugcaucuagauaugcagac

SEQ ID NO: 739674 - RNA, 22 nt, Human
aagccucuggggccucaucugu

SEQ ID NO: 739675 - RNA, 22 nt, Human
cagcagaaacccagcaaagcca

SEQ ID NO: 739676 - RNA, 22 nt, Human
cucucagaaguagcacgugggc

SEQ ID NO: 739677 - RNA, 22 nt, Human
uguguuaauuuauugccucaga

SEQ ID NO: 739678 - RNA, 23 nt, Human
ccacagagcugccaauuccugug

SEQ ID NO: 739679 - RNA, 22 nt, Human
aggggaagagcccuuuacaugg

SEQ ID NO: 739680 - RNA, 16 nt, Human
ccagguggggcuguga

SEQ ID NO: 739681 - RNA, 22 nt, Human
agucugccuuuccaaucccgug

SEQ ID NO: 739682 - RNA, 22 nt, Human
aggaggguggggucugccuguc

SEQ ID NO: 739683 - RNA, 22 nt, Human
auggcagggacuguggcccuug

SEQ ID NO: 739684 - RNA, 22 nt, Human
auucuacauuuggagugauguc

SEQ ID NO: 739685 - RNA, 22 nt, Human
gcagggcaguaagagcuagagu

SEQ ID NO: 739686 - RNA, 22 nt, Human
aggaagugcuaagagaacauca

SEQ ID NO: 739687 - RNA, 22 nt, Human
cuggacagaaaccaguccuggg

SEQ ID NO: 739688 - RNA, 20 nt, Human
ucagaggcugccagcugggg

SEQ ID NO: 739689 - RNA, 16 nt, Human
cgccucccucccucgc

SEQ ID NO: 739690 - RNA, 23 nt, Human
cauauucaaaacuggaccacucu

SEQ ID NO: 739691 - RNA, 22 nt, Human
gugauugcccagcaccauuguu

SEQ ID NO: 739692 - RNA, 22 nt, Human
uuuauugcauacacaaauguca

SEQ ID NO: 739693 - RNA, 22 nt, Human
uagcuucuggaguguuugaaaa

SEQ ID NO: 739694 - RNA, 22 nt, Human
uucugcuuuucucugucugagu

SEQ ID NO: 739695 - RNA, 22 nt, Human
gccucccuguagaggccagccu

SEQ ID NO: 739696 - RNA, 22 nt, Human
uacauacacaaaugcugaaugg

SEQ ID NO: 739697 - RNA, 22 nt, Human
ggagcagccacgucucagggca

SEQ ID NO: 739698 - RNA, 22 nt, Human
aaccacaacacuaaaugcuggu

SEQ ID NO: 739699 - RNA, 21 nt, Human
uuaauuuauucaugauagcua

SEQ ID NO: 739700 - RNA, 22 nt, Human
uggugcagaugcaggucacugg

SEQ ID NO: 739701 - RNA, 22 nt, Human
aaccuggaggacugcaauccau

SEQ ID NO: 739702 - RNA, 22 nt, Human
ucuggguguagggccuggcaac

SEQ ID NO: 739703 - RNA, 22 nt, Human
ugugugaacucucugauguaca

SEQ ID NO: 739704 - RNA, 21 nt, Human
cccugguuccacugucaccgc

SEQ ID NO: 739705 - RNA, 22 nt, Human
cugcuuucugcaccccaggucg

SEQ ID NO: 739706 - RNA, 22 nt, Human
ugcuccagccuaugcucuccgg

SEQ ID NO: 739707 - RNA, 22 nt, Human
gaagcacugugcugcuaaguug

SEQ ID NO: 739708 - RNA, 22 nt, Human
acuccaguuaccuuggcugagg

SEQ ID NO: 739709 - RNA, 20 nt, Human
ggaagcagagaacuguuuuc

SEQ ID NO: 739710 - RNA, 22 nt, Human
ugcugagauaagcuaugaccag

SEQ ID NO: 739711 - RNA, 22 nt, Human
uucacaaacuucaugauggcac

SEQ ID NO: 739712 - RNA, 22 nt, Human
acacagaaccucauagccucuc

SEQ ID NO: 739713 - RNA, 22 nt, Human
auuuacacauucauaagauuuc

SEQ ID NO: 739714 - RNA, 22 nt, Human
aggacacacagaauacaaaucc

SEQ ID NO: 739715 - RNA, 22 nt, Human
ccuaaguaaguugacuuucaga

SEQ ID NO: 739716 - RNA, 22 nt, Human
gccagagccacuuuugggugau

SEQ ID NO: 739717 - RNA, 22 nt, Human
ugcugccuucuaggcgugcccu

SEQ ID NO: 739718 - RNA, 22 nt, Human
aaacucaaguuucuuaauguca

SEQ ID NO: 739719 - RNA, 22 nt, Human
ggguuagguucuagaggcacaa

SEQ ID NO: 739720 - RNA, 22 nt, Human
acaaugaaagguauucugaacu

SEQ ID NO: 739721 - RNA, 20 nt, Human
ucuguguuucagcugcuuga

SEQ ID NO: 739722 - RNA, 22 nt, Human
caggaucccuggccuccgccca

SEQ ID NO: 739723 - RNA, 22 nt, Human
ugugucagaaggcaauggggau

SEQ ID NO: 739724 - RNA, 22 nt, Human
uucaugaaacuuaacuguuggg

SEQ ID NO: 739725 - RNA, 22 nt, Human
caggagccagaggcggauggag

SEQ ID NO: 739726 - RNA, 22 nt, Human
aguugcucaauguggcugugga

SEQ ID NO: 739727 - RNA, 22 nt, Human
auacaaagacaaaucucaaucu

SEQ ID NO: 739728 - RNA, 22 nt, Human
aacaauuaucauauacauugca

SEQ ID NO: 739729 - RNA, 23 nt, Human
cccuaacuaauucuagggccuaa

SEQ ID NO: 739730 - RNA, 22 nt, Human
aguguccugugucccagacugu

SEQ ID NO: 739731 - RNA, 22 nt, Human
auucuaaauguaauuuagaauu

SEQ ID NO: 739732 - RNA, 22 nt, Human
ucucucauaagaugaguacuua

SEQ ID NO: 739733 - RNA, 18 nt, Human
uuugcugaugagcaucau

SEQ ID NO: 739734 - RNA, 22 nt, Human
ggugggagugggcacaguuacg

SEQ ID NO: 739735 - RNA, 22 nt, Human
agcccagcagaaaguccagccu

SEQ ID NO: 739736 - RNA, 22 nt, Human
gguggcggccacuucagcccug

SEQ ID NO: 739737 - RNA, 22 nt, Human
agggugccuggaagccacucac

SEQ ID NO: 739738 - RNA, 22 nt, Human
ucaauguucuugguauauccuu

SEQ ID NO: 739739 - RNA, 22 nt, Human
uuugcacuagcauuuguccaug

SEQ ID NO: 739740 - RNA, 22 nt, Human
cagcugagcucccaggccauca

SEQ ID NO: 739741 - RNA, 22 nt, Human
uaaaguucuggugagagguaag

SEQ ID NO: 739742 - RNA, 22 nt, Human
agugucuguugaguuucaaaag

SEQ ID NO: 739743 - RNA, 22 nt, Human
cauggcagagaaggggaacugg

SEQ ID NO: 739744 - RNA, 22 nt, Human
agugucuuugacacauucaaag

SEQ ID NO: 739745 - RNA, 22 nt, Human
gaaccuggaauguggcgcccaa

SEQ ID NO: 739746 - RNA, 22 nt, Human
uaauacagggcacuuugaguga

SEQ ID NO: 739747 - RNA, 22 nt, Human
ucuggagcugggggcuuaguau

SEQ ID NO: 739748 - RNA, 22 nt, Human
cugggggccuuacggaacucca

SEQ ID NO: 739749 - RNA, 22 nt, Human
aaaugcaucagcucauaagaga

SEQ ID NO: 739750 - RNA, 22 nt, Human
acaguuauucuuuaugcaacca

SEQ ID NO: 739751 - RNA, 22 nt, Human
gcaaagcaucaguagaaauguu

SEQ ID NO: 739752 - RNA, 22 nt, Human
ugaaaauuaagcagaugaauga

SEQ ID NO: 739753 - RNA, 22 nt, Human
augacagaggagugcaggugau

SEQ ID NO: 739754 - RNA, 22 nt, Human
gcagcagaaguagaaguacagg

SEQ ID NO: 739755 - RNA, 22 nt, Human
gugcuuuacuggcagugaugua

SEQ ID NO: 739756 - RNA, 20 nt, Human
aaucugaaucccaguccuag

SEQ ID NO: 739757 - RNA, 22 nt, Human
ucauuuacacuucacaaaugga

SEQ ID NO: 739758 - RNA, 22 nt, Human
ucccugggguuccuccagccac

SEQ ID NO: 739759 - RNA, 22 nt, Human
uucaguuucuucccugugaaau

SEQ ID NO: 739760 - RNA, 22 nt, Human
aggccccaucaggaaggaggcc

SEQ ID NO: 739761 - RNA, 19 nt, Human
ggcaccuuggucuuggacu

SEQ ID NO: 739762 - RNA, 22 nt, Human
aaggcaguaggaucuuccacag

SEQ ID NO: 739763 - RNA, 22 nt, Human
ucugccuuuucacugccacuaa

SEQ ID NO: 739764 - RNA, 22 nt, Human
aagggugggcaccgccagguca

SEQ ID NO: 739765 - RNA, 22 nt, Human
gcugggcugagcuagacuuggc

SEQ ID NO: 739766 - RNA, 22 nt, Human
augacagaaggccucccugaca

SEQ ID NO: 739767 - RNA, 22 nt, Human
aaccugagauacuggucuuuau

SEQ ID NO: 739768 - RNA, 22 nt, Human
cuugcuugauuaugaucauaaa

SEQ ID NO: 739769 - RNA, 21 nt, Human
gcuggagagccaggcaggggc

SEQ ID NO: 739770 - RNA, 22 nt, Human
uacacaacugacaaccauucug

SEQ ID NO: 739771 - RNA, 22 nt, Human
uuuaaugauagucuuacgaaaa

SEQ ID NO: 739772 - RNA, 22 nt, Human
uuggaaggcagcauuuguccau

SEQ ID NO: 739773 - RNA, 21 nt, Human
ggcagaaguagcauggacggg

SEQ ID NO: 739774 - RNA, 20 nt, Human
agugcaagaaagcacagcug

SEQ ID NO: 739775 - RNA, 22 nt, Human
cagcagcucaggcuccuuccca

SEQ ID NO: 739776 - RNA, 22 nt, Human
acacuacaaucucagaacuaua

SEQ ID NO: 739777 - RNA, 22 nt, Human
uaaggcauuagagugaaagcaa

SEQ ID NO: 739778 - RNA, 22 nt, Human
cauuugucaucacugagcugcc

SEQ ID NO: 739779 - RNA, 18 nt, Human
gccagugcccuggcucac

SEQ ID NO: 739780 - RNA, 22 nt, Human
uugcauuucacuuucaguaggc

SEQ ID NO: 739781 - RNA, 22 nt, Human
uaccuuggaggccaagcaguuu

SEQ ID NO: 739782 - RNA, 22 nt, Human
cucugagaauauaagacuauuu

SEQ ID NO: 739783 - RNA, 22 nt, Human
aucuuugaaucaaugaaucagu

SEQ ID NO: 739784 - RNA, 22 nt, Human
ucugagaguagagcugccucuu

SEQ ID NO: 739785 - RNA, 22 nt, Human
ucuccuugacaggcaggcagac

SEQ ID NO: 739786 - RNA, 22 nt, Human
ccagcuuucucagaggcuucua

SEQ ID NO: 739787 - RNA, 22 nt, Human
gggcugagaaguugaucccaag

SEQ ID NO: 739788 - RNA, 21 nt, Human
aggagcugugugcuuccuuuc

SEQ ID NO: 739789 - RNA, 22 nt, Human
agagccugcuguguaagucaca

SEQ ID NO: 739790 - RNA, 22 nt, Human
uauauggauagugaucauaaga

SEQ ID NO: 739791 - RNA, 22 nt, Human
acaguaaggguaaauaagaaca

SEQ ID NO: 739792 - RNA, 23 nt, Human
auucuucauuaucuucuagaaaa

SEQ ID NO: 739793 - RNA, 22 nt, Human
ccacagagcauuagauuucaga

SEQ ID NO: 739794 - RNA, 20 nt, Human
cagagccaagagcagcaucu

SEQ ID NO: 739795 - RNA, 22 nt, Human
agcaaagcugauuaagagcaca

SEQ ID NO: 739796 - RNA, 22 nt, Human
ucacuagucaucaacuuccauu

SEQ ID NO: 739797 - RNA, 22 nt, Human
aaguuuagucuugucuuaguaa

SEQ ID NO: 739798 - RNA, 22 nt, Human
cuucucuggcagaugugugucc

SEQ ID NO: 739799 - RNA, 22 nt, Human
aacacuucuguugauaauaagc

SEQ ID NO: 739800 - RNA, 22 nt, Human
auucuuauuuaaauagagucug

SEQ ID NO: 739801 - RNA, 17 nt, Human
gcacauguguucuuuua

SEQ ID NO: 739802 - RNA, 22 nt, Human
ccauggcauuuuaugugucuua

SEQ ID NO: 739803 - RNA, 22 nt, Human
aggaggguacaauggguggaaa

SEQ ID NO: 739804 - RNA, 22 nt, Human
uuaugagacuguuuuacacacu

SEQ ID NO: 739805 - RNA, 22 nt, Human
ggggcagcuaccggaaguaggg

SEQ ID NO: 739806 - RNA, 22 nt, Human
acauguguacauauauaugugc

SEQ ID NO: 739807 - RNA, 22 nt, Human
acugcuuuucuaagauucugug

SEQ ID NO: 739808 - RNA, 22 nt, Human
gggcccuggggauguggacgcg

SEQ ID NO: 739809 - RNA, 22 nt, Human
gaacauucacagacucaccauu

SEQ ID NO: 739810 - RNA, 22 nt, Human
ccugcccugucacuggcuaggg

SEQ ID NO: 739811 - RNA, 21 nt, Human
gcacccagccgguucucccag

SEQ ID NO: 739812 - RNA, 22 nt, Human
cauuggaaaaugcaugcuuuuu

SEQ ID NO: 739813 - RNA, 22 nt, Human
uucacagcuuaauaaggcucag

SEQ ID NO: 739814 - RNA, 22 nt, Human
ucacaauauuuaucuuccaauu

SEQ ID NO: 739815 - RNA, 22 nt, Human
uuuuaugaagauaauuuucuga

SEQ ID NO: 739816 - RNA, 22 nt, Human
ucaaagcaugguuuugaaagac

SEQ ID NO: 739817 - RNA, 22 nt, Human
caucagagucagagcucuuucu

SEQ ID NO: 739818 - RNA, 22 nt, Human
caaugauggcuaggcagcugcu

SEQ ID NO: 739819 - RNA, 22 nt, Human
uuacacagugaauuuacucaag

SEQ ID NO: 739820 - RNA, 22 nt, Human
uggguuuaaacucaacucuaaa

SEQ ID NO: 739821 - RNA, 22 nt, Human
agcuucucuggucuucugccaa

SEQ ID NO: 739822 - RNA, 22 nt, Human
cccugccuuguuggagccuaug

SEQ ID NO: 739823 - RNA, 22 nt, Human
agcucuuacauuuaggucuaug

SEQ ID NO: 739824 - RNA, 22 nt, Human
cggcuucaguaauuccaugucc

SEQ ID NO: 739825 - RNA, 22 nt, Human
ucaccugggagggcugugguag

SEQ ID NO: 739826 - RNA, 22 nt, Human
ggcuagggagacagagggcaug

SEQ ID NO: 739827 - RNA, 22 nt, Human
auauaaguguguggcuguuagu

SEQ ID NO: 739828 - RNA, 22 nt, Human
caagguuucuaugcucaaagga

SEQ ID NO: 739829 - RNA, 22 nt, Human
uuguacaacguuuuaaauuuga

SEQ ID NO: 739830 - RNA, 22 nt, Human
ugugucucaagucagagcauca

SEQ ID NO: 739831 - RNA, 22 nt, Human
aguguauucugcaugggagacu

SEQ ID NO: 739832 - RNA, 23 nt, Human
uccuccuuuugcuugugcuuccc

SEQ ID NO: 739833 - RNA, 22 nt, Human
uucaggaaauuggaguccuucu

SEQ ID NO: 739834 - RNA, 22 nt, Human
ccagcugguguuccuuaggacc

SEQ ID NO: 739835 - RNA, 22 nt, Human
ccuucaaaguacacaucuuuau

SEQ ID NO: 739836 - RNA, 23 nt, Human
uucugggcuguggaagccucggg

SEQ ID NO: 739837 - RNA, 18 nt, Human
gaggaacauucaccuccu

SEQ ID NO: 739838 - RNA, 22 nt, Human
ugccuucaaucaggauggucuc

SEQ ID NO: 739839 - RNA, 22 nt, Human
aacccagccguguagcugccgc

SEQ ID NO: 739840 - RNA, 20 nt, Human
uucaugcuggaggggcuggc

SEQ ID NO: 739841 - RNA, 22 nt, Human
aagcuguguaaguugcuugguu

SEQ ID NO: 739842 - RNA, 22 nt, Human
acaaacaucuugaccucagauu

SEQ ID NO: 739843 - RNA, 19 nt, Human
agcuuuuacuaacagcaga

SEQ ID NO: 739844 - RNA, 22 nt, Human
ccauuguaaagaguauacuuug

SEQ ID NO: 739845 - RNA, 22 nt, Human
cuuacauuuaaucaugugucau

SEQ ID NO: 739846 - RNA, 22 nt, Human
cccagcaggaggagguugcagu

SEQ ID NO: 739847 - RNA, 22 nt, Human
uauggcuuuucuuuccuagugu

SEQ ID NO: 739848 - RNA, 22 nt, Human
uguggagacuauagccauaaca

SEQ ID NO: 739849 - RNA, 22 nt, Human
gagcucagccugaggccuggcu

SEQ ID NO: 739850 - RNA, 22 nt, Human
ggaggccuagccagcuccaguu

SEQ ID NO: 739851 - RNA, 22 nt, Human
uuuagggaaauugaggguuaag

SEQ ID NO: 739852 - RNA, 22 nt, Human
cauaacauguacauauaaaugc

SEQ ID NO: 739853 - RNA, 22 nt, Human
acacauguaaaacacuuagcaa

SEQ ID NO: 739854 - RNA, 22 nt, Human
gacuguacgucauugaaggcca

SEQ ID NO: 739855 - RNA, 17 nt, Human
augcucuauagucagug

SEQ ID NO: 739856 - RNA, 22 nt, Human
agcaucugcuuaauggcuuaac

SEQ ID NO: 739857 - RNA, 22 nt, Human
gugaagacuuggagaaguuaag

SEQ ID NO: 739858 - RNA, 22 nt, Human
ugauugaagaggugaggaaguu

SEQ ID NO: 739859 - RNA, 22 nt, Human
ucuucugaugccaguaaccaug

SEQ ID NO: 739860 - RNA, 23 nt, Human
gccuggccaccccagggcugcuu

SEQ ID NO: 739861 - RNA, 22 nt, Human
cacuucaaucucugccuccauc

SEQ ID NO: 739862 - RNA, 22 nt, Human
agcagguguaucggucaccuac

SEQ ID NO: 739863 - RNA, 22 nt, Human
ccagcauggcaccugagaugag

SEQ ID NO: 739864 - RNA, 22 nt, Human
agggugcagaaggagccuagga

SEQ ID NO: 739865 - RNA, 22 nt, Human
auauagaucaaaugaugcuaau

SEQ ID NO: 739866 - RNA, 22 nt, Human
cuuauuagugucugucugaguu

SEQ ID NO: 739867 - RNA, 20 nt, Human
uacuggaaauuucuccaccu

SEQ ID NO: 739868 - RNA, 22 nt, Human
ugggguucuuuguuuccugccu

SEQ ID NO: 739869 - RNA, 22 nt, Human
ugccaucucuuccucgugcugc

SEQ ID NO: 739870 - RNA, 21 nt, Human
ucgugcagcagcugaggcuug

SEQ ID NO: 739871 - RNA, 22 nt, Human
cccagcuccuuguuugcaucuc

SEQ ID NO: 739872 - RNA, 22 nt, Human
agagagcucugaugggagguga

SEQ ID NO: 739873 - RNA, 22 nt, Human
cugaaggauguguggugggagu

SEQ ID NO: 739874 - RNA, 22 nt, Human
ugcugccugguuucuucuugcu

SEQ ID NO: 739875 - RNA, 22 nt, Human
cugaggccucguuggcuggaac

SEQ ID NO: 739876 - RNA, 22 nt, Human
ucaggauccauagacucccaaa

SEQ ID NO: 739877 - RNA, 22 nt, Human
ugacaacaucauuuuugugugg

SEQ ID NO: 739878 - RNA, 22 nt, Human
cuauuucugccuaaugaccugu

SEQ ID NO: 739879 - RNA, 19 nt, Human
ugagaggcuuaaggcagcu

SEQ ID NO: 739880 - RNA, 22 nt, Human
ucuauuuuauacucaaaucuuc

SEQ ID NO: 739881 - RNA, 22 nt, Human
aagauucuguauuucuaacaau

SEQ ID NO: 739882 - RNA, 22 nt, Human
uagucaaaccucagaauacccc

SEQ ID NO: 739883 - RNA, 22 nt, Human
ugucuacuugggcucuacagca

SEQ ID NO: 739884 - RNA, 18 nt, Human
cuuggagaacuaaugaua

SEQ ID NO: 739885 - RNA, 22 nt, Human
ccagggcuuuaucugccuuuga

SEQ ID NO: 739886 - RNA, 21 nt, Human
ugccagcauguaggcuaguug

SEQ ID NO: 739887 - RNA, 20 nt, Human
cagugaggaggugcuggggg

SEQ ID NO: 739888 - RNA, 22 nt, Human
ucacugcaaggaggcuucucaa

SEQ ID NO: 739889 - RNA, 22 nt, Human
accaaggaagaaucuauuugag

SEQ ID NO: 739890 - RNA, 22 nt, Human
ucagagaaauaauugcugaguu

SEQ ID NO: 739891 - RNA, 22 nt, Human
cuccaggccaagauuaaguaau

SEQ ID NO: 739892 - RNA, 22 nt, Human
ugaaagcagugauuucuccuuc

SEQ ID NO: 739893 - RNA, 22 nt, Human
aggagguguugauagaagguuu

SEQ ID NO: 739894 - RNA, 22 nt, Human
ucuuuaaucauaaccaagaugg

SEQ ID NO: 739895 - RNA, 22 nt, Human
agcgggucugcaagccuucccu

SEQ ID NO: 739896 - RNA, 22 nt, Human
auggcccuuuauuccuucuucc

SEQ ID NO: 739897 - RNA, 22 nt, Human
cuccuaggugcucacugggguc

SEQ ID NO: 739898 - RNA, 22 nt, Human
agauacauuguucuaagcauug

SEQ ID NO: 739899 - RNA, 22 nt, Human
uggucugacuacaauaggaaga

SEQ ID NO: 739900 - RNA, 22 nt, Human
uccagggaugccagccauguug

SEQ ID NO: 739901 - RNA, 22 nt, Human
augcauauguacuugcauaugu

SEQ ID NO: 739902 - RNA, 22 nt, Human
ugauuguaugauugaaauauuu

SEQ ID NO: 739903 - RNA, 22 nt, Human
gcugccuuaugucuauuaguau

SEQ ID NO: 739904 - RNA, 22 nt, Human
cugucuggaugugagucaccua

SEQ ID NO: 739905 - RNA, 22 nt, Human
ccaggcuggaaucaauauucug

SEQ ID NO: 739906 - RNA, 22 nt, Human
agauguggaacacuagacugcu

SEQ ID NO: 739907 - RNA, 22 nt, Human
accucccuccaucuggacacua

SEQ ID NO: 739908 - RNA, 21 nt, Human
agacuucuagaagugagauag

SEQ ID NO: 739909 - RNA, 22 nt, Human
caagcuuuccauuacacacauu

SEQ ID NO: 739910 - RNA, 22 nt, Human
ugccuuuaggggccucucccuc

SEQ ID NO: 739911 - RNA, 22 nt, Human
uuuauaguuauauacagauguu

SEQ ID NO: 739912 - RNA, 22 nt, Human
uacaacuuccagcuuucagccc

SEQ ID NO: 739913 - RNA, 22 nt, Human
ucugggaaacacugcaucccca

SEQ ID NO: 739914 - RNA, 20 nt, Human
ugggccucuggugccucugg

SEQ ID NO: 739915 - RNA, 22 nt, Human
ccagggcuggguuugucggugu

SEQ ID NO: 739916 - RNA, 22 nt, Human
guguccugccacccugggcuuu

SEQ ID NO: 739917 - RNA, 22 nt, Human
aggagcugaagucucugcacuc

SEQ ID NO: 739918 - RNA, 22 nt, Human
agcagcauccccggccuccacc

SEQ ID NO: 739919 - RNA, 22 nt, Human
ggccucagggucacucuguaga

SEQ ID NO: 739920 - RNA, 22 nt, Human
aaccuguuuucuucucaucuag

SEQ ID NO: 739921 - RNA, 22 nt, Human
gcaagcugcuuaagcucauugu

SEQ ID NO: 739922 - RNA, 22 nt, Human
guggagcccugccuugcucaug

SEQ ID NO: 739923 - RNA, 22 nt, Human
cugaggaguuggugaauaagcc

SEQ ID NO: 739924 - RNA, 22 nt, Human
acaguggcucaugccugucauc

SEQ ID NO: 739925 - RNA, 22 nt, Human
gccuccugcccagaugagugau

SEQ ID NO: 739926 - RNA, 22 nt, Human
aacugcaguuacuuuugcacca

SEQ ID NO: 739927 - RNA, 22 nt, Human
cugcuuccauggucuggagacu

SEQ ID NO: 739928 - RNA, 22 nt, Human
ggaagcugguaauuguugggac

SEQ ID NO: 739929 - RNA, 22 nt, Human
caugugugugagggaaacaugu

SEQ ID NO: 739930 - RNA, 22 nt, Human
gaggccagacugccuuuuauga

SEQ ID NO: 739931 - RNA, 22 nt, Human
uaacuacaagggcggucucugu

SEQ ID NO: 739932 - RNA, 22 nt, Human
cagcucugcugguggugccagg

SEQ ID NO: 739933 - RNA, 22 nt, Human
uaaguguuauuauucucacuuu

SEQ ID NO: 739934 - RNA, 22 nt, Human
ugaggcucuaugugguagauua

SEQ ID NO: 739935 - RNA, 22 nt, Human
acaguaaacaaugcagcaaauu

SEQ ID NO: 739936 - RNA, 22 nt, Human
ucaggcuguagggccccuggag

SEQ ID NO: 739937 - RNA, 22 nt, Human
ccaguccuagaagaggagucga

SEQ ID NO: 739938 - RNA, 22 nt, Human
auaaaugaacauucacagagcu

SEQ ID NO: 739939 - RNA, 22 nt, Human
caggaggcaggugcauuuugag

SEQ ID NO: 739940 - RNA, 22 nt, Human
uucugguggccagaagucugaa

SEQ ID NO: 739941 - RNA, 22 nt, Human
aggaugaggcuggcaggucuug

SEQ ID NO: 739942 - RNA, 22 nt, Human
gcccagaaagacugccuaacag

SEQ ID NO: 739943 - RNA, 22 nt, Human
caggugucaaaauacuaagugg

SEQ ID NO: 739944 - RNA, 22 nt, Human
caggaaggaccguccagaucag

SEQ ID NO: 739945 - RNA, 22 nt, Human
gcagauaggguauuaggaguaa

SEQ ID NO: 739946 - RNA, 22 nt, Human
ucugcucagccgaucugcuccg

SEQ ID NO: 739947 - RNA, 22 nt, Human
augcaaucauauggcauacagc

SEQ ID NO: 739948 - RNA, 22 nt, Human
acaugcauaggagaagucuuua

SEQ ID NO: 739949 - RNA, 22 nt, Human
gaggcugaauggccagaagcca

SEQ ID NO: 739950 - RNA, 21 nt, Human
cucccagggugacuguucaac

SEQ ID NO: 739951 - RNA, 22 nt, Human
cucugccugcccaccgacccau

SEQ ID NO: 739952 - RNA, 22 nt, Human
gggagcuggccuacuauuagau

SEQ ID NO: 739953 - RNA, 22 nt, Human
agaagcagaaaagggcacuuuu

SEQ ID NO: 739954 - RNA, 22 nt, Human
uccuuucuucuucugcccaugg

SEQ ID NO: 739955 - RNA, 22 nt, Human
ucauaagcuagcugcaccauau

SEQ ID NO: 739956 - RNA, 22 nt, Human
cugcaggcaucuaacugugggc

SEQ ID NO: 739957 - RNA, 22 nt, Human
uccauucuaugcuuacauuuau

SEQ ID NO: 739958 - RNA, 22 nt, Human
auccagaacaccuguaucacca

SEQ ID NO: 739959 - RNA, 21 nt, Human
ggccugaguauaggacaggcc

SEQ ID NO: 739960 - RNA, 22 nt, Human
gagccugaauuugaccugcuua

SEQ ID NO: 739961 - RNA, 22 nt, Human
aauguguuuucacugaagauuc

SEQ ID NO: 739962 - RNA, 22 nt, Human
augcuaaauguuaauguuaccu

SEQ ID NO: 739963 - RNA, 22 nt, Human
caggcugccgugggguccaggc

SEQ ID NO: 739964 - RNA, 22 nt, Human
uccagcuugccuggucuuuugg

SEQ ID NO: 739965 - RNA, 22 nt, Human
aggagcugcagauucugccuug

SEQ ID NO: 739966 - RNA, 22 nt, Human
uuuucucagcugcacuguauua

SEQ ID NO: 739967 - RNA, 22 nt, Human
cucuggguguuaaugucagugu

SEQ ID NO: 739968 - RNA, 22 nt, Human
uucuaaguccuaccugaaagca

SEQ ID NO: 739969 - RNA, 22 nt, Human
ucugaaagcuagaaaaugcucu

SEQ ID NO: 739970 - RNA, 22 nt, Human
ccugggagugucagacuugcuu

SEQ ID NO: 739971 - RNA, 22 nt, Human
agaagccacaggaaagcagcuu

SEQ ID NO: 739972 - RNA, 22 nt, Human
uggaaugcauggcucugugacg

SEQ ID NO: 739973 - RNA, 19 nt, Human
ggagcuugguggcuguggc

SEQ ID NO: 739974 - RNA, 19 nt, Human
ugagcugcugcugcccauc

SEQ ID NO: 739975 - RNA, 21 nt, Human
aagagcuggaucaaggauaag

SEQ ID NO: 739976 - RNA, 20 nt, Human
gaaggaagggggcaagguga

SEQ ID NO: 739977 - RNA, 22 nt, Human
gccugagauuggacauuauuua

SEQ ID NO: 739978 - RNA, 20 nt, Human
caugcaugacacuggaaagg

SEQ ID NO: 739979 - RNA, 22 nt, Human
aaaggaaaauaaguaguuccau

SEQ ID NO: 739980 - RNA, 22 nt, Human
cuggggacgucgggcaguguuc

SEQ ID NO: 739981 - RNA, 22 nt, Human
agacucaagcagauaggaauua

SEQ ID NO: 739982 - RNA, 23 nt, Human
ugugaauugaggacaucaaaagc

SEQ ID NO: 739983 - RNA, 22 nt, Human
ugggugguccaggcucagcaga

SEQ ID NO: 739984 - RNA, 22 nt, Human
agcccaagcauaggagggaggc

SEQ ID NO: 739985 - RNA, 22 nt, Human
gcuucaaggccaagacaccuua

SEQ ID NO: 739986 - RNA, 22 nt, Human
uuggccagagaccagagcaggg

SEQ ID NO: 739987 - RNA, 22 nt, Human
caggguggaaaagcuaguugga

SEQ ID NO: 739988 - RNA, 22 nt, Human
uucuagucuauggcuagauagu

SEQ ID NO: 739989 - RNA, 23 nt, Human
ucuggcuuugcuggaaguuuuga

SEQ ID NO: 739990 - RNA, 22 nt, Human
accacccauucagaaacacuga

SEQ ID NO: 739991 - RNA, 22 nt, Human
gaagaacugugacagaagcagu

SEQ ID NO: 739992 - RNA, 22 nt, Human
ccucucucagcuugcugcaacu

SEQ ID NO: 739993 - RNA, 20 nt, Human
aaucucaguauccuaugcaa

SEQ ID NO: 739994 - RNA, 22 nt, Human
gugccugcagcaauccauggca

SEQ ID NO: 739995 - RNA, 22 nt, Human
uggagagcaagucgcagacaug

SEQ ID NO: 739996 - RNA, 22 nt, Human
gugaauaauauuguuuauaaaa

SEQ ID NO: 739997 - RNA, 21 nt, Human
uggagagcccuugccugaguc

SEQ ID NO: 739998 - RNA, 22 nt, Human
ugucuacaaacguguacacauu

SEQ ID NO: 739999 - RNA, 22 nt, Human
uaaaggauaacuuucaagaauu

SEQ ID NO: 740000 - RNA, 19 nt, Human
agaaucaggucaggugaca

SEQ ID NO: 740001 - RNA, 22 nt, Human
gacagggacacagccagugagg

SEQ ID NO: 740002 - RNA, 22 nt, Human
agggggugcccagaugaaggau

SEQ ID NO: 740003 - RNA, 22 nt, Human
ugucuucacucaagucucuugg

SEQ ID NO: 740004 - RNA, 22 nt, Human
cuuucaugaacagacaaggaac

SEQ ID NO: 740005 - RNA, 22 nt, Human
auguaauuuauguuauccauaa

SEQ ID NO: 740006 - RNA, 22 nt, Human
cugaaacuuuaguucugcaaca

SEQ ID NO: 740007 - RNA, 22 nt, Human
gccacagguacuaugggagaga

SEQ ID NO: 740008 - RNA, 22 nt, Human
guugcuuuucuccaucacaugg

SEQ ID NO: 740009 - RNA, 22 nt, Human
cuuauuucuccauccagaguca

SEQ ID NO: 740010 - RNA, 22 nt, Human
cacuugcagacuuugccugguu

SEQ ID NO: 740011 - RNA, 22 nt, Human
ugaauaugcuuugcaauccuaa

SEQ ID NO: 740012 - RNA, 22 nt, Human
gaaaaguucaucauauauucag

SEQ ID NO: 740013 - RNA, 22 nt, Human
acaguauacauugauuaggacc

SEQ ID NO: 740014 - RNA, 22 nt, Human
agaggggcaaguaaagagucuu

SEQ ID NO: 740015 - RNA, 22 nt, Human
ucacaggcaaagaagauuggug

SEQ ID NO: 740016 - RNA, 22 nt, Human
uaucuuuugaguucucaagaug

SEQ ID NO: 740017 - RNA, 22 nt, Human
auggcccuggcccagaccccac

SEQ ID NO: 740018 - RNA, 22 nt, Human
augggcugacaagacaugcaua

SEQ ID NO: 740019 - RNA, 22 nt, Human
caggggaagaugccaagggaga

SEQ ID NO: 740020 - RNA, 19 nt, Human
gcccaggggcccgaugcug

SEQ ID NO: 740021 - RNA, 22 nt, Human
acagagguuuccauugagguuu

SEQ ID NO: 740022 - RNA, 22 nt, Human
uguuuuguuuaugagagcacag

SEQ ID NO: 740023 - RNA, 22 nt, Human
ucagugcauuaauaauaucagu

SEQ ID NO: 740024 - RNA, 22 nt, Human
uauuaagauacguaguuguaaa

SEQ ID NO: 740025 - RNA, 22 nt, Human
acugagcucuagguuuugaacc

SEQ ID NO: 740026 - RNA, 22 nt, Human
gcauugucaaaagugguaugac

SEQ ID NO: 740027 - RNA, 22 nt, Human
ccagggcugcucauuggcuggu

SEQ ID NO: 740028 - RNA, 22 nt, Human
gcccugagugguaccugugggu

SEQ ID NO: 740029 - RNA, 22 nt, Human
agcuaaugaugagauacagaua

SEQ ID NO: 740030 - RNA, 22 nt, Human
cagaucaaacaaaauggguuag

SEQ ID NO: 740031 - RNA, 22 nt, Human
ugcaggagcugugcggugaggg

SEQ ID NO: 740032 - RNA, 22 nt, Human
caguacuuaacuuauaggagag

SEQ ID NO: 740033 - RNA, 22 nt, Human
gcugcaggcucugcaggaauug

SEQ ID NO: 740034 - RNA, 22 nt, Human
guuacaauguucuucaguucug

SEQ ID NO: 740035 - RNA, 20 nt, Human
gggcuggcucaacuggaucc

SEQ ID NO: 740036 - RNA, 22 nt, Human
gagggcugaagauuguggcccc

SEQ ID NO: 740037 - RNA, 22 nt, Human
gagugugguaugcucugaggcu

SEQ ID NO: 740038 - RNA, 22 nt, Human
caaugacacucugcacagugcu

SEQ ID NO: 740039 - RNA, 22 nt, Human
augugagguagauaggaugcag

SEQ ID NO: 740040 - RNA, 22 nt, Human
cauuucugcagaauugcucuuc

SEQ ID NO: 740041 - RNA, 22 nt, Human
cagauguaauuacucaagucaa

SEQ ID NO: 740042 - RNA, 22 nt, Human
auacagggacauccaguuuuuc

SEQ ID NO: 740043 - RNA, 22 nt, Human
aaucacaugugggucuuguagc

SEQ ID NO: 740044 - RNA, 22 nt, Human
ugucaguguauacauacaguau

SEQ ID NO: 740045 - RNA, 22 nt, Human
guccacauaggaacccagcuuc

SEQ ID NO: 740046 - RNA, 22 nt, Human
ugaaacagucuccagacuugga

SEQ ID NO: 740047 - RNA, 22 nt, Human
aggaaauguaguccucaucucc

SEQ ID NO: 740048 - RNA, 22 nt, Human
uacacuguacgcucugcuucaa

SEQ ID NO: 740049 - RNA, 22 nt, Human
cagggcucccuugcaaggaggg

SEQ ID NO: 740050 - RNA, 22 nt, Human
cuugccugaggaacagagggua

SEQ ID NO: 740051 - RNA, 22 nt, Human
cacuggggaaaacaggcuucuu

SEQ ID NO: 740052 - RNA, 22 nt, Human
uggcuucauucagcaugacagu

SEQ ID NO: 740053 - RNA, 22 nt, Human
cuccugagggaugcuuaggcuu

SEQ ID NO: 740054 - RNA, 22 nt, Human
acaugaaaugcagccuguaacc

SEQ ID NO: 740055 - RNA, 22 nt, Human
ugucuuuguguacaggaucgcc

SEQ ID NO: 740056 - RNA, 22 nt, Human
aauuucaaguggcaucuuugau

SEQ ID NO: 740057 - RNA, 22 nt, Human
ucacauuuuauaucucugguuu

SEQ ID NO: 740058 - RNA, 22 nt, Human
ugcuuuauuggaaccucauccu

SEQ ID NO: 740059 - RNA, 22 nt, Human
accugcagcugagaaaaugacu

SEQ ID NO: 740060 - RNA, 22 nt, Human
acauuuagaguucuuuacucca

SEQ ID NO: 740061 - RNA, 18 nt, Human
cccugagaugaugcugug

SEQ ID NO: 740062 - RNA, 22 nt, Human
acagcagacacaggcacgcugu

SEQ ID NO: 740063 - RNA, 22 nt, Human
gugccugugccaggggugugcu

SEQ ID NO: 740064 - RNA, 22 nt, Human
auggacaggcuuauaacagcaa

SEQ ID NO: 740065 - RNA, 22 nt, Human
guaugaaagcaucauuccugcu

SEQ ID NO: 740066 - RNA, 19 nt, Human
uuucagacucaucuccagc

SEQ ID NO: 740067 - RNA, 22 nt, Human
cuaggaauagcaaaguaggaca

SEQ ID NO: 740068 - RNA, 22 nt, Human
aggucaggguauucacgucugu

SEQ ID NO: 740069 - RNA, 22 nt, Human
agaaauaaucagcuuaggggca

SEQ ID NO: 740070 - RNA, 22 nt, Human
cagccaccauacagcagaagcu

SEQ ID NO: 740071 - RNA, 22 nt, Human
uccuucaguucaauuaguccgu

SEQ ID NO: 740072 - RNA, 19 nt, Human
cagaguuugcaggcagagg

SEQ ID NO: 740073 - RNA, 22 nt, Human
gaggaaugggugucucgugauu

SEQ ID NO: 740074 - RNA, 22 nt, Human
ucugaguucauaccaggcuacc

SEQ ID NO: 740075 - RNA, 22 nt, Human
ucucugaguauccugaacugcc

SEQ ID NO: 740076 - RNA, 22 nt, Human
cagagggcugcccugaguucgu

SEQ ID NO: 740077 - RNA, 22 nt, Human
uugaggaggccuuucagggcuu

SEQ ID NO: 740078 - RNA, 22 nt, Human
aagaugugcaguucauggcagg

SEQ ID NO: 740079 - RNA, 22 nt, Human
auauuucucucagacauggaag

SEQ ID NO: 740080 - RNA, 22 nt, Human
ugaggcauuaaagggaggucaa

SEQ ID NO: 740081 - RNA, 20 nt, Human
cugagcgucuaagaggugag

SEQ ID NO: 740082 - RNA, 22 nt, Human
augaaauguaugagucuggguu

SEQ ID NO: 740083 - RNA, 22 nt, Human
caaugucugaccguuuugccca

SEQ ID NO: 740084 - RNA, 22 nt, Human
ugauuuuuggaucugagcugca

SEQ ID NO: 740085 - RNA, 22 nt, Human
aaucgcuugguaauuuuaaaag

SEQ ID NO: 740086 - RNA, 22 nt, Human
aaagguuuccgagcuuuaauuu

SEQ ID NO: 740087 - RNA, 22 nt, Human
acacuuugaagauggaaacuug

SEQ ID NO: 740088 - RNA, 20 nt, Human
ccuccaggcacacccaugug

SEQ ID NO: 740089 - RNA, 22 nt, Human
uuccucuggaggcucuaggaga

SEQ ID NO: 740090 - RNA, 22 nt, Human
ugcaccugagaggucucugagg

SEQ ID NO: 740091 - RNA, 22 nt, Human
gcuuugcugaggucugaggauu

SEQ ID NO: 740092 - RNA, 22 nt, Human
ugcuucugcauucaauguugga

SEQ ID NO: 740093 - RNA, 22 nt, Human
uucauguauuuaucauguaaau

SEQ ID NO: 740094 - RNA, 22 nt, Human
cccaggagacugagcuguaacc

SEQ ID NO: 740095 - RNA, 22 nt, Human
ucagaggacagcagcuaaauaa

SEQ ID NO: 740096 - RNA, 22 nt, Human
cuggauucuuucauaaaaguca

SEQ ID NO: 740097 - RNA, 22 nt, Human
uguuuucugaugguuaaugagu

SEQ ID NO: 740098 - RNA, 17 nt, Human
auuccacagggaaucug

SEQ ID NO: 740099 - RNA, 19 nt, Human
uuuuccugccucauuguuu

SEQ ID NO: 740100 - RNA, 22 nt, Human
agauuuccaucuuuuucaugug

SEQ ID NO: 740101 - RNA, 22 nt, Human
ugccucagagugggcuugcuau

SEQ ID NO: 740102 - RNA, 22 nt, Human
uuuuuaugccuacgcugaaaag

SEQ ID NO: 740103 - RNA, 22 nt, Human
cucuuucaguucugauagucuc

SEQ ID NO: 740104 - RNA, 22 nt, Human
aagagacuaagaaagggcaaua

SEQ ID NO: 740105 - RNA, 21 nt, Human
ucucuguguacagucucaccc

SEQ ID NO: 740106 - RNA, 22 nt, Human
auguucuuucagccagugcauc

SEQ ID NO: 740107 - RNA, 22 nt, Human
gggaaaauauuaagcaggacuu

SEQ ID NO: 740108 - RNA, 22 nt, Human
ucagugcauggacagauuuaga

SEQ ID NO: 740109 - RNA, 22 nt, Human
ccagaaagaaugaacugaaccc

SEQ ID NO: 740110 - RNA, 22 nt, Human
uuauugccugauugaggucauu

SEQ ID NO: 740111 - RNA, 19 nt, Human
acauuuagaauguacuugc

SEQ ID NO: 740112 - RNA, 22 nt, Human
ucccugucucccuugagacuag

SEQ ID NO: 740113 - RNA, 20 nt, Human
ucagauuuugggucacugau

SEQ ID NO: 740114 - RNA, 22 nt, Human
uccugggaagcgccggccugcg

SEQ ID NO: 740115 - RNA, 22 nt, Human
gagcuaaggcacaggcaggcuu

SEQ ID NO: 740116 - RNA, 22 nt, Human
acacaauuuccuguccauaugu

SEQ ID NO: 740117 - RNA, 22 nt, Human
accaggaguugggggugggacc

SEQ ID NO: 740118 - RNA, 19 nt, Human
caggcccuggacccaucug

SEQ ID NO: 740119 - RNA, 21 nt, Human
guucuacaguuuuagaauucc

SEQ ID NO: 740120 - RNA, 22 nt, Human
cagggccugcuuccuucuuguu

SEQ ID NO: 740121 - RNA, 23 nt, Human
uacagcugcagaaucaggcuaag

SEQ ID NO: 740122 - RNA, 22 nt, Human
ccucauuaacacaaugucauuu

SEQ ID NO: 740123 - RNA, 22 nt, Human
aggaucauauaagcuccagcua

SEQ ID NO: 740124 - RNA, 22 nt, Human
uucauagugcuuaauuugauaa

SEQ ID NO: 740125 - RNA, 22 nt, Human
uggguccugucuccuuguucug

SEQ ID NO: 740126 - RNA, 18 nt, Human
agacuuugaguuagaggg

SEQ ID NO: 740127 - RNA, 22 nt, Human
uggcuggagggacccacucaga

SEQ ID NO: 740128 - RNA, 22 nt, Human
ucucaaauggcaaauguggguc

SEQ ID NO: 740129 - RNA, 22 nt, Human
cauugcacaucugagaagagau

SEQ ID NO: 740130 - RNA, 22 nt, Human
guuaguggguuacucucagccc

SEQ ID NO: 740131 - RNA, 22 nt, Human
uacagccucgaacuccugcauu

SEQ ID NO: 740132 - RNA, 22 nt, Human
uuugguuuagggucauuuaaca

SEQ ID NO: 740133 - RNA, 22 nt, Human
guccagcugcagcugggcagaa

SEQ ID NO: 740134 - RNA, 20 nt, Human
gucugaggagcagugggaaa

SEQ ID NO: 740135 - RNA, 22 nt, Human
ucagagcacuggugcuaccuug

SEQ ID NO: 740136 - RNA, 22 nt, Human
uggcucucugggagguccuggc

SEQ ID NO: 740137 - RNA, 22 nt, Human
guuaaacaguuacaugugcugg

SEQ ID NO: 740138 - RNA, 23 nt, Human
ggcacugaagcuacaauggugag

SEQ ID NO: 740139 - RNA, 22 nt, Human
cccuggagugugacgaggcauu

SEQ ID NO: 740140 - RNA, 22 nt, Human
uagcuucucuuuucaacaucuu

SEQ ID NO: 740141 - RNA, 22 nt, Human
ucccugcccugccuucaugguu

SEQ ID NO: 740142 - RNA, 22 nt, Human
ccagagcagggcagcagggcuc

SEQ ID NO: 740143 - RNA, 22 nt, Human
aagcaaggccggaaggaaacuc

SEQ ID NO: 740144 - RNA, 22 nt, Human
cuccucuagaagcugaccugga

SEQ ID NO: 740145 - RNA, 22 nt, Human
aaaauagcauauugcuuucuuu

SEQ ID NO: 740146 - RNA, 23 nt, Human
cugcagucgccggccugggugcc

SEQ ID NO: 740147 - RNA, 22 nt, Human
cagcauggacccaucgcugagu

SEQ ID NO: 740148 - RNA, 22 nt, Human
aauauggcuccauuccuuuagg

SEQ ID NO: 740149 - RNA, 22 nt, Human
cuccuggaagcccgcccugcug

SEQ ID NO: 740150 - RNA, 22 nt, Human
gcugugugcuaggauauguuuu

SEQ ID NO: 740151 - RNA, 22 nt, Human
ugcuccagggcugccagacccu

SEQ ID NO: 740152 - RNA, 22 nt, Human
cuggacuuggggaggcuagauu

SEQ ID NO: 740153 - RNA, 22 nt, Human
uguguuugggggagaugcauuu

SEQ ID NO: 740154 - RNA, 22 nt, Human
gaggacacaaaguggcugagau

SEQ ID NO: 740155 - RNA, 22 nt, Human
cuguccauuuugaauuuucagu

SEQ ID NO: 740156 - RNA, 22 nt, Human
agcuggcaucugaagucagggc

SEQ ID NO: 740157 - RNA, 22 nt, Human
aagggcuggagacugggucuuc

SEQ ID NO: 740158 - RNA, 22 nt, Human
aauaggaaaauauuuaacaaga

SEQ ID NO: 740159 - RNA, 22 nt, Human
ucacaugucaaaaacuacauaa

SEQ ID NO: 740160 - RNA, 22 nt, Human
gccugucugcagggcugucauu

SEQ ID NO: 740161 - RNA, 22 nt, Human
uuucacaggggcaaccuccaug

SEQ ID NO: 740162 - RNA, 22 nt, Human
uggcccugaaggccuugagcau

SEQ ID NO: 740163 - RNA, 22 nt, Human
cugcugaaaacaauaaugauga

SEQ ID NO: 740164 - RNA, 20 nt, Human
ggcagccaaucagcgugccg

SEQ ID NO: 740165 - RNA, 22 nt, Human
aaugucuuaaagucguguuaca

SEQ ID NO: 740166 - RNA, 21 nt, Human
uucuucaguuuaauauaaaau

SEQ ID NO: 740167 - RNA, 22 nt, Human
ugcugcagcggcauggucuuug

SEQ ID NO: 740168 - RNA, 22 nt, Human
gaaguggaagccaucggcaguc

SEQ ID NO: 740169 - RNA, 22 nt, Human
gaaggaggugucaguuggacug

SEQ ID NO: 740170 - RNA, 22 nt, Human
aagagcauuuuguaaaauccuu

SEQ ID NO: 740171 - RNA, 22 nt, Human
uucauuugccaucaguguaaug

SEQ ID NO: 740172 - RNA, 22 nt, Human
caaugcuucaggcuccuuauag

SEQ ID NO: 740173 - RNA, 22 nt, Human
uuuaaaaccaaagaaagccucu

SEQ ID NO: 740174 - RNA, 22 nt, Human
ugcagaauguggacaguggguu

SEQ ID NO: 740175 - RNA, 20 nt, Human
uggggaguugagcacgagca

SEQ ID NO: 740176 - RNA, 22 nt, Human
aaaauacacauacuaggggaaa

SEQ ID NO: 740177 - RNA, 22 nt, Human
ucaaagucauggcuaguaauga

SEQ ID NO: 740178 - RNA, 22 nt, Human
uucuuuaccacuacucuuccaa

SEQ ID NO: 740179 - RNA, 23 nt, Human
aggaggccugaaacugaggcuga

SEQ ID NO: 740180 - RNA, 22 nt, Human
aaauauugguaggaugcuuguu

SEQ ID NO: 740181 - RNA, 22 nt, Human
uguggccagcagguggcugugu

SEQ ID NO: 740182 - RNA, 22 nt, Human
agggcagagauuaauuaagaca

SEQ ID NO: 740183 - RNA, 22 nt, Human
uacacccuucuccugagugugu

SEQ ID NO: 740184 - RNA, 18 nt, Human
ccuggcagccaugcgcgc

SEQ ID NO: 740185 - RNA, 22 nt, Human
guaacauucuagaaacuuaaca

SEQ ID NO: 740186 - RNA, 22 nt, Human
gcccugcuccaggagaauaccc

SEQ ID NO: 740187 - RNA, 22 nt, Human
ggcuccuguuauuuaaugagga

SEQ ID NO: 740188 - RNA, 22 nt, Human
gggcucagucugcggcgcgcgg

SEQ ID NO: 740189 - RNA, 22 nt, Human
ucaaagaagugcaaaccucauc

SEQ ID NO: 740190 - RNA, 20 nt, Human
uccuggagcugcuugaauuc

SEQ ID NO: 740191 - RNA, 22 nt, Human
cauagaaacugagacaaggauu

SEQ ID NO: 740192 - RNA, 20 nt, Human
agauggugaaggccagggag

SEQ ID NO: 740193 - RNA, 22 nt, Human
ggucagaggaggaauaggacau

SEQ ID NO: 740194 - RNA, 22 nt, Human
ugggaaauguguuucuggacca

SEQ ID NO: 740195 - RNA, 22 nt, Human
uggagagcccgagacauccugu

SEQ ID NO: 740196 - RNA, 22 nt, Human
uuucuucagccuucacaaccug

SEQ ID NO: 740197 - RNA, 22 nt, Human
cuggcuguaacauuuugccaua

SEQ ID NO: 740198 - RNA, 22 nt, Human
aagcacauacauaauaaagucc

SEQ ID NO: 740199 - RNA, 22 nt, Human
caaucuuagagagauucuuuua

SEQ ID NO: 740200 - RNA, 22 nt, Human
gccagcucuugaugggugggua

SEQ ID NO: 740201 - RNA, 22 nt, Human
ugucuuuagccagcagucuucu

SEQ ID NO: 740202 - RNA, 22 nt, Human
caggugaggcugaacagaugaa

SEQ ID NO: 740203 - RNA, 22 nt, Human
guauuugauagauuucaaagga

SEQ ID NO: 740204 - RNA, 22 nt, Human
acuggcaucccacugguacagg

SEQ ID NO: 740205 - RNA, 22 nt, Human
cacagcauaaugaaauauacuu

SEQ ID NO: 740206 - RNA, 22 nt, Human
uaucaauacauguuaucagugu

SEQ ID NO: 740207 - RNA, 22 nt, Human
agcugaaauucacaaggaucca

SEQ ID NO: 740208 - RNA, 22 nt, Human
aacuguucuucauuuucaguau

SEQ ID NO: 740209 - RNA, 22 nt, Human
guaaaacauguuuuaacuagga

SEQ ID NO: 740210 - RNA, 20 nt, Human
accagagacuggggacaagu

SEQ ID NO: 740211 - RNA, 22 nt, Human
uauauuaaaugaccaguuuuaa

SEQ ID NO: 740212 - RNA, 21 nt, Human
agcauucugcuucuuuccugg

SEQ ID NO: 740213 - RNA, 22 nt, Human
uaaggaaugcuugaauguuccu

SEQ ID NO: 740214 - RNA, 22 nt, Human
cagagcuggcggugagaagaca

SEQ ID NO: 740215 - RNA, 22 nt, Human
gucuggggugaggcccgggauu

SEQ ID NO: 740216 - RNA, 22 nt, Human
agauguuccagccaaugggaau

SEQ ID NO: 740217 - RNA, 22 nt, Human
uggaaacuaacaacagagcaga

SEQ ID NO: 740218 - RNA, 20 nt, Human
accuggcucucaggagcaac

SEQ ID NO: 740219 - RNA, 22 nt, Human
ggcuucuguccucuggaucugu

SEQ ID NO: 740220 - RNA, 22 nt, Human
aggcccagagagccaguuagug

SEQ ID NO: 740221 - RNA, 22 nt, Human
acaacugaugggucauguggga

SEQ ID NO: 740222 - RNA, 22 nt, Human
ccacuugacauuuucauuaaga

SEQ ID NO: 740223 - RNA, 22 nt, Human
gagucuguaugucuuccaugca

SEQ ID NO: 740224 - RNA, 22 nt, Human
ugauacagagaaagcaucuuuu

SEQ ID NO: 740225 - RNA, 22 nt, Human
gccuggguccacugaucaugcu

SEQ ID NO: 740226 - RNA, 16 nt, Human
aaggcugauuuucccu

SEQ ID NO: 740227 - RNA, 22 nt, Human
uuagaaaggaaucuucauuuca

SEQ ID NO: 740228 - RNA, 22 nt, Human
auucucuguucaaggaugguga

SEQ ID NO: 740229 - RNA, 22 nt, Human
agagauguaugcauuugucaca

SEQ ID NO: 740230 - RNA, 22 nt, Human
cucagggagguccugugcugaa

SEQ ID NO: 740231 - RNA, 22 nt, Human
cugaggagaaagaugguccaag

SEQ ID NO: 740232 - RNA, 22 nt, Human
acuggcaguggcagcagaaaga

SEQ ID NO: 740233 - RNA, 22 nt, Human
cuggugguucaggagaauggcu

SEQ ID NO: 740234 - RNA, 18 nt, Human
auaucagcuacuucaugg

SEQ ID NO: 740235 - RNA, 22 nt, Human
gcucugcugggugggcaguuau

SEQ ID NO: 740236 - RNA, 22 nt, Human
ugcuccagaaccugaccaugcu

SEQ ID NO: 740237 - RNA, 22 nt, Human
uccagcucaggguuggcucaag

SEQ ID NO: 740238 - RNA, 22 nt, Human
gcaguguguguccccacacugg

SEQ ID NO: 740239 - RNA, 22 nt, Human
auggcuuugaaguucagcuuuu

SEQ ID NO: 740240 - RNA, 22 nt, Human
cacccagugaaggagcaagagg

SEQ ID NO: 740241 - RNA, 22 nt, Human
ggagauccaggcugagucuuuc

SEQ ID NO: 740242 - RNA, 22 nt, Human
gggcugcuuuuaagggucucag

SEQ ID NO: 740243 - RNA, 22 nt, Human
uugaaagauauguuaaucuuuc

SEQ ID NO: 740244 - RNA, 22 nt, Human
uuuuaauccucuugguaucuua

SEQ ID NO: 740245 - RNA, 21 nt, Human
ucaggagagcccaucuacaaa

SEQ ID NO: 740246 - RNA, 22 nt, Human
ucugagugucuuaauaggcucu

SEQ ID NO: 740247 - RNA, 22 nt, Human
uguguguauccauuagaggcca

SEQ ID NO: 740248 - RNA, 23 nt, Human
gccugccugaccugugcaaaguc

SEQ ID NO: 740249 - RNA, 22 nt, Human
gcuuuacagggcacaaagggag

SEQ ID NO: 740250 - RNA, 22 nt, Human
gggacccugggaggcuggcgca

SEQ ID NO: 740251 - RNA, 22 nt, Human
cuuugcagauuuguuuagugcu

SEQ ID NO: 740252 - RNA, 23 nt, Human
acaacaggaaaucagaccugaac

SEQ ID NO: 740253 - RNA, 22 nt, Human
uggguccucugagagggcagcg

SEQ ID NO: 740254 - RNA, 22 nt, Human
acaaaggugcgucccuucagcu

SEQ ID NO: 740255 - RNA, 22 nt, Human
uguguacaggacagaaaggagg

SEQ ID NO: 740256 - RNA, 22 nt, Human
cuucuauucacuggucacaguu

SEQ ID NO: 740257 - RNA, 22 nt, Human
cuguggcaaaugauaccuccca

SEQ ID NO: 740258 - RNA, 22 nt, Human
gcaggaugaaggcagaggcuga

SEQ ID NO: 740259 - RNA, 22 nt, Human
cugggaggugcagcaaaaauca

SEQ ID NO: 740260 - RNA, 22 nt, Human
uccaggacagcggcaggcagau

SEQ ID NO: 740261 - RNA, 21 nt, Human
ucuuccuccacagcgugccac

SEQ ID NO: 740262 - RNA, 22 nt, Human
ccuuuauucaauuaguccuaau

SEQ ID NO: 740263 - RNA, 22 nt, Human
cucuggagugcagccugguggc

SEQ ID NO: 740264 - RNA, 22 nt, Human
uucuuguucugguucuguuagc

SEQ ID NO: 740265 - RNA, 20 nt, Human
aaagucuuaugguuaauuuu

SEQ ID NO: 740266 - RNA, 22 nt, Human
gagcccugagaguugugaggcc

SEQ ID NO: 740267 - RNA, 22 nt, Human
gcacacagggauuuuugaaugg

SEQ ID NO: 740268 - RNA, 22 nt, Human
uucaauucugcucugaucuuag

SEQ ID NO: 740269 - RNA, 22 nt, Human
cugcagccucaaccuccugagc

SEQ ID NO: 740270 - RNA, 22 nt, Human
uacaaaggaguagagaaggcuu

SEQ ID NO: 740271 - RNA, 22 nt, Human
ugaacugcaggaaucucagugg

SEQ ID NO: 740272 - RNA, 22 nt, Human
uaacagcaggguuacaggcauu

SEQ ID NO: 740273 - RNA, 22 nt, Human
aagaggcuuucagugaacuugu

SEQ ID NO: 740274 - RNA, 22 nt, Human
aaaaauagcuucucuugucccu

SEQ ID NO: 740275 - RNA, 22 nt, Human
auuuaaugucgagcuauuguag

SEQ ID NO: 740276 - RNA, 22 nt, Human
uuucuuaugggguaguccuuua

SEQ ID NO: 740277 - RNA, 22 nt, Human
augcauuuauguguguacauug

SEQ ID NO: 740278 - RNA, 22 nt, Human
gccuccaccccuggggagugga

SEQ ID NO: 740279 - RNA, 22 nt, Human
ucauuucucccggccaaaaacu

SEQ ID NO: 740280 - RNA, 20 nt, Human
ugaggcaggagaauggcaug

SEQ ID NO: 740281 - RNA, 22 nt, Human
gucugagacugggcacauaccu

SEQ ID NO: 740282 - RNA, 22 nt, Human
gcucagagaaaacuggggcuug

SEQ ID NO: 740283 - RNA, 22 nt, Human
uuagguaaggauggugacagua

SEQ ID NO: 740284 - RNA, 22 nt, Human
uagcagcuccauuucucuggca

SEQ ID NO: 740285 - RNA, 22 nt, Human
ucuaugaaccucugcaaugaca

SEQ ID NO: 740286 - RNA, 22 nt, Human
cuucacauguuggaguccuuug

SEQ ID NO: 740287 - RNA, 22 nt, Human
uaggagggggaacaaggcauac

SEQ ID NO: 740288 - RNA, 22 nt, Human
auucuggacaaggcaagcuccu

SEQ ID NO: 740289 - RNA, 22 nt, Human
ccagaccacccuggccaugcac

SEQ ID NO: 740290 - RNA, 22 nt, Human
aggcugucugaccccagagccc

SEQ ID NO: 740291 - RNA, 21 nt, Human
cauuucaugauuauagaaaug

SEQ ID NO: 740292 - RNA, 22 nt, Human
aaauugucagaauucagaaagu

SEQ ID NO: 740293 - RNA, 22 nt, Human
uggcaacaccuggaagacaugg

SEQ ID NO: 740294 - RNA, 18 nt, Human
ucauuauuguuucuggag

SEQ ID NO: 740295 - RNA, 22 nt, Human
cacagaacugguuaauagcaga

SEQ ID NO: 740296 - RNA, 22 nt, Human
uccuggggccaggcaccucugg

SEQ ID NO: 740297 - RNA, 20 nt, Human
ugcacagcugugaauaggau

SEQ ID NO: 740298 - RNA, 22 nt, Human
gcagccugaggcccuuucuggc

SEQ ID NO: 740299 - RNA, 22 nt, Human
cacaaaaucuuucucgauuauu

SEQ ID NO: 740300 - RNA, 22 nt, Human
uccccugcagaugagggcagug

SEQ ID NO: 740301 - RNA, 22 nt, Human
guccuggggaauacagaagccg

SEQ ID NO: 740302 - RNA, 22 nt, Human
cgaggccaugcaugcugaggac

SEQ ID NO: 740303 - RNA, 22 nt, Human
uacaguucacaguaucauaaau

SEQ ID NO: 740304 - RNA, 22 nt, Human
cacaauuuguuuuaucaguauu

SEQ ID NO: 740305 - RNA, 22 nt, Human
caugcaggccuauggagcagug

SEQ ID NO: 740306 - RNA, 22 nt, Human
ucuucccaaugcaaaguaggac

SEQ ID NO: 740307 - RNA, 22 nt, Human
auauaugaagaagucuugauua

SEQ ID NO: 740308 - RNA, 22 nt, Human
ucaaugacauuguaucagaguu

SEQ ID NO: 740309 - RNA, 22 nt, Human
augauucagcccaauuuuucua

SEQ ID NO: 740310 - RNA, 23 nt, Human
aaguuguuuuuggccagggaaag

SEQ ID NO: 740311 - RNA, 22 nt, Human
ucaaaugcggucauggcuuuua

SEQ ID NO: 740312 - RNA, 22 nt, Human
guauaaacauggagugcauucu

SEQ ID NO: 740313 - RNA, 22 nt, Human
acacuauaagacagauacagca

SEQ ID NO: 740314 - RNA, 22 nt, Human
gccuggcugggcaccaggggag

SEQ ID NO: 740315 - RNA, 19 nt, Human
gggagcugaggucuuuggu

SEQ ID NO: 740316 - RNA, 20 nt, Human
ggcaggcuuuauauggaggg

SEQ ID NO: 740317 - RNA, 23 nt, Human
ugagucaccacaguuacagucac

SEQ ID NO: 740318 - RNA, 22 nt, Human
acuuagcaccuauggcauuuuu

SEQ ID NO: 740319 - RNA, 22 nt, Human
agugcuuuaccuagauaauguu

SEQ ID NO: 740320 - RNA, 22 nt, Human
uucuuucucaacaugaauguuu

SEQ ID NO: 740321 - RNA, 19 nt, Human
acagugcaugggaccuggu

SEQ ID NO: 740322 - RNA, 22 nt, Human
uagccggguguugugucaugca

SEQ ID NO: 740323 - RNA, 22 nt, Human
uuuuucauauuccccucucugg

SEQ ID NO: 740324 - RNA, 22 nt, Human
gcagagcauuggagggacccug

SEQ ID NO: 740325 - RNA, 22 nt, Human
ugacuggagaccucaguagggu

SEQ ID NO: 740326 - RNA, 22 nt, Human
ccaguccuuugagccaguucug

SEQ ID NO: 740327 - RNA, 22 nt, Human
auuaaagacagcagauggaugg

SEQ ID NO: 740328 - RNA, 22 nt, Human
ggagugagcaaauagagauuug

SEQ ID NO: 740329 - RNA, 22 nt, Human
uaguacaguacugggcucuagu

SEQ ID NO: 740330 - RNA, 22 nt, Human
ugguuuuaaaagauguuugaga

SEQ ID NO: 740331 - RNA, 22 nt, Human
uggcagugaaccaaggcuccaa

SEQ ID NO: 740332 - RNA, 22 nt, Human
ggccuuggugcucuguguugca

SEQ ID NO: 740333 - RNA, 22 nt, Human
gugcagaccuuccagaaagaac

SEQ ID NO: 740334 - RNA, 22 nt, Human
ucaggaugaccacgagccucua

SEQ ID NO: 740335 - RNA, 22 nt, Human
uaggaauuuuuguaaugguacu

SEQ ID NO: 740336 - RNA, 22 nt, Human
uaaacuguggaauguucucuuu

SEQ ID NO: 740337 - RNA, 16 nt, Human
uccuaacuggcaguuc

SEQ ID NO: 740338 - RNA, 22 nt, Human
aagaagagaaaugugcugcugg

SEQ ID NO: 740339 - RNA, 22 nt, Human
gcuucuggcagugcagccacca

SEQ ID NO: 740340 - RNA, 22 nt, Human
cccuggaggucagaggccuggg

SEQ ID NO: 740341 - RNA, 22 nt, Human
aguauggggcugugugugcaca

SEQ ID NO: 740342 - RNA, 22 nt, Human
augugaaacgcaaugggaucau

SEQ ID NO: 740343 - RNA, 22 nt, Human
gguggguaaaacugcuggcacu

SEQ ID NO: 740344 - RNA, 19 nt, Human
uaagauggcaagugucucu

SEQ ID NO: 740345 - RNA, 19 nt, Human
ucucagaauuaagagugcu

SEQ ID NO: 740346 - RNA, 22 nt, Human
ucugagcuaauccuguugccga

SEQ ID NO: 740347 - RNA, 20 nt, Human
ggcacugcaccaguuaguag

SEQ ID NO: 740348 - RNA, 22 nt, Human
ugcaggcuccacguuguugucc

SEQ ID NO: 740349 - RNA, 18 nt, Human
ggagcccacggcguccca

SEQ ID NO: 740350 - RNA, 19 nt, Human
aguuucccuggagacauca

SEQ ID NO: 740351 - RNA, 22 nt, Human
uacaaagauaaaaucucaccau

SEQ ID NO: 740352 - RNA, 22 nt, Human
augcugucaguauuaugugcag

SEQ ID NO: 740353 - RNA, 22 nt, Human
uacagugucugcaacugcacac

SEQ ID NO: 740354 - RNA, 22 nt, Human
gucaccagcaccaaugccacau

SEQ ID NO: 740355 - RNA, 22 nt, Human
gauaaaauaacuauggaauacu

SEQ ID NO: 740356 - RNA, 22 nt, Human
ugucacuucaguuuugaaacaa

SEQ ID NO: 740357 - RNA, 22 nt, Human
cugugcguaaguagccaaaaua

SEQ ID NO: 740358 - RNA, 22 nt, Human
agaaugggggcuacaggccaca

SEQ ID NO: 740359 - RNA, 22 nt, Human
ugucacucaaguuccaauuuac

SEQ ID NO: 740360 - RNA, 22 nt, Human
uuuagacaagauccuucugaau

SEQ ID NO: 740361 - RNA, 22 nt, Human
gucauuccuauccauuugauac

SEQ ID NO: 740362 - RNA, 22 nt, Human
caggcagcaggagcccugcucg

SEQ ID NO: 740363 - RNA, 22 nt, Human
gcacuugacccccagagcuggu

SEQ ID NO: 740364 - RNA, 22 nt, Human
agaggcaagauuaucagggcau

SEQ ID NO: 740365 - RNA, 22 nt, Human
ggaggagagagguugcaaacac

SEQ ID NO: 740366 - RNA, 22 nt, Human
auguuuauguugggcuauauuu

SEQ ID NO: 740367 - RNA, 22 nt, Human
ucuguuugcuggugcauggguu

SEQ ID NO: 740368 - RNA, 22 nt, Human
uugaccauaccuccaggcaguu

SEQ ID NO: 740369 - RNA, 22 nt, Human
gagagucuagugcaccuaguuu

SEQ ID NO: 740370 - RNA, 22 nt, Human
ugugugucagagucuccauggu

SEQ ID NO: 740371 - RNA, 22 nt, Human
aaagucauccaaauuuuuaugu

SEQ ID NO: 740372 - RNA, 22 nt, Human
acuauauacacauuaucuuguu

SEQ ID NO: 740373 - RNA, 22 nt, Human
gucccucugccugugguucucu

SEQ ID NO: 740374 - RNA, 22 nt, Human
ugcuccugagguuggagaucca

SEQ ID NO: 740375 - RNA, 18 nt, Human
ccaggacaggcaaaaggu

SEQ ID NO: 740376 - RNA, 22 nt, Human
ccuccagcauuacuggcccaug

SEQ ID NO: 740377 - RNA, 22 nt, Human
cagggugacugcccuggccacu

SEQ ID NO: 740378 - RNA, 22 nt, Human
gacuguggcuaaugguguuagg

SEQ ID NO: 740379 - RNA, 22 nt, Human
acugucucucuagcaguucagg

SEQ ID NO: 740380 - RNA, 20 nt, Human
aaguuacauuguauuguacc

SEQ ID NO: 740381 - RNA, 22 nt, Human
cacuggaauggauagagcagag

SEQ ID NO: 740382 - RNA, 22 nt, Human
ugaaaagugaucauggauuagg

SEQ ID NO: 740383 - RNA, 22 nt, Human
uuauucugccaggagcgucagu

SEQ ID NO: 740384 - RNA, 22 nt, Human
aguggcuguuccaggugaggac

SEQ ID NO: 740385 - RNA, 19 nt, Human
uaugugugcauuugugcau

SEQ ID NO: 740386 - RNA, 22 nt, Human
ugggggcagaggauucaggaau

SEQ ID NO: 740387 - RNA, 22 nt, Human
uugcauuuugguuguaaauaug

SEQ ID NO: 740388 - RNA, 22 nt, Human
ccacugcuguuacuuacgcaaa

SEQ ID NO: 740389 - RNA, 22 nt, Human
gcuugcucaacccccgucucuc

SEQ ID NO: 740390 - RNA, 22 nt, Human
aagauucucagagugaaagaau

SEQ ID NO: 740391 - RNA, 22 nt, Human
cuucaagguggcuaaauggggc

SEQ ID NO: 740392 - RNA, 22 nt, Human
uggcugccaauggcuuggaaag

SEQ ID NO: 740393 - RNA, 22 nt, Human
uuaaaugacuuuuauuauucuc

SEQ ID NO: 740394 - RNA, 22 nt, Human
agggugcguucuaugagaaucu

SEQ ID NO: 740395 - RNA, 22 nt, Human
uuacaaugacagguguaucauu

SEQ ID NO: 740396 - RNA, 22 nt, Human
aaugucauuuaggauuauguuu

SEQ ID NO: 740397 - RNA, 20 nt, Human
cagucccaauccagggccag

SEQ ID NO: 740398 - RNA, 22 nt, Human
cuggaagacucaauggccugcc

SEQ ID NO: 740399 - RNA, 22 nt, Human
gguucucuaacuuugacuggag

SEQ ID NO: 740400 - RNA, 22 nt, Human
uuuucuuuaaucugguggggug

SEQ ID NO: 740401 - RNA, 22 nt, Human
gggcaguguugugguucucuau

SEQ ID NO: 740402 - RNA, 22 nt, Human
augcauugcuugaggguaggaa

SEQ ID NO: 740403 - RNA, 22 nt, Human
uggaggagugugauugucugcc

SEQ ID NO: 740404 - RNA, 22 nt, Human
uaaggacauuagaaaugaugcu

SEQ ID NO: 740405 - RNA, 22 nt, Human
gcugccuucaguucugauucau

SEQ ID NO: 740406 - RNA, 22 nt, Human
auauaauaguuucauaaaggcu

SEQ ID NO: 740407 - RNA, 22 nt, Human
uugaagagugccuuccagacau

SEQ ID NO: 740408 - RNA, 19 nt, Human
agcagagcaaaguggcuga

SEQ ID NO: 740409 - RNA, 19 nt, Human
cacaaaugaugaggaccug

SEQ ID NO: 740410 - RNA, 22 nt, Human
guguuuccuaguuuaaugaaug

SEQ ID NO: 740411 - RNA, 23 nt, Human
agcaguaacuucagaaacaucag

SEQ ID NO: 740412 - RNA, 19 nt, Human
ccaguccucuuugggccug

SEQ ID NO: 740413 - RNA, 22 nt, Human
ccugccagcccgcguucaugcc

SEQ ID NO: 740414 - RNA, 22 nt, Human
caggugcuguccugcacauguc

SEQ ID NO: 740415 - RNA, 22 nt, Human
agguagcuaaaacaggcuuuug

SEQ ID NO: 740416 - RNA, 22 nt, Human
ccaggaagguguuuaacuagag

SEQ ID NO: 740417 - RNA, 23 nt, Human
ccucucucccuguuuggcaaaua

SEQ ID NO: 740418 - RNA, 22 nt, Human
uuaacacugauuguagagacac

SEQ ID NO: 740419 - RNA, 22 nt, Human
ugcuggaggcaguggaggugcc

SEQ ID NO: 740420 - RNA, 22 nt, Human
auguucuguuuuguaauucaua

SEQ ID NO: 740421 - RNA, 22 nt, Human
aaggaagaugaggugcugcuua

SEQ ID NO: 740422 - RNA, 22 nt, Human
uagucucugcuuugcccuuggc

SEQ ID NO: 740423 - RNA, 22 nt, Human
uuaguaaauaaagucuacuuuc

SEQ ID NO: 740424 - RNA, 22 nt, Human
ccacaguccgggcuggcaggac

SEQ ID NO: 740425 - RNA, 22 nt, Human
gaaggaggcguuagcccuagga

SEQ ID NO: 740426 - RNA, 22 nt, Human
cuugauguauaaguugauaugu

SEQ ID NO: 740427 - RNA, 22 nt, Human
aaaaugacauuccagugauauu

SEQ ID NO: 740428 - RNA, 22 nt, Human
cugcuguucugaagcaacaagc

SEQ ID NO: 740429 - RNA, 22 nt, Human
agcuuuuacauaaugaucuuga

SEQ ID NO: 740430 - RNA, 22 nt, Human
uuauaugaacuggacuuuagga

SEQ ID NO: 740431 - RNA, 22 nt, Human
acauuugugcacaugugcaugg

SEQ ID NO: 740432 - RNA, 22 nt, Human
cuggguaaaggcugcuuuucua

SEQ ID NO: 740433 - RNA, 20 nt, Human
gccucagucacauggccuac

SEQ ID NO: 740434 - RNA, 20 nt, Human
gccugccucagcuagcugag

SEQ ID NO: 740435 - RNA, 22 nt, Human
ccaggcuccccaggaggcccuu

SEQ ID NO: 740436 - RNA, 22 nt, Human
ucccagccugacagugcaucaa

SEQ ID NO: 740437 - RNA, 22 nt, Human
ugguacaaucacagcucacugu

SEQ ID NO: 740438 - RNA, 22 nt, Human
ccaguaaaccaaguguuuacua

SEQ ID NO: 740439 - RNA, 22 nt, Human
cugggcugcaggaguggggcaa

SEQ ID NO: 740440 - RNA, 22 nt, Human
aauuuuacaaaauaccuccgau

SEQ ID NO: 740441 - RNA, 20 nt, Human
uccagggcuagggagcucau

SEQ ID NO: 740442 - RNA, 22 nt, Human
gccacucaugggaggugugcaa

SEQ ID NO: 740443 - RNA, 22 nt, Human
uaaagcuuguauugcaauauuu

SEQ ID NO: 740444 - RNA, 22 nt, Human
ucagaggaggcauuuaaacaga

SEQ ID NO: 740445 - RNA, 22 nt, Human
uccugggagaguuugauucauu

SEQ ID NO: 740446 - RNA, 22 nt, Human
guccugaggcaggauggguuuc

SEQ ID NO: 740447 - RNA, 20 nt, Human
cagcccuuuauccuccuaug

SEQ ID NO: 740448 - RNA, 22 nt, Human
caggaugaagggcaaaggcaag

SEQ ID NO: 740449 - RNA, 22 nt, Human
caugcaguugaagcacagagag

SEQ ID NO: 740450 - RNA, 22 nt, Human
aagaucaccuugacaugaaaag

SEQ ID NO: 740451 - RNA, 22 nt, Human
guuacaaaggacugggggccac

SEQ ID NO: 740452 - RNA, 22 nt, Human
uauuagcacaaagcaagguauu

SEQ ID NO: 740453 - RNA, 22 nt, Human
aggccuggccccaguugcuagg

SEQ ID NO: 740454 - RNA, 22 nt, Human
gauacauuccauuucuacuuaa

SEQ ID NO: 740455 - RNA, 21 nt, Human
acugaccacuucugccugucu

SEQ ID NO: 740456 - RNA, 22 nt, Human
uuaaaugaggcugauguagauu

SEQ ID NO: 740457 - RNA, 22 nt, Human
cagagguagggagcuauguuau

SEQ ID NO: 740458 - RNA, 20 nt, Human
auuaggauuuuaggucauca

SEQ ID NO: 740459 - RNA, 22 nt, Human
acagauaauuagcauaaaugcu

SEQ ID NO: 740460 - RNA, 22 nt, Human
aggucugaguuuguuguuggcu

SEQ ID NO: 740461 - RNA, 22 nt, Human
guguccuuuugaggguccacag

SEQ ID NO: 740462 - RNA, 22 nt, Human
uaagcaaugcuguaguucaguc

SEQ ID NO: 740463 - RNA, 22 nt, Human
uauuuggaaaggacauguaagu

SEQ ID NO: 740464 - RNA, 22 nt, Human
uuaucuguuuucugugcguuuc

SEQ ID NO: 740465 - RNA, 22 nt, Human
cagaaccugagagcacaauccu

SEQ ID NO: 740466 - RNA, 22 nt, Human
ugggccucccaugucuuaggga

SEQ ID NO: 740467 - RNA, 22 nt, Human
uggcaggugaaguuguuaggga

SEQ ID NO: 740468 - RNA, 22 nt, Human
uagcccagaugauugaaccaug

SEQ ID NO: 740469 - RNA, 22 nt, Human
cugcugcccagugugcauuggg

SEQ ID NO: 740470 - RNA, 22 nt, Human
ucauugcaguagggagagaccc

SEQ ID NO: 740471 - RNA, 22 nt, Human
uuuaucaaacaaauuauccagc

SEQ ID NO: 740472 - RNA, 23 nt, Human
acaagcagcccagugcucugccu

SEQ ID NO: 740473 - RNA, 22 nt, Human
ucaccccuacauuucccuugcu

SEQ ID NO: 740474 - RNA, 22 nt, Human
ggugagcaaagcuucaucugua

SEQ ID NO: 740475 - RNA, 22 nt, Human
aggcuucagacaaauguuaugg

SEQ ID NO: 740476 - RNA, 21 nt, Human
auuuucucuggaugaugguca

SEQ ID NO: 740477 - RNA, 22 nt, Human
uugauuucuauucagauguaga

SEQ ID NO: 740478 - RNA, 22 nt, Human
ggaagggaaaauucauucggcu

SEQ ID NO: 740479 - RNA, 22 nt, Human
acuuuucaaaugggaaacucag

SEQ ID NO: 740480 - RNA, 22 nt, Human
acccaggaugauaauguucaca

SEQ ID NO: 740481 - RNA, 22 nt, Human
cugcucuguauaugagcaggaa

SEQ ID NO: 740482 - RNA, 22 nt, Human
uuugauucuggccucugagaag

SEQ ID NO: 740483 - RNA, 22 nt, Human
gcugcucagugggccugagccu

SEQ ID NO: 740484 - RNA, 22 nt, Human
ugccucugugggcagagcugcc

SEQ ID NO: 740485 - RNA, 22 nt, Human
ucccuuuggauccaagcuuaug

SEQ ID NO: 740486 - RNA, 20 nt, Human
agggcugagaagggacuagc

SEQ ID NO: 740487 - RNA, 22 nt, Human
cagagccucaucauccacucca

SEQ ID NO: 740488 - RNA, 22 nt, Human
uucucaguuucauagcugagca

SEQ ID NO: 740489 - RNA, 22 nt, Human
cucaggauugugccuagggaga

SEQ ID NO: 740490 - RNA, 22 nt, Human
agccccagccccucucucacaa

SEQ ID NO: 740491 - RNA, 20 nt, Human
auuugcaucugaauaacuua

SEQ ID NO: 740492 - RNA, 22 nt, Human
acaguguagugugaugucaaaa

SEQ ID NO: 740493 - RNA, 22 nt, Human
ucacagaaaaguggagagccua

SEQ ID NO: 740494 - RNA, 22 nt, Human
cugccugcguugccucgugccu

SEQ ID NO: 740495 - RNA, 22 nt, Human
ccaaagugcugagauuacaggu

SEQ ID NO: 740496 - RNA, 22 nt, Human
ggcacagagcccagcuuccuag

SEQ ID NO: 740497 - RNA, 22 nt, Human
gcagaggucaaauaccucauuu

SEQ ID NO: 740498 - RNA, 22 nt, Human
cagaggugcauacaggucauua

SEQ ID NO: 740499 - RNA, 22 nt, Human
uauguguggcagcugggagugu

SEQ ID NO: 740500 - RNA, 22 nt, Human
aggcacuuuccuugaggaguuu

SEQ ID NO: 740501 - RNA, 22 nt, Human
ccuggacagagggcagcggcca

SEQ ID NO: 740502 - RNA, 22 nt, Human
uuaucuuguagagauauuuucg

SEQ ID NO: 740503 - RNA, 19 nt, Human
ucuacaaaguggcaucagg

SEQ ID NO: 740504 - RNA, 22 nt, Human
aacagguagggacucuaacuug

SEQ ID NO: 740505 - RNA, 22 nt, Human
ucacuggugugagaggagcaaa

SEQ ID NO: 740506 - RNA, 22 nt, Human
gucuggaggagggcucugcggc

SEQ ID NO: 740507 - RNA, 22 nt, Human
ugcauucaguuggucagcuuuu

SEQ ID NO: 740508 - RNA, 22 nt, Human
agcugaggaggaaugaugggua

SEQ ID NO: 740509 - RNA, 22 nt, Human
cccaaggcugcagugagcauga

SEQ ID NO: 740510 - RNA, 22 nt, Human
ugccaggccaaugaaggcaggg

SEQ ID NO: 740511 - RNA, 22 nt, Human
aucgagggugaguacagcggac

SEQ ID NO: 740512 - RNA, 22 nt, Human
agagagagaaaugaaaugugcu

SEQ ID NO: 740513 - RNA, 22 nt, Human
caaagaaggaacuauaauccca

SEQ ID NO: 740514 - RNA, 22 nt, Human
ccagcuuuggaguguuguugcu

SEQ ID NO: 740515 - RNA, 18 nt, Human
ucugggcaaucucaguau

SEQ ID NO: 740516 - RNA, 23 nt, Human
uguaggcuaagucccauaaauca

SEQ ID NO: 740517 - RNA, 22 nt, Human
agguggaacguucaggugcuag

SEQ ID NO: 740518 - RNA, 18 nt, Human
gcucuggcucaccuccag

SEQ ID NO: 740519 - RNA, 22 nt, Human
ugagagucuguuccucuugcag

SEQ ID NO: 740520 - RNA, 22 nt, Human
gucugcagagggaaggcuucag

SEQ ID NO: 740521 - RNA, 22 nt, Human
cuguuuauaaaccaccaguuua

SEQ ID NO: 740522 - RNA, 22 nt, Human
gcucaggaccgaggggugggaa

SEQ ID NO: 740523 - RNA, 22 nt, Human
aagcuccccgaaacccaccucu

SEQ ID NO: 740524 - RNA, 22 nt, Human
uuuguuuacucauucauugaug

SEQ ID NO: 740525 - RNA, 22 nt, Human
aaugauaccaaacauguagaua

SEQ ID NO: 740526 - RNA, 22 nt, Human
uauucauaguaaacaaaagugg

SEQ ID NO: 740527 - RNA, 22 nt, Human
gggcccuggccgaaucccucug

SEQ ID NO: 740528 - RNA, 22 nt, Human
guaggaaaguaaaugaaauaca

SEQ ID NO: 740529 - RNA, 22 nt, Human
uugcuuuacauguucugguaaa

SEQ ID NO: 740530 - RNA, 22 nt, Human
ugaaaucaucugccaauaaguu

SEQ ID NO: 740531 - RNA, 22 nt, Human
uccaguaucaaaguccuagucc

SEQ ID NO: 740532 - RNA, 22 nt, Human
auguggaggaaaugaguguaca

SEQ ID NO: 740533 - RNA, 22 nt, Human
ccaggcucaccuggagccccug

SEQ ID NO: 740534 - RNA, 22 nt, Human
accagugggaaguggaaaauga

SEQ ID NO: 740535 - RNA, 18 nt, Human
aauggaaggggugcuguu

SEQ ID NO: 740536 - RNA, 22 nt, Human
aacagcagggaugacauggcca

SEQ ID NO: 740537 - RNA, 22 nt, Human
ugagauucuguucagaaaaaug

SEQ ID NO: 740538 - RNA, 19 nt, Human
ggcuucgaggcuggggaag

SEQ ID NO: 740539 - RNA, 22 nt, Human
aguaacaaauauucauuggauu

SEQ ID NO: 740540 - RNA, 22 nt, Human
cugcucugcaaggcacagugau

SEQ ID NO: 740541 - RNA, 22 nt, Human
aaggucauuguugcauguucuc

SEQ ID NO: 740542 - RNA, 22 nt, Human
uucucaggccuuugggauggga

SEQ ID NO: 740543 - RNA, 22 nt, Human
uucacaauaggagcaugcaaau

SEQ ID NO: 740544 - RNA, 22 nt, Human
uuaucguacgcuucagaaauuu

SEQ ID NO: 740545 - RNA, 22 nt, Human
ccugaagaugagggacagcuaa

SEQ ID NO: 740546 - RNA, 22 nt, Human
ccuccucugggaagauucagag

SEQ ID NO: 740547 - RNA, 22 nt, Human
gaguaauuuucuuaaaacauca

SEQ ID NO: 740548 - RNA, 22 nt, Human
uucucugccucacaggucuaag

SEQ ID NO: 740549 - RNA, 22 nt, Human
uacuagaaccucacaacaaucc

SEQ ID NO: 740550 - RNA, 22 nt, Human
uacacaguauaugggaucacag

SEQ ID NO: 740551 - RNA, 22 nt, Human
aucaaaguccaucagaagguag

SEQ ID NO: 740552 - RNA, 22 nt, Human
caggaggcagcgcucucaggac

SEQ ID NO: 740553 - RNA, 22 nt, Human
uuauucagcucucuagaggcac

SEQ ID NO: 740554 - RNA, 23 nt, Human
auugaugacuugauuacacuuuu

SEQ ID NO: 740555 - RNA, 22 nt, Human
cugggccugucagggcuuuuug

SEQ ID NO: 740556 - RNA, 22 nt, Human
gaccuucaagcaccauauuuau

SEQ ID NO: 740557 - RNA, 22 nt, Human
ugagcagaagcccuccuggacu

SEQ ID NO: 740558 - RNA, 22 nt, Human
ucaaauauuggcuauuucacau

SEQ ID NO: 740559 - RNA, 22 nt, Human
aaacaguagaaguguauuuuau

SEQ ID NO: 740560 - RNA, 22 nt, Human
ucccugccaaugauuggagcaa

SEQ ID NO: 740561 - RNA, 22 nt, Human
uaaggcuuaugaucagaagguu

SEQ ID NO: 740562 - RNA, 23 nt, Human
aguucucaaaaccagcuugacaa

SEQ ID NO: 740563 - RNA, 22 nt, Human
cagcagcucccauccgcugagc

SEQ ID NO: 740564 - RNA, 22 nt, Human
ugauauaagaaguaguauggau

SEQ ID NO: 740565 - RNA, 22 nt, Human
cuucuuaaucccuuauauauuu

SEQ ID NO: 740566 - RNA, 22 nt, Human
caugcauagcuuuggagcuagg

SEQ ID NO: 740567 - RNA, 22 nt, Human
ucugugaaaucacccagguuua

SEQ ID NO: 740568 - RNA, 22 nt, Human
gagcugcagacuugauacagga

SEQ ID NO: 740569 - RNA, 22 nt, Human
uuuuucugucucuuacauugca

SEQ ID NO: 740570 - RNA, 22 nt, Human
cgcuuuggagucccugcuuuac

SEQ ID NO: 740571 - RNA, 18 nt, Human
uuaucugcugcaaagggu

SEQ ID NO: 740572 - RNA, 22 nt, Human
gagaggaaugagguuaaggacu

SEQ ID NO: 740573 - RNA, 22 nt, Human
agaugagggguagaaaggacuu

SEQ ID NO: 740574 - RNA, 22 nt, Human
ccccuuccacagugcuuccuaa

SEQ ID NO: 740575 - RNA, 22 nt, Human
ugcugcuguugacggcugucca

SEQ ID NO: 740576 - RNA, 22 nt, Human
gguggcagaauaauugaagguc

SEQ ID NO: 740577 - RNA, 22 nt, Human
aguguuuaacuucguccugaag

SEQ ID NO: 740578 - RNA, 22 nt, Human
ugcuccagugccugccccacag

SEQ ID NO: 740579 - RNA, 22 nt, Human
acagcugauuggaucaaggaca

SEQ ID NO: 740580 - RNA, 22 nt, Human
ccagcaccuugaucuuggaguu

SEQ ID NO: 740581 - RNA, 22 nt, Human
agcaauuuuugauuuucagugu

SEQ ID NO: 740582 - RNA, 22 nt, Human
gggcugcaaugcuucaguuguu

SEQ ID NO: 740583 - RNA, 22 nt, Human
ugguccucagguucucugugcg

SEQ ID NO: 740584 - RNA, 22 nt, Human
agugagcuaugaucauguuacu

SEQ ID NO: 740585 - RNA, 22 nt, Human
aggcccucacagucuauuguga

SEQ ID NO: 740586 - RNA, 22 nt, Human
uguggcugcuccugggugguca

SEQ ID NO: 740587 - RNA, 22 nt, Human
acccugggucucaaucauccua

SEQ ID NO: 740588 - RNA, 22 nt, Human
ggcagaagauaggacagggaau

SEQ ID NO: 740589 - RNA, 17 nt, Human
aggggagagugggaaga

SEQ ID NO: 740590 - RNA, 22 nt, Human
ugcugaggcagaugucugugac

SEQ ID NO: 740591 - RNA, 22 nt, Human
ugugugggagcacgggcuguug

SEQ ID NO: 740592 - RNA, 22 nt, Human
uugucugugaaauggaaauagu

SEQ ID NO: 740593 - RNA, 22 nt, Human
gggcacaggagaaggaucuggc

SEQ ID NO: 740594 - RNA, 22 nt, Human
caggaauguccuugucauuuca

SEQ ID NO: 740595 - RNA, 22 nt, Human
gcuggggucugugaggagggcu

SEQ ID NO: 740596 - RNA, 22 nt, Human
ugugucugaacaugcuuuguaa

SEQ ID NO: 740597 - RNA, 22 nt, Human
augagaaagaguuguaucuaga

SEQ ID NO: 740598 - RNA, 22 nt, Human
guuuaaccaagagcauugugca

SEQ ID NO: 740599 - RNA, 22 nt, Human
uuucaaacuccagcucaccaau

SEQ ID NO: 740600 - RNA, 22 nt, Human
gauuucaagcccccagagauuc

SEQ ID NO: 740601 - RNA, 22 nt, Human
ugucauuauuugccuacugacu

SEQ ID NO: 740602 - RNA, 22 nt, Human
uugucaagauugagagaugacu

SEQ ID NO: 740603 - RNA, 18 nt, Human
uccugcagcuucuaugua

SEQ ID NO: 740604 - RNA, 22 nt, Human
cccagcuccagagccagaaaca

SEQ ID NO: 740605 - RNA, 22 nt, Human
cacaguggcuuugcuggucucg

SEQ ID NO: 740606 - RNA, 22 nt, Human
ggaagagagaucccauagaugu

SEQ ID NO: 740607 - RNA, 22 nt, Human
acagaggggucacagccugaag

SEQ ID NO: 740608 - RNA, 22 nt, Human
auuuuacuacuccaauuaauga

SEQ ID NO: 740609 - RNA, 22 nt, Human
gccagguggucuggcuccagag

SEQ ID NO: 740610 - RNA, 19 nt, Human
agccuggcuuugcucugcu

SEQ ID NO: 740611 - RNA, 22 nt, Human
auaauugugggcagugugauau

SEQ ID NO: 740612 - RNA, 22 nt, Human
uguauagaguuggaagaugacu

SEQ ID NO: 740613 - RNA, 22 nt, Human
aaggcugaggcagugaggcaga

SEQ ID NO: 740614 - RNA, 22 nt, Human
agagauguucauucagcauguu

SEQ ID NO: 740615 - RNA, 22 nt, Human
gggagaacuggguggagcaucu

SEQ ID NO: 740616 - RNA, 22 nt, Human
ucuggaauuuuauugaucaaaa

SEQ ID NO: 740617 - RNA, 22 nt, Human
gucccaggcagagucaggaggg

SEQ ID NO: 740618 - RNA, 20 nt, Human
aucuugggacagggcacaug

SEQ ID NO: 740619 - RNA, 22 nt, Human
gaauugauugauauguacugua

SEQ ID NO: 740620 - RNA, 22 nt, Human
aaugucauugguaaagauuagg

SEQ ID NO: 740621 - RNA, 22 nt, Human
agaaaaagucaaggaauuggac

SEQ ID NO: 740622 - RNA, 22 nt, Human
cccaggcuucccaaucagaagg

SEQ ID NO: 740623 - RNA, 22 nt, Human
ugaagcagagaauuugacaguc

SEQ ID NO: 740624 - RNA, 22 nt, Human
aauagaaaggaggggcucuugu

SEQ ID NO: 740625 - RNA, 22 nt, Human
agaaaguuagcagacucuuggc

SEQ ID NO: 740626 - RNA, 22 nt, Human
auuccuaaggaaggcuggcaag

SEQ ID NO: 740627 - RNA, 22 nt, Human
acaggcaagaggaaagcaagua

SEQ ID NO: 740628 - RNA, 22 nt, Human
gcugucuguucgagcguguguu

SEQ ID NO: 740629 - RNA, 22 nt, Human
auccuuaauuuacuugcaucuu

SEQ ID NO: 740630 - RNA, 22 nt, Human
acucacagacugcagguuuauu

SEQ ID NO: 740631 - RNA, 22 nt, Human
cccuggcuuggcacucuccacu

SEQ ID NO: 740632 - RNA, 22 nt, Human
ccuuccuuucagggcuaugccu

SEQ ID NO: 740633 - RNA, 22 nt, Human
ucagcccaccuucaggggaguu

SEQ ID NO: 740634 - RNA, 22 nt, Human
auacaugugucccugauuuauu

SEQ ID NO: 740635 - RNA, 22 nt, Human
ggcacaggagcuagucaaagcc

SEQ ID NO: 740636 - RNA, 23 nt, Human
ccagugugguagguccacaggug

SEQ ID NO: 740637 - RNA, 22 nt, Human
uuccuacauuuguacaauaaga

SEQ ID NO: 740638 - RNA, 22 nt, Human
auucagugggugcucagcacaa

SEQ ID NO: 740639 - RNA, 22 nt, Human
gcaaauguggcuuccuuucuag

SEQ ID NO: 740640 - RNA, 22 nt, Human
aucugggcguauaggugcaagu

SEQ ID NO: 740641 - RNA, 22 nt, Human
cauccaaagcaaauaucuuaaa

SEQ ID NO: 740642 - RNA, 22 nt, Human
uuugguaaguaugaaugcagua

SEQ ID NO: 740643 - RNA, 22 nt, Human
auggguggaggagaaaggcauc

SEQ ID NO: 740644 - RNA, 22 nt, Human
aacaaauuaguugcaagacugg

SEQ ID NO: 740645 - RNA, 22 nt, Human
guggguggauuccagcaacgcu

SEQ ID NO: 740646 - RNA, 22 nt, Human
uagcacaggucuuguugccauu

SEQ ID NO: 740647 - RNA, 19 nt, Human
aaugucucuaucuguucuc

SEQ ID NO: 740648 - RNA, 22 nt, Human
agcaagcuaacauaggagauug

SEQ ID NO: 740649 - RNA, 21 nt, Human
uagaagcacauagguucaaag

SEQ ID NO: 740650 - RNA, 22 nt, Human
agcaggcuugguccccagccuc

SEQ ID NO: 740651 - RNA, 22 nt, Human
uggggugccgacagggagggca

SEQ ID NO: 740652 - RNA, 22 nt, Human
uccagaguacggaagagucauc

SEQ ID NO: 740653 - RNA, 22 nt, Human
gcaguguuuuacagaccagcau

SEQ ID NO: 740654 - RNA, 22 nt, Human
ccaggcugugcuuuucauaaau

SEQ ID NO: 740655 - RNA, 22 nt, Human
uguggcagggcgugacauuugg

SEQ ID NO: 740656 - RNA, 22 nt, Human
ucuacaagucaagucuaucaag

SEQ ID NO: 740657 - RNA, 22 nt, Human
gcacaggcuccggaggagagcu

SEQ ID NO: 740658 - RNA, 22 nt, Human
acagucaaaugucuaucuucuu

SEQ ID NO: 740659 - RNA, 22 nt, Human
cagggauucagcugaaggaggc

SEQ ID NO: 740660 - RNA, 22 nt, Human
auaaguuugucuuuguaaagau

SEQ ID NO: 740661 - RNA, 22 nt, Human
agccacagcgaaccucucuucc

SEQ ID NO: 740662 - RNA, 22 nt, Human
ucacuugacuuuccagucuugg

SEQ ID NO: 740663 - RNA, 20 nt, Human
guuuagcauggcagugaaag

SEQ ID NO: 740664 - RNA, 22 nt, Human
ccagugcaggugagcaccaggu

SEQ ID NO: 740665 - RNA, 22 nt, Human
guggcugcagagggcacagcau

SEQ ID NO: 740666 - RNA, 22 nt, Human
auuauuguacuuucaauaaggu

SEQ ID NO: 740667 - RNA, 22 nt, Human
uuuuguguugccauguuaagca

SEQ ID NO: 740668 - RNA, 22 nt, Human
aauggcuuuggucuggguccca

SEQ ID NO: 740669 - RNA, 22 nt, Human
cagucuccgccagcuccucaca

SEQ ID NO: 740670 - RNA, 22 nt, Human
uagcuuuaauaagcugcugaau

SEQ ID NO: 740671 - RNA, 22 nt, Human
ucaaagagcuauucaguugugg

SEQ ID NO: 740672 - RNA, 21 nt, Human
ggaagcuguguccaugcuccu

SEQ ID NO: 740673 - RNA, 22 nt, Human
gacccugauaggaguagaagaa

SEQ ID NO: 740674 - RNA, 20 nt, Human
ccagcugagccaaggggaga

SEQ ID NO: 740675 - RNA, 17 nt, Human
ccagagaguaguuagga

SEQ ID NO: 740676 - RNA, 22 nt, Human
ccaugggagaugauggggagug

SEQ ID NO: 740677 - RNA, 22 nt, Human
gcaacugugauuuguuaucuug

SEQ ID NO: 740678 - RNA, 22 nt, Human
uaccauuuacuugaaaauaaaa

SEQ ID NO: 740679 - RNA, 22 nt, Human
gccagcagcucuugggcgggca

SEQ ID NO: 740680 - RNA, 22 nt, Human
aguucucagcuuaguaugcugu

SEQ ID NO: 740681 - RNA, 22 nt, Human
gcuguggccuccagcacucccc

SEQ ID NO: 740682 - RNA, 22 nt, Human
gugagcuuugugguaaugaagu

SEQ ID NO: 740683 - RNA, 22 nt, Human
cuuugccuccuagagcacguuc

SEQ ID NO: 740684 - RNA, 22 nt, Human
aaguuuagcgcucucucaagga

SEQ ID NO: 740685 - RNA, 22 nt, Human
aggagccauuuuccaagggcga

SEQ ID NO: 740686 - RNA, 22 nt, Human
gcugccugccugcauuuaaucc

SEQ ID NO: 740687 - RNA, 22 nt, Human
caugcauuccuccucugccuua

SEQ ID NO: 740688 - RNA, 22 nt, Human
cccaggcucacuguccgcuucc

SEQ ID NO: 740689 - RNA, 22 nt, Human
guuuauuauacaacaaaagcua

SEQ ID NO: 740690 - RNA, 22 nt, Human
acaauagucaaugcacgucauu

SEQ ID NO: 740691 - RNA, 21 nt, Human
agguccaguucugucuuggac

SEQ ID NO: 740692 - RNA, 22 nt, Human
acauuaacaccauaaguguguu

SEQ ID NO: 740693 - RNA, 22 nt, Human
uuuaucagaaguuagagaaaga

SEQ ID NO: 740694 - RNA, 22 nt, Human
guccagccacucaccuuccagc

SEQ ID NO: 740695 - RNA, 22 nt, Human
uauggcuucugcuuucuugacu

SEQ ID NO: 740696 - RNA, 22 nt, Human
cagcuauugauaaauguugggg

SEQ ID NO: 740697 - RNA, 18 nt, Human
ugucugaagccacuuuuu

SEQ ID NO: 740698 - RNA, 22 nt, Human
gcaccugguuuauauaaucaua

SEQ ID NO: 740699 - RNA, 22 nt, Human
auguggcuuuuccuggguuccu

SEQ ID NO: 740700 - RNA, 22 nt, Human
agacugaaguaagaaugcagcu

SEQ ID NO: 740701 - RNA, 22 nt, Human
agagcaauuagcuuagguaaaa

SEQ ID NO: 740702 - RNA, 22 nt, Human
agcuggcacagaccaggagauc

SEQ ID NO: 740703 - RNA, 20 nt, Human
uaaaugcaucuguucaacug

SEQ ID NO: 740704 - RNA, 22 nt, Human
ucuaauccuugcuaccugggug

SEQ ID NO: 740705 - RNA, 20 nt, Human
ugcuugucaugcacucaggc

SEQ ID NO: 740706 - RNA, 22 nt, Human
cuuuacauaaggauaaaccugg

SEQ ID NO: 740707 - RNA, 22 nt, Human
cugguccucuccagcaggcauu

SEQ ID NO: 740708 - RNA, 22 nt, Human
uagguucaaguucaggcucuau

SEQ ID NO: 740709 - RNA, 22 nt, Human
aggcuaauauggcacaugaaca

SEQ ID NO: 740710 - RNA, 22 nt, Human
gggcucaguucugcuucaugcu

SEQ ID NO: 740711 - RNA, 22 nt, Human
ucuggcagugauuucugugauc

SEQ ID NO: 740712 - RNA, 22 nt, Human
uucuuacaucuauaaaguuggg

SEQ ID NO: 740713 - RNA, 22 nt, Human
ugggagagauaggcuucuggac

SEQ ID NO: 740714 - RNA, 21 nt, Human
agccugcaauguagguaccgg

SEQ ID NO: 740715 - RNA, 22 nt, Human
aauauaugacuccacugcauga

SEQ ID NO: 740716 - RNA, 22 nt, Human
ccaggaucuggguccaugggac

SEQ ID NO: 740717 - RNA, 22 nt, Human
uauauguguggauucuuguaga

SEQ ID NO: 740718 - RNA, 22 nt, Human
uguggggaucuucuagcuuuuc

SEQ ID NO: 740719 - RNA, 22 nt, Human
ccauuguaaauucuguggaagu

SEQ ID NO: 740720 - RNA, 22 nt, Human
cccucgggucgcggacugcgcu

SEQ ID NO: 740721 - RNA, 22 nt, Human
agaaguaggcagggcuguauca

SEQ ID NO: 740722 - RNA, 22 nt, Human
gcacacaguacuauaugcuaca

SEQ ID NO: 740723 - RNA, 22 nt, Human
gacauuaaaugucuuaguugcc

SEQ ID NO: 740724 - RNA, 22 nt, Human
gagugggcaccgugggcacacu

SEQ ID NO: 740725 - RNA, 22 nt, Human
cugccugccacguucagcugua

SEQ ID NO: 740726 - RNA, 22 nt, Human
uuccacucuacucuggccaguc

SEQ ID NO: 740727 - RNA, 22 nt, Human
cagggcucccucuggcucccag

SEQ ID NO: 740728 - RNA, 22 nt, Human
ccugccucaucaacuugucgug

SEQ ID NO: 740729 - RNA, 22 nt, Human
gaaaauguuuguccggagcuga

SEQ ID NO: 740730 - RNA, 22 nt, Human
acauauguguuguacaugcaug

SEQ ID NO: 740731 - RNA, 22 nt, Human
uacacaguagaguauaaugcgu

SEQ ID NO: 740732 - RNA, 22 nt, Human
uccagcuguacuuuguccuggc

SEQ ID NO: 740733 - RNA, 19 nt, Human
uuuucucgugcuugucugc

SEQ ID NO: 740734 - RNA, 22 nt, Human
ugcuggggguucagaugaguaa

SEQ ID NO: 740735 - RNA, 22 nt, Human
uuugcaaauuagccacccuguu

SEQ ID NO: 740736 - RNA, 22 nt, Human
gaggaaaaugcaacaggaaugc

SEQ ID NO: 740737 - RNA, 22 nt, Human
aagaugcagcuuuacaauaagg

SEQ ID NO: 740738 - RNA, 22 nt, Human
auuucagaugaccaaauggaaa

SEQ ID NO: 740739 - RNA, 22 nt, Human
guaugucaccucuccuaagcac

SEQ ID NO: 740740 - RNA, 22 nt, Human
uccccacaucucugcaucaggc

SEQ ID NO: 740741 - RNA, 23 nt, Human
cugcaacucagucuggagcaguu

SEQ ID NO: 740742 - RNA, 22 nt, Human
uuaggucauucccugagcagau

SEQ ID NO: 740743 - RNA, 22 nt, Human
ucacagaguuaaaaguuucuuu

SEQ ID NO: 740744 - RNA, 22 nt, Human
uggagagcgugcuuagcacucu

SEQ ID NO: 740745 - RNA, 22 nt, Human
gauuuauaguaugugcuuucag

SEQ ID NO: 740746 - RNA, 22 nt, Human
uccucaucuguaccuuggggua

SEQ ID NO: 740747 - RNA, 22 nt, Human
cuggguugcaaagcgcuggcug

SEQ ID NO: 740748 - RNA, 22 nt, Human
aaguccaguuucauuugagguc

SEQ ID NO: 740749 - RNA, 22 nt, Human
uuuccuuccagguuccuaaggc

SEQ ID NO: 740750 - RNA, 22 nt, Human
agccaggggauucaucagggac

SEQ ID NO: 740751 - RNA, 22 nt, Human
uugcccugaagaacgucccaga

SEQ ID NO: 740752 - RNA, 22 nt, Human
uguccaaugcccuuuccacaug

SEQ ID NO: 740753 - RNA, 22 nt, Human
caaggacagcgucaggugcaac

SEQ ID NO: 740754 - RNA, 22 nt, Human
ucagcucacucugcuuccuggg

SEQ ID NO: 740755 - RNA, 22 nt, Human
uugaaugaaugguccauauaga

SEQ ID NO: 740756 - RNA, 22 nt, Human
cagggccuuuuagcaucuucuc

SEQ ID NO: 740757 - RNA, 22 nt, Human
uccugaauuucccagcaugaac

SEQ ID NO: 740758 - RNA, 22 nt, Human
guguacaggaugacuguacuua

SEQ ID NO: 740759 - RNA, 22 nt, Human
uccauacccagcuuucucacac

SEQ ID NO: 740760 - RNA, 22 nt, Human
cagaaguggccucagagggagu

SEQ ID NO: 740761 - RNA, 22 nt, Human
uaauacuuugaaugagagcuaa

SEQ ID NO: 740762 - RNA, 20 nt, Human
gcagcugaaaguaugacacc

SEQ ID NO: 740763 - RNA, 22 nt, Human
cacaauuucaguugcaugcaac

SEQ ID NO: 740764 - RNA, 22 nt, Human
uagcacaucuucuuggccugca

SEQ ID NO: 740765 - RNA, 22 nt, Human
gcaggaguuaggcgucguggau

SEQ ID NO: 740766 - RNA, 22 nt, Human
uccagggcuccccaacauccag

SEQ ID NO: 740767 - RNA, 21 nt, Human
auuuucauuuccaggggagga

SEQ ID NO: 740768 - RNA, 22 nt, Human
agagugcucagaugcaugucuu

SEQ ID NO: 740769 - RNA, 22 nt, Human
ugccauggccuagaccugugau

SEQ ID NO: 740770 - RNA, 22 nt, Human
ccaggaagaaacagucuuuaua

SEQ ID NO: 740771 - RNA, 22 nt, Human
uaagacauuugaaaugugaucc

SEQ ID NO: 740772 - RNA, 23 nt, Human
gaauacaaagcagaugguccagc

SEQ ID NO: 740773 - RNA, 22 nt, Human
acugggcuguggacacccagcg

SEQ ID NO: 740774 - RNA, 20 nt, Human
ucugucucugagcuagacuu

SEQ ID NO: 740775 - RNA, 22 nt, Human
cagcagaagcaacauucaggcu

SEQ ID NO: 740776 - RNA, 22 nt, Human
cacagggcagguacucucagag

SEQ ID NO: 740777 - RNA, 22 nt, Human
ucaacugauuuagucugugcca

SEQ ID NO: 740778 - RNA, 22 nt, Human
aaacauuccauuucuauguaag

SEQ ID NO: 740779 - RNA, 17 nt, Human
ccuguguuugcuccuuc

SEQ ID NO: 740780 - RNA, 22 nt, Human
acaugaaaagacuaucugauua

SEQ ID NO: 740781 - RNA, 22 nt, Human
agacaauuuuugguuuugcaag

SEQ ID NO: 740782 - RNA, 22 nt, Human
guuaauguuaucugaagacagu

SEQ ID NO: 740783 - RNA, 22 nt, Human
ucggggucuuugacacgcucug

SEQ ID NO: 740784 - RNA, 22 nt, Human
aagugugggaaguagguggcga

SEQ ID NO: 740785 - RNA, 22 nt, Human
ugucacaguuuguacuuuauag

SEQ ID NO: 740786 - RNA, 22 nt, Human
ggagcugugggacgcuguccca

SEQ ID NO: 740787 - RNA, 22 nt, Human
guggagagagauaagccugguc

SEQ ID NO: 740788 - RNA, 22 nt, Human
cugagaaacauauuuccaucua

SEQ ID NO: 740789 - RNA, 22 nt, Human
augugcuuucuuuguuucauaa

SEQ ID NO: 740790 - RNA, 22 nt, Human
uccugggcuguggccccgggca

SEQ ID NO: 740791 - RNA, 22 nt, Human
gaaagcauaacuaauauuuauu

SEQ ID NO: 740792 - RNA, 22 nt, Human
aggcugugaugagccucaugga

SEQ ID NO: 740793 - RNA, 21 nt, Human
ugcaggcuacuucugacucua

SEQ ID NO: 740794 - RNA, 22 nt, Human
gccugugguuugauuaagcauu

SEQ ID NO: 740795 - RNA, 22 nt, Human
aacacugugagguaaugaccua

SEQ ID NO: 740796 - RNA, 22 nt, Human
cuggcagauaguaagugaucaa

SEQ ID NO: 740797 - RNA, 22 nt, Human
uagcccuguccuuggccugugc

SEQ ID NO: 740798 - RNA, 19 nt, Human
ggccucugcaggccgcccc

SEQ ID NO: 740799 - RNA, 22 nt, Human
ugcacagagggaggcauaaaau

SEQ ID NO: 740800 - RNA, 22 nt, Human
aacuugaacugaugaguguuag

SEQ ID NO: 740801 - RNA, 22 nt, Human
ggccugcacagagguggcucua

SEQ ID NO: 740802 - RNA, 22 nt, Human
uucauaaggguggccauauaaa

SEQ ID NO: 740803 - RNA, 22 nt, Human
ugaaaugcuuuuacaggauauu

SEQ ID NO: 740804 - RNA, 22 nt, Human
auggggcuguucucugcccugc

SEQ ID NO: 740805 - RNA, 22 nt, Human
cuugaaagcacuccuuugacug

SEQ ID NO: 740806 - RNA, 21 nt, Human
gugaagacuuugccuuuaaga

SEQ ID NO: 740807 - RNA, 22 nt, Human
uggcucaggagggaucuuugcu

SEQ ID NO: 740808 - RNA, 22 nt, Human
cugggugacagagugagauggu

SEQ ID NO: 740809 - RNA, 22 nt, Human
cgggguggcacucuaaauagaa

SEQ ID NO: 740810 - RNA, 22 nt, Human
guauuuaauuccauuaaguuag

SEQ ID NO: 740811 - RNA, 22 nt, Human
uccuggaguaggccuuagccau

SEQ ID NO: 740812 - RNA, 22 nt, Human
uuacaacuuuccugugucaaau

SEQ ID NO: 740813 - RNA, 22 nt, Human
cacaaaggagaaugucagcaua

SEQ ID NO: 740814 - RNA, 22 nt, Human
acaugcauacacguacauaccu

SEQ ID NO: 740815 - RNA, 22 nt, Human
uuuuguauagucaaagacaaga

SEQ ID NO: 740816 - RNA, 22 nt, Human
gcucaggccucacuccauuugg

SEQ ID NO: 740817 - RNA, 22 nt, Human
cgcccagcugaaaucuccaggc

SEQ ID NO: 740818 - RNA, 18 nt, Human
acagacacuuaguaugag

SEQ ID NO: 740819 - RNA, 22 nt, Human
agcaacuguuacaagaacaaca

SEQ ID NO: 740820 - RNA, 22 nt, Human
uauguagacaggcugcuuuucc

SEQ ID NO: 740821 - RNA, 22 nt, Human
cucugugugguaugauugucau

SEQ ID NO: 740822 - RNA, 22 nt, Human
gccuggguuccaugaucuccag

SEQ ID NO: 740823 - RNA, 22 nt, Human
aaauaaacugaagcacagagag

SEQ ID NO: 740824 - RNA, 22 nt, Human
augcuccuuggcuucaaagcca

SEQ ID NO: 740825 - RNA, 22 nt, Human
agggcagccaugagccuucagg

SEQ ID NO: 740826 - RNA, 22 nt, Human
ucuucugaagguaggaagcauu

SEQ ID NO: 740827 - RNA, 22 nt, Human
aguuaaggggguucaucuguaa

SEQ ID NO: 740828 - RNA, 22 nt, Human
auggcugugugcuucuccccau

SEQ ID NO: 740829 - RNA, 22 nt, Human
ucagagaacugcagcccuuccu

SEQ ID NO: 740830 - RNA, 22 nt, Human
ugccugucuccucugcagggug

SEQ ID NO: 740831 - RNA, 22 nt, Human
ugacauuugagagagauauaca

SEQ ID NO: 740832 - RNA, 19 nt, Human
uuuucccacccuuuagaau

SEQ ID NO: 740833 - RNA, 19 nt, Human
agugucaucagcuacucag

SEQ ID NO: 740834 - RNA, 22 nt, Human
acacugaaugcuguuuagaaau

SEQ ID NO: 740835 - RNA, 22 nt, Human
aggggcucugagugggccagga

SEQ ID NO: 740836 - RNA, 22 nt, Human
gagagugucuggaggaagcuaa

SEQ ID NO: 740837 - RNA, 22 nt, Human
cugccugcugccuguggagggu

SEQ ID NO: 740838 - RNA, 22 nt, Human
guucaaauucuaugaaauaugu

SEQ ID NO: 740839 - RNA, 22 nt, Human
aagcugcagacccccugucuca

SEQ ID NO: 740840 - RNA, 22 nt, Human
auucacaaugauacauaagcga

SEQ ID NO: 740841 - RNA, 22 nt, Human
gacaucaggccugcagucuggg

SEQ ID NO: 740842 - RNA, 22 nt, Human
agucagauuuagauguagcaag

SEQ ID NO: 740843 - RNA, 22 nt, Human
gcauggcuuacagaggcugcag

SEQ ID NO: 740844 - RNA, 22 nt, Human
uuauuuguaaagguccauagua

SEQ ID NO: 740845 - RNA, 22 nt, Human
uuugaacuaccucuccuuagca

SEQ ID NO: 740846 - RNA, 22 nt, Human
gagacagcagggccagggccug

SEQ ID NO: 740847 - RNA, 22 nt, Human
uuuaauuugaaaugaguaaccc

SEQ ID NO: 740848 - RNA, 22 nt, Human
acaggccucccauccggagccc

SEQ ID NO: 740849 - RNA, 22 nt, Human
aguuugaaauguuggcaauauu

SEQ ID NO: 740850 - RNA, 22 nt, Human
auccaguucucagugcuuacag

SEQ ID NO: 740851 - RNA, 22 nt, Human
aauccuggcaugugccuuggga

SEQ ID NO: 740852 - RNA, 22 nt, Human
cuaaauguuuuaucuuccuggc

SEQ ID NO: 740853 - RNA, 22 nt, Human
uuuaucaucuuguuuuuaaagc

SEQ ID NO: 740854 - RNA, 22 nt, Human
uuuccagggaggaauguggggu

SEQ ID NO: 740855 - RNA, 22 nt, Human
cagauggagucccguggaguuc

SEQ ID NO: 740856 - RNA, 22 nt, Human
uggguccugcacugcaagcacc

SEQ ID NO: 740857 - RNA, 22 nt, Human
auaaaccagaaguaaaagcuac

SEQ ID NO: 740858 - RNA, 22 nt, Human
cuuagaugaagucacagaaccc

SEQ ID NO: 740859 - RNA, 23 nt, Human
cuguuaaauuccuuaagagcagg

SEQ ID NO: 740860 - RNA, 22 nt, Human
ugcuuaaaggauaguuuaaacu

SEQ ID NO: 740861 - RNA, 22 nt, Human
acaguacauaauccugagucug

SEQ ID NO: 740862 - RNA, 22 nt, Human
ccaguguuuacaguugaacaaa

SEQ ID NO: 740863 - RNA, 22 nt, Human
acagcuuuguguuaaugggaag

SEQ ID NO: 740864 - RNA, 22 nt, Human
cuuuguuuuacucagaggcaug

SEQ ID NO: 740865 - RNA, 22 nt, Human
aagaaagagaucacuccuccau

SEQ ID NO: 740866 - RNA, 22 nt, Human
ugucugaggaagucagcccuuu

SEQ ID NO: 740867 - RNA, 22 nt, Human
acaaagguggaccauguggcuu

SEQ ID NO: 740868 - RNA, 22 nt, Human
agagccuucagagauuauuuua

SEQ ID NO: 740869 - RNA, 22 nt, Human
ugccuugcuucaaucaaaccgu

SEQ ID NO: 740870 - RNA, 22 nt, Human
acagggcuuaguggaaauuuuu

SEQ ID NO: 740871 - RNA, 22 nt, Human
agcagcaggcuuaaggaaaagu

SEQ ID NO: 740872 - RNA, 22 nt, Human
uuucagauggagguuuaggaca

SEQ ID NO: 740873 - RNA, 22 nt, Human
gcugagguggagauugcaguga

SEQ ID NO: 740874 - RNA, 22 nt, Human
uuuuauugucucccaguucugg

SEQ ID NO: 740875 - RNA, 22 nt, Human
ucuuuggaguguuaucaguaau

SEQ ID NO: 740876 - RNA, 22 nt, Human
acucaggaaaugaagacugguu

SEQ ID NO: 740877 - RNA, 22 nt, Human
gaaggccauuuuuagguagaau

SEQ ID NO: 740878 - RNA, 22 nt, Human
agauaaugucaaauucugucug

SEQ ID NO: 740879 - RNA, 22 nt, Human
cagcaagauuaagggcagaaaa

SEQ ID NO: 740880 - RNA, 22 nt, Human
agugacucacuagcucucagug

SEQ ID NO: 740881 - RNA, 20 nt, Human
uccaggcagacagcuauggg

SEQ ID NO: 740882 - RNA, 17 nt, Human
auggcuuugucacacag

SEQ ID NO: 740883 - RNA, 22 nt, Human
auacaaucuagucugucagcaa

SEQ ID NO: 740884 - RNA, 22 nt, Human
acuguggaugccaaaggggagg

SEQ ID NO: 740885 - RNA, 22 nt, Human
auguuggagucguaaggcaugg

SEQ ID NO: 740886 - RNA, 22 nt, Human
aagucuuuugcuaagaguaaug

SEQ ID NO: 740887 - RNA, 20 nt, Human
gcugggcuaccacuggcccu

SEQ ID NO: 740888 - RNA, 22 nt, Human
uuuucuaagggaaacguccucc

SEQ ID NO: 740889 - RNA, 22 nt, Human
ugggccuggacaaggccacuag

SEQ ID NO: 740890 - RNA, 22 nt, Human
agucaacagaguggccgcagcg

SEQ ID NO: 740891 - RNA, 22 nt, Human
uguauuaucaaguaaauacaug

SEQ ID NO: 740892 - RNA, 22 nt, Human
gggcuucaguaccaaaguuuga

SEQ ID NO: 740893 - RNA, 22 nt, Human
caggggcuguuugccucaggcc

SEQ ID NO: 740894 - RNA, 22 nt, Human
agggagguccaucccugcagag

SEQ ID NO: 740895 - RNA, 20 nt, Human
gggcuagaccagggcagagg

SEQ ID NO: 740896 - RNA, 22 nt, Human
augggaugaucaccugagcuca

SEQ ID NO: 740897 - RNA, 22 nt, Human
gcauuccugagaaugcagagug

SEQ ID NO: 740898 - RNA, 22 nt, Human
gucaacuuuaagaugaucuuuu

SEQ ID NO: 740899 - RNA, 22 nt, Human
gccucagccggcggacgccagg

SEQ ID NO: 740900 - RNA, 22 nt, Human
accuuuggucauuuacuuuuca

SEQ ID NO: 740901 - RNA, 22 nt, Human
uuucuuaaauauuugcaggaca

SEQ ID NO: 740902 - RNA, 22 nt, Human
auccucagaccucagcaaagcc

SEQ ID NO: 740903 - RNA, 22 nt, Human
uuacuguuugaaaaaugaaugu

SEQ ID NO: 740904 - RNA, 22 nt, Human
ccaggagcaccaggccugugcc

SEQ ID NO: 740905 - RNA, 20 nt, Human
gggagaagggcugaugagag

SEQ ID NO: 740906 - RNA, 22 nt, Human
cuacccaggcuuagagggcugg

SEQ ID NO: 740907 - RNA, 22 nt, Human
gaggcugagacucugaauuuuu

SEQ ID NO: 740908 - RNA, 22 nt, Human
cagcacuuugagggcucuuaau

SEQ ID NO: 740909 - RNA, 22 nt, Human
ugugaagagaguaauaaaguca

SEQ ID NO: 740910 - RNA, 22 nt, Human
uuuaugucaaaacuacaguugg

SEQ ID NO: 740911 - RNA, 22 nt, Human
ggugcagaggagccagcugggg

SEQ ID NO: 740912 - RNA, 22 nt, Human
uggagugggcaauguaggcaag

SEQ ID NO: 740913 - RNA, 22 nt, Human
ugguugcauuaacugagagggg

SEQ ID NO: 740914 - RNA, 22 nt, Human
uccugagcuacaguaguaugau

SEQ ID NO: 740915 - RNA, 22 nt, Human
gaaguucugguguaugugauaa

SEQ ID NO: 740916 - RNA, 22 nt, Human
ucucacacuauuuauucugcuu

SEQ ID NO: 740917 - RNA, 22 nt, Human
uuguagcaucaaucaguacuuu

SEQ ID NO: 740918 - RNA, 22 nt, Human
uacuguauaugcuuguaucuga

SEQ ID NO: 740919 - RNA, 22 nt, Human
gaaucacgguauucugcacggg

SEQ ID NO: 740920 - RNA, 22 nt, Human
aaaaguucccugguuagaaaag

SEQ ID NO: 740921 - RNA, 22 nt, Human
cacauuuaagugcuuguucaga

SEQ ID NO: 740922 - RNA, 22 nt, Human
gcagagaguugggcugcgccag

SEQ ID NO: 740923 - RNA, 22 nt, Human
aggagcuggaaugguccuuuug

SEQ ID NO: 740924 - RNA, 22 nt, Human
cuuauucauaagucagacacac

SEQ ID NO: 740925 - RNA, 22 nt, Human
gaaaggcaguacagcugagccu

SEQ ID NO: 740926 - RNA, 22 nt, Human
uuucuuuaauucucacagcaau

SEQ ID NO: 740927 - RNA, 22 nt, Human
ggagcuguucaggacugcuuca

SEQ ID NO: 740928 - RNA, 22 nt, Human
gacaguauccagguggugaaga

SEQ ID NO: 740929 - RNA, 22 nt, Human
cgccccagaugcaagacaaaga

SEQ ID NO: 740930 - RNA, 22 nt, Human
uuucugccagguuucuggauga

SEQ ID NO: 740931 - RNA, 22 nt, Human
agacaguugauauacuauaaaa

SEQ ID NO: 740932 - RNA, 23 nt, Human
aaucagcaugcucuguggcuggc

SEQ ID NO: 740933 - RNA, 22 nt, Human
ggauggagguucucagaugcuc

SEQ ID NO: 740934 - RNA, 22 nt, Human
uuucaguuuaaguaacugcuau

SEQ ID NO: 740935 - RNA, 22 nt, Human
aacaguaucuacgggaacuauu

SEQ ID NO: 740936 - RNA, 22 nt, Human
cauuugaaauucuuagaacaaa

SEQ ID NO: 740937 - RNA, 22 nt, Human
cagcuauuuguaggaaaacugu

SEQ ID NO: 740938 - RNA, 22 nt, Human
augcauucauucauucuuucua

SEQ ID NO: 740939 - RNA, 23 nt, Human
aacuugcuguaaaguucuaggca

SEQ ID NO: 740940 - RNA, 22 nt, Human
cacugcccaggcacccaucuug

SEQ ID NO: 740941 - RNA, 22 nt, Human
ugggcucuccuggaggacaaca

SEQ ID NO: 740942 - RNA, 23 nt, Human
uaaauugaugguauggguuaagc

SEQ ID NO: 740943 - RNA, 22 nt, Human
cagucaccaccagguggcagua

SEQ ID NO: 740944 - RNA, 22 nt, Human
acaugaaugcagccauaacacu

SEQ ID NO: 740945 - RNA, 22 nt, Human
caaccucuggaaaguauggaca

SEQ ID NO: 740946 - RNA, 23 nt, Human
gggcuccagucucugcucaguug

SEQ ID NO: 740947 - RNA, 22 nt, Human
ccaagagguugaggcugcagug

SEQ ID NO: 740948 - RNA, 22 nt, Human
uacagguagcaaaaccuuuccu

SEQ ID NO: 740949 - RNA, 20 nt, Human
uguaaacaauaguguucuug

SEQ ID NO: 740950 - RNA, 22 nt, Human
agacagugauggacaggcagac

SEQ ID NO: 740951 - RNA, 22 nt, Human
cugcaggauucucccaguugga

SEQ ID NO: 740952 - RNA, 22 nt, Human
ccacugggggcugcaggcacuc

SEQ ID NO: 740953 - RNA, 21 nt, Human
gcugucuccuccuugcaccag

SEQ ID NO: 740954 - RNA, 22 nt, Human
gaucuuuagccaagacacacca

SEQ ID NO: 740955 - RNA, 22 nt, Human
ucuauuguaggcauguagcuug

SEQ ID NO: 740956 - RNA, 22 nt, Human
uaaaucccuacaucuguguuuu

SEQ ID NO: 740957 - RNA, 22 nt, Human
uacugaaauggcagauauauaa

SEQ ID NO: 740958 - RNA, 22 nt, Human
ccuuuacacguaaggcuguuga

SEQ ID NO: 740959 - RNA, 21 nt, Human
ucacaugcccauuacuggagc

SEQ ID NO: 740960 - RNA, 22 nt, Human
uuguaacaguagcugucagcuc

SEQ ID NO: 740961 - RNA, 22 nt, Human
uuuuccucaccuaacucaaggu

SEQ ID NO: 740962 - RNA, 22 nt, Human
caagcccuguuaggggucucua

SEQ ID NO: 740963 - RNA, 22 nt, Human
ccuggagacccacuucugccaa

SEQ ID NO: 740964 - RNA, 22 nt, Human
acugauuucagggaugagaaga

SEQ ID NO: 740965 - RNA, 22 nt, Human
gcagcagaggcccuacucuuug

SEQ ID NO: 740966 - RNA, 23 nt, Human
cuguaugauguuaaguggaaagc

SEQ ID NO: 740967 - RNA, 22 nt, Human
ucuuuucuggacucugcaugga

SEQ ID NO: 740968 - RNA, 22 nt, Human
agacauuuuaacaucuggguuu

SEQ ID NO: 740969 - RNA, 22 nt, Human
aggcuggaaagggaccagagug

SEQ ID NO: 740970 - RNA, 19 nt, Human
gcuguacaguaaggagaca

SEQ ID NO: 740971 - RNA, 22 nt, Human
ucugaauauguuuaucaucucu

SEQ ID NO: 740972 - RNA, 22 nt, Human
uugaucucauuguucuccucag

SEQ ID NO: 740973 - RNA, 22 nt, Human
cugguacaaaaugcugauauca

SEQ ID NO: 740974 - RNA, 22 nt, Human
ugcgauggcguagacaaauccc

SEQ ID NO: 740975 - RNA, 22 nt, Human
aggagccaaauuacuagcucug

SEQ ID NO: 740976 - RNA, 22 nt, Human
cacuguugaagauacuuccucu

SEQ ID NO: 740977 - RNA, 22 nt, Human
auuucucagcacuuccuaucuc

SEQ ID NO: 740978 - RNA, 22 nt, Human
agggaagcagcagccgccuguc

SEQ ID NO: 740979 - RNA, 22 nt, Human
uuuggaguuuaacaacuugaag

SEQ ID NO: 740980 - RNA, 22 nt, Human
cucacccauaucuccaugacuc

SEQ ID NO: 740981 - RNA, 22 nt, Human
uucaugugccagagcugaaaau

SEQ ID NO: 740982 - RNA, 22 nt, Human
gcgguagcucaagcuuguaauc

SEQ ID NO: 740983 - RNA, 22 nt, Human
auaaagcuauuccucucuuuuu

SEQ ID NO: 740984 - RNA, 22 nt, Human
uggcucugcugaaccuagugca

SEQ ID NO: 740985 - RNA, 22 nt, Human
gcuggugagcaaaggagaagga

SEQ ID NO: 740986 - RNA, 22 nt, Human
aagguaaugaaacagcagcuaa

SEQ ID NO: 740987 - RNA, 22 nt, Human
ugugugcuaauguaugcucuaa

SEQ ID NO: 740988 - RNA, 22 nt, Human
gaaagaccagcaugaggcuuua

SEQ ID NO: 740989 - RNA, 22 nt, Human
gcacagagagggaagguaacuu

SEQ ID NO: 740990 - RNA, 23 nt, Human
uggcagugaucaaaagcuuacau

SEQ ID NO: 740991 - RNA, 22 nt, Human
ugcauucaaauccugauccugc

SEQ ID NO: 740992 - RNA, 23 nt, Human
ccccucugguggcucagcuccug

SEQ ID NO: 740993 - RNA, 22 nt, Human
aaagauggcccaugaucucuug

SEQ ID NO: 740994 - RNA, 22 nt, Human
cuggggcccgagccuugggcca

SEQ ID NO: 740995 - RNA, 22 nt, Human
agcugaagcagucaguucagcu

SEQ ID NO: 740996 - RNA, 22 nt, Human
uggccaguggacuaaguucuga

SEQ ID NO: 740997 - RNA, 22 nt, Human
ggcuuuauuaagcaggguaagu

SEQ ID NO: 740998 - RNA, 21 nt, Human
auuccaguauaagccucuuug

SEQ ID NO: 740999 - RNA, 22 nt, Human
uuuucacacaaggugauaaguu

SEQ ID NO: 741000 - RNA, 20 nt, Human
caaaagcaaugaaguuauga

SEQ ID NO: 741001 - RNA, 22 nt, Human
cugccacuuucacccagugcuc

SEQ ID NO: 741002 - RNA, 22 nt, Human
cugcagggugacguugcccacc

SEQ ID NO: 741003 - RNA, 22 nt, Human
uauguacacauacacuuguaau

SEQ ID NO: 741004 - RNA, 22 nt, Human
aggccucuguagggcccugaag

SEQ ID NO: 741005 - RNA, 22 nt, Human
cagagucagcuagucuugggau

SEQ ID NO: 741006 - RNA, 22 nt, Human
cuguacauauacauuuuuuucc

SEQ ID NO: 741007 - RNA, 22 nt, Human
aguggcugaagcaucaaaggca

SEQ ID NO: 741008 - RNA, 19 nt, Human
cagugauuaauucaucuua

SEQ ID NO: 741009 - RNA, 22 nt, Human
aagauguuaggaaaguuagggu

SEQ ID NO: 741010 - RNA, 22 nt, Human
uucugugugucucagcaagcug

SEQ ID NO: 741011 - RNA, 22 nt, Human
acccaggggcagccuugcugug

SEQ ID NO: 741012 - RNA, 22 nt, Human
cauucaaaugugccacuguccu

SEQ ID NO: 741013 - RNA, 18 nt, Human
uacaggaaaaguguuaca

SEQ ID NO: 741014 - RNA, 22 nt, Human
ugcuguguucaccaauaugugu

SEQ ID NO: 741015 - RNA, 22 nt, Human
uuaguaguaagagucauaugua

SEQ ID NO: 741016 - RNA, 22 nt, Human
auuucacaaagaacagaugcag

SEQ ID NO: 741017 - RNA, 22 nt, Human
cagcacuuuagcggaggcauca

SEQ ID NO: 741018 - RNA, 22 nt, Human
cuggcacagccacugcaggcag

SEQ ID NO: 741019 - RNA, 22 nt, Human
gggagcugaugauguaaguccc

SEQ ID NO: 741020 - RNA, 22 nt, Human
uuacuaggccaguuuucacuuu

SEQ ID NO: 741021 - RNA, 22 nt, Human
guaugcugccuacgaacaugca

SEQ ID NO: 741022 - RNA, 22 nt, Human
uuaggaaacgcugcuauugacu

SEQ ID NO: 741023 - RNA, 22 nt, Human
ucagcugaaguggagaagcaga

SEQ ID NO: 741024 - RNA, 18 nt, Human
gucuuuggaguggaggua

SEQ ID NO: 741025 - RNA, 22 nt, Human
ugcuccaggagcaaccuuugag

SEQ ID NO: 741026 - RNA, 22 nt, Human
ugugcuucuugcagcuccugua

SEQ ID NO: 741027 - RNA, 22 nt, Human
ggggaaaggccauggcaagaac

SEQ ID NO: 741028 - RNA, 19 nt, Human
agucacagggaagaggaac

SEQ ID NO: 741029 - RNA, 22 nt, Human
agccuccacagaugcaaagggc

SEQ ID NO: 741030 - RNA, 22 nt, Human
ugagucuguauguccagauuua

SEQ ID NO: 741031 - RNA, 22 nt, Human
ggagcuggcagcgcaacccaga

SEQ ID NO: 741032 - RNA, 22 nt, Human
aaaugcaggaaauuaugcuuuu

SEQ ID NO: 741033 - RNA, 22 nt, Human
acccaggggcgaagcuggccac

SEQ ID NO: 741034 - RNA, 22 nt, Human
aauacagaugagcuucugccuc

SEQ ID NO: 741035 - RNA, 22 nt, Human
acacauguacagauuaguauuu

SEQ ID NO: 741036 - RNA, 22 nt, Human
uggcagaaguacacaagcaugc

SEQ ID NO: 741037 - RNA, 22 nt, Human
uccugcagguggaugauucucu

SEQ ID NO: 741038 - RNA, 19 nt, Human
uuaugaaggcuggggggag

SEQ ID NO: 741039 - RNA, 22 nt, Human
aucacauggaaugauuuuagac

SEQ ID NO: 741040 - RNA, 22 nt, Human
augugugguuuaagaauugaau

SEQ ID NO: 741041 - RNA, 22 nt, Human
acuuguguaacacagaaagaac

SEQ ID NO: 741042 - RNA, 22 nt, Human
gcucagaggagcaucauaagga

SEQ ID NO: 741043 - RNA, 22 nt, Human
agcuuucucuucuuuagaaagu

SEQ ID NO: 741044 - RNA, 22 nt, Human
caagugaucagacacugaaguc

SEQ ID NO: 741045 - RNA, 22 nt, Human
agagugcagaggucaaagaaca

SEQ ID NO: 741046 - RNA, 17 nt, Human
uuacagagguaauuaag

SEQ ID NO: 741047 - RNA, 22 nt, Human
gaagccaagugcaaaugccuua

SEQ ID NO: 741048 - RNA, 22 nt, Human
ugaggccugcauugaacuagaa

SEQ ID NO: 741049 - RNA, 22 nt, Human
aaagaggcucaaggugggccag

SEQ ID NO: 741050 - RNA, 22 nt, Human
agcagcagcauugagcgcuugu

SEQ ID NO: 741051 - RNA, 20 nt, Human
ggggcugcaugcagagaaga

SEQ ID NO: 741052 - RNA, 22 nt, Human
ucacaaauagcuauauuaagga

SEQ ID NO: 741053 - RNA, 22 nt, Human
cuuggcagauccaaaaaugaca

SEQ ID NO: 741054 - RNA, 19 nt, Human
gacaggacgaagggaaguu

SEQ ID NO: 741055 - RNA, 22 nt, Human
ugcuuaaaguaguggauuguua

SEQ ID NO: 741056 - RNA, 22 nt, Human
gauuuauuggucuuucauuggu

SEQ ID NO: 741057 - RNA, 22 nt, Human
ugcaggaaaaauaaauaguguu

SEQ ID NO: 741058 - RNA, 22 nt, Human
ucagcugccccgggcacugccc

SEQ ID NO: 741059 - RNA, 22 nt, Human
aguguggcugcguagggcucuc

SEQ ID NO: 741060 - RNA, 20 nt, Human
ucaaggacucccugggaaga

SEQ ID NO: 741061 - RNA, 22 nt, Human
cacaggaguuaacauaauuaag

SEQ ID NO: 741062 - RNA, 22 nt, Human
aucaggauuauuaaaucuggau

SEQ ID NO: 741063 - RNA, 22 nt, Human
auaaaugccucagaaucauccc

SEQ ID NO: 741064 - RNA, 22 nt, Human
ucucaucucaaauuguaauccc

SEQ ID NO: 741065 - RNA, 22 nt, Human
auucuucacauggauaggaucu

SEQ ID NO: 741066 - RNA, 23 nt, Human
cccuggagcuagucugagcagag

SEQ ID NO: 741067 - RNA, 22 nt, Human
uaguuaaagcccuaaauugaua

SEQ ID NO: 741068 - RNA, 22 nt, Human
gggagauggcucagaggccgcg

SEQ ID NO: 741069 - RNA, 22 nt, Human
cucugaaacuccagccccaggu

SEQ ID NO: 741070 - RNA, 22 nt, Human
uggaguuaaaaacaggaugcac

SEQ ID NO: 741071 - RNA, 19 nt, Human
ggcagagcuccugcuuucu

SEQ ID NO: 741072 - RNA, 22 nt, Human
aaaauuaagugucugggaagcc

SEQ ID NO: 741073 - RNA, 22 nt, Human
ucugaacauggcuuccucuuca

SEQ ID NO: 741074 - RNA, 22 nt, Human
cugcaguugggugacccaauau

SEQ ID NO: 741075 - RNA, 22 nt, Human
caggugcugcguggcggagcug

SEQ ID NO: 741076 - RNA, 22 nt, Human
aaagcagauucugaugcaguag

SEQ ID NO: 741077 - RNA, 22 nt, Human
cagccuguagaauacaguaaau

SEQ ID NO: 741078 - RNA, 22 nt, Human
ccagagggcuugguuugggcca

SEQ ID NO: 741079 - RNA, 22 nt, Human
uacagaggggacauggaagaca

SEQ ID NO: 741080 - RNA, 22 nt, Human
aaguacagaaggagcgaacaau

SEQ ID NO: 741081 - RNA, 22 nt, Human
ucuuagaaguucauguuccagc

SEQ ID NO: 741082 - RNA, 22 nt, Human
ucucagugagcuuuucuauguu

SEQ ID NO: 741083 - RNA, 18 nt, Human
uccuggccacacuaccuu

SEQ ID NO: 741084 - RNA, 17 nt, Human
agccugggaaggaguga

SEQ ID NO: 741085 - RNA, 22 nt, Human
ucuccuggguaaaaggguugau

SEQ ID NO: 741086 - RNA, 22 nt, Human
acauuuuacaccaagacuucuu

SEQ ID NO: 741087 - RNA, 22 nt, Human
ugugaggcgaggccagugagcu

SEQ ID NO: 741088 - RNA, 22 nt, Human
cuagaggaacaguuucagguuu

SEQ ID NO: 741089 - RNA, 22 nt, Human
uggggauggaugaaucuuugcu

SEQ ID NO: 741090 - RNA, 22 nt, Human
ucuaacuaacuacaguaagagg

SEQ ID NO: 741091 - RNA, 22 nt, Human
uucuuauugggagaccuuuucu

SEQ ID NO: 741092 - RNA, 22 nt, Human
agcacugugauuuauaacauuu

SEQ ID NO: 741093 - RNA, 22 nt, Human
uguguguccuugaccucagugg

SEQ ID NO: 741094 - RNA, 22 nt, Human
acauguucaugcaugcacaggu

SEQ ID NO: 741095 - RNA, 21 nt, Human
cucagaccacagcucacaccc

SEQ ID NO: 741096 - RNA, 22 nt, Human
uuuagacacuagggaugcagug

SEQ ID NO: 741097 - RNA, 23 nt, Human
cagcuccagugcacucagguagc

SEQ ID NO: 741098 - RNA, 22 nt, Human
aagccacuauggugauucucaa

SEQ ID NO: 741099 - RNA, 22 nt, Human
gcagauuucuaauaagcaaugu

SEQ ID NO: 741100 - RNA, 22 nt, Human
ucauugaagcauuuuguguauu

SEQ ID NO: 741101 - RNA, 22 nt, Human
cagccaggauggagaacuguug

SEQ ID NO: 741102 - RNA, 22 nt, Human
ugggacaggaugaccagaaggu

SEQ ID NO: 741103 - RNA, 22 nt, Human
ugcaguggaacaauuucaacag

SEQ ID NO: 741104 - RNA, 22 nt, Human
ucucaucuuguucaucuacccu

SEQ ID NO: 741105 - RNA, 22 nt, Human
agacagugugguuggugguucc

SEQ ID NO: 741106 - RNA, 19 nt, Human
agcuuugccaaaaacuuag

SEQ ID NO: 741107 - RNA, 19 nt, Human
cuugccuguuccuacagcu

SEQ ID NO: 741108 - RNA, 22 nt, Human
gaccugaaaugggggccugucc

SEQ ID NO: 741109 - RNA, 22 nt, Human
uguuuacuccugauauauuuuu

SEQ ID NO: 741110 - RNA, 22 nt, Human
ucagagaguuacacaaauuguu

SEQ ID NO: 741111 - RNA, 22 nt, Human
uucaaugagcccaagaacguga

SEQ ID NO: 741112 - RNA, 20 nt, Human
acugggagcuaacggagauu

SEQ ID NO: 741113 - RNA, 22 nt, Human
cuuacaagaccaaagaaaggau

SEQ ID NO: 741114 - RNA, 22 nt, Human
agacaaggaauguagcuuacuc

SEQ ID NO: 741115 - RNA, 22 nt, Human
uagcuuuaggcacguuugaauu

SEQ ID NO: 741116 - RNA, 22 nt, Human
auggcuucuagcauugucacaa

SEQ ID NO: 741117 - RNA, 22 nt, Human
uguggcugucuguucuccuagg

SEQ ID NO: 741118 - RNA, 22 nt, Human
uucggucuuguguaaacacugu

SEQ ID NO: 741119 - RNA, 22 nt, Human
ucaccacuaggaauuguguagu

SEQ ID NO: 741120 - RNA, 22 nt, Human
uggaacaacucccucggagccu

SEQ ID NO: 741121 - RNA, 22 nt, Human
uuuccaagauaauacacagaaa

SEQ ID NO: 741122 - RNA, 20 nt, Human
ccugggaaggcagccccagc

SEQ ID NO: 741123 - RNA, 22 nt, Human
gaaaugcauggaucuuggcaga

SEQ ID NO: 741124 - RNA, 20 nt, Human
guuuccuauuuaccuccuca

SEQ ID NO: 741125 - RNA, 22 nt, Human
acaaauauuuacugaauccacu

SEQ ID NO: 741126 - RNA, 22 nt, Human
uagguacagcuaaaaauuaucu

SEQ ID NO: 741127 - RNA, 22 nt, Human
ugcauuuaguuaugagaaaaac

SEQ ID NO: 741128 - RNA, 18 nt, Human
cugccugcucuccagcuu

SEQ ID NO: 741129 - RNA, 22 nt, Human
cagggcuagugacaccccaguc

SEQ ID NO: 741130 - RNA, 22 nt, Human
auggaauuaauaggggaauacu

SEQ ID NO: 741131 - RNA, 22 nt, Human
cugccagaagguuccugcugca

SEQ ID NO: 741132 - RNA, 22 nt, Human
aggaaaugcaggcaaauacucu

SEQ ID NO: 741133 - RNA, 22 nt, Human
ugacuucaaaggcucuacuccu

SEQ ID NO: 741134 - RNA, 22 nt, Human
gugaggcagaaguucccuuuua

SEQ ID NO: 741135 - RNA, 22 nt, Human
auuauuuacagugugcucgaag

SEQ ID NO: 741136 - RNA, 22 nt, Human
uuugaauagcauaggauuacau

SEQ ID NO: 741137 - RNA, 23 nt, Human
uggcccugaaucuguccuggagg

SEQ ID NO: 741138 - RNA, 22 nt, Human
cauuucuccgccgagaucacug

SEQ ID NO: 741139 - RNA, 22 nt, Human
aaguuaguggauaaacagcaaa

SEQ ID NO: 741140 - RNA, 22 nt, Human
cacugaaacagguauugcuggu

SEQ ID NO: 741141 - RNA, 22 nt, Human
uguggcagaacugggacucaaa

SEQ ID NO: 741142 - RNA, 22 nt, Human
acagucuugcuguauggucagg

SEQ ID NO: 741143 - RNA, 22 nt, Human
cacaggagagcugggaggugcc

SEQ ID NO: 741144 - RNA, 22 nt, Human
ugguuugagagugugagcuuuu

SEQ ID NO: 741145 - RNA, 22 nt, Human
gagaggaacucccagugccugg

SEQ ID NO: 741146 - RNA, 22 nt, Human
uagggcuggguacacucuugcc

SEQ ID NO: 741147 - RNA, 22 nt, Human
gggugcaacuaagaagagguga

SEQ ID NO: 741148 - RNA, 22 nt, Human
caaccugacaagacuaugagua

SEQ ID NO: 741149 - RNA, 22 nt, Human
uaacagaaauauuuccagguga

SEQ ID NO: 741150 - RNA, 20 nt, Human
cucucuggaaggugggagcc

SEQ ID NO: 741151 - RNA, 22 nt, Human
guuuccagcuuucugaugcuug

SEQ ID NO: 741152 - RNA, 22 nt, Human
uuuggccuuaguccagaagaag

SEQ ID NO: 741153 - RNA, 22 nt, Human
ucugcccugccauucacuggaa

SEQ ID NO: 741154 - RNA, 22 nt, Human
cacacaugugugcagcuuagaa

SEQ ID NO: 741155 - RNA, 22 nt, Human
uggaugagggcugagcacuggg

SEQ ID NO: 741156 - RNA, 22 nt, Human
gcugcuucucugauggagucca

SEQ ID NO: 741157 - RNA, 22 nt, Human
ucaaaugcucuuugcagagagg

SEQ ID NO: 741158 - RNA, 22 nt, Human
ugaagcaggcauugacugauga

SEQ ID NO: 741159 - RNA, 22 nt, Human
uacaguauagaauguguauuaa

SEQ ID NO: 741160 - RNA, 22 nt, Human
ucugcugaggugguuuuagaga

SEQ ID NO: 741161 - RNA, 22 nt, Human
gggaaggagccugcuugcuaga

SEQ ID NO: 741162 - RNA, 19 nt, Human
gcucagagucccccugcgg

SEQ ID NO: 741163 - RNA, 22 nt, Human
gaaaguuucuucauuaagaugu

SEQ ID NO: 741164 - RNA, 22 nt, Human
gcuguggcaauguuuauaauua

SEQ ID NO: 741165 - RNA, 22 nt, Human
gagggguggcccuggcguguac

SEQ ID NO: 741166 - RNA, 22 nt, Human
aggguguguucuccuaugagaa

SEQ ID NO: 741167 - RNA, 22 nt, Human
ucuguccuccacacuguaaguu

SEQ ID NO: 741168 - RNA, 22 nt, Human
cagugggaagaaugcagccucc

SEQ ID NO: 741169 - RNA, 22 nt, Human
ugccagcuccugcagcuccugu

SEQ ID NO: 741170 - RNA, 21 nt, Human
cucugcugaguccuaggauuc

SEQ ID NO: 741171 - RNA, 20 nt, Human
cagagccaggguuuuguuuu

SEQ ID NO: 741172 - RNA, 22 nt, Human
guguaugagccuccagcugggc

SEQ ID NO: 741173 - RNA, 21 nt, Human
uccuucagucuagaugauugu

SEQ ID NO: 741174 - RNA, 19 nt, Human
uaccauguugacuuuccug

SEQ ID NO: 741175 - RNA, 22 nt, Human
cuuuauguccuugaagaguugu

SEQ ID NO: 741176 - RNA, 22 nt, Human
cgcaugugcguugauugcagug

SEQ ID NO: 741177 - RNA, 21 nt, Human
gcaggaugcaucuuggugucu

SEQ ID NO: 741178 - RNA, 21 nt, Human
gaaaggucuuaacuuacagag

SEQ ID NO: 741179 - RNA, 22 nt, Human
uauuuacuuuuaaauugagaac

SEQ ID NO: 741180 - RNA, 22 nt, Human
ccucucagcgauuccucuugga

SEQ ID NO: 741181 - RNA, 22 nt, Human
acuuuuaaaugaguuucaguug

SEQ ID NO: 741182 - RNA, 22 nt, Human
cugugcuucgcaacuccaaggu

SEQ ID NO: 741183 - RNA, 22 nt, Human
cuggcuggaggugagucacuga

SEQ ID NO: 741184 - RNA, 22 nt, Human
acaguguuuucuuaaggagaaa

SEQ ID NO: 741185 - RNA, 22 nt, Human
aggugucuuugcggcccgccgc

SEQ ID NO: 741186 - RNA, 22 nt, Human
uaaaauguguuucuguaugguu

SEQ ID NO: 741187 - RNA, 22 nt, Human
ucaggaagggugguccacaggg

SEQ ID NO: 741188 - RNA, 22 nt, Human
cuggccgguauuugccucuggg

SEQ ID NO: 741189 - RNA, 22 nt, Human
ucugaagauuaccagcuaaaug

SEQ ID NO: 741190 - RNA, 22 nt, Human
agcugccuguguagaaccaucu

SEQ ID NO: 741191 - RNA, 22 nt, Human
uuagccauuaaauuacaaggug

SEQ ID NO: 741192 - RNA, 23 nt, Human
gaguguucauagcaggcucuugc

SEQ ID NO: 741193 - RNA, 23 nt, Human
agcagcagcaauuaaguggauau

SEQ ID NO: 741194 - RNA, 22 nt, Human
agaguccaaaugugcaguuaug

SEQ ID NO: 741195 - RNA, 23 nt, Human
cauguacacacagcuguacagug

SEQ ID NO: 741196 - RNA, 22 nt, Human
aagugugagccagcccuuugca

SEQ ID NO: 741197 - RNA, 22 nt, Human
ggcuccuggcaucuggugggua

SEQ ID NO: 741198 - RNA, 22 nt, Human
cugucagguuggucucagagcu

SEQ ID NO: 741199 - RNA, 23 nt, Human
cugagggcuggucugaagucugc

SEQ ID NO: 741200 - RNA, 22 nt, Human
uccugagaauagaguugcaugu

SEQ ID NO: 741201 - RNA, 22 nt, Human
uaguauauuaauucucacgguu

SEQ ID NO: 741202 - RNA, 22 nt, Human
uagcccaggagaauugucuuuc

SEQ ID NO: 741203 - RNA, 22 nt, Human
auuucucaaccaggucaaaaag

SEQ ID NO: 741204 - RNA, 22 nt, Human
gggacuguccuacauggagagg

SEQ ID NO: 741205 - RNA, 22 nt, Human
auacaacugccuuagaaggaaa

SEQ ID NO: 741206 - RNA, 22 nt, Human
gccuggaguugaaacuauuauu

SEQ ID NO: 741207 - RNA, 20 nt, Human
ucccaggcuccacccuagac

SEQ ID NO: 741208 - RNA, 22 nt, Human
ugcaggugcguuuucaagccuc

SEQ ID NO: 741209 - RNA, 22 nt, Human
cugcagaggguuugagcauccu

SEQ ID NO: 741210 - RNA, 21 nt, Human
ccaggacuccauggggucucu

SEQ ID NO: 741211 - RNA, 22 nt, Human
gggcaugguggcaggcaccugu

SEQ ID NO: 741212 - RNA, 22 nt, Human
cuggcugucuucugggagcugu

SEQ ID NO: 741213 - RNA, 22 nt, Human
ugcuguguaaaaggugauugaa

SEQ ID NO: 741214 - RNA, 22 nt, Human
cuagggacagaaagaggguaga

SEQ ID NO: 741215 - RNA, 22 nt, Human
gagaggcugacuggcuguccug

SEQ ID NO: 741216 - RNA, 22 nt, Human
aggacuggugugugaucagcau

SEQ ID NO: 741217 - RNA, 22 nt, Human
ggcugugcagggcagagucuca

SEQ ID NO: 741218 - RNA, 22 nt, Human
uccagcucugcugugcgccggu

SEQ ID NO: 741219 - RNA, 22 nt, Human
cuccuuccugccccagugauaa

SEQ ID NO: 741220 - RNA, 22 nt, Human
auuucagcaaaguuuugauugg

SEQ ID NO: 741221 - RNA, 16 nt, Human
agggccagaagcauca

SEQ ID NO: 741222 - RNA, 22 nt, Human
cuugaaagucacaugcagcccu

SEQ ID NO: 741223 - RNA, 22 nt, Human
gccugcagccagggaguucucu

SEQ ID NO: 741224 - RNA, 22 nt, Human
uggagcaggugggaugucguga

SEQ ID NO: 741225 - RNA, 18 nt, Human
aggucuguggucaccagg

SEQ ID NO: 741226 - RNA, 22 nt, Human
aggagccaagcagaacuaagga

SEQ ID NO: 741227 - RNA, 22 nt, Human
ccucaaauugucaaauaagaau

SEQ ID NO: 741228 - RNA, 22 nt, Human
uugcagcuucaagcagguugac

SEQ ID NO: 741229 - RNA, 22 nt, Human
auuucacagcugucaguguuac

SEQ ID NO: 741230 - RNA, 20 nt, Human
acaauagauuugagcaaagu

SEQ ID NO: 741231 - RNA, 23 nt, Human
acagugugguggacaaggagcag

SEQ ID NO: 741232 - RNA, 22 nt, Human
uccugggguuuagagggaagug

SEQ ID NO: 741233 - RNA, 22 nt, Human
acccuggacuggggcugaggcu

SEQ ID NO: 741234 - RNA, 22 nt, Human
auucccacuagcucuuuauaga

SEQ ID NO: 741235 - RNA, 22 nt, Human
cccugcagagaccacugaccuu

SEQ ID NO: 741236 - RNA, 22 nt, Human
gcagcucccuugaacuucuccu

SEQ ID NO: 741237 - RNA, 20 nt, Human
uggcuccuggcuccucccuc

SEQ ID NO: 741238 - RNA, 22 nt, Human
auugcuaaugugcgaaugugua

SEQ ID NO: 741239 - RNA, 22 nt, Human
aggcuggcuggcaggggacaca

SEQ ID NO: 741240 - RNA, 22 nt, Human
aacauggaggcagacagacgug

SEQ ID NO: 741241 - RNA, 22 nt, Human
gggcuggcgggaaaggcaauuc

SEQ ID NO: 741242 - RNA, 22 nt, Human
aaucuguuuccauguuuuauug

SEQ ID NO: 741243 - RNA, 22 nt, Human
auccuugacacacuccaguacu

SEQ ID NO: 741244 - RNA, 22 nt, Human
guggcagaaacuggcagaggag

SEQ ID NO: 741245 - RNA, 22 nt, Human
agaaugauaaugccaugaugga

SEQ ID NO: 741246 - RNA, 19 nt, Human
cacuguuguccuaguacuu

SEQ ID NO: 741247 - RNA, 22 nt, Human
gcagagccaggagcccaggauc

SEQ ID NO: 741248 - RNA, 22 nt, Human
aggcuggaugugccucaccgag

SEQ ID NO: 741249 - RNA, 22 nt, Human
uggucaggcugcucugcggcgu

SEQ ID NO: 741250 - RNA, 22 nt, Human
auggaauugaagacagcauagg

SEQ ID NO: 741251 - RNA, 22 nt, Human
gcacacagagaggugguauguc

SEQ ID NO: 741252 - RNA, 22 nt, Human
cccaggcugcguauccacaaua

SEQ ID NO: 741253 - RNA, 22 nt, Human
uaagcuaacguccauggaaaug

SEQ ID NO: 741254 - RNA, 20 nt, Human
agaguuuggggucauuuugg

SEQ ID NO: 741255 - RNA, 22 nt, Human
acauuggucacugaagaaugag

SEQ ID NO: 741256 - RNA, 22 nt, Human
aauucugaaagauuccuuauuc

SEQ ID NO: 741257 - RNA, 22 nt, Human
uugggagcuggaagcaaggccu

SEQ ID NO: 741258 - RNA, 22 nt, Human
agaguucagcuacugcaaaugu

SEQ ID NO: 741259 - RNA, 22 nt, Human
uaagaaacuauugucucugaac

SEQ ID NO: 741260 - RNA, 22 nt, Human
ucaccaggcuggaaugcagugg

SEQ ID NO: 741261 - RNA, 22 nt, Human
ucucagagaucuuucugcaugu

SEQ ID NO: 741262 - RNA, 22 nt, Human
aguggagaagaggauggucucc

SEQ ID NO: 741263 - RNA, 19 nt, Human
ccugugagaggacaggugu

SEQ ID NO: 741264 - RNA, 22 nt, Human
aaagcugaugucuacuagagaa

SEQ ID NO: 741265 - RNA, 22 nt, Human
caguuuuauugguugaaaucug

SEQ ID NO: 741266 - RNA, 22 nt, Human
uucauacaaugggauauuauga

SEQ ID NO: 741267 - RNA, 16 nt, Human
aaccucucuacugugg

SEQ ID NO: 741268 - RNA, 20 nt, Human
gcucuaaaccacaaagccca

SEQ ID NO: 741269 - RNA, 22 nt, Human
cccaagaucuuucgugcacuaa

SEQ ID NO: 741270 - RNA, 20 nt, Human
ucugauaacugguugugauu

SEQ ID NO: 741271 - RNA, 22 nt, Human
ugucuccaaaacaaucucagau

SEQ ID NO: 741272 - RNA, 21 nt, Human
gggcuuuuuauuuagcacugu

SEQ ID NO: 741273 - RNA, 22 nt, Human
cacacugucuuuaugagcugua

SEQ ID NO: 741274 - RNA, 22 nt, Human
gagucucugaccagggugccaa

SEQ ID NO: 741275 - RNA, 22 nt, Human
caaugcuuuauuuccuccccuu

SEQ ID NO: 741276 - RNA, 22 nt, Human
ccucacucugcacccugcagca

SEQ ID NO: 741277 - RNA, 18 nt, Human
cuaagaggucguuucuca

SEQ ID NO: 741278 - RNA, 22 nt, Human
uugagcaaagcagccauucauu

SEQ ID NO: 741279 - RNA, 22 nt, Human
ccugcccuaauccagagacuag

SEQ ID NO: 741280 - RNA, 22 nt, Human
cuccugaguaguagcauuguca

SEQ ID NO: 741281 - RNA, 17 nt, Human
uuagcaaaauagcacuu

SEQ ID NO: 741282 - RNA, 22 nt, Human
ucacaggacagccuuccacccg

SEQ ID NO: 741283 - RNA, 19 nt, Human
acaaacugaguacacuugu

SEQ ID NO: 741284 - RNA, 22 nt, Human
agaagcagaaacugggcuugug

SEQ ID NO: 741285 - RNA, 22 nt, Human
ugagggucuggaaucugggcuu

SEQ ID NO: 741286 - RNA, 22 nt, Human
gggauuugugggauggccagug

SEQ ID NO: 741287 - RNA, 22 nt, Human
gaagagguucaacguggucauc

SEQ ID NO: 741288 - RNA, 22 nt, Human
cugagggaugggcugggccgcc

SEQ ID NO: 741289 - RNA, 17 nt, Human
agcagcuggguugaucu

SEQ ID NO: 741290 - RNA, 22 nt, Human
cacacuuucagguccucuuugc

SEQ ID NO: 741291 - RNA, 22 nt, Human
ugcugcuccccagcacacagca

SEQ ID NO: 741292 - RNA, 22 nt, Human
ucauuguauucagaacugaaga

SEQ ID NO: 741293 - RNA, 22 nt, Human
acaggagcucuagggacagcac

SEQ ID NO: 741294 - RNA, 22 nt, Human
acuucuguaaagggaagacagu

SEQ ID NO: 741295 - RNA, 22 nt, Human
aucugccugagucuagguuuuc

SEQ ID NO: 741296 - RNA, 22 nt, Human
cuuuguauucaguugggcugug

SEQ ID NO: 741297 - RNA, 21 nt, Human
aggaaaggccagcacguaggg

SEQ ID NO: 741298 - RNA, 22 nt, Human
cagcucccgccaucgggaggca

SEQ ID NO: 741299 - RNA, 22 nt, Human
caaggccacugcucagguuucc

SEQ ID NO: 741300 - RNA, 22 nt, Human
acaaggcaauuccuggugaauu

SEQ ID NO: 741301 - RNA, 22 nt, Human
ggcugcaguuugucuuuugcuu

SEQ ID NO: 741302 - RNA, 22 nt, Human
aguguuagugaaagguguuuau

SEQ ID NO: 741303 - RNA, 22 nt, Human
ucagcagauggguuguguuggc

SEQ ID NO: 741304 - RNA, 22 nt, Human
ccacugccuauuugcagggccc

SEQ ID NO: 741305 - RNA, 22 nt, Human
ugaacacgcuucauacagaggg

SEQ ID NO: 741306 - RNA, 22 nt, Human
gaaggaaguuuauuuuagaaga

SEQ ID NO: 741307 - RNA, 22 nt, Human
uucaaaguccugucagguagcc

SEQ ID NO: 741308 - RNA, 19 nt, Human
agccaggguccagacaugu

SEQ ID NO: 741309 - RNA, 21 nt, Human
ggcacugagccagauggacuc

SEQ ID NO: 741310 - RNA, 23 nt, Human
augaaaguucuuaaaaugucaug

SEQ ID NO: 741311 - RNA, 22 nt, Human
uauguguaaucauaucugauac

SEQ ID NO: 741312 - RNA, 19 nt, Human
agaguauugaauuugcccu

SEQ ID NO: 741313 - RNA, 22 nt, Human
ugagugaaauucugguaaagga

SEQ ID NO: 741314 - RNA, 22 nt, Human
guguggccguguauccauggcu

SEQ ID NO: 741315 - RNA, 21 nt, Human
gcagugcagcuuggaggguag

SEQ ID NO: 741316 - RNA, 21 nt, Human
ccacaggggcuccccugucag

SEQ ID NO: 741317 - RNA, 20 nt, Human
ggucccugcccucugucauc

SEQ ID NO: 741318 - RNA, 22 nt, Human
uucagcaaacacgaugcuuguu

SEQ ID NO: 741319 - RNA, 22 nt, Human
uuucacaucaugggauggaagc

SEQ ID NO: 741320 - RNA, 22 nt, Human
uguacaauguguuuguuggcuu

SEQ ID NO: 741321 - RNA, 22 nt, Human
ucagagaauucgauuaaaugca

SEQ ID NO: 741322 - RNA, 22 nt, Human
cgaaaauagaucuguuucccag

SEQ ID NO: 741323 - RNA, 22 nt, Human
cugccccauggucccugguggg

SEQ ID NO: 741324 - RNA, 22 nt, Human
auugcaaauaacuguacugaau

SEQ ID NO: 741325 - RNA, 22 nt, Human
gucugagauuagggaagauuuu

SEQ ID NO: 741326 - RNA, 22 nt, Human
ccagagagggcgccaccuggag

SEQ ID NO: 741327 - RNA, 22 nt, Human
uggucucuguaggcuaccccau

SEQ ID NO: 741328 - RNA, 22 nt, Human
gggucaaaugauaauugcuucu

SEQ ID NO: 741329 - RNA, 22 nt, Human
ucacagacuguguugcuacuca

SEQ ID NO: 741330 - RNA, 22 nt, Human
agugucugugaggggaauuccu

SEQ ID NO: 741331 - RNA, 22 nt, Human
uuuauaccucauucuuagcaaa

SEQ ID NO: 741332 - RNA, 19 nt, Human
gcaggccucuugggaauua

SEQ ID NO: 741333 - RNA, 22 nt, Human
uucaguguuaaucuugggagaa

SEQ ID NO: 741334 - RNA, 22 nt, Human
ccaggcauggggagagccagau

SEQ ID NO: 741335 - RNA, 22 nt, Human
gaccuucuugcuguguccuaac

SEQ ID NO: 741336 - RNA, 22 nt, Human
aggucauuuuugccuucuauuu

SEQ ID NO: 741337 - RNA, 19 nt, Human
ugucaggggugugcugugc

SEQ ID NO: 741338 - RNA, 22 nt, Human
agcagggguggaagguagcuuu

SEQ ID NO: 741339 - RNA, 22 nt, Human
cacacagaugguaagggaggga

SEQ ID NO: 741340 - RNA, 22 nt, Human
acagaacuuccagggaacauac

SEQ ID NO: 741341 - RNA, 22 nt, Human
guucacaagaguuacagacaga

SEQ ID NO: 741342 - RNA, 22 nt, Human
agccaguggaauucccaggggu

SEQ ID NO: 741343 - RNA, 22 nt, Human
ucagaaagaacacaggcaguag

SEQ ID NO: 741344 - RNA, 22 nt, Human
aaaugucauauuuaaguaggaa

SEQ ID NO: 741345 - RNA, 23 nt, Human
ucagaacaaugccuuaggggcau

SEQ ID NO: 741346 - RNA, 22 nt, Human
acagaggguuucuaaggauuug

SEQ ID NO: 741347 - RNA, 22 nt, Human
uaaccugacugcucuuuagaau

SEQ ID NO: 741348 - RNA, 22 nt, Human
caguaacagugaucaccugugg

SEQ ID NO: 741349 - RNA, 22 nt, Human
ugucagcagaaguggugcacuc

SEQ ID NO: 741350 - RNA, 22 nt, Human
cccaggaguuugaguucagcau

SEQ ID NO: 741351 - RNA, 22 nt, Human
guacacauagguuacugauuaa

SEQ ID NO: 741352 - RNA, 22 nt, Human
uccuggaacauggauaaagaau

SEQ ID NO: 741353 - RNA, 22 nt, Human
caggagauguaccuguuuuuga

SEQ ID NO: 741354 - RNA, 22 nt, Human
ugaaagcucugucaucauuccu

SEQ ID NO: 741355 - RNA, 22 nt, Human
gagagacuggaaugggcugugg

SEQ ID NO: 741356 - RNA, 22 nt, Human
cacugagaggucucauuuccaa

SEQ ID NO: 741357 - RNA, 22 nt, Human
uucugagccagagucaguuaug

SEQ ID NO: 741358 - RNA, 21 nt, Human
ugguaauguucaguauccacu

SEQ ID NO: 741359 - RNA, 22 nt, Human
cagcaggguauacagggaauuu

SEQ ID NO: 741360 - RNA, 22 nt, Human
ugggccaggauuucaagacccu

SEQ ID NO: 741361 - RNA, 22 nt, Human
acaugauuuuaguaucauaaua

SEQ ID NO: 741362 - RNA, 22 nt, Human
guggcucuaggugagcauggag

SEQ ID NO: 741363 - RNA, 22 nt, Human
ugaauaaucuuggguauuaaua

SEQ ID NO: 741364 - RNA, 21 nt, Human
agacaaugcuguaaaauucag

SEQ ID NO: 741365 - RNA, 18 nt, Human
uuggggugaggccaggaa

SEQ ID NO: 741366 - RNA, 21 nt, Human
gagugggacaugggagugguu

SEQ ID NO: 741367 - RNA, 22 nt, Human
ucuagaaacagguuucuagaaa

SEQ ID NO: 741368 - RNA, 22 nt, Human
caagauggaguccgggaaugug

SEQ ID NO: 741369 - RNA, 22 nt, Human
ucacaguuaauuguuggaaugu

SEQ ID NO: 741370 - RNA, 22 nt, Human
aguguuuaaugccuuuuccagc

SEQ ID NO: 741371 - RNA, 22 nt, Human
ucugcagagccucaggagaaca

SEQ ID NO: 741372 - RNA, 22 nt, Human
acuggaaaaccacugaaaugag

SEQ ID NO: 741373 - RNA, 22 nt, Human
aaucaucacgaacacaacagcg

SEQ ID NO: 741374 - RNA, 22 nt, Human
cagcuggccugaucccuguggc

SEQ ID NO: 741375 - RNA, 22 nt, Human
aggaggguuucaaugggaugag

SEQ ID NO: 741376 - RNA, 22 nt, Human
cugccccacaggcuugguaggg

SEQ ID NO: 741377 - RNA, 22 nt, Human
ucagcuuccucugugguuccag

SEQ ID NO: 741378 - RNA, 22 nt, Human
gguggagcugugaguagaaucu

SEQ ID NO: 741379 - RNA, 22 nt, Human
uuaugcuucccugaggaucuua

SEQ ID NO: 741380 - RNA, 17 nt, Human
ucacugggccugcuccc

SEQ ID NO: 741381 - RNA, 22 nt, Human
uagaauguggagguaacagacu

SEQ ID NO: 741382 - RNA, 22 nt, Human
aaugacaauauuaauuuggagg

SEQ ID NO: 741383 - RNA, 22 nt, Human
cugggagcugucaggagcgugu

SEQ ID NO: 741384 - RNA, 22 nt, Human
ccugaugguauauuguugggag

SEQ ID NO: 741385 - RNA, 22 nt, Human
ucagggagauuuggggacucaa

SEQ ID NO: 741386 - RNA, 22 nt, Human
gccacagacagagagucuagug

SEQ ID NO: 741387 - RNA, 22 nt, Human
ucuggagaucauguggggugga

SEQ ID NO: 741388 - RNA, 21 nt, Human
agcaaggcagccucucagccu

SEQ ID NO: 741389 - RNA, 22 nt, Human
gaagcugaggucaggugggugg

SEQ ID NO: 741390 - RNA, 22 nt, Human
uagugucuuccaggacauggua

SEQ ID NO: 741391 - RNA, 22 nt, Human
cugggcuuugguacugugauua

SEQ ID NO: 741392 - RNA, 22 nt, Human
gcuuugugugaaguccauggcg

SEQ ID NO: 741393 - RNA, 22 nt, Human
guagcugauauuagcaaugagu

SEQ ID NO: 741394 - RNA, 22 nt, Human
auaugaagaaucuaggauaggc

SEQ ID NO: 741395 - RNA, 23 nt, Human
cuguccuuggucuuggcugagug

SEQ ID NO: 741396 - RNA, 22 nt, Human
agaagcacgguuuugucuagca

SEQ ID NO: 741397 - RNA, 22 nt, Human
cgaggcagaggcugaaacggcu

SEQ ID NO: 741398 - RNA, 21 nt, Human
gcagccaggacuuugggcugg

SEQ ID NO: 741399 - RNA, 22 nt, Human
ggcaggcagaggcugagacagg

SEQ ID NO: 741400 - RNA, 22 nt, Human
gaggcuggucagcccuaagauc

SEQ ID NO: 741401 - RNA, 17 nt, Human
ucugagaaugcuggagg

SEQ ID NO: 741402 - RNA, 22 nt, Human
gagcugaguagaggcugcuccc

SEQ ID NO: 741403 - RNA, 22 nt, Human
agaugaaagauuuuuauagaga

SEQ ID NO: 741404 - RNA, 22 nt, Human
acagagaaacuaaggaguuugg

SEQ ID NO: 741405 - RNA, 20 nt, Human
cacugcccuccagccugagc

SEQ ID NO: 741406 - RNA, 22 nt, Human
cacacaugaaguugcugagcua

SEQ ID NO: 741407 - RNA, 22 nt, Human
augacauuuauacagugagcuu

SEQ ID NO: 741408 - RNA, 22 nt, Human
ggagagucugccgagccagccc

SEQ ID NO: 741409 - RNA, 22 nt, Human
auucaguucugcugguucugcu

SEQ ID NO: 741410 - RNA, 22 nt, Human
agacacagcugcaggagguggg

SEQ ID NO: 741411 - RNA, 22 nt, Human
uggcuaggcuccaagagcugga

SEQ ID NO: 741412 - RNA, 22 nt, Human
gucuccagggcugcuggcgccu

SEQ ID NO: 741413 - RNA, 22 nt, Human
guuccagguggucacagagcuc

SEQ ID NO: 741414 - RNA, 22 nt, Human
uuauuaauacaugcaccugcau

SEQ ID NO: 741415 - RNA, 20 nt, Human
cucuggcaaaggaugccuau

SEQ ID NO: 741416 - RNA, 22 nt, Human
uuuauugcuggccaccuguagc

SEQ ID NO: 741417 - RNA, 22 nt, Human
uuacauauugucuauuguucaa

SEQ ID NO: 741418 - RNA, 22 nt, Human
ccaggagcccugccacaauggu

SEQ ID NO: 741419 - RNA, 22 nt, Human
aagguaauauuuuucucucuaa

SEQ ID NO: 741420 - RNA, 22 nt, Human
ggugcaggacgaaguggggguu

SEQ ID NO: 741421 - RNA, 22 nt, Human
uuucucugugccauuuccauaa

SEQ ID NO: 741422 - RNA, 22 nt, Human
augcaggguucugggcuagaga

SEQ ID NO: 741423 - RNA, 22 nt, Human
gcugaggcaagauuugaaccca

SEQ ID NO: 741424 - RNA, 22 nt, Human
ggaaagaccugagauaggaaua

SEQ ID NO: 741425 - RNA, 21 nt, Human
ugguuugcggccaaaguuaaa

SEQ ID NO: 741426 - RNA, 20 nt, Human
cuggguggcaagcaaggggg

SEQ ID NO: 741427 - RNA, 22 nt, Human
acagguccucaagucagcuggg

SEQ ID NO: 741428 - RNA, 22 nt, Human
guggucagggagcagagccaug

SEQ ID NO: 741429 - RNA, 23 nt, Human
uuuauacaagaaaccgcuggccu

SEQ ID NO: 741430 - RNA, 22 nt, Human
uucucuggagaguaucuucuua

SEQ ID NO: 741431 - RNA, 22 nt, Human
gguuuuaaccauucacaaguga

SEQ ID NO: 741432 - RNA, 22 nt, Human
ccugugucagccccugccucca

SEQ ID NO: 741433 - RNA, 22 nt, Human
caggcaccagugagaagggccu

SEQ ID NO: 741434 - RNA, 19 nt, Human
cugagcagcggcagcacuu

SEQ ID NO: 741435 - RNA, 22 nt, Human
auguguaucuaagguguucuau

SEQ ID NO: 741436 - RNA, 22 nt, Human
ccugcccagcuucaccucaggc

SEQ ID NO: 741437 - RNA, 22 nt, Human
ugcuucugacuaagcugcauga

SEQ ID NO: 741438 - RNA, 22 nt, Human
ccacaugaaucuuggaagcagg

SEQ ID NO: 741439 - RNA, 22 nt, Human
aaauugcugaccaaguauauuc

SEQ ID NO: 741440 - RNA, 22 nt, Human
aggccgaaguggaugggcaucu

SEQ ID NO: 741441 - RNA, 22 nt, Human
ucccacaugugaauccucaggu

SEQ ID NO: 741442 - RNA, 22 nt, Human
uuaaaggcuauggcugccuggg

SEQ ID NO: 741443 - RNA, 22 nt, Human
ucuggcuucaguaggguucacu

SEQ ID NO: 741444 - RNA, 22 nt, Human
uacagaggagaccaaggcucag

SEQ ID NO: 741445 - RNA, 22 nt, Human
aauaacuuguaugguuauucca

SEQ ID NO: 741446 - RNA, 22 nt, Human
cuggacuucucuucaaagacag

SEQ ID NO: 741447 - RNA, 22 nt, Human
gcccaggacucagggugucgcg

SEQ ID NO: 741448 - RNA, 22 nt, Human
ugauggaauggaggacaugugg

SEQ ID NO: 741449 - RNA, 22 nt, Human
ugguggagcuguggccacgacc

SEQ ID NO: 741450 - RNA, 22 nt, Human
cugguccuccuugccuucagau

SEQ ID NO: 741451 - RNA, 22 nt, Human
gcacucuguuucuccugucagc

SEQ ID NO: 741452 - RNA, 22 nt, Human
agggacaguuacaucaucagac

SEQ ID NO: 741453 - RNA, 22 nt, Human
cacugugucuggagugagcugg

SEQ ID NO: 741454 - RNA, 22 nt, Human
gcccugcugucuucagaguaua

SEQ ID NO: 741455 - RNA, 22 nt, Human
agguccaguuuucugacaaggg

SEQ ID NO: 741456 - RNA, 20 nt, Human
gcugggcuuugacugacaca

SEQ ID NO: 741457 - RNA, 17 nt, Human
cccugcacccuacucuc

SEQ ID NO: 741458 - RNA, 22 nt, Human
cucuggaauguuuacaugcccu

SEQ ID NO: 741459 - RNA, 20 nt, Human
gggugugugcagggccuggu

SEQ ID NO: 741460 - RNA, 22 nt, Human
ugaaaugauaucugauaacaaa

SEQ ID NO: 741461 - RNA, 21 nt, Human
cccuugccugcacuccucggc

SEQ ID NO: 741462 - RNA, 22 nt, Human
ccugaaauuugaagaccugaau

SEQ ID NO: 741463 - RNA, 22 nt, Human
caaagcaguuuuaaucaaguag

SEQ ID NO: 741464 - RNA, 22 nt, Human
cagauauaguggcuugccuggg

SEQ ID NO: 741465 - RNA, 22 nt, Human
uggcucagcgcggccuggucuu

SEQ ID NO: 741466 - RNA, 22 nt, Human
aagaccauaauguaagaugaau

SEQ ID NO: 741467 - RNA, 22 nt, Human
uuagaaaaaggcuguggucuua

SEQ ID NO: 741468 - RNA, 22 nt, Human
cauuuccacuucugaaaacugg

SEQ ID NO: 741469 - RNA, 20 nt, Human
cagggcucugggccuggccu

SEQ ID NO: 741470 - RNA, 20 nt, Human
ugaggcccagcagagucggg

SEQ ID NO: 741471 - RNA, 22 nt, Human
ucacugucccuguccucuuauc

SEQ ID NO: 741472 - RNA, 22 nt, Human
gauuucaaggauguuagaggug

SEQ ID NO: 741473 - RNA, 23 nt, Human
aaucacacguuuggccaggaugc

SEQ ID NO: 741474 - RNA, 23 nt, Human
agaaaccacugaagagauccagu

SEQ ID NO: 741475 - RNA, 21 nt, Human
uaaggccaagucuauuucugu

SEQ ID NO: 741476 - RNA, 22 nt, Human
acagagagguaaaauauauagu

SEQ ID NO: 741477 - RNA, 22 nt, Human
guagggagcccagagcccagug

SEQ ID NO: 741478 - RNA, 22 nt, Human
uaugagaaucugcaguaugcuu

SEQ ID NO: 741479 - RNA, 22 nt, Human
gagcaucuggcuagaggaguga

SEQ ID NO: 741480 - RNA, 18 nt, Human
uggcuggcagugggcagc

SEQ ID NO: 741481 - RNA, 22 nt, Human
uggcuccuuccgcagcaugccu

SEQ ID NO: 741482 - RNA, 22 nt, Human
uuccuguauuuugcgaauuuuc

SEQ ID NO: 741483 - RNA, 22 nt, Human
uuuugagauggugucucgcucc

SEQ ID NO: 741484 - RNA, 22 nt, Human
ggcuccuguggcaagacagcuu

SEQ ID NO: 741485 - RNA, 19 nt, Human
auguuuacacucaggggcu

SEQ ID NO: 741486 - RNA, 22 nt, Human
aggguggcugaguagauggaag

SEQ ID NO: 741487 - RNA, 22 nt, Human
cgcaggcuuuagaaucugcuac

SEQ ID NO: 741488 - RNA, 22 nt, Human
ugcaucagaguuugcugcugcu

SEQ ID NO: 741489 - RNA, 22 nt, Human
uugugcucuguguuauuuaagg

SEQ ID NO: 741490 - RNA, 20 nt, Human
ugcagguguguccaagcacu

SEQ ID NO: 741491 - RNA, 22 nt, Human
agacauuaugcugagugaaaga

SEQ ID NO: 741492 - RNA, 22 nt, Human
caauguguuugcauauuaaaau

SEQ ID NO: 741493 - RNA, 22 nt, Human
agaguggcccguuggccugaac

SEQ ID NO: 741494 - RNA, 23 nt, Human
uaucuuaccucccuucuuuccug

SEQ ID NO: 741495 - RNA, 23 nt, Human
ucagcuucauugucuucuauggc

SEQ ID NO: 741496 - RNA, 22 nt, Human
caccuaggguuucgccuuucuu

SEQ ID NO: 741497 - RNA, 22 nt, Human
ggcagugugcaucuguguggcc

SEQ ID NO: 741498 - RNA, 22 nt, Human
aggccucuucagggagcaugga

SEQ ID NO: 741499 - RNA, 22 nt, Human
uacaaaugaguuguaugaacca

SEQ ID NO: 741500 - RNA, 22 nt, Human
gcugaggccucagaaggcugag

SEQ ID NO: 741501 - RNA, 22 nt, Human
uggcugcagaaccuccucagga

SEQ ID NO: 741502 - RNA, 22 nt, Human
ugaugaaaguguuuacucaccu

SEQ ID NO: 741503 - RNA, 22 nt, Human
ugucucugguauuaggugaaaa

SEQ ID NO: 741504 - RNA, 22 nt, Human
uacuguuuucuauaauggcugu

SEQ ID NO: 741505 - RNA, 22 nt, Human
cugagagcagggacuugagcca

SEQ ID NO: 741506 - RNA, 22 nt, Human
auuuagaaauuccaaaaguauu

SEQ ID NO: 741507 - RNA, 22 nt, Human
cuguauuuucaugccuacguac

SEQ ID NO: 741508 - RNA, 22 nt, Human
uggucauuuuuauuucaguugc

SEQ ID NO: 741509 - RNA, 22 nt, Human
auuucugauacccggucacccu

SEQ ID NO: 741510 - RNA, 22 nt, Human
cugcuguggguuaagacacugu

SEQ ID NO: 741511 - RNA, 22 nt, Human
ugaagcacaggcauacacaacc

SEQ ID NO: 741512 - RNA, 22 nt, Human
gaggauuugauggcuuucuccc

SEQ ID NO: 741513 - RNA, 22 nt, Human
gggcugagugucccaggccgaa

SEQ ID NO: 741514 - RNA, 22 nt, Human
ggguuuuaugguucacuugcaa

SEQ ID NO: 741515 - RNA, 22 nt, Human
gucagugugaguugauuccaua

SEQ ID NO: 741516 - RNA, 22 nt, Human
ggcaggcugggugucauggagu

SEQ ID NO: 741517 - RNA, 22 nt, Human
cuguggcaggaagggacuagca

SEQ ID NO: 741518 - RNA, 22 nt, Human
uacaggcacugaaaugcuuauu

SEQ ID NO: 741519 - RNA, 22 nt, Human
agaauccgcuugacuuugaagu

SEQ ID NO: 741520 - RNA, 22 nt, Human
ccucugugugugcaugcaugcg

SEQ ID NO: 741521 - RNA, 22 nt, Human
uaaacaagcuggacugauaagu

SEQ ID NO: 741522 - RNA, 22 nt, Human
ucucuggguauucacugccuuc

SEQ ID NO: 741523 - RNA, 22 nt, Human
ugcugucuuuucccaauccugg

SEQ ID NO: 741524 - RNA, 22 nt, Human
uccucuuuaaaugcuuuuaucu

SEQ ID NO: 741525 - RNA, 22 nt, Human
gcugggcccugggugcccuagc

SEQ ID NO: 741526 - RNA, 22 nt, Human
auggauaaugucucuguuuccc

SEQ ID NO: 741527 - RNA, 22 nt, Human
cugcugccugauugcagaccuc

SEQ ID NO: 741528 - RNA, 22 nt, Human
gcucaggccuccagaggggcaa

SEQ ID NO: 741529 - RNA, 22 nt, Human
acaugaggugcuauaggucuac

SEQ ID NO: 741530 - RNA, 17 nt, Human
ggcaggugacagacacc

SEQ ID NO: 741531 - RNA, 22 nt, Human
ucucaggcauucccacauagaa

SEQ ID NO: 741532 - RNA, 21 nt, Human
uggaaacagcgccaucugccg

SEQ ID NO: 741533 - RNA, 22 nt, Human
aauaacuucaucuucaggauag

SEQ ID NO: 741534 - RNA, 22 nt, Human
guucuauuccccuuaucuguga

SEQ ID NO: 741535 - RNA, 21 nt, Human
aguccccuguccuuacuucua

SEQ ID NO: 741536 - RNA, 19 nt, Human
ggaaggugacaguggugaa

SEQ ID NO: 741537 - RNA, 22 nt, Human
ugauucuguucuccuugagaau

SEQ ID NO: 741538 - RNA, 22 nt, Human
uuauuuugccacaggugaccuu

SEQ ID NO: 741539 - RNA, 22 nt, Human
aagcacauugccuggcacauag

SEQ ID NO: 741540 - RNA, 22 nt, Human
gguuuuauuaacuuuaacauca

SEQ ID NO: 741541 - RNA, 21 nt, Human
accaggccaggaggcuggcac

SEQ ID NO: 741542 - RNA, 22 nt, Human
uaacacuaagaaucuaaauuua

SEQ ID NO: 741543 - RNA, 22 nt, Human
uuugacucuugucucuuguuag

SEQ ID NO: 741544 - RNA, 22 nt, Human
agcuguaauauaagcaaugaaa

SEQ ID NO: 741545 - RNA, 22 nt, Human
uaccuggaauuuauauagcuau

SEQ ID NO: 741546 - RNA, 22 nt, Human
gaauuucuggacccuuugagaa

SEQ ID NO: 741547 - RNA, 21 nt, Human
auacuacauuucucugacuuu

SEQ ID NO: 741548 - RNA, 22 nt, Human
cuuucuagacuguccagaugau

SEQ ID NO: 741549 - RNA, 22 nt, Human
gggaugacaaagugucuguccc

SEQ ID NO: 741550 - RNA, 22 nt, Human
ugaugagggagauuugagccca

SEQ ID NO: 741551 - RNA, 22 nt, Human
ucugggccugauggcuaaagcc

SEQ ID NO: 741552 - RNA, 21 nt, Human
aggagggcacaaggccaggaa

SEQ ID NO: 741553 - RNA, 22 nt, Human
ucuuuuauccuacauuuagcuc

SEQ ID NO: 741554 - RNA, 22 nt, Human
augugucuuucaagguauagaa

SEQ ID NO: 741555 - RNA, 22 nt, Human
aauuagaaucuuauuuggggaa

SEQ ID NO: 741556 - RNA, 21 nt, Human
ugcaagcagcagagauauggg

SEQ ID NO: 741557 - RNA, 22 nt, Human
caagaagcuuucccugcuugca

SEQ ID NO: 741558 - RNA, 22 nt, Human
cagcucaggcacuggcgcggga

SEQ ID NO: 741559 - RNA, 22 nt, Human
agguccacaguucagcugccca

SEQ ID NO: 741560 - RNA, 22 nt, Human
gugaccauaauagauuaugagu

SEQ ID NO: 741561 - RNA, 22 nt, Human
guggcuggaguaugaggaaagg

SEQ ID NO: 741562 - RNA, 22 nt, Human
agcuacaguugcccucagcagg

SEQ ID NO: 741563 - RNA, 22 nt, Human
uucagaaacagagugagugagu

SEQ ID NO: 741564 - RNA, 22 nt, Human
uuguguuucccuugcauauucc

SEQ ID NO: 741565 - RNA, 22 nt, Human
uccauaguagaaaaugggacag

SEQ ID NO: 741566 - RNA, 22 nt, Human
gcuacagagcucugugaagaga

SEQ ID NO: 741567 - RNA, 22 nt, Human
cucaggccugaguggcaguccc

SEQ ID NO: 741568 - RNA, 22 nt, Human
agccaggcugcaguuggcuggc

SEQ ID NO: 741569 - RNA, 22 nt, Human
aaagcucuuaaugagauuaucc

SEQ ID NO: 741570 - RNA, 22 nt, Human
gcuuccuccaucuggggcuugc

SEQ ID NO: 741571 - RNA, 19 nt, Human
gcuccuggaugaccugugg

SEQ ID NO: 741572 - RNA, 22 nt, Human
uccaggcccauggagcagagcu

SEQ ID NO: 741573 - RNA, 20 nt, Human
gcccaggaucucugaggcau

SEQ ID NO: 741574 - RNA, 22 nt, Human
agaaggaaggcugagugcugau

SEQ ID NO: 741575 - RNA, 22 nt, Human
gucccagagagcacuaguccau

SEQ ID NO: 741576 - RNA, 22 nt, Human
cagggccacuguagaugaggag

SEQ ID NO: 741577 - RNA, 22 nt, Human
auacaugaggaggcuggaaaca

SEQ ID NO: 741578 - RNA, 22 nt, Human
aagacaucagugaugacauuug

SEQ ID NO: 741579 - RNA, 22 nt, Human
cagggagccccaauuccaugcc

SEQ ID NO: 741580 - RNA, 22 nt, Human
gcaugcauuuguacuugauuuu

SEQ ID NO: 741581 - RNA, 22 nt, Human
aagaggaaaugauugacuauau

SEQ ID NO: 741582 - RNA, 22 nt, Human
augcaucuauucccaagggcag

SEQ ID NO: 741583 - RNA, 18 nt, Human
cuaucccuggagcuuggg

SEQ ID NO: 741584 - RNA, 18 nt, Human
caauagaaacaguaggaa

SEQ ID NO: 741585 - RNA, 22 nt, Human
agucucugugagcucccaaugg

SEQ ID NO: 741586 - RNA, 22 nt, Human
cagaggaggccaccgcauaggc

SEQ ID NO: 741587 - RNA, 22 nt, Human
ggcuggaaaggauauuuuaggu

SEQ ID NO: 741588 - RNA, 22 nt, Human
ggccuggacaccugaggucuua

SEQ ID NO: 741589 - RNA, 22 nt, Human
auuuuucucuccacuccauuaa

SEQ ID NO: 741590 - RNA, 22 nt, Human
ccuggaguaccguggccaucca

SEQ ID NO: 741591 - RNA, 22 nt, Human
ccugccugcaaaaugggacaag

SEQ ID NO: 741592 - RNA, 22 nt, Human
ucagaagucacuuaggaaaggg

SEQ ID NO: 741593 - RNA, 23 nt, Human
uacagaaggaguagucacuaaga

SEQ ID NO: 741594 - RNA, 22 nt, Human
gcagagguggaugcaauugggg

SEQ ID NO: 741595 - RNA, 22 nt, Human
ugaggcagcauucuucaagaca

SEQ ID NO: 741596 - RNA, 22 nt, Human
augaaaacagccuccugugaua

SEQ ID NO: 741597 - RNA, 22 nt, Human
cacaguaagaaaugaagaggua

SEQ ID NO: 741598 - RNA, 23 nt, Human
acucagagaccccgggaagugac

SEQ ID NO: 741599 - RNA, 21 nt, Human
aggcucccagaaaugggcauc

SEQ ID NO: 741600 - RNA, 22 nt, Human
ccaggguggcguagaugcuggg

SEQ ID NO: 741601 - RNA, 22 nt, Human
ucucaguguuaucuaucugccu

SEQ ID NO: 741602 - RNA, 22 nt, Human
augaaacaguguguauagcaaa

SEQ ID NO: 741603 - RNA, 22 nt, Human
ugcugugauaauucaaugagcu

SEQ ID NO: 741604 - RNA, 18 nt, Human
acaggcugugggaauggu

SEQ ID NO: 741605 - RNA, 22 nt, Human
caaggcagucccuacucccugc

SEQ ID NO: 741606 - RNA, 22 nt, Human
ugggagcccaagggagcugccg

SEQ ID NO: 741607 - RNA, 22 nt, Human
aggccuccagccacaugccagu

SEQ ID NO: 741608 - RNA, 22 nt, Human
ggccaccucugcccuaccgagu

SEQ ID NO: 741609 - RNA, 22 nt, Human
agacagcaugagccugcugaug

SEQ ID NO: 741610 - RNA, 22 nt, Human
cucaggcugcccugacagcccc

SEQ ID NO: 741611 - RNA, 22 nt, Human
guccucuggagguuuuuaggug

SEQ ID NO: 741612 - RNA, 23 nt, Human
acuuugcagagccccuugaaaca

SEQ ID NO: 741613 - RNA, 17 nt, Human
ugcuuucuuccugcccu

SEQ ID NO: 741614 - RNA, 22 nt, Human
ugagacaguaucgccccaaggc

SEQ ID NO: 741615 - RNA, 22 nt, Human
cuguggcucagcacggggucag

SEQ ID NO: 741616 - RNA, 22 nt, Human
ucugcaacagugcccuguaaau

SEQ ID NO: 741617 - RNA, 22 nt, Human
gcaaugauugcauuagaagaug

SEQ ID NO: 741618 - RNA, 22 nt, Human
ucugcugucuuuucugggugag

SEQ ID NO: 741619 - RNA, 22 nt, Human
ucuguggccuguguccaagugc

SEQ ID NO: 741620 - RNA, 21 nt, Human
agccaagccuugggagccagg

SEQ ID NO: 741621 - RNA, 22 nt, Human
guacugcuguaaauauucuuca

SEQ ID NO: 741622 - RNA, 23 nt, Human
uugcaaauuucaguuaguucaug

SEQ ID NO: 741623 - RNA, 22 nt, Human
agagccaggcucuaccuggguu

SEQ ID NO: 741624 - RNA, 22 nt, Human
gcuggcuuccaucagaggguga

SEQ ID NO: 741625 - RNA, 22 nt, Human
gucaggcagccuggagauucag

SEQ ID NO: 741626 - RNA, 23 nt, Human
ugcucugggaggcccuggagagc

SEQ ID NO: 741627 - RNA, 20 nt, Human
auguccagugacuggaccau

SEQ ID NO: 741628 - RNA, 22 nt, Human
gggcuccagcagaggcagccgg

SEQ ID NO: 741629 - RNA, 22 nt, Human
gaagagcugcaguuuccugggc

SEQ ID NO: 741630 - RNA, 22 nt, Human
caggacaguuugcuuugcccug

SEQ ID NO: 741631 - RNA, 17 nt, Human
gcuggcugacccaugcc

SEQ ID NO: 741632 - RNA, 22 nt, Human
ucccuguccaaagucuuccuau

SEQ ID NO: 741633 - RNA, 23 nt, Human
ucugggaauuggcuguccacagg

SEQ ID NO: 741634 - RNA, 17 nt, Human
uuauucuggcauaugug

SEQ ID NO: 741635 - RNA, 22 nt, Human
gugcauuucucauacacuaaau

SEQ ID NO: 741636 - RNA, 19 nt, Human
gugaggucuuuccuuuugu

SEQ ID NO: 741637 - RNA, 22 nt, Human
ucugcucuccauacuuccgcac

SEQ ID NO: 741638 - RNA, 22 nt, Human
caguaacauuucaagguagagg

SEQ ID NO: 741639 - RNA, 20 nt, Human
ugagggcuaaccagacucug

SEQ ID NO: 741640 - RNA, 22 nt, Human
ggguaauuggggccuugcagug

SEQ ID NO: 741641 - RNA, 17 nt, Human
ggucuggggccauuggc

SEQ ID NO: 741642 - RNA, 21 nt, Human
agcugccugcucuggaccugg

SEQ ID NO: 741643 - RNA, 22 nt, Human
gccuaggaguacagaaugguuu

SEQ ID NO: 741644 - RNA, 22 nt, Human
augcacaaacccacaauuaguc

SEQ ID NO: 741645 - RNA, 22 nt, Human
aggugacuacuauuuuaaaaua

SEQ ID NO: 741646 - RNA, 22 nt, Human
uuugaaaguguuuacuugggaa

SEQ ID NO: 741647 - RNA, 22 nt, Human
uaaaaguaggaaugaaacgcau

SEQ ID NO: 741648 - RNA, 22 nt, Human
ggcauacaagagaaauauaaga

SEQ ID NO: 741649 - RNA, 22 nt, Human
uuauuugcugauuucaguuuca

SEQ ID NO: 741650 - RNA, 22 nt, Human
aagccaggcugcacuugcuggg

SEQ ID NO: 741651 - RNA, 21 nt, Human
ugggcucagccccagcccugc

SEQ ID NO: 741652 - RNA, 22 nt, Human
ugcacagugaccacugagcaag

SEQ ID NO: 741653 - RNA, 22 nt, Human
ugagcuccggcauauggaauua

SEQ ID NO: 741654 - RNA, 22 nt, Human
agauguaguagugggucuuuua

SEQ ID NO: 741655 - RNA, 21 nt, Human
gcucccugcucagcuccuggg

SEQ ID NO: 741656 - RNA, 22 nt, Human
aggcucuaaggagggcugucua

SEQ ID NO: 741657 - RNA, 22 nt, Human
guguguauuauugcauacacau

SEQ ID NO: 741658 - RNA, 22 nt, Human
acuuucaauucacugagauaua

SEQ ID NO: 741659 - RNA, 22 nt, Human
uggcggggcagcucuggcuucu

SEQ ID NO: 741660 - RNA, 19 nt, Human
cuucugcagggugacagug

SEQ ID NO: 741661 - RNA, 22 nt, Human
ugagccagccuugcagcugugc

SEQ ID NO: 741662 - RNA, 22 nt, Human
uggcuccuaucaaggagugggu

SEQ ID NO: 741663 - RNA, 22 nt, Human
uguguauguaagcaugugcaua

SEQ ID NO: 741664 - RNA, 22 nt, Human
cuccuccagacuuacugaaucc

SEQ ID NO: 741665 - RNA, 22 nt, Human
uucuucaaacaaaaguggcaug

SEQ ID NO: 741666 - RNA, 22 nt, Human
ucucucagaaagcccaugucug

SEQ ID NO: 741667 - RNA, 22 nt, Human
guguggcugugggagauguuca

SEQ ID NO: 741668 - RNA, 22 nt, Human
cagugcagaacacauggaaaau

SEQ ID NO: 741669 - RNA, 22 nt, Human
aaugaugguauugaugagcuaa

SEQ ID NO: 741670 - RNA, 22 nt, Human
cuugcuguugugggagacuggg

SEQ ID NO: 741671 - RNA, 22 nt, Human
ggcuuggcagaggugggugcuu

SEQ ID NO: 741672 - RNA, 22 nt, Human
cacaguacuuaauucucuaaau

SEQ ID NO: 741673 - RNA, 22 nt, Human
uagagcauuuagaggggcagga

SEQ ID NO: 741674 - RNA, 21 nt, Human
uccagggcgggcgcacggaga

SEQ ID NO: 741675 - RNA, 22 nt, Human
uguagcagaguaucucuguuuu

SEQ ID NO: 741676 - RNA, 22 nt, Human
aucagcaagauugugucuugua

SEQ ID NO: 741677 - RNA, 22 nt, Human
acugagagucaagauagcaugg

SEQ ID NO: 741678 - RNA, 22 nt, Human
auguggcuaguggcuaugaucu

SEQ ID NO: 741679 - RNA, 22 nt, Human
ugcauuaaauauaaucuguuga

SEQ ID NO: 741680 - RNA, 22 nt, Human
ggaggugggauuaggaccuaaa

SEQ ID NO: 741681 - RNA, 22 nt, Human
cccucgccgcagcugcuucccg

SEQ ID NO: 741682 - RNA, 22 nt, Human
guguguggggccuucggguccu

SEQ ID NO: 741683 - RNA, 22 nt, Human
gcaggggcaggagaucucaggc

SEQ ID NO: 741684 - RNA, 22 nt, Human
aaacauuguaauuuuagcaugg

SEQ ID NO: 741685 - RNA, 22 nt, Human
uuugauucaauguuuauauaaa

SEQ ID NO: 741686 - RNA, 22 nt, Human
uccugggccaagggcugugagg

SEQ ID NO: 741687 - RNA, 22 nt, Human
uugacaguugcaauggugaucu

SEQ ID NO: 741688 - RNA, 22 nt, Human
ccagcucucagcgggagacuca

SEQ ID NO: 741689 - RNA, 22 nt, Human
augcaacagaaaauugccuggg

SEQ ID NO: 741690 - RNA, 22 nt, Human
ggugaaggucuacugugugcca

SEQ ID NO: 741691 - RNA, 22 nt, Human
agccccaguucccuggaagucu

SEQ ID NO: 741692 - RNA, 22 nt, Human
accuuccucuaagacauuuagc

SEQ ID NO: 741693 - RNA, 22 nt, Human
gggacccagguaauccugugcu

SEQ ID NO: 741694 - RNA, 22 nt, Human
aucuggacuagagcagaauggg

SEQ ID NO: 741695 - RNA, 22 nt, Human
uccacagcacaaagccagugug

SEQ ID NO: 741696 - RNA, 22 nt, Human
ucuaugaagugcgaagaggcac

SEQ ID NO: 741697 - RNA, 17 nt, Human
cccagcugcgucugagg

SEQ ID NO: 741698 - RNA, 22 nt, Human
caggcacagugggguccucucu

SEQ ID NO: 741699 - RNA, 22 nt, Human
aggucagcugugugugcaugag

SEQ ID NO: 741700 - RNA, 22 nt, Human
cagcaggagcagucagacuccu

SEQ ID NO: 741701 - RNA, 22 nt, Human
uuaggaaaggguuuucuaacag

SEQ ID NO: 741702 - RNA, 22 nt, Human
gcuccaguggacugggggaggc

SEQ ID NO: 741703 - RNA, 22 nt, Human
caggcucaauggccacuugggc

SEQ ID NO: 741704 - RNA, 22 nt, Human
cccaggagguuggggcuacagu

SEQ ID NO: 741705 - RNA, 22 nt, Human
gcucugaacuuccaccuuuuca

SEQ ID NO: 741706 - RNA, 23 nt, Human
gcagauggccccagagugcugcc

SEQ ID NO: 741707 - RNA, 22 nt, Human
cagacuugaaagagacucaguu

SEQ ID NO: 741708 - RNA, 21 nt, Human
cugggcuggcaggcauuaccu

SEQ ID NO: 741709 - RNA, 22 nt, Human
acauuucugcuagaauagguga

SEQ ID NO: 741710 - RNA, 22 nt, Human
ccucucuguguggccucuccau

SEQ ID NO: 741711 - RNA, 22 nt, Human
aucugacaaguuguguguauag

SEQ ID NO: 741712 - RNA, 22 nt, Human
auuuacagccuugccaucuaua

SEQ ID NO: 741713 - RNA, 22 nt, Human
cucagauguagaaagauuguga

SEQ ID NO: 741714 - RNA, 22 nt, Human
gcagugggcaacaagagcugga

SEQ ID NO: 741715 - RNA, 22 nt, Human
ggcugagcccccucugcguagg

SEQ ID NO: 741716 - RNA, 22 nt, Human
aagguacaggguauuagauuau

SEQ ID NO: 741717 - RNA, 22 nt, Human
ugugucauagagagcacaaauc

SEQ ID NO: 741718 - RNA, 22 nt, Human
auuugacagugaguuguggaug

SEQ ID NO: 741719 - RNA, 22 nt, Human
ugccuggggauugcucugggcc

SEQ ID NO: 741720 - RNA, 22 nt, Human
uggcuucaggguugucuucagc

SEQ ID NO: 741721 - RNA, 22 nt, Human
gcuuccgcgauguccuaggugg

SEQ ID NO: 741722 - RNA, 22 nt, Human
ccagagggagccaccagggugu

SEQ ID NO: 741723 - RNA, 22 nt, Human
acccccaaacaugaucauggug

SEQ ID NO: 741724 - RNA, 22 nt, Human
uccugugacggagcgccagagg

SEQ ID NO: 741725 - RNA, 22 nt, Human
cacuguuuucagucaguucuau

SEQ ID NO: 741726 - RNA, 22 nt, Human
uauggcuuaaaauuucagcaug

SEQ ID NO: 741727 - RNA, 22 nt, Human
gggcugcguguggaggauguaa

SEQ ID NO: 741728 - RNA, 22 nt, Human
cugcagcuaaggaaugugguug

SEQ ID NO: 741729 - RNA, 22 nt, Human
uccuaggguaaucagcauacau

SEQ ID NO: 741730 - RNA, 22 nt, Human
ccagcagagggucuuggccauu

SEQ ID NO: 741731 - RNA, 22 nt, Human
caggaggggguggaguuucgcc

SEQ ID NO: 741732 - RNA, 22 nt, Human
agcuagacuuucccuuuccaug

SEQ ID NO: 741733 - RNA, 22 nt, Human
gaugaucaucuguaaaguuaga

SEQ ID NO: 741734 - RNA, 20 nt, Human
acaguuuauuuuacuugguu

SEQ ID NO: 741735 - RNA, 22 nt, Human
ggcagcaguaggagcuaaucuu

SEQ ID NO: 741736 - RNA, 22 nt, Human
cagagagaauauguaguaugga

SEQ ID NO: 741737 - RNA, 22 nt, Human
cugucugucaaguucaucucca

SEQ ID NO: 741738 - RNA, 22 nt, Human
gccaccucccaggacgaggcug

SEQ ID NO: 741739 - RNA, 17 nt, Human
ugcauuguaggcuagcc

SEQ ID NO: 741740 - RNA, 23 nt, Human
cugggcugcuugagucccuggcu

SEQ ID NO: 741741 - RNA, 22 nt, Human
ucuuugcaggccaaauuguuaa

SEQ ID NO: 741742 - RNA, 22 nt, Human
ucagacaguuugcagugugccu

SEQ ID NO: 741743 - RNA, 22 nt, Human
ucauugagcgguucuuaaccca

SEQ ID NO: 741744 - RNA, 22 nt, Human
ugcuuugcucugucucuagcua

SEQ ID NO: 741745 - RNA, 22 nt, Human
ucaggucuauacuaugagaggc

SEQ ID NO: 741746 - RNA, 22 nt, Human
gccuuauuaccugcacuuugaa

SEQ ID NO: 741747 - RNA, 22 nt, Human
ugcagcugcuugauucaucuug

SEQ ID NO: 741748 - RNA, 22 nt, Human
gcuuuauagcccuauuacauga

SEQ ID NO: 741749 - RNA, 22 nt, Human
guccucagggagucccagucau

SEQ ID NO: 741750 - RNA, 22 nt, Human
cagcagagaaauuaaacuucug

SEQ ID NO: 741751 - RNA, 22 nt, Human
ugcaacaguggggcaugcugaa

SEQ ID NO: 741752 - RNA, 22 nt, Human
aaagugcagcuugugaucccua

SEQ ID NO: 741753 - RNA, 22 nt, Human
aauugugcccgugacauuucau

SEQ ID NO: 741754 - RNA, 22 nt, Human
augugagcagggagaugcugcc

SEQ ID NO: 741755 - RNA, 17 nt, Human
ucaggauguagcaguag

SEQ ID NO: 741756 - RNA, 20 nt, Human
agacagaaucagagauaaag

SEQ ID NO: 741757 - RNA, 22 nt, Human
ugaggcaguucuuacuuguauu

SEQ ID NO: 741758 - RNA, 18 nt, Human
cugaggcccagagagggc

SEQ ID NO: 741759 - RNA, 22 nt, Human
ucucccaggucauacacagaga

SEQ ID NO: 741760 - RNA, 22 nt, Human
cuccccacgccuggacuaagag

SEQ ID NO: 741761 - RNA, 22 nt, Human
agaaaguuuauuucuugaugga

SEQ ID NO: 741762 - RNA, 22 nt, Human
uauugacauuuuuauagcuuga

SEQ ID NO: 741763 - RNA, 17 nt, Human
cagcucugcaucuuccu

SEQ ID NO: 741764 - RNA, 20 nt, Human
uacugggucuggguccugga

SEQ ID NO: 741765 - RNA, 20 nt, Human
ccagucccugagcaccaggg

SEQ ID NO: 741766 - RNA, 22 nt, Human
uuagcaaauuuccaggugaugc

SEQ ID NO: 741767 - RNA, 22 nt, Human
uccugagcuuuacaguaaggac

SEQ ID NO: 741768 - RNA, 22 nt, Human
aauucauagcaacaaagaccca

SEQ ID NO: 741769 - RNA, 22 nt, Human
ugguucauagccucacaggaua

SEQ ID NO: 741770 - RNA, 22 nt, Human
aaacugaauucaaguauccagu

SEQ ID NO: 741771 - RNA, 22 nt, Human
cuggccuggcaggggaccucua

SEQ ID NO: 741772 - RNA, 22 nt, Human
ggcugaggcucaugccaucuug

SEQ ID NO: 741773 - RNA, 19 nt, Human
ucaaagcaagcauguucug

SEQ ID NO: 741774 - RNA, 22 nt, Human
ugggcagacuaaggucaaagcu

SEQ ID NO: 741775 - RNA, 22 nt, Human
ccuggguacgcagggcuccucu

SEQ ID NO: 741776 - RNA, 22 nt, Human
uaaugcaaggaauuccaaguag

SEQ ID NO: 741777 - RNA, 22 nt, Human
cacagcuagacuaauugcuggg

SEQ ID NO: 741778 - RNA, 23 nt, Human
uuucucugagaagcaguucucua

SEQ ID NO: 741779 - RNA, 22 nt, Human
agcccuggcccggcugugcuuu

SEQ ID NO: 741780 - RNA, 22 nt, Human
gccaggcugacucccccggccu

SEQ ID NO: 741781 - RNA, 21 nt, Human
ugucacauguggaugguauuu

SEQ ID NO: 741782 - RNA, 22 nt, Human
gccaugggucugcuggcucagc

SEQ ID NO: 741783 - RNA, 22 nt, Human
aaguuauuuuucaagauccuuu

SEQ ID NO: 741784 - RNA, 22 nt, Human
guggucauuugucugagcucca

SEQ ID NO: 741785 - RNA, 22 nt, Human
ugauucugagggagcauucugc

SEQ ID NO: 741786 - RNA, 16 nt, Human
gcaggcagaucacaug

SEQ ID NO: 741787 - RNA, 19 nt, Human
ccaccccuuugcugggccc

SEQ ID NO: 741788 - RNA, 22 nt, Human
aggaggcugcaacccugaggcc

SEQ ID NO: 741789 - RNA, 22 nt, Human
cccugcucuucugacucaagcu

SEQ ID NO: 741790 - RNA, 22 nt, Human
ucaauauuuuuaugagcauaga

SEQ ID NO: 741791 - RNA, 22 nt, Human
aguuuccucaucuguaaaauga

SEQ ID NO: 741792 - RNA, 22 nt, Human
cugaaauaguuucauagaacuu

SEQ ID NO: 741793 - RNA, 21 nt, Human
uccugcugcuccugucguguu

SEQ ID NO: 741794 - RNA, 22 nt, Human
cuuuuucacuguguccucacac

SEQ ID NO: 741795 - RNA, 22 nt, Human
aauuucacuggaaaagauaauu

SEQ ID NO: 741796 - RNA, 22 nt, Human
acggguggcugaggaggccucu

SEQ ID NO: 741797 - RNA, 22 nt, Human
ugcaggaaucagaggggaagcg

SEQ ID NO: 741798 - RNA, 19 nt, Human
ggcuccuggggcucagccc

SEQ ID NO: 741799 - RNA, 23 nt, Human
augcaguauaugucaguaguuua

SEQ ID NO: 741800 - RNA, 22 nt, Human
gcagcagcucucaaaguggucu

SEQ ID NO: 741801 - RNA, 22 nt, Human
uuacaaguuucuggcuucaucc

SEQ ID NO: 741802 - RNA, 22 nt, Human
ggcaggcaggagcucugucucc

SEQ ID NO: 741803 - RNA, 22 nt, Human
ucuguuaacaggagagaaugau

SEQ ID NO: 741804 - RNA, 22 nt, Human
uuggaacugauggccuucaucc

SEQ ID NO: 741805 - RNA, 19 nt, Human
ucucagugccgcugaccgc

SEQ ID NO: 741806 - RNA, 22 nt, Human
ucaggggacagccagcuggagg

SEQ ID NO: 741807 - RNA, 22 nt, Human
ggaguugauuuuggauauauua

SEQ ID NO: 741808 - RNA, 22 nt, Human
gguaacuuagcucauggcugug

SEQ ID NO: 741809 - RNA, 19 nt, Human
uugaauuguuuugaguagg

SEQ ID NO: 741810 - RNA, 22 nt, Human
uggcucugucaaacugcacaca

SEQ ID NO: 741811 - RNA, 22 nt, Human
uagaagcaccacucaucacgug

SEQ ID NO: 741812 - RNA, 22 nt, Human
aguuuauguuguuuauaagcca

SEQ ID NO: 741813 - RNA, 22 nt, Human
ugagguaauaaguguuuguuuu

SEQ ID NO: 741814 - RNA, 18 nt, Human
agucuuguucuguugccc

SEQ ID NO: 741815 - RNA, 22 nt, Human
aucuuggauuggagaaagaagu

SEQ ID NO: 741816 - RNA, 22 nt, Human
aagcauggcuguucuagcuaua

SEQ ID NO: 741817 - RNA, 22 nt, Human
caauaauugcuuuccagaguua

SEQ ID NO: 741818 - RNA, 22 nt, Human
ccuggaguugaaggaagguggg

SEQ ID NO: 741819 - RNA, 22 nt, Human
uccacugcagcuucugauggaa

SEQ ID NO: 741820 - RNA, 19 nt, Human
agacagagcucaguggguu

SEQ ID NO: 741821 - RNA, 22 nt, Human
gcagagcucaagguguucagcu

SEQ ID NO: 741822 - RNA, 22 nt, Human
uguaaagaaauagcauuuguag

SEQ ID NO: 741823 - RNA, 22 nt, Human
ccuccucuggugcugccaaccc

SEQ ID NO: 741824 - RNA, 22 nt, Human
ucagaggcucaucugccuugca

SEQ ID NO: 741825 - RNA, 22 nt, Human
ugggagaauauauuuaaaacuu

SEQ ID NO: 741826 - RNA, 22 nt, Human
uagcagaggcugucugacuuaa

SEQ ID NO: 741827 - RNA, 22 nt, Human
uuaagauagaacccaguagucu

SEQ ID NO: 741828 - RNA, 22 nt, Human
agaggcagaaguguucaaaccc

SEQ ID NO: 741829 - RNA, 21 nt, Human
ugaaaguuggagucaaaugua

SEQ ID NO: 741830 - RNA, 22 nt, Human
caguaagucaacaaacaugggg

SEQ ID NO: 741831 - RNA, 22 nt, Human
gggcuacauugugagagaaguu

SEQ ID NO: 741832 - RNA, 22 nt, Human
ggguggcauagggugauggcuu

SEQ ID NO: 741833 - RNA, 21 nt, Human
uaucugcuuuuuaaggcucac

SEQ ID NO: 741834 - RNA, 22 nt, Human
uacuaugugaaaauacuauagu

SEQ ID NO: 741835 - RNA, 22 nt, Human
uaugaagaaguucugugaaaug

SEQ ID NO: 741836 - RNA, 22 nt, Human
aaacccaggguuuugucuuccc

SEQ ID NO: 741837 - RNA, 22 nt, Human
aguaugaaccuggguucuggau

SEQ ID NO: 741838 - RNA, 22 nt, Human
gccucacauauucaugguuacu

SEQ ID NO: 741839 - RNA, 22 nt, Human
aaugcuucaaccucccacaugu

SEQ ID NO: 741840 - RNA, 22 nt, Human
agcuggcagagcauuuguggcc

SEQ ID NO: 741841 - RNA, 22 nt, Human
auucuuuggacaauaaguggug

SEQ ID NO: 741842 - RNA, 22 nt, Human
uuaacaggaguaacucuagaaa

SEQ ID NO: 741843 - RNA, 22 nt, Human
acaccagggauaugaggaagga

SEQ ID NO: 741844 - RNA, 22 nt, Human
gucugucuguuguugagaagca

SEQ ID NO: 741845 - RNA, 22 nt, Human
ccagugcacaauggaacaacuc

SEQ ID NO: 741846 - RNA, 22 nt, Human
ucugggagacguguguugucag

SEQ ID NO: 741847 - RNA, 22 nt, Human
aaaggcacuagaaguuaccuuu

SEQ ID NO: 741848 - RNA, 22 nt, Human
auaguuugugaaacacagcagu

SEQ ID NO: 741849 - RNA, 22 nt, Human
cagaggauuauuucagaaucua

SEQ ID NO: 741850 - RNA, 22 nt, Human
gaaguuguaagccugggaaggu

SEQ ID NO: 741851 - RNA, 22 nt, Human
uacuuuuagccuauuugauucu

SEQ ID NO: 741852 - RNA, 22 nt, Human
aauuagaaccagaagccauauu

SEQ ID NO: 741853 - RNA, 22 nt, Human
caaaugaagggagcugaagucu

SEQ ID NO: 741854 - RNA, 22 nt, Human
uuuuuguauaugcuucgaggau

SEQ ID NO: 741855 - RNA, 22 nt, Human
gccuuccuuuuaccaccagcca

SEQ ID NO: 741856 - RNA, 22 nt, Human
ugaucuuuacugcuguuuauaa

SEQ ID NO: 741857 - RNA, 22 nt, Human
acaucgauggucagccgaggag

SEQ ID NO: 741858 - RNA, 22 nt, Human
ucucacaagcucaaggauuagu

SEQ ID NO: 741859 - RNA, 22 nt, Human
ggugacggggcccagguuuccu

SEQ ID NO: 741860 - RNA, 22 nt, Human
gcucucucgugaacaggugguu

SEQ ID NO: 741861 - RNA, 22 nt, Human
cagcaucuuuauaaaaaguaaa

SEQ ID NO: 741862 - RNA, 22 nt, Human
ucaagacagugugauacuggcc

SEQ ID NO: 741863 - RNA, 22 nt, Human
aagucugagagaaacucucuca

SEQ ID NO: 741864 - RNA, 22 nt, Human
ugcucuguugugcaugugggau

SEQ ID NO: 741865 - RNA, 22 nt, Human
acagaauacucauaagaagggg

SEQ ID NO: 741866 - RNA, 22 nt, Human
gagcagcagcugggccagguuc

SEQ ID NO: 741867 - RNA, 22 nt, Human
agcuccagcccaucugcucgug

SEQ ID NO: 741868 - RNA, 22 nt, Human
auguggccuuaaugacagcagc

SEQ ID NO: 741869 - RNA, 22 nt, Human
ugccauuucuuucaauauucuu

SEQ ID NO: 741870 - RNA, 22 nt, Human
uggcuucucccucugccugauu

SEQ ID NO: 741871 - RNA, 22 nt, Human
uuaacauuuaguguaccccugu

SEQ ID NO: 741872 - RNA, 22 nt, Human
gggcuggagucuucugaaagcc

SEQ ID NO: 741873 - RNA, 20 nt, Human
uccagcuguugagaucugag

SEQ ID NO: 741874 - RNA, 22 nt, Human
cuggggacuuugguucuccaug

SEQ ID NO: 741875 - RNA, 22 nt, Human
gcuggcacugggaaggacugag

SEQ ID NO: 741876 - RNA, 20 nt, Human
uugcaaauaucuauugauug

SEQ ID NO: 741877 - RNA, 22 nt, Human
cuggauaaauguuugcuuuaga

SEQ ID NO: 741878 - RNA, 22 nt, Human
ucagcucucacagaucucaacc

SEQ ID NO: 741879 - RNA, 22 nt, Human
guggcaaggagcaugaaaaguc

SEQ ID NO: 741880 - RNA, 22 nt, Human
ccuuggagacagguuugcuuuc

SEQ ID NO: 741881 - RNA, 22 nt, Human
acaauagguguccaauuaacaa

SEQ ID NO: 741882 - RNA, 22 nt, Human
uuuacauuucccucugucaguu

SEQ ID NO: 741883 - RNA, 22 nt, Human
uuguuuugcuaaagggucauca

SEQ ID NO: 741884 - RNA, 22 nt, Human
cugcuuuaagaaugaguguaag

SEQ ID NO: 741885 - RNA, 22 nt, Human
uugcaaaaccauccuaaguaaa

SEQ ID NO: 741886 - RNA, 20 nt, Human
agcugggcaauuaugacuau

SEQ ID NO: 741887 - RNA, 22 nt, Human
cuggcagcugugugaagaacug

SEQ ID NO: 741888 - RNA, 22 nt, Human
uagacuuuccagccugcugcuu

SEQ ID NO: 741889 - RNA, 22 nt, Human
uucuaacuuaacacuccuguga

SEQ ID NO: 741890 - RNA, 22 nt, Human
ccucaaauugcucagcgucuag

SEQ ID NO: 741891 - RNA, 22 nt, Human
auguaucaugcaggguccauga

SEQ ID NO: 741892 - RNA, 21 nt, Human
ccagugcuacagcugccugac

SEQ ID NO: 741893 - RNA, 22 nt, Human
ucuguccauucagaauggcccu

SEQ ID NO: 741894 - RNA, 21 nt, Human
uucaguaugcgucaugcuguu

SEQ ID NO: 741895 - RNA, 22 nt, Human
cccuccagagccuggacauucu

SEQ ID NO: 741896 - RNA, 22 nt, Human
uuccuuaguugacugucuuagu

SEQ ID NO: 741897 - RNA, 22 nt, Human
accugccuauggagccacaugg

SEQ ID NO: 741898 - RNA, 22 nt, Human
ugagcagaguuguuucuccuga

SEQ ID NO: 741899 - RNA, 18 nt, Human
agcccagcggagugaauc

SEQ ID NO: 741900 - RNA, 22 nt, Human
gaaagcacccaagauuuccuuc

SEQ ID NO: 741901 - RNA, 22 nt, Human
cugggcuccacuacuugcuaac

SEQ ID NO: 741902 - RNA, 22 nt, Human
ggaguggcagagaggguauacu

SEQ ID NO: 741903 - RNA, 22 nt, Human
uuuagagucauuuuauauugac

SEQ ID NO: 741904 - RNA, 22 nt, Human
uuccugggugguccugguagag

SEQ ID NO: 741905 - RNA, 22 nt, Human
agaaacuaaagccaagggcucu

SEQ ID NO: 741906 - RNA, 22 nt, Human
auauuaggaguuaaauguauua

SEQ ID NO: 741907 - RNA, 22 nt, Human
uuacauuguccagaaauuauug

SEQ ID NO: 741908 - RNA, 22 nt, Human
ugcuucugcugauauuuuguga

SEQ ID NO: 741909 - RNA, 22 nt, Human
gcuggcucuucaguggagauag

SEQ ID NO: 741910 - RNA, 22 nt, Human
agaggcagcagucauacuacag

SEQ ID NO: 741911 - RNA, 23 nt, Human
auugauucccucuuggaagggau

SEQ ID NO: 741912 - RNA, 22 nt, Human
gggaucugaugcacugcugaaa

SEQ ID NO: 741913 - RNA, 22 nt, Human
agccugcuggaccaagcucaug

SEQ ID NO: 741914 - RNA, 22 nt, Human
uggagagucucugagccagggc

SEQ ID NO: 741915 - RNA, 22 nt, Human
cuugccucccucagcucacagc

SEQ ID NO: 741916 - RNA, 22 nt, Human
acauucccuuggcuugaagcag

SEQ ID NO: 741917 - RNA, 22 nt, Human
ccugggagguggagguugcagu

SEQ ID NO: 741918 - RNA, 22 nt, Human
accagugucuuauugaccaucu

SEQ ID NO: 741919 - RNA, 22 nt, Human
aaugucuuuucccuuacuuucc

SEQ ID NO: 741920 - RNA, 20 nt, Human
uaacagaaguagaagugggu

SEQ ID NO: 741921 - RNA, 22 nt, Human
cagugauggauauggagaaguc

SEQ ID NO: 741922 - RNA, 22 nt, Human
auccuuccuucauuugacaggu

SEQ ID NO: 741923 - RNA, 22 nt, Human
ucagagaauguccuucuucauu

SEQ ID NO: 741924 - RNA, 21 nt, Human
aggauggaaaggacuaggggu

SEQ ID NO: 741925 - RNA, 22 nt, Human
gaggagcuggcagcgucuccgc

SEQ ID NO: 741926 - RNA, 22 nt, Human
gggaggaaagagaaguggucca

SEQ ID NO: 741927 - RNA, 22 nt, Human
ccacuugaaauaucuuuguucu

SEQ ID NO: 741928 - RNA, 22 nt, Human
aagaugugcuaucaacuggaga

SEQ ID NO: 741929 - RNA, 22 nt, Human
ucuaaagacacuuuuuacaggg

SEQ ID NO: 741930 - RNA, 22 nt, Human
ucagaggauagaaauacuuauu

SEQ ID NO: 741931 - RNA, 22 nt, Human
uuuaagagcuaguaugucauuu

SEQ ID NO: 741932 - RNA, 22 nt, Human
uucucuggacuauuugcacucc

SEQ ID NO: 741933 - RNA, 22 nt, Human
cuugggaggggagcauuggccu

SEQ ID NO: 741934 - RNA, 22 nt, Human
auguaacuuccucagggauggu

SEQ ID NO: 741935 - RNA, 22 nt, Human
ugaaaucauguaguuauugcaa

SEQ ID NO: 741936 - RNA, 20 nt, Human
cugcaaaaugacauuaggaa

SEQ ID NO: 741937 - RNA, 20 nt, Human
agugggagagggcagacugc

SEQ ID NO: 741938 - RNA, 22 nt, Human
ucccuggggaagggcaagcaag

SEQ ID NO: 741939 - RNA, 22 nt, Human
uauugacuuuuaaagugauaua

SEQ ID NO: 741940 - RNA, 22 nt, Human
cuagccaugggcauuaaaggua

SEQ ID NO: 741941 - RNA, 22 nt, Human
auaacuuauuagauuggagcug

SEQ ID NO: 741942 - RNA, 22 nt, Human
guccugagucaagugugggcag

SEQ ID NO: 741943 - RNA, 19 nt, Human
ucauugaacauaauuacuu

SEQ ID NO: 741944 - RNA, 22 nt, Human
uggcaccauguuggcaaauguu

SEQ ID NO: 741945 - RNA, 22 nt, Human
cccuuggaagguagcuggcagu

SEQ ID NO: 741946 - RNA, 22 nt, Human
aaacugggauucuucacaaggu

SEQ ID NO: 741947 - RNA, 22 nt, Human
uuucuucuaggacuaauaagag

SEQ ID NO: 741948 - RNA, 22 nt, Human
cagaggcuggauggacuugccu

SEQ ID NO: 741949 - RNA, 21 nt, Human
gugcccuguucccacaugccc

SEQ ID NO: 741950 - RNA, 22 nt, Human
agcaggggcuccuccacagcca

SEQ ID NO: 741951 - RNA, 22 nt, Human
uaggacaggaucaugaugcugg

SEQ ID NO: 741952 - RNA, 22 nt, Human
caaucacugaccugcagaugca

SEQ ID NO: 741953 - RNA, 22 nt, Human
uggcuccagcucaaguauggca

SEQ ID NO: 741954 - RNA, 22 nt, Human
uuccuuaaugaaucaggccauu

SEQ ID NO: 741955 - RNA, 20 nt, Human
cagcuuuagaucuuugauua

SEQ ID NO: 741956 - RNA, 17 nt, Human
ggagcagauccaccauu

SEQ ID NO: 741957 - RNA, 22 nt, Human
acaguagaguaaaugguuagau

SEQ ID NO: 741958 - RNA, 22 nt, Human
uuuagcaaauuacucacagggu

SEQ ID NO: 741959 - RNA, 22 nt, Human
uguuccaugucuuuguaggacu

SEQ ID NO: 741960 - RNA, 22 nt, Human
ucaaugcaaccuccaccucccg

SEQ ID NO: 741961 - RNA, 23 nt, Human
aaagaccuaggaugagggagacg

SEQ ID NO: 741962 - RNA, 22 nt, Human
ccucugaggucauggacuuggc

SEQ ID NO: 741963 - RNA, 22 nt, Human
cacuugaaaguaaugguugugc

SEQ ID NO: 741964 - RNA, 22 nt, Human
ugauuaacguuuuaggcauacu

SEQ ID NO: 741965 - RNA, 21 nt, Human
ugggauagaaauauggcugcu

SEQ ID NO: 741966 - RNA, 23 nt, Human
cuguauuugacuugagcggaaau

SEQ ID NO: 741967 - RNA, 22 nt, Human
cacagauagaccuuaugagauu

SEQ ID NO: 741968 - RNA, 22 nt, Human
uuaaagaguuuauuacuuguaa

SEQ ID NO: 741969 - RNA, 21 nt, Human
uugagcagaaauguguaugcc

SEQ ID NO: 741970 - RNA, 22 nt, Human
uguccuggaaaaauggagaguu

SEQ ID NO: 741971 - RNA, 22 nt, Human
uuuaccaaauagauuaugucag

SEQ ID NO: 741972 - RNA, 22 nt, Human
ccaggcuccucaugaucuuguu

SEQ ID NO: 741973 - RNA, 22 nt, Human
ccucuggcaagugauuuaucau

SEQ ID NO: 741974 - RNA, 20 nt, Human
agcacauuaaacauacuccu

SEQ ID NO: 741975 - RNA, 22 nt, Human
uauaaaugccaggacuuuagau

SEQ ID NO: 741976 - RNA, 22 nt, Human
gcugucacacauggccccagcu

SEQ ID NO: 741977 - RNA, 22 nt, Human
gcccagccccuggguggacgug

SEQ ID NO: 741978 - RNA, 22 nt, Human
cugcguguuccugaagcgcgcu

SEQ ID NO: 741979 - RNA, 22 nt, Human
aaugcaauaccuuuuuaugcug

SEQ ID NO: 741980 - RNA, 22 nt, Human
gcugcagaauuuccuucucauu

SEQ ID NO: 741981 - RNA, 22 nt, Human
uaucuguuaaaacaagcuuuaa

SEQ ID NO: 741982 - RNA, 22 nt, Human
auacauucagcagugcucauga

SEQ ID NO: 741983 - RNA, 22 nt, Human
ugcagcagcagggaggaggcuc

SEQ ID NO: 741984 - RNA, 22 nt, Human
ucuggcuccguguccgcuccca

SEQ ID NO: 741985 - RNA, 23 nt, Human
ggagugcaauggcgccaucucgg

SEQ ID NO: 741986 - RNA, 22 nt, Human
uggaagacggaaaucuguagau

SEQ ID NO: 741987 - RNA, 19 nt, Human
ugcuggagguugacagggu

SEQ ID NO: 741988 - RNA, 22 nt, Human
gggcagggguagcauuccaagu

SEQ ID NO: 741989 - RNA, 22 nt, Human
cauauauucugguuuucacugg

SEQ ID NO: 741990 - RNA, 22 nt, Human
cugggagugaaaggagggcugc

SEQ ID NO: 741991 - RNA, 22 nt, Human
gggaagagugucgguugaagug

SEQ ID NO: 741992 - RNA, 22 nt, Human
cacaugcaucugucauguuugg

SEQ ID NO: 741993 - RNA, 22 nt, Human
gcaguauauccauuacuucaua

SEQ ID NO: 741994 - RNA, 22 nt, Human
caguccuuagucuggauggcuu

SEQ ID NO: 741995 - RNA, 22 nt, Human
uccuggggcucugagcgagaca

SEQ ID NO: 741996 - RNA, 22 nt, Human
cacaaggacauguauauuuaug

SEQ ID NO: 741997 - RNA, 22 nt, Human
ugcaggcuggcagugcugaaau

SEQ ID NO: 741998 - RNA, 22 nt, Human
cucuggacagcaggugcugugg

SEQ ID NO: 741999 - RNA, 22 nt, Human
ccucagacgcaggccuaugggc

SEQ ID NO: 742000 - RNA, 22 nt, Human
ucagacagggagucagaaaaua

SEQ ID NO: 742001 - RNA, 22 nt, Human
gaugaaaugcugagccugaguu

SEQ ID NO: 742002 - RNA, 22 nt, Human
cagauguaaucugacagcugga

SEQ ID NO: 742003 - RNA, 19 nt, Human
agugguagaugagcaggag

SEQ ID NO: 742004 - RNA, 22 nt, Human
agaggggcgggaacucaaccuc

SEQ ID NO: 742005 - RNA, 22 nt, Human
agagcccuuucuccaggcaccu

SEQ ID NO: 742006 - RNA, 22 nt, Human
cuguuguagcugcgcugcuuca

SEQ ID NO: 742007 - RNA, 22 nt, Human
uugcacagaguggauauucagu

SEQ ID NO: 742008 - RNA, 20 nt, Human
ucucaguuucuagagucagg

SEQ ID NO: 742009 - RNA, 22 nt, Human
gaggugguucagguagagccca

SEQ ID NO: 742010 - RNA, 22 nt, Human
ucucugcccaugagcaaucugc

SEQ ID NO: 742011 - RNA, 22 nt, Human
gccugccugcugucaucugccu

SEQ ID NO: 742012 - RNA, 22 nt, Human
ugucaaagacagaaggaaaugg

SEQ ID NO: 742013 - RNA, 22 nt, Human
uaugucuuuaguaucuuuugga

SEQ ID NO: 742014 - RNA, 22 nt, Human
ucagcaggcagaaaucugcaga

SEQ ID NO: 742015 - RNA, 22 nt, Human
cugcagccacgagucacagccc

SEQ ID NO: 742016 - RNA, 22 nt, Human
aggcucucagaucagccacauu

SEQ ID NO: 742017 - RNA, 22 nt, Human
uaacaaugauuagugacuacag

SEQ ID NO: 742018 - RNA, 22 nt, Human
ucuuuacacaagacaagaauaa

SEQ ID NO: 742019 - RNA, 21 nt, Human
uucucagagucuauuacaguu

SEQ ID NO: 742020 - RNA, 22 nt, Human
cagaauaagcuguguugucaag

SEQ ID NO: 742021 - RNA, 20 nt, Human
cauuugggaucaugagguuu

SEQ ID NO: 742022 - RNA, 22 nt, Human
aaagcuaccuuuguguucauag

SEQ ID NO: 742023 - RNA, 22 nt, Human
aucaucugcacagauccuauuu

SEQ ID NO: 742024 - RNA, 22 nt, Human
caugagcauaaaucagucacga

SEQ ID NO: 742025 - RNA, 22 nt, Human
uuucuagaugcggggcuugugc

SEQ ID NO: 742026 - RNA, 22 nt, Human
cacccuggaaagaaggucuggg

SEQ ID NO: 742027 - RNA, 22 nt, Human
cuacagucuggcaggaauguua

SEQ ID NO: 742028 - RNA, 22 nt, Human
uagcacaguauuucucaacugg

SEQ ID NO: 742029 - RNA, 22 nt, Human
cuuguacauagagaagaagccu

SEQ ID NO: 742030 - RNA, 21 nt, Human
uuccagagauuguuucaccug

SEQ ID NO: 742031 - RNA, 22 nt, Human
ggcucagacucccaggcccucu

SEQ ID NO: 742032 - RNA, 22 nt, Human
ugugacuucuuuuugaguucaa

SEQ ID NO: 742033 - RNA, 22 nt, Human
uucaagauggcugcaaauacuu

SEQ ID NO: 742034 - RNA, 22 nt, Human
aggucauuccuugucuucuugc

SEQ ID NO: 742035 - RNA, 22 nt, Human
uggaagagaaaggaguggaucu

SEQ ID NO: 742036 - RNA, 22 nt, Human
uuuuuccuagugcuuucuggua

SEQ ID NO: 742037 - RNA, 22 nt, Human
uggcccugccgccacgacgucu

SEQ ID NO: 742038 - RNA, 22 nt, Human
guuauugcuggauagauacauc

SEQ ID NO: 742039 - RNA, 22 nt, Human
uggcuccaggggacacgcagua

SEQ ID NO: 742040 - RNA, 22 nt, Human
gcugccuggcugaugaaaauuc

SEQ ID NO: 742041 - RNA, 22 nt, Human
aaugucuauuugcuacaaagcc

SEQ ID NO: 742042 - RNA, 22 nt, Human
uuuacagucaccaaacuuugcu

SEQ ID NO: 742043 - RNA, 22 nt, Human
auuaaggagguaaacuaugguu

SEQ ID NO: 742044 - RNA, 22 nt, Human
caucuggcuagcuaucauugug

SEQ ID NO: 742045 - RNA, 22 nt, Human
ggcucagguuuccuucccagcu

SEQ ID NO: 742046 - RNA, 23 nt, Human
gcccagagaggcucaccaggaau

SEQ ID NO: 742047 - RNA, 22 nt, Human
uguuagcagagcagcugacaga

SEQ ID NO: 742048 - RNA, 22 nt, Human
ccagauagaaaagaaggcagga

SEQ ID NO: 742049 - RNA, 22 nt, Human
ggaggggcagccauggaacucc

SEQ ID NO: 742050 - RNA, 22 nt, Human
cccucuccuggcugcauggagc

SEQ ID NO: 742051 - RNA, 22 nt, Human
ggccucucuccagucagugcag

SEQ ID NO: 742052 - RNA, 17 nt, Human
agucugggaccugcgug

SEQ ID NO: 742053 - RNA, 23 nt, Human
ccuccccaccagacucuaacaua

SEQ ID NO: 742054 - RNA, 22 nt, Human
uuggaaaaacacgauagugguu

SEQ ID NO: 742055 - RNA, 22 nt, Human
ugcuauuuuuaucuugaucaaa

SEQ ID NO: 742056 - RNA, 23 nt, Human
uggcuccaugaaaauuacgagga

SEQ ID NO: 742057 - RNA, 22 nt, Human
cccaggaucaccuggucaaggg

SEQ ID NO: 742058 - RNA, 22 nt, Human
cauuugaacuaauaacugugcu

SEQ ID NO: 742059 - RNA, 22 nt, Human
gcaccaggcagcugagcaggcc

SEQ ID NO: 742060 - RNA, 18 nt, Human
cuucagugacagucuggc

SEQ ID NO: 742061 - RNA, 22 nt, Human
acaaaguagucaaaguagauga

SEQ ID NO: 742062 - RNA, 22 nt, Human
uuuauugaguaucuacuaugug

SEQ ID NO: 742063 - RNA, 22 nt, Human
caugcaaaggucaagaucagga

SEQ ID NO: 742064 - RNA, 22 nt, Human
ccugggcaggaugggcccggug

SEQ ID NO: 742065 - RNA, 22 nt, Human
guagaugagcucacaugaccuu

SEQ ID NO: 742066 - RNA, 22 nt, Human
uaccuagacaugaacacagaug

SEQ ID NO: 742067 - RNA, 22 nt, Human
gcugagguggugaugguucauc

SEQ ID NO: 742068 - RNA, 22 nt, Human
ugucucugauaaguaguucagu

SEQ ID NO: 742069 - RNA, 22 nt, Human
aaguaaauguuggagcucaaau

SEQ ID NO: 742070 - RNA, 22 nt, Human
cacccauuaaccaaagagugaa

SEQ ID NO: 742071 - RNA, 22 nt, Human
gacaauugcuuuugccgaauaa

SEQ ID NO: 742072 - RNA, 22 nt, Human
uugggaguuccuacugcgguuu

SEQ ID NO: 742073 - RNA, 22 nt, Human
ggagagcagggaggcugcucug

SEQ ID NO: 742074 - RNA, 22 nt, Human
acaaggcacuuuaugaagagga

SEQ ID NO: 742075 - RNA, 22 nt, Human
uuacaggugggaaaacuaagcu

SEQ ID NO: 742076 - RNA, 22 nt, Human
cuuuccuuaauaagcagguaua

SEQ ID NO: 742077 - RNA, 22 nt, Human
caggcaccaauagggaucgugg

SEQ ID NO: 742078 - RNA, 22 nt, Human
accugggaaagccguggaaagg

SEQ ID NO: 742079 - RNA, 22 nt, Human
aagagcuggauggaaucuggga

SEQ ID NO: 742080 - RNA, 22 nt, Human
ggccugcucuguuuagaggggg

SEQ ID NO: 742081 - RNA, 22 nt, Human
uuggcagauggauucaacauua

SEQ ID NO: 742082 - RNA, 17 nt, Human
acagagcuacauauucu

SEQ ID NO: 742083 - RNA, 20 nt, Human
agucacauugagcuuuugga

SEQ ID NO: 742084 - RNA, 22 nt, Human
guccucugggcuuugagcaguc

SEQ ID NO: 742085 - RNA, 19 nt, Human
ucucccagcugagaagggc

SEQ ID NO: 742086 - RNA, 22 nt, Human
ccucccaggcauugccauuuuc

SEQ ID NO: 742087 - RNA, 22 nt, Human
uuucacaguuagcaugaggacu

SEQ ID NO: 742088 - RNA, 22 nt, Human
ugcugcuuuuaguuggauagaa

SEQ ID NO: 742089 - RNA, 22 nt, Human
ccaguguuuuccaguuugccca

SEQ ID NO: 742090 - RNA, 22 nt, Human
ugggcaguugcuccucagaccc

SEQ ID NO: 742091 - RNA, 22 nt, Human
uuguuuucagggugucauucac

SEQ ID NO: 742092 - RNA, 22 nt, Human
agacaacaucacuaaagcugag

SEQ ID NO: 742093 - RNA, 22 nt, Human
ucagaagaagagacuccacagc

SEQ ID NO: 742094 - RNA, 22 nt, Human
ccuuagugaaacagaggcaauu

SEQ ID NO: 742095 - RNA, 22 nt, Human
auuuuccuuguggguuagcgaa

SEQ ID NO: 742096 - RNA, 22 nt, Human
ucaccccuaccaaggagcacug

SEQ ID NO: 742097 - RNA, 22 nt, Human
uauacugagagcaaauacauuc

SEQ ID NO: 742098 - RNA, 22 nt, Human
agcugggccugauuugcagggg

SEQ ID NO: 742099 - RNA, 22 nt, Human
aauaaaaugaacugguagaguu

SEQ ID NO: 742100 - RNA, 22 nt, Human
guggcugcagcucugaacggac

SEQ ID NO: 742101 - RNA, 22 nt, Human
aagaacaugggugugggcauuc

SEQ ID NO: 742102 - RNA, 22 nt, Human
uaguagcaaaacucaucucuuu

SEQ ID NO: 742103 - RNA, 22 nt, Human
agcagcagaagggagacccagg

SEQ ID NO: 742104 - RNA, 22 nt, Human
auaaaaccaaagcagcaguguu

SEQ ID NO: 742105 - RNA, 22 nt, Human
aaguaaggcagugaaugagauu

SEQ ID NO: 742106 - RNA, 17 nt, Human
uucaaugauuaaugcau

SEQ ID NO: 742107 - RNA, 22 nt, Human
gcugauguuuaguugauguuac

SEQ ID NO: 742108 - RNA, 22 nt, Human
aggauccuccuuagaaaagacc

SEQ ID NO: 742109 - RNA, 18 nt, Human
gugccaggaggcgcagcc

SEQ ID NO: 742110 - RNA, 22 nt, Human
aauucccacuauaugccaagca

SEQ ID NO: 742111 - RNA, 22 nt, Human
gaccucagcuguggggaugcug

SEQ ID NO: 742112 - RNA, 22 nt, Human
aagcuguggcuuggaggaaaca

SEQ ID NO: 742113 - RNA, 22 nt, Human
gccagcagcccagaaggacuuu

SEQ ID NO: 742114 - RNA, 20 nt, Human
ugcguguguauuuauuuucu

SEQ ID NO: 742115 - RNA, 22 nt, Human
gggggagcuguuauuggcaggg

SEQ ID NO: 742116 - RNA, 22 nt, Human
ggaaccuguacguuguccuuga

SEQ ID NO: 742117 - RNA, 22 nt, Human
ucagcaguggcucucaugcagu

SEQ ID NO: 742118 - RNA, 22 nt, Human
cucugagagugcucagagggua

SEQ ID NO: 742119 - RNA, 22 nt, Human
gaguccugaauccuguggcaac

SEQ ID NO: 742120 - RNA, 22 nt, Human
auugauucucauaggaccaucu

SEQ ID NO: 742121 - RNA, 22 nt, Human
aaagcagccgguucccuggucu

SEQ ID NO: 742122 - RNA, 22 nt, Human
ugagacagcccuucugcacagg

SEQ ID NO: 742123 - RNA, 17 nt, Human
gagaguguauuggaugc

SEQ ID NO: 742124 - RNA, 22 nt, Human
ucugacuuggcgcucuugucuu

SEQ ID NO: 742125 - RNA, 21 nt, Human
agagcucaaggcaaaaauaau

SEQ ID NO: 742126 - RNA, 19 nt, Human
cugagccucaguuuccuag

SEQ ID NO: 742127 - RNA, 22 nt, Human
auugagaauccauuugagauga

SEQ ID NO: 742128 - RNA, 22 nt, Human
auugcugaacuuauaaaugaau

SEQ ID NO: 742129 - RNA, 23 nt, Human
uuucaaauuacucugcagaugac

SEQ ID NO: 742130 - RNA, 22 nt, Human
gugggccacaucccagggcucu

SEQ ID NO: 742131 - RNA, 22 nt, Human
ucucauguauugcccuggugug

SEQ ID NO: 742132 - RNA, 22 nt, Human
uuugcuuucuguugaacagagu

SEQ ID NO: 742133 - RNA, 22 nt, Human
agcagcucauggaguaggcacu

SEQ ID NO: 742134 - RNA, 22 nt, Human
uuaaacaccacagcagucccua

SEQ ID NO: 742135 - RNA, 22 nt, Human
aaguggaagagaaguuaucuua

SEQ ID NO: 742136 - RNA, 22 nt, Human
agaccgagaaguucuccaggcc

SEQ ID NO: 742137 - RNA, 22 nt, Human
ugcuccugauaucuaaugugua

SEQ ID NO: 742138 - RNA, 20 nt, Human
ucccucaggucauugggcug

SEQ ID NO: 742139 - RNA, 22 nt, Human
aaauccuugauaguuugcccua

SEQ ID NO: 742140 - RNA, 22 nt, Human
aagagaauaucgauagcacucu

SEQ ID NO: 742141 - RNA, 22 nt, Human
cuuccuggcaugggucucauga

SEQ ID NO: 742142 - RNA, 21 nt, Human
ugcccuggggcucuucccuca

SEQ ID NO: 742143 - RNA, 22 nt, Human
auaguauuuaauaguuagcuca

SEQ ID NO: 742144 - RNA, 22 nt, Human
aacugaaacuuaggaaguaauc

SEQ ID NO: 742145 - RNA, 22 nt, Human
gauacauuccgggagggcuacc

SEQ ID NO: 742146 - RNA, 22 nt, Human
ugcuggccaagcagaggucaau

SEQ ID NO: 742147 - RNA, 22 nt, Human
acugggaggcaucuggagcuga

SEQ ID NO: 742148 - RNA, 22 nt, Human
gaguccuuggcaucaucaguac

SEQ ID NO: 742149 - RNA, 22 nt, Human
gcucucaaguccuuuugcucag

SEQ ID NO: 742150 - RNA, 22 nt, Human
auggcagaagucaagaugaguu

SEQ ID NO: 742151 - RNA, 19 nt, Human
ccagaggacuguuaaugaa

SEQ ID NO: 742152 - RNA, 22 nt, Human
gaaauagaggacagcuggauca

SEQ ID NO: 742153 - RNA, 22 nt, Human
gaaggcuggggcaucagugaaa

SEQ ID NO: 742154 - RNA, 22 nt, Human
cagcagagcauuugguaggagg

SEQ ID NO: 742155 - RNA, 22 nt, Human
acaaugcaauuguaaggugugu

SEQ ID NO: 742156 - RNA, 22 nt, Human
aaaucaugugcagagaucagga

SEQ ID NO: 742157 - RNA, 22 nt, Human
gaagaaauugaauucaugagcu

SEQ ID NO: 742158 - RNA, 22 nt, Human
gccccucuccuugugcaccugc

SEQ ID NO: 742159 - RNA, 22 nt, Human
ccagggcaaaugagaucauagc

SEQ ID NO: 742160 - RNA, 22 nt, Human
uuucacaggaauacccggcuuu

SEQ ID NO: 742161 - RNA, 22 nt, Human
uuguagcauuuuaaaugagcau

SEQ ID NO: 742162 - RNA, 22 nt, Human
uggaggccaaggcaggcggauc

SEQ ID NO: 742163 - RNA, 22 nt, Human
ucacagaauaaauguacuggcc

SEQ ID NO: 742164 - RNA, 22 nt, Human
cucagcaacccacacacggucu

SEQ ID NO: 742165 - RNA, 22 nt, Human
aaggcugaguaaaacagagaac

SEQ ID NO: 742166 - RNA, 20 nt, Human
aacuuguucuaccuguuuca

SEQ ID NO: 742167 - RNA, 22 nt, Human
ccaggucuggaaccaccagggc

SEQ ID NO: 742168 - RNA, 20 nt, Human
auggagguggaugugacugc

SEQ ID NO: 742169 - RNA, 22 nt, Human
ucugggaugcaaacagaaucug

SEQ ID NO: 742170 - RNA, 22 nt, Human
gugcuuuaaaaauaggagauga

SEQ ID NO: 742171 - RNA, 22 nt, Human
uuucaggacaccuuuaaaaacg

SEQ ID NO: 742172 - RNA, 22 nt, Human
gaaagugcuuuugagugugugc

SEQ ID NO: 742173 - RNA, 22 nt, Human
agggucugacuccucuggcaag

SEQ ID NO: 742174 - RNA, 22 nt, Human
cugggcucugcggugucgcucu

SEQ ID NO: 742175 - RNA, 22 nt, Human
cuugcugucccuugguaugaac

SEQ ID NO: 742176 - RNA, 22 nt, Human
gguggcugcacccuggcuaacu

SEQ ID NO: 742177 - RNA, 22 nt, Human
uucugcaugauauuaaauguaa

SEQ ID NO: 742178 - RNA, 22 nt, Human
guccuucaaguaaccugggacc

SEQ ID NO: 742179 - RNA, 22 nt, Human
augagcaauuaggaagaaaaca

SEQ ID NO: 742180 - RNA, 22 nt, Human
aaaucccuugcucucucagacc

SEQ ID NO: 742181 - RNA, 22 nt, Human
aagaggaggaugcuuuacagcu

SEQ ID NO: 742182 - RNA, 22 nt, Human
agccugguguggggcugcagag

SEQ ID NO: 742183 - RNA, 22 nt, Human
ugggggacugcacuggcgucag

SEQ ID NO: 742184 - RNA, 22 nt, Human
acccuccccaagaggucgugcc

SEQ ID NO: 742185 - RNA, 22 nt, Human
ggcaagugguagaacaucugag

SEQ ID NO: 742186 - RNA, 22 nt, Human
aaugaaaucugcuggguaaaga

SEQ ID NO: 742187 - RNA, 22 nt, Human
ggcagagcuaguggcuucucuu

SEQ ID NO: 742188 - RNA, 22 nt, Human
gaagaauugaggauguuuaccu

SEQ ID NO: 742189 - RNA, 22 nt, Human
cauucuucucccuuaccuucca

SEQ ID NO: 742190 - RNA, 22 nt, Human
ugcauacugaaucugccaucac

SEQ ID NO: 742191 - RNA, 22 nt, Human
aagccaggggcugcuuaggaga

SEQ ID NO: 742192 - RNA, 23 nt, Human
ccucugacaaugaugucaccugc

SEQ ID NO: 742193 - RNA, 22 nt, Human
aggcugugugcuccuuaugaga

SEQ ID NO: 742194 - RNA, 22 nt, Human
cugggaagggacgccagugccu

SEQ ID NO: 742195 - RNA, 22 nt, Human
aucuaagaguuaacaucaagaa

SEQ ID NO: 742196 - RNA, 22 nt, Human
cugugggaacacugaggacuuc

SEQ ID NO: 742197 - RNA, 22 nt, Human
uggcaggggaggugcuugcuua

SEQ ID NO: 742198 - RNA, 22 nt, Human
ucaguagcagaaagcaaugagu

SEQ ID NO: 742199 - RNA, 22 nt, Human
gcuauguguguuuugcugcagc

SEQ ID NO: 742200 - RNA, 22 nt, Human
caguggaaaucagagugagagu

SEQ ID NO: 742201 - RNA, 22 nt, Human
auuugugggacuauaaugcagg

SEQ ID NO: 742202 - RNA, 22 nt, Human
aguuucuaccgguacauucagg

SEQ ID NO: 742203 - RNA, 22 nt, Human
ugggcgaggagaaugcugugaa

SEQ ID NO: 742204 - RNA, 22 nt, Human
gaggcagccagagguucucauu

SEQ ID NO: 742205 - RNA, 23 nt, Human
uauccuaaaggcaacaggaaguc

SEQ ID NO: 742206 - RNA, 22 nt, Human
acagaauugaaaguauaaucug

SEQ ID NO: 742207 - RNA, 22 nt, Human
uccaggcuggaaaugucaaacu

SEQ ID NO: 742208 - RNA, 22 nt, Human
uucacugugaacucauauucag

SEQ ID NO: 742209 - RNA, 22 nt, Human
caggagcccguugcuccggcgg

SEQ ID NO: 742210 - RNA, 22 nt, Human
guuuuuauauccuguggagugu

SEQ ID NO: 742211 - RNA, 22 nt, Human
agcagguggacagaggaagaaa

SEQ ID NO: 742212 - RNA, 22 nt, Human
aacacagucaguuccuggauca

SEQ ID NO: 742213 - RNA, 22 nt, Human
aggcuggagguuuguugcggcu

SEQ ID NO: 742214 - RNA, 22 nt, Human
auuucaacagaguuugaaggca

SEQ ID NO: 742215 - RNA, 22 nt, Human
cucuggccccaguggccccuug

SEQ ID NO: 742216 - RNA, 19 nt, Human
agggcuaggcacauagggc

SEQ ID NO: 742217 - RNA, 22 nt, Human
cagaggccccauuggcugugcg

SEQ ID NO: 742218 - RNA, 22 nt, Human
uugaaucucuugaaucucuguu

SEQ ID NO: 742219 - RNA, 22 nt, Human
uccuugaagagugggcggucga

SEQ ID NO: 742220 - RNA, 22 nt, Human
cugugucuucaauguacuggga

SEQ ID NO: 742221 - RNA, 22 nt, Human
uuggcauuggagaugcaagaac

SEQ ID NO: 742222 - RNA, 22 nt, Human
ucagcuucagaucagcuagaga

SEQ ID NO: 742223 - RNA, 22 nt, Human
aggcuggugccugcagugaauc

SEQ ID NO: 742224 - RNA, 22 nt, Human
cauuugaaauaguucauucuug

SEQ ID NO: 742225 - RNA, 22 nt, Human
gcugccuuccaaagaguuuuau

SEQ ID NO: 742226 - RNA, 22 nt, Human
aaaugucagaggaacauauuga

SEQ ID NO: 742227 - RNA, 22 nt, Human
cagcugagaaaggcaggcucac

SEQ ID NO: 742228 - RNA, 22 nt, Human
uuuccuuccuugcuagccugag

SEQ ID NO: 742229 - RNA, 22 nt, Human
auuauaaauauuuucuaggggu

SEQ ID NO: 742230 - RNA, 23 nt, Human
gggcugcuccaggccaaggcugg

SEQ ID NO: 742231 - RNA, 22 nt, Human
caagaucuuccucaauagaccu

SEQ ID NO: 742232 - RNA, 22 nt, Human
uagggguggagcuaagaguccc

SEQ ID NO: 742233 - RNA, 22 nt, Human
uuaaggcauucuccuacuaaua

SEQ ID NO: 742234 - RNA, 22 nt, Human
aucugccuggcuccaggugagc

SEQ ID NO: 742235 - RNA, 22 nt, Human
ugaagcagaggggucuugagcu

SEQ ID NO: 742236 - RNA, 22 nt, Human
cugaagccaguuugcugcccuu

SEQ ID NO: 742237 - RNA, 22 nt, Human
caggaagaaggguggugagucc

SEQ ID NO: 742238 - RNA, 22 nt, Human
aaguguauauaugacuuauaaa

SEQ ID NO: 742239 - RNA, 22 nt, Human
agcccuggguuagggugggagc

SEQ ID NO: 742240 - RNA, 22 nt, Human
caggcacacagcacauggccug

SEQ ID NO: 742241 - RNA, 22 nt, Human
ccuccaguacuccaguccagcg

SEQ ID NO: 742242 - RNA, 22 nt, Human
ucucugaagaaucgaugauucu

SEQ ID NO: 742243 - RNA, 22 nt, Human
caggaagcugccggugagcgag

SEQ ID NO: 742244 - RNA, 22 nt, Human
cuggcugggagcucgccugcgg

SEQ ID NO: 742245 - RNA, 21 nt, Human
ugaggauaaguaaagcugaag

SEQ ID NO: 742246 - RNA, 22 nt, Human
ucuccuggauggaccuucucuu

SEQ ID NO: 742247 - RNA, 22 nt, Human
auucacagggcuuuccgcaugg

SEQ ID NO: 742248 - RNA, 22 nt, Human
cuggcucugagcccaccuccag

SEQ ID NO: 742249 - RNA, 22 nt, Human
gagcuugguguuauuucugugg

SEQ ID NO: 742250 - RNA, 22 nt, Human
agggggagcuuggcuacuccug

SEQ ID NO: 742251 - RNA, 21 nt, Human
gcagcagaggcuugacagaca

SEQ ID NO: 742252 - RNA, 22 nt, Human
cugggugguuuugaugugaauu

SEQ ID NO: 742253 - RNA, 22 nt, Human
gaccccaucuggcugccccagg

SEQ ID NO: 742254 - RNA, 22 nt, Human
gaggcaguaauugugggcaaua

SEQ ID NO: 742255 - RNA, 22 nt, Human
gacaggggucccucugggcugu

SEQ ID NO: 742256 - RNA, 22 nt, Human
ucucagagaagugaugagcaau

SEQ ID NO: 742257 - RNA, 22 nt, Human
auguagaaauuaggaugauagu

SEQ ID NO: 742258 - RNA, 22 nt, Human
uucaucuggaaguucccaaggc

SEQ ID NO: 742259 - RNA, 22 nt, Human
cccaggaguucgaggcuguagu

SEQ ID NO: 742260 - RNA, 22 nt, Human
agaguucugucugccacacgaa

SEQ ID NO: 742261 - RNA, 22 nt, Human
uguguuucucugaggggucccu

SEQ ID NO: 742262 - RNA, 22 nt, Human
uccugggacuuucaaggcuagg

SEQ ID NO: 742263 - RNA, 22 nt, Human
ucccacugugaauccaaggccu

SEQ ID NO: 742264 - RNA, 22 nt, Human
gaggcucaacccacagggguug

SEQ ID NO: 742265 - RNA, 22 nt, Human
guggcuauauuugaggauacgu

SEQ ID NO: 742266 - RNA, 22 nt, Human
aggcucagcugguggugaucgc

SEQ ID NO: 742267 - RNA, 22 nt, Human
aggcagcugcccucuccuuccu

SEQ ID NO: 742268 - RNA, 22 nt, Human
gcauggccuucagggacagcug

SEQ ID NO: 742269 - RNA, 22 nt, Human
gaaugucuucuguucccagcug

SEQ ID NO: 742270 - RNA, 20 nt, Human
uauugaguaccuacuguaua

SEQ ID NO: 742271 - RNA, 22 nt, Human
gugcaauuuugcaucuguaugc

SEQ ID NO: 742272 - RNA, 19 nt, Human
ccaggccucuggggccugu

SEQ ID NO: 742273 - RNA, 22 nt, Human
cacauucagcucauuaaugguc

SEQ ID NO: 742274 - RNA, 22 nt, Human
cagggccaaguuggugccuuuu

SEQ ID NO: 742275 - RNA, 22 nt, Human
aaacaucaccauuuuaccuaau

SEQ ID NO: 742276 - RNA, 22 nt, Human
ccacagggugucaucagcuuga

SEQ ID NO: 742277 - RNA, 22 nt, Human
gcucaaauuucagacucaugaa

SEQ ID NO: 742278 - RNA, 22 nt, Human
uaaacugugaaaggcuuaacau

SEQ ID NO: 742279 - RNA, 22 nt, Human
uacagcuuaaaagaugcauuua

SEQ ID NO: 742280 - RNA, 22 nt, Human
gggagcugcugaacacaagggu

SEQ ID NO: 742281 - RNA, 23 nt, Human
agggcugaaugcagagaagcaga

SEQ ID NO: 742282 - RNA, 23 nt, Human
gggugcugccuguagucaugcug

SEQ ID NO: 742283 - RNA, 22 nt, Human
ggggucaagcucagaauccuag

SEQ ID NO: 742284 - RNA, 22 nt, Human
gagaagccgagucagcugagcc

SEQ ID NO: 742285 - RNA, 22 nt, Human
cuguuuauucucaucuaaaaug

SEQ ID NO: 742286 - RNA, 22 nt, Human
cagcaggcucugaguggcugcc

SEQ ID NO: 742287 - RNA, 22 nt, Human
agagacugauggaucaccaaau

SEQ ID NO: 742288 - RNA, 22 nt, Human
ggcaggguguggaguugggaca

SEQ ID NO: 742289 - RNA, 22 nt, Human
uacaagacgagggaaguucuuu

SEQ ID NO: 742290 - RNA, 22 nt, Human
aaugagauggaauucccgccua

SEQ ID NO: 742291 - RNA, 22 nt, Human
ugcuuccagccuucccaaugcu

SEQ ID NO: 742292 - RNA, 22 nt, Human
ucuguguugagaaggaucauga

SEQ ID NO: 742293 - RNA, 22 nt, Human
uauauguaagcuauguaagagu

SEQ ID NO: 742294 - RNA, 22 nt, Human
ucaaauaccagcaauuucaugu

SEQ ID NO: 742295 - RNA, 22 nt, Human
uagaacagaggguugcccagau

SEQ ID NO: 742296 - RNA, 22 nt, Human
agaaacagaagggaaagcuuuu

SEQ ID NO: 742297 - RNA, 22 nt, Human
uucugaggaggagcaaaaacuc

SEQ ID NO: 742298 - RNA, 22 nt, Human
uaacuguauuuuucugagauuc

SEQ ID NO: 742299 - RNA, 22 nt, Human
cagggcccaggccacuggguug

SEQ ID NO: 742300 - RNA, 22 nt, Human
gaugcacugcaguauauacugu

SEQ ID NO: 742301 - RNA, 20 nt, Human
agccagaagaaggcuggaga

SEQ ID NO: 742302 - RNA, 22 nt, Human
guguguccaggcgggagucaag

SEQ ID NO: 742303 - RNA, 22 nt, Human
agcuugaguuuuggaugaagug

SEQ ID NO: 742304 - RNA, 22 nt, Human
ggaauguugucauuuacauuau

SEQ ID NO: 742305 - RNA, 22 nt, Human
ccccagcugcauacuugccaag

SEQ ID NO: 742306 - RNA, 22 nt, Human
gaggagccaagguauguguguu

SEQ ID NO: 742307 - RNA, 22 nt, Human
gcacagagagcagugggggaca

SEQ ID NO: 742308 - RNA, 22 nt, Human
cugaccuggccuuggugggcca

SEQ ID NO: 742309 - RNA, 22 nt, Human
gcagagcagugcuugcccagcg

SEQ ID NO: 742310 - RNA, 22 nt, Human
gaguuauaaccuaguuuaacug

SEQ ID NO: 742311 - RNA, 22 nt, Human
gugcagcucaguugaaaugcag

SEQ ID NO: 742312 - RNA, 22 nt, Human
uccagucaggcugaauucaagg

SEQ ID NO: 742313 - RNA, 20 nt, Human
ugcccuguggaggggaaagg

SEQ ID NO: 742314 - RNA, 22 nt, Human
cuguauauggcuuacuuuauau

SEQ ID NO: 742315 - RNA, 22 nt, Human
auuacacaggcuggcucuuuga

SEQ ID NO: 742316 - RNA, 22 nt, Human
ucagauuucugaaagcccucuc

SEQ ID NO: 742317 - RNA, 22 nt, Human
uacccagcccaugccuaccuca

SEQ ID NO: 742318 - RNA, 22 nt, Human
auuuuaauaagauccauuuggu

SEQ ID NO: 742319 - RNA, 22 nt, Human
guggugcaugcaugcauaugua

SEQ ID NO: 742320 - RNA, 22 nt, Human
guuuccuauaacucaggcacca

SEQ ID NO: 742321 - RNA, 22 nt, Human
ucugcaggacugaggccuguuu

SEQ ID NO: 742322 - RNA, 22 nt, Human
aucuggagcucugcacaccugg

SEQ ID NO: 742323 - RNA, 22 nt, Human
uccugggcgauuuucugaauau

SEQ ID NO: 742324 - RNA, 22 nt, Human
cucacaggcgguaauucaggga

SEQ ID NO: 742325 - RNA, 22 nt, Human
aaucucuugggaggaaugaauu

SEQ ID NO: 742326 - RNA, 22 nt, Human
gugucugcuugcugagcauuua

SEQ ID NO: 742327 - RNA, 22 nt, Human
cagacugagggcaucacauacg

SEQ ID NO: 742328 - RNA, 16 nt, Human
cuggucuugcugccga

SEQ ID NO: 742329 - RNA, 22 nt, Human
uuuccucuuugugacacagcug

SEQ ID NO: 742330 - RNA, 22 nt, Human
auucucauaggagcgugaaccu

SEQ ID NO: 742331 - RNA, 22 nt, Human
ugucauuuucauccuaaggagc

SEQ ID NO: 742332 - RNA, 22 nt, Human
guggggugcagcaguacugugu

SEQ ID NO: 742333 - RNA, 22 nt, Human
auaauggcuucugaguauuagg

SEQ ID NO: 742334 - RNA, 22 nt, Human
aagaguuuuuggagugugaguu

SEQ ID NO: 742335 - RNA, 19 nt, Human
cuucagggaggggccaggc

SEQ ID NO: 742336 - RNA, 22 nt, Human
aggcaggcucaggcccaugcuu

SEQ ID NO: 742337 - RNA, 22 nt, Human
cuguguccugcgucaagccaau

SEQ ID NO: 742338 - RNA, 22 nt, Human
ggauuucuuccuuccucagaag

SEQ ID NO: 742339 - RNA, 22 nt, Human
acccuugguuuugcagagcugu

SEQ ID NO: 742340 - RNA, 22 nt, Human
auuugccuugugauuuguaagu

SEQ ID NO: 742341 - RNA, 22 nt, Human
uccaugaguuugaggaaaagag

SEQ ID NO: 742342 - RNA, 22 nt, Human
acuguaaccaguguggugagag

SEQ ID NO: 742343 - RNA, 22 nt, Human
aggcaagaaacuuucugggaga

SEQ ID NO: 742344 - RNA, 20 nt, Human
ugggcagcacugcuggcugg

SEQ ID NO: 742345 - RNA, 19 nt, Human
ucuuucauuucuagcucug

SEQ ID NO: 742346 - RNA, 22 nt, Human
cagaggccauauuucuucacuc

SEQ ID NO: 742347 - RNA, 22 nt, Human
ucacuaagugccgaguuuaguu

SEQ ID NO: 742348 - RNA, 22 nt, Human
gggacuccauaagcacauggau

SEQ ID NO: 742349 - RNA, 22 nt, Human
cuggaagguuccucccagcucc

SEQ ID NO: 742350 - RNA, 22 nt, Human
ggagaguggauuccagcuguau

SEQ ID NO: 742351 - RNA, 22 nt, Human
ugccugggacaugcuguggacu

SEQ ID NO: 742352 - RNA, 22 nt, Human
gagcucugacugcugggugaca

SEQ ID NO: 742353 - RNA, 22 nt, Human
uggaagaauguuugccuuauaa

SEQ ID NO: 742354 - RNA, 22 nt, Human
ucuuucagcucuucaggaccca

SEQ ID NO: 742355 - RNA, 22 nt, Human
ggacagaggguugacagaguau

SEQ ID NO: 742356 - RNA, 22 nt, Human
cugugucccccucagccaggug

SEQ ID NO: 742357 - RNA, 22 nt, Human
ggccccaggaccuccacggucc

SEQ ID NO: 742358 - RNA, 22 nt, Human
acucagagcuuggcuccuugcu

SEQ ID NO: 742359 - RNA, 18 nt, Human
uaugagaagauuagcaau

SEQ ID NO: 742360 - RNA, 22 nt, Human
uacagucaauacuaggaccaua

SEQ ID NO: 742361 - RNA, 22 nt, Human
uuacagagggcuucucugaacu

SEQ ID NO: 742362 - RNA, 22 nt, Human
gcuggguuuccagcaggcagga

SEQ ID NO: 742363 - RNA, 22 nt, Human
gaugcacagugacccugccagu

SEQ ID NO: 742364 - RNA, 22 nt, Human
uucuuuuggacucaaagagaac

SEQ ID NO: 742365 - RNA, 22 nt, Human
agagaucaguuaaaaucuuuuu

SEQ ID NO: 742366 - RNA, 22 nt, Human
auucuucuaauaugaucguguu

SEQ ID NO: 742367 - RNA, 22 nt, Human
aaaucuggccccuugccuauuu

SEQ ID NO: 742368 - RNA, 22 nt, Human
acagccagggucucaggaggcg

SEQ ID NO: 742369 - RNA, 22 nt, Human
guuuccuggaaacugcuccacu

SEQ ID NO: 742370 - RNA, 23 nt, Human
ucagagaacucgggcagaugacc

SEQ ID NO: 742371 - RNA, 23 nt, Human
acugucugauauguuuuccauca

SEQ ID NO: 742372 - RNA, 22 nt, Human
uguauuuaauuguaucaucaca

SEQ ID NO: 742373 - RNA, 22 nt, Human
uucaaacauucaaauaaaccgg

SEQ ID NO: 742374 - RNA, 22 nt, Human
ugcagccucucugcuucaggaa

SEQ ID NO: 742375 - RNA, 22 nt, Human
aggugcuguuggcagcgggcag

SEQ ID NO: 742376 - RNA, 22 nt, Human
aagacuuucaaguaugcaugca

SEQ ID NO: 742377 - RNA, 22 nt, Human
uccccaccccagaacuacuagg

SEQ ID NO: 742378 - RNA, 19 nt, Human
aauaagcuuggguaaaacu

SEQ ID NO: 742379 - RNA, 22 nt, Human
uuccacugaaggaucuagggaa

SEQ ID NO: 742380 - RNA, 22 nt, Human
gcucaggcaggagugcaguggc

SEQ ID NO: 742381 - RNA, 22 nt, Human
uauugaaauccauuacguucuu

SEQ ID NO: 742382 - RNA, 22 nt, Human
cagcacuaggauauacauuucc

SEQ ID NO: 742383 - RNA, 22 nt, Human
accacuggauaucagagaugua

SEQ ID NO: 742384 - RNA, 22 nt, Human
uuuuggcucugucuguaucuuu

SEQ ID NO: 742385 - RNA, 22 nt, Human
uuaauacagaagcaagacacug

SEQ ID NO: 742386 - RNA, 22 nt, Human
agcucccugagaugccacagca

SEQ ID NO: 742387 - RNA, 22 nt, Human
uuaaagcauguugcuuaacagg

SEQ ID NO: 742388 - RNA, 22 nt, Human
ugggccaggucugugucagcug

SEQ ID NO: 742389 - RNA, 22 nt, Human
uauuuaaccaguuaaauuucca

SEQ ID NO: 742390 - RNA, 22 nt, Human
cuccaggcuucaagggccggcc

SEQ ID NO: 742391 - RNA, 22 nt, Human
uuuauuggauauuuacaagaua

SEQ ID NO: 742392 - RNA, 22 nt, Human
agagcacagugcaggauccccg

SEQ ID NO: 742393 - RNA, 22 nt, Human
aucugggagucuuggcucugcu

SEQ ID NO: 742394 - RNA, 22 nt, Human
cauuagguauuuaagcacacag

SEQ ID NO: 742395 - RNA, 22 nt, Human
uggccucaagucugagggccuu

SEQ ID NO: 742396 - RNA, 22 nt, Human
uauguuuuuaagagaaugcauu

SEQ ID NO: 742397 - RNA, 22 nt, Human
gcuuuaugcaaaccugguacuu

SEQ ID NO: 742398 - RNA, 22 nt, Human
cagcauguaagccacugcccug

SEQ ID NO: 742399 - RNA, 22 nt, Human
augacagaugcuguggggaggu

SEQ ID NO: 742400 - RNA, 22 nt, Human
ugguuccuacgcacauugaauu

SEQ ID NO: 742401 - RNA, 21 nt, Human
gcucagcugcuugguuccugu

SEQ ID NO: 742402 - RNA, 22 nt, Human
ugcaugcagcuggugauaagaa

SEQ ID NO: 742403 - RNA, 19 nt, Human
gugggacagacauuacaua

SEQ ID NO: 742404 - RNA, 22 nt, Human
ccugcucagccccagcucaccc

SEQ ID NO: 742405 - RNA, 22 nt, Human
ccugcugugaccggggagcagg

SEQ ID NO: 742406 - RNA, 22 nt, Human
gaacacaucacauuuuacagug

SEQ ID NO: 742407 - RNA, 22 nt, Human
ugcagcucugggcaagugccuu

SEQ ID NO: 742408 - RNA, 22 nt, Human
uuuaucugaggaaagcagacaa

SEQ ID NO: 742409 - RNA, 22 nt, Human
uuucaagagaaaacuaaccuau

SEQ ID NO: 742410 - RNA, 22 nt, Human
gaagauuuggauuccaugucac

SEQ ID NO: 742411 - RNA, 22 nt, Human
augucccagcugagagacaacu

SEQ ID NO: 742412 - RNA, 22 nt, Human
uugcaucagaaaauaugggaag

SEQ ID NO: 742413 - RNA, 22 nt, Human
ccacagugggcacagcaggacu

SEQ ID NO: 742414 - RNA, 22 nt, Human
uccucuggggucagggcacuac

SEQ ID NO: 742415 - RNA, 22 nt, Human
cauaauuagagaauucauguua

SEQ ID NO: 742416 - RNA, 22 nt, Human
auguguuaguuugugauuauac

SEQ ID NO: 742417 - RNA, 22 nt, Human
ugcuuuaucugugagaaccuga

SEQ ID NO: 742418 - RNA, 23 nt, Human
agacaaaagccucagucuuaggc

SEQ ID NO: 742419 - RNA, 22 nt, Human
agccccucuguggcucugccuc

SEQ ID NO: 742420 - RNA, 22 nt, Human
uaacaucuugcaguagcagaac

SEQ ID NO: 742421 - RNA, 22 nt, Human
gcagugggccugaggaagggug

SEQ ID NO: 742422 - RNA, 22 nt, Human
gggagagaauuauugccagacc

SEQ ID NO: 742423 - RNA, 22 nt, Human
agacaaaugaacaaauauguga

SEQ ID NO: 742424 - RNA, 21 nt, Human
aaaugcuuuguauauaucugu

SEQ ID NO: 742425 - RNA, 18 nt, Human
caggugggucuccugccc

SEQ ID NO: 742426 - RNA, 22 nt, Human
augcuuuaaaacguauguguaa

SEQ ID NO: 742427 - RNA, 22 nt, Human
augcacuacuuggcuuuacuga

SEQ ID NO: 742428 - RNA, 22 nt, Human
ugcagcauauagcuuagugaug

SEQ ID NO: 742429 - RNA, 22 nt, Human
cugccguguuuuucauguuaaa

SEQ ID NO: 742430 - RNA, 22 nt, Human
ugcuugagacacauaugaauuu

SEQ ID NO: 742431 - RNA, 22 nt, Human
aggaaacagagugaagcuuggg

SEQ ID NO: 742432 - RNA, 22 nt, Human
agauuuauguggucacacucag

SEQ ID NO: 742433 - RNA, 22 nt, Human
gucuguggaguugcuugcugga

SEQ ID NO: 742434 - RNA, 22 nt, Human
aaguucaaguaguguuacaugg

SEQ ID NO: 742435 - RNA, 22 nt, Human
ugggauaguagcugagagacaa

SEQ ID NO: 742436 - RNA, 22 nt, Human
aaagccaguuugucucuuuaaa

SEQ ID NO: 742437 - RNA, 22 nt, Human
gugcuuuagguguuuggcugaa

SEQ ID NO: 742438 - RNA, 18 nt, Human
ugcaggcugggguuccuc

SEQ ID NO: 742439 - RNA, 22 nt, Human
aggcgguggccaaggagcggga

SEQ ID NO: 742440 - RNA, 22 nt, Human
gcagacagaugagggugcuggg

SEQ ID NO: 742441 - RNA, 22 nt, Human
aggaggaaaaaggccacagcaa

SEQ ID NO: 742442 - RNA, 22 nt, Human
auccaaaucaugucagaagaac

SEQ ID NO: 742443 - RNA, 22 nt, Human
uguacaauggcuauaauacccu

SEQ ID NO: 742444 - RNA, 22 nt, Human
ucuggaauagguccugaguauu

SEQ ID NO: 742445 - RNA, 20 nt, Human
ucuuugugucagauggacag

SEQ ID NO: 742446 - RNA, 22 nt, Human
aauuuucuaaggugaugaucug

SEQ ID NO: 742447 - RNA, 22 nt, Human
gaaggcaucucuggacuuauuu

SEQ ID NO: 742448 - RNA, 22 nt, Human
ccuuuacacauggaaugggucu

SEQ ID NO: 742449 - RNA, 22 nt, Human
gcccaggcuagcguagagugca

SEQ ID NO: 742450 - RNA, 22 nt, Human
uacacugugacaaucaugacag

SEQ ID NO: 742451 - RNA, 22 nt, Human
agugcugaggccauacuccaua

SEQ ID NO: 742452 - RNA, 22 nt, Human
auauuuaaacaggguaccaaua

SEQ ID NO: 742453 - RNA, 22 nt, Human
uuuguuugccacacaaaacagu

SEQ ID NO: 742454 - RNA, 20 nt, Human
acugugaaugcugaauuagc

SEQ ID NO: 742455 - RNA, 22 nt, Human
uggguaaacugggucuggagag

SEQ ID NO: 742456 - RNA, 22 nt, Human
auuauucuuugauaaauggcag

SEQ ID NO: 742457 - RNA, 22 nt, Human
uuuugccugcacuguauauaua

SEQ ID NO: 742458 - RNA, 22 nt, Human
ccugucugcaugagugagcaua

SEQ ID NO: 742459 - RNA, 22 nt, Human
cacaucagguagaccuacagag

SEQ ID NO: 742460 - RNA, 22 nt, Human
cagagcuugaauguccaugguu

SEQ ID NO: 742461 - RNA, 19 nt, Human
ucuguggagcucagaguag

SEQ ID NO: 742462 - RNA, 22 nt, Human
gaccucaguauuguucaggaug

SEQ ID NO: 742463 - RNA, 19 nt, Human
ugcucauggggacuucucc

SEQ ID NO: 742464 - RNA, 22 nt, Human
agggcagagaucugagugggca

SEQ ID NO: 742465 - RNA, 22 nt, Human
gcuacugauugaccuuggagag

SEQ ID NO: 742466 - RNA, 22 nt, Human
ugcagcaggagccaggccuggu

SEQ ID NO: 742467 - RNA, 22 nt, Human
ccagcugguuaaaauagagaaa

SEQ ID NO: 742468 - RNA, 18 nt, Human
agaguguucucagugaaa

SEQ ID NO: 742469 - RNA, 22 nt, Human
uaggcugggcugagcuggacgg

SEQ ID NO: 742470 - RNA, 22 nt, Human
ccuggcucuucagagguuccua

SEQ ID NO: 742471 - RNA, 22 nt, Human
uggagguggaguuggaaacuga

SEQ ID NO: 742472 - RNA, 21 nt, Human
cuuuucuguguuccucccugu

SEQ ID NO: 742473 - RNA, 22 nt, Human
gagaucucuagcacuuccugua

SEQ ID NO: 742474 - RNA, 22 nt, Human
uggaaggaagccaaggaagguu

SEQ ID NO: 742475 - RNA, 22 nt, Human
ucacaguauaaccucauauagg

SEQ ID NO: 742476 - RNA, 22 nt, Human
cucaguuugugugauauugucu

SEQ ID NO: 742477 - RNA, 22 nt, Human
uaaaguauaagcauuggaguau

SEQ ID NO: 742478 - RNA, 22 nt, Human
gugugccucccauuagggugua

SEQ ID NO: 742479 - RNA, 22 nt, Human
ucacaucuuauuagaguaucuc

SEQ ID NO: 742480 - RNA, 22 nt, Human
guuuauuccagcaaucugcuua

SEQ ID NO: 742481 - RNA, 22 nt, Human
ggcgagggagcagugcgguggg

SEQ ID NO: 742482 - RNA, 22 nt, Human
ucuguuuaggcaaaauagcuac

SEQ ID NO: 742483 - RNA, 23 nt, Human
guuaauaaugaacacuuucuccc

SEQ ID NO: 742484 - RNA, 22 nt, Human
ucaugcaaucucuuguucagga

SEQ ID NO: 742485 - RNA, 23 nt, Human
ucuggcucuaugugacagcucuc

SEQ ID NO: 742486 - RNA, 22 nt, Human
uuucucugggcuguuggcagcc

SEQ ID NO: 742487 - RNA, 22 nt, Human
acucaaauagcugccccuagug

SEQ ID NO: 742488 - RNA, 22 nt, Human
aaggcuccuuuguaguucuuuu

SEQ ID NO: 742489 - RNA, 22 nt, Human
ugcaaagcaauguaggucagcu

SEQ ID NO: 742490 - RNA, 22 nt, Human
ccagucagccaagcugcagcgg

SEQ ID NO: 742491 - RNA, 22 nt, Human
agcagcaaagaauaggcccucu

SEQ ID NO: 742492 - RNA, 22 nt, Human
caggcagagcaacugguccaga

SEQ ID NO: 742493 - RNA, 22 nt, Human
ugccugagugauguggcagcca

SEQ ID NO: 742494 - RNA, 22 nt, Human
cugagagucagcuucuccuccu

SEQ ID NO: 742495 - RNA, 22 nt, Human
auaaacagcuccauuuagugcc

SEQ ID NO: 742496 - RNA, 22 nt, Human
cagggagucaacaaacagauca

SEQ ID NO: 742497 - RNA, 22 nt, Human
agccacuguaaggggaauugcc

SEQ ID NO: 742498 - RNA, 22 nt, Human
gcugaggcaaaccaagaaugua

SEQ ID NO: 742499 - RNA, 22 nt, Human
gcacacagccagcugagggcua

SEQ ID NO: 742500 - RNA, 23 nt, Human
caguauaauguauggauggggca

SEQ ID NO: 742501 - RNA, 22 nt, Human
cacccucccgucagccccuggg

SEQ ID NO: 742502 - RNA, 22 nt, Human
uuuucuguaagaggacuuuaau

SEQ ID NO: 742503 - RNA, 22 nt, Human
ugagguggguggcuucuguuau

SEQ ID NO: 742504 - RNA, 22 nt, Human
uuaauuaacuagccaaccacua

SEQ ID NO: 742505 - RNA, 22 nt, Human
gagcccugcgugucugggggca

SEQ ID NO: 742506 - RNA, 22 nt, Human
uaggugcuggauaaagaauggu

SEQ ID NO: 742507 - RNA, 22 nt, Human
uuuuauguaauaaacuguacac

SEQ ID NO: 742508 - RNA, 22 nt, Human
ugggggugcccuaugaggaagc

SEQ ID NO: 742509 - RNA, 22 nt, Human
uuaaauauuuucagcaggguca

SEQ ID NO: 742510 - RNA, 21 nt, Human
gacagcaacuguaguccucuu

SEQ ID NO: 742511 - RNA, 22 nt, Human
uauaagcacauccuugacugau

SEQ ID NO: 742512 - RNA, 22 nt, Human
ggaugcaggaacacagcgaccu

SEQ ID NO: 742513 - RNA, 22 nt, Human
acaaucaguauuuagacccagg

SEQ ID NO: 742514 - RNA, 22 nt, Human
agaaacugacaggaaaugaauu

SEQ ID NO: 742515 - RNA, 22 nt, Human
uuuucuguggucagagcuugag

SEQ ID NO: 742516 - RNA, 22 nt, Human
aggucucccaagggccagggag

SEQ ID NO: 742517 - RNA, 20 nt, Human
cugcagggugagugggcgau

SEQ ID NO: 742518 - RNA, 22 nt, Human
gagaaggcugauccuuggaguu

SEQ ID NO: 742519 - RNA, 22 nt, Human
aagugugucuggcggcccagug

SEQ ID NO: 742520 - RNA, 22 nt, Human
auuuccuucaucagccuauccu

SEQ ID NO: 742521 - RNA, 22 nt, Human
cauuuguaucugggcugcugug

SEQ ID NO: 742522 - RNA, 22 nt, Human
caucucacuucccugcagcauc

SEQ ID NO: 742523 - RNA, 22 nt, Human
gcucagagcaucccagugaaug

SEQ ID NO: 742524 - RNA, 22 nt, Human
guuuuucugugagcgguaaagg

SEQ ID NO: 742525 - RNA, 22 nt, Human
uccucacagggcaggaaggagg

SEQ ID NO: 742526 - RNA, 22 nt, Human
guggagaggaacccagcucugu

SEQ ID NO: 742527 - RNA, 22 nt, Human
uggcacauagcagguacucagu

SEQ ID NO: 742528 - RNA, 22 nt, Human
cacaggaaaugauucugcagca

SEQ ID NO: 742529 - RNA, 22 nt, Human
uuuaagacuuagauuuauuggg

SEQ ID NO: 742530 - RNA, 22 nt, Human
ugcacauuaguguuugagaugc

SEQ ID NO: 742531 - RNA, 22 nt, Human
uucugaagcucccuuuuguagu

SEQ ID NO: 742532 - RNA, 21 nt, Human
ugcugggcugcaggggaugca

SEQ ID NO: 742533 - RNA, 22 nt, Human
uccccagaggaauaugagauug

SEQ ID NO: 742534 - RNA, 22 nt, Human
acccagggccacagcccgcagu

SEQ ID NO: 742535 - RNA, 22 nt, Human
ugagggcagagcacuggggagc

SEQ ID NO: 742536 - RNA, 22 nt, Human
gagggccaaagagcaagagccu

SEQ ID NO: 742537 - RNA, 22 nt, Human
uagacauuugucaagaaugacu

SEQ ID NO: 742538 - RNA, 22 nt, Human
aagaggacuugugaagauguac

SEQ ID NO: 742539 - RNA, 22 nt, Human
aaagucaaugauuucuccugga

SEQ ID NO: 742540 - RNA, 18 nt, Human
gcagggcuggacaaguca

SEQ ID NO: 742541 - RNA, 22 nt, Human
ucacuguauuuggaagggaugg

SEQ ID NO: 742542 - RNA, 19 nt, Human
cccuggagaauacccugga

SEQ ID NO: 742543 - RNA, 22 nt, Human
aaguuccugagcucauauagca

SEQ ID NO: 742544 - RNA, 22 nt, Human
gcagggcagggcaagaacuggg

SEQ ID NO: 742545 - RNA, 22 nt, Human
uccagcuggcccggccaugaau

SEQ ID NO: 742546 - RNA, 23 nt, Human
ucuguucuuuuagcugaucauuu

SEQ ID NO: 742547 - RNA, 22 nt, Human
auuuauuaugggauuuggcuca

SEQ ID NO: 742548 - RNA, 22 nt, Human
auuuguucauggguuguuaugc

SEQ ID NO: 742549 - RNA, 22 nt, Human
gacaguuuaagcaccuaauauu

SEQ ID NO: 742550 - RNA, 22 nt, Human
cgcugggcauggugccuuauuu

SEQ ID NO: 742551 - RNA, 22 nt, Human
uuugaaagacagaauauuuuug

SEQ ID NO: 742552 - RNA, 19 nt, Human
auaaggcaggaggaaauuu

SEQ ID NO: 742553 - RNA, 22 nt, Human
caucagucugaaagccagggag

SEQ ID NO: 742554 - RNA, 22 nt, Human
ugccagagaguggcuggguguc

SEQ ID NO: 742555 - RNA, 22 nt, Human
uggaacaauucuugaagggaau

SEQ ID NO: 742556 - RNA, 22 nt, Human
ggaaggaauuccaagacuaaag

SEQ ID NO: 742557 - RNA, 22 nt, Human
uucccucccccagccuggcagg

SEQ ID NO: 742558 - RNA, 22 nt, Human
aacuguuucagaaauauuguug

SEQ ID NO: 742559 - RNA, 22 nt, Human
agggugcaggggaagcugcccu

SEQ ID NO: 742560 - RNA, 22 nt, Human
uccugguuagagcucucugggg

SEQ ID NO: 742561 - RNA, 19 nt, Human
uguguaaagucugugguca

SEQ ID NO: 742562 - RNA, 18 nt, Human
ccucugccauagccagca

SEQ ID NO: 742563 - RNA, 22 nt, Human
aacuuauuccauaggcucacug

SEQ ID NO: 742564 - RNA, 20 nt, Human
uugggccacacugauucagc

SEQ ID NO: 742565 - RNA, 22 nt, Human
cagaggcugauggcuguagcca

SEQ ID NO: 742566 - RNA, 22 nt, Human
aagccgaggccacacagcagga

SEQ ID NO: 742567 - RNA, 22 nt, Human
aaacugcagagccaugguucaa

SEQ ID NO: 742568 - RNA, 22 nt, Human
ugguccagacauuucugaggua

SEQ ID NO: 742569 - RNA, 22 nt, Human
gggacuguaaauucauauggcc

SEQ ID NO: 742570 - RNA, 22 nt, Human
aaagcagguuaugaccauggcc

SEQ ID NO: 742571 - RNA, 22 nt, Human
ucucaaauuugcuggaccagua

SEQ ID NO: 742572 - RNA, 22 nt, Human
gagcacugaggaaagcugguua

SEQ ID NO: 742573 - RNA, 22 nt, Human
augcucugggcuuuugaagugg

SEQ ID NO: 742574 - RNA, 22 nt, Human
gccuccccaggggugucaugag

SEQ ID NO: 742575 - RNA, 22 nt, Human
gcuggcagagacaagaagacua

SEQ ID NO: 742576 - RNA, 22 nt, Human
cuccagagagaaaggaggccgc

SEQ ID NO: 742577 - RNA, 22 nt, Human
ucagacuuuaaaggcuaacagg

SEQ ID NO: 742578 - RNA, 22 nt, Human
cugcccugucuuuuucugauga

SEQ ID NO: 742579 - RNA, 22 nt, Human
ucagggcauucaagaggccugg

SEQ ID NO: 742580 - RNA, 22 nt, Human
auggcuccaagauggagagcca

SEQ ID NO: 742581 - RNA, 22 nt, Human
caggcugcaagaaaggcauuca

SEQ ID NO: 742582 - RNA, 22 nt, Human
aacagcagggacuugaauggaa

SEQ ID NO: 742583 - RNA, 19 nt, Human
cuccacagggauugugauu

SEQ ID NO: 742584 - RNA, 22 nt, Human
aaagguuuauugauucugcucu

SEQ ID NO: 742585 - RNA, 22 nt, Human
ugcaauuucaggcauauauugu

SEQ ID NO: 742586 - RNA, 22 nt, Human
gugguccugcacccgcuuggcc

SEQ ID NO: 742587 - RNA, 22 nt, Human
aacacuuuccguagguuuagua

SEQ ID NO: 742588 - RNA, 22 nt, Human
uugggcuggcagagguggucuu

SEQ ID NO: 742589 - RNA, 22 nt, Human
cugcaaaggugggggaggagcu

SEQ ID NO: 742590 - RNA, 22 nt, Human
ggcucugcccagguggacagca

SEQ ID NO: 742591 - RNA, 21 nt, Human
agcuccaggcuccugggguuc

SEQ ID NO: 742592 - RNA, 22 nt, Human
caaggcaggccaguuucaaggc

SEQ ID NO: 742593 - RNA, 22 nt, Human
gcauuugaaaugcaagaaagug

SEQ ID NO: 742594 - RNA, 22 nt, Human
ugggacagagugagcuuuggcc

SEQ ID NO: 742595 - RNA, 21 nt, Human
gucagcagauccagcacuugu

SEQ ID NO: 742596 - RNA, 22 nt, Human
gggucucucaugcaguugcugu

SEQ ID NO: 742597 - RNA, 20 nt, Human
agguccugguucucugggau

SEQ ID NO: 742598 - RNA, 22 nt, Human
cuucugugcuucacaguugcca

SEQ ID NO: 742599 - RNA, 22 nt, Human
gcuccugcaggacccaggagac

SEQ ID NO: 742600 - RNA, 22 nt, Human
cagcugccccgcuggcugacca

SEQ ID NO: 742601 - RNA, 22 nt, Human
gcagaggagugauuaugccgug

SEQ ID NO: 742602 - RNA, 22 nt, Human
cuuucuuugcagugagccagag

SEQ ID NO: 742603 - RNA, 22 nt, Human
gaauggaaacugggagauggcc

SEQ ID NO: 742604 - RNA, 22 nt, Human
cugguggggaguccuggucucc

SEQ ID NO: 742605 - RNA, 22 nt, Human
cagaaauguucuaaugauucag

SEQ ID NO: 742606 - RNA, 22 nt, Human
gagggcuguggggcaugaccag

SEQ ID NO: 742607 - RNA, 18 nt, Human
agaauugcugcuucuucu

SEQ ID NO: 742608 - RNA, 22 nt, Human
cgacgggcucgguccgcuuccu

SEQ ID NO: 742609 - RNA, 22 nt, Human
aggccagacuuuggccaaaucc

SEQ ID NO: 742610 - RNA, 22 nt, Human
ucugaaauagaagugucuuucu

SEQ ID NO: 742611 - RNA, 22 nt, Human
aucaguaaauauucauugugca

SEQ ID NO: 742612 - RNA, 22 nt, Human
caaauagacuucaaucucuuga

SEQ ID NO: 742613 - RNA, 22 nt, Human
gcgagaaacuaagugcccuuug

SEQ ID NO: 742614 - RNA, 22 nt, Human
acagcagggguggaauaaacgu

SEQ ID NO: 742615 - RNA, 22 nt, Human
accagcuccaggccccugcugg

SEQ ID NO: 742616 - RNA, 22 nt, Human
uucagcacaagacuagacaggu

SEQ ID NO: 742617 - RNA, 22 nt, Human
gcucucuugacagcuugcuguu

SEQ ID NO: 742618 - RNA, 22 nt, Human
cuggaauugcauaauauguccu

SEQ ID NO: 742619 - RNA, 18 nt, Human
uggagccagcucuaggau

SEQ ID NO: 742620 - RNA, 22 nt, Human
gcauggcagugaggauggugcu

SEQ ID NO: 742621 - RNA, 22 nt, Human
aacaaugcugaacugaggaaag

SEQ ID NO: 742622 - RNA, 22 nt, Human
cuccuggggcacuuagaagcaa

SEQ ID NO: 742623 - RNA, 22 nt, Human
gugaggauacuuaagagaacac

SEQ ID NO: 742624 - RNA, 22 nt, Human
gggaggagugaagauucaccug

SEQ ID NO: 742625 - RNA, 20 nt, Human
ugaaaggugggaauuguggg

SEQ ID NO: 742626 - RNA, 22 nt, Human
uuccagucuaguaccuggaugc

SEQ ID NO: 742627 - RNA, 22 nt, Human
agaaugugugauugaagcucuu

SEQ ID NO: 742628 - RNA, 22 nt, Human
uugaggaguguuuagggugagg

SEQ ID NO: 742629 - RNA, 22 nt, Human
ucugguaaccuuuaucccuccu

SEQ ID NO: 742630 - RNA, 22 nt, Human
aaacagcuacuucuguauaaug

SEQ ID NO: 742631 - RNA, 22 nt, Human
agaugcugugaggaagcuagga

SEQ ID NO: 742632 - RNA, 22 nt, Human
agagauuacagcaggguccagc

SEQ ID NO: 742633 - RNA, 22 nt, Human
aaacauugagcacuugcuauuu

SEQ ID NO: 742634 - RNA, 22 nt, Human
ccugagcuuacaauuuaagaac

SEQ ID NO: 742635 - RNA, 22 nt, Human
agaguccagaaaacagugugcu

SEQ ID NO: 742636 - RNA, 22 nt, Human
caugcuggguaaagguggugaa

SEQ ID NO: 742637 - RNA, 22 nt, Human
gcaccugggguacacagcuaca

SEQ ID NO: 742638 - RNA, 22 nt, Human
agcacacaguauuagccauugu

SEQ ID NO: 742639 - RNA, 22 nt, Human
gccuccuggguucaugccauuc

SEQ ID NO: 742640 - RNA, 22 nt, Human
ggcugagaggacgucgggcuca

SEQ ID NO: 742641 - RNA, 22 nt, Human
agaauauucaucuguauucuua

SEQ ID NO: 742642 - RNA, 22 nt, Human
uucaaacucugaguaguucugc

SEQ ID NO: 742643 - RNA, 22 nt, Human
ggacacuuugaguugaaggggu

SEQ ID NO: 742644 - RNA, 22 nt, Human
cucagaggaggcagggugugcc

SEQ ID NO: 742645 - RNA, 22 nt, Human
acauauguauauguacacaguc

SEQ ID NO: 742646 - RNA, 22 nt, Human
uugaaacugucagcuuuuacgc

SEQ ID NO: 742647 - RNA, 22 nt, Human
guauuucuagaaaaugcagauu

SEQ ID NO: 742648 - RNA, 22 nt, Human
ucuucugugagaauucaagcaa

SEQ ID NO: 742649 - RNA, 22 nt, Human
gguggccauucuaccgccuucu

SEQ ID NO: 742650 - RNA, 22 nt, Human
gcagcuggacccacacggcuua

SEQ ID NO: 742651 - RNA, 22 nt, Human
auucuaauuaguucuacauguu

SEQ ID NO: 742652 - RNA, 22 nt, Human
gggagccuugggagugccagcc

SEQ ID NO: 742653 - RNA, 18 nt, Human
uaacaucggcuaugcauc

SEQ ID NO: 742654 - RNA, 22 nt, Human
aaugauuuggcaaaggaaucca

SEQ ID NO: 742655 - RNA, 22 nt, Human
aaaaguauuuugagcacuuuau

SEQ ID NO: 742656 - RNA, 22 nt, Human
gccaccucucucuugacucgag

SEQ ID NO: 742657 - RNA, 22 nt, Human
ggaaaacuguauuugaauaacu

SEQ ID NO: 742658 - RNA, 22 nt, Human
uagugcacacgcauguagcagu

SEQ ID NO: 742659 - RNA, 22 nt, Human
uuucaucuuauuugucuacauc

SEQ ID NO: 742660 - RNA, 19 nt, Human
ugugggcaagggauggcag

SEQ ID NO: 742661 - RNA, 22 nt, Human
ucuggagcaacagagcaggaca

SEQ ID NO: 742662 - RNA, 21 nt, Human
uggccaaacuggagcauuuga

SEQ ID NO: 742663 - RNA, 22 nt, Human
uggccuggcugcccugucugga

SEQ ID NO: 742664 - RNA, 22 nt, Human
cuucugugauuugguuaggaua

SEQ ID NO: 742665 - RNA, 22 nt, Human
uaaaaucauucuggugucagua

SEQ ID NO: 742666 - RNA, 22 nt, Human
auucugaggacagagucuagca

SEQ ID NO: 742667 - RNA, 22 nt, Human
uguuuacuugagguggaaacaa

SEQ ID NO: 742668 - RNA, 18 nt, Human
aacaugcauuagaacugc

SEQ ID NO: 742669 - RNA, 17 nt, Human
gccugcaggcccgcaga

SEQ ID NO: 742670 - RNA, 22 nt, Human
aggugucuucagggugagacag

SEQ ID NO: 742671 - RNA, 22 nt, Human
gaagucagaaaagaauuaggga

SEQ ID NO: 742672 - RNA, 22 nt, Human
uauacagucuuuugcuauauuc

SEQ ID NO: 742673 - RNA, 22 nt, Human
ugccuguccugaggaugagggu

SEQ ID NO: 742674 - RNA, 22 nt, Human
gauuaguauccuuauuaagaga

SEQ ID NO: 742675 - RNA, 22 nt, Human
ugagucugcuccugguagcaga

SEQ ID NO: 742676 - RNA, 22 nt, Human
augcacuuucuagagauucuga

SEQ ID NO: 742677 - RNA, 20 nt, Human
cuggacuugcugcucaccug

SEQ ID NO: 742678 - RNA, 22 nt, Human
uucauaaugagguccuagaggc

SEQ ID NO: 742679 - RNA, 22 nt, Human
agcugggaugauaaccucaguc

SEQ ID NO: 742680 - RNA, 17 nt, Human
ucaauacacugcuuuua

SEQ ID NO: 742681 - RNA, 22 nt, Human
uggcuccacucuccaggaguuu

SEQ ID NO: 742682 - RNA, 22 nt, Human
augcacaggacagccucuacuc

SEQ ID NO: 742683 - RNA, 22 nt, Human
ugugcucuaccucagugucauu

SEQ ID NO: 742684 - RNA, 22 nt, Human
uagaagcacagccugauggaca

SEQ ID NO: 742685 - RNA, 23 nt, Human
uuuaaaaguuguaauguaggcuu

SEQ ID NO: 742686 - RNA, 22 nt, Human
gacaacacauguaugccacucu

SEQ ID NO: 742687 - RNA, 20 nt, Human
uggauucuggagcugcccuc

SEQ ID NO: 742688 - RNA, 22 nt, Human
uccugggugugauauucauaga

SEQ ID NO: 742689 - RNA, 22 nt, Human
uuuuaucugcuucauuaguuga

SEQ ID NO: 742690 - RNA, 21 nt, Human
aacugcaaaucuuagacugca

SEQ ID NO: 742691 - RNA, 22 nt, Human
gcaccugcaggaugagccaggg

SEQ ID NO: 742692 - RNA, 22 nt, Human
uucuggagucccacagccaggg

SEQ ID NO: 742693 - RNA, 22 nt, Human
guaacacagaaaugaaauucca

SEQ ID NO: 742694 - RNA, 22 nt, Human
ucagaucauggaucuauuacuu

SEQ ID NO: 742695 - RNA, 21 nt, Human
aaauuuucuuggcuguagugu

SEQ ID NO: 742696 - RNA, 22 nt, Human
gcucagagaugucugcugccuu

SEQ ID NO: 742697 - RNA, 22 nt, Human
agcuaagauuuauuaaaggccc

SEQ ID NO: 742698 - RNA, 19 nt, Human
ucaugcauuucuaagugca

SEQ ID NO: 742699 - RNA, 22 nt, Human
aaguacagccagcacccagacu

SEQ ID NO: 742700 - RNA, 22 nt, Human
cugagcaccuguuauagguuag

SEQ ID NO: 742701 - RNA, 22 nt, Human
accaggcccauguggauuacua

SEQ ID NO: 742702 - RNA, 22 nt, Human
ugccucugaggaagauuguguu

SEQ ID NO: 742703 - RNA, 22 nt, Human
ucaaacuguucagaacuccuuu

SEQ ID NO: 742704 - RNA, 22 nt, Human
ccaggaagccuuuuucuuugac

SEQ ID NO: 742705 - RNA, 18 nt, Human
aagaacugagguccuaga

SEQ ID NO: 742706 - RNA, 22 nt, Human
aggugcaugaugcagagugcag

SEQ ID NO: 742707 - RNA, 22 nt, Human
ugaagcaggaaacuucuuguuu

SEQ ID NO: 742708 - RNA, 22 nt, Human
guggccuuuccugaagaaauga

SEQ ID NO: 742709 - RNA, 22 nt, Human
uuugaaaguucuucugacacua

SEQ ID NO: 742710 - RNA, 22 nt, Human
gccagcaguccugcugugugcc

SEQ ID NO: 742711 - RNA, 22 nt, Human
uuguaugaguaugguguauagg

SEQ ID NO: 742712 - RNA, 22 nt, Human
cagacaaggccaucuuucauuu

SEQ ID NO: 742713 - RNA, 22 nt, Human
acuuuaucaggaaucacacagc

SEQ ID NO: 742714 - RNA, 22 nt, Human
agaacaggcaguugguuggauu

SEQ ID NO: 742715 - RNA, 20 nt, Human
cccucugcuacacugggagc

SEQ ID NO: 742716 - RNA, 22 nt, Human
ugccuggauacucauuaauuuc

SEQ ID NO: 742717 - RNA, 22 nt, Human
uuagaaaauggaggugggaggg

SEQ ID NO: 742718 - RNA, 22 nt, Human
gcuucugucuuagcuaccuccc

SEQ ID NO: 742719 - RNA, 22 nt, Human
caucucuugccaaaguuugacc

SEQ ID NO: 742720 - RNA, 22 nt, Human
uucagaguacacagagaucuuc

SEQ ID NO: 742721 - RNA, 21 nt, Human
aaucauacaaaacaugucagg

SEQ ID NO: 742722 - RNA, 22 nt, Human
aaaaguauccacagcucaggag

SEQ ID NO: 742723 - RNA, 23 nt, Human
uggccugcagaguuucugcuggg

SEQ ID NO: 742724 - RNA, 22 nt, Human
cauucaaaggcauguccuauuu

SEQ ID NO: 742725 - RNA, 22 nt, Human
uguggcaggcuaggcuuuuugg

SEQ ID NO: 742726 - RNA, 22 nt, Human
uaggaaauaaauacuuaugguu

SEQ ID NO: 742727 - RNA, 22 nt, Human
aauggguugaacaucaaggucu

SEQ ID NO: 742728 - RNA, 22 nt, Human
gauacaaauucaugucugaauu

SEQ ID NO: 742729 - RNA, 22 nt, Human
cuucuuuacuuucuagaaauaa

SEQ ID NO: 742730 - RNA, 22 nt, Human
gcccugugcgacucuagagguu

SEQ ID NO: 742731 - RNA, 22 nt, Human
ggugagagucuuguggucccag

SEQ ID NO: 742732 - RNA, 22 nt, Human
cuuggggacacagagcccaggg

SEQ ID NO: 742733 - RNA, 22 nt, Human
cuucugagggccuuugcuucca

SEQ ID NO: 742734 - RNA, 22 nt, Human
gguccuggaugagacagguagu

SEQ ID NO: 742735 - RNA, 22 nt, Human
guaggcagauaggagugcagcc

SEQ ID NO: 742736 - RNA, 22 nt, Human
cuuuguauucauccguaauaau

SEQ ID NO: 742737 - RNA, 22 nt, Human
acagcagcaauagcagugacau

SEQ ID NO: 742738 - RNA, 22 nt, Human
cuugcacaggaucugaaguggg

SEQ ID NO: 742739 - RNA, 22 nt, Human
agggagaguagauaucaggugu

SEQ ID NO: 742740 - RNA, 22 nt, Human
gagaacuaaucaugcauggagu

SEQ ID NO: 742741 - RNA, 22 nt, Human
cccccagaugcgagccauagcc

SEQ ID NO: 742742 - RNA, 22 nt, Human
uaucauuauacagacguauaca

SEQ ID NO: 742743 - RNA, 18 nt, Human
agcuugccucaagcuuuu

SEQ ID NO: 742744 - RNA, 22 nt, Human
uuacauggauguaaaaaaguua

SEQ ID NO: 742745 - RNA, 22 nt, Human
agcaguguucuaaucuggcuag

SEQ ID NO: 742746 - RNA, 22 nt, Human
ucucacccaacgugcaaugagu

SEQ ID NO: 742747 - RNA, 22 nt, Human
guggccagaggucccauguguc

SEQ ID NO: 742748 - RNA, 22 nt, Human
auguaacuucugugaaucugac

SEQ ID NO: 742749 - RNA, 22 nt, Human
cagcccuggugagguuggcuau

SEQ ID NO: 742750 - RNA, 22 nt, Human
ggaggaccccagcagcucccca

SEQ ID NO: 742751 - RNA, 22 nt, Human
ugugaccucaucuuaacuggaa

SEQ ID NO: 742752 - RNA, 22 nt, Human
acauauuggcuuagcucuguga

SEQ ID NO: 742753 - RNA, 22 nt, Human
gcagggacaucuucagaucacu

SEQ ID NO: 742754 - RNA, 22 nt, Human
cuccuccagcucucccuggggg

SEQ ID NO: 742755 - RNA, 22 nt, Human
ucucaugccuggaauuaucauu

SEQ ID NO: 742756 - RNA, 20 nt, Human
ugggccugagccugugggcu

SEQ ID NO: 742757 - RNA, 22 nt, Human
ggucaguguacacaugugcagg

SEQ ID NO: 742758 - RNA, 21 nt, Human
agcggcagacccugcauuuga

SEQ ID NO: 742759 - RNA, 22 nt, Human
cuccaggcccacggccgcggcc

SEQ ID NO: 742760 - RNA, 22 nt, Human
gggcuuuaaucuuguuaacuag

SEQ ID NO: 742761 - RNA, 22 nt, Human
acugggccuugugugucucauc

SEQ ID NO: 742762 - RNA, 22 nt, Human
gucagcuaugucuguuguugag

SEQ ID NO: 742763 - RNA, 22 nt, Human
ucaugucagcuguugaugugca

SEQ ID NO: 742764 - RNA, 22 nt, Human
ucacauuaggaaguaauguugu

SEQ ID NO: 742765 - RNA, 22 nt, Human
gcagagauaaguagacaggaug

SEQ ID NO: 742766 - RNA, 22 nt, Human
cgugucaucugagccuugggcg

SEQ ID NO: 742767 - RNA, 22 nt, Human
gccugggagauuaauuaggaag

SEQ ID NO: 742768 - RNA, 22 nt, Human
uuauuuggcaaugcuucaccau

SEQ ID NO: 742769 - RNA, 22 nt, Human
guacacauugucuguuuacuuc

SEQ ID NO: 742770 - RNA, 22 nt, Human
acccugagggaugagaguugca

SEQ ID NO: 742771 - RNA, 22 nt, Human
aggcucugugaugugccaggca

SEQ ID NO: 742772 - RNA, 22 nt, Human
gguggagcgcagggugcuggcg

SEQ ID NO: 742773 - RNA, 22 nt, Human
aacugaggucuccagugcagaa

SEQ ID NO: 742774 - RNA, 22 nt, Human
uuauucuguuugccgaccagua

SEQ ID NO: 742775 - RNA, 22 nt, Human
ccugggggccaggaagguguga

SEQ ID NO: 742776 - RNA, 22 nt, Human
agguggagugaaggaaaggcag

SEQ ID NO: 742777 - RNA, 19 nt, Human
cugagcaggcagguaggau

SEQ ID NO: 742778 - RNA, 22 nt, Human
cagcaggggaacugugggccag

SEQ ID NO: 742779 - RNA, 22 nt, Human
gcccuggagagggauauggcau

SEQ ID NO: 742780 - RNA, 22 nt, Human
cuucaugacccauaaaaauuua

SEQ ID NO: 742781 - RNA, 22 nt, Human
ugcuggcugggcugcuggagac

SEQ ID NO: 742782 - RNA, 22 nt, Human
ggggaugguggcauuuguaaaa

SEQ ID NO: 742783 - RNA, 22 nt, Human
gccugggugcccaaugaugaga

SEQ ID NO: 742784 - RNA, 22 nt, Human
cauguauugaagugugcaucug

SEQ ID NO: 742785 - RNA, 22 nt, Human
cauccaggcaccacaaccagcu

SEQ ID NO: 742786 - RNA, 21 nt, Human
ucucuuucuggaagcuucccu

SEQ ID NO: 742787 - RNA, 21 nt, Human
acuuucuguggguucaagcau

SEQ ID NO: 742788 - RNA, 22 nt, Human
ucuguuggcuugagauuuaauu

SEQ ID NO: 742789 - RNA, 23 nt, Human
gcaguguuugcuucaucuuaucc

SEQ ID NO: 742790 - RNA, 22 nt, Human
auguguauuaccucgauuguga

SEQ ID NO: 742791 - RNA, 22 nt, Human
auggaagacuaacagaaacaug

SEQ ID NO: 742792 - RNA, 22 nt, Human
aagcugauucuaaaauuuauua

SEQ ID NO: 742793 - RNA, 22 nt, Human
agcaguggcuggauggugugcu

SEQ ID NO: 742794 - RNA, 22 nt, Human
ucacauugccgucugugcacuu

SEQ ID NO: 742795 - RNA, 22 nt, Human
ccuggcuggauggagccccugg

SEQ ID NO: 742796 - RNA, 22 nt, Human
gcugcccucucuggccccacac

SEQ ID NO: 742797 - RNA, 22 nt, Human
uccuccagcaggacugaggccc

SEQ ID NO: 742798 - RNA, 22 nt, Human
aggaauuuucacaguuggguau

SEQ ID NO: 742799 - RNA, 22 nt, Human
gcugccagggaggugguggagg

SEQ ID NO: 742800 - RNA, 22 nt, Human
cuucaugaguguacaaccugug

SEQ ID NO: 742801 - RNA, 22 nt, Human
agcuggccuuagugagcaccug

SEQ ID NO: 742802 - RNA, 22 nt, Human
uguguguguuccuccucagcua

SEQ ID NO: 742803 - RNA, 22 nt, Human
gagccuggggacccuccugagu

SEQ ID NO: 742804 - RNA, 22 nt, Human
ucagaagcagauauuucaaaau

SEQ ID NO: 742805 - RNA, 21 nt, Human
ccugggagaucagcugccuuc

SEQ ID NO: 742806 - RNA, 22 nt, Human
cccagagcauaacguaucuuga

SEQ ID NO: 742807 - RNA, 22 nt, Human
aggcugagaaagugggaagaug

SEQ ID NO: 742808 - RNA, 22 nt, Human
cuggcugucuuggaggaaggag

SEQ ID NO: 742809 - RNA, 22 nt, Human
aaagcaauggcacaugauggua

SEQ ID NO: 742810 - RNA, 22 nt, Human
cagggagcuggcuggcugugcc

SEQ ID NO: 742811 - RNA, 20 nt, Human
uggccaccacuguauaucaa

SEQ ID NO: 742812 - RNA, 20 nt, Human
uuugcaggaaggaaauaggu

SEQ ID NO: 742813 - RNA, 22 nt, Human
aacagaacccgagugugaaucu

SEQ ID NO: 742814 - RNA, 22 nt, Human
uguugcgaugaagagcuucacg

SEQ ID NO: 742815 - RNA, 22 nt, Human
ugagcccaggaguuggaggcug

SEQ ID NO: 742816 - RNA, 22 nt, Human
gugaugucagcaagaauaggaa

SEQ ID NO: 742817 - RNA, 22 nt, Human
auuugcuuccuaauacucauau

SEQ ID NO: 742818 - RNA, 19 nt, Human
ugaaacaaacuuaaaagga

SEQ ID NO: 742819 - RNA, 22 nt, Human
guccagagaguaaaggggguaa

SEQ ID NO: 742820 - RNA, 22 nt, Human
uacauucagagaaaguuuccau

SEQ ID NO: 742821 - RNA, 19 nt, Human
cucugggcugcaucuuggu

SEQ ID NO: 742822 - RNA, 22 nt, Human
uggcagauguggcauagagcau

SEQ ID NO: 742823 - RNA, 22 nt, Human
acauuauaguugcuacagagua

SEQ ID NO: 742824 - RNA, 21 nt, Human
cagaggccuaucacagacucc

SEQ ID NO: 742825 - RNA, 22 nt, Human
gggccugcagguucugagaggc

SEQ ID NO: 742826 - RNA, 22 nt, Human
acucucugguauuggcaaguuu

SEQ ID NO: 742827 - RNA, 22 nt, Human
auuaggauguuccuaugcacau

SEQ ID NO: 742828 - RNA, 22 nt, Human
acaacuuuguagcaauuccacg

SEQ ID NO: 742829 - RNA, 22 nt, Human
uuucaaauagaaucuuuccaaa

SEQ ID NO: 742830 - RNA, 22 nt, Human
auauucuauaagcaguuggaag

SEQ ID NO: 742831 - RNA, 22 nt, Human
cugcuuccugcugggauacuga

SEQ ID NO: 742832 - RNA, 22 nt, Human
gccuggcaggccugggccagca

SEQ ID NO: 742833 - RNA, 22 nt, Human
uaacuuuuacuuaccaucugag

SEQ ID NO: 742834 - RNA, 22 nt, Human
aauuuguacaaaauguuuauaa

SEQ ID NO: 742835 - RNA, 22 nt, Human
gcuggaauuggacccagggcuc

SEQ ID NO: 742836 - RNA, 22 nt, Human
ugaggggcagagagguguccag

SEQ ID NO: 742837 - RNA, 22 nt, Human
auggacagugugucuguuucca

SEQ ID NO: 742838 - RNA, 22 nt, Human
aaguuucauuguucauguaaca

SEQ ID NO: 742839 - RNA, 22 nt, Human
ugggccaccugcucuguuucua

SEQ ID NO: 742840 - RNA, 22 nt, Human
agucucugucguagaucagcgu

SEQ ID NO: 742841 - RNA, 22 nt, Human
ccuggcacagagcgguggucac

SEQ ID NO: 742842 - RNA, 22 nt, Human
aguaaugugccugaaauacuug

SEQ ID NO: 742843 - RNA, 22 nt, Human
uucaguccucacaaccucacua

SEQ ID NO: 742844 - RNA, 22 nt, Human
gcuguugcaaucaaggccaugg

SEQ ID NO: 742845 - RNA, 19 nt, Human
agcagcuguagauagacac

SEQ ID NO: 742846 - RNA, 20 nt, Human
gcacaugcaacuuuuauuua

SEQ ID NO: 742847 - RNA, 22 nt, Human
guggaacagccugugcaaaccu

SEQ ID NO: 742848 - RNA, 22 nt, Human
uaguggaggguguagcugcugg

SEQ ID NO: 742849 - RNA, 22 nt, Human
auggaagacagauaaggcagaa

SEQ ID NO: 742850 - RNA, 22 nt, Human
cugcagauuuggugucugguga

SEQ ID NO: 742851 - RNA, 22 nt, Human
augcagaagaaaccauggcuuc

SEQ ID NO: 742852 - RNA, 22 nt, Human
aucugcuuuugagaauuuacuu

SEQ ID NO: 742853 - RNA, 20 nt, Human
uuucugugaggacuguacug

SEQ ID NO: 742854 - RNA, 22 nt, Human
uucacaguuugcugggacagga

SEQ ID NO: 742855 - RNA, 22 nt, Human
guuaaggaucuugagaugagga

SEQ ID NO: 742856 - RNA, 22 nt, Human
agccugccugugaggcuuugag

SEQ ID NO: 742857 - RNA, 22 nt, Human
aacaguuuggguagguauguag

SEQ ID NO: 742858 - RNA, 22 nt, Human
ggagucugcucccagacaugau

SEQ ID NO: 742859 - RNA, 22 nt, Human
aauuccacagcugcacagaggu

SEQ ID NO: 742860 - RNA, 23 nt, Human
ugcugcccgcuuggcacgcuccc

SEQ ID NO: 742861 - RNA, 22 nt, Human
uccagggauguccuguagcacu

SEQ ID NO: 742862 - RNA, 22 nt, Human
uccugaggaaaguucaugaaug

SEQ ID NO: 742863 - RNA, 21 nt, Human
acacauuaugagcauagacuc

SEQ ID NO: 742864 - RNA, 22 nt, Human
uucauugcauuccagccugggu

SEQ ID NO: 742865 - RNA, 22 nt, Human
uaaaggcaguaauuccugaguu

SEQ ID NO: 742866 - RNA, 22 nt, Human
gaaagacauaguugcaagaugg

SEQ ID NO: 742867 - RNA, 23 nt, Human
gcagagguuauguuuuuuaggcu

SEQ ID NO: 742868 - RNA, 22 nt, Human
gucuucugaucugguuagccau

SEQ ID NO: 742869 - RNA, 19 nt, Human
aggcuuggcuagauuuacu

SEQ ID NO: 742870 - RNA, 22 nt, Human
agagucaguuagcgaauacuua

SEQ ID NO: 742871 - RNA, 22 nt, Human
auuagacaucauaugauucagc

SEQ ID NO: 742872 - RNA, 22 nt, Human
agucaguguagaaagcccaggc

SEQ ID NO: 742873 - RNA, 22 nt, Human
caguggcgugaucucugcucac

SEQ ID NO: 742874 - RNA, 22 nt, Human
uagauacauuuuucuuuccugu

SEQ ID NO: 742875 - RNA, 22 nt, Human
aaagugcugagauuacaagcgu

SEQ ID NO: 742876 - RNA, 22 nt, Human
aaggcacagaggcagggcacuu

SEQ ID NO: 742877 - RNA, 22 nt, Human
uggagcagcuaagccucugaga

SEQ ID NO: 742878 - RNA, 22 nt, Human
cagggcuucgauggauggaugg

SEQ ID NO: 742879 - RNA, 22 nt, Human
accagggccgcgggcgacuagc

SEQ ID NO: 742880 - RNA, 22 nt, Human
aauauaguucuagaaauauuuu

SEQ ID NO: 742881 - RNA, 22 nt, Human
augaacaauaaaauagaucaca

SEQ ID NO: 742882 - RNA, 22 nt, Human
uauguacaucguugaauucaaa

SEQ ID NO: 742883 - RNA, 22 nt, Human
uaucucuguaaaagaaaucaca

SEQ ID NO: 742884 - RNA, 22 nt, Human
acagagcuaaauuucaauccca

SEQ ID NO: 742885 - RNA, 19 nt, Human
augucuggguaacagcugc

SEQ ID NO: 742886 - RNA, 22 nt, Human
uagaggggaaaaugcguauuaa

SEQ ID NO: 742887 - RNA, 22 nt, Human
aagacacaauguagcccagcac

SEQ ID NO: 742888 - RNA, 22 nt, Human
cacaggagugcugcuauuguug

SEQ ID NO: 742889 - RNA, 22 nt, Human
guguguguacucuguauauaaa

SEQ ID NO: 742890 - RNA, 22 nt, Human
gaagucugcugcucaggaguuu

SEQ ID NO: 742891 - RNA, 22 nt, Human
ugugugugggcggaacggcccc

SEQ ID NO: 742892 - RNA, 22 nt, Human
guucagcaaguacucaguccac

SEQ ID NO: 742893 - RNA, 22 nt, Human
augauguugguuuaauuugagu

SEQ ID NO: 742894 - RNA, 22 nt, Human
ccugacucuggccaggccagcu

SEQ ID NO: 742895 - RNA, 22 nt, Human
caaagcuggaaaaggaggcugg

SEQ ID NO: 742896 - RNA, 22 nt, Human
gaggggcagaaugugaucaggg

SEQ ID NO: 742897 - RNA, 22 nt, Human
gagaauuagggcguaauucaga

SEQ ID NO: 742898 - RNA, 22 nt, Human
ucucaguggguuaaaagagaag

SEQ ID NO: 742899 - RNA, 22 nt, Human
cuggagccugcaguuuucacuu

SEQ ID NO: 742900 - RNA, 22 nt, Human
uugcuuccucugugcaauccuc

SEQ ID NO: 742901 - RNA, 22 nt, Human
ggaagcuguugugagugcagca

SEQ ID NO: 742902 - RNA, 22 nt, Human
ccaggcucagcgcgcacgucug

SEQ ID NO: 742903 - RNA, 22 nt, Human
guuaaggcugagcaggacacug

SEQ ID NO: 742904 - RNA, 22 nt, Human
ugcaggagccuuggacuugaaa

SEQ ID NO: 742905 - RNA, 22 nt, Human
gcugaaaugaaaacacaggucg

SEQ ID NO: 742906 - RNA, 22 nt, Human
auuccucauuuguugagaacca

SEQ ID NO: 742907 - RNA, 22 nt, Human
guuuaugcacuugguuuguguc

SEQ ID NO: 742908 - RNA, 18 nt, Human
aaaauaacaaaguuggcu

SEQ ID NO: 742909 - RNA, 22 nt, Human
aauagauucaugguuaagagca

SEQ ID NO: 742910 - RNA, 22 nt, Human
gcuggccuugugucugaggaag

SEQ ID NO: 742911 - RNA, 22 nt, Human
aacauccccuucaugucaugau

SEQ ID NO: 742912 - RNA, 22 nt, Human
uucuucuguuggcagagcauac

SEQ ID NO: 742913 - RNA, 22 nt, Human
cugggguggugcaggccucaug

SEQ ID NO: 742914 - RNA, 22 nt, Human
agggaaggaggccauguguccc

SEQ ID NO: 742915 - RNA, 22 nt, Human
cuucucuaucuuuggcacauca

SEQ ID NO: 742916 - RNA, 22 nt, Human
uauguuuuucaagugcacacua

SEQ ID NO: 742917 - RNA, 22 nt, Human
uucagaaugugaccuuauuugg

SEQ ID NO: 742918 - RNA, 22 nt, Human
gaccuggaagaacugaggccuu

SEQ ID NO: 742919 - RNA, 22 nt, Human
aacauugaacuuggcacaccca

SEQ ID NO: 742920 - RNA, 22 nt, Human
auucaaguccagcuucucuaca

SEQ ID NO: 742921 - RNA, 22 nt, Human
acaggucagauaaaggcuggug

SEQ ID NO: 742922 - RNA, 22 nt, Human
ccuuggagcggucagcacuggu

SEQ ID NO: 742923 - RNA, 22 nt, Human
uagcacaagaaguacacauaga

SEQ ID NO: 742924 - RNA, 17 nt, Human
cugucugcgcaugaggu

SEQ ID NO: 742925 - RNA, 22 nt, Human
gcaauguuguguuggcauucua

SEQ ID NO: 742926 - RNA, 22 nt, Human
aauaauuauuugagagcagacc

SEQ ID NO: 742927 - RNA, 22 nt, Human
aaauagcuacaugaucucuagg

SEQ ID NO: 742928 - RNA, 22 nt, Human
cuuauauuugucaacuuuacaa

SEQ ID NO: 742929 - RNA, 22 nt, Human
auauguuacucuuucaagcaga

SEQ ID NO: 742930 - RNA, 22 nt, Human
ucuaacuugugaguauagauga

SEQ ID NO: 742931 - RNA, 22 nt, Human
aagggcuccaagagguagcugg

SEQ ID NO: 742932 - RNA, 22 nt, Human
ccaggaacaaagccccauccac

SEQ ID NO: 742933 - RNA, 22 nt, Human
uuugcuuuugugcucuaguggu

SEQ ID NO: 742934 - RNA, 22 nt, Human
ucugauguguuuaagaaagaag

SEQ ID NO: 742935 - RNA, 22 nt, Human
ggugggaugccucuggagaagu

SEQ ID NO: 742936 - RNA, 17 nt, Human
gcuguuucuccagaagu

SEQ ID NO: 742937 - RNA, 22 nt, Human
uagcugccuaugugauaagaga

SEQ ID NO: 742938 - RNA, 22 nt, Human
cacaugggcguaauguccaugg

SEQ ID NO: 742939 - RNA, 19 nt, Human
uggccaccucugcuguucu

SEQ ID NO: 742940 - RNA, 22 nt, Human
uagcacugaaucacaugcugcu

SEQ ID NO: 742941 - RNA, 22 nt, Human
uucacuaugcuuggaaacuucu

SEQ ID NO: 742942 - RNA, 22 nt, Human
uugcauugaucccagcuugggc

SEQ ID NO: 742943 - RNA, 22 nt, Human
auuggcaaugucccggcugcug

SEQ ID NO: 742944 - RNA, 22 nt, Human
ggagcggucagcuggccacacg

SEQ ID NO: 742945 - RNA, 22 nt, Human
uuauuuaaaagugguaagauuc

SEQ ID NO: 742946 - RNA, 22 nt, Human
uggacaggugagugacucaggg

SEQ ID NO: 742947 - RNA, 22 nt, Human
uucuaaauuuuggaagaugcag

SEQ ID NO: 742948 - RNA, 22 nt, Human
ggugagggaguggaacgaggug

SEQ ID NO: 742949 - RNA, 16 nt, Human
gggcuggagauacagu

SEQ ID NO: 742950 - RNA, 22 nt, Human
uccugaagucacaggcucugag

SEQ ID NO: 742951 - RNA, 22 nt, Human
gaaucauuuagcucugcaugga

SEQ ID NO: 742952 - RNA, 22 nt, Human
gauggucuuugucucugauaag

SEQ ID NO: 742953 - RNA, 22 nt, Human
auucaaaagaccaugcagacuc

SEQ ID NO: 742954 - RNA, 22 nt, Human
agcagcaaaguauugggcaaga

SEQ ID NO: 742955 - RNA, 22 nt, Human
aaguuuuaugggaagaugugca

SEQ ID NO: 742956 - RNA, 22 nt, Human
uaacacuguccaaagaauucca

SEQ ID NO: 742957 - RNA, 18 nt, Human
ucauuuugucugccuuug

SEQ ID NO: 742958 - RNA, 22 nt, Human
gcuucuggagucuucagaggaa

SEQ ID NO: 742959 - RNA, 22 nt, Human
agggcuggcaagggauugaaau

SEQ ID NO: 742960 - RNA, 20 nt, Human
uuucagagugucuuuccauu

SEQ ID NO: 742961 - RNA, 22 nt, Human
caaugcuaucaugucagagaua

SEQ ID NO: 742962 - RNA, 22 nt, Human
cuuauauuuuaggaacagacaa

SEQ ID NO: 742963 - RNA, 22 nt, Human
augaccaagaguccaggucaag

SEQ ID NO: 742964 - RNA, 22 nt, Human
ucccugcuuucuugugagggga

SEQ ID NO: 742965 - RNA, 22 nt, Human
aagccuucccuuuuugagcuca

SEQ ID NO: 742966 - RNA, 22 nt, Human
gcagggaccaaaagaggcagua

SEQ ID NO: 742967 - RNA, 22 nt, Human
gucugagcacccuggccuguca

SEQ ID NO: 742968 - RNA, 22 nt, Human
gcuccuggcaggcagugugugu

SEQ ID NO: 742969 - RNA, 22 nt, Human
cugaggccucuccuuggcuugu

SEQ ID NO: 742970 - RNA, 22 nt, Human
guuuccucugcugguuuucauu

SEQ ID NO: 742971 - RNA, 22 nt, Human
ccucuuuguucaggcugcuggc

SEQ ID NO: 742972 - RNA, 22 nt, Human
ucugccaugcuaacuucaguau

SEQ ID NO: 742973 - RNA, 22 nt, Human
cugggcacaguggcucacgccu

SEQ ID NO: 742974 - RNA, 22 nt, Human
uuucacuguuaggaguaugcua

SEQ ID NO: 742975 - RNA, 22 nt, Human
aaggcaccaugagaugcugguu

SEQ ID NO: 742976 - RNA, 22 nt, Human
aguucaguaguccuucauugua

SEQ ID NO: 742977 - RNA, 20 nt, Human
auguauauuacuggcuguga

SEQ ID NO: 742978 - RNA, 22 nt, Human
aagauucagccaaauuguucau

SEQ ID NO: 742979 - RNA, 22 nt, Human
cugcuuuaauuuagacaaggca

SEQ ID NO: 742980 - RNA, 21 nt, Human
agcucagccgggcacaguggc

SEQ ID NO: 742981 - RNA, 23 nt, Human
uuugaaaguaucaacucgccuga

SEQ ID NO: 742982 - RNA, 22 nt, Human
aguguuuauggaaucuuaguua

SEQ ID NO: 742983 - RNA, 22 nt, Human
ugaaggcacuugccuaggggca

SEQ ID NO: 742984 - RNA, 22 nt, Human
cucugcaugccacaugagugac

SEQ ID NO: 742985 - RNA, 22 nt, Human
gcugucuggguugagggcccug

SEQ ID NO: 742986 - RNA, 22 nt, Human
uugaggucuguguaggcagcaa

SEQ ID NO: 742987 - RNA, 22 nt, Human
uggaaggggccaggcgcggagu

SEQ ID NO: 742988 - RNA, 22 nt, Human
cagauagcaauuugggcagggg

SEQ ID NO: 742989 - RNA, 21 nt, Human
aggcagcaucugauuuauaug

SEQ ID NO: 742990 - RNA, 22 nt, Human
ucucagcucuuuuuucacagaa

SEQ ID NO: 742991 - RNA, 22 nt, Human
augcagggucuccgugugacga

SEQ ID NO: 742992 - RNA, 22 nt, Human
uugggcagugauuaguucauga

SEQ ID NO: 742993 - RNA, 22 nt, Human
ucucuuaauaaguaaauacuga

SEQ ID NO: 742994 - RNA, 22 nt, Human
gcagggacaucuuugucuagua

SEQ ID NO: 742995 - RNA, 22 nt, Human
aucagaaauugcuaccagugga

SEQ ID NO: 742996 - RNA, 22 nt, Human
uacucugcaaguugaagguggc

SEQ ID NO: 742997 - RNA, 22 nt, Human
aagcuguuuuggccuuaguuga

SEQ ID NO: 742998 - RNA, 23 nt, Human
agcugggaauuuucugaagcuuu

SEQ ID NO: 742999 - RNA, 22 nt, Human
uccugaagaggcuacacugcuu

SEQ ID NO: 743000 - RNA, 22 nt, Human
gcuuccugucccucagccauga

SEQ ID NO: 743001 - RNA, 23 nt, Human
ucuggcuccauccuuggggaucc

SEQ ID NO: 743002 - RNA, 21 nt, Human
cagaggucauccugaggacaa

SEQ ID NO: 743003 - RNA, 22 nt, Human
cuguauuagccaggugcacaag

SEQ ID NO: 743004 - RNA, 22 nt, Human
gagaucauggcuucugcugaua

SEQ ID NO: 743005 - RNA, 22 nt, Human
uggcagacacugucgaagccua

SEQ ID NO: 743006 - RNA, 22 nt, Human
auuccacuguuauaaaaugucc

SEQ ID NO: 743007 - RNA, 22 nt, Human
uggcccugacacgugguacugg

SEQ ID NO: 743008 - RNA, 22 nt, Human
gguugacagaagaaggaugaca

SEQ ID NO: 743009 - RNA, 22 nt, Human
agagucugauauuuguaccaga

SEQ ID NO: 743010 - RNA, 23 nt, Human
uaugaacugcauugcuggugugu

SEQ ID NO: 743011 - RNA, 22 nt, Human
cccagaggaggaucucggcccg

SEQ ID NO: 743012 - RNA, 22 nt, Human
ggagaugccagaauugcaaauu

SEQ ID NO: 743013 - RNA, 22 nt, Human
gcagauguaauggcuggagguc

SEQ ID NO: 743014 - RNA, 23 nt, Human
gccaggaguggguagacuaaugc

SEQ ID NO: 743015 - RNA, 22 nt, Human
aguauuucuucauaugauuacu

SEQ ID NO: 743016 - RNA, 19 nt, Human
auggaagcugggaucaaug

SEQ ID NO: 743017 - RNA, 22 nt, Human
uaacuuuaguguaugagguaag

SEQ ID NO: 743018 - RNA, 23 nt, Human
augcacaagccagcaggggacag

SEQ ID NO: 743019 - RNA, 22 nt, Human
gagaguucuaccucugaaggcg

SEQ ID NO: 743020 - RNA, 22 nt, Human
cacaguuucugaacacuuugca

SEQ ID NO: 743021 - RNA, 22 nt, Human
cuccagggagcuuggaaagacc

SEQ ID NO: 743022 - RNA, 22 nt, Human
guccugagaugucacaagguuu

SEQ ID NO: 743023 - RNA, 22 nt, Human
cuggcacagagugagcauucaa

SEQ ID NO: 743024 - RNA, 22 nt, Human
ucugggcagccucaggccaggg

SEQ ID NO: 743025 - RNA, 19 nt, Human
uggcaucuguaaaauggug

SEQ ID NO: 743026 - RNA, 22 nt, Human
acuuagcacgaacauuuacuuu

SEQ ID NO: 743027 - RNA, 22 nt, Human
ucugagugaguguaggccugac

SEQ ID NO: 743028 - RNA, 19 nt, Human
agcaccugugagagccugg

SEQ ID NO: 743029 - RNA, 23 nt, Human
ugaaggcccuggagccacgaggc

SEQ ID NO: 743030 - RNA, 22 nt, Human
caagaucaaucaauacuccuua

SEQ ID NO: 743031 - RNA, 22 nt, Human
aaaugcuuuggugcugguacag

SEQ ID NO: 743032 - RNA, 22 nt, Human
gacuacaacaauaagaacagcu

SEQ ID NO: 743033 - RNA, 22 nt, Human
agugacaaggccugaagcuccu

SEQ ID NO: 743034 - RNA, 20 nt, Human
caggccagagguuugauggc

SEQ ID NO: 743035 - RNA, 22 nt, Human
accccagggcugccagccuccu

SEQ ID NO: 743036 - RNA, 22 nt, Human
ugucaaugcuggucuugaauga

SEQ ID NO: 743037 - RNA, 22 nt, Human
uacacccacauugagcauggga

SEQ ID NO: 743038 - RNA, 22 nt, Human
aagcuuuucucuguauuaccug

SEQ ID NO: 743039 - RNA, 22 nt, Human
uccagcuggccuaacuucaggg

SEQ ID NO: 743040 - RNA, 21 nt, Human
agucccaggggugagugaugu

SEQ ID NO: 743041 - RNA, 22 nt, Human
ggauauaugcauguuaucauuu

SEQ ID NO: 743042 - RNA, 22 nt, Human
uuuauuucacucuccggauacu

SEQ ID NO: 743043 - RNA, 22 nt, Human
uauagcaauucagaauacaugu

SEQ ID NO: 743044 - RNA, 23 nt, Human
uguuacaagcaccacagguggcu

SEQ ID NO: 743045 - RNA, 22 nt, Human
cugagcagugcuuugcaguggg

SEQ ID NO: 743046 - RNA, 21 nt, Human
uuggaacaagcagcaguuugc

SEQ ID NO: 743047 - RNA, 22 nt, Human
gcccagcacuaaaagcuuugcu

SEQ ID NO: 743048 - RNA, 22 nt, Human
ucuaaacugcgagcaugccccc

SEQ ID NO: 743049 - RNA, 22 nt, Human
caugcuaaccagagacauaaag

SEQ ID NO: 743050 - RNA, 23 nt, Human
acauuacuuagccagagucucag

SEQ ID NO: 743051 - RNA, 22 nt, Human
gaggaggaaguucucuguaggc

SEQ ID NO: 743052 - RNA, 22 nt, Human
uuggugucuuuuuuauacaugu

SEQ ID NO: 743053 - RNA, 22 nt, Human
ucgcugugguuucuguacaugg

SEQ ID NO: 743054 - RNA, 22 nt, Human
ugcccugggaguuggagcugcu

SEQ ID NO: 743055 - RNA, 22 nt, Human
ugugugaauucugagcaguuua

SEQ ID NO: 743056 - RNA, 18 nt, Human
gagcugccauauuuaguu

SEQ ID NO: 743057 - RNA, 22 nt, Human
uuauuuauucauucugucuguc

SEQ ID NO: 743058 - RNA, 22 nt, Human
ucacaggcuggucuccgaggac

SEQ ID NO: 743059 - RNA, 22 nt, Human
gggcugggauggcuugaagauu

SEQ ID NO: 743060 - RNA, 22 nt, Human
aucuguguguucaggaaguccu

SEQ ID NO: 743061 - RNA, 21 nt, Human
acagaggcauacagcuuaagg

SEQ ID NO: 743062 - RNA, 22 nt, Human
acagccagaucugagagaucuu

SEQ ID NO: 743063 - RNA, 22 nt, Human
cagcugcaggaacaaaaaugug

SEQ ID NO: 743064 - RNA, 22 nt, Human
ccagauagcaggucagaagugc

SEQ ID NO: 743065 - RNA, 22 nt, Human
guggucaucuaacuaaauuuuc

SEQ ID NO: 743066 - RNA, 22 nt, Human
aagcaacucccuccucauuuuu

SEQ ID NO: 743067 - RNA, 22 nt, Human
uggagagcuccuauuugcuguc

SEQ ID NO: 743068 - RNA, 22 nt, Human
cagaggaagggugcugcgaaag

SEQ ID NO: 743069 - RNA, 22 nt, Human
aagcugcccucauucccagugc

SEQ ID NO: 743070 - RNA, 22 nt, Human
gggguugguuuaaaugcuugag

SEQ ID NO: 743071 - RNA, 22 nt, Human
agaugugguaguugaagggaag

SEQ ID NO: 743072 - RNA, 22 nt, Human
augaacaaugacuacauauuga

SEQ ID NO: 743073 - RNA, 22 nt, Human
ucugccuuccccauaaucugau

SEQ ID NO: 743074 - RNA, 22 nt, Human
ucuuuauuucugaaucccccau

SEQ ID NO: 743075 - RNA, 21 nt, Human
ggcuguguucagggcaugcgg

SEQ ID NO: 743076 - RNA, 22 nt, Human
aggcaagaacagacaugggagu

SEQ ID NO: 743077 - RNA, 22 nt, Human
ggcuuccuuucacuacccucag

SEQ ID NO: 743078 - RNA, 22 nt, Human
cuggaaauuggagaugauguuu

SEQ ID NO: 743079 - RNA, 22 nt, Human
uuuucucuauauugucugugaa

SEQ ID NO: 743080 - RNA, 19 nt, Human
uuacuuggcaaagucaguc

SEQ ID NO: 743081 - RNA, 22 nt, Human
aaucacuuugcacucuuauuug

SEQ ID NO: 743082 - RNA, 22 nt, Human
aggccucugggucuccucugac

SEQ ID NO: 743083 - RNA, 22 nt, Human
cagcccuggcgcccccagaucu

SEQ ID NO: 743084 - RNA, 23 nt, Human
aucccuucuccaguguggugagg

SEQ ID NO: 743085 - RNA, 22 nt, Human
gggcuucuauucuggcacaaga

SEQ ID NO: 743086 - RNA, 22 nt, Human
uggccacuuggcaugugugcca

SEQ ID NO: 743087 - RNA, 22 nt, Human
ugcaggugcagcgauacuguga

SEQ ID NO: 743088 - RNA, 22 nt, Human
cuagccagacucaagggccacc

SEQ ID NO: 743089 - RNA, 22 nt, Human
uucuuucugggguccuucggcu

SEQ ID NO: 743090 - RNA, 22 nt, Human
acccucugccuugagcagugcc

SEQ ID NO: 743091 - RNA, 22 nt, Human
ucuuccuaguuacauaugcaca

SEQ ID NO: 743092 - RNA, 22 nt, Human
acauccugaagucagucauuug

SEQ ID NO: 743093 - RNA, 22 nt, Human
cagacccucgggugaguuggcc

SEQ ID NO: 743094 - RNA, 23 nt, Human
caucauuguuaugggugcuacua

SEQ ID NO: 743095 - RNA, 22 nt, Human
cagucuggaggucagcuggcuu

SEQ ID NO: 743096 - RNA, 23 nt, Human
agggcccaagccuggacagcagg

SEQ ID NO: 743097 - RNA, 22 nt, Human
cagggcugguuugucgaagaaa

SEQ ID NO: 743098 - RNA, 21 nt, Human
uuuacugagcacuuacuaugu

SEQ ID NO: 743099 - RNA, 22 nt, Human
guugcuuuacagcuggugacag

SEQ ID NO: 743100 - RNA, 22 nt, Human
ucugacuuccuccacaucuguu

SEQ ID NO: 743101 - RNA, 22 nt, Human
ugauugaauucaaaugcaaucu

SEQ ID NO: 743102 - RNA, 22 nt, Human
cugccagcucaaagcgcagcua

SEQ ID NO: 743103 - RNA, 20 nt, Human
acaauacagguugugucuga

SEQ ID NO: 743104 - RNA, 22 nt, Human
cuggggcugugggagacaaggc

SEQ ID NO: 743105 - RNA, 22 nt, Human
gacaaugcauugugauugugac

SEQ ID NO: 743106 - RNA, 22 nt, Human
gcugagggauagcugcucacug

SEQ ID NO: 743107 - RNA, 22 nt, Human
auccagcacuuguucaugugaa

SEQ ID NO: 743108 - RNA, 22 nt, Human
uugaggcaaaaucaacgggaag

SEQ ID NO: 743109 - RNA, 21 nt, Human
cagcagugugucugagcuaga

SEQ ID NO: 743110 - RNA, 22 nt, Human
cguguaugugccugcauucaca

SEQ ID NO: 743111 - RNA, 22 nt, Human
aucuggcuauuucuggucgggg

SEQ ID NO: 743112 - RNA, 22 nt, Human
aagggcaggaaaagauggaugu

SEQ ID NO: 743113 - RNA, 22 nt, Human
caauguuuacuggggacccaga

SEQ ID NO: 743114 - RNA, 22 nt, Human
ggcuccugcaccugucccucug

SEQ ID NO: 743115 - RNA, 22 nt, Human
cagagcugucauuugccaguga

SEQ ID NO: 743116 - RNA, 22 nt, Human
aauuuggcagugucuugaagua

SEQ ID NO: 743117 - RNA, 22 nt, Human
agacagugcuaucccaucugug

SEQ ID NO: 743118 - RNA, 22 nt, Human
uagaaaucagguuuuuagaaag

SEQ ID NO: 743119 - RNA, 22 nt, Human
uccaggagaccagauguaggcc

SEQ ID NO: 743120 - RNA, 22 nt, Human
uagaagcaguaauagaaauagg

SEQ ID NO: 743121 - RNA, 22 nt, Human
ggcucccacccauagggcgagu

SEQ ID NO: 743122 - RNA, 22 nt, Human
gugggcagugugucaguaucuu

SEQ ID NO: 743123 - RNA, 22 nt, Human
ccaggaggcagaaguugcagug

SEQ ID NO: 743124 - RNA, 19 nt, Human
aguguuucaugugcuuuua

SEQ ID NO: 743125 - RNA, 22 nt, Human
agaaaucagaacccugaaguuc

SEQ ID NO: 743126 - RNA, 23 nt, Human
aauucaaauucagugugacuagg

SEQ ID NO: 743127 - RNA, 22 nt, Human
ccauuuuucacaagacucacuu

SEQ ID NO: 743128 - RNA, 22 nt, Human
cuaaaaauccacacuaggugaa

SEQ ID NO: 743129 - RNA, 22 nt, Human
agucagagucgccgacagucaa

SEQ ID NO: 743130 - RNA, 22 nt, Human
ugaguucuaguggcugcagauu

SEQ ID NO: 743131 - RNA, 22 nt, Human
uggggaggacgggcgccuuccu

SEQ ID NO: 743132 - RNA, 22 nt, Human
cagccaggagccucugcaacua

SEQ ID NO: 743133 - RNA, 20 nt, Human
ucuguaggcaaguuagcagg

SEQ ID NO: 743134 - RNA, 23 nt, Human
uugauacagaagaaucaguuugu

SEQ ID NO: 743135 - RNA, 22 nt, Human
uacauauuguccauaguugcuu

SEQ ID NO: 743136 - RNA, 22 nt, Human
cugcuuuaauggaaaguguuuu

SEQ ID NO: 743137 - RNA, 22 nt, Human
acacauuugcuaaaaugagcuc

SEQ ID NO: 743138 - RNA, 22 nt, Human
ggcuccucucuggccgcucccg

SEQ ID NO: 743139 - RNA, 22 nt, Human
auucauuuagguauucacuuac

SEQ ID NO: 743140 - RNA, 22 nt, Human
cugauggauggacagggguagu

SEQ ID NO: 743141 - RNA, 22 nt, Human
cacugggagucguaagacacgg

SEQ ID NO: 743142 - RNA, 22 nt, Human
gcaggcucccuugcagagcagg

SEQ ID NO: 743143 - RNA, 22 nt, Human
uuugguccuaagcugcucucua

SEQ ID NO: 743144 - RNA, 22 nt, Human
ucuauucauucaauuuagcucu

SEQ ID NO: 743145 - RNA, 22 nt, Human
uuaguguauuuucaaauguaga

SEQ ID NO: 743146 - RNA, 22 nt, Human
ccugugcucccauagcuucugu

SEQ ID NO: 743147 - RNA, 22 nt, Human
acugggccacauagaccugcug

SEQ ID NO: 743148 - RNA, 22 nt, Human
aguuuguacugaauucaauuua

SEQ ID NO: 743149 - RNA, 22 nt, Human
gaauauuuguaauuacuguuga

SEQ ID NO: 743150 - RNA, 22 nt, Human
cugucuccgcccucuugguagg

SEQ ID NO: 743151 - RNA, 22 nt, Human
cuggcccuuaggaaaacaaagu

SEQ ID NO: 743152 - RNA, 22 nt, Human
uacaaugcuguuuguuucuacu

SEQ ID NO: 743153 - RNA, 22 nt, Human
acaagagugagauuaucaugua

SEQ ID NO: 743154 - RNA, 22 nt, Human
aggcugccucuuuugagagggu

SEQ ID NO: 743155 - RNA, 22 nt, Human
cccuagggcuaagcaggacugc

SEQ ID NO: 743156 - RNA, 22 nt, Human
ugggcaucauggacagcagagg

SEQ ID NO: 743157 - RNA, 22 nt, Human
cacuguuauuacuacuauacau

SEQ ID NO: 743158 - RNA, 21 nt, Human
ugcugccaucaugcagagaug

SEQ ID NO: 743159 - RNA, 22 nt, Human
caagaugaucccugaaggcagc

SEQ ID NO: 743160 - RNA, 22 nt, Human
uaguauauuuuguugcaauuca

SEQ ID NO: 743161 - RNA, 22 nt, Human
aaacacuggcaauuucaugcac

SEQ ID NO: 743162 - RNA, 22 nt, Human
gagccaggaagaaggccuuacu

SEQ ID NO: 743163 - RNA, 22 nt, Human
agugaauuuaaaacacugagga

SEQ ID NO: 743164 - RNA, 20 nt, Human
ugcugcuuugccacuaguug

SEQ ID NO: 743165 - RNA, 22 nt, Human
cugagcagcacagggcgccagg

SEQ ID NO: 743166 - RNA, 22 nt, Human
guaaucucagcuacuugggagg

SEQ ID NO: 743167 - RNA, 22 nt, Human
cccugcagcauucucuaacugg

SEQ ID NO: 743168 - RNA, 17 nt, Human
accuggagaccaagucc

SEQ ID NO: 743169 - RNA, 22 nt, Human
gcauucaucaaaaauguuccuc

SEQ ID NO: 743170 - RNA, 23 nt, Human
agacacuguaaagaauugcaguu

SEQ ID NO: 743171 - RNA, 17 nt, Human
ugccuccagcaggguga

SEQ ID NO: 743172 - RNA, 22 nt, Human
acagcuccuaacaaaggcucuc

SEQ ID NO: 743173 - RNA, 22 nt, Human
ugagaaacauaugagagauuug

SEQ ID NO: 743174 - RNA, 22 nt, Human
uugacaaaggaauugaaucucu

SEQ ID NO: 743175 - RNA, 19 nt, Human
auacacauacguaaacuga

SEQ ID NO: 743176 - RNA, 20 nt, Human
gggaggcauuggucccucac

SEQ ID NO: 743177 - RNA, 20 nt, Human
uggcccagcacgacgaggac

SEQ ID NO: 743178 - RNA, 22 nt, Human
agaacuuaggaacaacagcuua

SEQ ID NO: 743179 - RNA, 22 nt, Human
acuuugaaacuaaaauucauua

SEQ ID NO: 743180 - RNA, 22 nt, Human
aaugacaagacauagucucuga

SEQ ID NO: 743181 - RNA, 22 nt, Human
uaauccugugcuguguaaguac

SEQ ID NO: 743182 - RNA, 22 nt, Human
ccucugugacaaacaguccugg

SEQ ID NO: 743183 - RNA, 22 nt, Human
agcuucuguucaucuuccaggc

SEQ ID NO: 743184 - RNA, 22 nt, Human
ccagcccaaacaagccgccuuc

SEQ ID NO: 743185 - RNA, 22 nt, Human
aaaauuggacguagcuacucca

SEQ ID NO: 743186 - RNA, 22 nt, Human
uuggcuucuucgcacagcagua

SEQ ID NO: 743187 - RNA, 22 nt, Human
uuugcuuguucaagauuucugu

SEQ ID NO: 743188 - RNA, 22 nt, Human
gggugggaaggcuaagggauug

SEQ ID NO: 743189 - RNA, 22 nt, Human
ugcccuggagucaguggcuauu

SEQ ID NO: 743190 - RNA, 22 nt, Human
acagauuuuauuauucagguau

SEQ ID NO: 743191 - RNA, 22 nt, Human
uguggguggagugauauuagcu

SEQ ID NO: 743192 - RNA, 22 nt, Human
aggcagcagcuugcugguugcc

SEQ ID NO: 743193 - RNA, 22 nt, Human
aagggcaggugggcauuucugg

SEQ ID NO: 743194 - RNA, 22 nt, Human
uggaaaaaacccagacucuaga

SEQ ID NO: 743195 - RNA, 22 nt, Human
ucucuggagcugcagauccagg

SEQ ID NO: 743196 - RNA, 20 nt, Human
uacaggaaucaagacugcau

SEQ ID NO: 743197 - RNA, 22 nt, Human
gcuguggccgggcccaggccgc

SEQ ID NO: 743198 - RNA, 22 nt, Human
guuuccugaugugggagaucuu

SEQ ID NO: 743199 - RNA, 22 nt, Human
aacacaaaaauucucaggggca

SEQ ID NO: 743200 - RNA, 22 nt, Human
ggccuugguucugucacagccg

SEQ ID NO: 743201 - RNA, 22 nt, Human
cuggcccuguaggaugugaguu

SEQ ID NO: 743202 - RNA, 22 nt, Human
ccuugcuguuagccuacauuau

SEQ ID NO: 743203 - RNA, 22 nt, Human
gugcaaaaguaaaugugguuuu

SEQ ID NO: 743204 - RNA, 22 nt, Human
uugggcucaggaguuugagacc

SEQ ID NO: 743205 - RNA, 22 nt, Human
ggcuggcacucuguccaguguc

SEQ ID NO: 743206 - RNA, 22 nt, Human
augcauuuuugaguaugaauga

SEQ ID NO: 743207 - RNA, 22 nt, Human
agucugugagugauguaccugc

SEQ ID NO: 743208 - RNA, 22 nt, Human
agauuguagaaacuguagcauu

SEQ ID NO: 743209 - RNA, 22 nt, Human
ugccugggcucgguagccaucg

SEQ ID NO: 743210 - RNA, 22 nt, Human
guuaagaagcuagagaugaaca

SEQ ID NO: 743211 - RNA, 22 nt, Human
uuuuuuauaucaacugaagucu

SEQ ID NO: 743212 - RNA, 22 nt, Human
ugcuggaaauauauuuguuuau

SEQ ID NO: 743213 - RNA, 22 nt, Human
gagcucccaggccccagcaagg

SEQ ID NO: 743214 - RNA, 22 nt, Human
aaggaggguucccagguccugg

SEQ ID NO: 743215 - RNA, 22 nt, Human
cugagguggcauccuagcucua

SEQ ID NO: 743216 - RNA, 22 nt, Human
ccagaagaggacacagugugga

SEQ ID NO: 743217 - RNA, 22 nt, Human
uauuuugcuuuagcugacuguu

SEQ ID NO: 743218 - RNA, 22 nt, Human
guaggaaagggagugaagggaa

SEQ ID NO: 743219 - RNA, 22 nt, Human
ugggagcagcagggagaugcgg

SEQ ID NO: 743220 - RNA, 22 nt, Human
gccagagcaucgcacccuccau

SEQ ID NO: 743221 - RNA, 21 nt, Human
gcagaugggaagagacgaggc

SEQ ID NO: 743222 - RNA, 22 nt, Human
cagcuguggagggaggaaaugc

SEQ ID NO: 743223 - RNA, 22 nt, Human
cacacugaccugaacuuagcau

SEQ ID NO: 743224 - RNA, 19 nt, Human
agcauagacuucucaggaa

SEQ ID NO: 743225 - RNA, 22 nt, Human
aggcauggauguagcagugacc

SEQ ID NO: 743226 - RNA, 22 nt, Human
ugcaggugucuccagggcaggu

SEQ ID NO: 743227 - RNA, 22 nt, Human
caggaggcagagguugcaguga

SEQ ID NO: 743228 - RNA, 22 nt, Human
cagcagguauguuuguucagca

SEQ ID NO: 743229 - RNA, 22 nt, Human
ucaccuguuggauguauacugu

SEQ ID NO: 743230 - RNA, 22 nt, Human
aagccaagaguuaacuauuugu

SEQ ID NO: 743231 - RNA, 22 nt, Human
ccuucugcucccuggccagggc

SEQ ID NO: 743232 - RNA, 22 nt, Human
acauguauugacauuauauucu

SEQ ID NO: 743233 - RNA, 22 nt, Human
gggccucucccuucucacgcau

SEQ ID NO: 743234 - RNA, 22 nt, Human
cacaggaagcaagccuggggcc

SEQ ID NO: 743235 - RNA, 22 nt, Human
cuucugugacguaugugaggac

SEQ ID NO: 743236 - RNA, 22 nt, Human
cacugagcugauagaauuccag

SEQ ID NO: 743237 - RNA, 22 nt, Human
ucacaugaagaucccucaauuu

SEQ ID NO: 743238 - RNA, 22 nt, Human
gagccuguguuuccuguagcca

SEQ ID NO: 743239 - RNA, 22 nt, Human
cacacaugcauguaagaccucu

SEQ ID NO: 743240 - RNA, 22 nt, Human
cccaaccagaaauugacagaga

SEQ ID NO: 743241 - RNA, 22 nt, Human
agugugucaguugaaagagauu

SEQ ID NO: 743242 - RNA, 22 nt, Human
ugaggaaagaaaggcaugcaug

SEQ ID NO: 743243 - RNA, 18 nt, Human
cagacacucugcucugca

SEQ ID NO: 743244 - RNA, 22 nt, Human
cuucagccucguuacuccugcg

SEQ ID NO: 743245 - RNA, 20 nt, Human
agacccucuggacugggccc

SEQ ID NO: 743246 - RNA, 22 nt, Human
agcauguaaagcucuuagcacc

SEQ ID NO: 743247 - RNA, 22 nt, Human
ucaauauauuccauguuuucuc

SEQ ID NO: 743248 - RNA, 17 nt, Human
ucugagaaaggagaauc

SEQ ID NO: 743249 - RNA, 22 nt, Human
auaagguuaggauuauaguguu

SEQ ID NO: 743250 - RNA, 22 nt, Human
agcaacaggguggucuucagaa

SEQ ID NO: 743251 - RNA, 22 nt, Human
uuaugcuaaaugaaucaaguca

SEQ ID NO: 743252 - RNA, 22 nt, Human
ucagcccagcccagcaagugca

SEQ ID NO: 743253 - RNA, 23 nt, Human
ugcaggguguuccugccuuugcu

SEQ ID NO: 743254 - RNA, 23 nt, Human
cugccugcuggggagacagaucu

SEQ ID NO: 743255 - RNA, 22 nt, Human
caggcccaugagggcagccaca

SEQ ID NO: 743256 - RNA, 22 nt, Human
aacuuuaaaaaauaugucuguu

SEQ ID NO: 743257 - RNA, 22 nt, Human
agcagcaucuucuguucuccgc

SEQ ID NO: 743258 - RNA, 22 nt, Human
ccuggcugcuuucacuauggag

SEQ ID NO: 743259 - RNA, 18 nt, Human
cucucuuuccacucuuug

SEQ ID NO: 743260 - RNA, 22 nt, Human
cagagcagagugauuguucugg

SEQ ID NO: 743261 - RNA, 22 nt, Human
ucacccagaaaagacagcagau

SEQ ID NO: 743262 - RNA, 22 nt, Human
uaucaaaaggaguugaaagggg

SEQ ID NO: 743263 - RNA, 22 nt, Human
uaauuacaaagcaagcacaggg

SEQ ID NO: 743264 - RNA, 22 nt, Human
agcugcuucaaaaugggcuccu

SEQ ID NO: 743265 - RNA, 22 nt, Human
cucucuguuaugcuuucaugaa

SEQ ID NO: 743266 - RNA, 22 nt, Human
aaaguccuguuaacuguuaaca

SEQ ID NO: 743267 - RNA, 22 nt, Human
uuuauaaaauagacugggucua

SEQ ID NO: 743268 - RNA, 20 nt, Human
gcaggcccucucucuagucu

SEQ ID NO: 743269 - RNA, 22 nt, Human
cagcuccagcucugggcgccuc

SEQ ID NO: 743270 - RNA, 22 nt, Human
ugugggacagggacagugauau

SEQ ID NO: 743271 - RNA, 22 nt, Human
cuggcccuaugagccuccugau

SEQ ID NO: 743272 - RNA, 22 nt, Human
uaucuauuccaaauaucagcgu

SEQ ID NO: 743273 - RNA, 22 nt, Human
uauucagaaaauaaauuggauu

SEQ ID NO: 743274 - RNA, 22 nt, Human
ggaaugggagcuauuaguggaa

SEQ ID NO: 743275 - RNA, 22 nt, Human
uaaugaaugagaauauaacaga

SEQ ID NO: 743276 - RNA, 22 nt, Human
accugaggaagggcgagaagcu

SEQ ID NO: 743277 - RNA, 21 nt, Human
ccaggcugggagggcaguucc

SEQ ID NO: 743278 - RNA, 22 nt, Human
gcaugcaugguuugugacugug

SEQ ID NO: 743279 - RNA, 22 nt, Human
cauuuguuaaugcugcuuuuaa

SEQ ID NO: 743280 - RNA, 22 nt, Human
uggcugaacuaaugugcuguuu

SEQ ID NO: 743281 - RNA, 22 nt, Human
uggaagagcaggcagacaaugc

SEQ ID NO: 743282 - RNA, 22 nt, Human
aauggcaacaugguauagugag

SEQ ID NO: 743283 - RNA, 22 nt, Human
gcagggcugggauuugagccca

SEQ ID NO: 743284 - RNA, 21 nt, Human
uaacacauuuugguacuuugg

SEQ ID NO: 743285 - RNA, 22 nt, Human
agugaggaaauccauuaucaag

SEQ ID NO: 743286 - RNA, 21 nt, Human
ugaguuaaggauccaauucug

SEQ ID NO: 743287 - RNA, 17 nt, Human
ucuguucaugcauaccu

SEQ ID NO: 743288 - RNA, 22 nt, Human
gagggagaauugcagccagcgu

SEQ ID NO: 743289 - RNA, 22 nt, Human
aguccugggugugcaaggcaga

SEQ ID NO: 743290 - RNA, 22 nt, Human
cagaaugcaaauuuuauaauau

SEQ ID NO: 743291 - RNA, 22 nt, Human
uuuagcaaguauuuacugacua

SEQ ID NO: 743292 - RNA, 22 nt, Human
aggugggcggauucaugagguc

SEQ ID NO: 743293 - RNA, 22 nt, Human
guccugugugagugcaccaccu

SEQ ID NO: 743294 - RNA, 22 nt, Human
aagucagagcaacugagacauu

SEQ ID NO: 743295 - RNA, 22 nt, Human
uccuucaccucaagcuuuugaa

SEQ ID NO: 743296 - RNA, 22 nt, Human
aggcuggcgacaucuggcgggc

SEQ ID NO: 743297 - RNA, 22 nt, Human
aacuguaagugguuggaagaag

SEQ ID NO: 743298 - RNA, 22 nt, Human
ugugugcauguuaaugagaaaa

SEQ ID NO: 743299 - RNA, 22 nt, Human
uagacagauuucuuguuagaca

SEQ ID NO: 743300 - RNA, 22 nt, Human
gugccucagcaccgccugcagc

SEQ ID NO: 743301 - RNA, 21 nt, Human
ugagcaggugcugcuuuuaug

SEQ ID NO: 743302 - RNA, 22 nt, Human
aaaugcuagaacauuuuaaagg

SEQ ID NO: 743303 - RNA, 22 nt, Human
aaaacucugcaguuaguuucua

SEQ ID NO: 743304 - RNA, 22 nt, Human
acaucugaaagggauugcagaa

SEQ ID NO: 743305 - RNA, 22 nt, Human
cugcccaccacaccugcuccug

SEQ ID NO: 743306 - RNA, 22 nt, Human
cugcccagauuuuaccaccugc

SEQ ID NO: 743307 - RNA, 22 nt, Human
uccaggugugcucugugcccug

SEQ ID NO: 743308 - RNA, 22 nt, Human
ccugaggcuggcccuuccaucc

SEQ ID NO: 743309 - RNA, 22 nt, Human
cuccagaggcgacuugcaucac

SEQ ID NO: 743310 - RNA, 22 nt, Human
gugcugugucuaucaggaauaa

SEQ ID NO: 743311 - RNA, 22 nt, Human
augggcugggaucugaguguca

SEQ ID NO: 743312 - RNA, 22 nt, Human
uuucucauagucaugccucuua

SEQ ID NO: 743313 - RNA, 22 nt, Human
agucagucaccauuuaagaaca

SEQ ID NO: 743314 - RNA, 22 nt, Human
uucucacaauucuuguauuugc

SEQ ID NO: 743315 - RNA, 22 nt, Human
cugugccacugcccugccacgc

SEQ ID NO: 743316 - RNA, 22 nt, Human
cuguugucccugggagcucagc

SEQ ID NO: 743317 - RNA, 22 nt, Human
aucuagaaguggcaugaauuac

SEQ ID NO: 743318 - RNA, 22 nt, Human
uuggcccacaguaccaugcugu

SEQ ID NO: 743319 - RNA, 22 nt, Human
uggcucugccacuaacuuggua

SEQ ID NO: 743320 - RNA, 22 nt, Human
ucagggcaaugucccucagaag

SEQ ID NO: 743321 - RNA, 22 nt, Human
guauuuggucuauuuggcaucc

SEQ ID NO: 743322 - RNA, 22 nt, Human
cccucugccugcgcccuggugu

SEQ ID NO: 743323 - RNA, 22 nt, Human
cugaggcucugagaaagccaaa

SEQ ID NO: 743324 - RNA, 22 nt, Human
ugucccugccugcccacucugu

SEQ ID NO: 743325 - RNA, 22 nt, Human
guggaggcagugacacaguagc

SEQ ID NO: 743326 - RNA, 22 nt, Human
uccaggagguugagugaguucc

SEQ ID NO: 743327 - RNA, 22 nt, Human
ugaaacauaaaguuaucuucag

SEQ ID NO: 743328 - RNA, 22 nt, Human
uagcuauuuugcuuggaaauac

SEQ ID NO: 743329 - RNA, 22 nt, Human
ugauucugaggacccugugacg

SEQ ID NO: 743330 - RNA, 22 nt, Human
caccacuguaucccuagcacuu

SEQ ID NO: 743331 - RNA, 22 nt, Human
cacugcagaucagaggcugaga

SEQ ID NO: 743332 - RNA, 22 nt, Human
gaaaauguuagcuucauaguca

SEQ ID NO: 743333 - RNA, 22 nt, Human
ucagggcaggcgagcagcugcu

SEQ ID NO: 743334 - RNA, 21 nt, Human
ccuggacuaaaaccaggccac

SEQ ID NO: 743335 - RNA, 22 nt, Human
ggccucucuccuuggcuugcag

SEQ ID NO: 743336 - RNA, 22 nt, Human
ugaaaugucaguguuuuauaag

SEQ ID NO: 743337 - RNA, 22 nt, Human
agugucuguuguucagaacucu

SEQ ID NO: 743338 - RNA, 22 nt, Human
uggcuucuugucuaauuuguua

SEQ ID NO: 743339 - RNA, 23 nt, Human
ugcuggcugaaacagccaaagga

SEQ ID NO: 743340 - RNA, 22 nt, Human
gugcauauguguguauacaaac

SEQ ID NO: 743341 - RNA, 22 nt, Human
ugggucuccaguucagggcagg

SEQ ID NO: 743342 - RNA, 22 nt, Human
cugcuuccauaaauaaugugcu

SEQ ID NO: 743343 - RNA, 22 nt, Human
aauguguacaugacagauagaa

SEQ ID NO: 743344 - RNA, 17 nt, Human
auacauuguuaaaguau

SEQ ID NO: 743345 - RNA, 22 nt, Human
gcccucagaugggaaaggaggg

SEQ ID NO: 743346 - RNA, 22 nt, Human
gaaacuguuucuggcuuuggug

SEQ ID NO: 743347 - RNA, 22 nt, Human
caggccggugauucuggaugua

SEQ ID NO: 743348 - RNA, 22 nt, Human
acacugaguuuuaccaggcaca

SEQ ID NO: 743349 - RNA, 22 nt, Human
gccuuucaguuccaucaaagga

SEQ ID NO: 743350 - RNA, 22 nt, Human
acucaugauaugccuauaagau

SEQ ID NO: 743351 - RNA, 22 nt, Human
ccuggccugcucggcucuuaag

SEQ ID NO: 743352 - RNA, 22 nt, Human
ucauguacauguaagucagaaa

SEQ ID NO: 743353 - RNA, 22 nt, Human
agcagaacagucuucuaguucu

SEQ ID NO: 743354 - RNA, 22 nt, Human
agugucuuuauagacugacaau

SEQ ID NO: 743355 - RNA, 22 nt, Human
augcguguuuguauacacacaa

SEQ ID NO: 743356 - RNA, 22 nt, Human
agggcucagaaagcagguuuuc

SEQ ID NO: 743357 - RNA, 22 nt, Human
aauggacaggagagcauaguca

SEQ ID NO: 743358 - RNA, 17 nt, Human
gagauuuucguccugaa

SEQ ID NO: 743359 - RNA, 22 nt, Human
uacaaauguauuuuauuuuggu

SEQ ID NO: 743360 - RNA, 22 nt, Human
gcaccucauuuugcagguagaa

SEQ ID NO: 743361 - RNA, 22 nt, Human
uaguaucuauuaguaacaagag

SEQ ID NO: 743362 - RNA, 22 nt, Human
auuguguaauuuucagcucaua

SEQ ID NO: 743363 - RNA, 22 nt, Human
ucucaggcuaccuugcacaagg

SEQ ID NO: 743364 - RNA, 22 nt, Human
uuucugcucauccuaguggagc

SEQ ID NO: 743365 - RNA, 22 nt, Human
caguuuaguccugccaccaugg

SEQ ID NO: 743366 - RNA, 22 nt, Human
uuuacacugccauucugaauac

SEQ ID NO: 743367 - RNA, 22 nt, Human
cacuacagggguccacagcuga

SEQ ID NO: 743368 - RNA, 20 nt, Human
aggaggccugcagauaguuc

SEQ ID NO: 743369 - RNA, 22 nt, Human
ccccuuccgucucuugaguguc

SEQ ID NO: 743370 - RNA, 22 nt, Human
gcaggagcccuggcauguucuu

SEQ ID NO: 743371 - RNA, 22 nt, Human
cugccaaguaaugccugggcuc

SEQ ID NO: 743372 - RNA, 22 nt, Human
aaaucucacuguagucaaagug

SEQ ID NO: 743373 - RNA, 22 nt, Human
gagggcugcuggaaaaaugcag

SEQ ID NO: 743374 - RNA, 22 nt, Human
gcagggcugagucaugugugcc

SEQ ID NO: 743375 - RNA, 22 nt, Human
uggcaggcauugaugcgaguuc

SEQ ID NO: 743376 - RNA, 22 nt, Human
gugugggggcagcucugauaug

SEQ ID NO: 743377 - RNA, 22 nt, Human
agagcuggccagggaucacucu

SEQ ID NO: 743378 - RNA, 22 nt, Human
auguuuucaaaguaaacuugua

SEQ ID NO: 743379 - RNA, 22 nt, Human
cuggagagggagcuguuggaag

SEQ ID NO: 743380 - RNA, 22 nt, Human
ucccaggcuggcaggcagcagu

SEQ ID NO: 743381 - RNA, 22 nt, Human
guaacaaacgguuccaagaugc

SEQ ID NO: 743382 - RNA, 19 nt, Human
uuucuguuagaaggauaca

SEQ ID NO: 743383 - RNA, 22 nt, Human
caaggccuucgucuccuagcuu

SEQ ID NO: 743384 - RNA, 23 nt, Human
agggccugauggcucccgcuggc

SEQ ID NO: 743385 - RNA, 19 nt, Human
uaccagccuccugccugau

SEQ ID NO: 743386 - RNA, 22 nt, Human
cugugagaaaggugauggaggu

SEQ ID NO: 743387 - RNA, 22 nt, Human
augccuggacugacaugcacug

SEQ ID NO: 743388 - RNA, 23 nt, Human
uaauugcuugaguuaguaauaca

SEQ ID NO: 743389 - RNA, 22 nt, Human
ugaaacaggcaaaacugcagau

SEQ ID NO: 743390 - RNA, 22 nt, Human
ucaggcugauuucuuuugaggg

SEQ ID NO: 743391 - RNA, 18 nt, Human
auuuugaacugggaauau

SEQ ID NO: 743392 - RNA, 22 nt, Human
cugagaucuuuauacgaggcac

SEQ ID NO: 743393 - RNA, 22 nt, Human
uauguauaugguagaaguaugu

SEQ ID NO: 743394 - RNA, 22 nt, Human
auucaaacuguguuaggcagca

SEQ ID NO: 743395 - RNA, 22 nt, Human
ccaggcaggcagcguucucagg

SEQ ID NO: 743396 - RNA, 22 nt, Human
ccuuggcuugugggcugcagcc

SEQ ID NO: 743397 - RNA, 21 nt, Human
gcaugccugcaucuuaguguu

SEQ ID NO: 743398 - RNA, 22 nt, Human
gcuuccucccugcugcucacua

SEQ ID NO: 743399 - RNA, 22 nt, Human
aaguccugaaacuucuuucuga

SEQ ID NO: 743400 - RNA, 22 nt, Human
aagguacaaaguuauacagcgu

SEQ ID NO: 743401 - RNA, 22 nt, Human
uauuagguagauuuuacugauu

SEQ ID NO: 743402 - RNA, 22 nt, Human
guggccaggcguccgcgcggcu

SEQ ID NO: 743403 - RNA, 22 nt, Human
acagauguggaguuugcaugau

SEQ ID NO: 743404 - RNA, 22 nt, Human
uggcaaagauuaccacaucuac

SEQ ID NO: 743405 - RNA, 22 nt, Human
aagcagaugggacuccaaggca

SEQ ID NO: 743406 - RNA, 22 nt, Human
acguggagccacagauggagca

SEQ ID NO: 743407 - RNA, 22 nt, Human
uuaauguaugggguugagauga

SEQ ID NO: 743408 - RNA, 23 nt, Human
ugguggcuugugguggccaccag

SEQ ID NO: 743409 - RNA, 22 nt, Human
aaagguuuuucagcagggagau

SEQ ID NO: 743410 - RNA, 22 nt, Human
uaagucauaagucaugauguua

SEQ ID NO: 743411 - RNA, 22 nt, Human
uaugcuuugaaaaugugcugaa

SEQ ID NO: 743412 - RNA, 22 nt, Human
ucagaaucugaaaagcgcuugg

SEQ ID NO: 743413 - RNA, 17 nt, Human
uccagcccugcccgacg

SEQ ID NO: 743414 - RNA, 21 nt, Human
ggccucugucauccugggaag

SEQ ID NO: 743415 - RNA, 22 nt, Human
auaguaacuggcauguuuauga

SEQ ID NO: 743416 - RNA, 22 nt, Human
ccccgcgcguugucccgcaggu

SEQ ID NO: 743417 - RNA, 22 nt, Human
acuuccuggauucccaagggcu

SEQ ID NO: 743418 - RNA, 22 nt, Human
ccaggaacucagcucugcacuu

SEQ ID NO: 743419 - RNA, 22 nt, Human
augcauaauguauguauugacu

SEQ ID NO: 743420 - RNA, 22 nt, Human
cugcagagguugguucuaagau

SEQ ID NO: 743421 - RNA, 22 nt, Human
ucaucugggagcuuguuagaaa

SEQ ID NO: 743422 - RNA, 22 nt, Human
cuucccagaacaauguaggcuu

SEQ ID NO: 743423 - RNA, 22 nt, Human
aaggacagagagccauuccaga

SEQ ID NO: 743424 - RNA, 22 nt, Human
uaucuguuggcuccuaguugua

SEQ ID NO: 743425 - RNA, 22 nt, Human
ccaggcagggagcuguuuggcc

SEQ ID NO: 743426 - RNA, 22 nt, Human
aucugugaucaagacagacagu

SEQ ID NO: 743427 - RNA, 22 nt, Human
cugugugcagggcacaauggaa

SEQ ID NO: 743428 - RNA, 22 nt, Human
uguucccauggauaucugcaua

SEQ ID NO: 743429 - RNA, 22 nt, Human
aaagugcacuagaauccagauu

SEQ ID NO: 743430 - RNA, 22 nt, Human
cuggaagggggacagccacaca

SEQ ID NO: 743431 - RNA, 22 nt, Human
uaccugaguuauauuaauaauu

SEQ ID NO: 743432 - RNA, 22 nt, Human
cagagcugugauaaauagauau

SEQ ID NO: 743433 - RNA, 22 nt, Human
gaaggcaguaaauggcuguuuu

SEQ ID NO: 743434 - RNA, 20 nt, Human
gcccuggagccuuguccugg

SEQ ID NO: 743435 - RNA, 22 nt, Human
caggcccugccuuggcaugugu

SEQ ID NO: 743436 - RNA, 22 nt, Human
ggcagguggcacugcugcuccc

SEQ ID NO: 743437 - RNA, 22 nt, Human
gugagcagaacagguggcuucu

SEQ ID NO: 743438 - RNA, 20 nt, Human
gcagcugcccccagucccug

SEQ ID NO: 743439 - RNA, 20 nt, Human
ggccaccugcuucagacccc

SEQ ID NO: 743440 - RNA, 22 nt, Human
gccagccagaguggcugugugu

SEQ ID NO: 743441 - RNA, 22 nt, Human
gaguggcaggcacugugacgga

SEQ ID NO: 743442 - RNA, 22 nt, Human
uacagacaguuuuucagauauu

SEQ ID NO: 743443 - RNA, 22 nt, Human
agaauagaauucucauagaauu

SEQ ID NO: 743444 - RNA, 23 nt, Human
cuguccaggauucuugagagaac

SEQ ID NO: 743445 - RNA, 22 nt, Human
uuuucuguguauccaggcuucc

SEQ ID NO: 743446 - RNA, 22 nt, Human
uccccugcagcgccugcuucua

SEQ ID NO: 743447 - RNA, 22 nt, Human
gggaaauugugugagaucuuug

SEQ ID NO: 743448 - RNA, 22 nt, Human
uagguuuuccuaaaauucuggu

SEQ ID NO: 743449 - RNA, 23 nt, Human
agcacagacuagaaaggucuuuc

SEQ ID NO: 743450 - RNA, 22 nt, Human
caaggaauauuuaagaacguca

SEQ ID NO: 743451 - RNA, 22 nt, Human
agugaaauaugcccauugcugu

SEQ ID NO: 743452 - RNA, 22 nt, Human
cagcuguuguguaucaggcaga

SEQ ID NO: 743453 - RNA, 22 nt, Human
ucucuugaagauugaagacaaa

SEQ ID NO: 743454 - RNA, 17 nt, Human
gguucaguucugcauuc

SEQ ID NO: 743455 - RNA, 22 nt, Human
auucauuggcuugaacuccacc

SEQ ID NO: 743456 - RNA, 22 nt, Human
auucagaucauauuuauagcuu

SEQ ID NO: 743457 - RNA, 22 nt, Human
ccuggcucauuaugugccccca

SEQ ID NO: 743458 - RNA, 22 nt, Human
ccugggagagucuguggucucc

SEQ ID NO: 743459 - RNA, 22 nt, Human
cugagagaucaagccacaggau

SEQ ID NO: 743460 - RNA, 19 nt, Human
gccaggccuggaccugcag

SEQ ID NO: 743461 - RNA, 22 nt, Human
aagauuuccauuucuagcucau

SEQ ID NO: 743462 - RNA, 22 nt, Human
aacauuucauuggaagcuaugu

SEQ ID NO: 743463 - RNA, 22 nt, Human
aguguccccuacagaggcauuc

SEQ ID NO: 743464 - RNA, 22 nt, Human
auuuccagugcacugaauagaa

SEQ ID NO: 743465 - RNA, 22 nt, Human
aggagaguucacacuggucaga

SEQ ID NO: 743466 - RNA, 22 nt, Human
uggagcugggauuugaacugca

SEQ ID NO: 743467 - RNA, 22 nt, Human
uagaaugugccuggaauacagu

SEQ ID NO: 743468 - RNA, 22 nt, Human
aggccacagccugggaggugac

SEQ ID NO: 743469 - RNA, 22 nt, Human
gggcagcacucauaccuauauu

SEQ ID NO: 743470 - RNA, 22 nt, Human
aaugucuuucucauaacagaua

SEQ ID NO: 743471 - RNA, 22 nt, Human
uguaacaguaagccugugagcu

SEQ ID NO: 743472 - RNA, 22 nt, Human
gggaagagauuuccacaucauu

SEQ ID NO: 743473 - RNA, 22 nt, Human
aggugggguguuggauguuuau

SEQ ID NO: 743474 - RNA, 22 nt, Human
auugaacugauauuugguguag

SEQ ID NO: 743475 - RNA, 22 nt, Human
cuuuucuagagccgcagcccua

SEQ ID NO: 743476 - RNA, 22 nt, Human
uucauuugcacuggauuacugg

SEQ ID NO: 743477 - RNA, 22 nt, Human
cccugaugacacgggcaucagg

SEQ ID NO: 743478 - RNA, 22 nt, Human
cucucucuuuagaagcgucugg

SEQ ID NO: 743479 - RNA, 22 nt, Human
uggggaaaagcguuaggaguuc

SEQ ID NO: 743480 - RNA, 22 nt, Human
ccaggcucaggugcgagagaca

SEQ ID NO: 743481 - RNA, 22 nt, Human
gugccagccgcaccccaggaga

SEQ ID NO: 743482 - RNA, 22 nt, Human
ggaggguccacugugaggcaga

SEQ ID NO: 743483 - RNA, 22 nt, Human
ugaaaaugcccucuaugucuca

SEQ ID NO: 743484 - RNA, 22 nt, Human
uccuggccucacaguccugggu

SEQ ID NO: 743485 - RNA, 22 nt, Human
cagaaauaugugccaugccuua

SEQ ID NO: 743486 - RNA, 22 nt, Human
gcaggccugucuugcucgcccu

SEQ ID NO: 743487 - RNA, 22 nt, Human
agcuuuggauuucuuauagccc

SEQ ID NO: 743488 - RNA, 22 nt, Human
uggcuaugguauugauggguuu

SEQ ID NO: 743489 - RNA, 22 nt, Human
gaguucauauucagagaucgcu

SEQ ID NO: 743490 - RNA, 22 nt, Human
ugugaccauaauuuguaaauaa

SEQ ID NO: 743491 - RNA, 22 nt, Human
guuaaaugcauuuuccaagcac

SEQ ID NO: 743492 - RNA, 22 nt, Human
caccugggucauugcugguguu

SEQ ID NO: 743493 - RNA, 22 nt, Human
ugccagcuccgaggagcugcag

SEQ ID NO: 743494 - RNA, 22 nt, Human
aucuacaggauaguuuaauauu

SEQ ID NO: 743495 - RNA, 22 nt, Human
gcuggcuuuaucgucagacucc

SEQ ID NO: 743496 - RNA, 22 nt, Human
aggcucccaugguguggcagga

SEQ ID NO: 743497 - RNA, 22 nt, Human
gcuucugcgccuagccucaggu

SEQ ID NO: 743498 - RNA, 22 nt, Human
gcucccuggaauguuggcugcc

SEQ ID NO: 743499 - RNA, 22 nt, Human
uguacaauagcuauuaucucca

SEQ ID NO: 743500 - RNA, 22 nt, Human
cucucugguacauagaguuugg

SEQ ID NO: 743501 - RNA, 22 nt, Human
agauggaguuaguaccagaguc

SEQ ID NO: 743502 - RNA, 22 nt, Human
ugccuagaacuuuauucuuuau

SEQ ID NO: 743503 - RNA, 22 nt, Human
acugcuuacccggccugacuuc

SEQ ID NO: 743504 - RNA, 21 nt, Human
cuuggaacggguagaacucac

SEQ ID NO: 743505 - RNA, 22 nt, Human
agugaguggacccugcaaggaa

SEQ ID NO: 743506 - RNA, 22 nt, Human
caaagcaagggcugaagacucc

SEQ ID NO: 743507 - RNA, 22 nt, Human
aggcaggagcaagcccuacaag

SEQ ID NO: 743508 - RNA, 18 nt, Human
agcaacagaaacauaugg

SEQ ID NO: 743509 - RNA, 22 nt, Human
ucucuccuaauuucaggugcuu

SEQ ID NO: 743510 - RNA, 21 nt, Human
uggccagcugcucgucuccuc

SEQ ID NO: 743511 - RNA, 22 nt, Human
agacuccaaaugaaagaggggg

SEQ ID NO: 743512 - RNA, 22 nt, Human
uggauaaaaugacauuaccuga

SEQ ID NO: 743513 - RNA, 22 nt, Human
ugggaggaucucuugaggccag

SEQ ID NO: 743514 - RNA, 22 nt, Human
cagagccccccuucugaucaca

SEQ ID NO: 743515 - RNA, 21 nt, Human
agacaacugugacuauucccu

SEQ ID NO: 743516 - RNA, 22 nt, Human
cagucucagaggugggaguggg

SEQ ID NO: 743517 - RNA, 22 nt, Human
augucccagacacuuuaucuua

SEQ ID NO: 743518 - RNA, 22 nt, Human
aguucacauaucuguuuuauuu

SEQ ID NO: 743519 - RNA, 22 nt, Human
gcagacuguaccuggaagaggg

SEQ ID NO: 743520 - RNA, 22 nt, Human
aguaaacauaauuuaccuguag

SEQ ID NO: 743521 - RNA, 22 nt, Human
agccagcuguguggucaggcaa

SEQ ID NO: 743522 - RNA, 22 nt, Human
gcugaggugucaccuugcuggg

SEQ ID NO: 743523 - RNA, 22 nt, Human
cucguugcugaagccaaaguca

SEQ ID NO: 743524 - RNA, 22 nt, Human
uuuacaucucaccagauucaua

SEQ ID NO: 743525 - RNA, 22 nt, Human
acccagcccagaaucuggggcc

SEQ ID NO: 743526 - RNA, 22 nt, Human
gagggcuccacacgggcccagc

SEQ ID NO: 743527 - RNA, 22 nt, Human
gggaucuggaauuuugguaugu

SEQ ID NO: 743528 - RNA, 20 nt, Human
uaggaaauauguuuuuaccc

SEQ ID NO: 743529 - RNA, 21 nt, Human
caggcucugcugggugcuggg

SEQ ID NO: 743530 - RNA, 22 nt, Human
ugaguuuugucuugcuagaagu

SEQ ID NO: 743531 - RNA, 22 nt, Human
uccuucuccuccuugagugaca

SEQ ID NO: 743532 - RNA, 22 nt, Human
aagcaucucuauguggagagug

SEQ ID NO: 743533 - RNA, 22 nt, Human
aguggucugccugccucagccu

SEQ ID NO: 743534 - RNA, 22 nt, Human
ggagcugagguaacagugagug

SEQ ID NO: 743535 - RNA, 22 nt, Human
uaccagcuuccuucaagaugug

SEQ ID NO: 743536 - RNA, 22 nt, Human
cucccaggggagucaucugcuu

SEQ ID NO: 743537 - RNA, 22 nt, Human
caguuaaaggcccaauaucugg

SEQ ID NO: 743538 - RNA, 22 nt, Human
gaguccaguucuuuccagcagu

SEQ ID NO: 743539 - RNA, 22 nt, Human
augcuguccacucuugguguuu

SEQ ID NO: 743540 - RNA, 23 nt, Human
ucucuggccuuugaucagguuga

SEQ ID NO: 743541 - RNA, 22 nt, Human
uguaugcagcaaaacaauuagu

SEQ ID NO: 743542 - RNA, 21 nt, Human
ugggaccuagcuuugcacagg

SEQ ID NO: 743543 - RNA, 23 nt, Human
uuucacaaugagcauuacagaau

SEQ ID NO: 743544 - RNA, 22 nt, Human
uuuguagcagcaugauuuauaa

SEQ ID NO: 743545 - RNA, 22 nt, Human
cugacuucagggauaaaaagua

SEQ ID NO: 743546 - RNA, 22 nt, Human
augcauugcugcuuucaaaaca

SEQ ID NO: 743547 - RNA, 22 nt, Human
gaggagggccuggugucccuuc

SEQ ID NO: 743548 - RNA, 22 nt, Human
cuccagauguauacuuuccaag

SEQ ID NO: 743549 - RNA, 22 nt, Human
cagcacagggacaauagcagau

SEQ ID NO: 743550 - RNA, 22 nt, Human
ucuuugcagaauuuaacuuugc

SEQ ID NO: 743551 - RNA, 16 nt, Human
gugcaaaagugaggag

SEQ ID NO: 743552 - RNA, 22 nt, Human
agugggcccuugucacacugau

SEQ ID NO: 743553 - RNA, 22 nt, Human
aagagacuuguccgaaguugua

SEQ ID NO: 743554 - RNA, 22 nt, Human
agacuggauagcuuuggacuug

SEQ ID NO: 743555 - RNA, 22 nt, Human
ucuuuggggcaucugggagauu

SEQ ID NO: 743556 - RNA, 23 nt, Human
uggagcugggcucagacccuggg

SEQ ID NO: 743557 - RNA, 22 nt, Human
auuaacuuuugaucaguguggu

SEQ ID NO: 743558 - RNA, 22 nt, Human
cauaauccuugauucaaauaau

SEQ ID NO: 743559 - RNA, 22 nt, Human
ugcuucaaguugaaauauucuu

SEQ ID NO: 743560 - RNA, 19 nt, Human
agaggcugucaccuguagc

SEQ ID NO: 743561 - RNA, 22 nt, Human
ugaaugauaugugaaaaggaac

SEQ ID NO: 743562 - RNA, 22 nt, Human
cucccaagcugugcugaacugu

SEQ ID NO: 743563 - RNA, 22 nt, Human
augccaaauucucagccucuuu

SEQ ID NO: 743564 - RNA, 22 nt, Human
gggcagagacucagaaacagaa

SEQ ID NO: 743565 - RNA, 22 nt, Human
guuucucugucuguuacauugg

SEQ ID NO: 743566 - RNA, 22 nt, Human
acacauuccugcagacaugaug

SEQ ID NO: 743567 - RNA, 22 nt, Human
uuauugugaggaauaagugaga

SEQ ID NO: 743568 - RNA, 22 nt, Human
guggcugcuacagagcuggagg

SEQ ID NO: 743569 - RNA, 22 nt, Human
uauucaucuucauagucacagu

SEQ ID NO: 743570 - RNA, 22 nt, Human
aagccagggucaggggccuccu

SEQ ID NO: 743571 - RNA, 22 nt, Human
aagugaaauugccauucuuaua

SEQ ID NO: 743572 - RNA, 19 nt, Human
accucugcagagauguuua

SEQ ID NO: 743573 - RNA, 22 nt, Human
auuuugaugcuaucuaaugaau

SEQ ID NO: 743574 - RNA, 22 nt, Human
ggauccuucuuugaccucacag

SEQ ID NO: 743575 - RNA, 22 nt, Human
ugauugaacugagcuucaagau

SEQ ID NO: 743576 - RNA, 22 nt, Human
acaaaggacugaaacuggcugu

SEQ ID NO: 743577 - RNA, 22 nt, Human
auggcugugaaggucacacccu

SEQ ID NO: 743578 - RNA, 22 nt, Human
aaucucacucaaagaauucucu

SEQ ID NO: 743579 - RNA, 22 nt, Human
uaugugcaguuugcucuuaaca

SEQ ID NO: 743580 - RNA, 22 nt, Human
aaagcacaggagaguucaguaa

SEQ ID NO: 743581 - RNA, 20 nt, Human
ggagaugcagcccaggugcc

SEQ ID NO: 743582 - RNA, 22 nt, Human
cugggagauugaggccauggug

SEQ ID NO: 743583 - RNA, 22 nt, Human
auggcuggauuugauccauggg

SEQ ID NO: 743584 - RNA, 22 nt, Human
aacaauguccugugagaugaua

SEQ ID NO: 743585 - RNA, 22 nt, Human
cccuguuuuaaguugauauuga

SEQ ID NO: 743586 - RNA, 22 nt, Human
gcauuucauguaagucagacca

SEQ ID NO: 743587 - RNA, 22 nt, Human
cugcuguguggauucaauggcu

SEQ ID NO: 743588 - RNA, 22 nt, Human
gagugaggcuggaaucauggcu

SEQ ID NO: 743589 - RNA, 22 nt, Human
ggcucugguggcaauugacugg

SEQ ID NO: 743590 - RNA, 22 nt, Human
auuuucaaaacaucugcugugu

SEQ ID NO: 743591 - RNA, 22 nt, Human
cuggccagguuuugaacaguug

SEQ ID NO: 743592 - RNA, 22 nt, Human
augaggcagucuggccugaggg

SEQ ID NO: 743593 - RNA, 22 nt, Human
uccaggccccccacgcuaaugg

SEQ ID NO: 743594 - RNA, 22 nt, Human
caguauguuuauuagaacugca

SEQ ID NO: 743595 - RNA, 22 nt, Human
uuuuauguuccucuuuaugcga

SEQ ID NO: 743596 - RNA, 22 nt, Human
gccagcuggcugcaggucccag

SEQ ID NO: 743597 - RNA, 22 nt, Human
ccuaggcuggcugucuucaggu

SEQ ID NO: 743598 - RNA, 22 nt, Human
uggauggagacugauaugggua

SEQ ID NO: 743599 - RNA, 22 nt, Human
uaaaucaagaauaucagcuugu

SEQ ID NO: 743600 - RNA, 22 nt, Human
augaguucaauuguuucaguca

SEQ ID NO: 743601 - RNA, 23 nt, Human
uggacaggguaacuggugguuuu

SEQ ID NO: 743602 - RNA, 20 nt, Human
uggccucuguagaggccaag

SEQ ID NO: 743603 - RNA, 21 nt, Human
cugugggaccaagcacuggga

SEQ ID NO: 743604 - RNA, 22 nt, Human
agacagaaauaggagaaaccag

SEQ ID NO: 743605 - RNA, 17 nt, Human
uaaagccagucaaguca

SEQ ID NO: 743606 - RNA, 22 nt, Human
gaggggaaagugugaggcugcg

SEQ ID NO: 743607 - RNA, 22 nt, Human
aucacauuauguagugaaaagg

SEQ ID NO: 743608 - RNA, 22 nt, Human
cuauuauuagcaaaagguggau

SEQ ID NO: 743609 - RNA, 22 nt, Human
ucugccuguucaagucuucuag

SEQ ID NO: 743610 - RNA, 21 nt, Human
ccugggcugugguuuggagac

SEQ ID NO: 743611 - RNA, 22 nt, Human
ggaagaaagacauuuauuuuga

SEQ ID NO: 743612 - RNA, 22 nt, Human
aguguugucaaacggcucagca

SEQ ID NO: 743613 - RNA, 22 nt, Human
uucagcacuuuguuuugcucau

SEQ ID NO: 743614 - RNA, 22 nt, Human
aaguuuaagguggaaguggugg

SEQ ID NO: 743615 - RNA, 22 nt, Human
ucaggcagcauuaaacuucagc

SEQ ID NO: 743616 - RNA, 22 nt, Human
agccuccaaaugucaggucccg

SEQ ID NO: 743617 - RNA, 22 nt, Human
agguuccaagaaaucaucagug

SEQ ID NO: 743618 - RNA, 22 nt, Human
auuuaauuuauagauguggaua

SEQ ID NO: 743619 - RNA, 22 nt, Human
gggagccaugcuggucuucuuu

SEQ ID NO: 743620 - RNA, 23 nt, Human
uggaggaaacacaucagaagacc

SEQ ID NO: 743621 - RNA, 22 nt, Human
ccugccugucuuuauccccugu

SEQ ID NO: 743622 - RNA, 22 nt, Human
ccagagaauccggagaguccau

SEQ ID NO: 743623 - RNA, 22 nt, Human
ggcuuuaugcagggauagaaau

SEQ ID NO: 743624 - RNA, 22 nt, Human
uccaggagguuuggaggaagca

SEQ ID NO: 743625 - RNA, 22 nt, Human
ccuggcugugugaccuuggcaa

SEQ ID NO: 743626 - RNA, 22 nt, Human
aagucucuuuucuuccuguauu

SEQ ID NO: 743627 - RNA, 22 nt, Human
acagugugcaagaaauggggga

SEQ ID NO: 743628 - RNA, 22 nt, Human
ggucaggauccaagucugugcu

SEQ ID NO: 743629 - RNA, 22 nt, Human
aggcuucaccugcaccugagcu

SEQ ID NO: 743630 - RNA, 22 nt, Human
augcaaaagacuauuuguugcu

SEQ ID NO: 743631 - RNA, 21 nt, Human
aaggaaaagcuuggucucuga

SEQ ID NO: 743632 - RNA, 22 nt, Human
ccugugagucaaccccuccuug

SEQ ID NO: 743633 - RNA, 22 nt, Human
agcagagacaugaaauaugcuu

SEQ ID NO: 743634 - RNA, 22 nt, Human
uucagacugcuggugcuucccu

SEQ ID NO: 743635 - RNA, 22 nt, Human
aagcugggacuuagcgcagaua

SEQ ID NO: 743636 - RNA, 22 nt, Human
ugcuuagacgucaaguacagcc

SEQ ID NO: 743637 - RNA, 22 nt, Human
cuguggcauugugaggacugca

SEQ ID NO: 743638 - RNA, 22 nt, Human
cugaggccccucucuugagcuu

SEQ ID NO: 743639 - RNA, 22 nt, Human
agcugucucugguauuauguga

SEQ ID NO: 743640 - RNA, 22 nt, Human
aaugaacacagcccucuacuuu

SEQ ID NO: 743641 - RNA, 22 nt, Human
cuuggucuagugagugagcaua

SEQ ID NO: 743642 - RNA, 19 nt, Human
uccaccccagccagcucug

SEQ ID NO: 743643 - RNA, 22 nt, Human
uuggaucacucugaagccuuac

SEQ ID NO: 743644 - RNA, 22 nt, Human
aaacuagaugauuaugaagcau

SEQ ID NO: 743645 - RNA, 22 nt, Human
uuaaagagucuacugcacaucc

SEQ ID NO: 743646 - RNA, 22 nt, Human
ugaugucugccaggguccuggg

SEQ ID NO: 743647 - RNA, 22 nt, Human
gcucuguggcauucaugggcag

SEQ ID NO: 743648 - RNA, 22 nt, Human
uggggccagagauggggcgcag

SEQ ID NO: 743649 - RNA, 22 nt, Human
ugcuccuguuucaucagcuaua

SEQ ID NO: 743650 - RNA, 22 nt, Human
gagaugagugggggaucucuca

SEQ ID NO: 743651 - RNA, 22 nt, Human
gcagccucugcaguucaggagg

SEQ ID NO: 743652 - RNA, 22 nt, Human
uucuuuuaauugugggggagug

SEQ ID NO: 743653 - RNA, 22 nt, Human
augcuuaacucuguacauaguu

SEQ ID NO: 743654 - RNA, 22 nt, Human
cauuuugugcacacguggaguu

SEQ ID NO: 743655 - RNA, 22 nt, Human
acucuggcugccuugugagcau

SEQ ID NO: 743656 - RNA, 22 nt, Human
gacccagugacucgucucugug

SEQ ID NO: 743657 - RNA, 22 nt, Human
cauuuacauaacaguaacgcug

SEQ ID NO: 743658 - RNA, 22 nt, Human
uuuaccaguguuaaacaccagc

SEQ ID NO: 743659 - RNA, 22 nt, Human
uggccagguguggguucucaga

SEQ ID NO: 743660 - RNA, 22 nt, Human
gaaaaaugagcugaugucaggg

SEQ ID NO: 743661 - RNA, 22 nt, Human
uaccauuucuacauaucuuguc

SEQ ID NO: 743662 - RNA, 22 nt, Human
acaaaugugauuguuucugaaa

SEQ ID NO: 743663 - RNA, 22 nt, Human
cagcagugaugugugaggguuc

SEQ ID NO: 743664 - RNA, 22 nt, Human
uggauuaguuaagaaauguuag

SEQ ID NO: 743665 - RNA, 23 nt, Human
ugguggggucuuggagacagcac

SEQ ID NO: 743666 - RNA, 22 nt, Human
aaaccuuugugugucugugccu

SEQ ID NO: 743667 - RNA, 22 nt, Human
ugcaugcacuuggcuggcacgu

SEQ ID NO: 743668 - RNA, 22 nt, Human
uggucugauggucccaccaccg

SEQ ID NO: 743669 - RNA, 21 nt, Human
ugcuuugcagguggauuuagu

SEQ ID NO: 743670 - RNA, 22 nt, Human
ggccagggccuggggacugucc

SEQ ID NO: 743671 - RNA, 18 nt, Human
ucaggaguuuguggaugg

SEQ ID NO: 743672 - RNA, 22 nt, Human
ggugccuguauuuggggcacag

SEQ ID NO: 743673 - RNA, 22 nt, Human
ucucugagcccagugucccccu

SEQ ID NO: 743674 - RNA, 22 nt, Human
ucaaaagucugcauucuucaca

SEQ ID NO: 743675 - RNA, 22 nt, Human
agagccuggaccugggcucuga

SEQ ID NO: 743676 - RNA, 22 nt, Human
cagcccagcgcaaacaacuggc

SEQ ID NO: 743677 - RNA, 19 nt, Human
cuccuucccugguuucugu

SEQ ID NO: 743678 - RNA, 22 nt, Human
ggggccgaccgcgguucaggcc

SEQ ID NO: 743679 - RNA, 22 nt, Human
gggagcugagaaacaacauucu

SEQ ID NO: 743680 - RNA, 22 nt, Human
auacauagcagagucaauuaau

SEQ ID NO: 743681 - RNA, 22 nt, Human
agucagagaauaaagaaugcau

SEQ ID NO: 743682 - RNA, 22 nt, Human
uaugaagcucucacuguguguc

SEQ ID NO: 743683 - RNA, 22 nt, Human
caguuucucucauacauauuug

SEQ ID NO: 743684 - RNA, 22 nt, Human
gcauccaugcaugcagggugug

SEQ ID NO: 743685 - RNA, 22 nt, Human
caugaguucaucugcuucucuu

SEQ ID NO: 743686 - RNA, 22 nt, Human
uccauacacauugaauuuuagu

SEQ ID NO: 743687 - RNA, 22 nt, Human
uucucuguaguugccuggugga

SEQ ID NO: 743688 - RNA, 22 nt, Human
cuuuggcaaugucauuuucaau

SEQ ID NO: 743689 - RNA, 22 nt, Human
aguguagacauaggucuggucu

SEQ ID NO: 743690 - RNA, 22 nt, Human
guuuuacaaaugacggcauuca

SEQ ID NO: 743691 - RNA, 20 nt, Human
guaaaauauggucuuugggu

SEQ ID NO: 743692 - RNA, 22 nt, Human
guggggcaugcacgcugcuccu

SEQ ID NO: 743693 - RNA, 22 nt, Human
cuggcuccuccaaggccuggag

SEQ ID NO: 743694 - RNA, 22 nt, Human
uuuauucacuucagugccaaag

SEQ ID NO: 743695 - RNA, 23 nt, Human
ugcugugccuuugucugccucca

SEQ ID NO: 743696 - RNA, 22 nt, Human
cuuauuuccugacauggaaaga

SEQ ID NO: 743697 - RNA, 19 nt, Human
uggcugagcuggacugagg

SEQ ID NO: 743698 - RNA, 19 nt, Human
gcucuaaaagauuuugaag

SEQ ID NO: 743699 - RNA, 22 nt, Human
cagacacagauaugcauauggc

SEQ ID NO: 743700 - RNA, 22 nt, Human
auuguuucugcuuuauuuaggg

SEQ ID NO: 743701 - RNA, 22 nt, Human
uggacaggauagugcaguacgc

SEQ ID NO: 743702 - RNA, 21 nt, Human
guccuucauuaucaagucaaa

SEQ ID NO: 743703 - RNA, 22 nt, Human
ccuguaaguaguuugccugagc

SEQ ID NO: 743704 - RNA, 20 nt, Human
uuuagcaaaagggacugcuc

SEQ ID NO: 743705 - RNA, 22 nt, Human
uucacauuagugguucuauaua

SEQ ID NO: 743706 - RNA, 22 nt, Human
guccuauuagcauauugaauac

SEQ ID NO: 743707 - RNA, 22 nt, Human
agauaagauaguccagcacaau

SEQ ID NO: 743708 - RNA, 22 nt, Human
gugcuucucuucacacccaacu

SEQ ID NO: 743709 - RNA, 22 nt, Human
gcugggcaugugaccaacagaa

SEQ ID NO: 743710 - RNA, 22 nt, Human
uggcaggcauccggcaccuucu

SEQ ID NO: 743711 - RNA, 20 nt, Human
uugagcuuuuaguacagaca

SEQ ID NO: 743712 - RNA, 18 nt, Human
cuugcugagggccucauu

SEQ ID NO: 743713 - RNA, 22 nt, Human
ucccaucacuagcaucugcacc

SEQ ID NO: 743714 - RNA, 23 nt, Human
gcauccagagcucaguccccuuu

SEQ ID NO: 743715 - RNA, 22 nt, Human
aucuuuguugcucucauuucug

SEQ ID NO: 743716 - RNA, 22 nt, Human
ggaggugggcuaaggacucucu

SEQ ID NO: 743717 - RNA, 18 nt, Human
ugaggcugaggguagagg

SEQ ID NO: 743718 - RNA, 22 nt, Human
agggauggaucuuggcccugga

SEQ ID NO: 743719 - RNA, 22 nt, Human
caccagcuuacagucucacccc

SEQ ID NO: 743720 - RNA, 22 nt, Human
gccucccuccaccacugcaggu

SEQ ID NO: 743721 - RNA, 22 nt, Human
auaugcuugacucuuucacauc

SEQ ID NO: 743722 - RNA, 20 nt, Human
uucuagcauacuuacaagga

SEQ ID NO: 743723 - RNA, 22 nt, Human
ggcagggguucauuuugucuua

SEQ ID NO: 743724 - RNA, 23 nt, Human
ugaggagcauagcugacugacag

SEQ ID NO: 743725 - RNA, 20 nt, Human
aucaccuguagguucuuugu

SEQ ID NO: 743726 - RNA, 20 nt, Human
auuauucauacaugugugac

SEQ ID NO: 743727 - RNA, 22 nt, Human
ggaagaaaguagaaaaccgugg

SEQ ID NO: 743728 - RNA, 22 nt, Human
ucuguuuauauuucaaaccuuc

SEQ ID NO: 743729 - RNA, 22 nt, Human
acuaaaacaguggcuaguagac

SEQ ID NO: 743730 - RNA, 23 nt, Human
aggcgagcucuucuccagcacgu

SEQ ID NO: 743731 - RNA, 22 nt, Human
uccucacaagcauccugucuca

SEQ ID NO: 743732 - RNA, 22 nt, Human
ggcaguggcuguagucucuugg

SEQ ID NO: 743733 - RNA, 22 nt, Human
ugacauucuguuaagucucaua

SEQ ID NO: 743734 - RNA, 22 nt, Human
cagaauuucagugauguuuucu

SEQ ID NO: 743735 - RNA, 22 nt, Human
gggaaaggaucagugggaggcu

SEQ ID NO: 743736 - RNA, 22 nt, Human
acuaacuugcugagugaccaug

SEQ ID NO: 743737 - RNA, 22 nt, Human
gguggcaucucaguucaugggc

SEQ ID NO: 743738 - RNA, 22 nt, Human
aaaugucuaucuggcauauucc

SEQ ID NO: 743739 - RNA, 22 nt, Human
caggaaguggcugggcuggguu

SEQ ID NO: 743740 - RNA, 22 nt, Human
acucaggaaaaauguagugaua

SEQ ID NO: 743741 - RNA, 23 nt, Human
agcagccagagauccucggcccu

SEQ ID NO: 743742 - RNA, 22 nt, Human
ucacacuucaaaggguuagauc

SEQ ID NO: 743743 - RNA, 22 nt, Human
agcagggcuggggcacgagcca

SEQ ID NO: 743744 - RNA, 22 nt, Human
gggcuucuagaccagcagugag

SEQ ID NO: 743745 - RNA, 22 nt, Human
gauuauggagaaauaauuagaa

SEQ ID NO: 743746 - RNA, 22 nt, Human
aaguggacuaauacaaggacua

SEQ ID NO: 743747 - RNA, 22 nt, Human
agagcugggugguggugacuca

SEQ ID NO: 743748 - RNA, 22 nt, Human
ccuuccagauguaagagcugau

SEQ ID NO: 743749 - RNA, 21 nt, Human
gagcccaggcaucucauuaau

SEQ ID NO: 743750 - RNA, 22 nt, Human
cugagccaaccacagcaggagc

SEQ ID NO: 743751 - RNA, 22 nt, Human
aggauucauggugcagacaaag

SEQ ID NO: 743752 - RNA, 22 nt, Human
cuauuuggccaagcugcccaca

SEQ ID NO: 743753 - RNA, 22 nt, Human
uguguuuuaaauggaaauuuga

SEQ ID NO: 743754 - RNA, 22 nt, Human
agcaacagcaacgacauuucuc

SEQ ID NO: 743755 - RNA, 22 nt, Human
uccagagccugggguuuguaac

SEQ ID NO: 743756 - RNA, 22 nt, Human
ucagcaucucaaccuucucuac

SEQ ID NO: 743757 - RNA, 22 nt, Human
ugcagggcuccuggcuccaauc

SEQ ID NO: 743758 - RNA, 21 nt, Human
cccucaggaaacagaaugcac

SEQ ID NO: 743759 - RNA, 22 nt, Human
aagcugaaucugaaauagaauu

SEQ ID NO: 743760 - RNA, 22 nt, Human
ccacuguguccaccaggaaugc

SEQ ID NO: 743761 - RNA, 22 nt, Human
gcugccccccggacucggcggg

SEQ ID NO: 743762 - RNA, 22 nt, Human
uggggucuggaguugcccauga

SEQ ID NO: 743763 - RNA, 22 nt, Human
ucauaaaucauacuccauuugc

SEQ ID NO: 743764 - RNA, 22 nt, Human
ggugacagcgggucaagaggag

SEQ ID NO: 743765 - RNA, 18 nt, Human
gucuuuucucccuuccuc

SEQ ID NO: 743766 - RNA, 22 nt, Human
uccuggcucugcugccuccuag

SEQ ID NO: 743767 - RNA, 22 nt, Human
caggacauugauccauuggcac

SEQ ID NO: 743768 - RNA, 23 nt, Human
ugaguguggggacagugguuugc

SEQ ID NO: 743769 - RNA, 22 nt, Human
cagacaucuguacccagccugu

SEQ ID NO: 743770 - RNA, 22 nt, Human
gagcagagacaguacaacuggc

SEQ ID NO: 743771 - RNA, 22 nt, Human
gccaguggguaguuggagcugg

SEQ ID NO: 743772 - RNA, 22 nt, Human
ucagauuucagcuaaagggaug

SEQ ID NO: 743773 - RNA, 22 nt, Human
gccucugcggggcccgagcccg

SEQ ID NO: 743774 - RNA, 20 nt, Human
cagagacccaggcuucagcu

SEQ ID NO: 743775 - RNA, 23 nt, Human
gcaugaagugcuacgucuacagc

SEQ ID NO: 743776 - RNA, 22 nt, Human
aagauucucccugagauauuua

SEQ ID NO: 743777 - RNA, 22 nt, Human
gcugucugacuccaaguuggag

SEQ ID NO: 743778 - RNA, 22 nt, Human
auacaugcgccauguuggugug

SEQ ID NO: 743779 - RNA, 22 nt, Human
guucaugcuacccuuuccuaau

SEQ ID NO: 743780 - RNA, 22 nt, Human
uccagggcuacaaggcaccaga

SEQ ID NO: 743781 - RNA, 22 nt, Human
cuucuuggaagucguccuucca

SEQ ID NO: 743782 - RNA, 22 nt, Human
uacagagaauaauaggacaggu

SEQ ID NO: 743783 - RNA, 22 nt, Human
cuuacaguguugagggaauuaa

SEQ ID NO: 743784 - RNA, 22 nt, Human
uucacaggauagcuauugcacg

SEQ ID NO: 743785 - RNA, 22 nt, Human
auugcuuuuagugaaauuauau

SEQ ID NO: 743786 - RNA, 22 nt, Human
cuuggcccaguugccaaggaaa

SEQ ID NO: 743787 - RNA, 22 nt, Human
aucaagagaaggggaagaugaa

SEQ ID NO: 743788 - RNA, 22 nt, Human
acaggcugauagaccauaaaua

SEQ ID NO: 743789 - RNA, 22 nt, Human
auucaagguuggcucaggaauu

SEQ ID NO: 743790 - RNA, 22 nt, Human
cuggcagccaagugggauacuc

SEQ ID NO: 743791 - RNA, 22 nt, Human
ucccucaggacccaacuuguaa

SEQ ID NO: 743792 - RNA, 22 nt, Human
ggaacacuggcucaauuauauc

SEQ ID NO: 743793 - RNA, 22 nt, Human
cuuuucuuguauuggaugcccc

SEQ ID NO: 743794 - RNA, 22 nt, Human
ugugucuuacauaauuacaugu

SEQ ID NO: 743795 - RNA, 22 nt, Human
gagguggauguugcagugagcu

SEQ ID NO: 743796 - RNA, 22 nt, Human
augccagcuauagacuuguuau

SEQ ID NO: 743797 - RNA, 22 nt, Human
cagggagcaggcucuguccauc

SEQ ID NO: 743798 - RNA, 22 nt, Human
cugggccacuuccucaggggaa

SEQ ID NO: 743799 - RNA, 22 nt, Human
aagaaaacaaugacuugccagc

SEQ ID NO: 743800 - RNA, 22 nt, Human
gcgaaaaauguguaaauauguu

SEQ ID NO: 743801 - RNA, 20 nt, Human
caaggcagaccagagugagu

SEQ ID NO: 743802 - RNA, 22 nt, Human
ugcuauaaguagacauucaaca

SEQ ID NO: 743803 - RNA, 22 nt, Human
agcaguugagugggaaucaggc

SEQ ID NO: 743804 - RNA, 22 nt, Human
aggcugugaucucaugauuugu

SEQ ID NO: 743805 - RNA, 19 nt, Human
agugaacuccauaucaggu

SEQ ID NO: 743806 - RNA, 22 nt, Human
ucagcucugccuguggaggcac

SEQ ID NO: 743807 - RNA, 22 nt, Human
aggaggaggcuggaguacaccc

SEQ ID NO: 743808 - RNA, 22 nt, Human
uggcauguggcuuugagucauc

SEQ ID NO: 743809 - RNA, 22 nt, Human
uauuacaaauuauaaugggaga

SEQ ID NO: 743810 - RNA, 22 nt, Human
acucuguguuuugguggcagca

SEQ ID NO: 743811 - RNA, 22 nt, Human
uuuagcuucaguucuagcuucu

SEQ ID NO: 743812 - RNA, 22 nt, Human
ugucugccaaagcuuccuccug

SEQ ID NO: 743813 - RNA, 22 nt, Human
cugcagguuaggagcacuccuu

SEQ ID NO: 743814 - RNA, 17 nt, Human
uguuaauuccaaugaua

SEQ ID NO: 743815 - RNA, 22 nt, Human
ucaguccugaugacaggcccaa

SEQ ID NO: 743816 - RNA, 22 nt, Human
cagucucuugcuucauuaguug

SEQ ID NO: 743817 - RNA, 22 nt, Human
acaucucaaauuccaggcucca

SEQ ID NO: 743818 - RNA, 22 nt, Human
ccaugugcuugcucuggcaccu

SEQ ID NO: 743819 - RNA, 22 nt, Human
ccugaguagcuggaauuaaagg

SEQ ID NO: 743820 - RNA, 22 nt, Human
ugagcccugaccuagccuggcc

SEQ ID NO: 743821 - RNA, 22 nt, Human
agccaaggacacggagccuccu

SEQ ID NO: 743822 - RNA, 22 nt, Human
ggcacagcgacuaccaucgaaa

SEQ ID NO: 743823 - RNA, 22 nt, Human
agccuggcacugaggcagggcg

SEQ ID NO: 743824 - RNA, 22 nt, Human
acacagaggcuccagagauaga

SEQ ID NO: 743825 - RNA, 22 nt, Human
ccccuuccaggaagcagaaucg

SEQ ID NO: 743826 - RNA, 22 nt, Human
uucuucucagggucccacaugg

SEQ ID NO: 743827 - RNA, 22 nt, Human
agcaccugcuuaaugugcagug

SEQ ID NO: 743828 - RNA, 22 nt, Human
ucuuacaagaaauaagccaaug

SEQ ID NO: 743829 - RNA, 22 nt, Human
aagucagaauaauguuucuuuu

SEQ ID NO: 743830 - RNA, 22 nt, Human
uagggggcuuugcugcuugaca

SEQ ID NO: 743831 - RNA, 22 nt, Human
guuacaaauguaaauucugggg

SEQ ID NO: 743832 - RNA, 22 nt, Human
uaagaguaagugauuaagaaga

SEQ ID NO: 743833 - RNA, 22 nt, Human
uccucuggcccagcugccucug

SEQ ID NO: 743834 - RNA, 22 nt, Human
ucacacacauggauaguauuuu

SEQ ID NO: 743835 - RNA, 22 nt, Human
agucacaguuccuacccaguaa

SEQ ID NO: 743836 - RNA, 21 nt, Human
ucucuguguucaaggugccag

SEQ ID NO: 743837 - RNA, 22 nt, Human
uccaggcaucuguauuuuuuaa

SEQ ID NO: 743838 - RNA, 22 nt, Human
gaaggagaggauugugaggcug

SEQ ID NO: 743839 - RNA, 22 nt, Human
guuucuuaauagcaggggccaa

SEQ ID NO: 743840 - RNA, 22 nt, Human
aaaucguuauaauguuaagccu

SEQ ID NO: 743841 - RNA, 22 nt, Human
uucuugaguaucugcacagugc

SEQ ID NO: 743842 - RNA, 22 nt, Human
ugccugccucuggcagcccugc

SEQ ID NO: 743843 - RNA, 22 nt, Human
cagcugccuaugaccuagccuc

SEQ ID NO: 743844 - RNA, 22 nt, Human
uuucagacauagccugauucug

SEQ ID NO: 743845 - RNA, 22 nt, Human
gucuuuuuauuauagaguggag

SEQ ID NO: 743846 - RNA, 22 nt, Human
ucacauaaauuauacaauuuca

SEQ ID NO: 743847 - RNA, 23 nt, Human
uuucacagcuuuuauucugcauc

SEQ ID NO: 743848 - RNA, 22 nt, Human
gagguucagcugcugccuggua

SEQ ID NO: 743849 - RNA, 22 nt, Human
cagaaaauaaaguuucuacgca

SEQ ID NO: 743850 - RNA, 22 nt, Human
agcaccuggucuccuggcgcug

SEQ ID NO: 743851 - RNA, 22 nt, Human
ugccaaguggagcucaggaauc

SEQ ID NO: 743852 - RNA, 22 nt, Human
gacuuuauuacuaacccuguga

SEQ ID NO: 743853 - RNA, 22 nt, Human
guguuuauuuagaguaggccau

SEQ ID NO: 743854 - RNA, 18 nt, Human
cccacccuggcucuuagu

SEQ ID NO: 743855 - RNA, 22 nt, Human
cccagguguuuguggcagaggu

SEQ ID NO: 743856 - RNA, 22 nt, Human
augcaacagucaguacauccgg

SEQ ID NO: 743857 - RNA, 22 nt, Human
gugcauuggugcgccacuucac

SEQ ID NO: 743858 - RNA, 22 nt, Human
gcagacagaagcuaaguagaca

SEQ ID NO: 743859 - RNA, 22 nt, Human
cugggccuucauugcucuccca

SEQ ID NO: 743860 - RNA, 22 nt, Human
gaacaggguugggugagagagg

SEQ ID NO: 743861 - RNA, 22 nt, Human
agcaggugacagggcuguggug

SEQ ID NO: 743862 - RNA, 22 nt, Human
cagugacguaaacugcaugugc

SEQ ID NO: 743863 - RNA, 22 nt, Human
uggcucagaagaaaagguaaac

SEQ ID NO: 743864 - RNA, 22 nt, Human
aauggcuuuuaaaaauagcauu

SEQ ID NO: 743865 - RNA, 22 nt, Human
ucacagcauucgcaauggacag

SEQ ID NO: 743866 - RNA, 20 nt, Human
gcacccagcuucuuguucua

SEQ ID NO: 743867 - RNA, 22 nt, Human
guuggcuaugagagcuuuagug

SEQ ID NO: 743868 - RNA, 22 nt, Human
ucuggcugaagcuuuugcagcu

SEQ ID NO: 743869 - RNA, 22 nt, Human
gcugucugucuucacaucucgc

SEQ ID NO: 743870 - RNA, 20 nt, Human
gccucuggagccaaggacca

SEQ ID NO: 743871 - RNA, 18 nt, Human
uguuaaaugaagauuugc

SEQ ID NO: 743872 - RNA, 22 nt, Human
ucaguggaacugucugggugag

SEQ ID NO: 743873 - RNA, 21 nt, Human
auuacaucccuggugauacau

SEQ ID NO: 743874 - RNA, 19 nt, Human
cugugggugugcaagggug

SEQ ID NO: 743875 - RNA, 20 nt, Human
uaauuugauaucuauaaguu

SEQ ID NO: 743876 - RNA, 22 nt, Human
uccugccacugcacauauacuu

SEQ ID NO: 743877 - RNA, 22 nt, Human
aguuuauucugcuuggcccucc

SEQ ID NO: 743878 - RNA, 22 nt, Human
uuucugauauacuguagaaucc

SEQ ID NO: 743879 - RNA, 23 nt, Human
agggaagaaacaugaagggcugu

SEQ ID NO: 743880 - RNA, 22 nt, Human
agaaguuguagguuugcauauu

SEQ ID NO: 743881 - RNA, 22 nt, Human
agaggcugggaaggguccccgg

SEQ ID NO: 743882 - RNA, 22 nt, Human
aggguccaguaacagaugccag

SEQ ID NO: 743883 - RNA, 22 nt, Human
uagaggcacccuggaggagacu

SEQ ID NO: 743884 - RNA, 22 nt, Human
ugacacaguaucaaacaugauu

SEQ ID NO: 743885 - RNA, 19 nt, Human
uaugacaaguacuaguucu

SEQ ID NO: 743886 - RNA, 22 nt, Human
cugaagauuuuugguaaucaug

SEQ ID NO: 743887 - RNA, 22 nt, Human
uccugaaauucugguugucacu

SEQ ID NO: 743888 - RNA, 22 nt, Human
agggaaauggagaguguaguuu

SEQ ID NO: 743889 - RNA, 22 nt, Human
auugucucugaauuuccagcug

SEQ ID NO: 743890 - RNA, 22 nt, Human
gacaagacugguuuauuuaagg

SEQ ID NO: 743891 - RNA, 22 nt, Human
aucugcuguucuucacagcuug

SEQ ID NO: 743892 - RNA, 22 nt, Human
uccaggcauuggagagauaaug

SEQ ID NO: 743893 - RNA, 22 nt, Human
gggcuguggagccgcgagggcu

SEQ ID NO: 743894 - RNA, 22 nt, Human
aaaguagucucuuucaucuuuu

SEQ ID NO: 743895 - RNA, 22 nt, Human
agcuuuaccugccuuggggcac

SEQ ID NO: 743896 - RNA, 22 nt, Human
uuagaacuuaagaauacugucu

SEQ ID NO: 743897 - RNA, 17 nt, Human
cguuagugauuccugcc

SEQ ID NO: 743898 - RNA, 22 nt, Human
uacuugcuggguguaauuuucu

SEQ ID NO: 743899 - RNA, 22 nt, Human
uagcuucugggaguguuuacua

SEQ ID NO: 743900 - RNA, 22 nt, Human
uggagguccugcaggauggcac

SEQ ID NO: 743901 - RNA, 22 nt, Human
cagugaaauaguggacaucaaa

SEQ ID NO: 743902 - RNA, 22 nt, Human
uucagaaggauuuuaacacaug

SEQ ID NO: 743903 - RNA, 22 nt, Human
ggcaugggccgaggugccuccu

SEQ ID NO: 743904 - RNA, 22 nt, Human
aagccaggaagagagccuucac

SEQ ID NO: 743905 - RNA, 22 nt, Human
ggcaggcauggggucugccauu

SEQ ID NO: 743906 - RNA, 22 nt, Human
ugugugaauggauuauucuauu

SEQ ID NO: 743907 - RNA, 22 nt, Human
gagggggcgugcaaggcuccgc

SEQ ID NO: 743908 - RNA, 21 nt, Human
gcaggcacucuagaggagcug

SEQ ID NO: 743909 - RNA, 22 nt, Human
acagagguuaggauggguugua

SEQ ID NO: 743910 - RNA, 22 nt, Human
ugcuucugcaacuugaauguac

SEQ ID NO: 743911 - RNA, 18 nt, Human
uccuucacagcaggaagg

SEQ ID NO: 743912 - RNA, 22 nt, Human
gacucugcuacaggccgagguu

SEQ ID NO: 743913 - RNA, 22 nt, Human
ggcuauauccucacaagaugga

SEQ ID NO: 743914 - RNA, 22 nt, Human
ugaagaacgugagauccagaaa

SEQ ID NO: 743915 - RNA, 22 nt, Human
uguguaaaaucugauuaauacu

SEQ ID NO: 743916 - RNA, 22 nt, Human
acagacauuuucuguauugccu

SEQ ID NO: 743917 - RNA, 22 nt, Human
ucaucauguuugauuuccacag

SEQ ID NO: 743918 - RNA, 22 nt, Human
ugcugguccccugcagccugug

SEQ ID NO: 743919 - RNA, 22 nt, Human
uggguccucuggagcagcagca

SEQ ID NO: 743920 - RNA, 22 nt, Human
cuagaaauauuuuacagucaag

SEQ ID NO: 743921 - RNA, 21 nt, Human
agccugggaggcggagguugc

SEQ ID NO: 743922 - RNA, 22 nt, Human
uggcuugguccuggcccuuccc

SEQ ID NO: 743923 - RNA, 22 nt, Human
agggcagcaauuugguuccugg

SEQ ID NO: 743924 - RNA, 22 nt, Human
guauacagauacuuagacgugc

SEQ ID NO: 743925 - RNA, 22 nt, Human
agaauaaaauagucugaagaug

SEQ ID NO: 743926 - RNA, 22 nt, Human
gcagccccaggagacgcccagg

SEQ ID NO: 743927 - RNA, 22 nt, Human
guggaaauaguuugguuauaga

SEQ ID NO: 743928 - RNA, 22 nt, Human
uggagcugaacuuugaggccag

SEQ ID NO: 743929 - RNA, 22 nt, Human
aggcacugacucaagggagcca

SEQ ID NO: 743930 - RNA, 22 nt, Human
aaggcaaugcuaagagguuugg

SEQ ID NO: 743931 - RNA, 22 nt, Human
gagcccuguagcaagucauguc

SEQ ID NO: 743932 - RNA, 22 nt, Human
gaagccugguucgcuggccacc

SEQ ID NO: 743933 - RNA, 22 nt, Human
cucuggaccucagcuacagacu

SEQ ID NO: 743934 - RNA, 22 nt, Human
cacaggaggaggugcccgggcc

SEQ ID NO: 743935 - RNA, 22 nt, Human
cugugcacuucucuuuauuugu

SEQ ID NO: 743936 - RNA, 22 nt, Human
uggaacacagugauugauagcg

SEQ ID NO: 743937 - RNA, 22 nt, Human
aucucuggccccugggguccga

SEQ ID NO: 743938 - RNA, 22 nt, Human
cugugccugccuuguucacuga

SEQ ID NO: 743939 - RNA, 22 nt, Human
guggcaacaaaagagccuagug

SEQ ID NO: 743940 - RNA, 22 nt, Human
ugcccugcggcuaucuagauga

SEQ ID NO: 743941 - RNA, 22 nt, Human
agaaugcaagauaaacuuuauu

SEQ ID NO: 743942 - RNA, 22 nt, Human
agcugagagcugugucaagaua

SEQ ID NO: 743943 - RNA, 22 nt, Human
gcugccucugcgacucugggcg

SEQ ID NO: 743944 - RNA, 22 nt, Human
gcauaggccacuagugccagga

SEQ ID NO: 743945 - RNA, 22 nt, Human
ggugcccagcgaaguggcugug

SEQ ID NO: 743946 - RNA, 22 nt, Human
cuggagcucuccagagccccgu

SEQ ID NO: 743947 - RNA, 22 nt, Human
cuguggcaagucugccugucac

SEQ ID NO: 743948 - RNA, 22 nt, Human
cuguguggccucaagccagccu

SEQ ID NO: 743949 - RNA, 22 nt, Human
caggaccugaagacaggcaggu

SEQ ID NO: 743950 - RNA, 22 nt, Human
ucucuguaagagaggcuuucau

SEQ ID NO: 743951 - RNA, 22 nt, Human
acauucaaggcagcacugagug

SEQ ID NO: 743952 - RNA, 22 nt, Human
accaggagccacaggaggagcc

SEQ ID NO: 743953 - RNA, 22 nt, Human
uugggcugaggagggcguggcc

SEQ ID NO: 743954 - RNA, 22 nt, Human
ucuggcuuuuauucaguuggca

SEQ ID NO: 743955 - RNA, 22 nt, Human
uggggacccggacuccuggguc

SEQ ID NO: 743956 - RNA, 22 nt, Human
auuccugcauuggucaacccau

SEQ ID NO: 743957 - RNA, 22 nt, Human
cuggugagacucagggaugcuu

SEQ ID NO: 743958 - RNA, 22 nt, Human
cugggagaggcugcuccgcucu

SEQ ID NO: 743959 - RNA, 22 nt, Human
uaagaugggggaaagaaauagu

SEQ ID NO: 743960 - RNA, 22 nt, Human
gagcugagaucauguacacuag

SEQ ID NO: 743961 - RNA, 22 nt, Human
auugcuuucuuuggggaacugu

SEQ ID NO: 743962 - RNA, 22 nt, Human
caaaucauggaauaacuagaga

SEQ ID NO: 743963 - RNA, 22 nt, Human
gggcagcagaggaucccuuaau

SEQ ID NO: 743964 - RNA, 22 nt, Human
ccucaggugugggccagcuguc

SEQ ID NO: 743965 - RNA, 22 nt, Human
gcugccuccacuggcucccagu

SEQ ID NO: 743966 - RNA, 22 nt, Human
uucccgucuuugcuaugccugc

SEQ ID NO: 743967 - RNA, 22 nt, Human
ccaggucuuuggccuuggcacu

SEQ ID NO: 743968 - RNA, 22 nt, Human
cuaguuuaaagcagcugaaagg

SEQ ID NO: 743969 - RNA, 22 nt, Human
caucuuaauaaaucuccucccu

SEQ ID NO: 743970 - RNA, 22 nt, Human
uacccuggagcaaguuuccuca

SEQ ID NO: 743971 - RNA, 19 nt, Human
agcagcagaagugugccuu

SEQ ID NO: 743972 - RNA, 23 nt, Human
uguaaagaucaagugacugauuu

SEQ ID NO: 743973 - RNA, 22 nt, Human
cugggccaggaccaggguugaa

SEQ ID NO: 743974 - RNA, 22 nt, Human
cauuguuugagcaucugggauc

SEQ ID NO: 743975 - RNA, 22 nt, Human
ggagauuuauagcacacuucag

SEQ ID NO: 743976 - RNA, 22 nt, Human
aaggggagaugucaugggcccu

SEQ ID NO: 743977 - RNA, 22 nt, Human
gaauucuuuucuuucugaaagu

SEQ ID NO: 743978 - RNA, 22 nt, Human
gagacacagagaggcuguguga

SEQ ID NO: 743979 - RNA, 22 nt, Human
ucucacuuuccagacuuuucaa

SEQ ID NO: 743980 - RNA, 22 nt, Human
ccagggugugggcgucggcacg

SEQ ID NO: 743981 - RNA, 22 nt, Human
cugugcuucagagucagugcug

SEQ ID NO: 743982 - RNA, 22 nt, Human
gcccugugauggagacuagagg

SEQ ID NO: 743983 - RNA, 22 nt, Human
cucuccaggagagcacuuugag

SEQ ID NO: 743984 - RNA, 19 nt, Human
acccagggguuuaugugug

SEQ ID NO: 743985 - RNA, 22 nt, Human
aggacuaaggaacagcugauuc

SEQ ID NO: 743986 - RNA, 22 nt, Human
uggaggcauaggccugggcccu

SEQ ID NO: 743987 - RNA, 22 nt, Human
auuucuguaacuuaugaaaguu

SEQ ID NO: 743988 - RNA, 22 nt, Human
ugcucaguuaagcagaggaaau

SEQ ID NO: 743989 - RNA, 22 nt, Human
agggccuggcgcguggccgccg

SEQ ID NO: 743990 - RNA, 22 nt, Human
ccuguguggaaggcaggaggcc

SEQ ID NO: 743991 - RNA, 22 nt, Human
gcugaauaauguguaaugucuc

SEQ ID NO: 743992 - RNA, 22 nt, Human
ugagucacagccuugccuuggu

SEQ ID NO: 743993 - RNA, 22 nt, Human
uaaggccagcaugaaugcagca

SEQ ID NO: 743994 - RNA, 22 nt, Human
uucaggaucauuuguuuuaucu

SEQ ID NO: 743995 - RNA, 22 nt, Human
gggauggacugacgguagcgcg

SEQ ID NO: 743996 - RNA, 22 nt, Human
ucugcguugcucacgcugggag

SEQ ID NO: 743997 - RNA, 22 nt, Human
acagugaaaagaauauuagaau

SEQ ID NO: 743998 - RNA, 22 nt, Human
ucagcccugggacccagggaug

SEQ ID NO: 743999 - RNA, 22 nt, Human
ggcugcugagucacgacaguga

SEQ ID NO: 744000 - RNA, 22 nt, Human
gucccagcuucccacuagcagc

SEQ ID NO: 744001 - RNA, 22 nt, Human
agagccugcagcugugaagaaa

SEQ ID NO: 744002 - RNA, 22 nt, Human
caggggacacuccugcuugggc

SEQ ID NO: 744003 - RNA, 22 nt, Human
ugggagaacacugcucuggaug

SEQ ID NO: 744004 - RNA, 22 nt, Human
uaaagguagcaugaaacugcaa

SEQ ID NO: 744005 - RNA, 20 nt, Human
uguuucauaagcuguccuau

SEQ ID NO: 744006 - RNA, 22 nt, Human
aaugcuuuugcugucauugcuu

SEQ ID NO: 744007 - RNA, 22 nt, Human
auaaaauuugcuacuguuaaau

SEQ ID NO: 744008 - RNA, 22 nt, Human
cucuggccagagccugcgggaa

SEQ ID NO: 744009 - RNA, 22 nt, Human
ggcucacgcaauuaucccggcc

SEQ ID NO: 744010 - RNA, 22 nt, Human
gacauuuauuagaaaacuauca

SEQ ID NO: 744011 - RNA, 22 nt, Human
uaauauauaccuuuguuaggaa

SEQ ID NO: 744012 - RNA, 22 nt, Human
ccagaggacuugggggcugaau

SEQ ID NO: 744013 - RNA, 18 nt, Human
aggugcucaaaugggaaa

SEQ ID NO: 744014 - RNA, 22 nt, Human
augcucaguagcuggcugaccc

SEQ ID NO: 744015 - RNA, 17 nt, Human
aaauaugaccucaaagu

SEQ ID NO: 744016 - RNA, 22 nt, Human
gaaacauauuaauccagugaaa

SEQ ID NO: 744017 - RNA, 22 nt, Human
ucaggauguuaauauagcauua

SEQ ID NO: 744018 - RNA, 22 nt, Human
aguccuggccccaaggaaggau

SEQ ID NO: 744019 - RNA, 22 nt, Human
gcugucagcgcccaaggagcuc

SEQ ID NO: 744020 - RNA, 22 nt, Human
aguccaggcauuccagccauuc

SEQ ID NO: 744021 - RNA, 22 nt, Human
ggggaggagccauguaacuagu

SEQ ID NO: 744022 - RNA, 22 nt, Human
ggucaucuguaauucuguuccu

SEQ ID NO: 744023 - RNA, 22 nt, Human
uccacugacaggugaauggaua

SEQ ID NO: 744024 - RNA, 22 nt, Human
uggcucagcauucacuggucuu

SEQ ID NO: 744025 - RNA, 22 nt, Human
gucugcuuucugggaacucuuu

SEQ ID NO: 744026 - RNA, 22 nt, Human
ccugccugggcucacuugccag

SEQ ID NO: 744027 - RNA, 22 nt, Human
gcuggcuggagugagcuacccu

SEQ ID NO: 744028 - RNA, 22 nt, Human
uggcuguagaacaguggauauu

SEQ ID NO: 744029 - RNA, 22 nt, Human
auaguuguguggggauucuggu

SEQ ID NO: 744030 - RNA, 23 nt, Human
gagauucuccuguugucaagucu

SEQ ID NO: 744031 - RNA, 22 nt, Human
cugggacacccaaggaaagagc

SEQ ID NO: 744032 - RNA, 22 nt, Human
uugucccaggacuugcauagau

SEQ ID NO: 744033 - RNA, 19 nt, Human
aagcaauguugugaaucua

SEQ ID NO: 744034 - RNA, 22 nt, Human
ucagcacugauguuucagaaga

SEQ ID NO: 744035 - RNA, 20 nt, Human
uuccuggcucuaggaccuug

SEQ ID NO: 744036 - RNA, 22 nt, Human
uccucugaaaucuagauuguga

SEQ ID NO: 744037 - RNA, 22 nt, Human
aguuacacaacuuaucacaucu

SEQ ID NO: 744038 - RNA, 21 nt, Human
acaaugucaaggucagacauu

SEQ ID NO: 744039 - RNA, 22 nt, Human
uuucagaaauuguuauuauucu

SEQ ID NO: 744040 - RNA, 22 nt, Human
cagggagcuuugucuucucauu

SEQ ID NO: 744041 - RNA, 22 nt, Human
uuggccaagggaucgagguugg

SEQ ID NO: 744042 - RNA, 22 nt, Human
agcuuccugacuggugcucuua

SEQ ID NO: 744043 - RNA, 22 nt, Human
ucuggaaugaaugagguucugu

SEQ ID NO: 744044 - RNA, 22 nt, Human
caggcagaagaaguggaaggac

SEQ ID NO: 744045 - RNA, 22 nt, Human
acacuucuauucccugcacaaa

SEQ ID NO: 744046 - RNA, 22 nt, Human
uaaaccaaguguccauauuagu

SEQ ID NO: 744047 - RNA, 22 nt, Human
gggaucugggacaacagguggu

SEQ ID NO: 744048 - RNA, 22 nt, Human
gagucaggcacugcugcugcuc

SEQ ID NO: 744049 - RNA, 22 nt, Human
aaggaagagcaaagaauuaugu

SEQ ID NO: 744050 - RNA, 22 nt, Human
uuacacauugcagaucaaaaug

SEQ ID NO: 744051 - RNA, 21 nt, Human
cccacggaaugaugaggcacu

SEQ ID NO: 744052 - RNA, 22 nt, Human
uguuccagauucggcgugggac

SEQ ID NO: 744053 - RNA, 22 nt, Human
cacauuuaucucucuccgguga

SEQ ID NO: 744054 - RNA, 22 nt, Human
gaacaaauuggagaaaucagga

SEQ ID NO: 744055 - RNA, 22 nt, Human
uggagucacuuccauaugggaa

SEQ ID NO: 744056 - RNA, 23 nt, Human
agucugugcugaagaaguuacaa

SEQ ID NO: 744057 - RNA, 22 nt, Human
ugagccugguugcagugucugg

SEQ ID NO: 744058 - RNA, 22 nt, Human
gagccccaggacagcucuaguu

SEQ ID NO: 744059 - RNA, 22 nt, Human
aagccagcauuuucccauuccu

SEQ ID NO: 744060 - RNA, 22 nt, Human
caguauaugcucuuucaucaaa

SEQ ID NO: 744061 - RNA, 22 nt, Human
agaggcuguuacacucccagau

SEQ ID NO: 744062 - RNA, 22 nt, Human
cagcuuggaggaggaucuaaga

SEQ ID NO: 744063 - RNA, 22 nt, Human
ucucagugacugcugggucccc

SEQ ID NO: 744064 - RNA, 22 nt, Human
cuggcuucagcugccaucaaug

SEQ ID NO: 744065 - RNA, 22 nt, Human
uaguuuagcacuaagaaaaaca

SEQ ID NO: 744066 - RNA, 22 nt, Human
caggaagagguaucaccgagca

SEQ ID NO: 744067 - RNA, 22 nt, Human
cacagggccuggggcagcugcu

SEQ ID NO: 744068 - RNA, 22 nt, Human
aaguuugagaagcuuauagaua

SEQ ID NO: 744069 - RNA, 22 nt, Human
uguguccuucugggagucccag

SEQ ID NO: 744070 - RNA, 22 nt, Human
uuuucugugugucccucgacag

SEQ ID NO: 744071 - RNA, 22 nt, Human
gaacaacuuugaaacaugaaga

SEQ ID NO: 744072 - RNA, 22 nt, Human
ugcuggccaacaaggcuccaag

SEQ ID NO: 744073 - RNA, 21 nt, Human
uuaagaccugcaucaucauua

SEQ ID NO: 744074 - RNA, 18 nt, Human
cuucaguggcugcucugc

SEQ ID NO: 744075 - RNA, 22 nt, Human
aaauggauguugaguuaaaugu

SEQ ID NO: 744076 - RNA, 22 nt, Human
ugcauuaagguaauuguauaau

SEQ ID NO: 744077 - RNA, 22 nt, Human
cgcugccaggucaccaggggua

SEQ ID NO: 744078 - RNA, 22 nt, Human
ucuucaaagcauaugcaggcau

SEQ ID NO: 744079 - RNA, 22 nt, Human
uauguguguaugacagacagag

SEQ ID NO: 744080 - RNA, 22 nt, Human
ucuuccucuucugcugagaagu

SEQ ID NO: 744081 - RNA, 22 nt, Human
augggcugugagguccggcagg

SEQ ID NO: 744082 - RNA, 22 nt, Human
cauugucacccaaagcucauag

SEQ ID NO: 744083 - RNA, 22 nt, Human
gauugcaaaucauuacaaagga

SEQ ID NO: 744084 - RNA, 22 nt, Human
uuuuuagccaagccauaggucu

SEQ ID NO: 744085 - RNA, 22 nt, Human
aaguacaacgcauacagagaaa

SEQ ID NO: 744086 - RNA, 22 nt, Human
acaugacuauaauuacuuaaau

SEQ ID NO: 744087 - RNA, 22 nt, Human
acccugggaacuggaaacugga

SEQ ID NO: 744088 - RNA, 22 nt, Human
uugaaaguuaggauuuagcugg

SEQ ID NO: 744089 - RNA, 20 nt, Human
uccucccccaccuuugcagc

SEQ ID NO: 744090 - RNA, 22 nt, Human
caaggcagaauucagacucagg

SEQ ID NO: 744091 - RNA, 22 nt, Human
ugaagcaguucucagaaguggg

SEQ ID NO: 744092 - RNA, 18 nt, Human
aggcaggauccuggccuc

SEQ ID NO: 744093 - RNA, 22 nt, Human
ccaggaaaccugcgccauccag

SEQ ID NO: 744094 - RNA, 22 nt, Human
ccugccugcggcccgcggggag

SEQ ID NO: 744095 - RNA, 22 nt, Human
aagucauagucgggaaagacau

SEQ ID NO: 744096 - RNA, 22 nt, Human
ugugaacauuucugguuauuug

SEQ ID NO: 744097 - RNA, 22 nt, Human
uuguuguuggagccaauaugca

SEQ ID NO: 744098 - RNA, 22 nt, Human
aggcaucaggaguauagccaga

SEQ ID NO: 744099 - RNA, 22 nt, Human
gggggcuggacuuucccacaca

SEQ ID NO: 744100 - RNA, 22 nt, Human
acagugugaugggccugccuga

SEQ ID NO: 744101 - RNA, 22 nt, Human
ucccagaggucucugcugguuc

SEQ ID NO: 744102 - RNA, 22 nt, Human
caggccacaaguuggguucaag

SEQ ID NO: 744103 - RNA, 22 nt, Human
aguguuuuauuagaacacagcc

SEQ ID NO: 744104 - RNA, 22 nt, Human
aauggagacccuaaggaagagg

SEQ ID NO: 744105 - RNA, 23 nt, Human
agaguaauguuuuuacuguauuc

SEQ ID NO: 744106 - RNA, 22 nt, Human
agcuccugaguagcuuuacuca

SEQ ID NO: 744107 - RNA, 22 nt, Human
uccaucaccacagaggacagag

SEQ ID NO: 744108 - RNA, 22 nt, Human
cgugucugggauagcagaagua

SEQ ID NO: 744109 - RNA, 20 nt, Human
ucccucccuccagcucuggg

SEQ ID NO: 744110 - RNA, 20 nt, Human
acauaugaaugauagagcca

SEQ ID NO: 744111 - RNA, 22 nt, Human
aagaaacuguugcgugacagcg

SEQ ID NO: 744112 - RNA, 22 nt, Human
cacagaggaugcccaagcgauc

SEQ ID NO: 744113 - RNA, 22 nt, Human
cugcagagaccuaggucagguu

SEQ ID NO: 744114 - RNA, 22 nt, Human
agucaacaaaaauguggagccu

SEQ ID NO: 744115 - RNA, 22 nt, Human
ucacugcuuuguuuacaacuau

SEQ ID NO: 744116 - RNA, 22 nt, Human
uugauucaguaaagcuaaauuu

SEQ ID NO: 744117 - RNA, 22 nt, Human
auugcaaaggucccauucaaga

SEQ ID NO: 744118 - RNA, 22 nt, Human
uccaagaagcuuacaaucuaau

SEQ ID NO: 744119 - RNA, 22 nt, Human
uagagagagcugugguggcucu

SEQ ID NO: 744120 - RNA, 22 nt, Human
gagaaccucuccacaagucugg

SEQ ID NO: 744121 - RNA, 22 nt, Human
uucuccauuuaacuuccuuaug

SEQ ID NO: 744122 - RNA, 23 nt, Human
ugaaggccuggaggacgcguugu

SEQ ID NO: 744123 - RNA, 19 nt, Human
agaagcugugaaaugaagg

SEQ ID NO: 744124 - RNA, 22 nt, Human
ucuagcuguggucgagugagga

SEQ ID NO: 744125 - RNA, 19 nt, Human
gugagacccugcauagggc

SEQ ID NO: 744126 - RNA, 22 nt, Human
cuguuuauacgacagguggagg

SEQ ID NO: 744127 - RNA, 20 nt, Human
uuggaaucaccuggagaggu

SEQ ID NO: 744128 - RNA, 23 nt, Human
uaacuuacaucauucugcacaag

SEQ ID NO: 744129 - RNA, 22 nt, Human
uugacaaagauauauucaugcu

SEQ ID NO: 744130 - RNA, 22 nt, Human
aaugaugagaacuggaguaauu

SEQ ID NO: 744131 - RNA, 20 nt, Human
ucugaggcugagcucuacuu

SEQ ID NO: 744132 - RNA, 22 nt, Human
uagugaaacaguuaucaaucug

SEQ ID NO: 744133 - RNA, 22 nt, Human
ugcagccauuugaaaagcaguu

SEQ ID NO: 744134 - RNA, 22 nt, Human
cucaggauccaucuccugcccu

SEQ ID NO: 744135 - RNA, 22 nt, Human
ggcuggucucagugcuggguuc

SEQ ID NO: 744136 - RNA, 22 nt, Human
uuugguuuuuaauacaaaguac

SEQ ID NO: 744137 - RNA, 22 nt, Human
uuucagagaauuagaagcugau

SEQ ID NO: 744138 - RNA, 22 nt, Human
gaaucaggauucaagaucagcu

SEQ ID NO: 744139 - RNA, 22 nt, Human
cagcaacugugccugacacaca

SEQ ID NO: 744140 - RNA, 22 nt, Human
uagcagcuaugccauuuugaca

SEQ ID NO: 744141 - RNA, 22 nt, Human
guggacagcuucuaggugccag

SEQ ID NO: 744142 - RNA, 22 nt, Human
agauauguuuguauauauuugu

SEQ ID NO: 744143 - RNA, 22 nt, Human
ugguuuugcuccaguauaaaua

SEQ ID NO: 744144 - RNA, 22 nt, Human
cucucugguuucagcgaagggg

SEQ ID NO: 744145 - RNA, 22 nt, Human
uccugggaagagaccugagcau

SEQ ID NO: 744146 - RNA, 22 nt, Human
uggcagcuguguccagguagaa

SEQ ID NO: 744147 - RNA, 22 nt, Human
uggggcagcagaccuuucuugg

SEQ ID NO: 744148 - RNA, 22 nt, Human
aaagaggcagguguuacuggaa

SEQ ID NO: 744149 - RNA, 22 nt, Human
accuggcauaagggcuugaguc

SEQ ID NO: 744150 - RNA, 22 nt, Human
agaggcuccucggugccucgug

SEQ ID NO: 744151 - RNA, 22 nt, Human
uccugagagcagaguccaggug

SEQ ID NO: 744152 - RNA, 17 nt, Human
uucagcaguguuucucc

SEQ ID NO: 744153 - RNA, 22 nt, Human
ggguucagacuaaagcuaugca

SEQ ID NO: 744154 - RNA, 22 nt, Human
uucagcacuggacagcgagucu

SEQ ID NO: 744155 - RNA, 22 nt, Human
ccaauguuuuauacagaaguac

SEQ ID NO: 744156 - RNA, 22 nt, Human
uggagcaggucggcaccauuug

SEQ ID NO: 744157 - RNA, 22 nt, Human
uccucaguggggcauucauuau

SEQ ID NO: 744158 - RNA, 22 nt, Human
ugauuuccaguugcugggugcu

SEQ ID NO: 744159 - RNA, 22 nt, Human
cagauucaaccuaagacaaucu

SEQ ID NO: 744160 - RNA, 22 nt, Human
aagggcuggccacauucugggu

SEQ ID NO: 744161 - RNA, 22 nt, Human
cccagggacagcuagguggggc

SEQ ID NO: 744162 - RNA, 22 nt, Human
cagagccccuggguugggagcu

SEQ ID NO: 744163 - RNA, 22 nt, Human
caaaaguucucacccagacaug

SEQ ID NO: 744164 - RNA, 22 nt, Human
ccacuuuugggaacagugagua

SEQ ID NO: 744165 - RNA, 22 nt, Human
auuguacucccucuccugcccg

SEQ ID NO: 744166 - RNA, 22 nt, Human
uauuuccugcauggugauguaa

SEQ ID NO: 744167 - RNA, 20 nt, Human
aguggaauuucagauacccc

SEQ ID NO: 744168 - RNA, 22 nt, Human
ucugccucgcuaacagcagcca

SEQ ID NO: 744169 - RNA, 22 nt, Human
cucugggaagggcugagcacug

SEQ ID NO: 744170 - RNA, 23 nt, Human
ugcugggcagagcuggugcugag

SEQ ID NO: 744171 - RNA, 22 nt, Human
ucauaaagagugcuguuguuuu

SEQ ID NO: 744172 - RNA, 22 nt, Human
acagcugacauuggcagcuauu

SEQ ID NO: 744173 - RNA, 22 nt, Human
ccugggaggcggagguugcagg

SEQ ID NO: 744174 - RNA, 22 nt, Human
ggcuucaggggcccagucagca

SEQ ID NO: 744175 - RNA, 22 nt, Human
aggcugguguguccugaagccu

SEQ ID NO: 744176 - RNA, 22 nt, Human
gcacagaaaugucuacacaugu

SEQ ID NO: 744177 - RNA, 22 nt, Human
acaggcucgugcgcgcacgugu

SEQ ID NO: 744178 - RNA, 23 nt, Human
ucucuuaccugagacauuuccua

SEQ ID NO: 744179 - RNA, 22 nt, Human
uugugcuagaaccaguacagaa

SEQ ID NO: 744180 - RNA, 22 nt, Human
agcugcaggcccaugcucaguc

SEQ ID NO: 744181 - RNA, 22 nt, Human
agcaaggaguagaacaagagug

SEQ ID NO: 744182 - RNA, 22 nt, Human
guggcagaaaugggacuuugag

SEQ ID NO: 744183 - RNA, 22 nt, Human
ccugcaccaggcccagcauggu

SEQ ID NO: 744184 - RNA, 22 nt, Human
agugggagggccauauggugaa

SEQ ID NO: 744185 - RNA, 22 nt, Human
agcaccuguggcucaugcucgu

SEQ ID NO: 744186 - RNA, 22 nt, Human
ugauucugcccuuucuucugac

SEQ ID NO: 744187 - RNA, 22 nt, Human
gcguuggggaccccgaagcugg

SEQ ID NO: 744188 - RNA, 22 nt, Human
aagagagacaauagguagcauu

SEQ ID NO: 744189 - RNA, 22 nt, Human
aaccauggauuucaguucaccu

SEQ ID NO: 744190 - RNA, 22 nt, Human
ggcugcuugcuguuucuuggau

SEQ ID NO: 744191 - RNA, 22 nt, Human
aauguaugagcgugaaagcacu

SEQ ID NO: 744192 - RNA, 22 nt, Human
ccuguguggccgcacugcuccc

SEQ ID NO: 744193 - RNA, 22 nt, Human
ucugggaagccuguaugcagaa

SEQ ID NO: 744194 - RNA, 22 nt, Human
ggacaaagcucugcugccuccc

SEQ ID NO: 744195 - RNA, 22 nt, Human
uggcucugggaaucuguugcuu

SEQ ID NO: 744196 - RNA, 22 nt, Human
uggggagguaacaauuucaggc

SEQ ID NO: 744197 - RNA, 22 nt, Human
ggagcuggucagccuugagcau

SEQ ID NO: 744198 - RNA, 22 nt, Human
gcagcaggcacggucucgacau

SEQ ID NO: 744199 - RNA, 22 nt, Human
ugcuccagcaugacccucaaug

SEQ ID NO: 744200 - RNA, 20 nt, Human
ucccaaggaugccugggugu

SEQ ID NO: 744201 - RNA, 22 nt, Human
ugggcacuggaagccugcugug

SEQ ID NO: 744202 - RNA, 18 nt, Human
ugcaggagugaccccggc

SEQ ID NO: 744203 - RNA, 22 nt, Human
gccugggaaaugguggggucag

SEQ ID NO: 744204 - RNA, 22 nt, Human
cugggcucuaggaaccauuccu

SEQ ID NO: 744205 - RNA, 19 nt, Human
uuuaaagugacugguauuu

SEQ ID NO: 744206 - RNA, 17 nt, Human
aagacagaagccaugag

SEQ ID NO: 744207 - RNA, 22 nt, Human
ugaggcuaaaggugaccagauu

SEQ ID NO: 744208 - RNA, 22 nt, Human
cuggaucuguccccuuuuuguu

SEQ ID NO: 744209 - RNA, 22 nt, Human
gacaaggaaauuacuagcugga

SEQ ID NO: 744210 - RNA, 22 nt, Human
aaagccaucaguaaaaugauuu

SEQ ID NO: 744211 - RNA, 22 nt, Human
caccugagacuccucaccauga

SEQ ID NO: 744212 - RNA, 22 nt, Human
uggugagauaacuuucggcaag

SEQ ID NO: 744213 - RNA, 22 nt, Human
ugcuccugacaguuuuaggcuc

SEQ ID NO: 744214 - RNA, 23 nt, Human
ucucaaaucuuugcguuguaucu

SEQ ID NO: 744215 - RNA, 22 nt, Human
ccucaggggucacugugaggag

SEQ ID NO: 744216 - RNA, 22 nt, Human
guguggaaagaguggccucuca

SEQ ID NO: 744217 - RNA, 22 nt, Human
agcagguguuuguaucauaagg

SEQ ID NO: 744218 - RNA, 22 nt, Human
acagugauugggguaucugcag

SEQ ID NO: 744219 - RNA, 22 nt, Human
aaacucucauuuuagugcacug

SEQ ID NO: 744220 - RNA, 22 nt, Human
aucaacaugucauaaagugaaa

SEQ ID NO: 744221 - RNA, 18 nt, Human
acagggagggcgcugggg

SEQ ID NO: 744222 - RNA, 22 nt, Human
caggccuggguucaaaucccuu

SEQ ID NO: 744223 - RNA, 22 nt, Human
gagguagggcagaggcugaaug

SEQ ID NO: 744224 - RNA, 17 nt, Human
cuggagaagccugugga

SEQ ID NO: 744225 - RNA, 22 nt, Human
cuuauuuuaagucaguuugggu

SEQ ID NO: 744226 - RNA, 22 nt, Human
ucugacaaugaacaaucuauag

SEQ ID NO: 744227 - RNA, 22 nt, Human
cagagacagccugggagggaca

SEQ ID NO: 744228 - RNA, 22 nt, Human
augcauuggucagggucuuagg

SEQ ID NO: 744229 - RNA, 22 nt, Human
gccaaugacagucucaguucug

SEQ ID NO: 744230 - RNA, 22 nt, Human
uguggagcccccaggagugggg

SEQ ID NO: 744231 - RNA, 19 nt, Human
uuuuccuucuauauguuuc

SEQ ID NO: 744232 - RNA, 22 nt, Human
aggcaggagugacccugacagg

SEQ ID NO: 744233 - RNA, 22 nt, Human
aagacacagcgaaauguuccug

SEQ ID NO: 744234 - RNA, 22 nt, Human
gugcacagauuuaauuuuauuc

SEQ ID NO: 744235 - RNA, 22 nt, Human
ggcagcagggucuagauugaug

SEQ ID NO: 744236 - RNA, 22 nt, Human
uccuauugguagacauuucugu

SEQ ID NO: 744237 - RNA, 22 nt, Human
aaagggaaguugcacauguucc

SEQ ID NO: 744238 - RNA, 22 nt, Human
aggaggccuggcuggggagauc

SEQ ID NO: 744239 - RNA, 22 nt, Human
ucacauuuucauauucucugag

SEQ ID NO: 744240 - RNA, 22 nt, Human
uggccugccuucgcugagcuga

SEQ ID NO: 744241 - RNA, 22 nt, Human
uuguucaucuggaacccagagc

SEQ ID NO: 744242 - RNA, 22 nt, Human
uccacccaguguuucuacaggu

SEQ ID NO: 744243 - RNA, 22 nt, Human
cugaauaauuuuauaguugcug

SEQ ID NO: 744244 - RNA, 22 nt, Human
uggaaaacuuugguggugaggg

SEQ ID NO: 744245 - RNA, 22 nt, Human
ggccaugguuggggaagacaug

SEQ ID NO: 744246 - RNA, 22 nt, Human
uaagacaugguugaucuagugu

SEQ ID NO: 744247 - RNA, 22 nt, Human
uaacacuugggggcauccuuag

SEQ ID NO: 744248 - RNA, 22 nt, Human
agggcccuggggugcacugaca

SEQ ID NO: 744249 - RNA, 22 nt, Human
uggaugcuguaggacacgcucu

SEQ ID NO: 744250 - RNA, 22 nt, Human
caugaauuuauauuauuaguga

SEQ ID NO: 744251 - RNA, 22 nt, Human
ucauuuauauuguauucuguag

SEQ ID NO: 744252 - RNA, 22 nt, Human
gacuuggggauuuaucucacag

SEQ ID NO: 744253 - RNA, 22 nt, Human
agagggagugaaauggaauaga

SEQ ID NO: 744254 - RNA, 22 nt, Human
cagcagaaaaugugggugauuu

SEQ ID NO: 744255 - RNA, 22 nt, Human
ugaggcaguauuuuagugacuu

SEQ ID NO: 744256 - RNA, 22 nt, Human
cagaccucaguccucaguagga

SEQ ID NO: 744257 - RNA, 21 nt, Human
gaugauggcaggcagcacugg

SEQ ID NO: 744258 - RNA, 22 nt, Human
aaggccauuguaauguaaauau

SEQ ID NO: 744259 - RNA, 22 nt, Human
ccuggcucgcugaccucagggg

SEQ ID NO: 744260 - RNA, 19 nt, Human
auuuacugccuaaaaucuc

SEQ ID NO: 744261 - RNA, 22 nt, Human
ugcuggagacucacucaggugc

SEQ ID NO: 744262 - RNA, 22 nt, Human
gcauggccuugugcuccuucuc

SEQ ID NO: 744263 - RNA, 22 nt, Human
uccagauggauuuaagaccuaa

SEQ ID NO: 744264 - RNA, 22 nt, Human
guuucauauaccaagcacuuga

SEQ ID NO: 744265 - RNA, 22 nt, Human
ucccaagcccuggaugccucag

SEQ ID NO: 744266 - RNA, 19 nt, Human
ccugaggugggguggaagg

SEQ ID NO: 744267 - RNA, 22 nt, Human
auggccaccauuuaaugaagcu

SEQ ID NO: 744268 - RNA, 22 nt, Human
augugcuuuauuaaguaaaaau

SEQ ID NO: 744269 - RNA, 22 nt, Human
cacauguccuggcgcugagccc

SEQ ID NO: 744270 - RNA, 22 nt, Human
ggcugcagggcagcuggugugg

SEQ ID NO: 744271 - RNA, 22 nt, Human
cugaggugcuauggaggauacg

SEQ ID NO: 744272 - RNA, 22 nt, Human
cugcagagcuuucugaaugaag

SEQ ID NO: 744273 - RNA, 22 nt, Human
ccucuucuaccauuuacauuuu

SEQ ID NO: 744274 - RNA, 22 nt, Human
gguccugaggggagcugaaggu

SEQ ID NO: 744275 - RNA, 22 nt, Human
uugagaaugaugagauucuucc

SEQ ID NO: 744276 - RNA, 22 nt, Human
ucccucagagggcaagcgcaga

SEQ ID NO: 744277 - RNA, 22 nt, Human
cgggggcacccacaaaugagga

SEQ ID NO: 744278 - RNA, 23 nt, Human
cuucucugagcuaggaaugcucu

SEQ ID NO: 744279 - RNA, 22 nt, Human
agggacuauuuacccaucucac

SEQ ID NO: 744280 - RNA, 22 nt, Human
aacuuccuucuaguucauaugu

SEQ ID NO: 744281 - RNA, 22 nt, Human
aggaaauaagggcacuucagau

SEQ ID NO: 744282 - RNA, 22 nt, Human
acaugcauguuguguagggggg

SEQ ID NO: 744283 - RNA, 22 nt, Human
uagggcucuggugggcucuguu

SEQ ID NO: 744284 - RNA, 22 nt, Human
cugcuguccaaccugcacucgc

SEQ ID NO: 744285 - RNA, 22 nt, Human
cccuguggcaggaggaggagca

SEQ ID NO: 744286 - RNA, 22 nt, Human
augcauuuguaaaauauaaucg

SEQ ID NO: 744287 - RNA, 22 nt, Human
ucccagccauuccuuuaggugu

SEQ ID NO: 744288 - RNA, 22 nt, Human
cccaggcuggggcuccuccagc

SEQ ID NO: 744289 - RNA, 19 nt, Human
aggguccagggagcggcuc

SEQ ID NO: 744290 - RNA, 22 nt, Human
ccucacuuuccuuucuccuggg

SEQ ID NO: 744291 - RNA, 22 nt, Human
aacaucacaauuucauuuaugc

SEQ ID NO: 744292 - RNA, 22 nt, Human
ucuccucaccaccagcagcaga

SEQ ID NO: 744293 - RNA, 22 nt, Human
guuucuuuuaaaauauguagac

SEQ ID NO: 744294 - RNA, 22 nt, Human
uauacacauuacaguuucagga

SEQ ID NO: 744295 - RNA, 22 nt, Human
uucuaacaaguggcuuguuagu

SEQ ID NO: 744296 - RNA, 22 nt, Human
ggcccugggcagaggagugggc

SEQ ID NO: 744297 - RNA, 22 nt, Human
ggccagggggcuucagacucca

SEQ ID NO: 744298 - RNA, 18 nt, Human
aggcaugguggugcgcac

SEQ ID NO: 744299 - RNA, 22 nt, Human
gcagagaccccgcagugaggcc

SEQ ID NO: 744300 - RNA, 22 nt, Human
ugggugcuucgucagcucugag

SEQ ID NO: 744301 - RNA, 22 nt, Human
uagugggugauuugaugaggaa

SEQ ID NO: 744302 - RNA, 22 nt, Human
ucauucauacucuuuucuauua

SEQ ID NO: 744303 - RNA, 22 nt, Human
aggggcacuagaaugggagacu

SEQ ID NO: 744304 - RNA, 22 nt, Human
gugcuuuuaaaggcaauuagua

SEQ ID NO: 744305 - RNA, 22 nt, Human
caguccuuucaauggugaccuu

SEQ ID NO: 744306 - RNA, 22 nt, Human
ggcuguggcauuaggugaggcc

SEQ ID NO: 744307 - RNA, 16 nt, Human
aucuaagaugugcauu

SEQ ID NO: 744308 - RNA, 22 nt, Human
acauuauagcuuugaguuugga

SEQ ID NO: 744309 - RNA, 22 nt, Human
aacauagaauuguuauauuuuc

SEQ ID NO: 744310 - RNA, 22 nt, Human
ucauugcaagcucauuuaucug

SEQ ID NO: 744311 - RNA, 22 nt, Human
ugggauauaccuauccuagaag

SEQ ID NO: 744312 - RNA, 22 nt, Human
cuuuuccuauugauucuguuac

SEQ ID NO: 744313 - RNA, 22 nt, Human
auggccuuggcugcagagacau

SEQ ID NO: 744314 - RNA, 22 nt, Human
ucauacaucuuguauaucuauc

SEQ ID NO: 744315 - RNA, 22 nt, Human
aguaaauaacagagaaaauggg

SEQ ID NO: 744316 - RNA, 22 nt, Human
ugcagaggugaaagacuagcaa

SEQ ID NO: 744317 - RNA, 22 nt, Human
gcucugugguggggcagaguuu

SEQ ID NO: 744318 - RNA, 22 nt, Human
cccagcccccgagugucuggaa

SEQ ID NO: 744319 - RNA, 22 nt, Human
uggcugagguaacuaugaauaa

SEQ ID NO: 744320 - RNA, 22 nt, Human
acaaguuuuggaagucuuaagg

SEQ ID NO: 744321 - RNA, 23 nt, Human
uccuccugacacagccugaguga

SEQ ID NO: 744322 - RNA, 22 nt, Human
uucuccugcccuuggacuucca

SEQ ID NO: 744323 - RNA, 22 nt, Human
aauucugcauaagguggcucug

SEQ ID NO: 744324 - RNA, 22 nt, Human
gagcagggagacaacucuggug

SEQ ID NO: 744325 - RNA, 19 nt, Human
uucuaugauuaacaugaga

SEQ ID NO: 744326 - RNA, 22 nt, Human
gacagccuggcuuaaucugucu

SEQ ID NO: 744327 - RNA, 21 nt, Human
uaggggcuggggcuccagcug

SEQ ID NO: 744328 - RNA, 22 nt, Human
cugaggcugagacaggugaaau

SEQ ID NO: 744329 - RNA, 23 nt, Human
ugggcucagcuuccaguggggag

SEQ ID NO: 744330 - RNA, 22 nt, Human
ccauccaugcgccagacagauu

SEQ ID NO: 744331 - RNA, 21 nt, Human
gagugcaggucugaugccauc

SEQ ID NO: 744332 - RNA, 22 nt, Human
uacaaucaggauaauaauagug

SEQ ID NO: 744333 - RNA, 22 nt, Human
ccagggcagaaaaagagggaau

SEQ ID NO: 744334 - RNA, 22 nt, Human
gaggcucacgacgggacgaacu

SEQ ID NO: 744335 - RNA, 22 nt, Human
cuguacaaaguagcugcuggga

SEQ ID NO: 744336 - RNA, 22 nt, Human
acagacaucaucaacaucuucc

SEQ ID NO: 744337 - RNA, 22 nt, Human
uuuuauuggagugauaccaagc

SEQ ID NO: 744338 - RNA, 22 nt, Human
agggccaccagggagucucagg

SEQ ID NO: 744339 - RNA, 20 nt, Human
uguuccaugacuauuuggau

SEQ ID NO: 744340 - RNA, 22 nt, Human
ugauuuccucuacuagcaauua

SEQ ID NO: 744341 - RNA, 22 nt, Human
gccuuggccaacaccuugcaaa

SEQ ID NO: 744342 - RNA, 22 nt, Human
gcuucauuugagaaccucugug

SEQ ID NO: 744343 - RNA, 22 nt, Human
agcaggguuuggggauuggcac

SEQ ID NO: 744344 - RNA, 22 nt, Human
uggggauguaaaugaggugaua

SEQ ID NO: 744345 - RNA, 21 nt, Human
gccaagaacaagacagacaug

SEQ ID NO: 744346 - RNA, 22 nt, Human
caguccuggggaccaggcugag

SEQ ID NO: 744347 - RNA, 22 nt, Human
acaguguggaaagucaacuuga

SEQ ID NO: 744348 - RNA, 22 nt, Human
uagaggugagauauuuuauuuu

SEQ ID NO: 744349 - RNA, 22 nt, Human
ggggacaguuaaagaccaagac

SEQ ID NO: 744350 - RNA, 22 nt, Human
uacacauaaaaugcucauggua

SEQ ID NO: 744351 - RNA, 22 nt, Human
uuagcaaacaaaugaaaugguu

SEQ ID NO: 744352 - RNA, 22 nt, Human
gggccagcaguaucggaggcau

SEQ ID NO: 744353 - RNA, 22 nt, Human
aggaccugacuggcuccugcuu

SEQ ID NO: 744354 - RNA, 22 nt, Human
ccucugggugacagacucuugg

SEQ ID NO: 744355 - RNA, 22 nt, Human
ccuggaccaaacacuggccugg

SEQ ID NO: 744356 - RNA, 22 nt, Human
uggcaagcucguuugggucaga

SEQ ID NO: 744357 - RNA, 22 nt, Human
gagagccagcucacuccagggc

SEQ ID NO: 744358 - RNA, 22 nt, Human
agagaaugcagggcuucggaca

SEQ ID NO: 744359 - RNA, 22 nt, Human
aaacugcugguugcuggccagc

SEQ ID NO: 744360 - RNA, 22 nt, Human
uacagaauauagaagcuggaag

SEQ ID NO: 744361 - RNA, 22 nt, Human
ugcucuagcucauaggacucau

SEQ ID NO: 744362 - RNA, 22 nt, Human
gggggcaguaaccucaaagugu

SEQ ID NO: 744363 - RNA, 22 nt, Human
ugucuguggcaauuguggguaa

SEQ ID NO: 744364 - RNA, 22 nt, Human
ugguaauuaauuugauagguuc

SEQ ID NO: 744365 - RNA, 22 nt, Human
uguggugccgagagucuggacg

SEQ ID NO: 744366 - RNA, 22 nt, Human
ucuuugcacacagcgauucuuc

SEQ ID NO: 744367 - RNA, 22 nt, Human
auguacaucuuuauaacaagcu

SEQ ID NO: 744368 - RNA, 22 nt, Human
uuauaguaugugcauaugugug

SEQ ID NO: 744369 - RNA, 22 nt, Human
uuucagaaaacuuaucaucagu

SEQ ID NO: 744370 - RNA, 20 nt, Human
ucugggcuucccccagcucc

SEQ ID NO: 744371 - RNA, 22 nt, Human
uggggacauucaugcagguugu

SEQ ID NO: 744372 - RNA, 22 nt, Human
uggccugccccgagauccuggc

SEQ ID NO: 744373 - RNA, 22 nt, Human
ucagcuggagauccuuguugug

SEQ ID NO: 744374 - RNA, 22 nt, Human
ccaggcucuguuccccgaggag

SEQ ID NO: 744375 - RNA, 22 nt, Human
augaaauuugcugcuaaguucc

SEQ ID NO: 744376 - RNA, 22 nt, Human
uuauucacaugggcucauucua

SEQ ID NO: 744377 - RNA, 22 nt, Human
agccagagaguguuggagaugu

SEQ ID NO: 744378 - RNA, 20 nt, Human
caguaucugaagccacacaa

SEQ ID NO: 744379 - RNA, 22 nt, Human
gggcagcugccagaggccaugg

SEQ ID NO: 744380 - RNA, 22 nt, Human
gcaaagaaaugucagugagagg

SEQ ID NO: 744381 - RNA, 22 nt, Human
ccaccagcuuuggcggugacag

SEQ ID NO: 744382 - RNA, 19 nt, Human
uugcauuucauguuugauu

SEQ ID NO: 744383 - RNA, 22 nt, Human
uggcuggcuuucuuguauuuac

SEQ ID NO: 744384 - RNA, 22 nt, Human
acaauagaguucucauaggaca

SEQ ID NO: 744385 - RNA, 22 nt, Human
aaguugaagcaugaaccaaggu

SEQ ID NO: 744386 - RNA, 22 nt, Human
guacaugugcacaacaugcaug

SEQ ID NO: 744387 - RNA, 22 nt, Human
cugggaaauggcuucgagcuca

SEQ ID NO: 744388 - RNA, 22 nt, Human
caguguguccucagaauauaua

SEQ ID NO: 744389 - RNA, 22 nt, Human
guuccuugggaacaacgcugaa

SEQ ID NO: 744390 - RNA, 22 nt, Human
ucccugugggcagaggcugccu

SEQ ID NO: 744391 - RNA, 22 nt, Human
acauuugucuucuuucagauua

SEQ ID NO: 744392 - RNA, 21 nt, Human
gcacagggacagaucaucaca

SEQ ID NO: 744393 - RNA, 22 nt, Human
cacccaggacaaaauauggaau

SEQ ID NO: 744394 - RNA, 19 nt, Human
uacccucagggccucauuu

SEQ ID NO: 744395 - RNA, 22 nt, Human
guuuauuauucaacuucauguu

SEQ ID NO: 744396 - RNA, 22 nt, Human
uguggcugugccgucacacgug

SEQ ID NO: 744397 - RNA, 20 nt, Human
cagcaguggaugagaguuuu

SEQ ID NO: 744398 - RNA, 22 nt, Human
cacccaggcuagagugcagugg

SEQ ID NO: 744399 - RNA, 22 nt, Human
ucccugggaaaugucaguuuca

SEQ ID NO: 744400 - RNA, 22 nt, Human
uaugaguguguguagaagguac

SEQ ID NO: 744401 - RNA, 22 nt, Human
agguccugaugaucucugagag

SEQ ID NO: 744402 - RNA, 22 nt, Human
ggcaccuggagguuuacuggau

SEQ ID NO: 744403 - RNA, 22 nt, Human
aggcuggcugagcugcagccug

SEQ ID NO: 744404 - RNA, 22 nt, Human
cacugucuuuugugaagacaau

SEQ ID NO: 744405 - RNA, 22 nt, Human
aaaauucucuugaucuugacag

SEQ ID NO: 744406 - RNA, 22 nt, Human
gcaguguuauguuuucuauaau

SEQ ID NO: 744407 - RNA, 22 nt, Human
cuugagaagcauuaagagguag

SEQ ID NO: 744408 - RNA, 22 nt, Human
ugucacauguguggcauuuuuc

SEQ ID NO: 744409 - RNA, 22 nt, Human
ugucugaacgaaguagguccac

SEQ ID NO: 744410 - RNA, 22 nt, Human
ucugugcuuaacuacucacccc

SEQ ID NO: 744411 - RNA, 22 nt, Human
augcaggagcccucuugagggc

SEQ ID NO: 744412 - RNA, 22 nt, Human
agacacauuuuacauuaacugu

SEQ ID NO: 744413 - RNA, 22 nt, Human
ggucccaagugcuuuuccugca

SEQ ID NO: 744414 - RNA, 22 nt, Human
uucuaccauugggaaaacagcc

SEQ ID NO: 744415 - RNA, 18 nt, Human
acagugguuugaugugcu

SEQ ID NO: 744416 - RNA, 22 nt, Human
agcaaccuggaucauggugaaa

SEQ ID NO: 744417 - RNA, 22 nt, Human
augacuuuccuggcaaaaguug

SEQ ID NO: 744418 - RNA, 22 nt, Human
accacugcccauggugaaaacu

SEQ ID NO: 744419 - RNA, 22 nt, Human
gugagcugggugaaugguaggg

SEQ ID NO: 744420 - RNA, 22 nt, Human
uagaaaggcaagcgugaaauau

SEQ ID NO: 744421 - RNA, 22 nt, Human
gcugcgccggaucccacguucc

SEQ ID NO: 744422 - RNA, 22 nt, Human
guguguguaucugccuaucaca

SEQ ID NO: 744423 - RNA, 22 nt, Human
cuuuacagauggauaauuguuu

SEQ ID NO: 744424 - RNA, 23 nt, Human
gguagagccgcgcccugggggaa

SEQ ID NO: 744425 - RNA, 20 nt, Human
uuuuccuucugaguauguug

SEQ ID NO: 744426 - RNA, 22 nt, Human
gagggccucugcugcuccacau

SEQ ID NO: 744427 - RNA, 22 nt, Human
acauucuagauauguuauauuu

SEQ ID NO: 744428 - RNA, 22 nt, Human
aaagccaguucuuuuauauugg

SEQ ID NO: 744429 - RNA, 22 nt, Human
uaaugcaauuuagcaaaguuuu

SEQ ID NO: 744430 - RNA, 22 nt, Human
augugcauuaaaugucaauguu

SEQ ID NO: 744431 - RNA, 22 nt, Human
agggcucugagugggaaagagg

SEQ ID NO: 744432 - RNA, 22 nt, Human
cagcuccucuguuagcccuggg

SEQ ID NO: 744433 - RNA, 22 nt, Human
acucugcccuaggccucugggg

SEQ ID NO: 744434 - RNA, 22 nt, Human
ucagagagcuggugggcagagg

SEQ ID NO: 744435 - RNA, 23 nt, Human
gccugugccuaugcccagcucug

SEQ ID NO: 744436 - RNA, 22 nt, Human
uuuugaaagccagguuuguaug

SEQ ID NO: 744437 - RNA, 22 nt, Human
aacuggaaugaaauuuacgaug

SEQ ID NO: 744438 - RNA, 22 nt, Human
aaaugcagcugggcaugagagg

SEQ ID NO: 744439 - RNA, 22 nt, Human
ugggaauacaaguuauucaccu

SEQ ID NO: 744440 - RNA, 18 nt, Human
ucacaugauuacccuggg

SEQ ID NO: 744441 - RNA, 22 nt, Human
agacuucuuugugagcauuuuc

SEQ ID NO: 744442 - RNA, 20 nt, Human
cugaggggucugacuuggac

SEQ ID NO: 744443 - RNA, 22 nt, Human
cugcacugcugaucccaggucu

SEQ ID NO: 744444 - RNA, 22 nt, Human
uuuuauugcaauaaagugugua

SEQ ID NO: 744445 - RNA, 22 nt, Human
acauucuuggacuccacucuag

SEQ ID NO: 744446 - RNA, 22 nt, Human
uuggggcaccuccccagcauuu

SEQ ID NO: 744447 - RNA, 22 nt, Human
aaguuccuguuacuccccagaa

SEQ ID NO: 744448 - RNA, 22 nt, Human
gacagcagaauccauucccagu

SEQ ID NO: 744449 - RNA, 17 nt, Human
cauucuguaaucuuucu

SEQ ID NO: 744450 - RNA, 21 nt, Human
uauggcuuuacuaagcugcac

SEQ ID NO: 744451 - RNA, 22 nt, Human
gaagcugugcugggggaucugu

SEQ ID NO: 744452 - RNA, 22 nt, Human
agacuauuaccuaaaagauaca

SEQ ID NO: 744453 - RNA, 18 nt, Human
uugccccugggugaggau

SEQ ID NO: 744454 - RNA, 20 nt, Human
gcugugccuccagcuggugg

SEQ ID NO: 744455 - RNA, 22 nt, Human
uucagugccuguccacagcuuc

SEQ ID NO: 744456 - RNA, 22 nt, Human
cugcugacagcccugcuucagg

SEQ ID NO: 744457 - RNA, 22 nt, Human
ucucagagaggggccgggccuu

SEQ ID NO: 744458 - RNA, 22 nt, Human
ugagcauuggaucaaaugacuu

SEQ ID NO: 744459 - RNA, 22 nt, Human
augaggcagcacaugggauugu

SEQ ID NO: 744460 - RNA, 22 nt, Human
ucacaaaucgaagccuuauaau

SEQ ID NO: 744461 - RNA, 22 nt, Human
cagaugcuuguuggcuggucuc

SEQ ID NO: 744462 - RNA, 22 nt, Human
agcagcaacugcuagaguggca

SEQ ID NO: 744463 - RNA, 22 nt, Human
cacuguggaauuagaauaaccu

SEQ ID NO: 744464 - RNA, 22 nt, Human
ugaguauuccuuaucugaaaug

SEQ ID NO: 744465 - RNA, 22 nt, Human
auaaggcagucccuuaacaagg

SEQ ID NO: 744466 - RNA, 22 nt, Human
uauacaaguaaugcugaaugau

SEQ ID NO: 744467 - RNA, 22 nt, Human
aaguuucaugauguaauuauug

SEQ ID NO: 744468 - RNA, 22 nt, Human
gucaucuuaaggacugcuauag

SEQ ID NO: 744469 - RNA, 22 nt, Human
gagcagcacugaguuagcagcu

SEQ ID NO: 744470 - RNA, 22 nt, Human
cucagugguugagagccugggc

SEQ ID NO: 744471 - RNA, 22 nt, Human
gcagggaccuugcccacccucc

SEQ ID NO: 744472 - RNA, 22 nt, Human
uuaaagcaaaaacuaggaugga

SEQ ID NO: 744473 - RNA, 22 nt, Human
cuccuccacagaguccuugcca

SEQ ID NO: 744474 - RNA, 22 nt, Human
gggugugucuuuugcuccugga

SEQ ID NO: 744475 - RNA, 22 nt, Human
cugcuccaagccagcccugcag

SEQ ID NO: 744476 - RNA, 22 nt, Human
ugcauguuaagaaaauauugag

SEQ ID NO: 744477 - RNA, 22 nt, Human
uuucaaagguuuugucaugucu

SEQ ID NO: 744478 - RNA, 22 nt, Human
uuauguaauuuguuugcucuuc

SEQ ID NO: 744479 - RNA, 22 nt, Human
gugggcaggagugagcaacagg

SEQ ID NO: 744480 - RNA, 22 nt, Human
acagcuggugaauguucucugu

SEQ ID NO: 744481 - RNA, 22 nt, Human
gaggagaaauuauccuuggugu

SEQ ID NO: 744482 - RNA, 22 nt, Human
cagagcacugcuuggaggauuu

SEQ ID NO: 744483 - RNA, 22 nt, Human
cuucuuaaaguugucacagcug

SEQ ID NO: 744484 - RNA, 22 nt, Human
caggacaucgucaucaugggga

SEQ ID NO: 744485 - RNA, 18 nt, Human
ggcaggagcaagaauagg

SEQ ID NO: 744486 - RNA, 22 nt, Human
aaacauucccuaauguguccgu

SEQ ID NO: 744487 - RNA, 22 nt, Human
accccccagauaaucccuugag

SEQ ID NO: 744488 - RNA, 22 nt, Human
ggcacacagcuuggcaggagau

SEQ ID NO: 744489 - RNA, 22 nt, Human
uuugugaauaagagaaugacag

SEQ ID NO: 744490 - RNA, 22 nt, Human
uggcccaggggcucuugguguu

SEQ ID NO: 744491 - RNA, 22 nt, Human
cagugcugagagccuggccagg

SEQ ID NO: 744492 - RNA, 22 nt, Human
aucaaugcuugccaaauggaag

SEQ ID NO: 744493 - RNA, 22 nt, Human
aaggucauugguucugaauucu

SEQ ID NO: 744494 - RNA, 22 nt, Human
cgaggcucagagagggugacuu

SEQ ID NO: 744495 - RNA, 22 nt, Human
uccaggaggugaggggaccaaa

SEQ ID NO: 744496 - RNA, 22 nt, Human
gccugguggugugcucaagugg

SEQ ID NO: 744497 - RNA, 22 nt, Human
gauagcagcucuggggucagac

SEQ ID NO: 744498 - RNA, 22 nt, Human
accauguguuuuacacauggua

SEQ ID NO: 744499 - RNA, 18 nt, Human
guuuacacauucuagaaa

SEQ ID NO: 744500 - RNA, 22 nt, Human
cccagcucccaaguugcuaugg

SEQ ID NO: 744501 - RNA, 16 nt, Human
ccaccugcagcucuca

SEQ ID NO: 744502 - RNA, 22 nt, Human
ggccuugggcgagucccucagu

SEQ ID NO: 744503 - RNA, 18 nt, Human
uacaguauuuucucgccu

SEQ ID NO: 744504 - RNA, 22 nt, Human
augcuuuacccacaccaggaug

SEQ ID NO: 744505 - RNA, 22 nt, Human
aggcuguccucucuugcucagu

SEQ ID NO: 744506 - RNA, 22 nt, Human
cacaauuguaucagaaaauagu

SEQ ID NO: 744507 - RNA, 22 nt, Human
auucacaauuagaaguagauaa

SEQ ID NO: 744508 - RNA, 22 nt, Human
guagaauuuuaauaauggagau

SEQ ID NO: 744509 - RNA, 22 nt, Human
ucaggaggccaccaggaccugu

SEQ ID NO: 744510 - RNA, 22 nt, Human
acaguuaucuuugaaauagaga

SEQ ID NO: 744511 - RNA, 22 nt, Human
ugcugccacugguagucucauu

SEQ ID NO: 744512 - RNA, 22 nt, Human
ucaugcaguuugaaguucaggg

SEQ ID NO: 744513 - RNA, 22 nt, Human
uaaauguguuagucaugguuuu

SEQ ID NO: 744514 - RNA, 22 nt, Human
acccagugacauccuuuaccug

SEQ ID NO: 744515 - RNA, 22 nt, Human
ucaguaaaugagcaaaaauuuc

SEQ ID NO: 744516 - RNA, 22 nt, Human
ggcaagugauccuggagcaccg

SEQ ID NO: 744517 - RNA, 22 nt, Human
caggaagggggauccuuggaag

SEQ ID NO: 744518 - RNA, 22 nt, Human
agugaaacagagcacagcaugc

SEQ ID NO: 744519 - RNA, 22 nt, Human
gacaggcaugcuuucaggacua

SEQ ID NO: 744520 - RNA, 19 nt, Human
cugugcccuaugacuugua

SEQ ID NO: 744521 - RNA, 22 nt, Human
ucagauuugaugugguuuucua

SEQ ID NO: 744522 - RNA, 22 nt, Human
aaacaacaugguggguguguag

SEQ ID NO: 744523 - RNA, 22 nt, Human
auuucccacucaggccgcggcg

SEQ ID NO: 744524 - RNA, 22 nt, Human
gcuccugcccucuugcaauucc

SEQ ID NO: 744525 - RNA, 19 nt, Human
aggacccuuauccuggcuu

SEQ ID NO: 744526 - RNA, 17 nt, Human
ucagcucagagcaccug

SEQ ID NO: 744527 - RNA, 22 nt, Human
agcagcuucagaggcgggcgca

SEQ ID NO: 744528 - RNA, 22 nt, Human
gcgccuggcacacagcaagggc

SEQ ID NO: 744529 - RNA, 22 nt, Human
ggagaagcaggugcuuuggguc

SEQ ID NO: 744530 - RNA, 22 nt, Human
ucacuacugacagagaugugua

SEQ ID NO: 744531 - RNA, 22 nt, Human
aaggcuggguaaccuguccacu

SEQ ID NO: 744532 - RNA, 22 nt, Human
aggagcagaccguaguccugca

SEQ ID NO: 744533 - RNA, 22 nt, Human
uggagccagcaggacucagagg

SEQ ID NO: 744534 - RNA, 22 nt, Human
ucuccugacaugucuggaggaa

SEQ ID NO: 744535 - RNA, 22 nt, Human
gagcugaacaucauggaaaggc

SEQ ID NO: 744536 - RNA, 22 nt, Human
auccaguucuuggaagcacagg

SEQ ID NO: 744537 - RNA, 22 nt, Human
ucacugucuuuuaaggugguua

SEQ ID NO: 744538 - RNA, 22 nt, Human
uugacaaaaauaacacagcaua

SEQ ID NO: 744539 - RNA, 22 nt, Human
ccucccacauccuagcucugcu

SEQ ID NO: 744540 - RNA, 22 nt, Human
cgggcacacacuugacagguuc

SEQ ID NO: 744541 - RNA, 22 nt, Human
cccaggcuuuuaaguuagacag

SEQ ID NO: 744542 - RNA, 22 nt, Human
auacagguaggggacauacauc

SEQ ID NO: 744543 - RNA, 22 nt, Human
acuggagcugagagcaugggua

SEQ ID NO: 744544 - RNA, 20 nt, Human
aggaacuuuguagaauacaa

SEQ ID NO: 744545 - RNA, 22 nt, Human
cagugggacaugggcacugggc

SEQ ID NO: 744546 - RNA, 22 nt, Human
gucacagguguggaggugcugg

SEQ ID NO: 744547 - RNA, 22 nt, Human
caauacuuuaguaaaauggccc

SEQ ID NO: 744548 - RNA, 17 nt, Human
agcugagcuggccaggg

SEQ ID NO: 744549 - RNA, 22 nt, Human
agauuauuuccagacuaaugaa

SEQ ID NO: 744550 - RNA, 17 nt, Human
agaugcuggccacaugu

SEQ ID NO: 744551 - RNA, 22 nt, Human
cuagaucagcuaacuuuccagu

SEQ ID NO: 744552 - RNA, 22 nt, Human
aggaaaacacaguauugaugga

SEQ ID NO: 744553 - RNA, 22 nt, Human
auauaucaugaguaaaacuuga

SEQ ID NO: 744554 - RNA, 22 nt, Human
aaggccauguaggaggcaugcg

SEQ ID NO: 744555 - RNA, 22 nt, Human
ccugucuuagggaaagacugga

SEQ ID NO: 744556 - RNA, 17 nt, Human
aagcauuuaauuugcua

SEQ ID NO: 744557 - RNA, 22 nt, Human
uauggguaucuguacugauugu

SEQ ID NO: 744558 - RNA, 22 nt, Human
gauaucaugggaagguguacuu

SEQ ID NO: 744559 - RNA, 22 nt, Human
uuauauuaguuagacuugcugu

SEQ ID NO: 744560 - RNA, 22 nt, Human
uccagggcagggugcgcauggg

SEQ ID NO: 744561 - RNA, 19 nt, Human
acagaaauuaguuauuuuc

SEQ ID NO: 744562 - RNA, 22 nt, Human
uuaugauuuagaaagauucacu

SEQ ID NO: 744563 - RNA, 22 nt, Human
ugaggccugaagccugaaguga

SEQ ID NO: 744564 - RNA, 22 nt, Human
aaucaauguuagucaugaauuu

SEQ ID NO: 744565 - RNA, 22 nt, Human
auggagcugugugaauauucau

SEQ ID NO: 744566 - RNA, 22 nt, Human
guaggcagaauaauuccuccuu

SEQ ID NO: 744567 - RNA, 22 nt, Human
auuuucugguugagguuuaaca

SEQ ID NO: 744568 - RNA, 22 nt, Human
cugcccaggggagugcugucgg

SEQ ID NO: 744569 - RNA, 22 nt, Human
cuuuagcaacgaugaugauauu

SEQ ID NO: 744570 - RNA, 20 nt, Human
auacacaugcagacagaugc

SEQ ID NO: 744571 - RNA, 22 nt, Human
ucaggcagguuggcugcagguc

SEQ ID NO: 744572 - RNA, 22 nt, Human
agguagggaagaaggcaugaaa

SEQ ID NO: 744573 - RNA, 18 nt, Human
agcagcugugccacacug

SEQ ID NO: 744574 - RNA, 22 nt, Human
uuguuuauguaauuggcacacu

SEQ ID NO: 744575 - RNA, 22 nt, Human
uccugggcccuccggaucaggu

SEQ ID NO: 744576 - RNA, 22 nt, Human
cucuccuauugugugguaagga

SEQ ID NO: 744577 - RNA, 22 nt, Human
ucuguuaaccuggucuuggcuu

SEQ ID NO: 744578 - RNA, 22 nt, Human
ucagaacauggcauguuccauc

SEQ ID NO: 744579 - RNA, 22 nt, Human
gcugccucuguagcuuuggacc

SEQ ID NO: 744580 - RNA, 22 nt, Human
aaacaccagucccaguauacac

SEQ ID NO: 744581 - RNA, 22 nt, Human
ugggccaguuucucauugaaau

SEQ ID NO: 744582 - RNA, 22 nt, Human
ugggaugggaucucgcuguguc

SEQ ID NO: 744583 - RNA, 22 nt, Human
gcuggccauagaagccaaagag

SEQ ID NO: 744584 - RNA, 22 nt, Human
ucaucacuguaucauugauaga

SEQ ID NO: 744585 - RNA, 22 nt, Human
agaguggcuucuuugacaugcu

SEQ ID NO: 744586 - RNA, 22 nt, Human
gggucaggcuagcccagacuuc

SEQ ID NO: 744587 - RNA, 23 nt, Human
gugcagcagugucugcagucaug

SEQ ID NO: 744588 - RNA, 22 nt, Human
aagaucauaauauuuaucucau

SEQ ID NO: 744589 - RNA, 22 nt, Human
uuugcaaagugacuauuauaug

SEQ ID NO: 744590 - RNA, 22 nt, Human
ucaaugauuagaguuuagugug

SEQ ID NO: 744591 - RNA, 22 nt, Human
gccuucaguaguauccucauga

SEQ ID NO: 744592 - RNA, 22 nt, Human
ggucaacagagguaaugguaac

SEQ ID NO: 744593 - RNA, 22 nt, Human
auauuacucugauuuaguaaau

SEQ ID NO: 744594 - RNA, 22 nt, Human
ugaggacauuggucaggacaug

SEQ ID NO: 744595 - RNA, 22 nt, Human
uggcucucaggccugcugcguu

SEQ ID NO: 744596 - RNA, 22 nt, Human
cuuccuucugaagcauagaagc

SEQ ID NO: 744597 - RNA, 22 nt, Human
ugcauuguugaccaguugugca

SEQ ID NO: 744598 - RNA, 22 nt, Human
ugucucugugcauuugugcuuc

SEQ ID NO: 744599 - RNA, 22 nt, Human
gagaagucauuugaccaccuag

SEQ ID NO: 744600 - RNA, 22 nt, Human
ccacaugagcuggcaaugcccu

SEQ ID NO: 744601 - RNA, 22 nt, Human
aagcccagaugggagcauuuca

SEQ ID NO: 744602 - RNA, 22 nt, Human
ucugugcaaguauuugacauuu

SEQ ID NO: 744603 - RNA, 22 nt, Human
cuggcccagguggucguugagg

SEQ ID NO: 744604 - RNA, 22 nt, Human
acacugaaggcuacaagguuga

SEQ ID NO: 744605 - RNA, 22 nt, Human
gggaggcucagugguguccucu

SEQ ID NO: 744606 - RNA, 22 nt, Human
cuguccuguacuuugaggcccu

SEQ ID NO: 744607 - RNA, 22 nt, Human
ugcauucaaaucuccaggcuca

SEQ ID NO: 744608 - RNA, 22 nt, Human
ccagacugagggucccugagcu

SEQ ID NO: 744609 - RNA, 22 nt, Human
agggcccucugggcacuguggc

SEQ ID NO: 744610 - RNA, 19 nt, Human
gaacaauuuguuagcucuc

SEQ ID NO: 744611 - RNA, 22 nt, Human
gggcuggaggagauccagaggc

SEQ ID NO: 744612 - RNA, 22 nt, Human
ucucaggcccacuguguugaaa

SEQ ID NO: 744613 - RNA, 22 nt, Human
uuuuguuggcuuaagaaauaca

SEQ ID NO: 744614 - RNA, 22 nt, Human
aaugaagcaguuuucaucaagu

SEQ ID NO: 744615 - RNA, 22 nt, Human
aaagccagggacagugugcaug

SEQ ID NO: 744616 - RNA, 22 nt, Human
ucacugugcucucuagauaggc

SEQ ID NO: 744617 - RNA, 22 nt, Human
aaauccuuuucuauacagcaua

SEQ ID NO: 744618 - RNA, 22 nt, Human
ccuuagcauggcugugcugugu

SEQ ID NO: 744619 - RNA, 21 nt, Human
aagaggaagcauuauggcaua

SEQ ID NO: 744620 - RNA, 22 nt, Human
aaaguucugggggagaagaacg

SEQ ID NO: 744621 - RNA, 22 nt, Human
uguagaaagaauauguuucaua

SEQ ID NO: 744622 - RNA, 22 nt, Human
uuaaacagguuuuugaauggcc

SEQ ID NO: 744623 - RNA, 22 nt, Human
aggcaggaaaaucgcuugaacc

SEQ ID NO: 744624 - RNA, 22 nt, Human
ucccguugaugacggugcaucc

SEQ ID NO: 744625 - RNA, 21 nt, Human
uucaugagauaaccagcugua

SEQ ID NO: 744626 - RNA, 22 nt, Human
uggagaguuuagccuacuggaa

SEQ ID NO: 744627 - RNA, 22 nt, Human
cuggaacccaggccuggaagcc

SEQ ID NO: 744628 - RNA, 22 nt, Human
uauuccuauuucuaaacauaug

SEQ ID NO: 744629 - RNA, 22 nt, Human
aauuagggaaaauuuacuugua

SEQ ID NO: 744630 - RNA, 22 nt, Human
caggguggcccuguggucucau

SEQ ID NO: 744631 - RNA, 22 nt, Human
aacacucaauuuacaaacucug

SEQ ID NO: 744632 - RNA, 22 nt, Human
auguuuucuagaguuuaaaauc

SEQ ID NO: 744633 - RNA, 22 nt, Human
cuuuauguccaccagacugcaa

SEQ ID NO: 744634 - RNA, 22 nt, Human
agcugccuguaaaaugugugau

SEQ ID NO: 744635 - RNA, 22 nt, Human
uuacaagaucuuugaaggcaag

SEQ ID NO: 744636 - RNA, 22 nt, Human
uucugaugauggcggcuggagc

SEQ ID NO: 744637 - RNA, 22 nt, Human
ggugggguuuuaggcugcugca

SEQ ID NO: 744638 - RNA, 22 nt, Human
ccaccagcuuugccacccugcu

SEQ ID NO: 744639 - RNA, 22 nt, Human
agauguggaaagaaguuagaag

SEQ ID NO: 744640 - RNA, 22 nt, Human
uuguaauuugcaaauguauugu

SEQ ID NO: 744641 - RNA, 22 nt, Human
ucauaaauucuggugcugugag

SEQ ID NO: 744642 - RNA, 22 nt, Human
uccucagacacccugcuggcuu

SEQ ID NO: 744643 - RNA, 22 nt, Human
gucucagugcccaaugccauaa

SEQ ID NO: 744644 - RNA, 22 nt, Human
gacuggucuuuugugauggaug

SEQ ID NO: 744645 - RNA, 22 nt, Human
uguaccaaacccaucauaacua

SEQ ID NO: 744646 - RNA, 22 nt, Human
ugaugcuguuccaguuauauug

SEQ ID NO: 744647 - RNA, 22 nt, Human
gagcuuccauggacgccaucug

SEQ ID NO: 744648 - RNA, 22 nt, Human
auguuauugaugccugaggcuu

SEQ ID NO: 744649 - RNA, 22 nt, Human
uugcauuuccuguacuguuuga

SEQ ID NO: 744650 - RNA, 22 nt, Human
guacuuuaagacuccaguagca

SEQ ID NO: 744651 - RNA, 20 nt, Human
auucuaaagcucugcucuuu

SEQ ID NO: 744652 - RNA, 22 nt, Human
acacagccaggguaguaaggcu

SEQ ID NO: 744653 - RNA, 22 nt, Human
gcagagccuugcgucaugugcc

SEQ ID NO: 744654 - RNA, 22 nt, Human
uuucaaacugcccagcacaccu

SEQ ID NO: 744655 - RNA, 22 nt, Human
ucagguuuuucucaaaucaggu

SEQ ID NO: 744656 - RNA, 22 nt, Human
uucuuucaauagcuggcauaug

SEQ ID NO: 744657 - RNA, 22 nt, Human
ccaggaagguaugggaagaaaa

SEQ ID NO: 744658 - RNA, 22 nt, Human
gaggcacucucgacaagggugg

SEQ ID NO: 744659 - RNA, 22 nt, Human
ugcccuggaaccaucuacaguc

SEQ ID NO: 744660 - RNA, 22 nt, Human
cacagcaaaggcuucggcugau

SEQ ID NO: 744661 - RNA, 22 nt, Human
uggcagggaguugcaggauuuc

SEQ ID NO: 744662 - RNA, 22 nt, Human
uucagugccgugcugggucgcu

SEQ ID NO: 744663 - RNA, 22 nt, Human
ccuggcacgaagggcugagguu

SEQ ID NO: 744664 - RNA, 22 nt, Human
aguccaagaucaaggugucaac

SEQ ID NO: 744665 - RNA, 22 nt, Human
ggcagcaacucggagagaagag

SEQ ID NO: 744666 - RNA, 22 nt, Human
acaaaugaaccugaaaucucag

SEQ ID NO: 744667 - RNA, 22 nt, Human
gcugggcucguucccacacgcg

SEQ ID NO: 744668 - RNA, 22 nt, Human
aaaugcuuauuagugucacaaa

SEQ ID NO: 744669 - RNA, 22 nt, Human
caaugaaaauuuaaguugcagc

SEQ ID NO: 744670 - RNA, 22 nt, Human
ugucaugcagguuuguuauaga

SEQ ID NO: 744671 - RNA, 22 nt, Human
gcugccuggcuuuaguccacuu

SEQ ID NO: 744672 - RNA, 22 nt, Human
uuaauacagucuccagaaguaa

SEQ ID NO: 744673 - RNA, 22 nt, Human
augucuguucauuauuaacugc

SEQ ID NO: 744674 - RNA, 22 nt, Human
gcugcuggaugcgcuugauggu

SEQ ID NO: 744675 - RNA, 22 nt, Human
ugggugugcccagauggugucc

SEQ ID NO: 744676 - RNA, 22 nt, Human
acugggcucauaaugucauaga

SEQ ID NO: 744677 - RNA, 22 nt, Human
gcgcagaguagcagagugcuga

SEQ ID NO: 744678 - RNA, 22 nt, Human
cuuuuuaucucuuaaugauguu

SEQ ID NO: 744679 - RNA, 22 nt, Human
agagagguuggcuaggauguuu

SEQ ID NO: 744680 - RNA, 22 nt, Human
aagggcagcuuaaauugguagc

SEQ ID NO: 744681 - RNA, 22 nt, Human
uuuuaauuuugcaaaucuggug

SEQ ID NO: 744682 - RNA, 22 nt, Human
ugagaguauuuuggcauuauca

SEQ ID NO: 744683 - RNA, 22 nt, Human
ucugcccacagccuccugucca

SEQ ID NO: 744684 - RNA, 22 nt, Human
uaacucugaauccucacagcag

SEQ ID NO: 744685 - RNA, 21 nt, Human
ggagcugcaggagccgaaggc

SEQ ID NO: 744686 - RNA, 22 nt, Human
uucugggccuccuaggacaggc

SEQ ID NO: 744687 - RNA, 22 nt, Human
agauuauuuaagacaggaacca

SEQ ID NO: 744688 - RNA, 22 nt, Human
uacacaauucuggaugcauguc

SEQ ID NO: 744689 - RNA, 22 nt, Human
guggggaggccuaagcaaguug

SEQ ID NO: 744690 - RNA, 22 nt, Human
uccuguuuccaauuuguugggu

SEQ ID NO: 744691 - RNA, 22 nt, Human
aagaacaacugcuuuaaaagca

SEQ ID NO: 744692 - RNA, 22 nt, Human
uuacagaggcuuccagggccca

SEQ ID NO: 744693 - RNA, 22 nt, Human
gccaggguucgaauccguaugg

SEQ ID NO: 744694 - RNA, 19 nt, Human
ugccagcauuaggcugaag

SEQ ID NO: 744695 - RNA, 22 nt, Human
aggcccugagaaaaucccugca

SEQ ID NO: 744696 - RNA, 22 nt, Human
cguucucucaugaucuucccga

SEQ ID NO: 744697 - RNA, 22 nt, Human
uuucuaagaauauugcucuuaa

SEQ ID NO: 744698 - RNA, 22 nt, Human
caagaauauaaauacuuucaaa

SEQ ID NO: 744699 - RNA, 22 nt, Human
aggcuucauguguccuggguga

SEQ ID NO: 744700 - RNA, 22 nt, Human
aucuauucucuacaguagacag

SEQ ID NO: 744701 - RNA, 23 nt, Human
uggacgccgacuuuggaggcgcu

SEQ ID NO: 744702 - RNA, 22 nt, Human
acacagauaaugcucauauagg

SEQ ID NO: 744703 - RNA, 22 nt, Human
uuucuucuugauuuaaacaggg

SEQ ID NO: 744704 - RNA, 22 nt, Human
agaugcugucacacacacuguu

SEQ ID NO: 744705 - RNA, 22 nt, Human
guggccuuuucaaguaggguau

SEQ ID NO: 744706 - RNA, 22 nt, Human
ucauggcacuuagcacaguccu

SEQ ID NO: 744707 - RNA, 22 nt, Human
ucagcugcagcaggcaccauuu

SEQ ID NO: 744708 - RNA, 22 nt, Human
cugcacguauaaucagucuguu

SEQ ID NO: 744709 - RNA, 19 nt, Human
uaguggagugacaaguucu

SEQ ID NO: 744710 - RNA, 22 nt, Human
gcacaauaauucuuguuuugcu

SEQ ID NO: 744711 - RNA, 22 nt, Human
cuguggggaaaggguccugcuc

SEQ ID NO: 744712 - RNA, 22 nt, Human
auggaagcugaaaaagacacgg

SEQ ID NO: 744713 - RNA, 22 nt, Human
aaguguuuuguaaacagaaaag

SEQ ID NO: 744714 - RNA, 22 nt, Human
uggaccaugagcugcagguguu

SEQ ID NO: 744715 - RNA, 19 nt, Human
ggcagacacaguugacaug

SEQ ID NO: 744716 - RNA, 22 nt, Human
aauuuuacuaaucugaguguga

SEQ ID NO: 744717 - RNA, 22 nt, Human
uuugauuuucagcaauaguggc

SEQ ID NO: 744718 - RNA, 22 nt, Human
gacccuggagccgucugaggca

SEQ ID NO: 744719 - RNA, 22 nt, Human
caggcugugggagucaggaccc

SEQ ID NO: 744720 - RNA, 22 nt, Human
gauggcuucacuuacauggcug

SEQ ID NO: 744721 - RNA, 23 nt, Human
ucacauaauccuucauccacagg

SEQ ID NO: 744722 - RNA, 22 nt, Human
accauagacuggaggaucuccu

SEQ ID NO: 744723 - RNA, 22 nt, Human
ugugccaucugauauaagagcc

SEQ ID NO: 744724 - RNA, 19 nt, Human
gucccuucacuccugcugg

SEQ ID NO: 744725 - RNA, 22 nt, Human
ugggaggcccaggccuggcagg

SEQ ID NO: 744726 - RNA, 18 nt, Human
aucuuuccauagcauguu

SEQ ID NO: 744727 - RNA, 22 nt, Human
caauagcagaccuagaaagcaa

SEQ ID NO: 744728 - RNA, 22 nt, Human
agguauauugaaugcuuacuua

SEQ ID NO: 744729 - RNA, 22 nt, Human
aaaaauagaaggauugacugag

SEQ ID NO: 744730 - RNA, 22 nt, Human
uguuacacagcagaauagcaag

SEQ ID NO: 744731 - RNA, 22 nt, Human
uggaugccugggccuccuucca

SEQ ID NO: 744732 - RNA, 23 nt, Human
cugcagagaacugagggacagcc

SEQ ID NO: 744733 - RNA, 22 nt, Human
aaagcccauguggaaguacagg

SEQ ID NO: 744734 - RNA, 22 nt, Human
ucuguaaaauuaguauaauugu

SEQ ID NO: 744735 - RNA, 22 nt, Human
auaagcaugauuaccgggagca

SEQ ID NO: 744736 - RNA, 22 nt, Human
ucaggugggcguuccggugcgg

SEQ ID NO: 744737 - RNA, 18 nt, Human
auggucucauacugggag

SEQ ID NO: 744738 - RNA, 22 nt, Human
guaaugcuuuugauacagggac

SEQ ID NO: 744739 - RNA, 21 nt, Human
uugcuuauggcacugcuuugc

SEQ ID NO: 744740 - RNA, 22 nt, Human
uuucaaggcuaauccacaguau

SEQ ID NO: 744741 - RNA, 22 nt, Human
cauguuaauaugcauugaguac

SEQ ID NO: 744742 - RNA, 22 nt, Human
cugaggaucuaauuauuggguc

SEQ ID NO: 744743 - RNA, 22 nt, Human
gaacauuugaugaugacauugg

SEQ ID NO: 744744 - RNA, 22 nt, Human
ccagguggaggugugagguccu

SEQ ID NO: 744745 - RNA, 22 nt, Human
uguuuucugauucucguguggu

SEQ ID NO: 744746 - RNA, 22 nt, Human
cacaaaaguaggaggcaggcgg

SEQ ID NO: 744747 - RNA, 22 nt, Human
ucccaagacgaugugcuuggcc

SEQ ID NO: 744748 - RNA, 22 nt, Human
ucucugugacauuucugagccu

SEQ ID NO: 744749 - RNA, 18 nt, Human
caggaauggaugggauuu

SEQ ID NO: 744750 - RNA, 22 nt, Human
cucugggugugacagcaccugg

SEQ ID NO: 744751 - RNA, 22 nt, Human
guucuacaguuccuauuacuua

SEQ ID NO: 744752 - RNA, 22 nt, Human
ugccugcuuguguaccugguga

SEQ ID NO: 744753 - RNA, 22 nt, Human
acugaagaacgcaucagugguu

SEQ ID NO: 744754 - RNA, 22 nt, Human
ccuggguccaauucuggcuugu

SEQ ID NO: 744755 - RNA, 22 nt, Human
uucaucuguagcaucuuccaau

SEQ ID NO: 744756 - RNA, 22 nt, Human
ucucugcuugguguaugugagu

SEQ ID NO: 744757 - RNA, 22 nt, Human
aaggaccugauuuugagcaucu

SEQ ID NO: 744758 - RNA, 22 nt, Human
gucauauacacugcauguaauc

SEQ ID NO: 744759 - RNA, 22 nt, Human
uccaggucugugagcuaaaugg

SEQ ID NO: 744760 - RNA, 22 nt, Human
gaagcagucagcagcaccuuug

SEQ ID NO: 744761 - RNA, 22 nt, Human
ucacuggggccuuuggucagga

SEQ ID NO: 744762 - RNA, 22 nt, Human
aaguggcacgcuuuuuggaguu

SEQ ID NO: 744763 - RNA, 22 nt, Human
ccuuuacaucugacuucuuuca

SEQ ID NO: 744764 - RNA, 22 nt, Human
ucccauguguuccucuagucua

SEQ ID NO: 744765 - RNA, 22 nt, Human
uacaugcauguguguaaauaua

SEQ ID NO: 744766 - RNA, 21 nt, Human
agauuacaggugugauccacc

SEQ ID NO: 744767 - RNA, 16 nt, Human
aaagaaacaggugucc

SEQ ID NO: 744768 - RNA, 22 nt, Human
ugugaggccuagacagccuggg

SEQ ID NO: 744769 - RNA, 18 nt, Human
gugcaugcaugcucugcc

SEQ ID NO: 744770 - RNA, 22 nt, Human
ggccagccuggggcucccagac

SEQ ID NO: 744771 - RNA, 22 nt, Human
ugcauauuauaaagagaauuag

SEQ ID NO: 744772 - RNA, 22 nt, Human
aucuuacacgauaacuguuagu

SEQ ID NO: 744773 - RNA, 22 nt, Human
uggcaggaaauacccugccuag

SEQ ID NO: 744774 - RNA, 22 nt, Human
cuugagaaucuugaugucuacc

SEQ ID NO: 744775 - RNA, 22 nt, Human
acugggccggugcagaguaguu

SEQ ID NO: 744776 - RNA, 22 nt, Human
ugcauaaacagauacuucaugu

SEQ ID NO: 744777 - RNA, 22 nt, Human
agcauuuauagccccuaucauc

SEQ ID NO: 744778 - RNA, 22 nt, Human
cugagaggcacaaggcauuucg

SEQ ID NO: 744779 - RNA, 22 nt, Human
ggcugaguggagguagcccugu

SEQ ID NO: 744780 - RNA, 18 nt, Human
cacccuccgcggcugccc

SEQ ID NO: 744781 - RNA, 22 nt, Human
gagcuaggcuagggggagucgc

SEQ ID NO: 744782 - RNA, 22 nt, Human
gucaggauuauaauccccaugg

SEQ ID NO: 744783 - RNA, 23 nt, Human
uggauaaagcugugcugcauagg

SEQ ID NO: 744784 - RNA, 22 nt, Human
auccuguuugucacuagaaaau

SEQ ID NO: 744785 - RNA, 22 nt, Human
uagggcuguuuaaaagugaggu

SEQ ID NO: 744786 - RNA, 21 nt, Human
gagagggcauuauaggaagug

SEQ ID NO: 744787 - RNA, 22 nt, Human
uugcuuuaucuaagcauggcca

SEQ ID NO: 744788 - RNA, 22 nt, Human
cauucaucuaucaaaugguacc

SEQ ID NO: 744789 - RNA, 22 nt, Human
cagugcagucaaggaagaacca

SEQ ID NO: 744790 - RNA, 22 nt, Human
augugucuucuaagccaagccu

SEQ ID NO: 744791 - RNA, 22 nt, Human
uucaggaucacuaaacccucca

SEQ ID NO: 744792 - RNA, 22 nt, Human
uuaggaaaggaacauugaaacg

SEQ ID NO: 744793 - RNA, 22 nt, Human
uguguucaaucaccaaagguau

SEQ ID NO: 744794 - RNA, 22 nt, Human
acaaugugauaauuuaaagaua

SEQ ID NO: 744795 - RNA, 22 nt, Human
aguaauaauagcuguaaagugc

SEQ ID NO: 744796 - RNA, 22 nt, Human
acuucuggugucauacugcauu

SEQ ID NO: 744797 - RNA, 22 nt, Human
aaugucaaaauggaaugagacu

SEQ ID NO: 744798 - RNA, 22 nt, Human
aaacagaaauuuccucaugcuc

SEQ ID NO: 744799 - RNA, 22 nt, Human
aaauuagaagugcucaggaaua

SEQ ID NO: 744800 - RNA, 22 nt, Human
gucccagaggacagggucacau

SEQ ID NO: 744801 - RNA, 22 nt, Human
gugcugagaguuuauuaugaua

SEQ ID NO: 744802 - RNA, 22 nt, Human
ugcugccauggucgcugguguc

SEQ ID NO: 744803 - RNA, 20 nt, Human
augugcugggcaauauguua

SEQ ID NO: 744804 - RNA, 20 nt, Human
cuguagggugcagcaggcuc

SEQ ID NO: 744805 - RNA, 23 nt, Human
cuggaagugcuuuuauagcuuug

SEQ ID NO: 744806 - RNA, 22 nt, Human
ugagguggaaggauccuuugaa

SEQ ID NO: 744807 - RNA, 22 nt, Human
agagccuggggauuggcaaggg

SEQ ID NO: 744808 - RNA, 19 nt, Human
ugaaggagggggauggcca

SEQ ID NO: 744809 - RNA, 22 nt, Human
aggucccaggcauagcuggucu

SEQ ID NO: 744810 - RNA, 22 nt, Human
ggcuugagacccgggagccaga

SEQ ID NO: 744811 - RNA, 22 nt, Human
ugcagggccuugggaugugucc

SEQ ID NO: 744812 - RNA, 22 nt, Human
aaauuauaggugccaccuugga

SEQ ID NO: 744813 - RNA, 21 nt, Human
cacaagacacauaggguguuu

SEQ ID NO: 744814 - RNA, 22 nt, Human
cccaguggcccagcauguggug

SEQ ID NO: 744815 - RNA, 22 nt, Human
aacuuuauuguuaggggcuaaa

SEQ ID NO: 744816 - RNA, 22 nt, Human
ugaggcacauccaggccagcuc

SEQ ID NO: 744817 - RNA, 22 nt, Human
cccaguuucaacuuuccagugg

SEQ ID NO: 744818 - RNA, 22 nt, Human
ugucuuuuuaccugugaugagu

SEQ ID NO: 744819 - RNA, 22 nt, Human
gggcagcagagcccugccgagu

SEQ ID NO: 744820 - RNA, 19 nt, Human
ugacagagagcaggguggu

SEQ ID NO: 744821 - RNA, 22 nt, Human
gcuucagacuggagcagaggaa

SEQ ID NO: 744822 - RNA, 22 nt, Human
aagcaggugugagccagugggc

SEQ ID NO: 744823 - RNA, 22 nt, Human
cucuggaguggguggccgggag

SEQ ID NO: 744824 - RNA, 22 nt, Human
ugaaauguagauuaggcauucu

SEQ ID NO: 744825 - RNA, 22 nt, Human
cuggcuugaaguuaugcaccag

SEQ ID NO: 744826 - RNA, 22 nt, Human
aguuuccuuggauucaauuugg

SEQ ID NO: 744827 - RNA, 22 nt, Human
aaggcagucaaagcagacuucu

SEQ ID NO: 744828 - RNA, 22 nt, Human
uucuauugacauucacuguaac

SEQ ID NO: 744829 - RNA, 22 nt, Human
agucucugcaugaugcagcaca

SEQ ID NO: 744830 - RNA, 22 nt, Human
augccacugacauggacaauuu

SEQ ID NO: 744831 - RNA, 22 nt, Human
augucacauggucaccucuagc

SEQ ID NO: 744832 - RNA, 22 nt, Human
uccaggcaaaaaccaacuacag

SEQ ID NO: 744833 - RNA, 22 nt, Human
gagcccgagcgcguacccggcg

SEQ ID NO: 744834 - RNA, 22 nt, Human
gaagcuuuauugcaagugaggc

SEQ ID NO: 744835 - RNA, 22 nt, Human
uggguuaaaaugauaccuugca

SEQ ID NO: 744836 - RNA, 22 nt, Human
uagcugggagugucugaugggu

SEQ ID NO: 744837 - RNA, 22 nt, Human
gaaugacauugagccauaacau

SEQ ID NO: 744838 - RNA, 22 nt, Human
ccuuccuugagaagcaauuccu

SEQ ID NO: 744839 - RNA, 22 nt, Human
agccugggcccugccucuucuc

SEQ ID NO: 744840 - RNA, 22 nt, Human
augcuaaagcuuugcuuucauu

SEQ ID NO: 744841 - RNA, 22 nt, Human
ucucccuucucuggauuccguu

SEQ ID NO: 744842 - RNA, 22 nt, Human
agugggcaugaucuggugucug

SEQ ID NO: 744843 - RNA, 22 nt, Human
cuuguagcugcuucuucugaag

SEQ ID NO: 744844 - RNA, 22 nt, Human
ccagagcagauguggccuuggu

SEQ ID NO: 744845 - RNA, 22 nt, Human
cauucauucacauuuugucuau

SEQ ID NO: 744846 - RNA, 22 nt, Human
gggcccugggauucagagcaag

SEQ ID NO: 744847 - RNA, 22 nt, Human
gaagcagagccuaaggcagaca

SEQ ID NO: 744848 - RNA, 22 nt, Human
gcuggugccuuguuguuguuac

SEQ ID NO: 744849 - RNA, 22 nt, Human
gaaugaagcaggucacacaguu

SEQ ID NO: 744850 - RNA, 22 nt, Human
uugggacaucuggcauacaguu

SEQ ID NO: 744851 - RNA, 22 nt, Human
gacccugccaugagugacaggg

SEQ ID NO: 744852 - RNA, 22 nt, Human
auggaagaguccccauggauga

SEQ ID NO: 744853 - RNA, 22 nt, Human
cugugcugaacaauucugcauu

SEQ ID NO: 744854 - RNA, 22 nt, Human
auauagcugagggguauuauaa

SEQ ID NO: 744855 - RNA, 22 nt, Human
aagggagcggggagacccuaug

SEQ ID NO: 744856 - RNA, 22 nt, Human
aacacuuuuuaguaaagauuga

SEQ ID NO: 744857 - RNA, 22 nt, Human
gcuccccuugguccuccuggga

SEQ ID NO: 744858 - RNA, 22 nt, Human
gauuucuaaggaggcugaacuu

SEQ ID NO: 744859 - RNA, 22 nt, Human
gccugcucuggaauccauguaa

SEQ ID NO: 744860 - RNA, 22 nt, Human
guuauuaguaagacucgcacau

SEQ ID NO: 744861 - RNA, 22 nt, Human
caggaacaggcugaugggcagg

SEQ ID NO: 744862 - RNA, 19 nt, Human
uucuguguuaauuccuuua

SEQ ID NO: 744863 - RNA, 22 nt, Human
uuguuuguaaggcucuuagaau

SEQ ID NO: 744864 - RNA, 16 nt, Human
uuuuauugugacagcc

SEQ ID NO: 744865 - RNA, 22 nt, Human
acacuguugcuggcacagacag

SEQ ID NO: 744866 - RNA, 22 nt, Human
aagcaaagugcuuugccuccag

SEQ ID NO: 744867 - RNA, 22 nt, Human
aaauuauuauaggcagagcuga

SEQ ID NO: 744868 - RNA, 20 nt, Human
uacaaguacauuauaguuau

SEQ ID NO: 744869 - RNA, 22 nt, Human
aaugaacuggagaacaaugacc

SEQ ID NO: 744870 - RNA, 20 nt, Human
cucuccuugccgacuuggca

SEQ ID NO: 744871 - RNA, 22 nt, Human
caaauguauucucacuucaggg

SEQ ID NO: 744872 - RNA, 22 nt, Human
auagaagcuuuuaaauaacagg

SEQ ID NO: 744873 - RNA, 22 nt, Human
gguauuuauaugucugaagcug

SEQ ID NO: 744874 - RNA, 22 nt, Human
aggauguguucauagcugacgc

SEQ ID NO: 744875 - RNA, 22 nt, Human
uuacauguuuaugugguacaug

SEQ ID NO: 744876 - RNA, 22 nt, Human
gcccacaguacgaggcucaggc

SEQ ID NO: 744877 - RNA, 22 nt, Human
aauguuacaguuuuaauucuga

SEQ ID NO: 744878 - RNA, 22 nt, Human
cacugacaguaucagagcuguu

SEQ ID NO: 744879 - RNA, 22 nt, Human
gccaggagugucccacucauuu

SEQ ID NO: 744880 - RNA, 22 nt, Human
uggcagagugcagaagaggcau

SEQ ID NO: 744881 - RNA, 22 nt, Human
uguuuguagagacagcugaugc

SEQ ID NO: 744882 - RNA, 22 nt, Human
aaggugugaagagaugggaaga

SEQ ID NO: 744883 - RNA, 22 nt, Human
caggcacaaauuucuagauaag

SEQ ID NO: 744884 - RNA, 22 nt, Human
caggaagaggacaggcuucccc

SEQ ID NO: 744885 - RNA, 22 nt, Human
gacaggcaggccagggcugugg

SEQ ID NO: 744886 - RNA, 23 nt, Human
aguggggaaucaacagauucuuu

SEQ ID NO: 744887 - RNA, 22 nt, Human
cagcucugggugacaggagggc

SEQ ID NO: 744888 - RNA, 22 nt, Human
uugcaaaugugguuagggcuuu

SEQ ID NO: 744889 - RNA, 19 nt, Human
gaggaggcuucagcuuucu

SEQ ID NO: 744890 - RNA, 22 nt, Human
ggcagcucugcuccacaugagu

SEQ ID NO: 744891 - RNA, 22 nt, Human
uaucuguuaggaucagagcugg

SEQ ID NO: 744892 - RNA, 22 nt, Human
auaugcacacucugcccacaga

SEQ ID NO: 744893 - RNA, 22 nt, Human
cauggccagggcagauggcagg

SEQ ID NO: 744894 - RNA, 18 nt, Human
uugcagguaccucuaucu

SEQ ID NO: 744895 - RNA, 22 nt, Human
gcagggccagugcagagaggaa

SEQ ID NO: 744896 - RNA, 22 nt, Human
ggcaguuucaucaggagaaaag

SEQ ID NO: 744897 - RNA, 22 nt, Human
aaagccuucaaguagauguaag

SEQ ID NO: 744898 - RNA, 20 nt, Human
aaauuuaggaaauuuuacgc

SEQ ID NO: 744899 - RNA, 22 nt, Human
ggaggucauagcugugcaggua

SEQ ID NO: 744900 - RNA, 22 nt, Human
cugcuggcaagcccaguuggag

SEQ ID NO: 744901 - RNA, 22 nt, Human
cucagcccagcccaggaccagg

SEQ ID NO: 744902 - RNA, 23 nt, Human
ugagaagccauuagagcaggugg

SEQ ID NO: 744903 - RNA, 22 nt, Human
ugaagcacauuucuugagauga

SEQ ID NO: 744904 - RNA, 22 nt, Human
cuugcacacauguacaugugua

SEQ ID NO: 744905 - RNA, 22 nt, Human
augugcuuuaaagaagccagcu

SEQ ID NO: 744906 - RNA, 22 nt, Human
ccuguguuuagauaugaugcug

SEQ ID NO: 744907 - RNA, 19 nt, Human
aaauuggcaugcugaccuc

SEQ ID NO: 744908 - RNA, 22 nt, Human
uuuguggcaggagcggagaccg

SEQ ID NO: 744909 - RNA, 22 nt, Human
gaacagugccagcacacaauaa

SEQ ID NO: 744910 - RNA, 22 nt, Human
acagucuugagcaucagccaga

SEQ ID NO: 744911 - RNA, 22 nt, Human
ggccucugguucguggugaccu

SEQ ID NO: 744912 - RNA, 22 nt, Human
agggccaguauuaagguaauua

SEQ ID NO: 744913 - RNA, 22 nt, Human
ucccaggauguuuauggcuggu

SEQ ID NO: 744914 - RNA, 22 nt, Human
gagggagggccaggucccaacc

SEQ ID NO: 744915 - RNA, 22 nt, Human
ggagaugcuauguaguuugguu

SEQ ID NO: 744916 - RNA, 22 nt, Human
acaauucaagaagagagaugaa

SEQ ID NO: 744917 - RNA, 22 nt, Human
ugugcuauuugacuguuugcua

SEQ ID NO: 744918 - RNA, 22 nt, Human
cuccugucaauaggcuccuggc

SEQ ID NO: 744919 - RNA, 22 nt, Human
cccucugguuugcccuugggug

SEQ ID NO: 744920 - RNA, 22 nt, Human
agugcauguaucuacagucaca

SEQ ID NO: 744921 - RNA, 22 nt, Human
ggaagccaggcugggggaucug

SEQ ID NO: 744922 - RNA, 23 nt, Human
uccuaacucaauucagggguguc

SEQ ID NO: 744923 - RNA, 22 nt, Human
ggagggugcuuaaguuguguuu

SEQ ID NO: 744924 - RNA, 22 nt, Human
aggagaaguaaggcuagaugau

SEQ ID NO: 744925 - RNA, 22 nt, Human
uguaggaagauauaaaauaucu

SEQ ID NO: 744926 - RNA, 22 nt, Human
ucaguccuccacacaggcaccc

SEQ ID NO: 744927 - RNA, 22 nt, Human
gugaaggaguuaucagugguua

SEQ ID NO: 744928 - RNA, 22 nt, Human
gugggcaggaggcccugcccug

SEQ ID NO: 744929 - RNA, 21 nt, Human
guccacagggguuuguccugg

SEQ ID NO: 744930 - RNA, 22 nt, Human
ucuguucuuaaagcauucuugc

SEQ ID NO: 744931 - RNA, 22 nt, Human
acauccagaggcguggaaggcu

SEQ ID NO: 744932 - RNA, 22 nt, Human
uuuaggucuucuuaagagucaa

SEQ ID NO: 744933 - RNA, 22 nt, Human
aguguacauguuuacagcaucu

SEQ ID NO: 744934 - RNA, 22 nt, Human
acaauguucucugaguugugug

SEQ ID NO: 744935 - RNA, 22 nt, Human
acagagcaguaagaacacagcu

SEQ ID NO: 744936 - RNA, 22 nt, Human
aaugaagaaauggacaucuuua

SEQ ID NO: 744937 - RNA, 22 nt, Human
agguccagcuguugcagccucc

SEQ ID NO: 744938 - RNA, 22 nt, Human
augcaauuuacuguacauaaau

SEQ ID NO: 744939 - RNA, 22 nt, Human
ggcugcccucugcugacugcaa

SEQ ID NO: 744940 - RNA, 22 nt, Human
ucugccacugugaugcaugaua

SEQ ID NO: 744941 - RNA, 22 nt, Human
aggccagcaccagagucaagaa

SEQ ID NO: 744942 - RNA, 22 nt, Human
uaacagaguaacagguauguaa

SEQ ID NO: 744943 - RNA, 22 nt, Human
ucaguucuuauuuucaugaaua

SEQ ID NO: 744944 - RNA, 20 nt, Human
cgaggccaaggggcugggcc

SEQ ID NO: 744945 - RNA, 22 nt, Human
cacaugagagcccccaagagca

SEQ ID NO: 744946 - RNA, 22 nt, Human
aaugcauguauucauuguggaa

SEQ ID NO: 744947 - RNA, 22 nt, Human
uguggcagcuggagguggagaa

SEQ ID NO: 744948 - RNA, 22 nt, Human
gacugggcuccaagagggagag

SEQ ID NO: 744949 - RNA, 22 nt, Human
gaugcugggaccacagaguguu

SEQ ID NO: 744950 - RNA, 22 nt, Human
ggucugagcucuaaaacuaacu

SEQ ID NO: 744951 - RNA, 23 nt, Human
uggucugacuuguagcugugaga

SEQ ID NO: 744952 - RNA, 22 nt, Human
ugaaugcagagacugugggaaa

SEQ ID NO: 744953 - RNA, 22 nt, Human
ugcugcuguauccuuaguguca

SEQ ID NO: 744954 - RNA, 22 nt, Human
cuggguaaguuccuaaggcuca

SEQ ID NO: 744955 - RNA, 22 nt, Human
caagcagagacuagauagcugu

SEQ ID NO: 744956 - RNA, 22 nt, Human
gaugaggucauguuuuacauau

SEQ ID NO: 744957 - RNA, 22 nt, Human
ucuggguuugaaguagagccca

SEQ ID NO: 744958 - RNA, 21 nt, Human
caugaacaugcuuauccucag

SEQ ID NO: 744959 - RNA, 22 nt, Human
cagguaagagacggauuggccc

SEQ ID NO: 744960 - RNA, 22 nt, Human
ucuuccuucuuugaugacaagg

SEQ ID NO: 744961 - RNA, 22 nt, Human
aggagccuccuucucaugugca

SEQ ID NO: 744962 - RNA, 22 nt, Human
cagccuggagccacagcccagg

SEQ ID NO: 744963 - RNA, 22 nt, Human
uuucacagcuggguggcagagu

SEQ ID NO: 744964 - RNA, 23 nt, Human
auccacauuacaguaucauacaa

SEQ ID NO: 744965 - RNA, 22 nt, Human
aacauuuacaaauccuucugca

SEQ ID NO: 744966 - RNA, 22 nt, Human
aauggccagcugggagaguuga

SEQ ID NO: 744967 - RNA, 22 nt, Human
agaaaaguuuaaaucuuggcac

SEQ ID NO: 744968 - RNA, 22 nt, Human
uuuugugagcugagaaauguau

SEQ ID NO: 744969 - RNA, 22 nt, Human
cuccaaguccgagggcucucaa

SEQ ID NO: 744970 - RNA, 15 nt, Human
ccaaugucagaugcu

SEQ ID NO: 744971 - RNA, 22 nt, Human
aaagguaacugggguuuugcca

SEQ ID NO: 744972 - RNA, 22 nt, Human
acagccugcagccccaggucgc

SEQ ID NO: 744973 - RNA, 22 nt, Human
cuggcaggcggagguugcagug

SEQ ID NO: 744974 - RNA, 22 nt, Human
ccugggcauucuuugaguucuc

SEQ ID NO: 744975 - RNA, 19 nt, Human
uagcccagagccuggcuac

SEQ ID NO: 744976 - RNA, 20 nt, Human
auaaccugcccagaggauga

SEQ ID NO: 744977 - RNA, 22 nt, Human
guguuaaaugcaaucacaugca

SEQ ID NO: 744978 - RNA, 22 nt, Human
ucacaucugugugauugucauu

SEQ ID NO: 744979 - RNA, 22 nt, Human
uggcuucaggcagaauuuagac

SEQ ID NO: 744980 - RNA, 22 nt, Human
accagagcgcucaagccuuccc

SEQ ID NO: 744981 - RNA, 22 nt, Human
cuggagcauccaugcccagggu

SEQ ID NO: 744982 - RNA, 22 nt, Human
gugaccaucagagaauaacaaa

SEQ ID NO: 744983 - RNA, 22 nt, Human
agagaacacgugcaucugcaau

SEQ ID NO: 744984 - RNA, 22 nt, Human
agcugguauuuguuagggaguu

SEQ ID NO: 744985 - RNA, 22 nt, Human
ugguaaagaaaugucagggcag

SEQ ID NO: 744986 - RNA, 22 nt, Human
aucacauugccagugauuaccc

SEQ ID NO: 744987 - RNA, 22 nt, Human
cagaaauguacugacaugcagu

SEQ ID NO: 744988 - RNA, 22 nt, Human
cuuggcaugcagcaggcacuca

SEQ ID NO: 744989 - RNA, 22 nt, Human
accuggaccugccaccuaugag

SEQ ID NO: 744990 - RNA, 22 nt, Human
cuccaugaauuugagcuuugug

SEQ ID NO: 744991 - RNA, 22 nt, Human
ucagaccucugaccuugccaaa

SEQ ID NO: 744992 - RNA, 22 nt, Human
aagucguggcaggcuugcacga

SEQ ID NO: 744993 - RNA, 22 nt, Human
aaugcuuugauugauuaaaaca

SEQ ID NO: 744994 - RNA, 22 nt, Human
aagaguuugucagaucugcacg

SEQ ID NO: 744995 - RNA, 22 nt, Human
gagcacagaaucuucccaugca

SEQ ID NO: 744996 - RNA, 23 nt, Human
aguguuccaguugguugagagug

SEQ ID NO: 744997 - RNA, 22 nt, Human
agucucuuccuucaaggcuggu

SEQ ID NO: 744998 - RNA, 22 nt, Human
aaagcugcuuuaaacaucuaug

SEQ ID NO: 744999 - RNA, 22 nt, Human
uuucaguguguaaauugaaaua

SEQ ID NO: 745000 - RNA, 22 nt, Human
auugacaauguauuuguaucug

SEQ ID NO: 745001 - RNA, 22 nt, Human
ggcaggcagauggcugcaccaa

SEQ ID NO: 745002 - RNA, 22 nt, Human
acacaagugaauauuuuaagga

SEQ ID NO: 745003 - RNA, 22 nt, Human
acagaugagaagcugcauucaa

SEQ ID NO: 745004 - RNA, 22 nt, Human
ccaggccaggagagcgagguuu

SEQ ID NO: 745005 - RNA, 22 nt, Human
acccaggagguggaggcugcag

SEQ ID NO: 745006 - RNA, 22 nt, Human
ucuuuaaggugauuucugcuac

SEQ ID NO: 745007 - RNA, 22 nt, Human
gccucaggccgcccugcugcuc

SEQ ID NO: 745008 - RNA, 22 nt, Human
aggugggacccguggggugcga

SEQ ID NO: 745009 - RNA, 22 nt, Human
ucgcugaggcugcacggcugcc

SEQ ID NO: 745010 - RNA, 22 nt, Human
cccuuccuugugacuggugggg

SEQ ID NO: 745011 - RNA, 22 nt, Human
ucuguuaugcauaagcaucagu

SEQ ID NO: 745012 - RNA, 20 nt, Human
ugacaacaugccuuuugcuu

SEQ ID NO: 745013 - RNA, 22 nt, Human
aagcagaauuucccacuaguug

SEQ ID NO: 745014 - RNA, 22 nt, Human
ggcugggacgaugaggauuagu

SEQ ID NO: 745015 - RNA, 22 nt, Human
cccguguggaugcgcuggugcu

SEQ ID NO: 745016 - RNA, 22 nt, Human
ucucuuggugauagucuuucuu

SEQ ID NO: 745017 - RNA, 22 nt, Human
uccguggagauuuugugcaggg

SEQ ID NO: 745018 - RNA, 22 nt, Human
cuucagcaacuuuggaauguuu

SEQ ID NO: 745019 - RNA, 17 nt, Human
aucugcugacauucugu

SEQ ID NO: 745020 - RNA, 22 nt, Human
ugggcagauguggcucuccuug

SEQ ID NO: 745021 - RNA, 22 nt, Human
ugccuggguugacucuuagcug

SEQ ID NO: 745022 - RNA, 22 nt, Human
cacacaugagucuccccauugg

SEQ ID NO: 745023 - RNA, 22 nt, Human
gccucuguaggagugagagcau

SEQ ID NO: 745024 - RNA, 22 nt, Human
gagcagugggaaggaacagggu

SEQ ID NO: 745025 - RNA, 22 nt, Human
ucucauuuggcuuuguuuuaaa

SEQ ID NO: 745026 - RNA, 19 nt, Human
ucucuucucccugguuuua

SEQ ID NO: 745027 - RNA, 22 nt, Human
gcccagaagugacucagcacug

SEQ ID NO: 745028 - RNA, 22 nt, Human
acuuuugguucuguaacuguga

SEQ ID NO: 745029 - RNA, 22 nt, Human
agcucugggauucucaggccac

SEQ ID NO: 745030 - RNA, 22 nt, Human
acacacaacucauuguguaaua

SEQ ID NO: 745031 - RNA, 22 nt, Human
agcuggguucagaggcacaugg

SEQ ID NO: 745032 - RNA, 22 nt, Human
gggaugagaguagggugugaaa

SEQ ID NO: 745033 - RNA, 22 nt, Human
ucagccaguuuguuuauuccgg

SEQ ID NO: 745034 - RNA, 22 nt, Human
uggugggcacagugcccaggcu

SEQ ID NO: 745035 - RNA, 21 nt, Human
cugugcuucuuccuaagccag

SEQ ID NO: 745036 - RNA, 22 nt, Human
uuaaauugucauuugagcaaug

SEQ ID NO: 745037 - RNA, 22 nt, Human
ugaaacauugcacuguaugaau

SEQ ID NO: 745038 - RNA, 23 nt, Human
aaggccagaauuucaauggugcc

SEQ ID NO: 745039 - RNA, 22 nt, Human
uagaaacagauguuuuugaaga

SEQ ID NO: 745040 - RNA, 22 nt, Human
ugcccuggcacacacacagcug

SEQ ID NO: 745041 - RNA, 22 nt, Human
ggguccagacacuccagaggaa

SEQ ID NO: 745042 - RNA, 22 nt, Human
acauacaucaaguaucacaaga

SEQ ID NO: 745043 - RNA, 22 nt, Human
ggcagcauugccaauccagaca

SEQ ID NO: 745044 - RNA, 22 nt, Human
ucacaucacaugagugcaagga

SEQ ID NO: 745045 - RNA, 22 nt, Human
uggggagaggaauuugaaugau

SEQ ID NO: 745046 - RNA, 22 nt, Human
ccugggucccugagagaugauu

SEQ ID NO: 745047 - RNA, 21 nt, Human
uggauaaaggcacuuuucauc

SEQ ID NO: 745048 - RNA, 22 nt, Human
uacacauuucucuuagagacac

SEQ ID NO: 745049 - RNA, 22 nt, Human
cccaggagcuucucucugccuc

SEQ ID NO: 745050 - RNA, 22 nt, Human
gggagacaaggagaaccaaaga

SEQ ID NO: 745051 - RNA, 22 nt, Human
ugagccuggagucguggagggg

SEQ ID NO: 745052 - RNA, 22 nt, Human
aaagguuuauuuaaucagggag

SEQ ID NO: 745053 - RNA, 22 nt, Human
cugggcuuucaggcccuaaggc

SEQ ID NO: 745054 - RNA, 22 nt, Human
ucagggcuuuggcuuuuacucu

SEQ ID NO: 745055 - RNA, 22 nt, Human
agucaggugguucugcuccacu

SEQ ID NO: 745056 - RNA, 22 nt, Human
ugaaaaggaguccuuguuuuca

SEQ ID NO: 745057 - RNA, 22 nt, Human
ggaacuggguuagggucucuuc

SEQ ID NO: 745058 - RNA, 22 nt, Human
agugcuggauuacaggcgugag

SEQ ID NO: 745059 - RNA, 22 nt, Human
agugucuuugucaaauuacagg

SEQ ID NO: 745060 - RNA, 22 nt, Human
ggagacaugcagacugagauac

SEQ ID NO: 745061 - RNA, 19 nt, Human
ucuaacagaagugucgucc

SEQ ID NO: 745062 - RNA, 22 nt, Human
aaagauuugaguucugcuuaua

SEQ ID NO: 745063 - RNA, 22 nt, Human
cacaggacucgacugcagacag

SEQ ID NO: 745064 - RNA, 22 nt, Human
ugauggauguggcucuggagcu

SEQ ID NO: 745065 - RNA, 22 nt, Human
aggcaggcagcugucaccacuc

SEQ ID NO: 745066 - RNA, 22 nt, Human
aagaagugguuggaagaagcau

SEQ ID NO: 745067 - RNA, 22 nt, Human
aauuagcuaauuaauuguagcc

SEQ ID NO: 745068 - RNA, 22 nt, Human
ggagcagccgcgucucagggca

SEQ ID NO: 745069 - RNA, 22 nt, Human
cccugcagaucuaggguccuuc

SEQ ID NO: 745070 - RNA, 22 nt, Human
ccagucugcugugguaggaaga

SEQ ID NO: 745071 - RNA, 22 nt, Human
cccugugcugucaugcugggcg

SEQ ID NO: 745072 - RNA, 22 nt, Human
aguaacaagugccaacguuaga

SEQ ID NO: 745073 - RNA, 22 nt, Human
ugcaauuuuuuagcacaaggag

SEQ ID NO: 745074 - RNA, 22 nt, Human
agcacugugagcaccagcacgc

SEQ ID NO: 745075 - RNA, 21 nt, Human
gcugccaggauuuugcaggaa

SEQ ID NO: 745076 - RNA, 22 nt, Human
agacuaagcgguucuuuucaau

SEQ ID NO: 745077 - RNA, 22 nt, Human
guggagcaggacuagcugagaa

SEQ ID NO: 745078 - RNA, 22 nt, Human
cuucacaguauaggucccugag

SEQ ID NO: 745079 - RNA, 21 nt, Human
agaaaaguagaguuuucagag

SEQ ID NO: 745080 - RNA, 22 nt, Human
cugaggcuaguauaaagagcau

SEQ ID NO: 745081 - RNA, 22 nt, Human
ugucaccaguuccaggaaauaa

SEQ ID NO: 745082 - RNA, 22 nt, Human
uuucacagguauccacgggucu

SEQ ID NO: 745083 - RNA, 22 nt, Human
gggcuccacagcagugagugga

SEQ ID NO: 745084 - RNA, 22 nt, Human
uuaaguaagaccuuaugucuug

SEQ ID NO: 745085 - RNA, 22 nt, Human
cagagcaguggagaguaggucu

SEQ ID NO: 745086 - RNA, 22 nt, Human
uuccuucucagcccucgaggau

SEQ ID NO: 745087 - RNA, 22 nt, Human
aaacucuaaucaaauauagcau

SEQ ID NO: 745088 - RNA, 22 nt, Human
gagcagugguugaacagaggca

SEQ ID NO: 745089 - RNA, 21 nt, Human
uuacaacauuuguguucuaug

SEQ ID NO: 745090 - RNA, 22 nt, Human
agccauuuugguaaugauaaca

SEQ ID NO: 745091 - RNA, 22 nt, Human
augcacuucaagcaucucucug

SEQ ID NO: 745092 - RNA, 22 nt, Human
gcccagggcuucaaagagagaa

SEQ ID NO: 745093 - RNA, 22 nt, Human
ucagcccaucacucacguauua

SEQ ID NO: 745094 - RNA, 22 nt, Human
agcagcagagcucuggucugca

SEQ ID NO: 745095 - RNA, 23 nt, Human
cccauuuucauguuaacuccugg

SEQ ID NO: 745096 - RNA, 22 nt, Human
gacagugguguuuuccauugca

SEQ ID NO: 745097 - RNA, 22 nt, Human
gcuuucugguuugugcuacagg

SEQ ID NO: 745098 - RNA, 22 nt, Human
uaacaguauugaagauaaacua

SEQ ID NO: 745099 - RNA, 22 nt, Human
gacauucacaguuuccgauggu

SEQ ID NO: 745100 - RNA, 22 nt, Human
gacauuuaaauugcaggcagcc

SEQ ID NO: 745101 - RNA, 22 nt, Human
cagcauuuaucuuguagcagga

SEQ ID NO: 745102 - RNA, 22 nt, Human
auucaagguauuuaaaacauaa

SEQ ID NO: 745103 - RNA, 22 nt, Human
ccaggacucaaugaccacaggg

SEQ ID NO: 745104 - RNA, 19 nt, Human
ggggagguauuguuuucau

SEQ ID NO: 745105 - RNA, 20 nt, Human
uucgcugggaguggccaggc

SEQ ID NO: 745106 - RNA, 22 nt, Human
aagagauuucuguaaaauguaa

SEQ ID NO: 745107 - RNA, 22 nt, Human
acccagaggcggagguugcagu

SEQ ID NO: 745108 - RNA, 22 nt, Human
gcagaaccauaaauucagguaa

SEQ ID NO: 745109 - RNA, 22 nt, Human
gagcuuuaagggauaaaaugau

SEQ ID NO: 745110 - RNA, 17 nt, Human
uugagucuggggucuac

SEQ ID NO: 745111 - RNA, 22 nt, Human
ggcagagaguucuccaccucuc

SEQ ID NO: 745112 - RNA, 22 nt, Human
agcugucugugaacacagcauu

SEQ ID NO: 745113 - RNA, 22 nt, Human
aaacaguacucgauuuuuguag

SEQ ID NO: 745114 - RNA, 22 nt, Human
ucaggacacuuggcacaagguc

SEQ ID NO: 745115 - RNA, 22 nt, Human
ucagggacgugagcucagaguc

SEQ ID NO: 745116 - RNA, 22 nt, Human
ugcagccaauucauucauucuu

SEQ ID NO: 745117 - RNA, 22 nt, Human
ucuuugaaacacccuaaccuuu

SEQ ID NO: 745118 - RNA, 22 nt, Human
uaaagguaguuuuaaaggugcu

SEQ ID NO: 745119 - RNA, 22 nt, Human
ugcccagccaauuuguuauguu

SEQ ID NO: 745120 - RNA, 22 nt, Human
gaggcucagagggacuuucaag

SEQ ID NO: 745121 - RNA, 22 nt, Human
cucaggaaggaagcagggagcc

SEQ ID NO: 745122 - RNA, 22 nt, Human
agcaaagaguaauuuuguuuug

SEQ ID NO: 745123 - RNA, 22 nt, Human
cagcacuuggugccauugagug

SEQ ID NO: 745124 - RNA, 22 nt, Human
uauuugcaacauaaaacucuga

SEQ ID NO: 745125 - RNA, 22 nt, Human
acagaccaaguuuccagcaggu

SEQ ID NO: 745126 - RNA, 22 nt, Human
gcucagggucccuuggugcugg

SEQ ID NO: 745127 - RNA, 22 nt, Human
agcaacaggcauaauguguuga

SEQ ID NO: 745128 - RNA, 22 nt, Human
ccuaccaguaggaggccagaga

SEQ ID NO: 745129 - RNA, 22 nt, Human
cgcugggcagguccacuuguua

SEQ ID NO: 745130 - RNA, 22 nt, Human
cucaggacggccgggggagccu

SEQ ID NO: 745131 - RNA, 22 nt, Human
ggccagagggagggcacaaauc

SEQ ID NO: 745132 - RNA, 22 nt, Human
aggugcuguuugucagcaguuu

SEQ ID NO: 745133 - RNA, 22 nt, Human
aguuuauuuuugauaagucuug

SEQ ID NO: 745134 - RNA, 22 nt, Human
ccaguucugagaugaauaucca

SEQ ID NO: 745135 - RNA, 22 nt, Human
acauguguaaaaguggauaaaa

SEQ ID NO: 745136 - RNA, 22 nt, Human
aaaucaucucugcauccuuagc

SEQ ID NO: 745137 - RNA, 22 nt, Human
ugaaauguguccauguuauuuc

SEQ ID NO: 745138 - RNA, 22 nt, Human
aaagaguuuccauugacauuuc

SEQ ID NO: 745139 - RNA, 22 nt, Human
ccaggugucuguggccagcccu

SEQ ID NO: 745140 - RNA, 22 nt, Human
cauacauuaccuaacuuaaugc

SEQ ID NO: 745141 - RNA, 22 nt, Human
ucagugcuaaaagagcuggugu

SEQ ID NO: 745142 - RNA, 22 nt, Human
cugaggcucccucgggucugcu

SEQ ID NO: 745143 - RNA, 22 nt, Human
cucugcuggcagcccccgggcc

SEQ ID NO: 745144 - RNA, 22 nt, Human
gcacaauaacagccaagguuau

SEQ ID NO: 745145 - RNA, 22 nt, Human
uggcuucagacuucugcuacgu

SEQ ID NO: 745146 - RNA, 22 nt, Human
acaauuugaggcuacucaauug

SEQ ID NO: 745147 - RNA, 22 nt, Human
gaauuucaaagagguuaagagg

SEQ ID NO: 745148 - RNA, 22 nt, Human
aagcucucuguccccuggacug

SEQ ID NO: 745149 - RNA, 22 nt, Human
ugggcuccguugccuggggcag

SEQ ID NO: 745150 - RNA, 22 nt, Human
ucugccuucgcugcucccugaa

SEQ ID NO: 745151 - RNA, 22 nt, Human
uauguuuuucagacguccuaca

SEQ ID NO: 745152 - RNA, 22 nt, Human
gagcaucuuguucccaacuucu

SEQ ID NO: 745153 - RNA, 22 nt, Human
gcugcuguccuuagggaguucu

SEQ ID NO: 745154 - RNA, 22 nt, Human
gcaccugccugggacugaagau

SEQ ID NO: 745155 - RNA, 22 nt, Human
agacagacuuugaucuggaugu

SEQ ID NO: 745156 - RNA, 22 nt, Human
augggaggaaggaggcccuuga

SEQ ID NO: 745157 - RNA, 21 nt, Human
ucucaggcgagaauucuuuua

SEQ ID NO: 745158 - RNA, 22 nt, Human
ucaaaggguccuuaacaugaga

SEQ ID NO: 745159 - RNA, 22 nt, Human
cccagcagugacccagugauac

SEQ ID NO: 745160 - RNA, 22 nt, Human
guuuauauucaacggaguaucu

SEQ ID NO: 745161 - RNA, 22 nt, Human
aggacagcccccaacagcaaca

SEQ ID NO: 745162 - RNA, 22 nt, Human
gagcaccucaauuugcuauuug

SEQ ID NO: 745163 - RNA, 22 nt, Human
uaucauuuaacagaaucauugc

SEQ ID NO: 745164 - RNA, 22 nt, Human
uugcucugacuggagugcagug

SEQ ID NO: 745165 - RNA, 22 nt, Human
ugaaaugagcauuuauucuuua

SEQ ID NO: 745166 - RNA, 19 nt, Human
ugucuccucaugcaagugu

SEQ ID NO: 745167 - RNA, 22 nt, Human
aucuuggggacugucucuugua

SEQ ID NO: 745168 - RNA, 23 nt, Human
acagccaguucaccucuccuugg

SEQ ID NO: 745169 - RNA, 22 nt, Human
auggcacuaagagggagcugga

SEQ ID NO: 745170 - RNA, 22 nt, Human
cauggccugccuccuccuggug

SEQ ID NO: 745171 - RNA, 22 nt, Human
uuuauugagcacccguugugcg

SEQ ID NO: 745172 - RNA, 22 nt, Human
gccuggcuuggggcucaguggu

SEQ ID NO: 745173 - RNA, 22 nt, Human
aggcuguugagccccagcaagu

SEQ ID NO: 745174 - RNA, 22 nt, Human
uuucacagcaacacugucugca

SEQ ID NO: 745175 - RNA, 22 nt, Human
guuucauacagauuauucaugg

SEQ ID NO: 745176 - RNA, 22 nt, Human
acauauaugcugggacugugac

SEQ ID NO: 745177 - RNA, 22 nt, Human
ggacaacauguuuuaauuaagg

SEQ ID NO: 745178 - RNA, 22 nt, Human
gcagcugaauguccauugcugc

SEQ ID NO: 745179 - RNA, 22 nt, Human
ugaggaauguuuugagugccga

SEQ ID NO: 745180 - RNA, 22 nt, Human
cauugcacuccacccuaggcaa

SEQ ID NO: 745181 - RNA, 22 nt, Human
auucacaacugauccuugcuca

SEQ ID NO: 745182 - RNA, 22 nt, Human
gcugaggcuccucgggaggaca

SEQ ID NO: 745183 - RNA, 22 nt, Human
ucuagauuuggggcaugaaguu

SEQ ID NO: 745184 - RNA, 22 nt, Human
ucuggaguggcagucaucugaa

SEQ ID NO: 745185 - RNA, 22 nt, Human
aaagguuauuauuacuauuguc

SEQ ID NO: 745186 - RNA, 22 nt, Human
ucugggucacugugggagggca

SEQ ID NO: 745187 - RNA, 22 nt, Human
uuucauguuuucuuaaauggca

SEQ ID NO: 745188 - RNA, 22 nt, Human
cauggacagugggacagugugu

SEQ ID NO: 745189 - RNA, 22 nt, Human
ucugcucuaguugcuuccugcc

SEQ ID NO: 745190 - RNA, 22 nt, Human
ucaggaaggagcuggccugcca

SEQ ID NO: 745191 - RNA, 22 nt, Human
uggcagaggaaaaagucacugg

SEQ ID NO: 745192 - RNA, 22 nt, Human
caggcucaaggcugacuuccau

SEQ ID NO: 745193 - RNA, 22 nt, Human
gagugcugcuugggauagugag

SEQ ID NO: 745194 - RNA, 22 nt, Human
gaccucugaaggcagagcaggg

SEQ ID NO: 745195 - RNA, 22 nt, Human
ggccuugguuccaaagcaggca

SEQ ID NO: 745196 - RNA, 22 nt, Human
uccugucuuaaugaucucgugc

SEQ ID NO: 745197 - RNA, 22 nt, Human
uauucacauucucaggccuggu

SEQ ID NO: 745198 - RNA, 22 nt, Human
ucuggagaggggccuagaauuu

SEQ ID NO: 745199 - RNA, 22 nt, Human
agggcagcagcccauggcucug

SEQ ID NO: 745200 - RNA, 22 nt, Human
caggugccgggaaugcagcaau

SEQ ID NO: 745201 - RNA, 22 nt, Human
acauaacaaucauaggacauag

SEQ ID NO: 745202 - RNA, 22 nt, Human
gaagcugcguguagccauacuu

SEQ ID NO: 745203 - RNA, 20 nt, Human
acagauaccagggacauggg

SEQ ID NO: 745204 - RNA, 22 nt, Human
uguuccagauuuagccaaccga

SEQ ID NO: 745205 - RNA, 22 nt, Human
uaucuuaaaugcaugauagaca

SEQ ID NO: 745206 - RNA, 23 nt, Human
gaacauucauugguugcuuuaga

SEQ ID NO: 745207 - RNA, 17 nt, Human
gcuuuccuugccccucc

SEQ ID NO: 745208 - RNA, 22 nt, Human
aggcuggcuggggaugcgucuu

SEQ ID NO: 745209 - RNA, 22 nt, Human
ccagcccugauuagagaauguc

SEQ ID NO: 745210 - RNA, 22 nt, Human
uagugugguaucuucuauggaa

SEQ ID NO: 745211 - RNA, 22 nt, Human
uauuuauaacagugagaacggg

SEQ ID NO: 745212 - RNA, 22 nt, Human
uucguuuucuaggaccaacaga

SEQ ID NO: 745213 - RNA, 22 nt, Human
ucucaggguuuguacaagugua

SEQ ID NO: 745214 - RNA, 21 nt, Human
acuuaaauuccuugauauuua

SEQ ID NO: 745215 - RNA, 22 nt, Human
gacaagcaggcuccugaagaaa

SEQ ID NO: 745216 - RNA, 22 nt, Human
aggcaguucucguguguguccc

SEQ ID NO: 745217 - RNA, 20 nt, Human
augcuuccagggugugucug

SEQ ID NO: 745218 - RNA, 22 nt, Human
cgagaggcuggacagggcuggg

SEQ ID NO: 745219 - RNA, 22 nt, Human
agcccagcuuucaccccucugg

SEQ ID NO: 745220 - RNA, 22 nt, Human
cugugcuuucaggccgcugugu

SEQ ID NO: 745221 - RNA, 22 nt, Human
cugagagaaucaugcugcaggu

SEQ ID NO: 745222 - RNA, 22 nt, Human
uccaggccccagcaccuuggga

SEQ ID NO: 745223 - RNA, 21 nt, Human
ggucccauugugaggcuugaa

SEQ ID NO: 745224 - RNA, 23 nt, Human
uccucccaaauuucagccucauu

SEQ ID NO: 745225 - RNA, 22 nt, Human
ggucugagguuugggauucacu

SEQ ID NO: 745226 - RNA, 22 nt, Human
aagcaaagaguuuaguggguga

SEQ ID NO: 745227 - RNA, 22 nt, Human
guggcauggagaaggaggcagu

SEQ ID NO: 745228 - RNA, 22 nt, Human
uuccuuccucuuucacaacagc

SEQ ID NO: 745229 - RNA, 22 nt, Human
auuucccacucuacuacaugcu

SEQ ID NO: 745230 - RNA, 22 nt, Human
ggguguccagggcgugucugga

SEQ ID NO: 745231 - RNA, 22 nt, Human
gcugugcagguccccacugccu

SEQ ID NO: 745232 - RNA, 22 nt, Human
auucacaaaaugauauagauac

SEQ ID NO: 745233 - RNA, 22 nt, Human
cauggcuugcaagcauaggaga

SEQ ID NO: 745234 - RNA, 22 nt, Human
cauucugagucacucuuuagca

SEQ ID NO: 745235 - RNA, 22 nt, Human
uuccaaauggagaagaugaguu

SEQ ID NO: 745236 - RNA, 22 nt, Human
cuagugugucuaugucuguucc

SEQ ID NO: 745237 - RNA, 22 nt, Human
auuuaugacuggugaauagaac

SEQ ID NO: 745238 - RNA, 22 nt, Human
auguuuacaaaaaggaggcuug

SEQ ID NO: 745239 - RNA, 22 nt, Human
gcagggcagaaggugcugagga

SEQ ID NO: 745240 - RNA, 22 nt, Human
auuugguuacucaguugucuga

SEQ ID NO: 745241 - RNA, 22 nt, Human
ggcugcaggcuucccuccagca

SEQ ID NO: 745242 - RNA, 22 nt, Human
gucaggaaaacccggguugacu

SEQ ID NO: 745243 - RNA, 22 nt, Human
cugucccauccuuacucuaccc

SEQ ID NO: 745244 - RNA, 22 nt, Human
aagcaugggaggccuggaggag

SEQ ID NO: 745245 - RNA, 23 nt, Human
acacauauauucagauacagaug

SEQ ID NO: 745246 - RNA, 22 nt, Human
cacucccuucaggagccuagga

SEQ ID NO: 745247 - RNA, 22 nt, Human
cucccugaccuggauuccaggc

SEQ ID NO: 745248 - RNA, 22 nt, Human
aagcacccaauuuacagcaguu

SEQ ID NO: 745249 - RNA, 22 nt, Human
agaacacacgucagaguuuccu

SEQ ID NO: 745250 - RNA, 22 nt, Human
uuguguacuguugguugauauu

SEQ ID NO: 745251 - RNA, 22 nt, Human
aaaguguagagugccucaaaau

SEQ ID NO: 745252 - RNA, 22 nt, Human
acauuuauuuucagcugggaaa

SEQ ID NO: 745253 - RNA, 22 nt, Human
gggcagcuccuguggaauccac

SEQ ID NO: 745254 - RNA, 17 nt, Human
uacaggagagcaggaac

SEQ ID NO: 745255 - RNA, 22 nt, Human
ccauggcucuuaccuuguuaua

SEQ ID NO: 745256 - RNA, 22 nt, Human
gcagaagcacaggugacgggcc

SEQ ID NO: 745257 - RNA, 22 nt, Human
uggcagucuggguuggcaguua

SEQ ID NO: 745258 - RNA, 21 nt, Human
cucagagaaaugucugggagc

SEQ ID NO: 745259 - RNA, 22 nt, Human
accccagcccugcuucugggag

SEQ ID NO: 745260 - RNA, 22 nt, Human
cuuacaaauacacuuaggagag

SEQ ID NO: 745261 - RNA, 22 nt, Human
ugcuuuuaagaacaaugcugcu

SEQ ID NO: 745262 - RNA, 22 nt, Human
augauacauugcaaaauuuuaa

SEQ ID NO: 745263 - RNA, 18 nt, Human
agcugcuuuuggcuuaaa

SEQ ID NO: 745264 - RNA, 22 nt, Human
aaccuggagcacccucauaucu

SEQ ID NO: 745265 - RNA, 22 nt, Human
gaggccagcuacccaaggguca

SEQ ID NO: 745266 - RNA, 22 nt, Human
gccucugggcucugccccuggc

SEQ ID NO: 745267 - RNA, 22 nt, Human
ucagaggucacacagcaaguuu

SEQ ID NO: 745268 - RNA, 22 nt, Human
uaauuauuugaagacauuagag

SEQ ID NO: 745269 - RNA, 21 nt, Human
uagcaaauugcuauuaaggca

SEQ ID NO: 745270 - RNA, 22 nt, Human
cagagcauugagggucugccaa

SEQ ID NO: 745271 - RNA, 22 nt, Human
cugaggucuauuuugaaacugc

SEQ ID NO: 745272 - RNA, 22 nt, Human
gagcugcccugagcuuugcaug

SEQ ID NO: 745273 - RNA, 22 nt, Human
cacagggcuaaaugaaggguug

SEQ ID NO: 745274 - RNA, 22 nt, Human
ucugugugcccuaaagccugcu

SEQ ID NO: 745275 - RNA, 22 nt, Human
aggcaggccccugagaauagac

SEQ ID NO: 745276 - RNA, 22 nt, Human
cuuugaauugccguuucaucug

SEQ ID NO: 745277 - RNA, 22 nt, Human
ccucacagccucaugcccagcc

SEQ ID NO: 745278 - RNA, 22 nt, Human
gaagaacaagcagugcuuuccu

SEQ ID NO: 745279 - RNA, 22 nt, Human
gcacccagggacuuggcuggcc

SEQ ID NO: 745280 - RNA, 22 nt, Human
gaugcauguauggagugagggu

SEQ ID NO: 745281 - RNA, 22 nt, Human
auguaguguagagauuagucuc

SEQ ID NO: 745282 - RNA, 22 nt, Human
cacagcugcccuacuccaugug

SEQ ID NO: 745283 - RNA, 22 nt, Human
agggccagcugcagaauuagca

SEQ ID NO: 745284 - RNA, 22 nt, Human
ggccucucaugcccagagccaa

SEQ ID NO: 745285 - RNA, 22 nt, Human
ugucaugccaggaaauaguccc

SEQ ID NO: 745286 - RNA, 22 nt, Human
ucccagagcugauaagccuuua

SEQ ID NO: 745287 - RNA, 22 nt, Human
acacauaucuaagauagaugac

SEQ ID NO: 745288 - RNA, 22 nt, Human
auguggauggaagucagauagc

SEQ ID NO: 745289 - RNA, 22 nt, Human
auuguggugucaguuauaggca

SEQ ID NO: 745290 - RNA, 22 nt, Human
gacuucacaauaaugugacacu

SEQ ID NO: 745291 - RNA, 22 nt, Human
uauagacaagcguaacaagaag

SEQ ID NO: 745292 - RNA, 22 nt, Human
uuucuaaggccagagacugcug

SEQ ID NO: 745293 - RNA, 22 nt, Human
ucagaacagcacagggugauuu

SEQ ID NO: 745294 - RNA, 22 nt, Human
acagcuggaggggcugcagagg

SEQ ID NO: 745295 - RNA, 22 nt, Human
aggacuccauguguccuggaga

SEQ ID NO: 745296 - RNA, 22 nt, Human
aagcacuggguauagcaaugau

SEQ ID NO: 745297 - RNA, 22 nt, Human
cuacaggcucagggagcccucu

SEQ ID NO: 745298 - RNA, 22 nt, Human
aauucacaauguguagucaugc

SEQ ID NO: 745299 - RNA, 23 nt, Human
agaaagucauggccagguuugau

SEQ ID NO: 745300 - RNA, 22 nt, Human
uuagcuuucagccuuucucacc

SEQ ID NO: 745301 - RNA, 23 nt, Human
ucugucaccuauggcugcucuuc

SEQ ID NO: 745302 - RNA, 22 nt, Human
gaaauuaagcaggggucugugg

SEQ ID NO: 745303 - RNA, 20 nt, Human
ucuggcacacugagaagcuc

SEQ ID NO: 745304 - RNA, 22 nt, Human
aucauuucccuuuagaucacaa

SEQ ID NO: 745305 - RNA, 22 nt, Human
agcgagggaggucugaggacag

SEQ ID NO: 745306 - RNA, 22 nt, Human
ggguugggacugucaucuggag

SEQ ID NO: 745307 - RNA, 22 nt, Human
acugaaauggggacaguccuua

SEQ ID NO: 745308 - RNA, 22 nt, Human
augcaacagagaaaauauugag

SEQ ID NO: 745309 - RNA, 22 nt, Human
uccaggugacagagacaggaua

SEQ ID NO: 745310 - RNA, 22 nt, Human
uucacauugugguucaugugaa

SEQ ID NO: 745311 - RNA, 23 nt, Human
uacaugcuauaauuucacccuca

SEQ ID NO: 745312 - RNA, 22 nt, Human
cuguuacuguauuuaaucaucu

SEQ ID NO: 745313 - RNA, 22 nt, Human
cugugcuuccaggauggcagcu

SEQ ID NO: 745314 - RNA, 22 nt, Human
acuguuuaguaaauugaaaugg

SEQ ID NO: 745315 - RNA, 22 nt, Human
agccagugccagucaugccugc

SEQ ID NO: 745316 - RNA, 22 nt, Human
ggugcagccuuuguuucuacuu

SEQ ID NO: 745317 - RNA, 22 nt, Human
uggcugagguuaugcugguugu

SEQ ID NO: 745318 - RNA, 22 nt, Human
gcagguggcagaggugggaucu

SEQ ID NO: 745319 - RNA, 21 nt, Human
agcugggccucagccugcagu

SEQ ID NO: 745320 - RNA, 22 nt, Human
gagaggcugugugccauuguug

SEQ ID NO: 745321 - RNA, 22 nt, Human
acugcuuuugaucucuucugua

SEQ ID NO: 745322 - RNA, 22 nt, Human
aaauggcugacuaaauuaaauu

SEQ ID NO: 745323 - RNA, 22 nt, Human
aaggcccuaauagagcacauau

SEQ ID NO: 745324 - RNA, 22 nt, Human
ugaguagacgugaucuaguaac

SEQ ID NO: 745325 - RNA, 22 nt, Human
uaaugcuucaauuuccuugauu

SEQ ID NO: 745326 - RNA, 22 nt, Human
aguggcugcugacuuuaauaca

SEQ ID NO: 745327 - RNA, 22 nt, Human
cccaccacgugcuuugcuggag

SEQ ID NO: 745328 - RNA, 22 nt, Human
gaaguuuauuucaaucuauuca

SEQ ID NO: 745329 - RNA, 22 nt, Human
cuccagucucuuucggagacac

SEQ ID NO: 745330 - RNA, 22 nt, Human
gcugaggauugaagaguugcca

SEQ ID NO: 745331 - RNA, 22 nt, Human
acagaguacauucagagacuau

SEQ ID NO: 745332 - RNA, 22 nt, Human
cuucaauaccugcguugcuagu

SEQ ID NO: 745333 - RNA, 22 nt, Human
ucucaguccaaaugagagguug

SEQ ID NO: 745334 - RNA, 22 nt, Human
gugcauuaggcuggaauguuga

SEQ ID NO: 745335 - RNA, 22 nt, Human
guggcagcucauguuguuuuaa

SEQ ID NO: 745336 - RNA, 22 nt, Human
gaaugcacacgugugugcaugc

SEQ ID NO: 745337 - RNA, 22 nt, Human
uugauucuuugagaccgugaua

SEQ ID NO: 745338 - RNA, 22 nt, Human
aggcaaauagauaguccauaca

SEQ ID NO: 745339 - RNA, 19 nt, Human
ugccccuuaagaguuucuc

SEQ ID NO: 745340 - RNA, 22 nt, Human
aggagugagcuuuggggucaga

SEQ ID NO: 745341 - RNA, 22 nt, Human
acagucaaugagugagugaaug

SEQ ID NO: 745342 - RNA, 22 nt, Human
caaggcagcuuaauagaauuug

SEQ ID NO: 745343 - RNA, 22 nt, Human
ucuucacauuuuagugguuugu

SEQ ID NO: 745344 - RNA, 22 nt, Human
aucaucaugcacucucagguuu

SEQ ID NO: 745345 - RNA, 21 nt, Human
acauacauuaucuuuuuaaaa

SEQ ID NO: 745346 - RNA, 22 nt, Human
cagcagaacaggcagggaagcu

SEQ ID NO: 745347 - RNA, 21 nt, Human
acacaggaguuucuucuuucu

SEQ ID NO: 745348 - RNA, 22 nt, Human
gaagacacuaaggcccagggag

SEQ ID NO: 745349 - RNA, 22 nt, Human
ccugagcucaaagggugccugg

SEQ ID NO: 745350 - RNA, 22 nt, Human
guacaaaaguuauugcgguuuu

SEQ ID NO: 745351 - RNA, 22 nt, Human
ugucacauguuuaauguggacu

SEQ ID NO: 745352 - RNA, 21 nt, Human
gggucugaauaucuggugcug

SEQ ID NO: 745353 - RNA, 18 nt, Human
ucagaggagauaccuaaa

SEQ ID NO: 745354 - RNA, 22 nt, Human
agcugggaagaguuuucugcag

SEQ ID NO: 745355 - RNA, 22 nt, Human
uggggcaagaagugcccugaag

SEQ ID NO: 745356 - RNA, 22 nt, Human
gcuccugaaggcucugcagggu

SEQ ID NO: 745357 - RNA, 20 nt, Human
auauguguacguguauacau

SEQ ID NO: 745358 - RNA, 22 nt, Human
gucugugugcacagcgagugcc

SEQ ID NO: 745359 - RNA, 22 nt, Human
augaguugaagcuacaagaggc

SEQ ID NO: 745360 - RNA, 16 nt, Human
uugaaugacugugugc

SEQ ID NO: 745361 - RNA, 22 nt, Human
uuggaaaugcaaauauauugaa

SEQ ID NO: 745362 - RNA, 19 nt, Human
gggagacagcucugggcug

SEQ ID NO: 745363 - RNA, 22 nt, Human
agauaaguacuguuauuauugc

SEQ ID NO: 745364 - RNA, 22 nt, Human
aggaagcuccuggagagccagu

SEQ ID NO: 745365 - RNA, 22 nt, Human
agcucaggccggagcuacaggc

SEQ ID NO: 745366 - RNA, 22 nt, Human
aaggcaauguaaauuacagcuu

SEQ ID NO: 745367 - RNA, 20 nt, Human
augugucuuagagcaucagg

SEQ ID NO: 745368 - RNA, 22 nt, Human
ugguccagaagauauucaacca

SEQ ID NO: 745369 - RNA, 22 nt, Human
aauuucaaacuaauaggaacca

SEQ ID NO: 745370 - RNA, 22 nt, Human
agaaugcuuccuuugaaacuga

SEQ ID NO: 745371 - RNA, 22 nt, Human
ggcaggcauugcaacauguaca

SEQ ID NO: 745372 - RNA, 22 nt, Human
aacauaaauuugaaguggcaaa

SEQ ID NO: 745373 - RNA, 23 nt, Human
acagaagccaggagccgcugggc

SEQ ID NO: 745374 - RNA, 22 nt, Human
ccaggcuuccuaaugugugcag

SEQ ID NO: 745375 - RNA, 22 nt, Human
ugaggcucaagaaucugcauuu

SEQ ID NO: 745376 - RNA, 22 nt, Human
augaaggcaguuaaacgucauc

SEQ ID NO: 745377 - RNA, 22 nt, Human
auuuugauaaucauguuagaga

SEQ ID NO: 745378 - RNA, 20 nt, Human
cugggcucaagugagccucc

SEQ ID NO: 745379 - RNA, 21 nt, Human
accucaagcaacaaccaaggu

SEQ ID NO: 745380 - RNA, 22 nt, Human
gggagcagccugccucccaccu

SEQ ID NO: 745381 - RNA, 22 nt, Human
augccagucaaagaagaugaca

SEQ ID NO: 745382 - RNA, 22 nt, Human
acagagagaggcccgaggcugc

SEQ ID NO: 745383 - RNA, 18 nt, Human
ugaacuuuggugucucuc

SEQ ID NO: 745384 - RNA, 22 nt, Human
ucagaggcugcauuuuuaucca

SEQ ID NO: 745385 - RNA, 22 nt, Human
cccuccucucccuaagagucac

SEQ ID NO: 745386 - RNA, 22 nt, Human
ugcuuaccucuggcuguuuucc

SEQ ID NO: 745387 - RNA, 22 nt, Human
ccuuuagagcaaacgccaccua

SEQ ID NO: 745388 - RNA, 22 nt, Human
agcagccuuugaucaucuggga

SEQ ID NO: 745389 - RNA, 20 nt, Human
gacaggugcuaaagaggggc

SEQ ID NO: 745390 - RNA, 22 nt, Human
uagggaugagccaguggguagu

SEQ ID NO: 745391 - RNA, 22 nt, Human
uccagagacuugcaugugcuug

SEQ ID NO: 745392 - RNA, 22 nt, Human
auaaagcuaagacuuacaugaa

SEQ ID NO: 745393 - RNA, 19 nt, Human
ugagccagggaggccaugc

SEQ ID NO: 745394 - RNA, 20 nt, Human
uccagcauauaaacuccucu

SEQ ID NO: 745395 - RNA, 22 nt, Human
ccaggcugagcaugauuggagc

SEQ ID NO: 745396 - RNA, 22 nt, Human
gcuucucuucgccuagguccuu

SEQ ID NO: 745397 - RNA, 22 nt, Human
aaaagcuagucaaugauguauu

SEQ ID NO: 745398 - RNA, 22 nt, Human
ucugaagaacugaguaaacaug

SEQ ID NO: 745399 - RNA, 22 nt, Human
gacacagggggauguguggacg

SEQ ID NO: 745400 - RNA, 22 nt, Human
uggcucuguuuguuaacuagac

SEQ ID NO: 745401 - RNA, 22 nt, Human
ugugcaaucauauuuuaaaaug

SEQ ID NO: 745402 - RNA, 22 nt, Human
agucuguggauggacuggcaga

SEQ ID NO: 745403 - RNA, 23 nt, Human
gcaauacaagacuggucaugagc

SEQ ID NO: 745404 - RNA, 22 nt, Human
aggccugacuugaauuuagggc

SEQ ID NO: 745405 - RNA, 22 nt, Human
uucuuucccagaagauauguuu

SEQ ID NO: 745406 - RNA, 17 nt, Human
gcaaucucagucuccuu

SEQ ID NO: 745407 - RNA, 22 nt, Human
ucugggugaugaaaugcacugu

SEQ ID NO: 745408 - RNA, 22 nt, Human
auacaaguugugauaauguaaa

SEQ ID NO: 745409 - RNA, 22 nt, Human
uggcagagccuugccaaacucc

SEQ ID NO: 745410 - RNA, 17 nt, Human
cccaggccgccgggagc

SEQ ID NO: 745411 - RNA, 18 nt, Human
aagcugggaaggagacag

SEQ ID NO: 745412 - RNA, 22 nt, Human
gagucacaaagccuuucuuauu

SEQ ID NO: 745413 - RNA, 23 nt, Human
uaucuuuuucaauguuggaaaua

SEQ ID NO: 745414 - RNA, 22 nt, Human
cagaggcuggcggccgccccga

SEQ ID NO: 745415 - RNA, 22 nt, Human
uuccaucugcuagguaaaugaa

SEQ ID NO: 745416 - RNA, 22 nt, Human
agaucagaaagccaauaucaua

SEQ ID NO: 745417 - RNA, 22 nt, Human
cuucuuuccuuccuccaguggc

SEQ ID NO: 745418 - RNA, 22 nt, Human
aagauucuacaaacucugguaa

SEQ ID NO: 745419 - RNA, 22 nt, Human
gaguggcuguguacaugcccag

SEQ ID NO: 745420 - RNA, 22 nt, Human
ggcuuagcaacuccugaggcuc

SEQ ID NO: 745421 - RNA, 21 nt, Human
uuucuaaggaggaagaaaaga

SEQ ID NO: 745422 - RNA, 22 nt, Human
uaagugucuaaaaggcagaacu

SEQ ID NO: 745423 - RNA, 22 nt, Human
uauggagauucaaaagcaucuu

SEQ ID NO: 745424 - RNA, 22 nt, Human
auucucagaucuuagaggaaua

SEQ ID NO: 745425 - RNA, 22 nt, Human
uucagucuccucauuuuacaaa

SEQ ID NO: 745426 - RNA, 22 nt, Human
cauuagacacagauguauaaau

SEQ ID NO: 745427 - RNA, 22 nt, Human
augucuucauagcuuauaucca

SEQ ID NO: 745428 - RNA, 22 nt, Human
gauuaagagaaguuucuuaucg

SEQ ID NO: 745429 - RNA, 22 nt, Human
gaguuaaauauuuucugaaguu

SEQ ID NO: 745430 - RNA, 17 nt, Human
aauaccugccaauucua

SEQ ID NO: 745431 - RNA, 22 nt, Human
ccuggauucaagucuuucuuuc

SEQ ID NO: 745432 - RNA, 22 nt, Human
accugcaggggugcucucuggg

SEQ ID NO: 745433 - RNA, 22 nt, Human
acaggccuacgaagucaggugc

SEQ ID NO: 745434 - RNA, 22 nt, Human
ccugccuggagcugagugugga

SEQ ID NO: 745435 - RNA, 19 nt, Human
caggauuguuuaaagcuuu

SEQ ID NO: 745436 - RNA, 22 nt, Human
gggcugaugaugagcagaggug

SEQ ID NO: 745437 - RNA, 22 nt, Human
ggcuccagguacguaugggagg

SEQ ID NO: 745438 - RNA, 22 nt, Human
ucugauuagagcauucuugagu

SEQ ID NO: 745439 - RNA, 22 nt, Human
auggaugggauauugcuugcca

SEQ ID NO: 745440 - RNA, 22 nt, Human
guuguauagagggcaugaaucu

SEQ ID NO: 745441 - RNA, 22 nt, Human
aauagauacuacuuagauguag

SEQ ID NO: 745442 - RNA, 22 nt, Human
gcuuccuugguccuggucuaag

SEQ ID NO: 745443 - RNA, 22 nt, Human
uuucaaucaccauaaagcaacu

SEQ ID NO: 745444 - RNA, 22 nt, Human
aaaccuguggccacuaaauuug

SEQ ID NO: 745445 - RNA, 22 nt, Human
auguagcaucuauccugauaaa

SEQ ID NO: 745446 - RNA, 22 nt, Human
cuuuuuauaccgugccaguuga

SEQ ID NO: 745447 - RNA, 22 nt, Human
gcaggccuuggcaaugagccug

SEQ ID NO: 745448 - RNA, 19 nt, Human
ucucaggcugggcggcugc

SEQ ID NO: 745449 - RNA, 22 nt, Human
uacagcuaugucuugguguucu

SEQ ID NO: 745450 - RNA, 22 nt, Human
aaaguccagagggcacacugaa

SEQ ID NO: 745451 - RNA, 22 nt, Human
ccccaggcagggccuaacagag

SEQ ID NO: 745452 - RNA, 22 nt, Human
ucuaaggacaguuauuacuggg

SEQ ID NO: 745453 - RNA, 22 nt, Human
uggcuccagaagggagggcgcc

SEQ ID NO: 745454 - RNA, 22 nt, Human
cagcauguaucuuucaggugug

SEQ ID NO: 745455 - RNA, 22 nt, Human
ucuguucuuuagccugcuugag

SEQ ID NO: 745456 - RNA, 22 nt, Human
uggagcuggaauuugagcugga

SEQ ID NO: 745457 - RNA, 22 nt, Human
uacauuuacagagccuucucug

SEQ ID NO: 745458 - RNA, 22 nt, Human
cagaugaggacagaugacuggg

SEQ ID NO: 745459 - RNA, 22 nt, Human
uuugucaaguuugcaaauacgu

SEQ ID NO: 745460 - RNA, 22 nt, Human
accaucuuagcagacugcagug

SEQ ID NO: 745461 - RNA, 22 nt, Human
cccagugucucuugugccuuuc

SEQ ID NO: 745462 - RNA, 22 nt, Human
gcuaguccacagccauccaggc

SEQ ID NO: 745463 - RNA, 22 nt, Human
cuuacaguacuucuaauaugau

SEQ ID NO: 745464 - RNA, 22 nt, Human
ggcagaagguugaaguaauuug

SEQ ID NO: 745465 - RNA, 22 nt, Human
ucuuucuugugggugcccuuuu

SEQ ID NO: 745466 - RNA, 22 nt, Human
guuucuuucuauugacugaaca

SEQ ID NO: 745467 - RNA, 22 nt, Human
ucauauuuaguucacgcucaau

SEQ ID NO: 745468 - RNA, 22 nt, Human
acagcugggaacucacacagca

SEQ ID NO: 745469 - RNA, 22 nt, Human
ccaguguguuaguggauuuccc

SEQ ID NO: 745470 - RNA, 22 nt, Human
aaaggucauugaaaaggaggaa

SEQ ID NO: 745471 - RNA, 22 nt, Human
aaauaauguuaggccuuugcuc

SEQ ID NO: 745472 - RNA, 22 nt, Human
agugcucauaaaaaugugaaac

SEQ ID NO: 745473 - RNA, 22 nt, Human
ugcccagcacccagcaugaugc

SEQ ID NO: 745474 - RNA, 22 nt, Human
aaggcuuuugggaauuuucaac

SEQ ID NO: 745475 - RNA, 20 nt, Human
cuccugugccucucugggcc

SEQ ID NO: 745476 - RNA, 22 nt, Human
gaagauuucuuuaugaaagaug

SEQ ID NO: 745477 - RNA, 22 nt, Human
ggcugcagcggauuggggauug

SEQ ID NO: 745478 - RNA, 22 nt, Human
ggcagcaguggcugcuauuguc

SEQ ID NO: 745479 - RNA, 22 nt, Human
aaaagcaucucaaaggagcuuc

SEQ ID NO: 745480 - RNA, 17 nt, Human
uggacccuugggccucc

SEQ ID NO: 745481 - RNA, 22 nt, Human
ucagaaugaaauuucuuucaga

SEQ ID NO: 745482 - RNA, 22 nt, Human
ugggcagugagaaaggucaggu

SEQ ID NO: 745483 - RNA, 22 nt, Human
cucagacaaaugauuaagguua

SEQ ID NO: 745484 - RNA, 22 nt, Human
uuucagacagauucuucucagu

SEQ ID NO: 745485 - RNA, 22 nt, Human
agggcucaguugccuggagccc

SEQ ID NO: 745486 - RNA, 22 nt, Human
ccacugaggggucaugguggga

SEQ ID NO: 745487 - RNA, 23 nt, Human
ggcagccucugacucugcuuugc

SEQ ID NO: 745488 - RNA, 22 nt, Human
gaaauuauugcuagagacugca

SEQ ID NO: 745489 - RNA, 21 nt, Human
uuucggucccagaugccugug

SEQ ID NO: 745490 - RNA, 22 nt, Human
uggcauggcaacccugcaggga

SEQ ID NO: 745491 - RNA, 22 nt, Human
gcccucagaaugggcucuaauc

SEQ ID NO: 745492 - RNA, 22 nt, Human
uggcccugagggcucggagcca

SEQ ID NO: 745493 - RNA, 22 nt, Human
cuuccagcugauuggcauccag

SEQ ID NO: 745494 - RNA, 22 nt, Human
aaguuuggaggucacuggucuu

SEQ ID NO: 745495 - RNA, 22 nt, Human
aucugucugggugcagcagucc

SEQ ID NO: 745496 - RNA, 22 nt, Human
agaauucugacaauagaauugg

SEQ ID NO: 745497 - RNA, 22 nt, Human
agagcagccugugaugaugcac

SEQ ID NO: 745498 - RNA, 22 nt, Human
uggcugaguuccuggcacacgg

SEQ ID NO: 745499 - RNA, 22 nt, Human
caugcagggagugcuccuauua

SEQ ID NO: 745500 - RNA, 22 nt, Human
uucugacaauucaguaacagca

SEQ ID NO: 745501 - RNA, 22 nt, Human
cccugggaaguauuccagcuau

SEQ ID NO: 745502 - RNA, 20 nt, Human
uccagauauuaagacaggca

SEQ ID NO: 745503 - RNA, 22 nt, Human
caccagcccccucacgcuguca

SEQ ID NO: 745504 - RNA, 22 nt, Human
uugggcugaacccugcagcuga

SEQ ID NO: 745505 - RNA, 22 nt, Human
gagggcugaugcuuacuuauuu

SEQ ID NO: 745506 - RNA, 22 nt, Human
cuggcccaggcuccuggggcac

SEQ ID NO: 745507 - RNA, 22 nt, Human
cugucacacugauaucaggcuu

SEQ ID NO: 745508 - RNA, 21 nt, Human
gggcacugaaagggaauagca

SEQ ID NO: 745509 - RNA, 22 nt, Human
gcucacaguacagugcuggcuc

SEQ ID NO: 745510 - RNA, 22 nt, Human
uguauuagagcaguagaauuau

SEQ ID NO: 745511 - RNA, 22 nt, Human
agaauucagaaugcauuucuaa

SEQ ID NO: 745512 - RNA, 22 nt, Human
gcucugcuggagggaaagagaa

SEQ ID NO: 745513 - RNA, 22 nt, Human
uccaggggagugcuacgcacag

SEQ ID NO: 745514 - RNA, 22 nt, Human
uucaagaugucuucacaauagu

SEQ ID NO: 745515 - RNA, 22 nt, Human
gauggaaugaauggcagauaca

SEQ ID NO: 745516 - RNA, 22 nt, Human
aggacaguccgggguccuccac

SEQ ID NO: 745517 - RNA, 22 nt, Human
ucagucuuucgaauucagccag

SEQ ID NO: 745518 - RNA, 22 nt, Human
ucugugccagcagccuccugga

SEQ ID NO: 745519 - RNA, 22 nt, Human
ugaggcaggacuugcauaaagu

SEQ ID NO: 745520 - RNA, 22 nt, Human
aaaguuuguugcuuacaaagaa

SEQ ID NO: 745521 - RNA, 22 nt, Human
gggucuggacggcugcaggaag

SEQ ID NO: 745522 - RNA, 22 nt, Human
gcuuggcauugaccauuaucau

SEQ ID NO: 745523 - RNA, 22 nt, Human
caucacauuuaaggggaaggac

SEQ ID NO: 745524 - RNA, 22 nt, Human
gggcacuggugcugccaucuug

SEQ ID NO: 745525 - RNA, 22 nt, Human
uggccucaaucuguccuccagc

SEQ ID NO: 745526 - RNA, 22 nt, Human
ccagacuuuuaguagugaguua

SEQ ID NO: 745527 - RNA, 22 nt, Human
ugcuuucagauaucuguuucaa

SEQ ID NO: 745528 - RNA, 22 nt, Human
ugugcuucaucacuucucaguu

SEQ ID NO: 745529 - RNA, 22 nt, Human
auucuucacauaagugcuguac

SEQ ID NO: 745530 - RNA, 21 nt, Human
ucuuuacauuugccucuugca

SEQ ID NO: 745531 - RNA, 22 nt, Human
uagccagugagacccagaaaua

SEQ ID NO: 745532 - RNA, 22 nt, Human
aguauuuagcugacucgcuaca

SEQ ID NO: 745533 - RNA, 22 nt, Human
auauacagggagaaacagcuua

SEQ ID NO: 745534 - RNA, 22 nt, Human
gcugcugccgcggccgcuggga

SEQ ID NO: 745535 - RNA, 22 nt, Human
cauuucauaguugucacaauaa

SEQ ID NO: 745536 - RNA, 22 nt, Human
ggaaucagaugaggggcagagc

SEQ ID NO: 745537 - RNA, 22 nt, Human
guguacaaaaugucuccaugga

SEQ ID NO: 745538 - RNA, 22 nt, Human
ucagcauaucuugagcuucaug

SEQ ID NO: 745539 - RNA, 23 nt, Human
aauuaaauugcuagauccagggc

SEQ ID NO: 745540 - RNA, 22 nt, Human
ugugaggcuaccugccaggguc

SEQ ID NO: 745541 - RNA, 22 nt, Human
aaaacaguuauaaacagaguca

SEQ ID NO: 745542 - RNA, 22 nt, Human
ucccucacugguucugcauccc

SEQ ID NO: 745543 - RNA, 22 nt, Human
ucagaaccugcaagucuaaccu

SEQ ID NO: 745544 - RNA, 22 nt, Human
agaugguucucagaaacucaac

SEQ ID NO: 745545 - RNA, 22 nt, Human
agucuugcucuugcaucugcuu

SEQ ID NO: 745546 - RNA, 22 nt, Human
aaguaacaucugaacaugaugu

SEQ ID NO: 745547 - RNA, 22 nt, Human
ucccagcaggaguccaguuccc

SEQ ID NO: 745548 - RNA, 22 nt, Human
cacugagccuugccagcuuggu

SEQ ID NO: 745549 - RNA, 19 nt, Human
caaggguugggucugucau

SEQ ID NO: 745550 - RNA, 23 nt, Human
gaagugucugagcuguauuuuuc

SEQ ID NO: 745551 - RNA, 22 nt, Human
guuaacacaugcaauugcacuu

SEQ ID NO: 745552 - RNA, 22 nt, Human
uugaagcauuguggcuuguauu

SEQ ID NO: 745553 - RNA, 22 nt, Human
cagcaacuuggacagcagucuu

SEQ ID NO: 745554 - RNA, 22 nt, Human
cauuauuaauucagcacaugcu

SEQ ID NO: 745555 - RNA, 22 nt, Human
cagcucucacacuuagcuucua

SEQ ID NO: 745556 - RNA, 22 nt, Human
cagggccucauccucagagauu

SEQ ID NO: 745557 - RNA, 22 nt, Human
gucuccagaagccuagacagcc

SEQ ID NO: 745558 - RNA, 22 nt, Human
cagcaccuaggacaguagucag

SEQ ID NO: 745559 - RNA, 22 nt, Human
ccugggcuuacgaccucugacu

SEQ ID NO: 745560 - RNA, 22 nt, Human
acaguaauauugaugcucguca

SEQ ID NO: 745561 - RNA, 21 nt, Human
acuuggcagaacgcagaaggc

SEQ ID NO: 745562 - RNA, 22 nt, Human
ugccaggauggccagggggcca

SEQ ID NO: 745563 - RNA, 22 nt, Human
ugaagccuuguguggccucucu

SEQ ID NO: 745564 - RNA, 22 nt, Human
gcugaacuacaugaaguugccg

SEQ ID NO: 745565 - RNA, 22 nt, Human
agcaaagucaguggaaccaucc

SEQ ID NO: 745566 - RNA, 22 nt, Human
gagcaacaguuuaugguuuuuc

SEQ ID NO: 745567 - RNA, 22 nt, Human
gaggcugcaggcaaugcugccc

SEQ ID NO: 745568 - RNA, 22 nt, Human
cuggagccagccagggcccucu

SEQ ID NO: 745569 - RNA, 22 nt, Human
gcagggcgcguuugagcgggcu

SEQ ID NO: 745570 - RNA, 22 nt, Human
ccucccugucuaccuguugugg

SEQ ID NO: 745571 - RNA, 22 nt, Human
accauacuugaaauggauagga

SEQ ID NO: 745572 - RNA, 22 nt, Human
ggaacaggaaaggagggaugcu

SEQ ID NO: 745573 - RNA, 22 nt, Human
uuauguacucugcaauguuuga

SEQ ID NO: 745574 - RNA, 22 nt, Human
gcaaaggcuucuuuuauucucc

SEQ ID NO: 745575 - RNA, 22 nt, Human
agaacacacugggggaaacaag

SEQ ID NO: 745576 - RNA, 23 nt, Human
cugccccaauuauaaaagaagau

SEQ ID NO: 745577 - RNA, 22 nt, Human
caggaagauuagaccaagagcu

SEQ ID NO: 745578 - RNA, 22 nt, Human
guuaacauaggcuuagggguuu

SEQ ID NO: 745579 - RNA, 22 nt, Human
gacuuuauuauaguggcaauag

SEQ ID NO: 745580 - RNA, 22 nt, Human
ucuguuauucugcucaguauag

SEQ ID NO: 745581 - RNA, 23 nt, Human
ugaauuuggaacucagagaauua

SEQ ID NO: 745582 - RNA, 22 nt, Human
caccuucagaaugcuccaggca

SEQ ID NO: 745583 - RNA, 20 nt, Human
augcaaacucacaaaauacc

SEQ ID NO: 745584 - RNA, 22 nt, Human
gcuuccuagaucugugguacuc

SEQ ID NO: 745585 - RNA, 22 nt, Human
acauugcaauuagguaccuaug

SEQ ID NO: 745586 - RNA, 22 nt, Human
uggcauccagccaugugauuuu

SEQ ID NO: 745587 - RNA, 22 nt, Human
uugcuuuauuggguuuacugcc

SEQ ID NO: 745588 - RNA, 22 nt, Human
uuacagagcucauuucuaaggg

SEQ ID NO: 745589 - RNA, 22 nt, Human
gaugagacagaauagcccaagg

SEQ ID NO: 745590 - RNA, 22 nt, Human
uuguuucucuggucuugaguga

SEQ ID NO: 745591 - RNA, 16 nt, Human
ggcuccagaauagcga

SEQ ID NO: 745592 - RNA, 22 nt, Human
cagcaggacauggaggaguaaa

SEQ ID NO: 745593 - RNA, 22 nt, Human
guuuuauaggugaaauauuacu

SEQ ID NO: 745594 - RNA, 22 nt, Human
ugaaggaaugagggaguggguc

SEQ ID NO: 745595 - RNA, 22 nt, Human
ucaggccaggagaucagauuga

SEQ ID NO: 745596 - RNA, 22 nt, Human
gcccugcucuuuugcccaccca

SEQ ID NO: 745597 - RNA, 22 nt, Human
cuuaagaagcaagucucagcaa

SEQ ID NO: 745598 - RNA, 22 nt, Human
gcucagaggguuuuggccaagu

SEQ ID NO: 745599 - RNA, 21 nt, Human
aagggagauaggaaucaggcc

SEQ ID NO: 745600 - RNA, 20 nt, Human
gcugucuggauuagaagccu

SEQ ID NO: 745601 - RNA, 22 nt, Human
ugggagauauugcuguggcugu

SEQ ID NO: 745602 - RNA, 22 nt, Human
gggauggggagcuggaaagggg

SEQ ID NO: 745603 - RNA, 22 nt, Human
aaaaccacuuccuugcuauugg

SEQ ID NO: 745604 - RNA, 22 nt, Human
ccagcugucugguuccagagcc

SEQ ID NO: 745605 - RNA, 22 nt, Human
guuuuucuuugugugaagacaa

SEQ ID NO: 745606 - RNA, 21 nt, Human
ucuggcuuucauuccccuucu

SEQ ID NO: 745607 - RNA, 22 nt, Human
uauaaguaguuguugaagacuu

SEQ ID NO: 745608 - RNA, 22 nt, Human
cagcuucaauaauggcugaugg

SEQ ID NO: 745609 - RNA, 22 nt, Human
cuggagccaugucuugacugcu

SEQ ID NO: 745610 - RNA, 22 nt, Human
ugccuggaaggcccaugggaag

SEQ ID NO: 745611 - RNA, 22 nt, Human
uuaaacuauagcuugaugugaa

SEQ ID NO: 745612 - RNA, 18 nt, Human
aggcaggcggaucacaag

SEQ ID NO: 745613 - RNA, 22 nt, Human
ugguccuucguggugcaguucu

SEQ ID NO: 745614 - RNA, 22 nt, Human
augaaacagugaauuagucaag

SEQ ID NO: 745615 - RNA, 22 nt, Human
gcccccagaccucagugggcug

SEQ ID NO: 745616 - RNA, 22 nt, Human
uuccuucuagagcuuguuuagg

SEQ ID NO: 745617 - RNA, 22 nt, Human
guggcugcuaagucuccuuccu

SEQ ID NO: 745618 - RNA, 22 nt, Human
cucccugguguccccuccagga

SEQ ID NO: 745619 - RNA, 22 nt, Human
ccagugugaccaucuguuagcu

SEQ ID NO: 745620 - RNA, 22 nt, Human
cugucugcucauaauggagggc

SEQ ID NO: 745621 - RNA, 20 nt, Human
cacguuuuuccacuagcaaa

SEQ ID NO: 745622 - RNA, 22 nt, Human
gucucagggacugcuucugggg

SEQ ID NO: 745623 - RNA, 22 nt, Human
ccccuucuggucuucaauggug

SEQ ID NO: 745624 - RNA, 22 nt, Human
cagcuucugcucauggaggggu

SEQ ID NO: 745625 - RNA, 22 nt, Human
aaagcacuucaggagcaguuug

SEQ ID NO: 745626 - RNA, 22 nt, Human
cuggagggagauucaaaggagg

SEQ ID NO: 745627 - RNA, 22 nt, Human
ugcuggccucggcgcugggccu

SEQ ID NO: 745628 - RNA, 19 nt, Human
uauuuucguggaggccuau

SEQ ID NO: 745629 - RNA, 22 nt, Human
acacuguuccacacuaagaagg

SEQ ID NO: 745630 - RNA, 22 nt, Human
cagauccacccuuguagugaca

SEQ ID NO: 745631 - RNA, 20 nt, Human
ucagugauuaucucugagug

SEQ ID NO: 745632 - RNA, 22 nt, Human
ucuucauguauacucaugguac

SEQ ID NO: 745633 - RNA, 22 nt, Human
ucugcucugggccagcuauuaa

SEQ ID NO: 745634 - RNA, 22 nt, Human
gcuuccaguaaguugcugccau

SEQ ID NO: 745635 - RNA, 20 nt, Human
aagucccuaagucucuggcc

SEQ ID NO: 745636 - RNA, 22 nt, Human
uggcacugucaccaaugcuguc

SEQ ID NO: 745637 - RNA, 22 nt, Human
aguguguaagggaucaaagagu

SEQ ID NO: 745638 - RNA, 16 nt, Human
ucagggcagaauggca

SEQ ID NO: 745639 - RNA, 22 nt, Human
aaagucauugcuguuaucaaug

SEQ ID NO: 745640 - RNA, 22 nt, Human
ucauguuuggaguuugcucacu

SEQ ID NO: 745641 - RNA, 22 nt, Human
aggcagguguugggagacacca

SEQ ID NO: 745642 - RNA, 22 nt, Human
uuucagaucauuuuuuaaguac

SEQ ID NO: 745643 - RNA, 22 nt, Human
uucacagauguauuggaacucc

SEQ ID NO: 745644 - RNA, 22 nt, Human
uuucacaaugcaauccuacuuc

SEQ ID NO: 745645 - RNA, 22 nt, Human
augcuauguaacuggcagauag

SEQ ID NO: 745646 - RNA, 22 nt, Human
gggcuggugaggcugcccugca

SEQ ID NO: 745647 - RNA, 22 nt, Human
uucaaugccuagaacuuagcau

SEQ ID NO: 745648 - RNA, 22 nt, Human
gagguucacuuccugaaauagc

SEQ ID NO: 745649 - RNA, 22 nt, Human
acuggagucagggaaaaagugu

SEQ ID NO: 745650 - RNA, 22 nt, Human
uggauggauugacgaaggcagc

SEQ ID NO: 745651 - RNA, 22 nt, Human
augcguguaggaacagugucua

SEQ ID NO: 745652 - RNA, 20 nt, Human
uugucacagcuuuccaucag

SEQ ID NO: 745653 - RNA, 22 nt, Human
agacauagaaaaucauuaggaa

SEQ ID NO: 745654 - RNA, 22 nt, Human
cugggcaggagggcucuaugga

SEQ ID NO: 745655 - RNA, 22 nt, Human
ugucucaggcccaagccaguaa

SEQ ID NO: 745656 - RNA, 22 nt, Human
uuuguaacaucccaacaaauuu

SEQ ID NO: 745657 - RNA, 22 nt, Human
cccucugagacagguagcucac

SEQ ID NO: 745658 - RNA, 22 nt, Human
gguaacacaggugcaguuuuaa

SEQ ID NO: 745659 - RNA, 22 nt, Human
cacuugauggaagagcagaaga

SEQ ID NO: 745660 - RNA, 22 nt, Human
acacacuggcccccaguacuga

SEQ ID NO: 745661 - RNA, 19 nt, Human
cuuauuucugguuuugggu

SEQ ID NO: 745662 - RNA, 22 nt, Human
gcauacauugcacccugguagu

SEQ ID NO: 745663 - RNA, 22 nt, Human
agggaguguaaauggugcucag

SEQ ID NO: 745664 - RNA, 22 nt, Human
ggagaaggaagaaagcuacuau

SEQ ID NO: 745665 - RNA, 22 nt, Human
cccugcagaucagugagaacuu

SEQ ID NO: 745666 - RNA, 22 nt, Human
acagcuccuacugaagccaugu

SEQ ID NO: 745667 - RNA, 22 nt, Human
gugcaugaagacucagaaaguc

SEQ ID NO: 745668 - RNA, 22 nt, Human
ucagaggaaacaaucuuuagua

SEQ ID NO: 745669 - RNA, 22 nt, Human
gaaagauauuuauuggcaacag

SEQ ID NO: 745670 - RNA, 22 nt, Human
auucuuaauuccaaagacugag

SEQ ID NO: 745671 - RNA, 22 nt, Human
uucauugaugugguuuaaugua

SEQ ID NO: 745672 - RNA, 22 nt, Human
acagucuaggugugugauuuaa

SEQ ID NO: 745673 - RNA, 22 nt, Human
gcaggcugcccucuuguguuga

SEQ ID NO: 745674 - RNA, 22 nt, Human
gcaaauguuuuugaguguuuac

SEQ ID NO: 745675 - RNA, 22 nt, Human
gaccacuggggugagggccauc

SEQ ID NO: 745676 - RNA, 22 nt, Human
gugccuguuucuuuugaauuca

SEQ ID NO: 745677 - RNA, 22 nt, Human
acagugaaugagaauggagaaa

SEQ ID NO: 745678 - RNA, 22 nt, Human
uccuucaaucacccagugggga

SEQ ID NO: 745679 - RNA, 22 nt, Human
uggcauguggcagcugguucag

SEQ ID NO: 745680 - RNA, 22 nt, Human
auauuugucaauucacuguuca

SEQ ID NO: 745681 - RNA, 22 nt, Human
ucaguaaacagguuuaaguccu

SEQ ID NO: 745682 - RNA, 22 nt, Human
guaaaugagucaaaugggggaa

SEQ ID NO: 745683 - RNA, 22 nt, Human
ccaggagcaaagaucacuggga

SEQ ID NO: 745684 - RNA, 22 nt, Human
caguuucuucaauucagacacu

SEQ ID NO: 745685 - RNA, 22 nt, Human
gucuccuggcugcagcuaagac

SEQ ID NO: 745686 - RNA, 22 nt, Human
aaaccuuuucagcugaauggag

SEQ ID NO: 745687 - RNA, 22 nt, Human
acuuaguuaaguauuuuggaaa

SEQ ID NO: 745688 - RNA, 22 nt, Human
ugggcuggcugaggcauucacu

SEQ ID NO: 745689 - RNA, 22 nt, Human
ugccaggcuguccugggccugg

SEQ ID NO: 745690 - RNA, 22 nt, Human
uagagaugcccuagcugaagua

SEQ ID NO: 745691 - RNA, 22 nt, Human
acaugcauaaacuacuucuuau

SEQ ID NO: 745692 - RNA, 19 nt, Human
uguacguguggguguuuaa

SEQ ID NO: 745693 - RNA, 22 nt, Human
uugcuguaggcugauugcugaa

SEQ ID NO: 745694 - RNA, 17 nt, Human
uggcuucagauguacau

SEQ ID NO: 745695 - RNA, 22 nt, Human
uaaguucauuagacuacagaua

SEQ ID NO: 745696 - RNA, 22 nt, Human
acauccauuugucagcucuuga

SEQ ID NO: 745697 - RNA, 22 nt, Human
gggcgcgggaaggagcccgaga

SEQ ID NO: 745698 - RNA, 16 nt, Human
augggcagugaggaag

SEQ ID NO: 745699 - RNA, 22 nt, Human
aagcaaaugugggugcagaauu

SEQ ID NO: 745700 - RNA, 22 nt, Human
uggagagcgcgacgggaggaag

SEQ ID NO: 745701 - RNA, 22 nt, Human
accagacacugugaagacaggc

SEQ ID NO: 745702 - RNA, 22 nt, Human
aucucccagccacagcauucuu

SEQ ID NO: 745703 - RNA, 22 nt, Human
cuucacagaauaaacucauuau

SEQ ID NO: 745704 - RNA, 22 nt, Human
ucacagaaguguagugaggaaa

SEQ ID NO: 745705 - RNA, 22 nt, Human
ugguugugcugaguuuagugca

SEQ ID NO: 745706 - RNA, 22 nt, Human
agcaguuuggaaaauacuagaa

SEQ ID NO: 745707 - RNA, 22 nt, Human
gagcugggccucagaacacagu

SEQ ID NO: 745708 - RNA, 22 nt, Human
cugagguggaacagaggugaag

SEQ ID NO: 745709 - RNA, 22 nt, Human
aguaacaaagugggagaaugau

SEQ ID NO: 745710 - RNA, 22 nt, Human
uuugacaauuagguagaaaaag

SEQ ID NO: 745711 - RNA, 22 nt, Human
cucugggcuuaccugcuuccug

SEQ ID NO: 745712 - RNA, 22 nt, Human
auggagaguucacuucuaaguu

SEQ ID NO: 745713 - RNA, 22 nt, Human
ugcccugguuacacuggagucc

SEQ ID NO: 745714 - RNA, 22 nt, Human
ugaggccagcuucagcagugga

SEQ ID NO: 745715 - RNA, 22 nt, Human
ggguccagcgacagcaggcuca

SEQ ID NO: 745716 - RNA, 22 nt, Human
ucagaggaaucuguacuugaaa

SEQ ID NO: 745717 - RNA, 22 nt, Human
agggaggucuggcugcccugag

SEQ ID NO: 745718 - RNA, 22 nt, Human
ccagcuggaagagugcagaacu

SEQ ID NO: 745719 - RNA, 22 nt, Human
ccacagcugacaauggauagac

SEQ ID NO: 745720 - RNA, 22 nt, Human
ccaguguguuuuucucugacuc

SEQ ID NO: 745721 - RNA, 22 nt, Human
agccugggcaacuccauucacu

SEQ ID NO: 745722 - RNA, 19 nt, Human
uggcuggagaucugcuacu

SEQ ID NO: 745723 - RNA, 22 nt, Human
gcacccagggcaggaagugagg

SEQ ID NO: 745724 - RNA, 22 nt, Human
caauuucuggaacuaauucuga

SEQ ID NO: 745725 - RNA, 22 nt, Human
ggucagcucuuugggcuggugg

SEQ ID NO: 745726 - RNA, 23 nt, Human
aucaaaguggaaaucaauuaucu

SEQ ID NO: 745727 - RNA, 22 nt, Human
uggcauugcuucugaaguggag

SEQ ID NO: 745728 - RNA, 22 nt, Human
ucagagucucccccaguuuggg

SEQ ID NO: 745729 - RNA, 22 nt, Human
uggucauugcuauuguuucuca

SEQ ID NO: 745730 - RNA, 22 nt, Human
uguccaggugugucuaaagaga

SEQ ID NO: 745731 - RNA, 23 nt, Human
cauuccugauauggccacaagag

SEQ ID NO: 745732 - RNA, 22 nt, Human
acugccugccucugauucugca

SEQ ID NO: 745733 - RNA, 20 nt, Human
aggcucugccauugucccug

SEQ ID NO: 745734 - RNA, 23 nt, Human
cagcugguugugggaguggcugc

SEQ ID NO: 745735 - RNA, 22 nt, Human
cucaucugcucuuauuaucuua

SEQ ID NO: 745736 - RNA, 22 nt, Human
agaaucaauucacugcugcagc

SEQ ID NO: 745737 - RNA, 22 nt, Human
augucugugugaucuuggauaa

SEQ ID NO: 745738 - RNA, 22 nt, Human
cuggagcauuuucugcuucugc

SEQ ID NO: 745739 - RNA, 22 nt, Human
ugucacuuugccuucuggacuu

SEQ ID NO: 745740 - RNA, 22 nt, Human
gcagcucucuggccugcccugg

SEQ ID NO: 745741 - RNA, 22 nt, Human
gagcugaggauacaucagugaa

SEQ ID NO: 745742 - RNA, 22 nt, Human
cucucagacacccauuuggaaa

SEQ ID NO: 745743 - RNA, 21 nt, Human
aaauuagcuucaaguucugca

SEQ ID NO: 745744 - RNA, 22 nt, Human
aaugauaugcaaauuaucauca

SEQ ID NO: 745745 - RNA, 19 nt, Human
uuccaggugcuguggggag

SEQ ID NO: 745746 - RNA, 22 nt, Human
auacacauauguguguauaugu

SEQ ID NO: 745747 - RNA, 20 nt, Human
uuuuauauguaggguauaug

SEQ ID NO: 745748 - RNA, 22 nt, Human
cauacuauuacuaggagcagga

SEQ ID NO: 745749 - RNA, 22 nt, Human
ucccagagaaagucaaggucuu

SEQ ID NO: 745750 - RNA, 21 nt, Human
agauuugucccuucccauuua

SEQ ID NO: 745751 - RNA, 22 nt, Human
cucugugaaccccuccuuucuu

SEQ ID NO: 745752 - RNA, 22 nt, Human
aagccagggguugguaugcuau

SEQ ID NO: 745753 - RNA, 20 nt, Human
agcaguguggggagacugug

SEQ ID NO: 745754 - RNA, 22 nt, Human
aaaaguaauugugguuuuugcu

SEQ ID NO: 745755 - RNA, 22 nt, Human
guauuucugguuaaaugugcua

SEQ ID NO: 745756 - RNA, 22 nt, Human
cugcugucauagccaucccucc

SEQ ID NO: 745757 - RNA, 19 nt, Human
ucucucuguacauuagaua

SEQ ID NO: 745758 - RNA, 22 nt, Human
cccuguggugacaggccugucu

SEQ ID NO: 745759 - RNA, 22 nt, Human
acaggcagguugagaaacauuu

SEQ ID NO: 745760 - RNA, 20 nt, Human
ucccaucacgccugugccag

SEQ ID NO: 745761 - RNA, 22 nt, Human
aagccagguguuuaggccagcg

SEQ ID NO: 745762 - RNA, 22 nt, Human
cccaggaaaguggaggcggcug

SEQ ID NO: 745763 - RNA, 22 nt, Human
guguccugaucaauugagcugg

SEQ ID NO: 745764 - RNA, 22 nt, Human
cuagaacagaaaguacaggaaa

SEQ ID NO: 745765 - RNA, 22 nt, Human
cagggagaaaucuccaggaggu

SEQ ID NO: 745766 - RNA, 22 nt, Human
gcaauaguauuuauuaaaguag

SEQ ID NO: 745767 - RNA, 22 nt, Human
ugugcagcucuagagccaagcc

SEQ ID NO: 745768 - RNA, 22 nt, Human
ggguuccuccaguuccuagagc

SEQ ID NO: 745769 - RNA, 22 nt, Human
agugauguaacaaacagaguua

SEQ ID NO: 745770 - RNA, 22 nt, Human
uccaucauggcagcagcaguga

SEQ ID NO: 745771 - RNA, 22 nt, Human
gaagcauacuuucuauacugcu

SEQ ID NO: 745772 - RNA, 22 nt, Human
caaggacacugagcuuuguaaa

SEQ ID NO: 745773 - RNA, 22 nt, Human
agaggaugauuuuaaggacacu

SEQ ID NO: 745774 - RNA, 22 nt, Human
uauuugucacugcacuugaaau

SEQ ID NO: 745775 - RNA, 22 nt, Human
aacugugggaugcauuaauuca

SEQ ID NO: 745776 - RNA, 22 nt, Human
aggccaaauugaucaucuuuag

SEQ ID NO: 745777 - RNA, 22 nt, Human
aaguuccugggccaaguccagg

SEQ ID NO: 745778 - RNA, 22 nt, Human
ugucuuaauuuggaugauguuu

SEQ ID NO: 745779 - RNA, 22 nt, Human
uccuccccugcccaugaggagg

SEQ ID NO: 745780 - RNA, 22 nt, Human
gcaguccuagggugcucugcag

SEQ ID NO: 745781 - RNA, 22 nt, Human
agugggugagcuuggucuagau

SEQ ID NO: 745782 - RNA, 22 nt, Human
uaauuuugucacagugacaugc

SEQ ID NO: 745783 - RNA, 22 nt, Human
acagaacuuccugcuggagugg

SEQ ID NO: 745784 - RNA, 22 nt, Human
acugggccgaaauggacagaau

SEQ ID NO: 745785 - RNA, 22 nt, Human
cauggccagggagagagaaugu

SEQ ID NO: 745786 - RNA, 22 nt, Human
cacagggcagagaccugggugc

SEQ ID NO: 745787 - RNA, 22 nt, Human
ucuuuucuccagaccugggauc

SEQ ID NO: 745788 - RNA, 22 nt, Human
aauaagaauuuacuugucaaga

SEQ ID NO: 745789 - RNA, 22 nt, Human
uucuucauggguucuuuuagga

SEQ ID NO: 745790 - RNA, 22 nt, Human
uaugaguggcguagagguaggg

SEQ ID NO: 745791 - RNA, 22 nt, Human
uuggcagagccccagccuugga

SEQ ID NO: 745792 - RNA, 22 nt, Human
cagaacauuccaugugcccugc

SEQ ID NO: 745793 - RNA, 21 nt, Human
aaguuuuauguugccauuugu

SEQ ID NO: 745794 - RNA, 22 nt, Human
acgugcaggaucugguuggcga

SEQ ID NO: 745795 - RNA, 20 nt, Human
uuauaucauaaugugccaau

SEQ ID NO: 745796 - RNA, 22 nt, Human
acauugaacuacuuguaaugag

SEQ ID NO: 745797 - RNA, 22 nt, Human
aggucugguguugggccugaaa

SEQ ID NO: 745798 - RNA, 22 nt, Human
auggcugagaugggcuccaggc

SEQ ID NO: 745799 - RNA, 22 nt, Human
acaggcagcgucauugcugcuc

SEQ ID NO: 745800 - RNA, 22 nt, Human
gaccuggaagaugguccucacc

SEQ ID NO: 745801 - RNA, 22 nt, Human
cagggcuugaaucaaggaaguc

SEQ ID NO: 745802 - RNA, 22 nt, Human
auacauaguaccacauuugaca

SEQ ID NO: 745803 - RNA, 22 nt, Human
ggaaggagucuuuaacacccau

SEQ ID NO: 745804 - RNA, 22 nt, Human
aauagcaguuaaaaaucagccc

SEQ ID NO: 745805 - RNA, 22 nt, Human
acauugaugugaugcagaagug

SEQ ID NO: 745806 - RNA, 22 nt, Human
acauuucugagcagggagcugu

SEQ ID NO: 745807 - RNA, 22 nt, Human
ccaucauuugauacagcugucu

SEQ ID NO: 745808 - RNA, 23 nt, Human
ugaagugaaauuucacaagggac

SEQ ID NO: 745809 - RNA, 22 nt, Human
gggcccuucagcuuccucugca

SEQ ID NO: 745810 - RNA, 23 nt, Human
cgcccagccucagugaccugggc

SEQ ID NO: 745811 - RNA, 22 nt, Human
ccauuaaaauggaauguaguga

SEQ ID NO: 745812 - RNA, 22 nt, Human
ugugaaauuacuuaaaggaaau

SEQ ID NO: 745813 - RNA, 22 nt, Human
gacauuuagcuguuuugcauuu

SEQ ID NO: 745814 - RNA, 22 nt, Human
gcagucagacaggaggagcucc

SEQ ID NO: 745815 - RNA, 22 nt, Human
aauuaagagagaguugaagcaa

SEQ ID NO: 745816 - RNA, 22 nt, Human
uuacacagcuucuauccuugaa

SEQ ID NO: 745817 - RNA, 21 nt, Human
aggaauguguauauauacaau

SEQ ID NO: 745818 - RNA, 22 nt, Human
agacagugugaguucagggugg

SEQ ID NO: 745819 - RNA, 22 nt, Human
cugucauuuuuuuagaacaccu

SEQ ID NO: 745820 - RNA, 22 nt, Human
ggaguugguggcccggaaucuc

SEQ ID NO: 745821 - RNA, 22 nt, Human
ccuuugugagguccuguggggg

SEQ ID NO: 745822 - RNA, 22 nt, Human
ggagucugggaauuggagagaa

SEQ ID NO: 745823 - RNA, 22 nt, Human
aggucaccauggcaugcuccac

SEQ ID NO: 745824 - RNA, 22 nt, Human
ugcaaauagccugaugaaagaa

SEQ ID NO: 745825 - RNA, 22 nt, Human
aguggcuuauguuuagaaucau

SEQ ID NO: 745826 - RNA, 22 nt, Human
ucugaaaauguugacuuuguuu

SEQ ID NO: 745827 - RNA, 22 nt, Human
auacagaauucacuacaguuuc

SEQ ID NO: 745828 - RNA, 22 nt, Human
cuguacaucccgagagccagua

SEQ ID NO: 745829 - RNA, 22 nt, Human
auuguucagaguagggcucugu

SEQ ID NO: 745830 - RNA, 23 nt, Human
uucccacaucuuccacagcuaug

SEQ ID NO: 745831 - RNA, 22 nt, Human
cuuuucuuauguggacguaccu

SEQ ID NO: 745832 - RNA, 22 nt, Human
auccauuucuaucuugcugagg

SEQ ID NO: 745833 - RNA, 22 nt, Human
uccauuuacuauucucauaucg

SEQ ID NO: 745834 - RNA, 22 nt, Human
ugcuggagagcuaguucugcag

SEQ ID NO: 745835 - RNA, 22 nt, Human
uaccacuacauuugcuaauggc

SEQ ID NO: 745836 - RNA, 22 nt, Human
cuuucaacuacauacaggcgau

SEQ ID NO: 745837 - RNA, 22 nt, Human
ucauguguccuaguucauauaa

SEQ ID NO: 745838 - RNA, 22 nt, Human
ucaaagcaucagucaauuuagg

SEQ ID NO: 745839 - RNA, 22 nt, Human
cagcccugagcaaggcuuuuaa

SEQ ID NO: 745840 - RNA, 22 nt, Human
augcuuccccucucauuucagc

SEQ ID NO: 745841 - RNA, 22 nt, Human
ugagagagcgccugggaucauu

SEQ ID NO: 745842 - RNA, 23 nt, Human
cagggaggagauacuguguaucu

SEQ ID NO: 745843 - RNA, 22 nt, Human
guuuaugaauguuacuauagag

SEQ ID NO: 745844 - RNA, 22 nt, Human
auuuaccauauguacugaguau

SEQ ID NO: 745845 - RNA, 17 nt, Human
ggcaccagacggagagu

SEQ ID NO: 745846 - RNA, 22 nt, Human
auucucaaacaagugguuugau

SEQ ID NO: 745847 - RNA, 22 nt, Human
uguggcagagagagcuuccuug

SEQ ID NO: 745848 - RNA, 22 nt, Human
augugauucccacugaaucacu

SEQ ID NO: 745849 - RNA, 22 nt, Human
uuacaaguucagauuuucucau

SEQ ID NO: 745850 - RNA, 22 nt, Human
cugcaggaaucugugcuaggug

SEQ ID NO: 745851 - RNA, 22 nt, Human
agguucacacacacaaaaagau

SEQ ID NO: 745852 - RNA, 22 nt, Human
ucaguuugaauguuagcacagu

SEQ ID NO: 745853 - RNA, 22 nt, Human
ccuggagcgcgggucaagcugg

SEQ ID NO: 745854 - RNA, 22 nt, Human
gaaaacacuuugaucugaaagu

SEQ ID NO: 745855 - RNA, 22 nt, Human
ccacagcaccgcugccaguccc

SEQ ID NO: 745856 - RNA, 22 nt, Human
uuauucugcacuuuuaaaauau

SEQ ID NO: 745857 - RNA, 22 nt, Human
cugagggucaacuugauuguau

SEQ ID NO: 745858 - RNA, 22 nt, Human
gucacagaucucuugagucaag

SEQ ID NO: 745859 - RNA, 22 nt, Human
uugcccugucaguagaagugca

SEQ ID NO: 745860 - RNA, 22 nt, Human
cugcacaguggacagugaagau

SEQ ID NO: 745861 - RNA, 22 nt, Human
uccagcucagaugcagggauca

SEQ ID NO: 745862 - RNA, 22 nt, Human
aaaaccuucagguuuggaguuu

SEQ ID NO: 745863 - RNA, 22 nt, Human
ugcauuccuccaccuccugcac

SEQ ID NO: 745864 - RNA, 22 nt, Human
uauuuaaaauaagccccagugg

SEQ ID NO: 745865 - RNA, 23 nt, Human
ugcucugugaauaguuggugacu

SEQ ID NO: 745866 - RNA, 22 nt, Human
cagauauguggauucuauuagc

SEQ ID NO: 745867 - RNA, 22 nt, Human
acugagguuuuuaguguuaaau

SEQ ID NO: 745868 - RNA, 22 nt, Human
aagacaauguuucugauagaua

SEQ ID NO: 745869 - RNA, 22 nt, Human
uguuuuaaucucccauugcucu

SEQ ID NO: 745870 - RNA, 22 nt, Human
ccugccagaaaagagggaguuc

SEQ ID NO: 745871 - RNA, 22 nt, Human
ugcuccacuaagccaucccauu

SEQ ID NO: 745872 - RNA, 22 nt, Human
acacuuuagauauucccuucug

SEQ ID NO: 745873 - RNA, 22 nt, Human
gagcugagcagggagccucacu

SEQ ID NO: 745874 - RNA, 22 nt, Human
cauggccacaugauaaucaagu

SEQ ID NO: 745875 - RNA, 23 nt, Human
agcuaaggaagcugaggcacagu

SEQ ID NO: 745876 - RNA, 22 nt, Human
cacagaggcaaccuucuggggu

SEQ ID NO: 745877 - RNA, 22 nt, Human
acauguaaaaggaacaugcaug

SEQ ID NO: 745878 - RNA, 21 nt, Human
cauuucaaagagcuggaaauc

SEQ ID NO: 745879 - RNA, 23 nt, Human
ccugugucuguugcugaauaaug

SEQ ID NO: 745880 - RNA, 22 nt, Human
gggcugacaaccaucugacaag

SEQ ID NO: 745881 - RNA, 22 nt, Human
auuggcuauugagugugugcug

SEQ ID NO: 745882 - RNA, 22 nt, Human
gcucugcccaaagcuguggcug

SEQ ID NO: 745883 - RNA, 22 nt, Human
ucagaaagcuauaugguguguc

SEQ ID NO: 745884 - RNA, 22 nt, Human
cuuggagagggagaaaaauaac

SEQ ID NO: 745885 - RNA, 22 nt, Human
aguucacaagcguaggugcuga

SEQ ID NO: 745886 - RNA, 22 nt, Human
uauggguacuuugauuuagaaa

SEQ ID NO: 745887 - RNA, 22 nt, Human
ggcuggguucugagaaagagua

SEQ ID NO: 745888 - RNA, 22 nt, Human
gccuccaguuuuuuucugaacu

SEQ ID NO: 745889 - RNA, 22 nt, Human
cuuauuauaaaauccuguuuga

SEQ ID NO: 745890 - RNA, 22 nt, Human
uauugacagaugcauuauguug

SEQ ID NO: 745891 - RNA, 22 nt, Human
guucuucaucauuaacacucug

SEQ ID NO: 745892 - RNA, 22 nt, Human
uacagucaagcauaagaaguca

SEQ ID NO: 745893 - RNA, 22 nt, Human
ugcaggaaugagguucucaguu

SEQ ID NO: 745894 - RNA, 22 nt, Human
ucugggucucagagugaccaug

SEQ ID NO: 745895 - RNA, 22 nt, Human
ugaagguggcauaggagagaug

SEQ ID NO: 745896 - RNA, 22 nt, Human
gccugugcuguucccucugcca

SEQ ID NO: 745897 - RNA, 22 nt, Human
cacugugucaguuugguuagac

SEQ ID NO: 745898 - RNA, 22 nt, Human
cuguaugaggaucagacuggac

SEQ ID NO: 745899 - RNA, 22 nt, Human
agcugacuucuugauccaauga

SEQ ID NO: 745900 - RNA, 22 nt, Human
cagaucuguuugccagaucagc

SEQ ID NO: 745901 - RNA, 22 nt, Human
acagcauucaauaaauaauaac

SEQ ID NO: 745902 - RNA, 22 nt, Human
ucccagagguugagucacuuau

SEQ ID NO: 745903 - RNA, 22 nt, Human
uucuguaugccaauggguuuuu

SEQ ID NO: 745904 - RNA, 22 nt, Human
ggcuucauggaggaggugaguc

SEQ ID NO: 745905 - RNA, 22 nt, Human
aaggagaguacaggaguuggua

SEQ ID NO: 745906 - RNA, 22 nt, Human
gggcucuguccauuccuucaua

SEQ ID NO: 745907 - RNA, 17 nt, Human
cuaaauacuugcguuuc

SEQ ID NO: 745908 - RNA, 22 nt, Human
uaagaagcuucugcuaaugccu

SEQ ID NO: 745909 - RNA, 21 nt, Human
gcugcagggcccagggcaccc

SEQ ID NO: 745910 - RNA, 22 nt, Human
uacaagaaauuucugcauauau

SEQ ID NO: 745911 - RNA, 22 nt, Human
ugacacauuaaaugcucacaaa

SEQ ID NO: 745912 - RNA, 23 nt, Human
uuuauccaacucuguaaucucuc

SEQ ID NO: 745913 - RNA, 19 nt, Human
uggaaggcuaagacacuug

SEQ ID NO: 745914 - RNA, 22 nt, Human
ggcugcauaggcagaagcugug

SEQ ID NO: 745915 - RNA, 22 nt, Human
gaauuauaaacuagugacuuca

SEQ ID NO: 745916 - RNA, 22 nt, Human
agauggcuuagccuggcuccca

SEQ ID NO: 745917 - RNA, 20 nt, Human
uagagcaugaaguccuaucc

SEQ ID NO: 745918 - RNA, 22 nt, Human
aauaugcauuaacuguguacau

SEQ ID NO: 745919 - RNA, 22 nt, Human
ucugccacaugagggcacagca

SEQ ID NO: 745920 - RNA, 22 nt, Human
uccacugugcagcucugcugau

SEQ ID NO: 745921 - RNA, 22 nt, Human
gcugccuguguggccacucacu

SEQ ID NO: 745922 - RNA, 22 nt, Human
aauccagcacauggacacaguc

SEQ ID NO: 745923 - RNA, 22 nt, Human
uggcccugacugauguggaggg

SEQ ID NO: 745924 - RNA, 19 nt, Human
aggcugugaggggaaggaa

SEQ ID NO: 745925 - RNA, 22 nt, Human
ucugcagacaggaagcugaggc

SEQ ID NO: 745926 - RNA, 22 nt, Human
cugcuugaccuguuguucucac

SEQ ID NO: 745927 - RNA, 22 nt, Human
cagcaaaagccagcauaagcuc

SEQ ID NO: 745928 - RNA, 22 nt, Human
gggauggggggaagcguccaug

SEQ ID NO: 745929 - RNA, 22 nt, Human
ugucucuugagcugccugaugc

SEQ ID NO: 745930 - RNA, 22 nt, Human
acugggcccagugguguggcug

SEQ ID NO: 745931 - RNA, 22 nt, Human
uggaucugacuggcuuuucuuc

SEQ ID NO: 745932 - RNA, 22 nt, Human
augaugguuguccuaggugcau

SEQ ID NO: 745933 - RNA, 22 nt, Human
cugccugaguacaagucccaga

SEQ ID NO: 745934 - RNA, 22 nt, Human
uagauacauacauuuuaaaaug

SEQ ID NO: 745935 - RNA, 22 nt, Human
aucuguguccuuauaagagaca

SEQ ID NO: 745936 - RNA, 22 nt, Human
ucugcaggucacgcuccagccu

SEQ ID NO: 745937 - RNA, 22 nt, Human
caggccaggugcucuagaauca

SEQ ID NO: 745938 - RNA, 17 nt, Human
uggcacagaggugcuau

SEQ ID NO: 745939 - RNA, 22 nt, Human
ugacagaaagaguauuaaagau

SEQ ID NO: 745940 - RNA, 22 nt, Human
gcugcccugugguccagcaggu

SEQ ID NO: 745941 - RNA, 22 nt, Human
ucugggauaagaccacagauuu

SEQ ID NO: 745942 - RNA, 20 nt, Human
ucuucagaugcuuuuggagu

SEQ ID NO: 745943 - RNA, 22 nt, Human
cgaggccacaccugcuucuggg

SEQ ID NO: 745944 - RNA, 22 nt, Human
gucuucaauagagccucaauuu

SEQ ID NO: 745945 - RNA, 22 nt, Human
guuugauuugauccggagagau

SEQ ID NO: 745946 - RNA, 22 nt, Human
cugggcacagacccccugggcc

SEQ ID NO: 745947 - RNA, 22 nt, Human
auguagauguucacuugauuuu

SEQ ID NO: 745948 - RNA, 22 nt, Human
uaugugcauuauuaccagugga

SEQ ID NO: 745949 - RNA, 22 nt, Human
acuacagucccucauauguugg

SEQ ID NO: 745950 - RNA, 20 nt, Human
auagacaaagacaugccaga

SEQ ID NO: 745951 - RNA, 22 nt, Human
agcagcagaaaguugauggcag

SEQ ID NO: 745952 - RNA, 20 nt, Human
uggcggggaugagggaguua

SEQ ID NO: 745953 - RNA, 22 nt, Human
gaaucucaggaagaucucugca

SEQ ID NO: 745954 - RNA, 21 nt, Human
gcuugguuuugguuacuugcc

SEQ ID NO: 745955 - RNA, 22 nt, Human
cgaggcggcggaagugcccgua

SEQ ID NO: 745956 - RNA, 22 nt, Human
acagccagaggagccaggcugg

SEQ ID NO: 745957 - RNA, 22 nt, Human
gggugcaggcagcccaggcagg

SEQ ID NO: 745958 - RNA, 22 nt, Human
guacacauuaugcuucucuaaa

SEQ ID NO: 745959 - RNA, 22 nt, Human
uacuacauuaauaaaacauuca

SEQ ID NO: 745960 - RNA, 22 nt, Human
auugaagaucagggaaagauuc

SEQ ID NO: 745961 - RNA, 22 nt, Human
ucaaaaauuuucugaggaugag

SEQ ID NO: 745962 - RNA, 22 nt, Human
ggaggagucaguugggcugcuu

SEQ ID NO: 745963 - RNA, 22 nt, Human
auucuggauuaucaguccacca

SEQ ID NO: 745964 - RNA, 22 nt, Human
gcugagcagccuaagcaaauuu

SEQ ID NO: 745965 - RNA, 22 nt, Human
ccuggaguuuuuugguugacuc

SEQ ID NO: 745966 - RNA, 22 nt, Human
ccaggcucagggcagacuuuca

SEQ ID NO: 745967 - RNA, 22 nt, Human
uuagaaacuuuggaggauagau

SEQ ID NO: 745968 - RNA, 22 nt, Human
aaagauucgagcgauguauaaa

SEQ ID NO: 745969 - RNA, 22 nt, Human
aauuagagaucaguucuuugac

SEQ ID NO: 745970 - RNA, 22 nt, Human
ccaagggcugagauacaucuag

SEQ ID NO: 745971 - RNA, 22 nt, Human
ucacagacgccuccccucgccu

SEQ ID NO: 745972 - RNA, 22 nt, Human
agcaaggcucggucagggugau

SEQ ID NO: 745973 - RNA, 22 nt, Human
auccaguuccaaagaucauuua

SEQ ID NO: 745974 - RNA, 21 nt, Human
acuuuacaauuuacauaguga

SEQ ID NO: 745975 - RNA, 22 nt, Human
aguuacaugugaauagaaagua

SEQ ID NO: 745976 - RNA, 22 nt, Human
augggaagcugaccugcaugga

SEQ ID NO: 745977 - RNA, 22 nt, Human
agggcuccuccccggccuccac

SEQ ID NO: 745978 - RNA, 22 nt, Human
gaucaucuuuuccugcuuccag

SEQ ID NO: 745979 - RNA, 22 nt, Human
ucuaugaaaagucuauucauuc

SEQ ID NO: 745980 - RNA, 22 nt, Human
cuugggcucagcaccgugugga

SEQ ID NO: 745981 - RNA, 22 nt, Human
uccaugagcuagcuuuccaaag

SEQ ID NO: 745982 - RNA, 22 nt, Human
cuuccuugcugucugcuccagg

SEQ ID NO: 745983 - RNA, 22 nt, Human
uccaugagagguaacuuuacaa

SEQ ID NO: 745984 - RNA, 23 nt, Human
uauuagcaauucccacagagcag

SEQ ID NO: 745985 - RNA, 22 nt, Human
ugacaggggcugguggauaaau

SEQ ID NO: 745986 - RNA, 22 nt, Human
augacauaagugaaaaacauca

SEQ ID NO: 745987 - RNA, 22 nt, Human
aagggcuguaguuuguugauca

SEQ ID NO: 745988 - RNA, 22 nt, Human
gucaggacauuuuaccauccug

SEQ ID NO: 745989 - RNA, 22 nt, Human
acaaauuggguaugagcuaaga

SEQ ID NO: 745990 - RNA, 18 nt, Human
gacccagcagaugggcuu

SEQ ID NO: 745991 - RNA, 22 nt, Human
cagucuuuguucccauuacuga

SEQ ID NO: 745992 - RNA, 22 nt, Human
aucucuggcaaugcagcaucgu

SEQ ID NO: 745993 - RNA, 22 nt, Human
agggaggcaggaaaguugucug

SEQ ID NO: 745994 - RNA, 22 nt, Human
ugggucagacagccagugggcc

SEQ ID NO: 745995 - RNA, 22 nt, Human
gaagcacagggcucgaucucag

SEQ ID NO: 745996 - RNA, 22 nt, Human
uucacaauuucccuucaucagg

SEQ ID NO: 745997 - RNA, 22 nt, Human
cucagugguggucacuuggugg

SEQ ID NO: 745998 - RNA, 22 nt, Human
gaggaguguauuccacaccacu

SEQ ID NO: 745999 - RNA, 17 nt, Human
uuacagcagcaauagag

SEQ ID NO: 746000 - RNA, 22 nt, Human
uugcuuuauauucaagagagga

SEQ ID NO: 746001 - RNA, 23 nt, Human
ucuguggcuccuucaggcugcug

SEQ ID NO: 746002 - RNA, 22 nt, Human
cuuggggcagugcuuggcacau

SEQ ID NO: 746003 - RNA, 22 nt, Human
aucuaaaaggagcucuuuaucu

SEQ ID NO: 746004 - RNA, 22 nt, Human
ccaugcuccuuaccacucacuu

SEQ ID NO: 746005 - RNA, 22 nt, Human
augguuuguguggcccagauga

SEQ ID NO: 746006 - RNA, 22 nt, Human
gaagguuugauccuuauuuaua

SEQ ID NO: 746007 - RNA, 22 nt, Human
uuaaacagacaguaaaugaaac

SEQ ID NO: 746008 - RNA, 22 nt, Human
uguccauggagaagcucagggc

SEQ ID NO: 746009 - RNA, 22 nt, Human
acaaagugugcggagcccaggg

SEQ ID NO: 746010 - RNA, 22 nt, Human
agauccauuuuggugucaacuc

SEQ ID NO: 746011 - RNA, 22 nt, Human
gucugaggccugaggcccuggg

SEQ ID NO: 746012 - RNA, 22 nt, Human
cuccagggagcugcgggagcca

SEQ ID NO: 746013 - RNA, 22 nt, Human
gggcugugcugaguaggaggug

SEQ ID NO: 746014 - RNA, 22 nt, Human
aggcugugcucagccaauggga

SEQ ID NO: 746015 - RNA, 22 nt, Human
uucaggacuaggggcuucaagg

SEQ ID NO: 746016 - RNA, 23 nt, Human
guauuucagcauucucaguuaaa

SEQ ID NO: 746017 - RNA, 22 nt, Human
ucugaggcugaauggacuccgu

SEQ ID NO: 746018 - RNA, 22 nt, Human
gacccaggagugcagagagugg

SEQ ID NO: 746019 - RNA, 22 nt, Human
acaguaaaaagccuuagaauuu

SEQ ID NO: 746020 - RNA, 22 nt, Human
auggccagagagagcacaccug

SEQ ID NO: 746021 - RNA, 22 nt, Human
aaacucagaagguacagaaggg

SEQ ID NO: 746022 - RNA, 22 nt, Human
agcccagcaaagggguuugaga

SEQ ID NO: 746023 - RNA, 23 nt, Human
uguuccagauacgccuuuuccuc

SEQ ID NO: 746024 - RNA, 22 nt, Human
acagugaugagccggcugaggc

SEQ ID NO: 746025 - RNA, 21 nt, Human
cagugcucaaucugacagugg

SEQ ID NO: 746026 - RNA, 22 nt, Human
caguggaggcucaagugugcuu

SEQ ID NO: 746027 - RNA, 22 nt, Human
uauacaguaucuuuugaaggca

SEQ ID NO: 746028 - RNA, 22 nt, Human
uuacaugguuguuggaaaugcu

SEQ ID NO: 746029 - RNA, 22 nt, Human
agggcuuguuaacauagagauu

SEQ ID NO: 746030 - RNA, 20 nt, Human
uccuuuggccuuagagcugu

SEQ ID NO: 746031 - RNA, 22 nt, Human
uaaggcagagguaccacuaggc

SEQ ID NO: 746032 - RNA, 22 nt, Human
uaagaguaucuauuaaguacuu

SEQ ID NO: 746033 - RNA, 20 nt, Human
acaugcacguguguauauau

SEQ ID NO: 746034 - RNA, 22 nt, Human
ccugaguggugcuaagcagaua

SEQ ID NO: 746035 - RNA, 22 nt, Human
uugugugacuccuagaguagag

SEQ ID NO: 746036 - RNA, 22 nt, Human
aacccuggggcugcucugccug

SEQ ID NO: 746037 - RNA, 22 nt, Human
cuccugggagucuuccuggaug

SEQ ID NO: 746038 - RNA, 22 nt, Human
cuggcuuguuuuaagaauacaa

SEQ ID NO: 746039 - RNA, 22 nt, Human
uucuucaaauagcagggaguca

SEQ ID NO: 746040 - RNA, 22 nt, Human
ucugggaacuauaucugguggu

SEQ ID NO: 746041 - RNA, 22 nt, Human
guguucugcagaccagcaucau

SEQ ID NO: 746042 - RNA, 22 nt, Human
uguauauuguucugucucuuca

SEQ ID NO: 746043 - RNA, 22 nt, Human
cuggccugagcacagcggcugc

SEQ ID NO: 746044 - RNA, 22 nt, Human
uagcuuggaauaaaaugagaau

SEQ ID NO: 746045 - RNA, 20 nt, Human
aacaaacuacaaaauuaugu

SEQ ID NO: 746046 - RNA, 22 nt, Human
ucuuuccauggccacacagucu

SEQ ID NO: 746047 - RNA, 22 nt, Human
uuauaacuuuggauaugacaag

SEQ ID NO: 746048 - RNA, 22 nt, Human
cacaauuuguuugcucuuaguc

SEQ ID NO: 746049 - RNA, 22 nt, Human
ugacagaacagguugggagcaa

SEQ ID NO: 746050 - RNA, 22 nt, Human
agccucucuuuauucccagcua

SEQ ID NO: 746051 - RNA, 22 nt, Human
auggaagguccuacagagcgca

SEQ ID NO: 746052 - RNA, 22 nt, Human
caauuucagguggauagguuuu

SEQ ID NO: 746053 - RNA, 22 nt, Human
uucaguauuucaugacuuucuu

SEQ ID NO: 746054 - RNA, 22 nt, Human
ggucagagccguuagcauucag

SEQ ID NO: 746055 - RNA, 22 nt, Human
uuuauaucuuaugucauuucaa

SEQ ID NO: 746056 - RNA, 22 nt, Human
gccugugcauagcagcggacuc

SEQ ID NO: 746057 - RNA, 22 nt, Human
uuuagggaauagaagaucugaa

SEQ ID NO: 746058 - RNA, 22 nt, Human
agcuccuguggcugaaagagga

SEQ ID NO: 746059 - RNA, 22 nt, Human
ucagugacuggguauuaaauca

SEQ ID NO: 746060 - RNA, 22 nt, Human
uucucagagugaccaagucuuu

SEQ ID NO: 746061 - RNA, 22 nt, Human
cuucagcuguggucuccaaggc

SEQ ID NO: 746062 - RNA, 23 nt, Human
guguguggaaagugcaugggccu

SEQ ID NO: 746063 - RNA, 21 nt, Human
auguggcucccuuccucagga

SEQ ID NO: 746064 - RNA, 22 nt, Human
ggaggugcagaguaggguuggu

SEQ ID NO: 746065 - RNA, 20 nt, Human
ccucaguguccuggacuggg

SEQ ID NO: 746066 - RNA, 22 nt, Human
ggcccaaggcccaggucgagcu

SEQ ID NO: 746067 - RNA, 22 nt, Human
cuggcagcguguuuaugaacau

SEQ ID NO: 746068 - RNA, 23 nt, Human
ugcccauugcaucuugguacugg

SEQ ID NO: 746069 - RNA, 22 nt, Human
aagcagaggccacagagugggc

SEQ ID NO: 746070 - RNA, 17 nt, Human
uccuguuuaucauugau

SEQ ID NO: 746071 - RNA, 23 nt, Human
ugcagcaaccuuggaagcauuuc

SEQ ID NO: 746072 - RNA, 18 nt, Human
ccuggcuuccaucuuggu

SEQ ID NO: 746073 - RNA, 22 nt, Human
aaggugaacugguaaugacaga

SEQ ID NO: 746074 - RNA, 22 nt, Human
uuucaauguaacauuuccaggc

SEQ ID NO: 746075 - RNA, 21 nt, Human
guccagagagccggcuccuga

SEQ ID NO: 746076 - RNA, 22 nt, Human
acagaggguguggaggaagacg

SEQ ID NO: 746077 - RNA, 22 nt, Human
cucuccaggcgagguccuacug

SEQ ID NO: 746078 - RNA, 22 nt, Human
ucuuaacaagcuccucagugcu

SEQ ID NO: 746079 - RNA, 22 nt, Human
ugugaaggcagagccagugaaa

SEQ ID NO: 746080 - RNA, 22 nt, Human
aggcuucuucucuauguacaag

SEQ ID NO: 746081 - RNA, 22 nt, Human
acccaggaggugacacagggcu

SEQ ID NO: 746082 - RNA, 21 nt, Human
ccagcugcuccuugagguucc

SEQ ID NO: 746083 - RNA, 22 nt, Human
uuauuugauuaguaaaccugua

SEQ ID NO: 746084 - RNA, 22 nt, Human
ggcguugcucuccccaggcuca

SEQ ID NO: 746085 - RNA, 22 nt, Human
ugauggagcaugugugcuuccu

SEQ ID NO: 746086 - RNA, 22 nt, Human
ugauuguuuccuauguacaccu

SEQ ID NO: 746087 - RNA, 22 nt, Human
aacaaugaccacacaauguacu

SEQ ID NO: 746088 - RNA, 22 nt, Human
cauuguuaccaucuuuuaccua

SEQ ID NO: 746089 - RNA, 22 nt, Human
ccucaccuuuucucugauugcu

SEQ ID NO: 746090 - RNA, 22 nt, Human
uugagucugugcccuaugcugu

SEQ ID NO: 746091 - RNA, 22 nt, Human
aucaagcauauauaaaacugca

SEQ ID NO: 746092 - RNA, 22 nt, Human
gggccugacugagagcuccuca

SEQ ID NO: 746093 - RNA, 22 nt, Human
aucccccucuuggauggcggca

SEQ ID NO: 746094 - RNA, 22 nt, Human
ugagcagggagcugggcugagc

SEQ ID NO: 746095 - RNA, 17 nt, Human
gucaauauuguugacag

SEQ ID NO: 746096 - RNA, 22 nt, Human
aacuuuuguccgaucuccugga

SEQ ID NO: 746097 - RNA, 22 nt, Human
gcagaugguggaggcaagaggc

SEQ ID NO: 746098 - RNA, 21 nt, Human
ccuggccaaucugauaggguu

SEQ ID NO: 746099 - RNA, 22 nt, Human
aacaugaaaaccuccacagcaa

SEQ ID NO: 746100 - RNA, 22 nt, Human
agugcugucccgacaacugagg

SEQ ID NO: 746101 - RNA, 22 nt, Human
uccuaacuaauuuguagcaaaa

SEQ ID NO: 746102 - RNA, 22 nt, Human
acaaagcacgagugccauggac

SEQ ID NO: 746103 - RNA, 22 nt, Human
ucuuggucuuucauccuucaac

SEQ ID NO: 746104 - RNA, 22 nt, Human
auugaacugucuuugaagaaau

SEQ ID NO: 746105 - RNA, 22 nt, Human
uuccauauguauauagcuguua

SEQ ID NO: 746106 - RNA, 22 nt, Human
uuccaagagcuuuaauuguuga

SEQ ID NO: 746107 - RNA, 22 nt, Human
gcuuggccagcagccgggaugc

SEQ ID NO: 746108 - RNA, 22 nt, Human
ggagcugaggcugaggccucac

SEQ ID NO: 746109 - RNA, 22 nt, Human
ugaugcugcugggaguggugcu

SEQ ID NO: 746110 - RNA, 22 nt, Human
ccuuucugguauuuaaccaaag

SEQ ID NO: 746111 - RNA, 22 nt, Human
auguacaaccugcaugacaguc

SEQ ID NO: 746112 - RNA, 22 nt, Human
uugaccacugaaugguucugaa

SEQ ID NO: 746113 - RNA, 22 nt, Human
uauuacaguucgaguuucuagg

SEQ ID NO: 746114 - RNA, 22 nt, Human
acaaugaaaaaauuuacugugg

SEQ ID NO: 746115 - RNA, 22 nt, Human
uaaagugccucagguccugggu

SEQ ID NO: 746116 - RNA, 22 nt, Human
aaacuuggccgcauccaccggg

SEQ ID NO: 746117 - RNA, 22 nt, Human
agcccugcccugccauguggca

SEQ ID NO: 746118 - RNA, 22 nt, Human
ggcaagagguccaagaggucuc

SEQ ID NO: 746119 - RNA, 22 nt, Human
gagacagaguuucacucuuguu

SEQ ID NO: 746120 - RNA, 22 nt, Human
acugaagucucuuuuguucucu

SEQ ID NO: 746121 - RNA, 20 nt, Human
cuaggaacuauggucuggcu

SEQ ID NO: 746122 - RNA, 22 nt, Human
acuuccuuuugggaaacuguuu

SEQ ID NO: 746123 - RNA, 22 nt, Human
uguuacagucauuguuuucuga

SEQ ID NO: 746124 - RNA, 22 nt, Human
aaaccuggacuuguaaugauaa

SEQ ID NO: 746125 - RNA, 22 nt, Human
gacaggacuucacuguguugcc

SEQ ID NO: 746126 - RNA, 22 nt, Human
gcuggccugcaaagcccggcug

SEQ ID NO: 746127 - RNA, 22 nt, Human
caaagugagagaauggcagaaa

SEQ ID NO: 746128 - RNA, 22 nt, Human
agcaaucagcuucuuuguguuu

SEQ ID NO: 746129 - RNA, 22 nt, Human
gcaguggccacauggaggagga

SEQ ID NO: 746130 - RNA, 22 nt, Human
ggggucggggcauagccacuua

SEQ ID NO: 746131 - RNA, 22 nt, Human
uccuccagugguacuggccaau

SEQ ID NO: 746132 - RNA, 22 nt, Human
ucccugggcacaaucugcuggc

SEQ ID NO: 746133 - RNA, 22 nt, Human
aaggucuguauuagaguuucau

SEQ ID NO: 746134 - RNA, 22 nt, Human
uuuaugcagcacuuuacauuug

SEQ ID NO: 746135 - RNA, 22 nt, Human
gccuggcugcuagccagaggca

SEQ ID NO: 746136 - RNA, 22 nt, Human
agcauucaaguaauucacuugg

SEQ ID NO: 746137 - RNA, 20 nt, Human
uggaaggcaucugcauuauu

SEQ ID NO: 746138 - RNA, 22 nt, Human
agaugcagaaaaacuaagugau

SEQ ID NO: 746139 - RNA, 22 nt, Human
guagaucaugagaauguuuuug

SEQ ID NO: 746140 - RNA, 22 nt, Human
ugugcgugggcacacacauaug

SEQ ID NO: 746141 - RNA, 22 nt, Human
ggcagauguugcagugagcaga

SEQ ID NO: 746142 - RNA, 22 nt, Human
acguaguguguuguggaaagag

SEQ ID NO: 746143 - RNA, 22 nt, Human
uaugaguacugugaacgagaau

SEQ ID NO: 746144 - RNA, 22 nt, Human
aggcugagagcaacgugucaga

SEQ ID NO: 746145 - RNA, 22 nt, Human
aggggaugccugaggaucugua

SEQ ID NO: 746146 - RNA, 22 nt, Human
guggaauugcuggauaauauca

SEQ ID NO: 746147 - RNA, 22 nt, Human
uuuuauucaaauaguucacacu

SEQ ID NO: 746148 - RNA, 22 nt, Human
aggcuggguaccugucauaugc

SEQ ID NO: 746149 - RNA, 22 nt, Human
uggaagcgagacagagaucucc

SEQ ID NO: 746150 - RNA, 22 nt, Human
gcucagagauggggaaugaaaa

SEQ ID NO: 746151 - RNA, 22 nt, Human
gcucccaggaugaggagccagg

SEQ ID NO: 746152 - RNA, 18 nt, Human
gguggcaggucagaugcc

SEQ ID NO: 746153 - RNA, 22 nt, Human
ucucugugggcuuuggacuuga

SEQ ID NO: 746154 - RNA, 22 nt, Human
cuuaagauuugagauaccuaau

SEQ ID NO: 746155 - RNA, 22 nt, Human
auuuggaacaaauauuaguaaa

SEQ ID NO: 746156 - RNA, 22 nt, Human
aggccacaguacuuugcagacc

SEQ ID NO: 746157 - RNA, 22 nt, Human
auauucacuccuggugagacua

SEQ ID NO: 746158 - RNA, 22 nt, Human
cagaggccuugucuucuuugcu

SEQ ID NO: 746159 - RNA, 19 nt, Human
ccugugcuaggagcugacc

SEQ ID NO: 746160 - RNA, 22 nt, Human
aacauugaguucuacuuccauu

SEQ ID NO: 746161 - RNA, 19 nt, Human
uggaggagaggaaaaguca

SEQ ID NO: 746162 - RNA, 22 nt, Human
gcacaguggguggucauguaca

SEQ ID NO: 746163 - RNA, 22 nt, Human
uuugucugccuugcuggacugu

SEQ ID NO: 746164 - RNA, 22 nt, Human
gagacuuuuuaaucacuaggaa

SEQ ID NO: 746165 - RNA, 19 nt, Human
ugcagggcugcgccugggg

SEQ ID NO: 746166 - RNA, 22 nt, Human
augauuuuuucuaacacagucg

SEQ ID NO: 746167 - RNA, 22 nt, Human
uuccugaggcucaucggagucg

SEQ ID NO: 746168 - RNA, 22 nt, Human
aaugggaggauuuucucucuug

SEQ ID NO: 746169 - RNA, 20 nt, Human
aauacuaaacacaaagcagu

SEQ ID NO: 746170 - RNA, 22 nt, Human
uuucugaacuugguacuggagc

SEQ ID NO: 746171 - RNA, 22 nt, Human
cugcuaaaccucucugagagcu

SEQ ID NO: 746172 - RNA, 22 nt, Human
aaaugucagaagcuuuacuucu

SEQ ID NO: 746173 - RNA, 22 nt, Human
aggaaguuggcauuuuguuuca

SEQ ID NO: 746174 - RNA, 22 nt, Human
aguuuugaaaugaaauguaguu

SEQ ID NO: 746175 - RNA, 22 nt, Human
cacagcugcacagaggaggugc

SEQ ID NO: 746176 - RNA, 22 nt, Human
cuaauuuaaugaaugagucuua

SEQ ID NO: 746177 - RNA, 17 nt, Human
ugggugguagggagagg

SEQ ID NO: 746178 - RNA, 22 nt, Human
acauaugcgaucauaggaugca

SEQ ID NO: 746179 - RNA, 22 nt, Human
ucuuagaaaaaugguauguuuu

SEQ ID NO: 746180 - RNA, 22 nt, Human
uccugggagagugggacuguau

SEQ ID NO: 746181 - RNA, 22 nt, Human
agugugucuuauccugggagaa

SEQ ID NO: 746182 - RNA, 22 nt, Human
agcaacugggcucauuuuuuaa

SEQ ID NO: 746183 - RNA, 22 nt, Human
aagcagauauugugggaguggg

SEQ ID NO: 746184 - RNA, 22 nt, Human
augaucucauucuuucaaaggg

SEQ ID NO: 746185 - RNA, 20 nt, Human
gaaaccagaacgcagcccug

SEQ ID NO: 746186 - RNA, 22 nt, Human
cugggcucuguguuucaguuuc

SEQ ID NO: 746187 - RNA, 22 nt, Human
guaagggauuugaacauagguu

SEQ ID NO: 746188 - RNA, 23 nt, Human
uggugccucagaagcagugggcu

SEQ ID NO: 746189 - RNA, 22 nt, Human
uccccucuggaggcugcagggg

SEQ ID NO: 746190 - RNA, 22 nt, Human
ggguaguguggucucugggcug

SEQ ID NO: 746191 - RNA, 22 nt, Human
aaggggaagagaccgcagaguc

SEQ ID NO: 746192 - RNA, 22 nt, Human
ccuuuucuugccacugacucgg

SEQ ID NO: 746193 - RNA, 22 nt, Human
gauggcuuccuucucacugugu

SEQ ID NO: 746194 - RNA, 22 nt, Human
ugcuccagcgcugccaccaguu

SEQ ID NO: 746195 - RNA, 22 nt, Human
augcaagauguauagaagacuu

SEQ ID NO: 746196 - RNA, 22 nt, Human
aaagugcugagacagacuggga

SEQ ID NO: 746197 - RNA, 22 nt, Human
gccuuccaggcagggggagcag

SEQ ID NO: 746198 - RNA, 22 nt, Human
cccagguccccaccugucugcu

SEQ ID NO: 746199 - RNA, 22 nt, Human
uagaggugagccaucaaggggc

SEQ ID NO: 746200 - RNA, 22 nt, Human
acuuuauuuccuauugcaucca

SEQ ID NO: 746201 - RNA, 22 nt, Human
ugagcagcuuguuccgaguguu

SEQ ID NO: 746202 - RNA, 22 nt, Human
aucugcuggcaucucuagccca

SEQ ID NO: 746203 - RNA, 22 nt, Human
aaagacacaaauguagaccaaa

SEQ ID NO: 746204 - RNA, 22 nt, Human
aguggcuggagccccaggcugg

SEQ ID NO: 746205 - RNA, 22 nt, Human
ccagagguggaagauuguuuug

SEQ ID NO: 746206 - RNA, 22 nt, Human
agucauuucuguagucauguuu

SEQ ID NO: 746207 - RNA, 22 nt, Human
ugggcuguccagcaccugggcu

SEQ ID NO: 746208 - RNA, 22 nt, Human
uggcuccagguugaacuuuggg

SEQ ID NO: 746209 - RNA, 22 nt, Human
acuagaaaauuccuagaaacua

SEQ ID NO: 746210 - RNA, 22 nt, Human
ccucaaagcgguaugcagacgg

SEQ ID NO: 746211 - RNA, 22 nt, Human
ucuauuuuuauaguugaagugc

SEQ ID NO: 746212 - RNA, 22 nt, Human
ugauguuuaauacuaugcuuuu

SEQ ID NO: 746213 - RNA, 22 nt, Human
uucagcaugaaaggauuugagu

SEQ ID NO: 746214 - RNA, 22 nt, Human
ccagguagccaaggggucuggg

SEQ ID NO: 746215 - RNA, 21 nt, Human
uucugcuccagcuccucuggg

SEQ ID NO: 746216 - RNA, 22 nt, Human
cacagcagaaaguguaggagga

SEQ ID NO: 746217 - RNA, 22 nt, Human
aagucauugguagcuugauagg

SEQ ID NO: 746218 - RNA, 22 nt, Human
guguuaaacauguucacagcau

SEQ ID NO: 746219 - RNA, 22 nt, Human
ucucuuuuauguacacccugac

SEQ ID NO: 746220 - RNA, 19 nt, Human
cugaggugcaguaagaggc

SEQ ID NO: 746221 - RNA, 22 nt, Human
cccugcugucaggugcugggag

SEQ ID NO: 746222 - RNA, 22 nt, Human
aggcuucuuagauuggcuggag

SEQ ID NO: 746223 - RNA, 22 nt, Human
uuuacuacuucauugacuuacg

SEQ ID NO: 746224 - RNA, 22 nt, Human
acagaacuucaguaguauuccc

SEQ ID NO: 746225 - RNA, 22 nt, Human
guccugguagcuggcuugguca

SEQ ID NO: 746226 - RNA, 22 nt, Human
acaaauuuggugagaguaaaua

SEQ ID NO: 746227 - RNA, 22 nt, Human
uuugaagucagacacugcuuug

SEQ ID NO: 746228 - RNA, 22 nt, Human
acugccuugaaagauuguugag

SEQ ID NO: 746229 - RNA, 21 nt, Human
ugucagaaauaagcaugugau

SEQ ID NO: 746230 - RNA, 22 nt, Human
guuuuccacuggauuguuugga

SEQ ID NO: 746231 - RNA, 20 nt, Human
cugugccuaaaccuccgggu

SEQ ID NO: 746232 - RNA, 22 nt, Human
ugauauuuaagcaaaaauaugg

SEQ ID NO: 746233 - RNA, 22 nt, Human
ccuuggugcucugcugggaugg

SEQ ID NO: 746234 - RNA, 21 nt, Human
cacauuugaaccucacagcaa

SEQ ID NO: 746235 - RNA, 22 nt, Human
ugccugaauucaauuccuggcu

SEQ ID NO: 746236 - RNA, 22 nt, Human
augucucugccccagagagcuu

SEQ ID NO: 746237 - RNA, 22 nt, Human
uccugaggcacaauccuagaau

SEQ ID NO: 746238 - RNA, 22 nt, Human
uuacaauaccacaucaccucau

SEQ ID NO: 746239 - RNA, 22 nt, Human
aaaugucuguuagucauaucau

SEQ ID NO: 746240 - RNA, 21 nt, Human
gccauuguuuucuaccuggag

SEQ ID NO: 746241 - RNA, 22 nt, Human
aggccaggacacuuaaguaaga

SEQ ID NO: 746242 - RNA, 22 nt, Human
ucguguguauucccucuccuuc

SEQ ID NO: 746243 - RNA, 22 nt, Human
guguggcuguuuagugacuuuc

SEQ ID NO: 746244 - RNA, 22 nt, Human
ggacucagcagccaggaguggc

SEQ ID NO: 746245 - RNA, 22 nt, Human
uuauugaaauggaagcuauaac

SEQ ID NO: 746246 - RNA, 22 nt, Human
agagggcagcagcaacaacucu

SEQ ID NO: 746247 - RNA, 22 nt, Human
aaacacugaagaccuaucuggu

SEQ ID NO: 746248 - RNA, 22 nt, Human
auuugccaugaagaguguuuga

SEQ ID NO: 746249 - RNA, 20 nt, Human
cuuccaccagggccgcugau

SEQ ID NO: 746250 - RNA, 22 nt, Human
ugcuuuauguuaucagaagggu

SEQ ID NO: 746251 - RNA, 22 nt, Human
gugcugaagugaaauucaucaa

SEQ ID NO: 746252 - RNA, 22 nt, Human
cagugugggugaaauacaaagu

SEQ ID NO: 746253 - RNA, 18 nt, Human
ugggcugccuggccucug

SEQ ID NO: 746254 - RNA, 22 nt, Human
ucccacccccuccaaggaggaa

SEQ ID NO: 746255 - RNA, 22 nt, Human
aggcuccagccaaugggucugu

SEQ ID NO: 746256 - RNA, 22 nt, Human
gaaucuuaaaucggaaucuuaa

SEQ ID NO: 746257 - RNA, 22 nt, Human
uuuaacagaugcuaugucuacc

SEQ ID NO: 746258 - RNA, 22 nt, Human
gccaggaguucagaugcauguu

SEQ ID NO: 746259 - RNA, 22 nt, Human
ucugggcuuggguagaaaucac

SEQ ID NO: 746260 - RNA, 22 nt, Human
augcuuggcagaguucuuuuuc

SEQ ID NO: 746261 - RNA, 22 nt, Human
acaggcaguugagguuugugug

SEQ ID NO: 746262 - RNA, 22 nt, Human
gaggagacauauuuuugaagca

SEQ ID NO: 746263 - RNA, 22 nt, Human
auuuccuucaguguuuaauacu

SEQ ID NO: 746264 - RNA, 22 nt, Human
ucuuucccuguguuagccugua

SEQ ID NO: 746265 - RNA, 22 nt, Human
aagggcccggcugugggcagag

SEQ ID NO: 746266 - RNA, 22 nt, Human
aagaacaguguccugggacucg

SEQ ID NO: 746267 - RNA, 22 nt, Human
gggcuggaccgcgaccccugag

SEQ ID NO: 746268 - RNA, 22 nt, Human
caggacagcugggccaccacca

SEQ ID NO: 746269 - RNA, 22 nt, Human
guccagcugaucuugacccagc

SEQ ID NO: 746270 - RNA, 22 nt, Human
uguaauuuuacgugacacaguu

SEQ ID NO: 746271 - RNA, 22 nt, Human
ggacaugaagcaaaaugggagg

SEQ ID NO: 746272 - RNA, 22 nt, Human
ugauucugcuuauggguggauu

SEQ ID NO: 746273 - RNA, 18 nt, Human
uauauuucacacauauuc

SEQ ID NO: 746274 - RNA, 22 nt, Human
gcugccugucccaggaugagga

SEQ ID NO: 746275 - RNA, 22 nt, Human
ccugggcaacauagugagaccc

SEQ ID NO: 746276 - RNA, 22 nt, Human
uguggcuggauugauuuuaccu

SEQ ID NO: 746277 - RNA, 22 nt, Human
cugguuggaagugcagacucuc

SEQ ID NO: 746278 - RNA, 20 nt, Human
guaaagcauucuuggcauac

SEQ ID NO: 746279 - RNA, 22 nt, Human
gcugccuguugaagggucugug

SEQ ID NO: 746280 - RNA, 22 nt, Human
cccugccagaugugcuucaguu

SEQ ID NO: 746281 - RNA, 22 nt, Human
ugcccucuaggcuacaguucca

SEQ ID NO: 746282 - RNA, 22 nt, Human
auuagaauuaugcuugcuaaug

SEQ ID NO: 746283 - RNA, 22 nt, Human
cuucugugaccaccagcagccc

SEQ ID NO: 746284 - RNA, 20 nt, Human
ccuagggcaagugggugggc

SEQ ID NO: 746285 - RNA, 18 nt, Human
agaggggagguaagucug

SEQ ID NO: 746286 - RNA, 23 nt, Human
agagggagauguuuuucucaaga

SEQ ID NO: 746287 - RNA, 22 nt, Human
gaggggaguguccuccgggccc

SEQ ID NO: 746288 - RNA, 22 nt, Human
gggugggagucuggcccucaaa

SEQ ID NO: 746289 - RNA, 22 nt, Human
gggggagcuaguccagcugagg

SEQ ID NO: 746290 - RNA, 22 nt, Human
cucauugcagcugcauuacugu

SEQ ID NO: 746291 - RNA, 22 nt, Human
acaguaaauaaugcauguugau

SEQ ID NO: 746292 - RNA, 22 nt, Human
acuguaauuaucugaacgugca

SEQ ID NO: 746293 - RNA, 22 nt, Human
ccagcucucuguccuccccaca

SEQ ID NO: 746294 - RNA, 22 nt, Human
ucagcaggcccauccuccaggc

SEQ ID NO: 746295 - RNA, 22 nt, Human
uagagcuuggggauuuaguagu

SEQ ID NO: 746296 - RNA, 22 nt, Human
auuguacagcucugagaggggg

SEQ ID NO: 746297 - RNA, 22 nt, Human
guggccucaugucuauaaagag

SEQ ID NO: 746298 - RNA, 22 nt, Human
uggacucagaaguguucuuuua

SEQ ID NO: 746299 - RNA, 22 nt, Human
agaucacugguuacuuaaugaa

SEQ ID NO: 746300 - RNA, 22 nt, Human
aagcagagcaagcguauuuauu

SEQ ID NO: 746301 - RNA, 22 nt, Human
ugcuucuuacucauaugcugau

SEQ ID NO: 746302 - RNA, 19 nt, Human
guuuugcaggcagagggga

SEQ ID NO: 746303 - RNA, 22 nt, Human
ugccuguguaugugcaugcaca

SEQ ID NO: 746304 - RNA, 20 nt, Human
aauaaaagaagccuucaccc

SEQ ID NO: 746305 - RNA, 22 nt, Human
ugugaagguuuuuaugggauau

SEQ ID NO: 746306 - RNA, 22 nt, Human
ggggaagaaugcucucuagaga

SEQ ID NO: 746307 - RNA, 22 nt, Human
gugccuggcacacagaaggcaa

SEQ ID NO: 746308 - RNA, 22 nt, Human
ccuuuugaagguguuguuaagu

SEQ ID NO: 746309 - RNA, 22 nt, Human
caguagcauguaauaaagacag

SEQ ID NO: 746310 - RNA, 22 nt, Human
acuggcugcguuccugugagac

SEQ ID NO: 746311 - RNA, 22 nt, Human
caaaccuguuagaggucaucgu

SEQ ID NO: 746312 - RNA, 22 nt, Human
aaagaggaaccaagagcacgug

SEQ ID NO: 746313 - RNA, 22 nt, Human
cuucuuguaucugccgccgagc

SEQ ID NO: 746314 - RNA, 22 nt, Human
acuggcuuugagggaauagcua

SEQ ID NO: 746315 - RNA, 22 nt, Human
gauuacauucuccuuguauuag

SEQ ID NO: 746316 - RNA, 22 nt, Human
cagcuuugauucuuucugccau

SEQ ID NO: 746317 - RNA, 22 nt, Human
auccaggcuuaaugggagccac

SEQ ID NO: 746318 - RNA, 19 nt, Human
ggcagccugcacgggcugc

SEQ ID NO: 746319 - RNA, 22 nt, Human
ucugagccccuagaacugagcg

SEQ ID NO: 746320 - RNA, 22 nt, Human
auucugcacauccaagaacagg

SEQ ID NO: 746321 - RNA, 22 nt, Human
cagcucagucuggagagaugca

SEQ ID NO: 746322 - RNA, 22 nt, Human
acccagagcagagcuuggcuuc

SEQ ID NO: 746323 - RNA, 22 nt, Human
aauuauggugugugguuaaggg

SEQ ID NO: 746324 - RNA, 22 nt, Human
auggcauugaguaaagucagua

SEQ ID NO: 746325 - RNA, 22 nt, Human
ucucugaguaagugacaguuca

SEQ ID NO: 746326 - RNA, 22 nt, Human
caaggaaaacagaugaucaaca

SEQ ID NO: 746327 - RNA, 22 nt, Human
uggugcuguggaggggcagaag

SEQ ID NO: 746328 - RNA, 22 nt, Human
agucugugcuguuggugaggau

SEQ ID NO: 746329 - RNA, 22 nt, Human
acaggcucucagccaguuggca

SEQ ID NO: 746330 - RNA, 22 nt, Human
cacaguuugcauaggaaaaaca

SEQ ID NO: 746331 - RNA, 22 nt, Human
gagcuguccuaccaggaguccu

SEQ ID NO: 746332 - RNA, 22 nt, Human
uacaacuuacuugaauggcuuu

SEQ ID NO: 746333 - RNA, 22 nt, Human
cccaguccagaccaugaccuca

SEQ ID NO: 746334 - RNA, 22 nt, Human
ugugacguuccugcuggcgacc

SEQ ID NO: 746335 - RNA, 22 nt, Human
uaggcuccaagagcgaacucag

SEQ ID NO: 746336 - RNA, 22 nt, Human
aguuuauguaaaauuaguaaug

SEQ ID NO: 746337 - RNA, 22 nt, Human
uagcagggauacaaggucgccu

SEQ ID NO: 746338 - RNA, 22 nt, Human
uaacuucugcacagaaaauuug

SEQ ID NO: 746339 - RNA, 19 nt, Human
ugcaucuugcaugggugag

SEQ ID NO: 746340 - RNA, 22 nt, Human
cugggcaguuuacauuccuacc

SEQ ID NO: 746341 - RNA, 18 nt, Human
uggcagccagcugcuccu

SEQ ID NO: 746342 - RNA, 22 nt, Human
ugcacacacgcggcacaucugu

SEQ ID NO: 746343 - RNA, 22 nt, Human
ucuggcuuucucagcauggcau

SEQ ID NO: 746344 - RNA, 22 nt, Human
uucuaguuaauguagcaucuug

SEQ ID NO: 746345 - RNA, 20 nt, Human
agaaacauuucuugagaacu

SEQ ID NO: 746346 - RNA, 22 nt, Human
auagcacuuauuguaugcugag

SEQ ID NO: 746347 - RNA, 23 nt, Human
cugugugugccgaggguggccac

SEQ ID NO: 746348 - RNA, 22 nt, Human
ugcugcccacuguauuucucca

SEQ ID NO: 746349 - RNA, 22 nt, Human
aauguuuuaaaagagauugaga

SEQ ID NO: 746350 - RNA, 22 nt, Human
cacauacauacguauguauaca

SEQ ID NO: 746351 - RNA, 22 nt, Human
ucucuggccccauggcugagcu

SEQ ID NO: 746352 - RNA, 22 nt, Human
cugugaguucauugugccaccu

SEQ ID NO: 746353 - RNA, 22 nt, Human
uuccacucuguccccuguggga

SEQ ID NO: 746354 - RNA, 18 nt, Human
agcuccaucugucagcau

SEQ ID NO: 746355 - RNA, 22 nt, Human
ggguggcaucucucugagcugu

SEQ ID NO: 746356 - RNA, 22 nt, Human
uugcuucccccuguucuaguuc

SEQ ID NO: 746357 - RNA, 20 nt, Human
agauggugggcuggaacacc

SEQ ID NO: 746358 - RNA, 21 nt, Human
ucauggaaguaacaaacauau

SEQ ID NO: 746359 - RNA, 22 nt, Human
ccagaggugcucuuuggaagug

SEQ ID NO: 746360 - RNA, 22 nt, Human
ccagccuucugagcugccugga

SEQ ID NO: 746361 - RNA, 22 nt, Human
cauagcaaggugcuuuccacau

SEQ ID NO: 746362 - RNA, 22 nt, Human
caggcccuccugugaucugccu

SEQ ID NO: 746363 - RNA, 19 nt, Human
gagcaacauauguaaacuc

SEQ ID NO: 746364 - RNA, 22 nt, Human
uugcuugcccugcagcauacuu

SEQ ID NO: 746365 - RNA, 22 nt, Human
gggcacagcugcuacccagugc

SEQ ID NO: 746366 - RNA, 22 nt, Human
ggaagcuggcauauguaauccu

SEQ ID NO: 746367 - RNA, 22 nt, Human
uagcaggguaaauguagaugga

SEQ ID NO: 746368 - RNA, 22 nt, Human
uguggccuccccacuucugggg

SEQ ID NO: 746369 - RNA, 22 nt, Human
agggucuguuguuuguucugga

SEQ ID NO: 746370 - RNA, 18 nt, Human
auguacauuugcuaaagc

SEQ ID NO: 746371 - RNA, 22 nt, Human
uucugagauuguuaggcacuaa

SEQ ID NO: 746372 - RNA, 22 nt, Human
aauggccuuugagaugaaaggg

SEQ ID NO: 746373 - RNA, 22 nt, Human
aagcagagguagggugugcagu

SEQ ID NO: 746374 - RNA, 22 nt, Human
gcauggcauuaacaagauggaa

SEQ ID NO: 746375 - RNA, 22 nt, Human
cagcuaguacaaugggagagca

SEQ ID NO: 746376 - RNA, 22 nt, Human
acuuuucucccuccugccuuca

SEQ ID NO: 746377 - RNA, 22 nt, Human
ggaucuguuuugccucugaggg

SEQ ID NO: 746378 - RNA, 22 nt, Human
cccugaggauagggcaggaccc

SEQ ID NO: 746379 - RNA, 22 nt, Human
aucagugcugagagacuaucaa

SEQ ID NO: 746380 - RNA, 22 nt, Human
ccaggccagagugcaguggcac

SEQ ID NO: 746381 - RNA, 22 nt, Human
gauccuguuauaauuuggaugu

SEQ ID NO: 746382 - RNA, 22 nt, Human
gcacucaggacucucaucagua

SEQ ID NO: 746383 - RNA, 22 nt, Human
gcuguggcugaccaccaggggg

SEQ ID NO: 746384 - RNA, 22 nt, Human
cccugucuguaccgugaugagc

SEQ ID NO: 746385 - RNA, 22 nt, Human
ucuggagcgaggucccugucug

SEQ ID NO: 746386 - RNA, 22 nt, Human
augaaugauuuuauguaaauga

SEQ ID NO: 746387 - RNA, 22 nt, Human
uauggaauggcuauuuucuagg

SEQ ID NO: 746388 - RNA, 22 nt, Human
cugguccuugcuacccagcaag

SEQ ID NO: 746389 - RNA, 22 nt, Human
cccagguagugagaaauggagg

SEQ ID NO: 746390 - RNA, 22 nt, Human
gccagcugcaucuccugggcug

SEQ ID NO: 746391 - RNA, 22 nt, Human
ggaggcacaccucagacuggga

SEQ ID NO: 746392 - RNA, 22 nt, Human
ucucaucuagacucugcccuug

SEQ ID NO: 746393 - RNA, 21 nt, Human
ucagagagucacagugaacug

SEQ ID NO: 746394 - RNA, 22 nt, Human
uuucucaguaauguccuggaau

SEQ ID NO: 746395 - RNA, 22 nt, Human
ucaauagauuagguauuagauu

SEQ ID NO: 746396 - RNA, 22 nt, Human
uagcacauacauaauagauaga

SEQ ID NO: 746397 - RNA, 23 nt, Human
auauaaacaccagauagauugua

SEQ ID NO: 746398 - RNA, 22 nt, Human
ucagugaaguaauggugagaga

SEQ ID NO: 746399 - RNA, 22 nt, Human
aucaguuuggaacauucaggcc

SEQ ID NO: 746400 - RNA, 22 nt, Human
guuucacagauggggagacacg

SEQ ID NO: 746401 - RNA, 22 nt, Human
ggccacacagaugacugcuuuc

SEQ ID NO: 746402 - RNA, 22 nt, Human
aggcuugggucagaaggcuugu

SEQ ID NO: 746403 - RNA, 22 nt, Human
gcagaaagcuuagaggguuugc

SEQ ID NO: 746404 - RNA, 22 nt, Human
cuggcagcaguuaugaaacaau

SEQ ID NO: 746405 - RNA, 22 nt, Human
agacagaccauggcuauucaga

SEQ ID NO: 746406 - RNA, 22 nt, Human
caaagaaucacucaucuuuagc

SEQ ID NO: 746407 - RNA, 21 nt, Human
ugcuucucuagaucaacuacu

SEQ ID NO: 746408 - RNA, 22 nt, Human
uugcuguaccaaagauuccuga

SEQ ID NO: 746409 - RNA, 22 nt, Human
caggccugugacaccgugucug

SEQ ID NO: 746410 - RNA, 22 nt, Human
uaaguucaccaguuguaauaag

SEQ ID NO: 746411 - RNA, 22 nt, Human
acaguauaaacuccuaaaagcc

SEQ ID NO: 746412 - RNA, 22 nt, Human
cugcuuugggcagcuuuguggc

SEQ ID NO: 746413 - RNA, 22 nt, Human
cccacagguccccaugaacucg

SEQ ID NO: 746414 - RNA, 22 nt, Human
gcagccagcccuagucccacuu

SEQ ID NO: 746415 - RNA, 23 nt, Human
cagaggugucagugcccaguguc

SEQ ID NO: 746416 - RNA, 22 nt, Human
guuucuuaaguuacaaaaucuu

SEQ ID NO: 746417 - RNA, 22 nt, Human
ucuuugcacugugcaagcagaa

SEQ ID NO: 746418 - RNA, 22 nt, Human
augugaacucuguacucucuga

SEQ ID NO: 746419 - RNA, 22 nt, Human
aggagcagaauuuaaugugcag

SEQ ID NO: 746420 - RNA, 22 nt, Human
ggacugggagaauggaggcaag

SEQ ID NO: 746421 - RNA, 22 nt, Human
gcaggcguguuucacgugccag

SEQ ID NO: 746422 - RNA, 22 nt, Human
uuuucuaauuuaguuacccucc

SEQ ID NO: 746423 - RNA, 22 nt, Human
acccagagcacugggugugggc

SEQ ID NO: 746424 - RNA, 22 nt, Human
caagauggagaagcagcaaggg

SEQ ID NO: 746425 - RNA, 22 nt, Human
ggucuggggcaggcaucugaca

SEQ ID NO: 746426 - RNA, 22 nt, Human
guaaauaacugguaauuggggu

SEQ ID NO: 746427 - RNA, 19 nt, Human
uccuggugcuugacacuga

SEQ ID NO: 746428 - RNA, 21 nt, Human
agagucugcauuucugacaag

SEQ ID NO: 746429 - RNA, 22 nt, Human
ggcugccugggagcccuccucu

SEQ ID NO: 746430 - RNA, 22 nt, Human
cuccuuccugcagaucugagau

SEQ ID NO: 746431 - RNA, 22 nt, Human
uuuagaguaaaaacugugaccu

SEQ ID NO: 746432 - RNA, 22 nt, Human
ucacaguuauagucuguagaau

SEQ ID NO: 746433 - RNA, 20 nt, Human
aaugucuugagacauuucag

SEQ ID NO: 746434 - RNA, 22 nt, Human
uccagggccugagguugaagug

SEQ ID NO: 746435 - RNA, 17 nt, Human
cauguguaugugggagu

SEQ ID NO: 746436 - RNA, 22 nt, Human
uuugguuuauuaaauuguaggc

SEQ ID NO: 746437 - RNA, 22 nt, Human
gaguccugcccuuguguagucc

SEQ ID NO: 746438 - RNA, 21 nt, Human
cacagagauauuggugagccu

SEQ ID NO: 746439 - RNA, 22 nt, Human
aggacacacuucugaggucuuu

SEQ ID NO: 746440 - RNA, 20 nt, Human
augugagggguugaaguggg

SEQ ID NO: 746441 - RNA, 22 nt, Human
uaaggcagauguggaaucaauu

SEQ ID NO: 746442 - RNA, 22 nt, Human
uuucaaagucaauaucauuacc

SEQ ID NO: 746443 - RNA, 22 nt, Human
cuuuugcagccauuauugcugc

SEQ ID NO: 746444 - RNA, 22 nt, Human
gaaguuuagaguguuguaauuu

SEQ ID NO: 746445 - RNA, 22 nt, Human
ugaguauccuauaugguguaag

SEQ ID NO: 746446 - RNA, 22 nt, Human
cagagagagcaggaaaccuccg

SEQ ID NO: 746447 - RNA, 22 nt, Human
aaggagaaggguaaucaacaca

SEQ ID NO: 746448 - RNA, 20 nt, Human
aagcuggguaggagaggagc

SEQ ID NO: 746449 - RNA, 22 nt, Human
gguuuucucccccucuucucag

SEQ ID NO: 746450 - RNA, 22 nt, Human
acagugugguuugagcacuggg

SEQ ID NO: 746451 - RNA, 22 nt, Human
ucaauacauguguguggauggu

SEQ ID NO: 746452 - RNA, 22 nt, Human
gaggcccaguccugcaagcacg

SEQ ID NO: 746453 - RNA, 22 nt, Human
acccugggagggagaaaucaga

SEQ ID NO: 746454 - RNA, 20 nt, Human
guggcccuuaaagagggaag

SEQ ID NO: 746455 - RNA, 22 nt, Human
ucagcuccucagagccucaguu

SEQ ID NO: 746456 - RNA, 22 nt, Human
ugcacacacaugaaguagcaug

SEQ ID NO: 746457 - RNA, 22 nt, Human
gcagcuuucuugcccuaaucuu

SEQ ID NO: 746458 - RNA, 22 nt, Human
aggaagcuagagccaccggacu

SEQ ID NO: 746459 - RNA, 22 nt, Human
acuccuggggauccauuccuuu

SEQ ID NO: 746460 - RNA, 22 nt, Human
ugggccaguagcuacucgcaag

SEQ ID NO: 746461 - RNA, 22 nt, Human
cagcugaguuuccaagucugcc

SEQ ID NO: 746462 - RNA, 22 nt, Human
uacacuauuuuacugauacaaa

SEQ ID NO: 746463 - RNA, 22 nt, Human
aguaaaauuucugcugaggaga

SEQ ID NO: 746464 - RNA, 22 nt, Human
ccaaucuugcuguccacuuggu

SEQ ID NO: 746465 - RNA, 22 nt, Human
cuauuuuucuguacccuaauuu

SEQ ID NO: 746466 - RNA, 22 nt, Human
aaucuacauagagaucaaauga

SEQ ID NO: 746467 - RNA, 22 nt, Human
ucaaaccaccuuguuacugggg

SEQ ID NO: 746468 - RNA, 22 nt, Human
gacuuuauuuccuuauuuguga

SEQ ID NO: 746469 - RNA, 22 nt, Human
uaugcaguguaugcacugagau

SEQ ID NO: 746470 - RNA, 22 nt, Human
guucacagcuucuuaggucaua

SEQ ID NO: 746471 - RNA, 22 nt, Human
caucuguucuauccacguugcu

SEQ ID NO: 746472 - RNA, 22 nt, Human
auggagggaaaaguggagagcc

SEQ ID NO: 746473 - RNA, 22 nt, Human
aagcccuggcucagcucaccag

SEQ ID NO: 746474 - RNA, 22 nt, Human
uggcugugauuugcacgagaug

SEQ ID NO: 746475 - RNA, 22 nt, Human
cucugcccacgucuugcccaga

SEQ ID NO: 746476 - RNA, 22 nt, Human
acucugccuuaguccuggggcu

SEQ ID NO: 746477 - RNA, 22 nt, Human
ucccugggcggacauucuccca

SEQ ID NO: 746478 - RNA, 22 nt, Human
gggcagucacagugcuggagca

SEQ ID NO: 746479 - RNA, 22 nt, Human
gcugguccacucccuggaggcu

SEQ ID NO: 746480 - RNA, 22 nt, Human
uaaggcagaaauaugagcaggg

SEQ ID NO: 746481 - RNA, 22 nt, Human
agcagagucuucaagggcaggc

SEQ ID NO: 746482 - RNA, 22 nt, Human
aggcauuuccuaugggcagaga

SEQ ID NO: 746483 - RNA, 22 nt, Human
aaggcuggguuugggaugugau

SEQ ID NO: 746484 - RNA, 22 nt, Human
gacauccaucauuuccuguuga

SEQ ID NO: 746485 - RNA, 22 nt, Human
ucuacagccauuuugagcagug

SEQ ID NO: 746486 - RNA, 22 nt, Human
uaggucuggcagaagaaaaaug

SEQ ID NO: 746487 - RNA, 22 nt, Human
uugcauagugcugagguucggg

SEQ ID NO: 746488 - RNA, 20 nt, Human
agcccuguuuccuggagaga

SEQ ID NO: 746489 - RNA, 22 nt, Human
uggcuuccaaauuaucccuaga

SEQ ID NO: 746490 - RNA, 22 nt, Human
ucccugccaguccuggucugaa

SEQ ID NO: 746491 - RNA, 22 nt, Human
ucauccaguuguggagagggaa

SEQ ID NO: 746492 - RNA, 22 nt, Human
agggagccaggaacgcaggucg

SEQ ID NO: 746493 - RNA, 22 nt, Human
uuuggaaugguaccuucaguug

SEQ ID NO: 746494 - RNA, 21 nt, Human
cacauugaauacagagaugga

SEQ ID NO: 746495 - RNA, 22 nt, Human
auuuauugaagcuuauuacguu

SEQ ID NO: 746496 - RNA, 22 nt, Human
gauucugcuuaccauuugaucu

SEQ ID NO: 746497 - RNA, 17 nt, Human
ugaaacaccaagacugu

SEQ ID NO: 746498 - RNA, 22 nt, Human
aguuuccuugggcauuuguuua

SEQ ID NO: 746499 - RNA, 22 nt, Human
caccagguggaaaugucacagc

SEQ ID NO: 746500 - RNA, 22 nt, Human
agacagggccacucauccucac

SEQ ID NO: 746501 - RNA, 22 nt, Human
gaggcccagagagguugcauga

SEQ ID NO: 746502 - RNA, 22 nt, Human
cuggcaguguccagcucgugau

SEQ ID NO: 746503 - RNA, 22 nt, Human
acugaggcagaaggguaagugg

SEQ ID NO: 746504 - RNA, 22 nt, Human
ggugggcagcucuuggcaggca

SEQ ID NO: 746505 - RNA, 19 nt, Human
aggcagcacccaguccuug

SEQ ID NO: 746506 - RNA, 22 nt, Human
gagacacacccaagguuaugag

SEQ ID NO: 746507 - RNA, 22 nt, Human
agguggcagagcuggcccagcg

SEQ ID NO: 746508 - RNA, 22 nt, Human
ugccacccagccaggaguggga

SEQ ID NO: 746509 - RNA, 23 nt, Human
ucuccaggccuuacuccaggccu

SEQ ID NO: 746510 - RNA, 22 nt, Human
agaaggggcccaaggaugucag

SEQ ID NO: 746511 - RNA, 22 nt, Human
auucaguauucugcugcauaau

SEQ ID NO: 746512 - RNA, 22 nt, Human
accagggcuuacagcaguagcu

SEQ ID NO: 746513 - RNA, 22 nt, Human
uucccacaguguugaauccucu

SEQ ID NO: 746514 - RNA, 22 nt, Human
uaacaugaaacuccaaauggua

SEQ ID NO: 746515 - RNA, 22 nt, Human
uauauauucuuaaguaguguag

SEQ ID NO: 746516 - RNA, 22 nt, Human
acuuggaaaauucaaaauggca

SEQ ID NO: 746517 - RNA, 22 nt, Human
acuuugugcccaacagaaagaa

SEQ ID NO: 746518 - RNA, 22 nt, Human
agcaagcuaccuagauagucua

SEQ ID NO: 746519 - RNA, 22 nt, Human
ugcaggcucaccugccagggcc

SEQ ID NO: 746520 - RNA, 22 nt, Human
gacuggggcucuagccaggccu

SEQ ID NO: 746521 - RNA, 22 nt, Human
aggcucugaguagagcugccag

SEQ ID NO: 746522 - RNA, 22 nt, Human
gcuguggcuugcagcuggggcu

SEQ ID NO: 746523 - RNA, 22 nt, Human
ucaggagauguaaccuuagcug

SEQ ID NO: 746524 - RNA, 22 nt, Human
cuaugaaaggauuuggaguugu

SEQ ID NO: 746525 - RNA, 22 nt, Human
cagauucuccaggggcugcaga

SEQ ID NO: 746526 - RNA, 22 nt, Human
ccaggaaggcaggccuccccgc

SEQ ID NO: 746527 - RNA, 22 nt, Human
gauagaaagagugguucuuuuu

SEQ ID NO: 746528 - RNA, 22 nt, Human
ucaggccugagaaaaauccuuu

SEQ ID NO: 746529 - RNA, 22 nt, Human
uaucucuaggcugccacuuaaa

SEQ ID NO: 746530 - RNA, 22 nt, Human
uugacuauacucuggcggaaaa

SEQ ID NO: 746531 - RNA, 23 nt, Human
uggcucucucagugcugcagagg

SEQ ID NO: 746532 - RNA, 22 nt, Human
aggcuguggcccuggucuagca

SEQ ID NO: 746533 - RNA, 22 nt, Human
aggcuucacgaugggugaggug

SEQ ID NO: 746534 - RNA, 22 nt, Human
agacucugguccucuugaauuu

SEQ ID NO: 746535 - RNA, 22 nt, Human
cacagcuaccugcaugccugcu

SEQ ID NO: 746536 - RNA, 22 nt, Human
gauggggaugagaagugagcag

SEQ ID NO: 746537 - RNA, 22 nt, Human
uaguuuaggaacaaguagugga

SEQ ID NO: 746538 - RNA, 22 nt, Human
aagugcaaaucuguggcugaaa

SEQ ID NO: 746539 - RNA, 22 nt, Human
gauauuuacaaauuugccaaua

SEQ ID NO: 746540 - RNA, 22 nt, Human
caggcaccaacuuccuggggag

SEQ ID NO: 746541 - RNA, 22 nt, Human
augucacagucugacucaguga

SEQ ID NO: 746542 - RNA, 22 nt, Human
gcacuuggauauacaaaugaag

SEQ ID NO: 746543 - RNA, 22 nt, Human
ggaccaugaggagaugggccuc

SEQ ID NO: 746544 - RNA, 22 nt, Human
gguggcugcaauggcuaacuuc

SEQ ID NO: 746545 - RNA, 20 nt, Human
gcucugugcuggcggaggcu

SEQ ID NO: 746546 - RNA, 22 nt, Human
gaggaaaauggaguguaauuaa

SEQ ID NO: 746547 - RNA, 18 nt, Human
aucugcuggcaggucugg

SEQ ID NO: 746548 - RNA, 22 nt, Human
gaagccuuugccuaaaacauua

SEQ ID NO: 746549 - RNA, 22 nt, Human
ggcuuaaaacuuugaaaguguu

SEQ ID NO: 746550 - RNA, 22 nt, Human
ggucacaaggcagauaauaagg

SEQ ID NO: 746551 - RNA, 22 nt, Human
aagguaaucagccuuuccacaa

SEQ ID NO: 746552 - RNA, 22 nt, Human
aucucuuugauggcuccuguga

SEQ ID NO: 746553 - RNA, 22 nt, Human
auaagaaacauuauucuuucca

SEQ ID NO: 746554 - RNA, 22 nt, Human
gccucuccucuuaauaccauua

SEQ ID NO: 746555 - RNA, 22 nt, Human
ccagccagucccgcaugaccgc

SEQ ID NO: 746556 - RNA, 22 nt, Human
gucuuucuaugcauagagcaga

SEQ ID NO: 746557 - RNA, 22 nt, Human
ugugugucagucuuguuuaggg

SEQ ID NO: 746558 - RNA, 22 nt, Human
ugguuaaaugcuccgaucuugg

SEQ ID NO: 746559 - RNA, 20 nt, Human
uuccuuuucgccucucuccc

SEQ ID NO: 746560 - RNA, 18 nt, Human
uaaaugcauguuaauaac

SEQ ID NO: 746561 - RNA, 19 nt, Human
uuuacaaguucuuuguaug

SEQ ID NO: 746562 - RNA, 20 nt, Human
cucagcucuucagggcaagu

SEQ ID NO: 746563 - RNA, 22 nt, Human
uuaagagggugaugcuagcauu

SEQ ID NO: 746564 - RNA, 22 nt, Human
ugcagaaagucacauucccuuu

SEQ ID NO: 746565 - RNA, 22 nt, Human
gcuucucuuaaugccuggcuuu

SEQ ID NO: 746566 - RNA, 22 nt, Human
ccacuguuuccuuucugcuggc

SEQ ID NO: 746567 - RNA, 22 nt, Human
cccagcaguuugcuuagaguga

SEQ ID NO: 746568 - RNA, 21 nt, Human
ggugucaguuuuggucauuag

SEQ ID NO: 746569 - RNA, 22 nt, Human
uagaggcagaagaaauugacaa

SEQ ID NO: 746570 - RNA, 22 nt, Human
gaggccaggaagcccaagauca

SEQ ID NO: 746571 - RNA, 22 nt, Human
uguacaguggaaaauggauucg

SEQ ID NO: 746572 - RNA, 22 nt, Human
accaucagagcacaguccgugc

SEQ ID NO: 746573 - RNA, 22 nt, Human
uaagaacagugucugucucaca

SEQ ID NO: 746574 - RNA, 18 nt, Human
agagaaagaccaaagcau

SEQ ID NO: 746575 - RNA, 23 nt, Human
cauuugauccucacaauaaaugg

SEQ ID NO: 746576 - RNA, 22 nt, Human
aguuucacacaacauuugcaug

SEQ ID NO: 746577 - RNA, 22 nt, Human
uuugccuucucugaaccuauuu

SEQ ID NO: 746578 - RNA, 22 nt, Human
auugcuuuuccuuaacacaugc

SEQ ID NO: 746579 - RNA, 21 nt, Human
aaaaggaggcaggugaacagc

SEQ ID NO: 746580 - RNA, 22 nt, Human
uuccuucaaacgccuccugcac

SEQ ID NO: 746581 - RNA, 22 nt, Human
ugccgcagugcggggagggccc

SEQ ID NO: 746582 - RNA, 22 nt, Human
uugugugugagccuucaccaca

SEQ ID NO: 746583 - RNA, 22 nt, Human
cugcucagcggaaggaagagcg

SEQ ID NO: 746584 - RNA, 22 nt, Human
cccagcuugcccaggacugagg

SEQ ID NO: 746585 - RNA, 22 nt, Human
gauguggaugaucuuagauggu

SEQ ID NO: 746586 - RNA, 22 nt, Human
auaaacugguaggaaaacagua

SEQ ID NO: 746587 - RNA, 20 nt, Human
agucauuggguguccuucgg

SEQ ID NO: 746588 - RNA, 22 nt, Human
auuuuccuagucaugugcuucu

SEQ ID NO: 746589 - RNA, 22 nt, Human
uuauggaaaacuccagagagua

SEQ ID NO: 746590 - RNA, 22 nt, Human
gaagaagacauggaacaauagu

SEQ ID NO: 746591 - RNA, 22 nt, Human
cuggggcuguaggaggacuuau

SEQ ID NO: 746592 - RNA, 22 nt, Human
uaagacuuaggucgaguuuggc

SEQ ID NO: 746593 - RNA, 22 nt, Human
caacagcucagacacgggaccu

SEQ ID NO: 746594 - RNA, 22 nt, Human
uagaaagaucuguaggcaagag

SEQ ID NO: 746595 - RNA, 22 nt, Human
aauagugcuuacauuaucauga

SEQ ID NO: 746596 - RNA, 21 nt, Human
caaucacuuuugcaccaagcu

SEQ ID NO: 746597 - RNA, 22 nt, Human
ccugcacuaccuggggcugcug

SEQ ID NO: 746598 - RNA, 21 nt, Human
cuugaaagguagagucuacag

SEQ ID NO: 746599 - RNA, 22 nt, Human
ugcugcagaucagcugaguccu

SEQ ID NO: 746600 - RNA, 22 nt, Human
uuauaggaaaaguucuagaaaa

SEQ ID NO: 746601 - RNA, 21 nt, Human
agucucucuaauaaaugcuug

SEQ ID NO: 746602 - RNA, 22 nt, Human
uugcaaggugauaaaagaauga

SEQ ID NO: 746603 - RNA, 22 nt, Human
ccacacugaaccucagugucuu

SEQ ID NO: 746604 - RNA, 22 nt, Human
gaacuacagugcauuuucuuaa

SEQ ID NO: 746605 - RNA, 20 nt, Human
aguucacaggccaaauuucu

SEQ ID NO: 746606 - RNA, 22 nt, Human
ucaguuuuuacggucacaggga

SEQ ID NO: 746607 - RNA, 19 nt, Human
cagagccuucagugacucc

SEQ ID NO: 746608 - RNA, 22 nt, Human
uauuuguguggguaucuauaua

SEQ ID NO: 746609 - RNA, 22 nt, Human
uuugcauugcauacaaggaacu

SEQ ID NO: 746610 - RNA, 22 nt, Human
cuggguggcgucuggggccagu

SEQ ID NO: 746611 - RNA, 22 nt, Human
gagcccuggcagucugggaugg

SEQ ID NO: 746612 - RNA, 22 nt, Human
cuucagugauauaggcuucucc

SEQ ID NO: 746613 - RNA, 22 nt, Human
uccuucccaggugucgccgccu

SEQ ID NO: 746614 - RNA, 22 nt, Human
caucuuuuggccuauucugagg

SEQ ID NO: 746615 - RNA, 22 nt, Human
gucauucagagaugcagguaga

SEQ ID NO: 746616 - RNA, 20 nt, Human
accaggcccggugucuccuc

SEQ ID NO: 746617 - RNA, 22 nt, Human
ugaaggcccuaucuccauauac

SEQ ID NO: 746618 - RNA, 22 nt, Human
acacaucuuagacugaaauaug

SEQ ID NO: 746619 - RNA, 22 nt, Human
uguaacugguuauaauuuuuga

SEQ ID NO: 746620 - RNA, 22 nt, Human
cccaugagauucugaauuuggc

SEQ ID NO: 746621 - RNA, 21 nt, Human
gcugagagguugggaaguuca

SEQ ID NO: 746622 - RNA, 22 nt, Human
aaagaggauggaguagucagcu

SEQ ID NO: 746623 - RNA, 22 nt, Human
acauuucucuuagaguuggacu

SEQ ID NO: 746624 - RNA, 22 nt, Human
acagagcauauaaagugcuuug

SEQ ID NO: 746625 - RNA, 22 nt, Human
aaauacugcugcuauuccuuuu

SEQ ID NO: 746626 - RNA, 17 nt, Human
agagggcucaaggcauc

SEQ ID NO: 746627 - RNA, 22 nt, Human
uaggguggagacuggaagcagg

SEQ ID NO: 746628 - RNA, 22 nt, Human
caagggaguuacugagggcggg

SEQ ID NO: 746629 - RNA, 22 nt, Human
caccucugccucaagcuuccca

SEQ ID NO: 746630 - RNA, 22 nt, Human
ccugacaggagaagcgcagcau

SEQ ID NO: 746631 - RNA, 22 nt, Human
cacagcuucccgugcauggaga

SEQ ID NO: 746632 - RNA, 22 nt, Human
uuuaauguagcgugaaaugauu

SEQ ID NO: 746633 - RNA, 23 nt, Human
ugcuggaguuuacucaggccagc

SEQ ID NO: 746634 - RNA, 23 nt, Human
cacugcagcguggucuggcagga

SEQ ID NO: 746635 - RNA, 22 nt, Human
ggaggccaaggcaggcggauca

SEQ ID NO: 746636 - RNA, 20 nt, Human
aucugggcaucaauuuugug

SEQ ID NO: 746637 - RNA, 22 nt, Human
ugcugugguucccagaguggau

SEQ ID NO: 746638 - RNA, 22 nt, Human
gccucugcccuccugggacugc

SEQ ID NO: 746639 - RNA, 22 nt, Human
aaggccugggaguacugggaca

SEQ ID NO: 746640 - RNA, 22 nt, Human
gggcuucaggguacuuccuccu

SEQ ID NO: 746641 - RNA, 22 nt, Human
cagcugcugcccuuggcugcag

SEQ ID NO: 746642 - RNA, 22 nt, Human
cacagugauugauuuuuacuuu

SEQ ID NO: 746643 - RNA, 22 nt, Human
cacagcagucuuucacuaaaua

SEQ ID NO: 746644 - RNA, 22 nt, Human
aagagcagaaguccuuggaucc

SEQ ID NO: 746645 - RNA, 22 nt, Human
aucaguuucuaccauguggaau

SEQ ID NO: 746646 - RNA, 22 nt, Human
cucaaaagacuuaaacauaaga

SEQ ID NO: 746647 - RNA, 22 nt, Human
acucuucaccgcuacugaaaua

SEQ ID NO: 746648 - RNA, 22 nt, Human
uccuugagccguggccagggcc

SEQ ID NO: 746649 - RNA, 22 nt, Human
caccaggcugcccaggacaggg

SEQ ID NO: 746650 - RNA, 22 nt, Human
gggcagcacagacagugaaggc

SEQ ID NO: 746651 - RNA, 22 nt, Human
uguagaggaggaaacugaggcu

SEQ ID NO: 746652 - RNA, 22 nt, Human
ugcuucacaagaauucaggacc

SEQ ID NO: 746653 - RNA, 22 nt, Human
cuggagcucagcccagguucca

SEQ ID NO: 746654 - RNA, 22 nt, Human
uagugaaaugauaacagagcag

SEQ ID NO: 746655 - RNA, 22 nt, Human
gcaggaguaugcagcuaugguu

SEQ ID NO: 746656 - RNA, 23 nt, Human
agucagagagugugagacaacug

SEQ ID NO: 746657 - RNA, 22 nt, Human
gauuuuaucuuugugugcagua

SEQ ID NO: 746658 - RNA, 22 nt, Human
gagcccugcugggccuugucuc

SEQ ID NO: 746659 - RNA, 16 nt, Human
caguuuuaaggcccaa

SEQ ID NO: 746660 - RNA, 22 nt, Human
aauuuguguuaguccacguuca

SEQ ID NO: 746661 - RNA, 22 nt, Human
uucucacagaagcacgaagccu

SEQ ID NO: 746662 - RNA, 23 nt, Human
ucagaggaucaucaaacguuuuc

SEQ ID NO: 746663 - RNA, 22 nt, Human
uuauaucagaaggugagauuga

SEQ ID NO: 746664 - RNA, 22 nt, Human
ggccccagguagaagauauaga

SEQ ID NO: 746665 - RNA, 22 nt, Human
gaggguggaaaggguguaccug

SEQ ID NO: 746666 - RNA, 22 nt, Human
aucagaaaaacauaauguuauu

SEQ ID NO: 746667 - RNA, 21 nt, Human
cauugucgacauuuuccccuc

SEQ ID NO: 746668 - RNA, 22 nt, Human
cuuucacagcugugcuuaugau

SEQ ID NO: 746669 - RNA, 22 nt, Human
aaaugcauuucacuaauguuuc

SEQ ID NO: 746670 - RNA, 22 nt, Human
uggauaugggccauggaaaaaa

SEQ ID NO: 746671 - RNA, 22 nt, Human
uccugcagagacagaggccuca

SEQ ID NO: 746672 - RNA, 22 nt, Human
gguacaauccacuguggguuag

SEQ ID NO: 746673 - RNA, 22 nt, Human
uauguucuuuacaucugugcaa

SEQ ID NO: 746674 - RNA, 22 nt, Human
agaccacuaaaacuuucucuau

SEQ ID NO: 746675 - RNA, 22 nt, Human
acuucuguccuccaagccacgu

SEQ ID NO: 746676 - RNA, 22 nt, Human
acaguaauuaaacauucugauu

SEQ ID NO: 746677 - RNA, 22 nt, Human
ucaggaaacuacaguugaacua

SEQ ID NO: 746678 - RNA, 22 nt, Human
uauaaaugcacuuuugaaauau

SEQ ID NO: 746679 - RNA, 22 nt, Human
ucugagaggauuccugucccga

SEQ ID NO: 746680 - RNA, 22 nt, Human
uagcauuuggcaccaguuauuu

SEQ ID NO: 746681 - RNA, 22 nt, Human
gacaccagcaaggcugugagga

SEQ ID NO: 746682 - RNA, 19 nt, Human
gccucugagggcaggacac

SEQ ID NO: 746683 - RNA, 22 nt, Human
ugcauuaauuuuugccagguuc

SEQ ID NO: 746684 - RNA, 19 nt, Human
aggguuacccgcugccacc

SEQ ID NO: 746685 - RNA, 22 nt, Human
gcugaguguaaugauggcagag

SEQ ID NO: 746686 - RNA, 22 nt, Human
aagggcucuucuauuuauggcc

SEQ ID NO: 746687 - RNA, 22 nt, Human
caggcagcccugcaccaagugu

SEQ ID NO: 746688 - RNA, 22 nt, Human
gggcuacagacaugcucuaagc

SEQ ID NO: 746689 - RNA, 22 nt, Human
cagaugugagcuggggagagug

SEQ ID NO: 746690 - RNA, 22 nt, Human
uaccagccugacccugucugac

SEQ ID NO: 746691 - RNA, 21 nt, Human
acagaaguggcuuggucucag

SEQ ID NO: 746692 - RNA, 22 nt, Human
gcuucagagauuucacuaguuu

SEQ ID NO: 746693 - RNA, 19 nt, Human
accuugggcaagugccuuc

SEQ ID NO: 746694 - RNA, 20 nt, Human
agaagcauucaaagaaaacu

SEQ ID NO: 746695 - RNA, 20 nt, Human
aggccccaggaaacucucag

SEQ ID NO: 746696 - RNA, 22 nt, Human
ucucuguccccucagcuggggu

SEQ ID NO: 746697 - RNA, 21 nt, Human
guuuuucagcccugaggugag

SEQ ID NO: 746698 - RNA, 22 nt, Human
ucauuucuauugcuacugucug

SEQ ID NO: 746699 - RNA, 17 nt, Human
ggccuuggggccucagu

SEQ ID NO: 746700 - RNA, 22 nt, Human
uucaaaucacuuuggagcuuaa

SEQ ID NO: 746701 - RNA, 22 nt, Human
ucagaagucaugcucagucugu

SEQ ID NO: 746702 - RNA, 22 nt, Human
ugccugccaugcagaaagcuga

SEQ ID NO: 746703 - RNA, 22 nt, Human
agccuggccaggccugcccagg

SEQ ID NO: 746704 - RNA, 20 nt, Human
aauugaagcagaggagaggc

SEQ ID NO: 746705 - RNA, 22 nt, Human
cuggaggcugaguugggucucc

SEQ ID NO: 746706 - RNA, 22 nt, Human
ucagcuuugggggucucaggag

SEQ ID NO: 746707 - RNA, 22 nt, Human
agaaauguuuauggcugccuau

SEQ ID NO: 746708 - RNA, 22 nt, Human
uguuuaagugcugguaggguug

SEQ ID NO: 746709 - RNA, 22 nt, Human
aggcuguuuuguauaaacugga

SEQ ID NO: 746710 - RNA, 22 nt, Human
acagucugcauaugaccuguag

SEQ ID NO: 746711 - RNA, 22 nt, Human
uucccagguaauucugaggcag

SEQ ID NO: 746712 - RNA, 22 nt, Human
gggacagcuguagugcuuggcu

SEQ ID NO: 746713 - RNA, 22 nt, Human
augcaauguuacagaauguacu

SEQ ID NO: 746714 - RNA, 22 nt, Human
uuggccagguccauuucuccau

SEQ ID NO: 746715 - RNA, 22 nt, Human
uccugggaggcaggaccccuuu

SEQ ID NO: 746716 - RNA, 17 nt, Human
gacugagguaaggugag

SEQ ID NO: 746717 - RNA, 22 nt, Human
cuucuaagcugagaaugccuuu

SEQ ID NO: 746718 - RNA, 22 nt, Human
gcaggaccucuggaugcaaugc

SEQ ID NO: 746719 - RNA, 22 nt, Human
gcacacagauuaggaaacagaa

SEQ ID NO: 746720 - RNA, 22 nt, Human
gugaaacuucacauuuugauag

SEQ ID NO: 746721 - RNA, 22 nt, Human
uccuuagagauacugucuugaa

SEQ ID NO: 746722 - RNA, 22 nt, Human
ugagugaggaagcgguggagga

SEQ ID NO: 746723 - RNA, 16 nt, Human
auucugcugccugcuc

SEQ ID NO: 746724 - RNA, 22 nt, Human
caggaagagguggggcuaaagu

SEQ ID NO: 746725 - RNA, 22 nt, Human
acaauuuauccauuguauaguu

SEQ ID NO: 746726 - RNA, 22 nt, Human
auuuuacuuaguguaaugucca

SEQ ID NO: 746727 - RNA, 22 nt, Human
ucaguccauaggugggccugag

SEQ ID NO: 746728 - RNA, 22 nt, Human
cccugcagagagugcuuuugug

SEQ ID NO: 746729 - RNA, 22 nt, Human
uaaagacauaggaucagggaga

SEQ ID NO: 746730 - RNA, 22 nt, Human
ucccagccuggacccugccagu

SEQ ID NO: 746731 - RNA, 22 nt, Human
cagggcucccugcagccucugu

SEQ ID NO: 746732 - RNA, 22 nt, Human
ggguuaggucccucccuucugg

SEQ ID NO: 746733 - RNA, 22 nt, Human
ugcauauuuguaugauguuuag

SEQ ID NO: 746734 - RNA, 22 nt, Human
aucucuggccuuccuuuuccaa

SEQ ID NO: 746735 - RNA, 22 nt, Human
cuugcuuuccaaaugacucacu

SEQ ID NO: 746736 - RNA, 22 nt, Human
uucuguuaucauuaagcauuau

SEQ ID NO: 746737 - RNA, 22 nt, Human
ucuucuuaaaguauguucucuu

SEQ ID NO: 746738 - RNA, 22 nt, Human
auccuggacaguuuccccuauu

SEQ ID NO: 746739 - RNA, 22 nt, Human
gaaccucuuuagugcauccuuc

SEQ ID NO: 746740 - RNA, 22 nt, Human
uuucaagaagcaaauuaaaguc

SEQ ID NO: 746741 - RNA, 22 nt, Human
uagagggccagcuggacagcga

SEQ ID NO: 746742 - RNA, 18 nt, Human
ugaggccagagugggcau

SEQ ID NO: 746743 - RNA, 22 nt, Human
agucugugaacuuggcagggaa

SEQ ID NO: 746744 - RNA, 21 nt, Human
acaucagaguugugaagguag

SEQ ID NO: 746745 - RNA, 22 nt, Human
auuggcuuccuucuuauuguca

SEQ ID NO: 746746 - RNA, 22 nt, Human
ccugcucaugggucccuggcag

SEQ ID NO: 746747 - RNA, 22 nt, Human
aagcacaauuucaccuucuugu

SEQ ID NO: 746748 - RNA, 22 nt, Human
gguguccaucaggcugugcuuc

SEQ ID NO: 746749 - RNA, 22 nt, Human
agaaaucugacugcugugcaca

SEQ ID NO: 746750 - RNA, 22 nt, Human
aacagaaaucauuuagggcucu

SEQ ID NO: 746751 - RNA, 22 nt, Human
cacugagcaugagugggcugug

SEQ ID NO: 746752 - RNA, 22 nt, Human
agacaucucccaugcauuuuua

SEQ ID NO: 746753 - RNA, 22 nt, Human
cggaggggauacauuuucugaa

SEQ ID NO: 746754 - RNA, 22 nt, Human
ugugccuucucaguccugcuca

SEQ ID NO: 746755 - RNA, 21 nt, Human
uucuccuccaaguugcuccug

SEQ ID NO: 746756 - RNA, 22 nt, Human
uccagggccaguccuugucugu

SEQ ID NO: 746757 - RNA, 21 nt, Human
uggcggggacuuguggcugcc

SEQ ID NO: 746758 - RNA, 22 nt, Human
uuuaaggaggggcucacguggg

SEQ ID NO: 746759 - RNA, 22 nt, Human
uaaaggaggaguuaaugagacu

SEQ ID NO: 746760 - RNA, 22 nt, Human
cuggcucauuuuagcaucaggu

SEQ ID NO: 746761 - RNA, 22 nt, Human
ugaagcacagaccugggcauca

SEQ ID NO: 746762 - RNA, 20 nt, Human
ggccucugaggacaaggaga

SEQ ID NO: 746763 - RNA, 22 nt, Human
auucaaguggcugcuauguuaa

SEQ ID NO: 746764 - RNA, 22 nt, Human
aucuucaacuuuggggcugccu

SEQ ID NO: 746765 - RNA, 22 nt, Human
gcugucccuuucacaagguuuu

SEQ ID NO: 746766 - RNA, 22 nt, Human
agcagggcuggauuuggcaaga

SEQ ID NO: 746767 - RNA, 22 nt, Human
gaggccucuucuuuguuaaccu

SEQ ID NO: 746768 - RNA, 22 nt, Human
accaugccaguggcagccagac

SEQ ID NO: 746769 - RNA, 22 nt, Human
aucuaauuuucacucauuugcu

SEQ ID NO: 746770 - RNA, 22 nt, Human
uucaguguuaaauucaaagagu

SEQ ID NO: 746771 - RNA, 22 nt, Human
ccagaggaugcuggucagccuc

SEQ ID NO: 746772 - RNA, 22 nt, Human
gaaccuuuuuccaaguaaacaa

SEQ ID NO: 746773 - RNA, 22 nt, Human
cucucuggucccagauuccaga

SEQ ID NO: 746774 - RNA, 22 nt, Human
cucuuuguagccuuugcauauu

SEQ ID NO: 746775 - RNA, 22 nt, Human
acuguaaaacagguuucaucau

SEQ ID NO: 746776 - RNA, 22 nt, Human
aggccuugugagaagcagagaa

SEQ ID NO: 746777 - RNA, 22 nt, Human
caggcacucagucuggaucccu

SEQ ID NO: 746778 - RNA, 22 nt, Human
aaaaagacuagucgagugcagu

SEQ ID NO: 746779 - RNA, 22 nt, Human
uggcccagcccugcucuagggc

SEQ ID NO: 746780 - RNA, 22 nt, Human
uugcucugaacccagggcacca

SEQ ID NO: 746781 - RNA, 22 nt, Human
auuucucacaaaguugcuuauc

SEQ ID NO: 746782 - RNA, 22 nt, Human
cuguucuucuaguccacugaca

SEQ ID NO: 746783 - RNA, 22 nt, Human
guccacucccagugccugaggc

SEQ ID NO: 746784 - RNA, 22 nt, Human
uauuucucuucaaaauugaugu

SEQ ID NO: 746785 - RNA, 22 nt, Human
acugguggcuuucagacagaaa

SEQ ID NO: 746786 - RNA, 22 nt, Human
guauucugggccgauuacaaaa

SEQ ID NO: 746787 - RNA, 17 nt, Human
ugcuccugggacaagga

SEQ ID NO: 746788 - RNA, 22 nt, Human
uagaggguuauuaggacagaag

SEQ ID NO: 746789 - RNA, 22 nt, Human
aguggcuggaauugcaggugcg

SEQ ID NO: 746790 - RNA, 22 nt, Human
aauggcagaggcaaagauggua

SEQ ID NO: 746791 - RNA, 22 nt, Human
gggauggccuagacuagcuugg

SEQ ID NO: 746792 - RNA, 22 nt, Human
cagcugcccaggccaccuggag

SEQ ID NO: 746793 - RNA, 22 nt, Human
gcagcucuuuucuuaaagagau

SEQ ID NO: 746794 - RNA, 22 nt, Human
gcuggggagcuagaccucagca

SEQ ID NO: 746795 - RNA, 22 nt, Human
uguggagaagaaggccacugca

SEQ ID NO: 746796 - RNA, 22 nt, Human
guagaaaugguguguuucuucu

SEQ ID NO: 746797 - RNA, 18 nt, Human
uggaggaaaaaucucaug

SEQ ID NO: 746798 - RNA, 22 nt, Human
aagcacuaggacuucagucucu

SEQ ID NO: 746799 - RNA, 22 nt, Human
ucugggaguaaggccuaggcau

SEQ ID NO: 746800 - RNA, 22 nt, Human
aaauccuaccaagaaauucccu

SEQ ID NO: 746801 - RNA, 22 nt, Human
aauaucacaggaggagaccaag

SEQ ID NO: 746802 - RNA, 22 nt, Human
ccugggucuggucacuaaguca

SEQ ID NO: 746803 - RNA, 22 nt, Human
cacagagagcuacgugcagcgu

SEQ ID NO: 746804 - RNA, 22 nt, Human
uuaucacuuaugagcuuuuugc

SEQ ID NO: 746805 - RNA, 21 nt, Human
agucugagguggggccuagga

SEQ ID NO: 746806 - RNA, 22 nt, Human
agaucauaugcaguaaugaacu

SEQ ID NO: 746807 - RNA, 22 nt, Human
aggccaggccuuucuccauucc

SEQ ID NO: 746808 - RNA, 22 nt, Human
uguucacaggggagccauuuau

SEQ ID NO: 746809 - RNA, 22 nt, Human
ucaugaaaaauuuuccauguca

SEQ ID NO: 746810 - RNA, 22 nt, Human
aauauuaucaaaagcuuuuuca

SEQ ID NO: 746811 - RNA, 22 nt, Human
cccugggcaagcccuauuuucc

SEQ ID NO: 746812 - RNA, 22 nt, Human
acaaaugucuacauugagaaua

SEQ ID NO: 746813 - RNA, 22 nt, Human
uagugcauaccuaacauuuuug

SEQ ID NO: 746814 - RNA, 22 nt, Human
gcuuaguguaggaccuggaaua

SEQ ID NO: 746815 - RNA, 17 nt, Human
ugccagccugucccagg

SEQ ID NO: 746816 - RNA, 22 nt, Human
cacuguugagcaauguacagug

SEQ ID NO: 746817 - RNA, 22 nt, Human
caccacuucauaggcuuuaagg

SEQ ID NO: 746818 - RNA, 22 nt, Human
aaucuguuuaacagauuucugu

SEQ ID NO: 746819 - RNA, 22 nt, Human
uggcucugugcuucuaguaucu

SEQ ID NO: 746820 - RNA, 20 nt, Human
augcaucugguaucuuuccu

SEQ ID NO: 746821 - RNA, 22 nt, Human
ccgggagaguggaaccaagagg

SEQ ID NO: 746822 - RNA, 22 nt, Human
ugaaagcacugauucucaacuc

SEQ ID NO: 746823 - RNA, 22 nt, Human
ccugcccauacugaccucuaau

SEQ ID NO: 746824 - RNA, 22 nt, Human
aggcacaggaacaggaaaagag

SEQ ID NO: 746825 - RNA, 22 nt, Human
gcccucugcuggccucaccucg

SEQ ID NO: 746826 - RNA, 18 nt, Human
gcugugugcaccugauaa

SEQ ID NO: 746827 - RNA, 22 nt, Human
gacauaauaaucugaccuagau

SEQ ID NO: 746828 - RNA, 22 nt, Human
aggaagaauguuuacauaucaa

SEQ ID NO: 746829 - RNA, 20 nt, Human
uucuacaaaacugauucuga

SEQ ID NO: 746830 - RNA, 22 nt, Human
agaggccucuagggccccucag

SEQ ID NO: 746831 - RNA, 22 nt, Human
cagaaacaggcaacgugugcac

SEQ ID NO: 746832 - RNA, 22 nt, Human
auggcuguagucaucugaaggc

SEQ ID NO: 746833 - RNA, 22 nt, Human
caugggcuugcucucugagcuc

SEQ ID NO: 746834 - RNA, 22 nt, Human
ccucagaacggaaaugguuuug

SEQ ID NO: 746835 - RNA, 22 nt, Human
uaaguauuggccuauagcuaga

SEQ ID NO: 746836 - RNA, 22 nt, Human
augugcaugcacuuacaugugu

SEQ ID NO: 746837 - RNA, 22 nt, Human
aguguuccugcucucaggaagc

SEQ ID NO: 746838 - RNA, 22 nt, Human
aaacaggcaucacucagcaaag

SEQ ID NO: 746839 - RNA, 22 nt, Human
cugggccacagacucaaggcag

SEQ ID NO: 746840 - RNA, 22 nt, Human
cuccuggccccagaucccaauc

SEQ ID NO: 746841 - RNA, 21 nt, Human
aaagcaucacgaacauuuggg

SEQ ID NO: 746842 - RNA, 22 nt, Human
ugagcaagagaaacugacugua

SEQ ID NO: 746843 - RNA, 22 nt, Human
uuugguuaaacgagagaacaua

SEQ ID NO: 746844 - RNA, 22 nt, Human
uguagaaggcuauagacuagga

SEQ ID NO: 746845 - RNA, 22 nt, Human
cuuuggaggucauagccaagag

SEQ ID NO: 746846 - RNA, 23 nt, Human
cuuuuaacuugaucugagaccag

SEQ ID NO: 746847 - RNA, 22 nt, Human
uuugacucagcaaauucacagg

SEQ ID NO: 746848 - RNA, 22 nt, Human
ugcagagauagaacuacuuucu

SEQ ID NO: 746849 - RNA, 22 nt, Human
acaugcauuaaaaauacuugug

SEQ ID NO: 746850 - RNA, 22 nt, Human
aggcaguuuauccccagagccu

SEQ ID NO: 746851 - RNA, 22 nt, Human
uucaaacaacucauuuaugcaa

SEQ ID NO: 746852 - RNA, 22 nt, Human
ugccugccaggugcuucuucau

SEQ ID NO: 746853 - RNA, 22 nt, Human
caagauuugacuucgugguuug

SEQ ID NO: 746854 - RNA, 22 nt, Human
agaagcugagaaugaauuaaga

SEQ ID NO: 746855 - RNA, 22 nt, Human
acagagucuuacguggugauaa

SEQ ID NO: 746856 - RNA, 22 nt, Human
accaggagaggcacuugcaaug

SEQ ID NO: 746857 - RNA, 22 nt, Human
agcugccacugagggugcacag

SEQ ID NO: 746858 - RNA, 22 nt, Human
uugcaggugagggaaaugacug

SEQ ID NO: 746859 - RNA, 22 nt, Human
ccugaguaacauggugagaacc

SEQ ID NO: 746860 - RNA, 22 nt, Human
uccuucuuucaccucauaguca

SEQ ID NO: 746861 - RNA, 22 nt, Human
cugggaugucuauagaacacuu

SEQ ID NO: 746862 - RNA, 22 nt, Human
acaaagucucuaauaaucuucu

SEQ ID NO: 746863 - RNA, 23 nt, Human
cuauggaauaccaaugauucuca

SEQ ID NO: 746864 - RNA, 22 nt, Human
caggaaugacugcagauggggc

SEQ ID NO: 746865 - RNA, 22 nt, Human
uauguucaucuggugcaucagu

SEQ ID NO: 746866 - RNA, 22 nt, Human
acucauguccuaggaguaaagc

SEQ ID NO: 746867 - RNA, 22 nt, Human
uccaggucccuggggagauuuu

SEQ ID NO: 746868 - RNA, 22 nt, Human
acauuuuucuaggaggcaaggu

SEQ ID NO: 746869 - RNA, 22 nt, Human
auagaacucgggcuuuggaauc

SEQ ID NO: 746870 - RNA, 22 nt, Human
gcagggucuugagaggcagcca

SEQ ID NO: 746871 - RNA, 22 nt, Human
uuuagggacaagggucuggggu

SEQ ID NO: 746872 - RNA, 22 nt, Human
guuuccugacccuggcccagca

SEQ ID NO: 746873 - RNA, 22 nt, Human
acagaggcugcgcuugggaacg

SEQ ID NO: 746874 - RNA, 22 nt, Human
ccuuggcuuccuucccucuaga

SEQ ID NO: 746875 - RNA, 22 nt, Human
ugagagacacacugugcaugua

SEQ ID NO: 746876 - RNA, 22 nt, Human
gccugcagcaugcuaggucuug

SEQ ID NO: 746877 - RNA, 22 nt, Human
cacagcaggcacuauacagggc

SEQ ID NO: 746878 - RNA, 22 nt, Human
cccugggcucagagcagguagc

SEQ ID NO: 746879 - RNA, 22 nt, Human
ucagauuuccuugcaguuugga

SEQ ID NO: 746880 - RNA, 22 nt, Human
auaaucuguggaugguuuugag

SEQ ID NO: 746881 - RNA, 22 nt, Human
ucagaggccugaaagaauuugg

SEQ ID NO: 746882 - RNA, 22 nt, Human
uggggaagacagcagacacugu

SEQ ID NO: 746883 - RNA, 22 nt, Human
auaacacuaaauguauguaaca

SEQ ID NO: 746884 - RNA, 22 nt, Human
uugagcuugaggaguuauuuga

SEQ ID NO: 746885 - RNA, 21 nt, Human
acauucacaggauauuaucau

SEQ ID NO: 746886 - RNA, 19 nt, Human
acucaggcaaugagaaaca

SEQ ID NO: 746887 - RNA, 22 nt, Human
ugggccgggcacuguacugggc

SEQ ID NO: 746888 - RNA, 22 nt, Human
uggugcaguccaaagggagcag

SEQ ID NO: 746889 - RNA, 22 nt, Human
aguggcuggucuaaggucacag

SEQ ID NO: 746890 - RNA, 22 nt, Human
ccagggcuucccacgugcccug

SEQ ID NO: 746891 - RNA, 22 nt, Human
ggcugugaacccuggcagugug

SEQ ID NO: 746892 - RNA, 22 nt, Human
uguuauccucagcucaccucua

SEQ ID NO: 746893 - RNA, 22 nt, Human
gccagcugucuaagagaguaaa

SEQ ID NO: 746894 - RNA, 22 nt, Human
caguccagcucaucaguggcac

SEQ ID NO: 746895 - RNA, 22 nt, Human
uuucagaauaucgauucaguga

SEQ ID NO: 746896 - RNA, 22 nt, Human
gacauaauccuccucaccuacu

SEQ ID NO: 746897 - RNA, 22 nt, Human
agagauucauguuuacuguagg

SEQ ID NO: 746898 - RNA, 22 nt, Human
ucugggaagcaaauauguaaga

SEQ ID NO: 746899 - RNA, 22 nt, Human
ucagccaguuugauucuauuug

SEQ ID NO: 746900 - RNA, 22 nt, Human
uaguagcaggggguaccucuca

SEQ ID NO: 746901 - RNA, 22 nt, Human
cauuacagugucagaggaacug

SEQ ID NO: 746902 - RNA, 22 nt, Human
ucccugcagccccugagccuuc

SEQ ID NO: 746903 - RNA, 22 nt, Human
cuguuuauuacacuggauagca

SEQ ID NO: 746904 - RNA, 22 nt, Human
uccugaaaugugcacaugacau

SEQ ID NO: 746905 - RNA, 20 nt, Human
ugcuguaagauuagagagcu

SEQ ID NO: 746906 - RNA, 22 nt, Human
gggcaggaggcuaauucugcau

SEQ ID NO: 746907 - RNA, 21 nt, Human
ugcagcagauuugggggaaga

SEQ ID NO: 746908 - RNA, 20 nt, Human
uuccagagaucugcauuuua

SEQ ID NO: 746909 - RNA, 22 nt, Human
agaaccugccuuuacucuccuu

SEQ ID NO: 746910 - RNA, 22 nt, Human
ugaugugugauucauucucaaa

SEQ ID NO: 746911 - RNA, 22 nt, Human
gcauggccaggaaagguagaaa

SEQ ID NO: 746912 - RNA, 22 nt, Human
cccaagcagggugcagaggcau

SEQ ID NO: 746913 - RNA, 22 nt, Human
uaaauugaaaaucuacagaaca

SEQ ID NO: 746914 - RNA, 22 nt, Human
cagcuguggagauggggugcau

SEQ ID NO: 746915 - RNA, 22 nt, Human
cccagcuugcucaccauuccca

SEQ ID NO: 746916 - RNA, 22 nt, Human
aucuggcucacuuagucuagga

SEQ ID NO: 746917 - RNA, 23 nt, Human
agaauuucuaacucuagcucugu

SEQ ID NO: 746918 - RNA, 22 nt, Human
ugacacaguugucgacucuaca

SEQ ID NO: 746919 - RNA, 20 nt, Human
ugacauagcucuuggggugc

SEQ ID NO: 746920 - RNA, 23 nt, Human
uuugaacauuucuagauuacaua

SEQ ID NO: 746921 - RNA, 22 nt, Human
gcugccagcucacucuccugag

SEQ ID NO: 746922 - RNA, 22 nt, Human
gcaggcuggucugaccaucccu

SEQ ID NO: 746923 - RNA, 22 nt, Human
uggguggcagcuucagcauguu

SEQ ID NO: 746924 - RNA, 21 nt, Human
auggagggaccagggaagcag

SEQ ID NO: 746925 - RNA, 22 nt, Human
gucccuuccucauuccacuuua

SEQ ID NO: 746926 - RNA, 22 nt, Human
gagcaaggaugggucuauagua

SEQ ID NO: 746927 - RNA, 22 nt, Human
uguacacaugguguacacuccc

SEQ ID NO: 746928 - RNA, 22 nt, Human
uauagugcauuauuuacaguaa

SEQ ID NO: 746929 - RNA, 22 nt, Human
cuuaaagaaauugaggagagga

SEQ ID NO: 746930 - RNA, 22 nt, Human
agcugucagugcugugccugua

SEQ ID NO: 746931 - RNA, 22 nt, Human
ugucuccaugugauaguggccu

SEQ ID NO: 746932 - RNA, 22 nt, Human
uuucaagggaauaugaaauuca

SEQ ID NO: 746933 - RNA, 16 nt, Human
gucucuucccugcuga

SEQ ID NO: 746934 - RNA, 22 nt, Human
uguagaaccuguuuauuauaga

SEQ ID NO: 746935 - RNA, 22 nt, Human
cacacaauuaugugugcacaau

SEQ ID NO: 746936 - RNA, 19 nt, Human
gcucaggcugugugugggg

SEQ ID NO: 746937 - RNA, 22 nt, Human
agcagaggaggauuuaguuagg

SEQ ID NO: 746938 - RNA, 20 nt, Human
auuaacacugagcuaugggu

SEQ ID NO: 746939 - RNA, 22 nt, Human
cagucaggaaugccuccuuccu

SEQ ID NO: 746940 - RNA, 22 nt, Human
uugaaauagaugcgucagagau

SEQ ID NO: 746941 - RNA, 22 nt, Human
agaggcugugcagagggagugc

SEQ ID NO: 746942 - RNA, 22 nt, Human
aggggugacacauaucagugca

SEQ ID NO: 746943 - RNA, 22 nt, Human
gaggacugcagaugggugcauc

SEQ ID NO: 746944 - RNA, 22 nt, Human
cucugcugggauguaaagucuu

SEQ ID NO: 746945 - RNA, 22 nt, Human
aaggcuuuaaauaaccguaaag

SEQ ID NO: 746946 - RNA, 22 nt, Human
ugacagagcauguagugacagc

SEQ ID NO: 746947 - RNA, 22 nt, Human
uuugcauuuguuuagaaccuga

SEQ ID NO: 746948 - RNA, 22 nt, Human
gacuuuaaaaugcuagaacagg

SEQ ID NO: 746949 - RNA, 22 nt, Human
ccugcucagagcgucuugugug

SEQ ID NO: 746950 - RNA, 22 nt, Human
guccucaggaaggcuuucugac

SEQ ID NO: 746951 - RNA, 20 nt, Human
uggcaggaauagggccagag

SEQ ID NO: 746952 - RNA, 22 nt, Human
ggcuccuuaucucuccuaugcc

SEQ ID NO: 746953 - RNA, 21 nt, Human
acagugagaaauaaauggaaa

SEQ ID NO: 746954 - RNA, 22 nt, Human
ucugagcucaagugacaguuag

SEQ ID NO: 746955 - RNA, 22 nt, Human
augggcuggccuuucccgcucu

SEQ ID NO: 746956 - RNA, 22 nt, Human
ugcagggcauaggguccaguuu

SEQ ID NO: 746957 - RNA, 22 nt, Human
uuacaagcagcuacauaucaca

SEQ ID NO: 746958 - RNA, 22 nt, Human
gcagauggagauaaauggaacu

SEQ ID NO: 746959 - RNA, 22 nt, Human
cagggccacccucugcugggug

SEQ ID NO: 746960 - RNA, 22 nt, Human
uauugcuuucucagacguuuag

SEQ ID NO: 746961 - RNA, 22 nt, Human
gcucccugaagagauuuggucu

SEQ ID NO: 746962 - RNA, 22 nt, Human
ucaggcucagguuaggggccaa

SEQ ID NO: 746963 - RNA, 22 nt, Human
uucacuuaacauuuaccaagga

SEQ ID NO: 746964 - RNA, 22 nt, Human
cucccacauggaauagcaggga

SEQ ID NO: 746965 - RNA, 22 nt, Human
aucuuuuacauuacugcccaga

SEQ ID NO: 746966 - RNA, 22 nt, Human
acagauaguauguaaauuaagc

SEQ ID NO: 746967 - RNA, 22 nt, Human
ccaucccuucucuggccagcag

SEQ ID NO: 746968 - RNA, 22 nt, Human
ucugucacaauuugcuuacucu

SEQ ID NO: 746969 - RNA, 22 nt, Human
uccagggcuuggcugggacggu

SEQ ID NO: 746970 - RNA, 22 nt, Human
uuuucagugguaucuuuguaaa

SEQ ID NO: 746971 - RNA, 22 nt, Human
gcuuccugagaaacaaucugau

SEQ ID NO: 746972 - RNA, 22 nt, Human
auucuugauauagauaguuaau

SEQ ID NO: 746973 - RNA, 22 nt, Human
uuuacacugacagcacauaagg

SEQ ID NO: 746974 - RNA, 22 nt, Human
augcaauauagggaagauagau

SEQ ID NO: 746975 - RNA, 22 nt, Human
agguggggcccaccaauuugca

SEQ ID NO: 746976 - RNA, 22 nt, Human
ggugcaggaaaauuaccuggag

SEQ ID NO: 746977 - RNA, 22 nt, Human
aaacaguguuuuuaugauuuau

SEQ ID NO: 746978 - RNA, 22 nt, Human
aauuccauccauuuguuucaac

SEQ ID NO: 746979 - RNA, 22 nt, Human
uuggcucacaugauuauggagg

SEQ ID NO: 746980 - RNA, 22 nt, Human
ugucagugaguuggguccugag

SEQ ID NO: 746981 - RNA, 22 nt, Human
agggguuggauuuggccuagag

SEQ ID NO: 746982 - RNA, 22 nt, Human
cauguaaagaauuucacacaag

SEQ ID NO: 746983 - RNA, 22 nt, Human
aguuaaacuuugccagauggga

SEQ ID NO: 746984 - RNA, 22 nt, Human
caggguagacaguaggugucug

SEQ ID NO: 746985 - RNA, 22 nt, Human
ucuguuuuagauaagaaaggcu

SEQ ID NO: 746986 - RNA, 22 nt, Human
auauuauucuagcucuugugug

SEQ ID NO: 746987 - RNA, 22 nt, Human
uugcccugccucccugagguga

SEQ ID NO: 746988 - RNA, 18 nt, Human
agucucagcggaggagua

SEQ ID NO: 746989 - RNA, 22 nt, Human
ucugaaauaggaaagcaaaugg

SEQ ID NO: 746990 - RNA, 21 nt, Human
gcucugccacuuaccagauuu

SEQ ID NO: 746991 - RNA, 22 nt, Human
gacagcaggaugugaggggaug

SEQ ID NO: 746992 - RNA, 22 nt, Human
uccaggaguccuggguggcccc

SEQ ID NO: 746993 - RNA, 22 nt, Human
aaguggaggccgaguucacgca

SEQ ID NO: 746994 - RNA, 22 nt, Human
ugcaaauggagcauguauaaga

SEQ ID NO: 746995 - RNA, 22 nt, Human
acuucacagguuuucauaaaac

SEQ ID NO: 746996 - RNA, 17 nt, Human
agcugccuugcuugagc

SEQ ID NO: 746997 - RNA, 22 nt, Human
guccuggaauccuagaacagug

SEQ ID NO: 746998 - RNA, 22 nt, Human
gcaguuuacugucaauaacucu

SEQ ID NO: 746999 - RNA, 22 nt, Human
uaagaaacaugauacuuuuccu

SEQ ID NO: 747000 - RNA, 22 nt, Human
agaggaaguaaucaggaccugc

SEQ ID NO: 747001 - RNA, 22 nt, Human
cacagcagauccagggguugug

SEQ ID NO: 747002 - RNA, 22 nt, Human
agaucucaccucuguguauuau

SEQ ID NO: 747003 - RNA, 22 nt, Human
aucuccaggcauuucaagagac

SEQ ID NO: 747004 - RNA, 22 nt, Human
uacauacaagauguguuuaaaa

SEQ ID NO: 747005 - RNA, 22 nt, Human
agugaggcaaagugagaggcag

SEQ ID NO: 747006 - RNA, 22 nt, Human
aucaaauacaaagggcauaagg

SEQ ID NO: 747007 - RNA, 22 nt, Human
gucuggaggaggaagaaggcac

SEQ ID NO: 747008 - RNA, 22 nt, Human
gugggcuuuugacagugccugg

SEQ ID NO: 747009 - RNA, 22 nt, Human
cuguagaacgauccaggcauuu

SEQ ID NO: 747010 - RNA, 22 nt, Human
gccuuugccugcgacguggcug

SEQ ID NO: 747011 - RNA, 22 nt, Human
aagcugcuuugucaggaauaug

SEQ ID NO: 747012 - RNA, 22 nt, Human
ccaguguucauaauuuuacacu

SEQ ID NO: 747013 - RNA, 19 nt, Human
gguggcagaacgugggucc

SEQ ID NO: 747014 - RNA, 22 nt, Human
caaggaaaagaaguauuucaga

SEQ ID NO: 747015 - RNA, 18 nt, Human
cccagcuuagcgccccuc

SEQ ID NO: 747016 - RNA, 22 nt, Human
gcucacagccggcuggcagggg

SEQ ID NO: 747017 - RNA, 16 nt, Human
aucuuccaaaguuauu

SEQ ID NO: 747018 - RNA, 22 nt, Human
acucccagguugccuggcaggc

SEQ ID NO: 747019 - RNA, 22 nt, Human
ggacagagcagacgagcagcgg

SEQ ID NO: 747020 - RNA, 22 nt, Human
ugugucccuuggaaccucagcu

SEQ ID NO: 747021 - RNA, 22 nt, Human
aaugaauaacaauccucuggag

SEQ ID NO: 747022 - RNA, 22 nt, Human
uauguauagagucuuuuaaauu

SEQ ID NO: 747023 - RNA, 22 nt, Human
aauggcaagcugaacucagaag

SEQ ID NO: 747024 - RNA, 22 nt, Human
ugugugucagcccaagggccuu

SEQ ID NO: 747025 - RNA, 22 nt, Human
uucacagaugagaaaauugagg

SEQ ID NO: 747026 - RNA, 22 nt, Human
uuccagauauuuuuauguggaa

SEQ ID NO: 747027 - RNA, 22 nt, Human
agcacagagaagauuucaauua

SEQ ID NO: 747028 - RNA, 21 nt, Human
uccugggaagcacuggggugg

SEQ ID NO: 747029 - RNA, 22 nt, Human
uuacaaagauuauauucaguua

SEQ ID NO: 747030 - RNA, 22 nt, Human
guggccaaggcagagaaagagc

SEQ ID NO: 747031 - RNA, 22 nt, Human
ugaggcucauucugcaugccaa

SEQ ID NO: 747032 - RNA, 22 nt, Human
auauauauugcccaggcugguu

SEQ ID NO: 747033 - RNA, 22 nt, Human
auagcaauuugcccaauuaccu

SEQ ID NO: 747034 - RNA, 22 nt, Human
gagcaagguagcucucuggggc

SEQ ID NO: 747035 - RNA, 22 nt, Human
ugcagagguuuccaggcaaguu

SEQ ID NO: 747036 - RNA, 22 nt, Human
cucugcaucagcuucauucugu

SEQ ID NO: 747037 - RNA, 22 nt, Human
cugucuuugguccugucuguua

SEQ ID NO: 747038 - RNA, 22 nt, Human
ucaggaugagcucauaacuaug

SEQ ID NO: 747039 - RNA, 20 nt, Human
cucaggauugucuagccccu

SEQ ID NO: 747040 - RNA, 22 nt, Human
gugcugggcccugagaccaggg

SEQ ID NO: 747041 - RNA, 22 nt, Human
aagagucccaaaaugauucuua

SEQ ID NO: 747042 - RNA, 22 nt, Human
uuuccucagaagugucuacuau

SEQ ID NO: 747043 - RNA, 22 nt, Human
agagcuggcagcagcuucuccu

SEQ ID NO: 747044 - RNA, 22 nt, Human
ucccuggguucccguggaagug

SEQ ID NO: 747045 - RNA, 22 nt, Human
ggccuggacaaaugcaccaagg

SEQ ID NO: 747046 - RNA, 22 nt, Human
cagcuucugagcaagccagggg

SEQ ID NO: 747047 - RNA, 22 nt, Human
gugacugugaacuguuucugau

SEQ ID NO: 747048 - RNA, 22 nt, Human
ugaaacggaauguucuuuaucg

SEQ ID NO: 747049 - RNA, 22 nt, Human
aagcuggacauuguagggggga

SEQ ID NO: 747050 - RNA, 22 nt, Human
augcuucccuuugcuccacaug

SEQ ID NO: 747051 - RNA, 22 nt, Human
aauuuuaagcauaugacugguu

SEQ ID NO: 747052 - RNA, 22 nt, Human
aaagacucuuaacucccuagcg

SEQ ID NO: 747053 - RNA, 22 nt, Human
agaguggcuugcucagcuagca

SEQ ID NO: 747054 - RNA, 22 nt, Human
uuauguaaguggagucauauag

SEQ ID NO: 747055 - RNA, 22 nt, Human
ugguccugcaguaauagacauc

SEQ ID NO: 747056 - RNA, 22 nt, Human
cuuaauuuaaaauaguucaggc

SEQ ID NO: 747057 - RNA, 22 nt, Human
aaguuucaaauguugauuaugc

SEQ ID NO: 747058 - RNA, 22 nt, Human
ugagcuagguccugugucagcu

SEQ ID NO: 747059 - RNA, 22 nt, Human
gcaaguuauuuccauuuaaagc

SEQ ID NO: 747060 - RNA, 22 nt, Human
uggcugaggcuggagugcagug

SEQ ID NO: 747061 - RNA, 22 nt, Human
accugccuucucaaggacauga

SEQ ID NO: 747062 - RNA, 20 nt, Human
ugagugaguuuguggcagga

SEQ ID NO: 747063 - RNA, 22 nt, Human
agugcaaacuuuauugugaccu

SEQ ID NO: 747064 - RNA, 22 nt, Human
cagggcucgcucuugcccuucg

SEQ ID NO: 747065 - RNA, 22 nt, Human
gaugaggcucaugcacccugcg

SEQ ID NO: 747066 - RNA, 22 nt, Human
cauuauccaacagcacuuucca

SEQ ID NO: 747067 - RNA, 22 nt, Human
ugcucaugcuggggacagaugu

SEQ ID NO: 747068 - RNA, 22 nt, Human
guaggcagggcuguggggagaa

SEQ ID NO: 747069 - RNA, 19 nt, Human
cuuauacagauuuucucau

SEQ ID NO: 747070 - RNA, 22 nt, Human
uuuagcaagaugcccuggcuuu

SEQ ID NO: 747071 - RNA, 22 nt, Human
ugugaggauguaaccagaaguc

SEQ ID NO: 747072 - RNA, 22 nt, Human
aguauaauuuacauuugguauu

SEQ ID NO: 747073 - RNA, 21 nt, Human
ugaaggagaggaccgagugcu

SEQ ID NO: 747074 - RNA, 22 nt, Human
uacucaaaaaguuaugaaucau

SEQ ID NO: 747075 - RNA, 22 nt, Human
aguggacucuucccagugcuug

SEQ ID NO: 747076 - RNA, 22 nt, Human
gcaaggcugggagaugaggccu

SEQ ID NO: 747077 - RNA, 22 nt, Human
agggcgugguggugcuggagca

SEQ ID NO: 747078 - RNA, 22 nt, Human
uccaaggcuccggcccuggcgu

SEQ ID NO: 747079 - RNA, 22 nt, Human
agucaguguucuggguuguaau

SEQ ID NO: 747080 - RNA, 22 nt, Human
auaugcuuccaaguuauuccac

SEQ ID NO: 747081 - RNA, 22 nt, Human
aggaguggugcaggaccugcca

SEQ ID NO: 747082 - RNA, 22 nt, Human
gaacagaugggcucagauccug

SEQ ID NO: 747083 - RNA, 22 nt, Human
aucacaucgaggagcaaucaga

SEQ ID NO: 747084 - RNA, 22 nt, Human
guccccucauuuuagagaaaga

SEQ ID NO: 747085 - RNA, 22 nt, Human
acugugcaugaaccgaaacaaa

SEQ ID NO: 747086 - RNA, 22 nt, Human
uuaaaguucauuaaaugagcca

SEQ ID NO: 747087 - RNA, 22 nt, Human
uuguugguggaauugaugcuag

SEQ ID NO: 747088 - RNA, 22 nt, Human
aauggcuuaaugauaccuuauc

SEQ ID NO: 747089 - RNA, 22 nt, Human
uaacauuguuaugaaucagguc

SEQ ID NO: 747090 - RNA, 22 nt, Human
caaaagcagcaaguuuauaugu

SEQ ID NO: 747091 - RNA, 22 nt, Human
gauacuuuccauccaaaugcau

SEQ ID NO: 747092 - RNA, 22 nt, Human
aagaugcaugcugaagcuggcu

SEQ ID NO: 747093 - RNA, 22 nt, Human
ugagugggaccugcguguguca

SEQ ID NO: 747094 - RNA, 22 nt, Human
gaccccaggcagaucagggggu

SEQ ID NO: 747095 - RNA, 22 nt, Human
uccugaagagcccugcucugug

SEQ ID NO: 747096 - RNA, 22 nt, Human
cacaggguuguucugaggauuc

SEQ ID NO: 747097 - RNA, 22 nt, Human
ucuguaaacaccauguuagagu

SEQ ID NO: 747098 - RNA, 19 nt, Human
agguagcucagacucaaag

SEQ ID NO: 747099 - RNA, 22 nt, Human
uugacaaaaaccucauuucacc

SEQ ID NO: 747100 - RNA, 22 nt, Human
ggugaggcagguggcugcugag

SEQ ID NO: 747101 - RNA, 22 nt, Human
uucuaccucaguuucccacuua

SEQ ID NO: 747102 - RNA, 22 nt, Human
auuggcagggccagcaucuccc

SEQ ID NO: 747103 - RNA, 22 nt, Human
auguuuuuggaaaugggaacau

SEQ ID NO: 747104 - RNA, 22 nt, Human
cagaagcagauucuaaagcaag

SEQ ID NO: 747105 - RNA, 22 nt, Human
ugccucagcugaggccgcucca

SEQ ID NO: 747106 - RNA, 22 nt, Human
agucagacauaauucuaacauu

SEQ ID NO: 747107 - RNA, 20 nt, Human
uacuuugaucugauaagcaa

SEQ ID NO: 747108 - RNA, 22 nt, Human
auaaagcaucuagucugucacu

SEQ ID NO: 747109 - RNA, 22 nt, Human
ccccagcagcaccuggggcagu

SEQ ID NO: 747110 - RNA, 22 nt, Human
uccagcauguuugugcugcuga

SEQ ID NO: 747111 - RNA, 22 nt, Human
caggaggaggguacaccaucag

SEQ ID NO: 747112 - RNA, 22 nt, Human
aguccccucuaacccaacuuua

SEQ ID NO: 747113 - RNA, 22 nt, Human
gaaguuauagcuaugaucuuaa

SEQ ID NO: 747114 - RNA, 22 nt, Human
aauguucagaggacaauauaaa

SEQ ID NO: 747115 - RNA, 18 nt, Human
cuucucccaucuuggcca

SEQ ID NO: 747116 - RNA, 22 nt, Human
gcauguggaaucucuccauggu

SEQ ID NO: 747117 - RNA, 22 nt, Human
guugugaauagugccgcaauaa

SEQ ID NO: 747118 - RNA, 22 nt, Human
gguggcucccacccagcuuuga

SEQ ID NO: 747119 - RNA, 22 nt, Human
cuguguaguauuuguacacaua

SEQ ID NO: 747120 - RNA, 22 nt, Human
agcugagcugcagaugacugua

SEQ ID NO: 747121 - RNA, 22 nt, Human
aaacugcugggcauauauuucu

SEQ ID NO: 747122 - RNA, 22 nt, Human
ggaggaaggguagcauaaugua

SEQ ID NO: 747123 - RNA, 22 nt, Human
ccugccucccagagguccucua

SEQ ID NO: 747124 - RNA, 22 nt, Human
gaaaugugggucaugacccauu

SEQ ID NO: 747125 - RNA, 22 nt, Human
gccuaauaugcaaaauugauac

SEQ ID NO: 747126 - RNA, 22 nt, Human
uguccagcucgagacacuaucu

SEQ ID NO: 747127 - RNA, 22 nt, Human
auggcaggcccagguguucauu

SEQ ID NO: 747128 - RNA, 22 nt, Human
ucuucucccaucuccaggcagg

SEQ ID NO: 747129 - RNA, 22 nt, Human
uaaugcuugcaaauuaugggac

SEQ ID NO: 747130 - RNA, 22 nt, Human
auguggcugucacagcauaaug

SEQ ID NO: 747131 - RNA, 22 nt, Human
caugaacauucagaaauacagc

SEQ ID NO: 747132 - RNA, 22 nt, Human
cagcaggguagguuguaucagu

SEQ ID NO: 747133 - RNA, 22 nt, Human
cuggagggacaagguaugcauu

SEQ ID NO: 747134 - RNA, 22 nt, Human
cagccuggauugcagaaugcua

SEQ ID NO: 747135 - RNA, 21 nt, Human
agggacacacaggauggggcu

SEQ ID NO: 747136 - RNA, 22 nt, Human
acccucaugaagcuggccugga

SEQ ID NO: 747137 - RNA, 22 nt, Human
agccagagacugugucuguaau

SEQ ID NO: 747138 - RNA, 22 nt, Human
gcugcaggcauuuuccugggca

SEQ ID NO: 747139 - RNA, 22 nt, Human
gaguuaaaggcaguugaggaaa

SEQ ID NO: 747140 - RNA, 22 nt, Human
ucucagaacacccuucuauggu

SEQ ID NO: 747141 - RNA, 22 nt, Human
caagacuuagagcaucuugaaa

SEQ ID NO: 747142 - RNA, 22 nt, Human
ugauucuauggaaggcauaagg

SEQ ID NO: 747143 - RNA, 22 nt, Human
aacagcuuugagcaguucugua

SEQ ID NO: 747144 - RNA, 22 nt, Human
ugugccuggucccugagucgag

SEQ ID NO: 747145 - RNA, 22 nt, Human
agaaacagcauuagcaucaauu

SEQ ID NO: 747146 - RNA, 22 nt, Human
ggcagucacuuuugcuugugcc

SEQ ID NO: 747147 - RNA, 22 nt, Human
gagguuucacuguguuguccag

SEQ ID NO: 747148 - RNA, 22 nt, Human
ggcagagacaccgaaugacucu

SEQ ID NO: 747149 - RNA, 22 nt, Human
ggagcccuuggcaccuaguagg

SEQ ID NO: 747150 - RNA, 23 nt, Human
auuuuaaccuugacuaacaugca

SEQ ID NO: 747151 - RNA, 22 nt, Human
cagcccucaucucagcuucuuu

SEQ ID NO: 747152 - RNA, 22 nt, Human
accguuuacaccacuaccgcuu

SEQ ID NO: 747153 - RNA, 22 nt, Human
uucucucuggaccugggaugcg

SEQ ID NO: 747154 - RNA, 22 nt, Human
gcaugaaaugagcgaauauaau

SEQ ID NO: 747155 - RNA, 22 nt, Human
gcuugggauaugcugauguaaa

SEQ ID NO: 747156 - RNA, 22 nt, Human
uucucuaauacauuuugacaaa

SEQ ID NO: 747157 - RNA, 22 nt, Human
ugucuucauucuguauguccag

SEQ ID NO: 747158 - RNA, 22 nt, Human
guuuuucuagacugggaguuug

SEQ ID NO: 747159 - RNA, 22 nt, Human
acugcccucccaucuauugcaa

SEQ ID NO: 747160 - RNA, 22 nt, Human
ccaggccugugcaaggagggag

SEQ ID NO: 747161 - RNA, 22 nt, Human
ugcccuuggguaacuugcugau

SEQ ID NO: 747162 - RNA, 22 nt, Human
gauuuaaaguagaccuuuguuu

SEQ ID NO: 747163 - RNA, 22 nt, Human
guuagacaugagugugcuuaca

SEQ ID NO: 747164 - RNA, 22 nt, Human
ucuguagcauucaccagcccug

SEQ ID NO: 747165 - RNA, 22 nt, Human
cagggccagcccacuagcgagg

SEQ ID NO: 747166 - RNA, 22 nt, Human
agccccaguaagggagggccug

SEQ ID NO: 747167 - RNA, 22 nt, Human
auaauuaauuucaguaaucucc

SEQ ID NO: 747168 - RNA, 22 nt, Human
ugaagggguucagcaugggggu

SEQ ID NO: 747169 - RNA, 22 nt, Human
gaaacugugaggaucuuaacuu

SEQ ID NO: 747170 - RNA, 22 nt, Human
ccgggggcgggacgagcuugac

SEQ ID NO: 747171 - RNA, 22 nt, Human
auguuauaaauagagacacugg

SEQ ID NO: 747172 - RNA, 22 nt, Human
agcuaucaccuuaauaaacuga

SEQ ID NO: 747173 - RNA, 21 nt, Human
uagagaaaagaagcuguuccu

SEQ ID NO: 747174 - RNA, 22 nt, Human
ggccuuggauuuuacccuaaag

SEQ ID NO: 747175 - RNA, 22 nt, Human
acugagcucuugacugggaguu

SEQ ID NO: 747176 - RNA, 22 nt, Human
auggaugaaggcgaggaugagg

SEQ ID NO: 747177 - RNA, 22 nt, Human
aaaauagcagggaugugggaaa

SEQ ID NO: 747178 - RNA, 22 nt, Human
guucauccugacuuggauuagu

SEQ ID NO: 747179 - RNA, 22 nt, Human
aagcacauuaaggaacauugaa

SEQ ID NO: 747180 - RNA, 22 nt, Human
ggccaggcgaugaccccuccac

SEQ ID NO: 747181 - RNA, 22 nt, Human
cacugcccagcgucuuaggcac

SEQ ID NO: 747182 - RNA, 22 nt, Human
cagcaucucauuugacuucugc

SEQ ID NO: 747183 - RNA, 22 nt, Human
aacaggaaauacuuaugaggua

SEQ ID NO: 747184 - RNA, 22 nt, Human
cugugcuuucgagaugugaucu

SEQ ID NO: 747185 - RNA, 22 nt, Human
caggcacuguguuaggcacugu

SEQ ID NO: 747186 - RNA, 22 nt, Human
gcagcaggaauuuaaauuuaua

SEQ ID NO: 747187 - RNA, 22 nt, Human
ugaaaucaauugcaauguuuau

SEQ ID NO: 747188 - RNA, 22 nt, Human
gauauuuucagucuccuuucaa

SEQ ID NO: 747189 - RNA, 22 nt, Human
gucucauugguucugccagagu

SEQ ID NO: 747190 - RNA, 22 nt, Human
aaguauucauaaggacauaugu

SEQ ID NO: 747191 - RNA, 16 nt, Human
augaggcauaggcugc

SEQ ID NO: 747192 - RNA, 22 nt, Human
uuugcuauaaaagggucacacg

SEQ ID NO: 747193 - RNA, 22 nt, Human
acuguguguuugucuagcacag

SEQ ID NO: 747194 - RNA, 22 nt, Human
ugggggucaggaugaggccuug

SEQ ID NO: 747195 - RNA, 22 nt, Human
ugcaguggugguaaagaugcuc

SEQ ID NO: 747196 - RNA, 22 nt, Human
auaggcaagcacaaagucagga

SEQ ID NO: 747197 - RNA, 22 nt, Human
cacuacagaaucaaauacgggc

SEQ ID NO: 747198 - RNA, 22 nt, Human
uugugagcaugugcagccucug

SEQ ID NO: 747199 - RNA, 22 nt, Human
gcugcuuugacagugggaacag

SEQ ID NO: 747200 - RNA, 20 nt, Human
agcugccuucauuuucuaga

SEQ ID NO: 747201 - RNA, 22 nt, Human
cuggcagauuggggucagcagu

SEQ ID NO: 747202 - RNA, 22 nt, Human
uagggcucugagaguucagccu

SEQ ID NO: 747203 - RNA, 22 nt, Human
acaaagggggacugcagagggu

SEQ ID NO: 747204 - RNA, 22 nt, Human
uauuuuacaaaugggaaugcug

SEQ ID NO: 747205 - RNA, 22 nt, Human
auggcagauggcuggagcaggu

SEQ ID NO: 747206 - RNA, 22 nt, Human
aggccucaguuugucaucugua

SEQ ID NO: 747207 - RNA, 22 nt, Human
acugucuguacuucuugcaagg

SEQ ID NO: 747208 - RNA, 22 nt, Human
ugcauuuauuugaauugaucua

SEQ ID NO: 747209 - RNA, 19 nt, Human
gcagacagguccagagagg

SEQ ID NO: 747210 - RNA, 22 nt, Human
uuucagagcucuaggcucucag

SEQ ID NO: 747211 - RNA, 22 nt, Human
ugaaauacugagugaaagaauu

SEQ ID NO: 747212 - RNA, 22 nt, Human
ugcauuauaacugaauguuguu

SEQ ID NO: 747213 - RNA, 22 nt, Human
cugacagucucauugauuugcu

SEQ ID NO: 747214 - RNA, 22 nt, Human
cugauacacucccuaaaauaua

SEQ ID NO: 747215 - RNA, 22 nt, Human
aacucuugggcugcaugcuguu

SEQ ID NO: 747216 - RNA, 17 nt, Human
ucuucucuuccagucuu

SEQ ID NO: 747217 - RNA, 22 nt, Human
aaacugcaauuauuuuugcaau

SEQ ID NO: 747218 - RNA, 22 nt, Human
ucucuguacaguacaugccgug

SEQ ID NO: 747219 - RNA, 22 nt, Human
agcuggcccacuguguggucca

SEQ ID NO: 747220 - RNA, 22 nt, Human
auguccaguuucuacacacaua

SEQ ID NO: 747221 - RNA, 22 nt, Human
uguuucuagagaaaauauuuac

SEQ ID NO: 747222 - RNA, 22 nt, Human
cacugcuugguugcaacauugc

SEQ ID NO: 747223 - RNA, 22 nt, Human
uccauuaaugauuauuucugug

SEQ ID NO: 747224 - RNA, 22 nt, Human
aaaugccuauuuguuccuucag

SEQ ID NO: 747225 - RNA, 22 nt, Human
auguccuuugcuucucuggucc

SEQ ID NO: 747226 - RNA, 22 nt, Human
acauagaguucaauuuucaguc

SEQ ID NO: 747227 - RNA, 22 nt, Human
agcagcucuguuuaccuggagg

SEQ ID NO: 747228 - RNA, 22 nt, Human
uggguagagcaggcuggggcuu

SEQ ID NO: 747229 - RNA, 22 nt, Human
guaagaggaucaaggcggugca

SEQ ID NO: 747230 - RNA, 22 nt, Human
uuucuaacagcaaauguuuauc

SEQ ID NO: 747231 - RNA, 23 nt, Human
gugauauuaaggauagagacaag

SEQ ID NO: 747232 - RNA, 22 nt, Human
uauaaagaaggcacagcaagac

SEQ ID NO: 747233 - RNA, 22 nt, Human
gccagcagcugugggguggcca

SEQ ID NO: 747234 - RNA, 22 nt, Human
ucccuugagaguuggccaauug

SEQ ID NO: 747235 - RNA, 22 nt, Human
agggccugagcucuccuccagu

SEQ ID NO: 747236 - RNA, 22 nt, Human
agggaagaggaccagagucucu

SEQ ID NO: 747237 - RNA, 22 nt, Human
cauggccaggcccagggcccag

SEQ ID NO: 747238 - RNA, 22 nt, Human
cauugcuguuaauugucucuag

SEQ ID NO: 747239 - RNA, 22 nt, Human
agcagcucccuccucagccacc

SEQ ID NO: 747240 - RNA, 22 nt, Human
augugucuugagggggauggag

SEQ ID NO: 747241 - RNA, 22 nt, Human
uccgauuagcucuuuauaaaac

SEQ ID NO: 747242 - RNA, 22 nt, Human
ggaaacauuccaagaguugaaa

SEQ ID NO: 747243 - RNA, 22 nt, Human
ggaggagggguuuacauuggaa

SEQ ID NO: 747244 - RNA, 22 nt, Human
augacuucugcaaggucauuug

SEQ ID NO: 747245 - RNA, 22 nt, Human
gugcgggccuggggguuucucu

SEQ ID NO: 747246 - RNA, 22 nt, Human
uuagcauucugccuccuauauc

SEQ ID NO: 747247 - RNA, 21 nt, Human
ggccucagccaccuggcucug

SEQ ID NO: 747248 - RNA, 21 nt, Human
gcagcuggucucagagcuugc

SEQ ID NO: 747249 - RNA, 22 nt, Human
caguuuucuaaagucucuuuaa

SEQ ID NO: 747250 - RNA, 22 nt, Human
ucucaggggauucacuggcacc

SEQ ID NO: 747251 - RNA, 22 nt, Human
accagccagccacaguggcucc

SEQ ID NO: 747252 - RNA, 22 nt, Human
acuguuaaguaugaaguaaggc

SEQ ID NO: 747253 - RNA, 22 nt, Human
ggccuccaucuuaucuuacucu

SEQ ID NO: 747254 - RNA, 22 nt, Human
uucuaagucugcugucuucauc

SEQ ID NO: 747255 - RNA, 22 nt, Human
gcugccagcuuuccuuggcuga

SEQ ID NO: 747256 - RNA, 22 nt, Human
augcucuauaaauaugacaugu

SEQ ID NO: 747257 - RNA, 22 nt, Human
cagcucuguugccaaagugggc

SEQ ID NO: 747258 - RNA, 22 nt, Human
cgcugggcgccgaccugcuggc

SEQ ID NO: 747259 - RNA, 22 nt, Human
gaggcagcaggcugaggaggau

SEQ ID NO: 747260 - RNA, 22 nt, Human
aaacaggcuuccauuagagcaa

SEQ ID NO: 747261 - RNA, 22 nt, Human
ucaaaaauaagauauucuggac

SEQ ID NO: 747262 - RNA, 22 nt, Human
ucccuggcagcuguccuuucag

SEQ ID NO: 747263 - RNA, 22 nt, Human
uauguucaugcuuaugcagaau

SEQ ID NO: 747264 - RNA, 22 nt, Human
ggaggacugagacacuccuggc

SEQ ID NO: 747265 - RNA, 22 nt, Human
ucccagcagagccagcaagccg

SEQ ID NO: 747266 - RNA, 22 nt, Human
acaggaagcuggagacccuuga

SEQ ID NO: 747267 - RNA, 22 nt, Human
uuccacucaugcaaagguccca

SEQ ID NO: 747268 - RNA, 22 nt, Human
ucacagcuccagacugcaacuc

SEQ ID NO: 747269 - RNA, 22 nt, Human
uuggccaauuccagaggaucau

SEQ ID NO: 747270 - RNA, 22 nt, Human
aauguguucaguuaaaugaacu

SEQ ID NO: 747271 - RNA, 22 nt, Human
aagagcuggcccaaucugagca

SEQ ID NO: 747272 - RNA, 20 nt, Human
uuacucaguuccugccaugc

SEQ ID NO: 747273 - RNA, 22 nt, Human
ucaucugucauccacaaagcug

SEQ ID NO: 747274 - RNA, 22 nt, Human
cucagcuagggaagguuagcuu

SEQ ID NO: 747275 - RNA, 22 nt, Human
uggaguccuaguauuggaaaca

SEQ ID NO: 747276 - RNA, 22 nt, Human
guccucuguuagaaaugugcuu

SEQ ID NO: 747277 - RNA, 18 nt, Human
ucagcccagagcccaguu

SEQ ID NO: 747278 - RNA, 22 nt, Human
uucaagucaauuuuugaaugac

SEQ ID NO: 747279 - RNA, 22 nt, Human
uugaucucuguugcugucuuug

SEQ ID NO: 747280 - RNA, 22 nt, Human
cuguggcuggccugucugacau

SEQ ID NO: 747281 - RNA, 22 nt, Human
uuuagauaaugcucaagcaauu

SEQ ID NO: 747282 - RNA, 22 nt, Human
agcugagauuaugcucuucuca

SEQ ID NO: 747283 - RNA, 22 nt, Human
cauguuaaguguuugauaacca

SEQ ID NO: 747284 - RNA, 22 nt, Human
aacccaggagacagguugcagu

SEQ ID NO: 747285 - RNA, 22 nt, Human
aaacagcuggucucaaauguuc

SEQ ID NO: 747286 - RNA, 22 nt, Human
ugagcagaggagugacguaggu

SEQ ID NO: 747287 - RNA, 22 nt, Human
cacaggcucuucucacuugauu

SEQ ID NO: 747288 - RNA, 22 nt, Human
auggcagcuggcuugggcaccu

SEQ ID NO: 747289 - RNA, 22 nt, Human
ugaagcaguuacuggguguuaa

SEQ ID NO: 747290 - RNA, 22 nt, Human
uuugaauaucacaaacuuucaa

SEQ ID NO: 747291 - RNA, 22 nt, Human
uguaugaaccuuuaauauagug

SEQ ID NO: 747292 - RNA, 22 nt, Human
augcaacaguucauaguuuuau

SEQ ID NO: 747293 - RNA, 22 nt, Human
uugugaaaagccgcaaguauag

SEQ ID NO: 747294 - RNA, 22 nt, Human
ccaaggagcaaguuuacaccug

SEQ ID NO: 747295 - RNA, 22 nt, Human
caggugaagaggauaaaaaguu

SEQ ID NO: 747296 - RNA, 22 nt, Human
agagggagaagcuaaaauaacu

SEQ ID NO: 747297 - RNA, 22 nt, Human
cagaaaccaaaugggaugggga

SEQ ID NO: 747298 - RNA, 22 nt, Human
cuuucccacgcaguggaugaga

SEQ ID NO: 747299 - RNA, 22 nt, Human
gacacugaccccaagcuguccu

SEQ ID NO: 747300 - RNA, 22 nt, Human
augcacgccccacacuggugug

SEQ ID NO: 747301 - RNA, 22 nt, Human
uuucuauugaucuaauaaacau

SEQ ID NO: 747302 - RNA, 22 nt, Human
gggggaagaaagaacauggcau

SEQ ID NO: 747303 - RNA, 22 nt, Human
agcgagugggucagcguugcag

SEQ ID NO: 747304 - RNA, 22 nt, Human
caggcagcucuaauggaaagug

SEQ ID NO: 747305 - RNA, 22 nt, Human
ccugagagugagugccuccuua

SEQ ID NO: 747306 - RNA, 22 nt, Human
ugauuucuuccuugucauuaga

SEQ ID NO: 747307 - RNA, 22 nt, Human
ggucucagaucuuuauuaaggc

SEQ ID NO: 747308 - RNA, 22 nt, Human
cuguguaucucugugggacaga

SEQ ID NO: 747309 - RNA, 22 nt, Human
cagcugugggccugacguggca

SEQ ID NO: 747310 - RNA, 22 nt, Human
ucuggcucauacaagccugcaa

SEQ ID NO: 747311 - RNA, 22 nt, Human
gaauucugggagagaucugaca

SEQ ID NO: 747312 - RNA, 22 nt, Human
ucugccugccagucugguccuc

SEQ ID NO: 747313 - RNA, 22 nt, Human
augacaaauucagaccauagca

SEQ ID NO: 747314 - RNA, 19 nt, Human
aguuggggcagggaagaga

SEQ ID NO: 747315 - RNA, 22 nt, Human
ucagcucugcacuccacugugg

SEQ ID NO: 747316 - RNA, 22 nt, Human
aggcuucacauuuucuaggccu

SEQ ID NO: 747317 - RNA, 22 nt, Human
uuguuuguaugcugagaagaau

SEQ ID NO: 747318 - RNA, 22 nt, Human
uccaggcugggcugaagggugc

SEQ ID NO: 747319 - RNA, 22 nt, Human
uagggcuccacucccagagauu

SEQ ID NO: 747320 - RNA, 22 nt, Human
agcagacaggcugccacagugc

SEQ ID NO: 747321 - RNA, 16 nt, Human
ggagguggguaaggug

SEQ ID NO: 747322 - RNA, 22 nt, Human
ggugaagcguauuuguggagcu

SEQ ID NO: 747323 - RNA, 22 nt, Human
agggccuggaacuggagaccac

SEQ ID NO: 747324 - RNA, 22 nt, Human
uaaaggguagguuuuacuguaa

SEQ ID NO: 747325 - RNA, 22 nt, Human
auaauaaaccaggaugggucug

SEQ ID NO: 747326 - RNA, 22 nt, Human
agucugggugugaaugaacuug

SEQ ID NO: 747327 - RNA, 22 nt, Human
uucuuaaucuguguggguucga

SEQ ID NO: 747328 - RNA, 22 nt, Human
agcccagaggcugggcgugcau

SEQ ID NO: 747329 - RNA, 22 nt, Human
agauuucaauggauauugcaag

SEQ ID NO: 747330 - RNA, 22 nt, Human
uaaauugcauaaguacaaauga

SEQ ID NO: 747331 - RNA, 22 nt, Human
ugaagcaggaucguuugcuuca

SEQ ID NO: 747332 - RNA, 21 nt, Human
ucagugcaauucuauggggaa

SEQ ID NO: 747333 - RNA, 22 nt, Human
cagccagguaugggcgugcggg

SEQ ID NO: 747334 - RNA, 20 nt, Human
aaugaaguuauuaaugaugu

SEQ ID NO: 747335 - RNA, 22 nt, Human
gagaucaucuuuuuuagauucc

SEQ ID NO: 747336 - RNA, 22 nt, Human
uccagcagacucaucagcaagg

SEQ ID NO: 747337 - RNA, 22 nt, Human
uugaacaauuugguauacaaac

SEQ ID NO: 747338 - RNA, 22 nt, Human
ggagguccaugugaauguggcc

SEQ ID NO: 747339 - RNA, 22 nt, Human
gggcugagauuggugcccuguc

SEQ ID NO: 747340 - RNA, 22 nt, Human
ggucuucagcuuugcaugucuu

SEQ ID NO: 747341 - RNA, 22 nt, Human
ggcucuugagaggcacagguuu

SEQ ID NO: 747342 - RNA, 20 nt, Human
aaguuuggagucaggagacc

SEQ ID NO: 747343 - RNA, 22 nt, Human
uugugaauagugccgcaauaaa

SEQ ID NO: 747344 - RNA, 22 nt, Human
agggaagcaggaauagcucuga

SEQ ID NO: 747345 - RNA, 22 nt, Human
agugcuccuauggaucaguugu

SEQ ID NO: 747346 - RNA, 21 nt, Human
gcagccacagccaccaagcua

SEQ ID NO: 747347 - RNA, 22 nt, Human
gucaauaauugauagauauugg

SEQ ID NO: 747348 - RNA, 22 nt, Human
cccuggcucugccucagagccc

SEQ ID NO: 747349 - RNA, 22 nt, Human
cauuuagucaaggacacguggc

SEQ ID NO: 747350 - RNA, 22 nt, Human
agcugguggauuaugcuguaca

SEQ ID NO: 747351 - RNA, 22 nt, Human
ggaucagaaucucugagaguuu

SEQ ID NO: 747352 - RNA, 22 nt, Human
cugcccucccaguugguccgug

SEQ ID NO: 747353 - RNA, 22 nt, Human
aacaugcucuggauugcuguga

SEQ ID NO: 747354 - RNA, 22 nt, Human
gagguccauuuucacauaugau

SEQ ID NO: 747355 - RNA, 22 nt, Human
ccaguguauuuuugggaccugc

SEQ ID NO: 747356 - RNA, 22 nt, Human
agcagugggggaguguuaguuu

SEQ ID NO: 747357 - RNA, 22 nt, Human
aggaagcucauuuugacauauc

SEQ ID NO: 747358 - RNA, 22 nt, Human
cuuucuuucgaagacgugauua

SEQ ID NO: 747359 - RNA, 22 nt, Human
cuguuauuugagaguguugaau

SEQ ID NO: 747360 - RNA, 22 nt, Human
agcucuggaauaaugaugugau

SEQ ID NO: 747361 - RNA, 22 nt, Human
aacaguuugcuuuaagaggcac

SEQ ID NO: 747362 - RNA, 22 nt, Human
agucacauggacucaggaugac

SEQ ID NO: 747363 - RNA, 22 nt, Human
uuaacaaagcucuguuccuuuu

SEQ ID NO: 747364 - RNA, 22 nt, Human
gagucaggcuagaggugagucu

SEQ ID NO: 747365 - RNA, 22 nt, Human
ggugaagguggaacgcagagca

SEQ ID NO: 747366 - RNA, 22 nt, Human
uuccugguuggauucugauuaa

SEQ ID NO: 747367 - RNA, 22 nt, Human
aggaagggcuguuucuccaaga

SEQ ID NO: 747368 - RNA, 22 nt, Human
aggcaguggcuuuuguuguguu

SEQ ID NO: 747369 - RNA, 17 nt, Human
agaggcagauacuugga

SEQ ID NO: 747370 - RNA, 22 nt, Human
acuuguuuacaagcaguucuga

SEQ ID NO: 747371 - RNA, 22 nt, Human
cuuauaaaguccaucugaacaa

SEQ ID NO: 747372 - RNA, 22 nt, Human
aagaggagacuucagcaacuug

SEQ ID NO: 747373 - RNA, 22 nt, Human
uucugcugguaacuauguuuca

SEQ ID NO: 747374 - RNA, 22 nt, Human
uguggguuuguaguuaaguucu

SEQ ID NO: 747375 - RNA, 22 nt, Human
gggacgagccccaggcuggagg

SEQ ID NO: 747376 - RNA, 22 nt, Human
acaacagagcuggacugagagg

SEQ ID NO: 747377 - RNA, 23 nt, Human
uaagacacccgacuccagagaug

SEQ ID NO: 747378 - RNA, 22 nt, Human
ugagguagaagccuggguugag

SEQ ID NO: 747379 - RNA, 22 nt, Human
acccuuucuuacucacacgcuc

SEQ ID NO: 747380 - RNA, 22 nt, Human
uugagguccccaguacccacug

SEQ ID NO: 747381 - RNA, 22 nt, Human
auccucacaauaaaaucagccu

SEQ ID NO: 747382 - RNA, 22 nt, Human
ucucccauucagcuugcaguca

SEQ ID NO: 747383 - RNA, 22 nt, Human
uuuauauagagauuugugcaug

SEQ ID NO: 747384 - RNA, 23 nt, Human
cugcauguccacugguguaaaug

SEQ ID NO: 747385 - RNA, 22 nt, Human
agucucuuggcauucugaaaca

SEQ ID NO: 747386 - RNA, 22 nt, Human
aaugauccuacacauggaauuc

SEQ ID NO: 747387 - RNA, 22 nt, Human
uaauccacaauagagauuaucu

SEQ ID NO: 747388 - RNA, 22 nt, Human
gcccuucugcuguuagguagcc

SEQ ID NO: 747389 - RNA, 20 nt, Human
gcuccaagccccuuuagagg

SEQ ID NO: 747390 - RNA, 22 nt, Human
ucaagcaacugaauucuaaaag

SEQ ID NO: 747391 - RNA, 21 nt, Human
cugaggcaugcaggccugggc

SEQ ID NO: 747392 - RNA, 22 nt, Human
auuugucucucuggguuuacuu

SEQ ID NO: 747393 - RNA, 20 nt, Human
gcugccagugccugaugcuu

SEQ ID NO: 747394 - RNA, 22 nt, Human
ugggaacucucugggaggcauc

SEQ ID NO: 747395 - RNA, 22 nt, Human
uuguuucccuggaucuagagcu

SEQ ID NO: 747396 - RNA, 23 nt, Human
auuacaguuaauuacaacaucuu

SEQ ID NO: 747397 - RNA, 22 nt, Human
uuugauucaaaaaccacuccac

SEQ ID NO: 747398 - RNA, 22 nt, Human
acacugaaucagaaauuguugg

SEQ ID NO: 747399 - RNA, 22 nt, Human
acagcagaguaguuuuccaacu

SEQ ID NO: 747400 - RNA, 22 nt, Human
cccagugccaggcacaggcagc

SEQ ID NO: 747401 - RNA, 22 nt, Human
augcuuuacgacaaaaaacuca

SEQ ID NO: 747402 - RNA, 22 nt, Human
accuuauucuugcccuuagaug

SEQ ID NO: 747403 - RNA, 21 nt, Human
ccugggccaaauucccuggac

SEQ ID NO: 747404 - RNA, 22 nt, Human
aagaagcauggcuguagauucc

SEQ ID NO: 747405 - RNA, 22 nt, Human
augcccaaugucacaauuuuug

SEQ ID NO: 747406 - RNA, 22 nt, Human
ccagugugguagguccacaggu

SEQ ID NO: 747407 - RNA, 22 nt, Human
aacucaguguguuucuuaguau

SEQ ID NO: 747408 - RNA, 22 nt, Human
acucauuuuauaacacuguagu

SEQ ID NO: 747409 - RNA, 22 nt, Human
uggcuaaacccuaguaaauuaa

SEQ ID NO: 747410 - RNA, 22 nt, Human
cggagcuggcgucuguguggac

SEQ ID NO: 747411 - RNA, 22 nt, Human
gagucaggcaugaagguaauua

SEQ ID NO: 747412 - RNA, 22 nt, Human
gucacucaggcuggaguucagu

SEQ ID NO: 747413 - RNA, 19 nt, Human
ggugagcccucgccugccu

SEQ ID NO: 747414 - RNA, 22 nt, Human
acagagcuuaauucaggagcuu

SEQ ID NO: 747415 - RNA, 22 nt, Human
ugaacacaguucugaugagcuu

SEQ ID NO: 747416 - RNA, 22 nt, Human
cugcagggcccaaggucaacgg

SEQ ID NO: 747417 - RNA, 22 nt, Human
uacuccacacgcuauuauaaug

SEQ ID NO: 747418 - RNA, 22 nt, Human
gacaaggguucugcagagccug

SEQ ID NO: 747419 - RNA, 22 nt, Human
uggagccagcccaggccccucu

SEQ ID NO: 747420 - RNA, 17 nt, Human
agguucagguuacauuc

SEQ ID NO: 747421 - RNA, 22 nt, Human
cuaggcagggugcugugccaug

SEQ ID NO: 747422 - RNA, 22 nt, Human
uguggccuugcagccuggaggu

SEQ ID NO: 747423 - RNA, 22 nt, Human
agaguuuggauuuuaggacauc

SEQ ID NO: 747424 - RNA, 22 nt, Human
ucuucagagauguaacauaugg

SEQ ID NO: 747425 - RNA, 22 nt, Human
ugcuggaguucgacauugcaaa

SEQ ID NO: 747426 - RNA, 22 nt, Human
ugaggggaacugaugcccauug

SEQ ID NO: 747427 - RNA, 21 nt, Human
gacaggggccauggguuucua

SEQ ID NO: 747428 - RNA, 22 nt, Human
auuccacaguguguggugagga

SEQ ID NO: 747429 - RNA, 22 nt, Human
gccccuuccaucaugugaggac

SEQ ID NO: 747430 - RNA, 22 nt, Human
aagggaaaauaguugaugacca

SEQ ID NO: 747431 - RNA, 22 nt, Human
cccaggcacaccccgaacggaa

SEQ ID NO: 747432 - RNA, 22 nt, Human
gagagcugcagccgagaggggg

SEQ ID NO: 747433 - RNA, 22 nt, Human
gcucaggaucccaggggugugc

SEQ ID NO: 747434 - RNA, 22 nt, Human
agaucaguaagaggaagaaugg

SEQ ID NO: 747435 - RNA, 22 nt, Human
aagaaagcauuagacaggcauu

SEQ ID NO: 747436 - RNA, 22 nt, Human
gcuaggaguggugggucaagga

SEQ ID NO: 747437 - RNA, 23 nt, Human
gcucugccacuuaauagcugugu

SEQ ID NO: 747438 - RNA, 22 nt, Human
augaccccuaaaauuuacuguc

SEQ ID NO: 747439 - RNA, 22 nt, Human
cugagggccuucuaugcugagc

SEQ ID NO: 747440 - RNA, 20 nt, Human
cccaggcagagcuagcggca

SEQ ID NO: 747441 - RNA, 22 nt, Human
auguggccagucauguaguaac

SEQ ID NO: 747442 - RNA, 22 nt, Human
ucucagaguuuagagcugagcc

SEQ ID NO: 747443 - RNA, 22 nt, Human
gcuuccagaaugacuaggaugu

SEQ ID NO: 747444 - RNA, 22 nt, Human
cuuuggaaaaauaccuggcaua

SEQ ID NO: 747445 - RNA, 22 nt, Human
ucugccuguaccucuuuuuugc

SEQ ID NO: 747446 - RNA, 22 nt, Human
acagaggaagcauauagcacaa

SEQ ID NO: 747447 - RNA, 22 nt, Human
agcuuacaguucaaugacaaag

SEQ ID NO: 747448 - RNA, 22 nt, Human
uggaggaaucagggcuuaggcu

SEQ ID NO: 747449 - RNA, 22 nt, Human
caguggcucaugccuauaaucc

SEQ ID NO: 747450 - RNA, 22 nt, Human
ccagggugcucuguggcgucgc

SEQ ID NO: 747451 - RNA, 22 nt, Human
ugcccagucuccgggccagccc

SEQ ID NO: 747452 - RNA, 21 nt, Human
uggcagggguaguaguacagc

SEQ ID NO: 747453 - RNA, 22 nt, Human
uuuggcacucacuuaucauugg

SEQ ID NO: 747454 - RNA, 22 nt, Human
auagaagcugauaaacuacuuc

SEQ ID NO: 747455 - RNA, 22 nt, Human
ggacauagaggcccugcauggc

SEQ ID NO: 747456 - RNA, 21 nt, Human
guuuucuuugauagagggaag

SEQ ID NO: 747457 - RNA, 22 nt, Human
uugcaauagccuuauuuccaaa

SEQ ID NO: 747458 - RNA, 22 nt, Human
uucaggagaaaguucaguacuu

SEQ ID NO: 747459 - RNA, 22 nt, Human
aucucauucucccgugccaugg

SEQ ID NO: 747460 - RNA, 22 nt, Human
aagggcugaaugaaggguugaa

SEQ ID NO: 747461 - RNA, 22 nt, Human
ggggcccagggcagcagugcag

SEQ ID NO: 747462 - RNA, 22 nt, Human
uagauucuaagauucuaagaau

SEQ ID NO: 747463 - RNA, 22 nt, Human
uaugagaauuugcuaauuggcu

SEQ ID NO: 747464 - RNA, 22 nt, Human
gagcccagguucugcuuccagc

SEQ ID NO: 747465 - RNA, 22 nt, Human
agauauauuuaagguaauaagu

SEQ ID NO: 747466 - RNA, 22 nt, Human
cccagcauuucugggcugcacu

SEQ ID NO: 747467 - RNA, 22 nt, Human
aucauaaaccacuuuguaaucu

SEQ ID NO: 747468 - RNA, 22 nt, Human
ugagaacauuugcagggagagu

SEQ ID NO: 747469 - RNA, 22 nt, Human
ucugaaggugcuagagaaagcu

SEQ ID NO: 747470 - RNA, 22 nt, Human
uacugcagauggccuuguucuu

SEQ ID NO: 747471 - RNA, 22 nt, Human
uaggcaaguggaccagagguuu

SEQ ID NO: 747472 - RNA, 22 nt, Human
aggugccacucucaugggcuac

SEQ ID NO: 747473 - RNA, 22 nt, Human
ugacaaagaccuucaacaagau

SEQ ID NO: 747474 - RNA, 22 nt, Human
ggacacuggccacauuucaaaa

SEQ ID NO: 747475 - RNA, 21 nt, Human
aagcuguguuccacugauagc

SEQ ID NO: 747476 - RNA, 22 nt, Human
cggcuggaagcuggacaggccg

SEQ ID NO: 747477 - RNA, 22 nt, Human
cagcagccacuagagggcucac

SEQ ID NO: 747478 - RNA, 22 nt, Human
auuucuugccccugcucccuga

SEQ ID NO: 747479 - RNA, 22 nt, Human
ugagagcugggaaauguuagcu

SEQ ID NO: 747480 - RNA, 22 nt, Human
uccuccaggcaccucacuggcu

SEQ ID NO: 747481 - RNA, 22 nt, Human
gcugcugcgcuugucuacuguu

SEQ ID NO: 747482 - RNA, 21 nt, Human
uaagugcaaagagacagauac

SEQ ID NO: 747483 - RNA, 22 nt, Human
agccagggagguggagguugca

SEQ ID NO: 747484 - RNA, 22 nt, Human
uuggcauaccuuagugguggag

SEQ ID NO: 747485 - RNA, 22 nt, Human
aagugcauaauaacucccaagu

SEQ ID NO: 747486 - RNA, 22 nt, Human
gugggaugguagguagguaaua

SEQ ID NO: 747487 - RNA, 22 nt, Human
ugauggcuccuucauuaugggu

SEQ ID NO: 747488 - RNA, 22 nt, Human
cugcuggagguuggagcaugca

SEQ ID NO: 747489 - RNA, 22 nt, Human
aggcuggagagugcaguggcgu

SEQ ID NO: 747490 - RNA, 22 nt, Human
aagagguucuccuuggaguggg

SEQ ID NO: 747491 - RNA, 22 nt, Human
gcucagggaaugagaagauguu

SEQ ID NO: 747492 - RNA, 22 nt, Human
ugcuucaggaagaaacgccagg

SEQ ID NO: 747493 - RNA, 22 nt, Human
aaauugcugugaggugguagua

SEQ ID NO: 747494 - RNA, 23 nt, Human
ccugucugugcuggguggacaca

SEQ ID NO: 747495 - RNA, 22 nt, Human
cugaagcauaucaugccaaguu

SEQ ID NO: 747496 - RNA, 22 nt, Human
gggaagugugcagaguucucuu

SEQ ID NO: 747497 - RNA, 22 nt, Human
ugcccagcuucuuacuuuuaaa

SEQ ID NO: 747498 - RNA, 22 nt, Human
uuggcacuucacgagacagcua

SEQ ID NO: 747499 - RNA, 22 nt, Human
ggcucuggugaggguaggagau

SEQ ID NO: 747500 - RNA, 22 nt, Human
ucugggucuaucccaugccuuu

SEQ ID NO: 747501 - RNA, 22 nt, Human
uacaguaaccagucuacuuaga

SEQ ID NO: 747502 - RNA, 22 nt, Human
uggggcuguggauucucacgaa

SEQ ID NO: 747503 - RNA, 23 nt, Human
uggccacaguccaugcaugccca

SEQ ID NO: 747504 - RNA, 22 nt, Human
uuacagaaaagggcuuuaagag

SEQ ID NO: 747505 - RNA, 18 nt, Human
ccagagggugcgucagcu

SEQ ID NO: 747506 - RNA, 22 nt, Human
aaguauaagcuauucuucauga

SEQ ID NO: 747507 - RNA, 22 nt, Human
acugcaggccuuggugccagca

SEQ ID NO: 747508 - RNA, 22 nt, Human
gauagcugcugggauauuuuua

SEQ ID NO: 747509 - RNA, 22 nt, Human
ggccuguguccuccuugcccug

SEQ ID NO: 747510 - RNA, 22 nt, Human
aaauggcaacagaagggaguuc

SEQ ID NO: 747511 - RNA, 22 nt, Human
aaaagagccacuuaugaccuca

SEQ ID NO: 747512 - RNA, 22 nt, Human
gagcagcucugggugacccagu

SEQ ID NO: 747513 - RNA, 22 nt, Human
guuguaaauacagcagauaauu

SEQ ID NO: 747514 - RNA, 17 nt, Human
ugguggcuggagucagg

SEQ ID NO: 747515 - RNA, 22 nt, Human
guuuccugacuguggaauuaua

SEQ ID NO: 747516 - RNA, 22 nt, Human
agagccugucugccuuucuacc

SEQ ID NO: 747517 - RNA, 22 nt, Human
uggcacgacaauuggcaccaau

SEQ ID NO: 747518 - RNA, 22 nt, Human
aaagcaguauaguggaagggcu

SEQ ID NO: 747519 - RNA, 22 nt, Human
uggauuaguuuaacaauguggc

SEQ ID NO: 747520 - RNA, 15 nt, Human
cagucccagggaccc

SEQ ID NO: 747521 - RNA, 22 nt, Human
uauuuugaaagucuguuuugaa

SEQ ID NO: 747522 - RNA, 19 nt, Human
aucugccuuagugcugcug

SEQ ID NO: 747523 - RNA, 22 nt, Human
acauacaugggauuaaaaaauu

SEQ ID NO: 747524 - RNA, 22 nt, Human
uuguauauauucuuaaagaugu

SEQ ID NO: 747525 - RNA, 22 nt, Human
gccuguccacuaaacagccaag

SEQ ID NO: 747526 - RNA, 22 nt, Human
ucugggaaauggcuacuuguca

SEQ ID NO: 747527 - RNA, 22 nt, Human
aaacagacugcacugccaguca

SEQ ID NO: 747528 - RNA, 22 nt, Human
aggucacagcuuucucgugagg

SEQ ID NO: 747529 - RNA, 22 nt, Human
aggaaacauccuuaucuauucu

SEQ ID NO: 747530 - RNA, 22 nt, Human
cuccugcuccugcuugcaagga

SEQ ID NO: 747531 - RNA, 22 nt, Human
aggcuccauucaugugaaggca

SEQ ID NO: 747532 - RNA, 21 nt, Human
gcaugaaaacagccugugcuc

SEQ ID NO: 747533 - RNA, 21 nt, Human
cugucccucuuugcuucccuc

SEQ ID NO: 747534 - RNA, 22 nt, Human
uguuuacacaauagucucucuc

SEQ ID NO: 747535 - RNA, 22 nt, Human
uuugaagggcacgacaauaguu

SEQ ID NO: 747536 - RNA, 22 nt, Human
aaagaagacagacauuucuuuc

SEQ ID NO: 747537 - RNA, 21 nt, Human
uaauauagguucacaacuagu

SEQ ID NO: 747538 - RNA, 17 nt, Human
aaacuucauucucagga

SEQ ID NO: 747539 - RNA, 22 nt, Human
agcgcgcucgaugguuuccgcg

SEQ ID NO: 747540 - RNA, 22 nt, Human
uucaaaauccgggaggcgcccc

SEQ ID NO: 747541 - RNA, 22 nt, Human
ugaggcucagagcaccugcucc

SEQ ID NO: 747542 - RNA, 19 nt, Human
uccugaaaacuucuggaau

SEQ ID NO: 747543 - RNA, 22 nt, Human
augucugucaucuuccaggaag

SEQ ID NO: 747544 - RNA, 22 nt, Human
uuaugacagaaaugaaaagcug

SEQ ID NO: 747545 - RNA, 22 nt, Human
aaagaguucuguuugagcugaa

SEQ ID NO: 747546 - RNA, 22 nt, Human
auucuucucuggguuggguuca

SEQ ID NO: 747547 - RNA, 22 nt, Human
ccuggccacccagccuuggcca

SEQ ID NO: 747548 - RNA, 22 nt, Human
cuguuauucaagacaaaggcag

SEQ ID NO: 747549 - RNA, 22 nt, Human
uggguaggugcuggggauucag

SEQ ID NO: 747550 - RNA, 22 nt, Human
cugggcacagcguugggcucuu

SEQ ID NO: 747551 - RNA, 22 nt, Human
uaguacaguuuaaauauuaaua

SEQ ID NO: 747552 - RNA, 22 nt, Human
uuucacacugcagcaucagaga

SEQ ID NO: 747553 - RNA, 22 nt, Human
gaaacugaauauaagaaaggua

SEQ ID NO: 747554 - RNA, 20 nt, Human
gcuuuuucuaauagcagucc

SEQ ID NO: 747555 - RNA, 20 nt, Human
agguccacugaggcugccuc

SEQ ID NO: 747556 - RNA, 22 nt, Human
accaggcaaaaccacaggagca

SEQ ID NO: 747557 - RNA, 22 nt, Human
uuggccuucccuaccugggcca

SEQ ID NO: 747558 - RNA, 18 nt, Human
agugcaugcuaggggaag

SEQ ID NO: 747559 - RNA, 22 nt, Human
auuacacuaaugugacaacaau

SEQ ID NO: 747560 - RNA, 22 nt, Human
aaguacauauauuuaugauucu

SEQ ID NO: 747561 - RNA, 22 nt, Human
uugacaauugggagauauaaag

SEQ ID NO: 747562 - RNA, 22 nt, Human
cucacugacgaggaagcugaga

SEQ ID NO: 747563 - RNA, 22 nt, Human
cacauacaugcacaccuaaaua

SEQ ID NO: 747564 - RNA, 22 nt, Human
uucagacuagacacauuucaag

SEQ ID NO: 747565 - RNA, 22 nt, Human
aauagaauguaaucuaauacau

SEQ ID NO: 747566 - RNA, 22 nt, Human
aaagguuuuauguuuuccacuu

SEQ ID NO: 747567 - RNA, 22 nt, Human
gugcaggagguaacauagcaaa

SEQ ID NO: 747568 - RNA, 22 nt, Human
ugugaguuauuuucaggaguuu

SEQ ID NO: 747569 - RNA, 22 nt, Human
uagggaccuuagaauuguaugu

SEQ ID NO: 747570 - RNA, 16 nt, Human
agugggaggagaaaga

SEQ ID NO: 747571 - RNA, 22 nt, Human
gcuugucucucagccccaguca

SEQ ID NO: 747572 - RNA, 21 nt, Human
agacagagugcagucuacaua

SEQ ID NO: 747573 - RNA, 22 nt, Human
ugaggugagucaugcauuggag

SEQ ID NO: 747574 - RNA, 22 nt, Human
ggacccagguagggaggaagau

SEQ ID NO: 747575 - RNA, 20 nt, Human
gcaauuaauuuuugguuaca

SEQ ID NO: 747576 - RNA, 22 nt, Human
ugcuucagugugucauuauuua

SEQ ID NO: 747577 - RNA, 22 nt, Human
agagguggagcucuuggcauca

SEQ ID NO: 747578 - RNA, 22 nt, Human
cuuacacacuagaugguaggug

SEQ ID NO: 747579 - RNA, 22 nt, Human
ggguugaggcggaugucggcgg

SEQ ID NO: 747580 - RNA, 22 nt, Human
ucuccaggggcagggucuggag

SEQ ID NO: 747581 - RNA, 22 nt, Human
uuucuaacguagacagggaggu

SEQ ID NO: 747582 - RNA, 22 nt, Human
acgggccuucucuucaggcgag

SEQ ID NO: 747583 - RNA, 22 nt, Human
ugacagaggcugaguuagucug

SEQ ID NO: 747584 - RNA, 22 nt, Human
aggcuggccuauuucuuuaucg

SEQ ID NO: 747585 - RNA, 23 nt, Human
agugugacuuuuuugacugucac

SEQ ID NO: 747586 - RNA, 16 nt, Human
agcagaggugagugaa

SEQ ID NO: 747587 - RNA, 22 nt, Human
uuuauuuauaagccacuugcug

SEQ ID NO: 747588 - RNA, 22 nt, Human
gaggagcacaugaggcugaggg

SEQ ID NO: 747589 - RNA, 22 nt, Human
gcccaggaaaugccccguggug

SEQ ID NO: 747590 - RNA, 22 nt, Human
auuccacagcuacaucaaucua

SEQ ID NO: 747591 - RNA, 22 nt, Human
ugcccaagccgagcucucuguu

SEQ ID NO: 747592 - RNA, 22 nt, Human
acauugcugcauucuccuuccc

SEQ ID NO: 747593 - RNA, 22 nt, Human
uccaguggcaccuuggcccuca

SEQ ID NO: 747594 - RNA, 21 nt, Human
ucaggggcuguguuuuccauc

SEQ ID NO: 747595 - RNA, 22 nt, Human
gaggcucagagaagucauggua

SEQ ID NO: 747596 - RNA, 22 nt, Human
ccucagcuugauuucugcagag

SEQ ID NO: 747597 - RNA, 22 nt, Human
gugauuuucuccuccuagaagu

SEQ ID NO: 747598 - RNA, 22 nt, Human
ucuauacacacaaagaaugcuu

SEQ ID NO: 747599 - RNA, 22 nt, Human
uuggcuucugauguauuccuga

SEQ ID NO: 747600 - RNA, 22 nt, Human
aggcauggacauuucggcagcu

SEQ ID NO: 747601 - RNA, 22 nt, Human
uggcuguguuaccacuucaugu

SEQ ID NO: 747602 - RNA, 21 nt, Human
uccugcaggaggccugagagg

SEQ ID NO: 747603 - RNA, 22 nt, Human
auuucccaauacgcuaagugga

SEQ ID NO: 747604 - RNA, 18 nt, Human
cuuucaguaauuucagcc

SEQ ID NO: 747605 - RNA, 21 nt, Human
aaauucaccuaguaaaacuuc

SEQ ID NO: 747606 - RNA, 22 nt, Human
aauguccuaggcaugauuuugu

SEQ ID NO: 747607 - RNA, 22 nt, Human
cugugggaugggaccucagcug

SEQ ID NO: 747608 - RNA, 19 nt, Human
uggucuaaaugugugcccc

SEQ ID NO: 747609 - RNA, 22 nt, Human
agcccagagacaaugcucagua

SEQ ID NO: 747610 - RNA, 23 nt, Human
cuuucauugugguuucacagagc

SEQ ID NO: 747611 - RNA, 22 nt, Human
gggcucucaaggcagggcccca

SEQ ID NO: 747612 - RNA, 22 nt, Human
augcugaauaguucacucuucu

SEQ ID NO: 747613 - RNA, 22 nt, Human
ucacauaaauuuaccagaugau

SEQ ID NO: 747614 - RNA, 21 nt, Human
cccuucuugggucaaaguaua

SEQ ID NO: 747615 - RNA, 22 nt, Human
ggcuuugcauuuugauggaggu

SEQ ID NO: 747616 - RNA, 22 nt, Human
uggcuccucuucuggguguccc

SEQ ID NO: 747617 - RNA, 22 nt, Human
uggcagccacaucucguggauu

SEQ ID NO: 747618 - RNA, 22 nt, Human
aacuaaaggcuguugcagggaa

SEQ ID NO: 747619 - RNA, 20 nt, Human
uccugagaggcucuuggaga

SEQ ID NO: 747620 - RNA, 22 nt, Human
augcauaugcaaugcacaauuu

SEQ ID NO: 747621 - RNA, 21 nt, Human
uccuccuguagaggguccugg

SEQ ID NO: 747622 - RNA, 23 nt, Human
agccucagccgguggcagaagug

SEQ ID NO: 747623 - RNA, 22 nt, Human
ugucugugaccucuuuggagcc

SEQ ID NO: 747624 - RNA, 22 nt, Human
gccuucagcccugacuggccag

SEQ ID NO: 747625 - RNA, 22 nt, Human
uacagagacuuuauggcacaaa

SEQ ID NO: 747626 - RNA, 22 nt, Human
ucucuguggcaacuacuuagcu

SEQ ID NO: 747627 - RNA, 22 nt, Human
uaggggaggggaucaugugcug

SEQ ID NO: 747628 - RNA, 22 nt, Human
uuaggucuguuuauaaaacagu

SEQ ID NO: 747629 - RNA, 22 nt, Human
uggcgaggccaggccagggccu

SEQ ID NO: 747630 - RNA, 22 nt, Human
gcagccacagaggagggaugca

SEQ ID NO: 747631 - RNA, 18 nt, Human
cacauuuaccuggcuccc

SEQ ID NO: 747632 - RNA, 18 nt, Human
augggaggggccaagaga

SEQ ID NO: 747633 - RNA, 22 nt, Human
gccauuuagggaggcaagguga

SEQ ID NO: 747634 - RNA, 22 nt, Human
caggcuggagugcagugucgcc

SEQ ID NO: 747635 - RNA, 22 nt, Human
cuuugcagcaauuucuguuaaa

SEQ ID NO: 747636 - RNA, 22 nt, Human
auacacuggacaucauugcauu

SEQ ID NO: 747637 - RNA, 22 nt, Human
aagcauuucagguagagauauu

SEQ ID NO: 747638 - RNA, 22 nt, Human
ugggagugauacaguauggaau

SEQ ID NO: 747639 - RNA, 22 nt, Human
augcuuuuccaggagaaauaua

SEQ ID NO: 747640 - RNA, 22 nt, Human
ucuccaggagcaagucacccag

SEQ ID NO: 747641 - RNA, 22 nt, Human
ugcuuuaucugacuuggcgcug

SEQ ID NO: 747642 - RNA, 22 nt, Human
acucagaguuugcguuccauac

SEQ ID NO: 747643 - RNA, 22 nt, Human
aggccagcccucaccuguguuc

SEQ ID NO: 747644 - RNA, 22 nt, Human
agaguuggccaaaaggggcauu

SEQ ID NO: 747645 - RNA, 22 nt, Human
ccucaagaacaauccaccauua

SEQ ID NO: 747646 - RNA, 22 nt, Human
aacaugcuaugugucugaauca

SEQ ID NO: 747647 - RNA, 22 nt, Human
ggguggagugugaaaucuggcu

SEQ ID NO: 747648 - RNA, 22 nt, Human
gagguggcuuagucucuggaca

SEQ ID NO: 747649 - RNA, 22 nt, Human
gcagucacagggagauggugac

SEQ ID NO: 747650 - RNA, 22 nt, Human
gcuguggcucucacaagcaaau

SEQ ID NO: 747651 - RNA, 22 nt, Human
agaggcccucucugcucagucu

SEQ ID NO: 747652 - RNA, 22 nt, Human
agguuccaggucuggguuaugu

SEQ ID NO: 747653 - RNA, 19 nt, Human
aucauugaucuucaccccu

SEQ ID NO: 747654 - RNA, 21 nt, Human
acagcagagaucaagacuaag

SEQ ID NO: 747655 - RNA, 22 nt, Human
auugagaaucugagagccuagg

SEQ ID NO: 747656 - RNA, 22 nt, Human
uacauuccacuagugacuggcg

SEQ ID NO: 747657 - RNA, 22 nt, Human
cuccaggauaccuguuccuaua

SEQ ID NO: 747658 - RNA, 18 nt, Human
uuauuuguuacagcacau

SEQ ID NO: 747659 - RNA, 21 nt, Human
gagugucuaauccaggcuguc

SEQ ID NO: 747660 - RNA, 22 nt, Human
ccugcagaugugggacagcugu

SEQ ID NO: 747661 - RNA, 22 nt, Human
ccaggaggcggaagguacagug

SEQ ID NO: 747662 - RNA, 22 nt, Human
acaggagacccugcugguucug

SEQ ID NO: 747663 - RNA, 22 nt, Human
ugugccaagacuauauugugcu

SEQ ID NO: 747664 - RNA, 22 nt, Human
auaaacaguaaaugugagcagu

SEQ ID NO: 747665 - RNA, 22 nt, Human
aaugccaucagagaaaacucuu

SEQ ID NO: 747666 - RNA, 22 nt, Human
ugugcucuguggaucugagcaa

SEQ ID NO: 747667 - RNA, 22 nt, Human
cacugcuugauugacaugcacg

SEQ ID NO: 747668 - RNA, 22 nt, Human
aggauguguuuugagcugacua

SEQ ID NO: 747669 - RNA, 22 nt, Human
cacaggugcaagaaguugcagu

SEQ ID NO: 747670 - RNA, 22 nt, Human
ucuguaggguaguaguggagau

SEQ ID NO: 747671 - RNA, 22 nt, Human
uugacaguugaggguugucuaa

SEQ ID NO: 747672 - RNA, 22 nt, Human
ggcugcuggggacgugggagag

SEQ ID NO: 747673 - RNA, 22 nt, Human
cucugagaauaugagcucuuug

SEQ ID NO: 747674 - RNA, 22 nt, Human
acaaguuucauuguuuagaacc

SEQ ID NO: 747675 - RNA, 22 nt, Human
uguuuucacaaugaugucagau

SEQ ID NO: 747676 - RNA, 22 nt, Human
ugguuucucagacucuuugcag

SEQ ID NO: 747677 - RNA, 20 nt, Human
uacagaaacaggacuuuugg

SEQ ID NO: 747678 - RNA, 22 nt, Human
agagucagacuaagccauggug

SEQ ID NO: 747679 - RNA, 22 nt, Human
ugguaucagagccaucuguauu

SEQ ID NO: 747680 - RNA, 22 nt, Human
gucuacacugaauuuccacaga

SEQ ID NO: 747681 - RNA, 22 nt, Human
agagguucagagaaggcgaucu

SEQ ID NO: 747682 - RNA, 22 nt, Human
cuguguggacugguugaggccc

SEQ ID NO: 747683 - RNA, 22 nt, Human
gugugggacgggugaguggcca

SEQ ID NO: 747684 - RNA, 21 nt, Human
ugcuuugcucguucccagagu

SEQ ID NO: 747685 - RNA, 22 nt, Human
aggucaaaccacagcucuaggc

SEQ ID NO: 747686 - RNA, 22 nt, Human
aacagcaggcauuucuuagcuc

SEQ ID NO: 747687 - RNA, 22 nt, Human
gggaccuggcaccuuugcucug

SEQ ID NO: 747688 - RNA, 22 nt, Human
ugaaagcuguccacuaggcugu

SEQ ID NO: 747689 - RNA, 23 nt, Human
agcuuuggugaugugacagauaa

SEQ ID NO: 747690 - RNA, 18 nt, Human
gaguuuagguuguagaau

SEQ ID NO: 747691 - RNA, 22 nt, Human
ggaaagauuugucacaugaaug

SEQ ID NO: 747692 - RNA, 22 nt, Human
accugaggacuggaugguagaa

SEQ ID NO: 747693 - RNA, 22 nt, Human
ggagcugaaggggugggcucag

SEQ ID NO: 747694 - RNA, 22 nt, Human
uuaagguugagcucacuuuuau

SEQ ID NO: 747695 - RNA, 22 nt, Human
gcaagcaaguaucuggcaggga

SEQ ID NO: 747696 - RNA, 22 nt, Human
ucaagaaagggcuucaccagga

SEQ ID NO: 747697 - RNA, 22 nt, Human
acaugauauuaaugucuuauuu

SEQ ID NO: 747698 - RNA, 22 nt, Human
ccugggagcuguggaaaggcug

SEQ ID NO: 747699 - RNA, 22 nt, Human
ggggccagagaggacccaggug

SEQ ID NO: 747700 - RNA, 22 nt, Human
acacccaggaauaaggacuggg

SEQ ID NO: 747701 - RNA, 22 nt, Human
ggacugggccagggguuggacu

SEQ ID NO: 747702 - RNA, 22 nt, Human
uacacaucccagacucccagga

SEQ ID NO: 747703 - RNA, 22 nt, Human
auaccauggcaguuuauucacg

SEQ ID NO: 747704 - RNA, 22 nt, Human
caugcuuugggucagaaaugcc

SEQ ID NO: 747705 - RNA, 21 nt, Human
uaaacauaaccuuguauggcu

SEQ ID NO: 747706 - RNA, 22 nt, Human
uggcaaagugacuccuuggggc

SEQ ID NO: 747707 - RNA, 22 nt, Human
agugcaauagcaaagaacaaca

SEQ ID NO: 747708 - RNA, 22 nt, Human
uacauuguucaugcaugagaaa

SEQ ID NO: 747709 - RNA, 22 nt, Human
gcagcugucacuuucacaaugc

SEQ ID NO: 747710 - RNA, 22 nt, Human
uaggaagauaaacauuuguaug

SEQ ID NO: 747711 - RNA, 22 nt, Human
ggaagaaaucugguuaagagau

SEQ ID NO: 747712 - RNA, 22 nt, Human
uuccugugcuuaauucucacug

SEQ ID NO: 747713 - RNA, 22 nt, Human
auuuacacuugguuuacuagag

SEQ ID NO: 747714 - RNA, 19 nt, Human
ggagucugagcccagguau

SEQ ID NO: 747715 - RNA, 22 nt, Human
caacuacaggaaaagucauuca

SEQ ID NO: 747716 - RNA, 19 nt, Human
ccaggacuuugcagacacu

SEQ ID NO: 747717 - RNA, 17 nt, Human
caguggccuauggcuuu

SEQ ID NO: 747718 - RNA, 22 nt, Human
aaagggccuccgccugggcagg

SEQ ID NO: 747719 - RNA, 22 nt, Human
uuucacauuuaggcgugaauug

SEQ ID NO: 747720 - RNA, 22 nt, Human
uaagaggauauuuggccagaag

SEQ ID NO: 747721 - RNA, 22 nt, Human
cugggccagggaggugucugua

SEQ ID NO: 747722 - RNA, 22 nt, Human
uccuccuccucacagucaccug

SEQ ID NO: 747723 - RNA, 22 nt, Human
gaagcagcaaguauaggacagg

SEQ ID NO: 747724 - RNA, 22 nt, Human
ucaaaacaacacucagguguaa

SEQ ID NO: 747725 - RNA, 22 nt, Human
cccaggaggcagagcuugcagu

SEQ ID NO: 747726 - RNA, 22 nt, Human
ugcuuucuguuuuucauauaau

SEQ ID NO: 747727 - RNA, 22 nt, Human
uucuagggaaugggaugaggau

SEQ ID NO: 747728 - RNA, 22 nt, Human
cagaggugcuggagugaguccu

SEQ ID NO: 747729 - RNA, 22 nt, Human
ugcagguaggccugacuuccag

SEQ ID NO: 747730 - RNA, 23 nt, Human
uaaagugcugauggugagggagc

SEQ ID NO: 747731 - RNA, 22 nt, Human
gucuucuuguguugccugucuu

SEQ ID NO: 747732 - RNA, 22 nt, Human
uguucacaagaugucuguggcu

SEQ ID NO: 747733 - RNA, 22 nt, Human
auucagaaagcaagugcugggu

SEQ ID NO: 747734 - RNA, 22 nt, Human
ggguaggcucugcaggcugggu

SEQ ID NO: 747735 - RNA, 22 nt, Human
gucugugugcacagagcuuugg

SEQ ID NO: 747736 - RNA, 22 nt, Human
cguugugagcuugguagacacu

SEQ ID NO: 747737 - RNA, 22 nt, Human
ugggccaggcaugugaucagca

SEQ ID NO: 747738 - RNA, 22 nt, Human
aacacagaagugccaagagcca

SEQ ID NO: 747739 - RNA, 22 nt, Human
ucugcccaguuugugcucaggu

SEQ ID NO: 747740 - RNA, 22 nt, Human
uucauugauuuccuuggaauaa

SEQ ID NO: 747741 - RNA, 22 nt, Human
aauugucuugaaagcaacacuu

SEQ ID NO: 747742 - RNA, 22 nt, Human
gcaagcaguucgcagcccgccu

SEQ ID NO: 747743 - RNA, 22 nt, Human
ugucuauuaauuccacauaaaa

SEQ ID NO: 747744 - RNA, 22 nt, Human
ucauccuggagaagcuccuucg

SEQ ID NO: 747745 - RNA, 23 nt, Human
ugagcaucacaggagaaccaggc

SEQ ID NO: 747746 - RNA, 22 nt, Human
aguggagugaguggcagaagga

SEQ ID NO: 747747 - RNA, 22 nt, Human
gagcaucugugguccaucagaa

SEQ ID NO: 747748 - RNA, 22 nt, Human
aacuuaguuuaggguauugauu

SEQ ID NO: 747749 - RNA, 22 nt, Human
caggugccauagacgggccugg

SEQ ID NO: 747750 - RNA, 22 nt, Human
augugucuggcauggcucuauu

SEQ ID NO: 747751 - RNA, 22 nt, Human
uagggcaauauuucccagaaaa

SEQ ID NO: 747752 - RNA, 22 nt, Human
uccaccacuuccugcagccauu

SEQ ID NO: 747753 - RNA, 22 nt, Human
caggggccuggcugucuaggaa

SEQ ID NO: 747754 - RNA, 23 nt, Human
uguguucucacacagaugcagua

SEQ ID NO: 747755 - RNA, 22 nt, Human
auauacacauguguauacauuu

SEQ ID NO: 747756 - RNA, 22 nt, Human
agcacuguuaugggaugacuua

SEQ ID NO: 747757 - RNA, 22 nt, Human
ccuguggcugccacuuggguga

SEQ ID NO: 747758 - RNA, 22 nt, Human
uguacuuccccaaugacagcac

SEQ ID NO: 747759 - RNA, 22 nt, Human
cagcccagcacuaaguagauuu

SEQ ID NO: 747760 - RNA, 22 nt, Human
auuucucacucacaguccaugu

SEQ ID NO: 747761 - RNA, 19 nt, Human
aguuauugaucuauucagg

SEQ ID NO: 747762 - RNA, 22 nt, Human
gcugaauaagagucuacuuugc

SEQ ID NO: 747763 - RNA, 18 nt, Human
guguaaacagccauugag

SEQ ID NO: 747764 - RNA, 22 nt, Human
uucaguguacagugaagggauu

SEQ ID NO: 747765 - RNA, 22 nt, Human
aggaagggauacauaggauagu

SEQ ID NO: 747766 - RNA, 22 nt, Human
uucaaacaguugcacaacuuau

SEQ ID NO: 747767 - RNA, 22 nt, Human
ugauuuuuagcuauucugaaga

SEQ ID NO: 747768 - RNA, 22 nt, Human
uaaauggcaaccccuagagcug

SEQ ID NO: 747769 - RNA, 22 nt, Human
auucagucaaaaaugauggaga

SEQ ID NO: 747770 - RNA, 22 nt, Human
guccucaguaagagggccucug

SEQ ID NO: 747771 - RNA, 16 nt, Human
ugggugggaggagcgg

SEQ ID NO: 747772 - RNA, 22 nt, Human
uugggggguugaggaguagaua

SEQ ID NO: 747773 - RNA, 22 nt, Human
gccuggaaucaugcagggguua

SEQ ID NO: 747774 - RNA, 22 nt, Human
cacccacauggaaauucacagu

SEQ ID NO: 747775 - RNA, 22 nt, Human
ccucagacucagugcguuguga

SEQ ID NO: 747776 - RNA, 22 nt, Human
ggggugagaucaaggaagcccu

SEQ ID NO: 747777 - RNA, 22 nt, Human
aacaaugucucauccuaugugg

SEQ ID NO: 747778 - RNA, 22 nt, Human
ucugucucucaagggccguccu

SEQ ID NO: 747779 - RNA, 22 nt, Human
aaaaggcuaauccagagcaacu

SEQ ID NO: 747780 - RNA, 22 nt, Human
caguguucccugaacauauguu

SEQ ID NO: 747781 - RNA, 22 nt, Human
cucagagggaggacugggcugg

SEQ ID NO: 747782 - RNA, 22 nt, Human
ucuccuggcucaccaggcugga

SEQ ID NO: 747783 - RNA, 22 nt, Human
auucagaaagauaugccugguu

SEQ ID NO: 747784 - RNA, 22 nt, Human
gagucccaggauaugugcuguu

SEQ ID NO: 747785 - RNA, 21 nt, Human
ucacaucuauguuaagcaaac

SEQ ID NO: 747786 - RNA, 22 nt, Human
aguauuucuaguugguucuacu

SEQ ID NO: 747787 - RNA, 22 nt, Human
ugagggagcugaccuuucugug

SEQ ID NO: 747788 - RNA, 22 nt, Human
gggcccugccccguggcucuga

SEQ ID NO: 747789 - RNA, 22 nt, Human
gcccugagaggcaaugacucuu

SEQ ID NO: 747790 - RNA, 22 nt, Human
cagcaccuuccuuaacuccagg

SEQ ID NO: 747791 - RNA, 22 nt, Human
aaaaaauuccauucugugccuu

SEQ ID NO: 747792 - RNA, 17 nt, Human
gugaauggcauagucgg

SEQ ID NO: 747793 - RNA, 21 nt, Human
uagcagagaguuaacuucucc

SEQ ID NO: 747794 - RNA, 22 nt, Human
ggcucaccauuuucacucucug

SEQ ID NO: 747795 - RNA, 22 nt, Human
ugggagaagagaaauuacugcc

SEQ ID NO: 747796 - RNA, 22 nt, Human
aaaggaauauucaaaacaguca

SEQ ID NO: 747797 - RNA, 22 nt, Human
gggcccuggcuuuccuguucuu

SEQ ID NO: 747798 - RNA, 21 nt, Human
ggccagcagcguccacugugg

SEQ ID NO: 747799 - RNA, 22 nt, Human
uagaauaugugguaggaucugg

SEQ ID NO: 747800 - RNA, 22 nt, Human
gggucagaguucaggucgaggg

SEQ ID NO: 747801 - RNA, 22 nt, Human
acaaagauguuuaaagcauuua

SEQ ID NO: 747802 - RNA, 22 nt, Human
ucuuuacaguccucugucaauc

SEQ ID NO: 747803 - RNA, 22 nt, Human
gaacauuuggauuuguaaauuu

SEQ ID NO: 747804 - RNA, 18 nt, Human
aaguuccacaagagaucu

SEQ ID NO: 747805 - RNA, 22 nt, Human
caauacacuaaacuucucugaa

SEQ ID NO: 747806 - RNA, 22 nt, Human
caggccaacugcauggugacca

SEQ ID NO: 747807 - RNA, 22 nt, Human
ucucccagaaguccucaguaca

SEQ ID NO: 747808 - RNA, 22 nt, Human
ucacacagugguaaaacccuga

SEQ ID NO: 747809 - RNA, 22 nt, Human
acccagucuggagugcagugac

SEQ ID NO: 747810 - RNA, 22 nt, Human
cuguggccccacccucuuggcc

SEQ ID NO: 747811 - RNA, 22 nt, Human
cuguuguaucauuuguucacau

SEQ ID NO: 747812 - RNA, 22 nt, Human
gaaacuguauguaguuuuuggg

SEQ ID NO: 747813 - RNA, 22 nt, Human
ucaggcuacacucuuuucaugg

SEQ ID NO: 747814 - RNA, 22 nt, Human
gccuggcaggccuguuggggcu

SEQ ID NO: 747815 - RNA, 21 nt, Human
agacugccauuguucuuuugg

SEQ ID NO: 747816 - RNA, 22 nt, Human
aggcaaaugauccugcuccuug

SEQ ID NO: 747817 - RNA, 20 nt, Human
cagcccuccaguggaggcag

SEQ ID NO: 747818 - RNA, 22 nt, Human
ugaguagcggcuauguguaacu

SEQ ID NO: 747819 - RNA, 22 nt, Human
ggucucaucuuucagcgucgag

SEQ ID NO: 747820 - RNA, 22 nt, Human
gggcuccaacuacaucagccuu

SEQ ID NO: 747821 - RNA, 22 nt, Human
agugucuguguuuucuauugcu

SEQ ID NO: 747822 - RNA, 18 nt, Human
ugguggugacagggucau

SEQ ID NO: 747823 - RNA, 22 nt, Human
uuuggcauagcucuuuguuccu

SEQ ID NO: 747824 - RNA, 22 nt, Human
uccaguggcacuggagacuaga

SEQ ID NO: 747825 - RNA, 22 nt, Human
ucuggcuuucauuuguuuaaag

SEQ ID NO: 747826 - RNA, 22 nt, Human
uaacagaaaggggacagaaaua

SEQ ID NO: 747827 - RNA, 22 nt, Human
gagcugggcacacgccacuuga

SEQ ID NO: 747828 - RNA, 22 nt, Human
aacaaagucguugccuagaaga

SEQ ID NO: 747829 - RNA, 22 nt, Human
uauuagguaaaggacuugcagg

SEQ ID NO: 747830 - RNA, 22 nt, Human
auuagcuauaugcuaugugcca

SEQ ID NO: 747831 - RNA, 22 nt, Human
gugcuucaaguucuuaauguuu

SEQ ID NO: 747832 - RNA, 22 nt, Human
agaaaaugugaacuugugaauu

SEQ ID NO: 747833 - RNA, 22 nt, Human
uuacagaagagaaagaauucag

SEQ ID NO: 747834 - RNA, 22 nt, Human
gcacagggaggcuggccuggcc

SEQ ID NO: 747835 - RNA, 22 nt, Human
agauacauggaacgucaaaccu

SEQ ID NO: 747836 - RNA, 19 nt, Human
agcaguuauaugcauggga

SEQ ID NO: 747837 - RNA, 22 nt, Human
gugggcagccuguccggagacc

SEQ ID NO: 747838 - RNA, 22 nt, Human
caguggcagagaacagagaccu

SEQ ID NO: 747839 - RNA, 22 nt, Human
uauguuaagugggauaaucaaa

SEQ ID NO: 747840 - RNA, 22 nt, Human
guguuuccucuagaagccaugg

SEQ ID NO: 747841 - RNA, 22 nt, Human
aaugcaaacagcccagaaucca

SEQ ID NO: 747842 - RNA, 22 nt, Human
aggcuucacucgacaugccaau

SEQ ID NO: 747843 - RNA, 22 nt, Human
acauggaagauaaaaauacuca

SEQ ID NO: 747844 - RNA, 22 nt, Human
ggcugucucugugacugccacc

SEQ ID NO: 747845 - RNA, 22 nt, Human
uggcuuuaggguuccuucuacc

SEQ ID NO: 747846 - RNA, 22 nt, Human
auuuugaaucaccuuggaagaa

SEQ ID NO: 747847 - RNA, 22 nt, Human
ugggcugcacugcucuuuaucg

SEQ ID NO: 747848 - RNA, 22 nt, Human
guauuauucucagcuuugggau

SEQ ID NO: 747849 - RNA, 22 nt, Human
uguuaauauacuaaaauccacu

SEQ ID NO: 747850 - RNA, 22 nt, Human
gagcccugugauucuguugugu

SEQ ID NO: 747851 - RNA, 22 nt, Human
ccuggcucuagaggccacuccu

SEQ ID NO: 747852 - RNA, 22 nt, Human
cacaggagaacccacagauucu

SEQ ID NO: 747853 - RNA, 22 nt, Human
acaugauauaugggaaaugcuu

SEQ ID NO: 747854 - RNA, 22 nt, Human
gguccguuuuugaagacagugg

SEQ ID NO: 747855 - RNA, 22 nt, Human
agggcuggagccacagcuggga

SEQ ID NO: 747856 - RNA, 22 nt, Human
cacagcuuugcuuuccuuaaua

SEQ ID NO: 747857 - RNA, 22 nt, Human
ugcagaguggauucuguauacc

SEQ ID NO: 747858 - RNA, 22 nt, Human
cccugagcagucugcagagagc

SEQ ID NO: 747859 - RNA, 22 nt, Human
gcugugauugucagucuucaau

SEQ ID NO: 747860 - RNA, 22 nt, Human
gaagcugggucgcugggauccu

SEQ ID NO: 747861 - RNA, 22 nt, Human
ugagccaggguuuccggcugcu

SEQ ID NO: 747862 - RNA, 19 nt, Human
caguccuuuccgcuuucuc

SEQ ID NO: 747863 - RNA, 22 nt, Human
cgagugucugcuaugggcugag

SEQ ID NO: 747864 - RNA, 22 nt, Human
cauggaacaaggaagauguuug

SEQ ID NO: 747865 - RNA, 22 nt, Human
cuguggcuucugggucaguuca

SEQ ID NO: 747866 - RNA, 22 nt, Human
aaauacaguggcagcagauaau

SEQ ID NO: 747867 - RNA, 22 nt, Human
ucacaaaugaccaugguuacua

SEQ ID NO: 747868 - RNA, 22 nt, Human
uggcacagacauuuaauagccu

SEQ ID NO: 747869 - RNA, 22 nt, Human
uggauuauuguaagacaaagua

SEQ ID NO: 747870 - RNA, 22 nt, Human
caaacauuccgcuucucccagg

SEQ ID NO: 747871 - RNA, 22 nt, Human
auaguacacauccuacaauguu

SEQ ID NO: 747872 - RNA, 22 nt, Human
cagaggcugacccugcuguugu

SEQ ID NO: 747873 - RNA, 19 nt, Human
ucagcagcacugugauuuc

SEQ ID NO: 747874 - RNA, 22 nt, Human
guuuguguaacaugaugaugau

SEQ ID NO: 747875 - RNA, 22 nt, Human
ugagaaggcucaggcuuagaga

SEQ ID NO: 747876 - RNA, 22 nt, Human
aguguuuuuggguagggugagu

SEQ ID NO: 747877 - RNA, 21 nt, Human
gggguuggcaagagcagagac

SEQ ID NO: 747878 - RNA, 22 nt, Human
gggagcugccuuagaccggagg

SEQ ID NO: 747879 - RNA, 22 nt, Human
uuucaucugugcugccaagacu

SEQ ID NO: 747880 - RNA, 22 nt, Human
ucacuugacuccaguuucuucu

SEQ ID NO: 747881 - RNA, 22 nt, Human
guaauccaaaguaacauuaaac

SEQ ID NO: 747882 - RNA, 22 nt, Human
augggguggaguccgggcagcg

SEQ ID NO: 747883 - RNA, 22 nt, Human
aaaugcauguagaauaauagag

SEQ ID NO: 747884 - RNA, 22 nt, Human
uaacaucuuaacuggauacuuc

SEQ ID NO: 747885 - RNA, 22 nt, Human
uaaagcaaggcaaauuguuggu

SEQ ID NO: 747886 - RNA, 22 nt, Human
uuuguaaaagcccaagcuguag

SEQ ID NO: 747887 - RNA, 22 nt, Human
ucucaggcugacauugggacuc

SEQ ID NO: 747888 - RNA, 22 nt, Human
uuagaaucuaacauucuuaucu

SEQ ID NO: 747889 - RNA, 21 nt, Human
uucucagaucgaguagugaga

SEQ ID NO: 747890 - RNA, 21 nt, Human
aacauuucugggagaacucac

SEQ ID NO: 747891 - RNA, 22 nt, Human
uugcuuuacuuugccauucguu

SEQ ID NO: 747892 - RNA, 22 nt, Human
gaggcugugugucccucuggac

SEQ ID NO: 747893 - RNA, 22 nt, Human
agcuguggaaaucaggcaauga

SEQ ID NO: 747894 - RNA, 22 nt, Human
aagacagagacucugcaacagg

SEQ ID NO: 747895 - RNA, 22 nt, Human
agcaguccaacugagguggcau

SEQ ID NO: 747896 - RNA, 22 nt, Human
augguacaaaauguauaaaguc

SEQ ID NO: 747897 - RNA, 22 nt, Human
ggccaggaggcaggggcucaau

SEQ ID NO: 747898 - RNA, 22 nt, Human
ggauaggaauugagaugcuauu

SEQ ID NO: 747899 - RNA, 22 nt, Human
ggaagacagaagccuacagcuu

SEQ ID NO: 747900 - RNA, 22 nt, Human
cugcugacuuacacuguuuauu

SEQ ID NO: 747901 - RNA, 22 nt, Human
uaaauuuacccaaggaacaugu

SEQ ID NO: 747902 - RNA, 22 nt, Human
gugggggcuggcucguccugug

SEQ ID NO: 747903 - RNA, 22 nt, Human
uauguauucugaguacaaguuc

SEQ ID NO: 747904 - RNA, 22 nt, Human
ucagcaggggccguugggugga

SEQ ID NO: 747905 - RNA, 22 nt, Human
aagucucugacucacacaaugu

SEQ ID NO: 747906 - RNA, 22 nt, Human
ggagcuaguaguuucaugaguu

SEQ ID NO: 747907 - RNA, 19 nt, Human
ucugucagugcaucaccuc

SEQ ID NO: 747908 - RNA, 19 nt, Human
ggccuuucaccuggaugcu

SEQ ID NO: 747909 - RNA, 22 nt, Human
acugaaaaagacaucuugguaa

SEQ ID NO: 747910 - RNA, 22 nt, Human
ucccagagucagagguggggcc

SEQ ID NO: 747911 - RNA, 22 nt, Human
uucaacauguucuacauaaggg

SEQ ID NO: 747912 - RNA, 22 nt, Human
ccuggcuucugggucugugaga

SEQ ID NO: 747913 - RNA, 21 nt, Human
guagggacagagaguugguga

SEQ ID NO: 747914 - RNA, 22 nt, Human
uuucagacuccaaauucauaag

SEQ ID NO: 747915 - RNA, 22 nt, Human
acagaauauuuggcaugcgucu

SEQ ID NO: 747916 - RNA, 22 nt, Human
gagcucugcuuggguucuuagg

SEQ ID NO: 747917 - RNA, 22 nt, Human
aacuugcuucaacuuauuucac

SEQ ID NO: 747918 - RNA, 22 nt, Human
cagauucuucauugccccauuc

SEQ ID NO: 747919 - RNA, 22 nt, Human
ucagggacaggaugggcauuuc

SEQ ID NO: 747920 - RNA, 21 nt, Human
ugaugaggucauagcacccuc

SEQ ID NO: 747921 - RNA, 22 nt, Human
ccugagggaggguauaggcugu

SEQ ID NO: 747922 - RNA, 22 nt, Human
augcugcagcugcaggaucaga

SEQ ID NO: 747923 - RNA, 22 nt, Human
ucugucacccaggcuggagugc

SEQ ID NO: 747924 - RNA, 22 nt, Human
gggugggacucuuuggccugag

SEQ ID NO: 747925 - RNA, 22 nt, Human
gcuucugcuguugaagccacca

SEQ ID NO: 747926 - RNA, 22 nt, Human
aagcugcccaagacugaagcau

SEQ ID NO: 747927 - RNA, 20 nt, Human
uuggaggugcagugcaugca

SEQ ID NO: 747928 - RNA, 22 nt, Human
gacugcagugaaggcacauggg

SEQ ID NO: 747929 - RNA, 22 nt, Human
cucacaggagaaagucaugguc

SEQ ID NO: 747930 - RNA, 22 nt, Human
gaaggccacaaaaaaugucaua

SEQ ID NO: 747931 - RNA, 22 nt, Human
ccagcuccagcauagccaccau

SEQ ID NO: 747932 - RNA, 22 nt, Human
aacaucauuauguccauuaaug

SEQ ID NO: 747933 - RNA, 22 nt, Human
gcaccacaucaaugaggggagc

SEQ ID NO: 747934 - RNA, 22 nt, Human
uucagggucuagaguaucuacc

SEQ ID NO: 747935 - RNA, 22 nt, Human
cugagaauaaagccagcaggag

SEQ ID NO: 747936 - RNA, 22 nt, Human
ugggauaguggccaggaccccc

SEQ ID NO: 747937 - RNA, 21 nt, Human
cucugcccagggccuccugcc

SEQ ID NO: 747938 - RNA, 20 nt, Human
agccaggguucuggaugcac

SEQ ID NO: 747939 - RNA, 22 nt, Human
ugagcuagggcuggugaggagc

SEQ ID NO: 747940 - RNA, 22 nt, Human
ggccauggggacagagggugaa

SEQ ID NO: 747941 - RNA, 17 nt, Human
agcuuggagcagcauga

SEQ ID NO: 747942 - RNA, 22 nt, Human
ucugcucuguggcuucagcuaa

SEQ ID NO: 747943 - RNA, 17 nt, Human
ugcugcuaauuaaaaua

SEQ ID NO: 747944 - RNA, 22 nt, Human
cagagggcacaugguuuccuca

SEQ ID NO: 747945 - RNA, 22 nt, Human
aaggggcaugcuuuugccagga

SEQ ID NO: 747946 - RNA, 22 nt, Human
ugugccugugacagcgaccugg

SEQ ID NO: 747947 - RNA, 22 nt, Human
ccauuaaagcaccacuguaaua

SEQ ID NO: 747948 - RNA, 22 nt, Human
ugggacaggaggccucuggaga

SEQ ID NO: 747949 - RNA, 19 nt, Human
uuuuaagugcccuuucuuc

SEQ ID NO: 747950 - RNA, 22 nt, Human
ucaugcagagccagucaggaua

SEQ ID NO: 747951 - RNA, 22 nt, Human
gccacaggcuuaggagggaggu

SEQ ID NO: 747952 - RNA, 22 nt, Human
ccaaauagucuuucauugaauu

SEQ ID NO: 747953 - RNA, 22 nt, Human
aaacuaagacuaaugaagaacu

SEQ ID NO: 747954 - RNA, 21 nt, Human
agccagauccauuuugcaugg

SEQ ID NO: 747955 - RNA, 22 nt, Human
gagagcccugcuccuaucccag

SEQ ID NO: 747956 - RNA, 21 nt, Human
gcagaugggagucaucaggcu

SEQ ID NO: 747957 - RNA, 23 nt, Human
uauuuuccaaaugaugacuacau

SEQ ID NO: 747958 - RNA, 22 nt, Human
gccagcagccacagaagucacu

SEQ ID NO: 747959 - RNA, 23 nt, Human
ugcaaaauuugcagaguucgaug

SEQ ID NO: 747960 - RNA, 22 nt, Human
uuauaaagugagaagugcuaug

SEQ ID NO: 747961 - RNA, 22 nt, Human
cagcuuguuaccgagggagggu

SEQ ID NO: 747962 - RNA, 22 nt, Human
acucugcucuuauaguguuaua

SEQ ID NO: 747963 - RNA, 22 nt, Human
gcagagcuaucuucuggauuug

SEQ ID NO: 747964 - RNA, 23 nt, Human
uaggaagacagcaaaagaaugga

SEQ ID NO: 747965 - RNA, 22 nt, Human
aaggcauguguccucagagaga

SEQ ID NO: 747966 - RNA, 22 nt, Human
uccuagaaggaucauucuagug

SEQ ID NO: 747967 - RNA, 18 nt, Human
aauuuccauaugaauugc

SEQ ID NO: 747968 - RNA, 22 nt, Human
aggaaugacagauguccgcacc

SEQ ID NO: 747969 - RNA, 22 nt, Human
acacauugcagacaucucauua

SEQ ID NO: 747970 - RNA, 22 nt, Human
aagcacacagcaaaggggagcu

SEQ ID NO: 747971 - RNA, 18 nt, Human
augcuucugauagaagca

SEQ ID NO: 747972 - RNA, 22 nt, Human
uucucuuccagccgggcuugca

SEQ ID NO: 747973 - RNA, 22 nt, Human
agagagaggcagcagugcucac

SEQ ID NO: 747974 - RNA, 22 nt, Human
gaaguuaucaaagauguauucu

SEQ ID NO: 747975 - RNA, 19 nt, Human
ugucuuuggucugaguuuc

SEQ ID NO: 747976 - RNA, 22 nt, Human
ccacagugaguucuguacucug

SEQ ID NO: 747977 - RNA, 18 nt, Human
ucaugagguagaggcugg

SEQ ID NO: 747978 - RNA, 22 nt, Human
gguguccuugcagaaggcggcg

SEQ ID NO: 747979 - RNA, 22 nt, Human
ugagcaccaucuguuugugugc

SEQ ID NO: 747980 - RNA, 21 nt, Human
cauuuacaugacagauugguu

SEQ ID NO: 747981 - RNA, 22 nt, Human
uuggcaguagugguaguacauu

SEQ ID NO: 747982 - RNA, 22 nt, Human
aucauaauugcuccagugauau

SEQ ID NO: 747983 - RNA, 21 nt, Human
agcagcagaucuggugagggc

SEQ ID NO: 747984 - RNA, 22 nt, Human
agcagaugaaucccagauaaag

SEQ ID NO: 747985 - RNA, 15 nt, Human
agcugccugggugcu

SEQ ID NO: 747986 - RNA, 22 nt, Human
gggaguccaaauugguacaaua

SEQ ID NO: 747987 - RNA, 22 nt, Human
ucuuuggaucccaacuggcugg

SEQ ID NO: 747988 - RNA, 22 nt, Human
uccucccacauaggacaauggg

SEQ ID NO: 747989 - RNA, 22 nt, Human
ggccagcucagucuccaucagg

SEQ ID NO: 747990 - RNA, 22 nt, Human
acugcccuuguccuggcacacc

SEQ ID NO: 747991 - RNA, 22 nt, Human
cucagagaguuaagugaauuac

SEQ ID NO: 747992 - RNA, 22 nt, Human
agccagcaggugagugcagccu

SEQ ID NO: 747993 - RNA, 21 nt, Human
agaagccaugugguggagaac

SEQ ID NO: 747994 - RNA, 22 nt, Human
agcaaggaaaguaggcacggaa

SEQ ID NO: 747995 - RNA, 22 nt, Human
aagcagagaccggcuaauggag

SEQ ID NO: 747996 - RNA, 22 nt, Human
aauucuacauugguucacauuu

SEQ ID NO: 747997 - RNA, 22 nt, Human
cuuguauuaagcuuagagaggc

SEQ ID NO: 747998 - RNA, 17 nt, Human
gcucugccucucccacc

SEQ ID NO: 747999 - RNA, 22 nt, Human
uagaaaugucgucuccacauuu

SEQ ID NO: 748000 - RNA, 22 nt, Human
aaaaguaauugcaguuuugcca

SEQ ID NO: 748001 - RNA, 22 nt, Human
aagccagguguugugguaagag

SEQ ID NO: 748002 - RNA, 22 nt, Human
aauacuuuccuauauaaggugc

SEQ ID NO: 748003 - RNA, 19 nt, Human
ucuucugacuucaagaaac

SEQ ID NO: 748004 - RNA, 22 nt, Human
ugccuacauuccuugcuuaugg

SEQ ID NO: 748005 - RNA, 22 nt, Human
cagcuucuguccuagaaacugg

SEQ ID NO: 748006 - RNA, 22 nt, Human
cugggcacugcaggguguugag

SEQ ID NO: 748007 - RNA, 22 nt, Human
gugguaaucggauucuuaccgg

SEQ ID NO: 748008 - RNA, 22 nt, Human
aaccuuccugaggaaagucuaa

SEQ ID NO: 748009 - RNA, 18 nt, Human
ugacagaaccuggagccu

SEQ ID NO: 748010 - RNA, 17 nt, Human
aucucucuaaggcaggc

SEQ ID NO: 748011 - RNA, 22 nt, Human
gaggcaggcccugaaugaguca

SEQ ID NO: 748012 - RNA, 22 nt, Human
gagcuaagcuauguuaugcagc

SEQ ID NO: 748013 - RNA, 22 nt, Human
gguguuaacaaagauugaaaug

SEQ ID NO: 748014 - RNA, 22 nt, Human
ucccucuggucuggacgccaua

SEQ ID NO: 748015 - RNA, 22 nt, Human
gcugaggcuuagcuaaaaauuu

SEQ ID NO: 748016 - RNA, 22 nt, Human
uuccagaggggagguggcagcc

SEQ ID NO: 748017 - RNA, 22 nt, Human
cuauugaggacauaaggacucu

SEQ ID NO: 748018 - RNA, 22 nt, Human
cacuguggagcaaauuuauuua

SEQ ID NO: 748019 - RNA, 22 nt, Human
aggaauuugcuggaacacagau

SEQ ID NO: 748020 - RNA, 22 nt, Human
ccagagcaauucucacagaacu

SEQ ID NO: 748021 - RNA, 22 nt, Human
acagucucuguugcugcuguuu

SEQ ID NO: 748022 - RNA, 22 nt, Human
cuguggcucuccaauggaggga

SEQ ID NO: 748023 - RNA, 22 nt, Human
uagagcugcuggacuguaacag

SEQ ID NO: 748024 - RNA, 22 nt, Human
agggacugagcuaggaucuagu

SEQ ID NO: 748025 - RNA, 22 nt, Human
uaagcauaguaccguagcagcu

SEQ ID NO: 748026 - RNA, 22 nt, Human
guuugaaaaaagcaguauguaa

SEQ ID NO: 748027 - RNA, 22 nt, Human
uagggcaggugaagaaaagcua

SEQ ID NO: 748028 - RNA, 19 nt, Human
ugcaaauucuaaaaacuga

SEQ ID NO: 748029 - RNA, 22 nt, Human
aaagcuguagaaucaucuuaau

SEQ ID NO: 748030 - RNA, 22 nt, Human
aucagugcauccugccacaaag

SEQ ID NO: 748031 - RNA, 22 nt, Human
acacauguauggcacuuacauu

SEQ ID NO: 748032 - RNA, 22 nt, Human
gccuggcugggcugaaugcuua

SEQ ID NO: 748033 - RNA, 22 nt, Human
uuggaaaugauuucuauuauua

SEQ ID NO: 748034 - RNA, 22 nt, Human
auuuggaggccucuccugcuug

SEQ ID NO: 748035 - RNA, 22 nt, Human
ugugcgugguucccggggccau

SEQ ID NO: 748036 - RNA, 20 nt, Human
auugugaauacugcauaugu

SEQ ID NO: 748037 - RNA, 22 nt, Human
ccccacucucggccagauaggc

SEQ ID NO: 748038 - RNA, 19 nt, Human
ggcugucuggcguguggau

SEQ ID NO: 748039 - RNA, 22 nt, Human
cagcucaguuucaauaccaggu

SEQ ID NO: 748040 - RNA, 22 nt, Human
gugcacagaaacauacaaugug

SEQ ID NO: 748041 - RNA, 22 nt, Human
agcagaaccugcagaccugucu

SEQ ID NO: 748042 - RNA, 22 nt, Human
gcaggcugagaguccaagaagg

SEQ ID NO: 748043 - RNA, 22 nt, Human
auuauugucaucuuaaucuuaa

SEQ ID NO: 748044 - RNA, 22 nt, Human
cugggccugugggcacacggac

SEQ ID NO: 748045 - RNA, 22 nt, Human
agugcaggagccuggccagagc

SEQ ID NO: 748046 - RNA, 22 nt, Human
agugcuuuguaguuucauugug

SEQ ID NO: 748047 - RNA, 21 nt, Human
cagaggcaggcucugugugug

SEQ ID NO: 748048 - RNA, 22 nt, Human
aagcuuuuuggauuugcuucag

SEQ ID NO: 748049 - RNA, 22 nt, Human
cugcuugccuggacagcguuag

SEQ ID NO: 748050 - RNA, 22 nt, Human
agaguguaccaaauauccuaca

SEQ ID NO: 748051 - RNA, 23 nt, Human
aagcaugguucacaguuaguacu

SEQ ID NO: 748052 - RNA, 22 nt, Human
uguuuuuaucucuguguacaac

SEQ ID NO: 748053 - RNA, 22 nt, Human
cuggcccaggagagcaggcauu

SEQ ID NO: 748054 - RNA, 22 nt, Human
aaaccucuuuuaaggaguuguu

SEQ ID NO: 748055 - RNA, 22 nt, Human
cccugaaauccugugcucugug

SEQ ID NO: 748056 - RNA, 22 nt, Human
aucaguuuggugcuuucaguga

SEQ ID NO: 748057 - RNA, 22 nt, Human
ccugucuguucugacuggucag

SEQ ID NO: 748058 - RNA, 22 nt, Human
auccccagggagugagcugucu

SEQ ID NO: 748059 - RNA, 22 nt, Human
ugagcacaaguuugcaugugug

SEQ ID NO: 748060 - RNA, 22 nt, Human
agcugcuccaauuuuuaccauu

SEQ ID NO: 748061 - RNA, 22 nt, Human
cuaauaacaugaacuacuuucu

SEQ ID NO: 748062 - RNA, 22 nt, Human
gcagguggaucaccacgucagg

SEQ ID NO: 748063 - RNA, 22 nt, Human
ccacugggggcugcucccaggu

SEQ ID NO: 748064 - RNA, 20 nt, Human
gugcugagggcugggcaaug

SEQ ID NO: 748065 - RNA, 22 nt, Human
ugaggggagcuagcaugccuug

SEQ ID NO: 748066 - RNA, 22 nt, Human
auuuaccauccugugaauggcc

SEQ ID NO: 748067 - RNA, 22 nt, Human
ucauggggcucuucaaguggag

SEQ ID NO: 748068 - RNA, 21 nt, Human
cucaaagaccaaaaguguaga

SEQ ID NO: 748069 - RNA, 22 nt, Human
gcuguguuuuauguuagguuaa

SEQ ID NO: 748070 - RNA, 22 nt, Human
caggaacaugucuccaauuaga

SEQ ID NO: 748071 - RNA, 22 nt, Human
ggcugugauugguggaugugaa

SEQ ID NO: 748072 - RNA, 22 nt, Human
ccaggcaggcgauggugcagug

SEQ ID NO: 748073 - RNA, 21 nt, Human
gcaaguacuaucaucauuauc

SEQ ID NO: 748074 - RNA, 22 nt, Human
guuucaaaagucaggcuauucu

SEQ ID NO: 748075 - RNA, 22 nt, Human
uuucugcuguguaaaaugaggg

SEQ ID NO: 748076 - RNA, 22 nt, Human
gauucacagaacuuagucaagc

SEQ ID NO: 748077 - RNA, 22 nt, Human
aaagugauuuaaguaccucagg

SEQ ID NO: 748078 - RNA, 21 nt, Human
uuuguucauagcucacucuuu

SEQ ID NO: 748079 - RNA, 22 nt, Human
aucaucuucgaaaaaagucaga

SEQ ID NO: 748080 - RNA, 22 nt, Human
acuuugcagggcuugauaucca

SEQ ID NO: 748081 - RNA, 22 nt, Human
ucagcugccccaguggccccag

SEQ ID NO: 748082 - RNA, 22 nt, Human
uuaggaaaagaagacauuucua

SEQ ID NO: 748083 - RNA, 22 nt, Human
ucauucaugaggugcuagugcu

SEQ ID NO: 748084 - RNA, 22 nt, Human
gagagggugccuggaagccagg

SEQ ID NO: 748085 - RNA, 23 nt, Human
ccucuaauaaacuugaccuugug

SEQ ID NO: 748086 - RNA, 22 nt, Human
uucauucagguguauuuauggg

SEQ ID NO: 748087 - RNA, 22 nt, Human
gugcguccugggggcugggucg

SEQ ID NO: 748088 - RNA, 22 nt, Human
uuugcagucaaauuugcuaaau

SEQ ID NO: 748089 - RNA, 23 nt, Human
uuucaacuccugccauuauuucu

SEQ ID NO: 748090 - RNA, 22 nt, Human
gcaggucuugaaggugugauuu

SEQ ID NO: 748091 - RNA, 22 nt, Human
cuuccuugugguccuucucauu

SEQ ID NO: 748092 - RNA, 22 nt, Human
uuggaaggggcagaguggcugc

SEQ ID NO: 748093 - RNA, 20 nt, Human
gcugccuuguccugcuuggu

SEQ ID NO: 748094 - RNA, 21 nt, Human
agcagaacagucgagcacugc

SEQ ID NO: 748095 - RNA, 22 nt, Human
ugggccuguggcuuggcucuag

SEQ ID NO: 748096 - RNA, 22 nt, Human
gacaauguaaaucaggauagca

SEQ ID NO: 748097 - RNA, 22 nt, Human
guggcuaguuggcagagaacag

SEQ ID NO: 748098 - RNA, 22 nt, Human
uaacuuugauaagaaucaggga

SEQ ID NO: 748099 - RNA, 22 nt, Human
cugacccuuuaggguauguuua

SEQ ID NO: 748100 - RNA, 22 nt, Human
auuuguaucaaucucaauauau

SEQ ID NO: 748101 - RNA, 22 nt, Human
ugaguccugcucugggcagggu

SEQ ID NO: 748102 - RNA, 22 nt, Human
cuaaacauguuggugcuuuaaa

SEQ ID NO: 748103 - RNA, 22 nt, Human
uuuauugucuaugaacugcuug

SEQ ID NO: 748104 - RNA, 22 nt, Human
ugggcaggauaauaucucaugu

SEQ ID NO: 748105 - RNA, 22 nt, Human
gggugcagugguucacgccugu

SEQ ID NO: 748106 - RNA, 22 nt, Human
cagccagaaccuaggaugagcu

SEQ ID NO: 748107 - RNA, 22 nt, Human
ucuggcccagccccugauccca

SEQ ID NO: 748108 - RNA, 22 nt, Human
agagccagaccauugccgugca

SEQ ID NO: 748109 - RNA, 23 nt, Human
cugcuguuuucuguaccugaagc

SEQ ID NO: 748110 - RNA, 22 nt, Human
gggaagaagacauggugaaggc

SEQ ID NO: 748111 - RNA, 22 nt, Human
ggugggagagcucugucuccag

SEQ ID NO: 748112 - RNA, 22 nt, Human
aagauaugaggucaccugcugg

SEQ ID NO: 748113 - RNA, 22 nt, Human
ccuuacaccuaaaaugagaguu

SEQ ID NO: 748114 - RNA, 22 nt, Human
aagccaggaccaaacucauccu

SEQ ID NO: 748115 - RNA, 22 nt, Human
ugugugugaguccuggcuuucc

SEQ ID NO: 748116 - RNA, 22 nt, Human
ucuucuuuuauuucaagggugu

SEQ ID NO: 748117 - RNA, 22 nt, Human
ucauuguugcguuaaugucuuc

SEQ ID NO: 748118 - RNA, 22 nt, Human
guguuuaaugcagaugugggug

SEQ ID NO: 748119 - RNA, 22 nt, Human
ggcugagcuuauauaugugcug

SEQ ID NO: 748120 - RNA, 22 nt, Human
cucugagcuccuggaagcgugc

SEQ ID NO: 748121 - RNA, 19 nt, Human
ucucucaauugcuucaauu

SEQ ID NO: 748122 - RNA, 22 nt, Human
cuguggcuuuuccggggagccu

SEQ ID NO: 748123 - RNA, 22 nt, Human
gagcagcucugugccuggagac

SEQ ID NO: 748124 - RNA, 22 nt, Human
cacugaacuggucuuaggaggu

SEQ ID NO: 748125 - RNA, 22 nt, Human
guaauuaggaauaaaaugggaa

SEQ ID NO: 748126 - RNA, 22 nt, Human
gagauuggauuuaauggccaaa

SEQ ID NO: 748127 - RNA, 22 nt, Human
agaggggaguccuaaucugauu

SEQ ID NO: 748128 - RNA, 22 nt, Human
ugacuugucaaagaaaugugug

SEQ ID NO: 748129 - RNA, 17 nt, Human
gagcucuguggcacaag

SEQ ID NO: 748130 - RNA, 23 nt, Human
acuuccaguugcuucagcauaug

SEQ ID NO: 748131 - RNA, 22 nt, Human
gcugggccagccagacauguga

SEQ ID NO: 748132 - RNA, 22 nt, Human
uaguuacagcaggcaggauaua

SEQ ID NO: 748133 - RNA, 22 nt, Human
uuguacagaaaaaauucuuggu

SEQ ID NO: 748134 - RNA, 22 nt, Human
agggcugacagugaggagucaa

SEQ ID NO: 748135 - RNA, 22 nt, Human
ggggagugacgcagggccauag

SEQ ID NO: 748136 - RNA, 22 nt, Human
aaguguuuacuuaaagucaugg

SEQ ID NO: 748137 - RNA, 22 nt, Human
gggcagauggggcacaggcuga

SEQ ID NO: 748138 - RNA, 22 nt, Human
guccucuggccuuucccaggac

SEQ ID NO: 748139 - RNA, 22 nt, Human
uaaggcagccgcucagagaggu

SEQ ID NO: 748140 - RNA, 16 nt, Human
uuguggcuuuugcaca

SEQ ID NO: 748141 - RNA, 22 nt, Human
gagauucugugaaacggacauu

SEQ ID NO: 748142 - RNA, 22 nt, Human
ccacaagugaaguacaccugcc

SEQ ID NO: 748143 - RNA, 22 nt, Human
gcagaggccaucaacuuugcca

SEQ ID NO: 748144 - RNA, 22 nt, Human
uauuucugggaguucagaaauu

SEQ ID NO: 748145 - RNA, 22 nt, Human
ugagaugguucacagagaaggc

SEQ ID NO: 748146 - RNA, 18 nt, Human
uuugcuuuccuucuucag

SEQ ID NO: 748147 - RNA, 22 nt, Human
aaguggcagaauaguggcagga

SEQ ID NO: 748148 - RNA, 22 nt, Human
aacauuuaggaaggaccuccuc

SEQ ID NO: 748149 - RNA, 22 nt, Human
uuaaacacacugagauuuaugu

SEQ ID NO: 748150 - RNA, 19 nt, Human
ucaguaacuuuuaagagga

SEQ ID NO: 748151 - RNA, 23 nt, Human
cccugcagucagggugagauggu

SEQ ID NO: 748152 - RNA, 17 nt, Human
gguuuaauccuuaccug

SEQ ID NO: 748153 - RNA, 22 nt, Human
auccaguuaagaugaggucaua

SEQ ID NO: 748154 - RNA, 22 nt, Human
gcauuuguguggcggaaggauu

SEQ ID NO: 748155 - RNA, 22 nt, Human
uuuuggggagaacgguugcuau

SEQ ID NO: 748156 - RNA, 22 nt, Human
ucagagaauccguaagucacaa

SEQ ID NO: 748157 - RNA, 20 nt, Human
cuuagaaauuuuuacccugg

SEQ ID NO: 748158 - RNA, 22 nt, Human
auauauaaccuggauaaggcuu

SEQ ID NO: 748159 - RNA, 22 nt, Human
gggggcuguccugugcauugua

SEQ ID NO: 748160 - RNA, 22 nt, Human
agaugaguaaauggagucuucc

SEQ ID NO: 748161 - RNA, 22 nt, Human
ucacaacucuuuccauuuaaua

SEQ ID NO: 748162 - RNA, 22 nt, Human
gcaccuugggaagcgccaguug

SEQ ID NO: 748163 - RNA, 22 nt, Human
gggcuccagcccgggaccaggu

SEQ ID NO: 748164 - RNA, 22 nt, Human
agacauaagugcuaugacauug

SEQ ID NO: 748165 - RNA, 21 nt, Human
ugggagagggcucagcuaccc

SEQ ID NO: 748166 - RNA, 20 nt, Human
ggcucaucuugucugcugac

SEQ ID NO: 748167 - RNA, 23 nt, Human
cucccugaacaugacacaccaga

SEQ ID NO: 748168 - RNA, 22 nt, Human
uucuggagaucugccuauggga

SEQ ID NO: 748169 - RNA, 22 nt, Human
cagugcaggcugggggcccugc

SEQ ID NO: 748170 - RNA, 21 nt, Human
cucaggcauuugaggagaguc

SEQ ID NO: 748171 - RNA, 22 nt, Human
uaacugugugaacgugaucauu

SEQ ID NO: 748172 - RNA, 22 nt, Human
acugugggacaucccucccuau

SEQ ID NO: 748173 - RNA, 21 nt, Human
agugaaaugaaguguaugcuc

SEQ ID NO: 748174 - RNA, 22 nt, Human
gcccugaguugagccuuccaaa

SEQ ID NO: 748175 - RNA, 22 nt, Human
ucaucuucuauuaauagggaga

SEQ ID NO: 748176 - RNA, 22 nt, Human
gagcuguuugugacaggcugug

SEQ ID NO: 748177 - RNA, 22 nt, Human
ccugccagggccuuggaagaaa

SEQ ID NO: 748178 - RNA, 22 nt, Human
gcuggggaggcagcagagaaca

SEQ ID NO: 748179 - RNA, 22 nt, Human
aagcagggcucccuggggacuc

SEQ ID NO: 748180 - RNA, 22 nt, Human
uuguguauuuccugaagguaag

SEQ ID NO: 748181 - RNA, 22 nt, Human
auccuguuagcaccuucaaacu

SEQ ID NO: 748182 - RNA, 23 nt, Human
uaacucugugaagggugacuggg

SEQ ID NO: 748183 - RNA, 22 nt, Human
cucagugcuuuggauccuggau

SEQ ID NO: 748184 - RNA, 22 nt, Human
aggcuuggugccaaggagccug

SEQ ID NO: 748185 - RNA, 22 nt, Human
cuggaagaggggaaaugccaug

SEQ ID NO: 748186 - RNA, 21 nt, Human
ccaggguccagcugccauggu

SEQ ID NO: 748187 - RNA, 22 nt, Human
ggggacugaggcacugaaggug

SEQ ID NO: 748188 - RNA, 22 nt, Human
aauaaagacucagaggcccagg

SEQ ID NO: 748189 - RNA, 23 nt, Human
cuccaaggcccaacugucuaggc

SEQ ID NO: 748190 - RNA, 23 nt, Human
acuuccaguuauaggaacucuuc

SEQ ID NO: 748191 - RNA, 22 nt, Human
cagggagcagcaugggcaaagg

SEQ ID NO: 748192 - RNA, 22 nt, Human
ucacacaucucagguguuuaau

SEQ ID NO: 748193 - RNA, 22 nt, Human
augaauugaggaaaacagucgu

SEQ ID NO: 748194 - RNA, 22 nt, Human
ugauuaaaauuuaacuuaguua

SEQ ID NO: 748195 - RNA, 22 nt, Human
cagcuguugucucucacauauu

SEQ ID NO: 748196 - RNA, 22 nt, Human
auaguggguacaggggcagaga

SEQ ID NO: 748197 - RNA, 22 nt, Human
uucuacuugccaaaugacacau

SEQ ID NO: 748198 - RNA, 22 nt, Human
uucuggcuacccuccuaauguu

SEQ ID NO: 748199 - RNA, 22 nt, Human
gguuuucaaagaggcauuucau

SEQ ID NO: 748200 - RNA, 22 nt, Human
caggcgucacugccacggguau

SEQ ID NO: 748201 - RNA, 20 nt, Human
aagcugucagagguggacag

SEQ ID NO: 748202 - RNA, 22 nt, Human
gagaggugaauguggaugccac

SEQ ID NO: 748203 - RNA, 22 nt, Human
aucugggccagccccaagagac

SEQ ID NO: 748204 - RNA, 22 nt, Human
cugaaggaagcagguggccugu

SEQ ID NO: 748205 - RNA, 22 nt, Human
aggcuaaggagugugaugcuca

SEQ ID NO: 748206 - RNA, 21 nt, Human
cacaugugaauuacugaacug

SEQ ID NO: 748207 - RNA, 19 nt, Human
uacaggaggccugcaaucu

SEQ ID NO: 748208 - RNA, 22 nt, Human
uuacacaaaagcaagugugugu

SEQ ID NO: 748209 - RNA, 22 nt, Human
gggucaggaagaauucugccaa

SEQ ID NO: 748210 - RNA, 22 nt, Human
acagcuugggaugcuuuauuuc

SEQ ID NO: 748211 - RNA, 22 nt, Human
ggcccugggcccucuagcuugu

SEQ ID NO: 748212 - RNA, 23 nt, Human
cuucagugugggacugcagcgug

SEQ ID NO: 748213 - RNA, 22 nt, Human
acaauauuugggggcaguuugu

SEQ ID NO: 748214 - RNA, 22 nt, Human
uggaauucuuauucugacuuca

SEQ ID NO: 748215 - RNA, 22 nt, Human
uacaucuuugucuaugaccagc

SEQ ID NO: 748216 - RNA, 22 nt, Human
uuuauuauagugguggggacug

SEQ ID NO: 748217 - RNA, 22 nt, Human
ccccagggucaguguguggagg

SEQ ID NO: 748218 - RNA, 22 nt, Human
cauggaggccaggaaacagccu

SEQ ID NO: 748219 - RNA, 22 nt, Human
auccugggccucagaggugugu

SEQ ID NO: 748220 - RNA, 22 nt, Human
ugcauaaaauaugagaaaugua

SEQ ID NO: 748221 - RNA, 22 nt, Human
aaaguuuccaaguuacaccauu

SEQ ID NO: 748222 - RNA, 22 nt, Human
caagagcuuuagaaaugcucau

SEQ ID NO: 748223 - RNA, 19 nt, Human
uaagguuuaccagcaaaau

SEQ ID NO: 748224 - RNA, 22 nt, Human
ggcaucagcccgguccugggcu

SEQ ID NO: 748225 - RNA, 22 nt, Human
gacccuguuucuacaaauaauu

SEQ ID NO: 748226 - RNA, 21 nt, Human
ugauugauauuugcaaacaga

SEQ ID NO: 748227 - RNA, 22 nt, Human
uuccagauguuuaaguucugcu

SEQ ID NO: 748228 - RNA, 22 nt, Human
gcagcagcaggcgcucggccgu

SEQ ID NO: 748229 - RNA, 22 nt, Human
ggucucagcccucgccagcagc

SEQ ID NO: 748230 - RNA, 22 nt, Human
ucuuuugugauucuuuaguuac

SEQ ID NO: 748231 - RNA, 22 nt, Human
aaauuccauuaugauaauuucg

SEQ ID NO: 748232 - RNA, 22 nt, Human
caauagcaggucuacagagaga

SEQ ID NO: 748233 - RNA, 22 nt, Human
uuuguucaaggaauaguaaaug

SEQ ID NO: 748234 - RNA, 22 nt, Human
caaaaguaauggcgguuuuuac

SEQ ID NO: 748235 - RNA, 22 nt, Human
gugcucugaguuugcaugucag

SEQ ID NO: 748236 - RNA, 21 nt, Human
gcaaggcaaugccaugauuuc

SEQ ID NO: 748237 - RNA, 22 nt, Human
uggucaguugcaucagagaagu

SEQ ID NO: 748238 - RNA, 22 nt, Human
uuugauugucaccuaccuugca

SEQ ID NO: 748239 - RNA, 22 nt, Human
aggcucugcaguccaucccgug

SEQ ID NO: 748240 - RNA, 22 nt, Human
ucucagaaggcaagggcugggg

SEQ ID NO: 748241 - RNA, 22 nt, Human
gagggcuccucacauucucuau

SEQ ID NO: 748242 - RNA, 22 nt, Human
ggaaaggagaugaauaggauua

SEQ ID NO: 748243 - RNA, 23 nt, Human
gcauugaacaaaagaggggagua

SEQ ID NO: 748244 - RNA, 22 nt, Human
guuuauuggguauuguggagcc

SEQ ID NO: 748245 - RNA, 22 nt, Human
ugagcaguaacagcucacaggg

SEQ ID NO: 748246 - RNA, 22 nt, Human
agcaggggcaggguuuugugcu

SEQ ID NO: 748247 - RNA, 22 nt, Human
ucugccagaaguucugagagua

SEQ ID NO: 748248 - RNA, 22 nt, Human
ggugugggcccugaugucagca

SEQ ID NO: 748249 - RNA, 22 nt, Human
gucugaaaguagggcugaucua

SEQ ID NO: 748250 - RNA, 22 nt, Human
aucaggaugacaacugcugggu

SEQ ID NO: 748251 - RNA, 22 nt, Human
ggccucuggcaggcaggcccuc

SEQ ID NO: 748252 - RNA, 22 nt, Human
aggcucuccagagagcugcuuu

SEQ ID NO: 748253 - RNA, 22 nt, Human
cuucuugggcugccaguuucag

SEQ ID NO: 748254 - RNA, 22 nt, Human
guggccugggguuuguucugag

SEQ ID NO: 748255 - RNA, 22 nt, Human
caugcucucuggcaacuugugu

SEQ ID NO: 748256 - RNA, 22 nt, Human
cacugaagaugcgacuagugcu

SEQ ID NO: 748257 - RNA, 21 nt, Human
uuguguuuccccagucacuuu

SEQ ID NO: 748258 - RNA, 22 nt, Human
aagggggcgaagacgugauuga

SEQ ID NO: 748259 - RNA, 22 nt, Human
gggaaauugucaacacucucaa

SEQ ID NO: 748260 - RNA, 22 nt, Human
uuguccugugauuucagggccu

SEQ ID NO: 748261 - RNA, 22 nt, Human
aaggguugcaaggucagaggaa

SEQ ID NO: 748262 - RNA, 22 nt, Human
gcaggggcugcugggaacucgg

SEQ ID NO: 748263 - RNA, 22 nt, Human
uucggucuggcuguuauacgcu

SEQ ID NO: 748264 - RNA, 22 nt, Human
ggagcacuauaauagagauuuu

SEQ ID NO: 748265 - RNA, 22 nt, Human
gaaauauacauugcaggaagag

SEQ ID NO: 748266 - RNA, 21 nt, Human
agcagaggggacauguuugau

SEQ ID NO: 748267 - RNA, 22 nt, Human
ucguggagaggccauguggagg

SEQ ID NO: 748268 - RNA, 22 nt, Human
cccagcaggugccaucacucug

SEQ ID NO: 748269 - RNA, 22 nt, Human
ugaaggcuguuggauggggaag

SEQ ID NO: 748270 - RNA, 22 nt, Human
ucaacacucuuuggcacaguua

SEQ ID NO: 748271 - RNA, 22 nt, Human
cuuguguggucuggucuugcua

SEQ ID NO: 748272 - RNA, 22 nt, Human
agugucugaaccugcaguggga

SEQ ID NO: 748273 - RNA, 22 nt, Human
uuacaagauaugugagaacuag

SEQ ID NO: 748274 - RNA, 22 nt, Human
uuugaagucaaagauugauucc

SEQ ID NO: 748275 - RNA, 22 nt, Human
ugcugccacauuuaaagagggg

SEQ ID NO: 748276 - RNA, 22 nt, Human
cuuauaguaugauguugagaau

SEQ ID NO: 748277 - RNA, 21 nt, Human
gauuuuaaagagacugccaca

SEQ ID NO: 748278 - RNA, 22 nt, Human
cugaagcagauguggcugagau

SEQ ID NO: 748279 - RNA, 22 nt, Human
uuauugcaacuuuagggauaga

SEQ ID NO: 748280 - RNA, 22 nt, Human
aacuuucaggcaaugaauauuu

SEQ ID NO: 748281 - RNA, 22 nt, Human
ggugugggagagauucuuuccu

SEQ ID NO: 748282 - RNA, 22 nt, Human
guaaguuuuguauaggcauggg

SEQ ID NO: 748283 - RNA, 22 nt, Human
ucaacacuuuugucuuuguccc

SEQ ID NO: 748284 - RNA, 22 nt, Human
ccauuguaguaucuguuuuagu

SEQ ID NO: 748285 - RNA, 19 nt, Human
ggugugaagugaggaguua

SEQ ID NO: 748286 - RNA, 22 nt, Human
uccugggguccugacugcuucc

SEQ ID NO: 748287 - RNA, 22 nt, Human
uaugcacagaaguuugcugaau

SEQ ID NO: 748288 - RNA, 22 nt, Human
gagcucagguggucaaaacaau

SEQ ID NO: 748289 - RNA, 22 nt, Human
cugcugugaguuuggaggucua

SEQ ID NO: 748290 - RNA, 23 nt, Human
uagugauuggaaaaacuaguuuu

SEQ ID NO: 748291 - RNA, 22 nt, Human
auuugcuucuagucaguuccau

SEQ ID NO: 748292 - RNA, 22 nt, Human
gcugccuggaauaacggcuggc

SEQ ID NO: 748293 - RNA, 22 nt, Human
gggggacuaacuggauccugga

SEQ ID NO: 748294 - RNA, 22 nt, Human
gugaauaugaucuuauuuggaa

SEQ ID NO: 748295 - RNA, 22 nt, Human
caggacaguuggcaucugcugc

SEQ ID NO: 748296 - RNA, 22 nt, Human
ugguucauaauuugcacuacug

SEQ ID NO: 748297 - RNA, 19 nt, Human
cauuuagaaguacauauua

SEQ ID NO: 748298 - RNA, 22 nt, Human
uucuaaugaaaucuguacagua

SEQ ID NO: 748299 - RNA, 22 nt, Human
gaaugugucacccugucccaug

SEQ ID NO: 748300 - RNA, 22 nt, Human
aggcccagcuugaagugggaag

SEQ ID NO: 748301 - RNA, 23 nt, Human
acagagguccaaacaguauaagc

SEQ ID NO: 748302 - RNA, 22 nt, Human
gugggugcugucaggcagggaa

SEQ ID NO: 748303 - RNA, 20 nt, Human
cucugcugcgcaucccacuu

SEQ ID NO: 748304 - RNA, 22 nt, Human
uucucugaguacguuucagugu

SEQ ID NO: 748305 - RNA, 19 nt, Human
gggagcaggaaagcugugg

SEQ ID NO: 748306 - RNA, 22 nt, Human
ugugacuugauguuugcaccag

SEQ ID NO: 748307 - RNA, 22 nt, Human
caggaacauuuaaccacagggu

SEQ ID NO: 748308 - RNA, 22 nt, Human
uucuggaagccccagagucaga

SEQ ID NO: 748309 - RNA, 22 nt, Human
cagugugccugaaucaaguguu

SEQ ID NO: 748310 - RNA, 22 nt, Human
cuguggcugaguuccuuauguu

SEQ ID NO: 748311 - RNA, 17 nt, Human
cacuugcuggucuaccu

SEQ ID NO: 748312 - RNA, 22 nt, Human
guggcagggagaagccauuggg

SEQ ID NO: 748313 - RNA, 22 nt, Human
aauaugcaaagcguguuaucug

SEQ ID NO: 748314 - RNA, 22 nt, Human
cagaguuugcaagggcagaagc

SEQ ID NO: 748315 - RNA, 22 nt, Human
acaguucuguccuagacuucgu

SEQ ID NO: 748316 - RNA, 22 nt, Human
acacaggacggcccuguggcuu

SEQ ID NO: 748317 - RNA, 22 nt, Human
acuuucuuggucccauguuuga

SEQ ID NO: 748318 - RNA, 22 nt, Human
gggaugauaaugccagaguuaa

SEQ ID NO: 748319 - RNA, 22 nt, Human
ugucaggagccaccagcacucc

SEQ ID NO: 748320 - RNA, 22 nt, Human
aacccugggucggcaccauuuu

SEQ ID NO: 748321 - RNA, 22 nt, Human
aucuuacacuguuggguuucuc

SEQ ID NO: 748322 - RNA, 22 nt, Human
ggagaagcagcuucuugaugaa

SEQ ID NO: 748323 - RNA, 22 nt, Human
gccugagaguugaaguucagug

SEQ ID NO: 748324 - RNA, 18 nt, Human
cacaggagaugaccugac

SEQ ID NO: 748325 - RNA, 22 nt, Human
gcagagccagaauggccaggac

SEQ ID NO: 748326 - RNA, 22 nt, Human
gcuggagaggaucccaaagcca

SEQ ID NO: 748327 - RNA, 22 nt, Human
uguuaaacuguauugcauaagg

SEQ ID NO: 748328 - RNA, 22 nt, Human
agcugcucuugggugacuucaa

SEQ ID NO: 748329 - RNA, 22 nt, Human
ggcucacuuuggggucagcugg

SEQ ID NO: 748330 - RNA, 22 nt, Human
acaguguggggugagauggaac

SEQ ID NO: 748331 - RNA, 22 nt, Human
gcuggguuuucuuccgggccua

SEQ ID NO: 748332 - RNA, 22 nt, Human
cugggccuuggauugacacugu

SEQ ID NO: 748333 - RNA, 17 nt, Human
gccuuccuuccuccaca

SEQ ID NO: 748334 - RNA, 21 nt, Human
uggaagggaagucuugguugu

SEQ ID NO: 748335 - RNA, 22 nt, Human
uaacugauguucccuuacugua

SEQ ID NO: 748336 - RNA, 22 nt, Human
gagcuggugaucagcuggagga

SEQ ID NO: 748337 - RNA, 22 nt, Human
aaugcuuccuccucaccucagg

SEQ ID NO: 748338 - RNA, 22 nt, Human
cucuggaagaauacacuuagaa

SEQ ID NO: 748339 - RNA, 22 nt, Human
cuucaggauuaauuuggggccu

SEQ ID NO: 748340 - RNA, 22 nt, Human
ggaggugguuugauuucuauau

SEQ ID NO: 748341 - RNA, 22 nt, Human
ugauggucaggaugcauggaga

SEQ ID NO: 748342 - RNA, 22 nt, Human
cugugccauccuagggcugcug

SEQ ID NO: 748343 - RNA, 22 nt, Human
ugacccugcuucuuggugcagg

SEQ ID NO: 748344 - RNA, 22 nt, Human
cacccaggcuggagugcauugg

SEQ ID NO: 748345 - RNA, 22 nt, Human
agcugcuuugcugggcaggccc

SEQ ID NO: 748346 - RNA, 22 nt, Human
augucccaagauacagcuagag

SEQ ID NO: 748347 - RNA, 21 nt, Human
ggcagcccgcccucuccuggc

SEQ ID NO: 748348 - RNA, 17 nt, Human
ucuguccagggagugug

SEQ ID NO: 748349 - RNA, 22 nt, Human
aaugaguuagaugagaaaauaa

SEQ ID NO: 748350 - RNA, 22 nt, Human
ugaaggagcugauguaaggggu

SEQ ID NO: 748351 - RNA, 22 nt, Human
gaaacguuguggaaaauccucu

SEQ ID NO: 748352 - RNA, 22 nt, Human
gaggggcagagguagagaacaa

SEQ ID NO: 748353 - RNA, 22 nt, Human
acuucauguuguuuacaacuua

SEQ ID NO: 748354 - RNA, 22 nt, Human
ugcagcaggcacaggacggaag

SEQ ID NO: 748355 - RNA, 22 nt, Human
ucuuauuuuuuaaugacagaga

SEQ ID NO: 748356 - RNA, 22 nt, Human
ccagcuucucucugaugcagcu

SEQ ID NO: 748357 - RNA, 18 nt, Human
gaggauggaaggagaugc

SEQ ID NO: 748358 - RNA, 18 nt, Human
aggugcagccucugaggc

SEQ ID NO: 748359 - RNA, 22 nt, Human
agggaggaguccucaaagucau

SEQ ID NO: 748360 - RNA, 22 nt, Human
uucuccaguuucucccuucagu

SEQ ID NO: 748361 - RNA, 22 nt, Human
accccaggagcugugccuaguc

SEQ ID NO: 748362 - RNA, 22 nt, Human
cagaggcugaugugggaugggc

SEQ ID NO: 748363 - RNA, 22 nt, Human
uucaagaaagaguggcuauucc

SEQ ID NO: 748364 - RNA, 19 nt, Human
caagacaaagcccaucuuc

SEQ ID NO: 748365 - RNA, 22 nt, Human
gcagcauacagggagaguacuc

SEQ ID NO: 748366 - RNA, 16 nt, Human
gcuaggcaacaggcug

SEQ ID NO: 748367 - RNA, 22 nt, Human
agcacccuucagcccagccugg

SEQ ID NO: 748368 - RNA, 22 nt, Human
ggaggucaaauggagggcuggg

SEQ ID NO: 748369 - RNA, 22 nt, Human
ccaagggcucugacuugccugc

SEQ ID NO: 748370 - RNA, 23 nt, Human
gcuuccauucuaguuugcugugc

SEQ ID NO: 748371 - RNA, 17 nt, Human
ccagagcuacugagacu

SEQ ID NO: 748372 - RNA, 20 nt, Human
aggcacuggggauagguaag

SEQ ID NO: 748373 - RNA, 21 nt, Human
uagcagaaacaguucaggcca

SEQ ID NO: 748374 - RNA, 22 nt, Human
uauuaacaugaacugacuuuuc

SEQ ID NO: 748375 - RNA, 22 nt, Human
gaggucagucagaccaggguuu

SEQ ID NO: 748376 - RNA, 22 nt, Human
guggagggaaugaaucuucucu

SEQ ID NO: 748377 - RNA, 22 nt, Human
gaggugugguccucagccccca

SEQ ID NO: 748378 - RNA, 19 nt, Human
uacaaguaggcguuuucuc

SEQ ID NO: 748379 - RNA, 22 nt, Human
uggagaaucuggaaacuguuga

SEQ ID NO: 748380 - RNA, 22 nt, Human
ugcugcugaucauuuauagucu

SEQ ID NO: 748381 - RNA, 22 nt, Human
caugggaggccugcugcuggug

SEQ ID NO: 748382 - RNA, 22 nt, Human
cauaauuauaaacgcaaguuca

SEQ ID NO: 748383 - RNA, 22 nt, Human
agcucacauucucaucagaugu

SEQ ID NO: 748384 - RNA, 21 nt, Human
ucuguuggaggccucucuucc

SEQ ID NO: 748385 - RNA, 17 nt, Human
gacagcugguuccuggc

SEQ ID NO: 748386 - RNA, 22 nt, Human
cuuucacauaauugaccuugaa

SEQ ID NO: 748387 - RNA, 22 nt, Human
cccugaggcaguaggagcuuuu

SEQ ID NO: 748388 - RNA, 22 nt, Human
uccauucauucauugaugaaca

SEQ ID NO: 748389 - RNA, 22 nt, Human
ucuuugaaguugaaguaguugg

SEQ ID NO: 748390 - RNA, 22 nt, Human
uggccugguaccacauagauuu

SEQ ID NO: 748391 - RNA, 22 nt, Human
ucacacagggucggaaagagug

SEQ ID NO: 748392 - RNA, 22 nt, Human
cagagaacauucagagcuguag

SEQ ID NO: 748393 - RNA, 22 nt, Human
ucccaggaggugcuuccuagga

SEQ ID NO: 748394 - RNA, 22 nt, Human
uaaaggcuuuuacaggagugca

SEQ ID NO: 748395 - RNA, 22 nt, Human
cugggcuccuaaccauccaggu

SEQ ID NO: 748396 - RNA, 22 nt, Human
agauggcugggccccaccccag

SEQ ID NO: 748397 - RNA, 22 nt, Human
ugggccagcaauugcugcucag

SEQ ID NO: 748398 - RNA, 22 nt, Human
gggggcggagcacgugaccacg

SEQ ID NO: 748399 - RNA, 22 nt, Human
uucaucaauguguuuaauaaug

SEQ ID NO: 748400 - RNA, 22 nt, Human
ucaggcaggaucccagggaagg

SEQ ID NO: 748401 - RNA, 22 nt, Human
ucugccugagaaguggggugcc

SEQ ID NO: 748402 - RNA, 20 nt, Human
gagagcuggggaugaggcug

SEQ ID NO: 748403 - RNA, 22 nt, Human
gcugucacaaauauuucucagc

SEQ ID NO: 748404 - RNA, 22 nt, Human
aaauugcagguaggugggugau

SEQ ID NO: 748405 - RNA, 22 nt, Human
gcacccuagaguugccugagga

SEQ ID NO: 748406 - RNA, 22 nt, Human
agcagcugguaggaguggccac

SEQ ID NO: 748407 - RNA, 22 nt, Human
agagaggcugcuggacuauaug

SEQ ID NO: 748408 - RNA, 22 nt, Human
ccugaggcaaggacuugguggc

SEQ ID NO: 748409 - RNA, 22 nt, Human
cccaggcaggagugugguggcu

SEQ ID NO: 748410 - RNA, 22 nt, Human
cuuaaccagaaaaugcacuugu

SEQ ID NO: 748411 - RNA, 22 nt, Human
ucucagagccuaacuaaccuaa

SEQ ID NO: 748412 - RNA, 22 nt, Human
gaacccaggcuuuugaggcugu

SEQ ID NO: 748413 - RNA, 22 nt, Human
uguguuaaggugcaucuagugc

SEQ ID NO: 748414 - RNA, 22 nt, Human
cugcuggugaugucugggcaug

SEQ ID NO: 748415 - RNA, 18 nt, Human
ccagggaugcaugguccc

SEQ ID NO: 748416 - RNA, 22 nt, Human
aaugaguucugacacuucacga

SEQ ID NO: 748417 - RNA, 22 nt, Human
gagcuggucaguuucagggcca

SEQ ID NO: 748418 - RNA, 22 nt, Human
acuagauuuuggccauuauaca

SEQ ID NO: 748419 - RNA, 22 nt, Human
uuguacaaguauuaugugaaca

SEQ ID NO: 748420 - RNA, 22 nt, Human
ucauugcucuagguuccuugga

SEQ ID NO: 748421 - RNA, 22 nt, Human
gagauggagaaggaagcuguuu

SEQ ID NO: 748422 - RNA, 20 nt, Human
uuuaccaaaggaguuaugau

SEQ ID NO: 748423 - RNA, 22 nt, Human
gcucuggguucugauuuaugag

SEQ ID NO: 748424 - RNA, 22 nt, Human
ugucugaaagaggacgagcugg

SEQ ID NO: 748425 - RNA, 22 nt, Human
uaauugucagguuuuaguauca

SEQ ID NO: 748426 - RNA, 22 nt, Human
acauggaagcaaaguucuauuu

SEQ ID NO: 748427 - RNA, 22 nt, Human
acuggcacaagaagagucgugg

SEQ ID NO: 748428 - RNA, 22 nt, Human
auguacacaugcaugcaugugc

SEQ ID NO: 748429 - RNA, 19 nt, Human
cucagucuggcucugccug

SEQ ID NO: 748430 - RNA, 22 nt, Human
ugucauuuaugcuucuucagug

SEQ ID NO: 748431 - RNA, 22 nt, Human
augcacaggaccacacauaaug

SEQ ID NO: 748432 - RNA, 21 nt, Human
gccugcaguuuugaagcccuu

SEQ ID NO: 748433 - RNA, 22 nt, Human
ugcaauaucagauucaacacau

SEQ ID NO: 748434 - RNA, 22 nt, Human
uauuuaauaaaacuauggcaug

SEQ ID NO: 748435 - RNA, 22 nt, Human
ucaagucuugaugagacaaacc

SEQ ID NO: 748436 - RNA, 22 nt, Human
cugcugcucagugucaucaugu

SEQ ID NO: 748437 - RNA, 22 nt, Human
acauugaagggaaugcaaagau

SEQ ID NO: 748438 - RNA, 22 nt, Human
ugaguagauccaagacuguccu

SEQ ID NO: 748439 - RNA, 22 nt, Human
aggugucugugaugggagcgau

SEQ ID NO: 748440 - RNA, 22 nt, Human
auucugaauucugagccuuuca

SEQ ID NO: 748441 - RNA, 22 nt, Human
gagcccugcggagccccgaggc

SEQ ID NO: 748442 - RNA, 22 nt, Human
ugucugaauuccacaucguucu

SEQ ID NO: 748443 - RNA, 22 nt, Human
agauuucugucaccuucuaugc

SEQ ID NO: 748444 - RNA, 22 nt, Human
agaguggguuauaggcagacuu

SEQ ID NO: 748445 - RNA, 22 nt, Human
agaaaggucacuuagccucagc

SEQ ID NO: 748446 - RNA, 21 nt, Human
guuuacaaggcuuugcuccug

SEQ ID NO: 748447 - RNA, 22 nt, Human
uggcaugauaggaggugcagaa

SEQ ID NO: 748448 - RNA, 19 nt, Human
cauuuucucauugugcccc

SEQ ID NO: 748449 - RNA, 22 nt, Human
uuugaaaguccuaggagagucc

SEQ ID NO: 748450 - RNA, 23 nt, Human
gaacagacauuagugagccaggc

SEQ ID NO: 748451 - RNA, 22 nt, Human
cacagggcagugcugcccacuc

SEQ ID NO: 748452 - RNA, 22 nt, Human
acaguggaauuuguagaugugu

SEQ ID NO: 748453 - RNA, 22 nt, Human
agagaugucgccuugcccaggg

SEQ ID NO: 748454 - RNA, 22 nt, Human
uaaggccagccagcaaaucugu

SEQ ID NO: 748455 - RNA, 22 nt, Human
cagagguugagcaaaaaugaua

SEQ ID NO: 748456 - RNA, 22 nt, Human
cacuaguccugguuucaugcua

SEQ ID NO: 748457 - RNA, 22 nt, Human
aaguaaaauguuuccuuuauua

SEQ ID NO: 748458 - RNA, 22 nt, Human
cugugggagcacuggggaccga

SEQ ID NO: 748459 - RNA, 22 nt, Human
guggaugauugacucuguagac

SEQ ID NO: 748460 - RNA, 22 nt, Human
auaacaugaccugugcuucaca

SEQ ID NO: 748461 - RNA, 22 nt, Human
ucauggcuucaaggaagcaggc

SEQ ID NO: 748462 - RNA, 22 nt, Human
ccagcuuuagguugccugccag

SEQ ID NO: 748463 - RNA, 22 nt, Human
acagccuggccugaguuaaggc

SEQ ID NO: 748464 - RNA, 22 nt, Human
auccucaguguuucugacaucu

SEQ ID NO: 748465 - RNA, 22 nt, Human
cacauguaguaagcaggcaaug

SEQ ID NO: 748466 - RNA, 22 nt, Human
gcggggggcagcagucgcucag

SEQ ID NO: 748467 - RNA, 22 nt, Human
uagcaucugcauuuguaacuag

SEQ ID NO: 748468 - RNA, 22 nt, Human
acccagggcagccagcggggag

SEQ ID NO: 748469 - RNA, 22 nt, Human
cugcgugcauuaauauuuccuu

SEQ ID NO: 748470 - RNA, 22 nt, Human
aucucguuuugagaacuguguu

SEQ ID NO: 748471 - RNA, 22 nt, Human
gagcagagcuucucaaaguaaa

SEQ ID NO: 748472 - RNA, 22 nt, Human
aauuuccugggauaaaaagcca

SEQ ID NO: 748473 - RNA, 21 nt, Human
aaauacagaaacuuguuuuca

SEQ ID NO: 748474 - RNA, 22 nt, Human
gugcuggggguuucuguagguc

SEQ ID NO: 748475 - RNA, 19 nt, Human
gugaggauacugcucagag

SEQ ID NO: 748476 - RNA, 22 nt, Human
uguuauuuaucugagcauuuau

SEQ ID NO: 748477 - RNA, 22 nt, Human
cuauuucaaggcccagauauga

SEQ ID NO: 748478 - RNA, 22 nt, Human
acugcagacucuacaguuauaa

SEQ ID NO: 748479 - RNA, 22 nt, Human
aagcauauuuuaauuagccaca

SEQ ID NO: 748480 - RNA, 22 nt, Human
cauucuucuggauaguuaguug

SEQ ID NO: 748481 - RNA, 22 nt, Human
ucacuguuagagcaaacguaug

SEQ ID NO: 748482 - RNA, 22 nt, Human
ccaccaggcacucacagggaag

SEQ ID NO: 748483 - RNA, 22 nt, Human
caauguuuuuccuuccuuaaua

SEQ ID NO: 748484 - RNA, 22 nt, Human
gugugggcugcagaggcacagc

SEQ ID NO: 748485 - RNA, 18 nt, Human
ucuacccucucagagucu

SEQ ID NO: 748486 - RNA, 22 nt, Human
uuuacucaaguaugcauuuaug

SEQ ID NO: 748487 - RNA, 22 nt, Human
ggagugaggcauuuguagcuga

SEQ ID NO: 748488 - RNA, 22 nt, Human
uguucagaaaacagauaacuaa

SEQ ID NO: 748489 - RNA, 22 nt, Human
cacugucuucaguuucacugca

SEQ ID NO: 748490 - RNA, 22 nt, Human
ucuuuaucuggcucagagacac

SEQ ID NO: 748491 - RNA, 22 nt, Human
aaaucuaggcucauccuggucc

SEQ ID NO: 748492 - RNA, 22 nt, Human
agcaggcagcaugggacccucc

SEQ ID NO: 748493 - RNA, 22 nt, Human
gcccagggcugcaaguggacgc

SEQ ID NO: 748494 - RNA, 22 nt, Human
acuuugcacuucaauauaacuu

SEQ ID NO: 748495 - RNA, 22 nt, Human
cauaaucccaggcuugcauuca

SEQ ID NO: 748496 - RNA, 22 nt, Human
gccacagugggcuggggccaga

SEQ ID NO: 748497 - RNA, 22 nt, Human
uccagcugacaucuccugaggg

SEQ ID NO: 748498 - RNA, 22 nt, Human
ggcaggcucuuggccuuaugag

SEQ ID NO: 748499 - RNA, 22 nt, Human
acaggacaacucagcagccagc

SEQ ID NO: 748500 - RNA, 22 nt, Human
gcccucucggcauagcaggggc

SEQ ID NO: 748501 - RNA, 22 nt, Human
gaggggaagacuucuggacagu

SEQ ID NO: 748502 - RNA, 22 nt, Human
aggccacauugugauucccgca

SEQ ID NO: 748503 - RNA, 18 nt, Human
gcuuuuuagugcaucuuc

SEQ ID NO: 748504 - RNA, 22 nt, Human
auucuuacaaagcagagucugu

SEQ ID NO: 748505 - RNA, 22 nt, Human
ucacauuguaggucauuugcaa

SEQ ID NO: 748506 - RNA, 20 nt, Human
uaaaugcaugaauguaaggc

SEQ ID NO: 748507 - RNA, 22 nt, Human
ugagaaucauccagaggcuucu

SEQ ID NO: 748508 - RNA, 22 nt, Human
cucuguggcuugccuuucuguc

SEQ ID NO: 748509 - RNA, 22 nt, Human
cacagugaccucuuuaaaaggg

SEQ ID NO: 748510 - RNA, 18 nt, Human
cagggccccagaauuauc

SEQ ID NO: 748511 - RNA, 22 nt, Human
ggaguggcuguuucugccccca

SEQ ID NO: 748512 - RNA, 22 nt, Human
cugauuuucaaaauguguuaaa

SEQ ID NO: 748513 - RNA, 22 nt, Human
cuuuaagacuaaauuagaguuu

SEQ ID NO: 748514 - RNA, 22 nt, Human
uauuacagggcuaguuaugagu

SEQ ID NO: 748515 - RNA, 22 nt, Human
ggaacauuuccuggcagagagg

SEQ ID NO: 748516 - RNA, 22 nt, Human
augagguaucucauuuccugaa

SEQ ID NO: 748517 - RNA, 22 nt, Human
ucaugcagcuuuuccauucagc

SEQ ID NO: 748518 - RNA, 22 nt, Human
guuacucuuccccggggucugg

SEQ ID NO: 748519 - RNA, 22 nt, Human
ggccucagaggaggugugaguc

SEQ ID NO: 748520 - RNA, 22 nt, Human
ccagccagcaagcucccaguuc

SEQ ID NO: 748521 - RNA, 22 nt, Human
ucauucucugggaugcaguuug

SEQ ID NO: 748522 - RNA, 22 nt, Human
aauccauguugauguauauuuu

SEQ ID NO: 748523 - RNA, 22 nt, Human
ucuggcucggauuugucuagca

SEQ ID NO: 748524 - RNA, 22 nt, Human
aaaauaacuucuacuauuugca

SEQ ID NO: 748525 - RNA, 22 nt, Human
caauuucugggccucacacaag

SEQ ID NO: 748526 - RNA, 22 nt, Human
guagaacucccagugguauugu

SEQ ID NO: 748527 - RNA, 22 nt, Human
caaguauauuugaacauguaaa

SEQ ID NO: 748528 - RNA, 22 nt, Human
uugucugcuugaugccaagcau

SEQ ID NO: 748529 - RNA, 22 nt, Human
gugcuuucugcugcauuccucu

SEQ ID NO: 748530 - RNA, 22 nt, Human
gaaggcuguggcuggucucagu

SEQ ID NO: 748531 - RNA, 22 nt, Human
auucagcauuggcaccauggau

SEQ ID NO: 748532 - RNA, 22 nt, Human
guacauauuacagacaaagcuu

SEQ ID NO: 748533 - RNA, 22 nt, Human
acagugaauaagacaugugcuu

SEQ ID NO: 748534 - RNA, 22 nt, Human
ggagucugaguccucauagaca

SEQ ID NO: 748535 - RNA, 22 nt, Human
aaagcaguauaaguaacggaag

SEQ ID NO: 748536 - RNA, 22 nt, Human
agcaggugagcacagccaggcu

SEQ ID NO: 748537 - RNA, 22 nt, Human
auucauguuagcccacauguag

SEQ ID NO: 748538 - RNA, 22 nt, Human
ucucucaaccucggcacuauug

SEQ ID NO: 748539 - RNA, 18 nt, Human
ucaagacaucaugaaaua

SEQ ID NO: 748540 - RNA, 19 nt, Human
cuggccuguguccugugcu

SEQ ID NO: 748541 - RNA, 22 nt, Human
agccaugggagacugugggaga

SEQ ID NO: 748542 - RNA, 22 nt, Human
acccaggcuggagugcaguguc

SEQ ID NO: 748543 - RNA, 22 nt, Human
uacaaugcagugaccuccuuua

SEQ ID NO: 748544 - RNA, 22 nt, Human
caguccuggagcccuucuuggc

SEQ ID NO: 748545 - RNA, 22 nt, Human
cacacacucuuccuggcaccua

SEQ ID NO: 748546 - RNA, 22 nt, Human
uucuaguugagggagacaaaua

SEQ ID NO: 748547 - RNA, 22 nt, Human
ugcugagacaccuaagguaaau

SEQ ID NO: 748548 - RNA, 18 nt, Human
uccagagcagucuuuggc

SEQ ID NO: 748549 - RNA, 22 nt, Human
uccugagggcugcagucauagg

SEQ ID NO: 748550 - RNA, 22 nt, Human
uuuaauuuuccucuuccuggag

SEQ ID NO: 748551 - RNA, 22 nt, Human
ucuaagaggcaucaagacaagc

SEQ ID NO: 748552 - RNA, 22 nt, Human
ggagggaguuucauuccugccc

SEQ ID NO: 748553 - RNA, 22 nt, Human
ucucauugguauauacaugugu

SEQ ID NO: 748554 - RNA, 22 nt, Human
cugccuccuggcugauggguag

SEQ ID NO: 748555 - RNA, 22 nt, Human
agggaagagcuugcaagaaacc

SEQ ID NO: 748556 - RNA, 18 nt, Human
guuuccugucuuacgggg

SEQ ID NO: 748557 - RNA, 22 nt, Human
augaauaugagacugagagccu

SEQ ID NO: 748558 - RNA, 22 nt, Human
auuauaaagaacaugugugugg

SEQ ID NO: 748559 - RNA, 22 nt, Human
gaccuggaggcuuuucccaaga

SEQ ID NO: 748560 - RNA, 22 nt, Human
ccguggaguugugcugaguaug

SEQ ID NO: 748561 - RNA, 22 nt, Human
aucagugcuaaagcaaaugccc

SEQ ID NO: 748562 - RNA, 22 nt, Human
aagucucucauggcugacagca

SEQ ID NO: 748563 - RNA, 22 nt, Human
aguguuucuggcaaaugaaagu

SEQ ID NO: 748564 - RNA, 22 nt, Human
uucuggaaagauuugcguguaa

SEQ ID NO: 748565 - RNA, 22 nt, Human
uguguaugcauacacacauaga

SEQ ID NO: 748566 - RNA, 23 nt, Human
ugcuuauucaaaaggugcuuuca

SEQ ID NO: 748567 - RNA, 23 nt, Human
cuacaagagcaagcauggacaag

SEQ ID NO: 748568 - RNA, 22 nt, Human
aucuacagugcacaggacagcc

SEQ ID NO: 748569 - RNA, 22 nt, Human
aaagccauugaacuguacuuua

SEQ ID NO: 748570 - RNA, 22 nt, Human
ccaugcacaccagcaggcagac

SEQ ID NO: 748571 - RNA, 22 nt, Human
gagcaucacuguccucuccccg

SEQ ID NO: 748572 - RNA, 22 nt, Human
uuguuacaucuuauguaagugg

SEQ ID NO: 748573 - RNA, 22 nt, Human
uagggcucugcucaucaguugu

SEQ ID NO: 748574 - RNA, 21 nt, Human
uccagcacagaugaccucccc

SEQ ID NO: 748575 - RNA, 22 nt, Human
cagagacaccccagaaaauaag

SEQ ID NO: 748576 - RNA, 22 nt, Human
gggcaaaaccugggcaucauga

SEQ ID NO: 748577 - RNA, 22 nt, Human
ugaaugaugcauuuguuuccca

SEQ ID NO: 748578 - RNA, 22 nt, Human
uacuucaauuuguauaugugaa

SEQ ID NO: 748579 - RNA, 22 nt, Human
ugccaccaucuggcuguguuga

SEQ ID NO: 748580 - RNA, 22 nt, Human
cugagggagaagucacgggcag

SEQ ID NO: 748581 - RNA, 22 nt, Human
uggugaggaagaccugcuccug

SEQ ID NO: 748582 - RNA, 22 nt, Human
cccucccuuugcagcagugcau

SEQ ID NO: 748583 - RNA, 23 nt, Human
ugugacagugacaauacugacuu

SEQ ID NO: 748584 - RNA, 22 nt, Human
auuaaacaauguaaaguucuug

SEQ ID NO: 748585 - RNA, 22 nt, Human
cugagccaccggcagggacauc

SEQ ID NO: 748586 - RNA, 22 nt, Human
caguauuuguuacagcauuagc

SEQ ID NO: 748587 - RNA, 22 nt, Human
ggcacagucccuggcacagagu

SEQ ID NO: 748588 - RNA, 22 nt, Human
ucagaaaagguagcugugacaa

SEQ ID NO: 748589 - RNA, 22 nt, Human
gcccagcugagaagcgcggggc

SEQ ID NO: 748590 - RNA, 22 nt, Human
auaaccugagauugagcugccu

SEQ ID NO: 748591 - RNA, 22 nt, Human
ucauugaauauggggccauaca

SEQ ID NO: 748592 - RNA, 22 nt, Human
auuccucagcaggccuuuuguu

SEQ ID NO: 748593 - RNA, 22 nt, Human
caugaacagauucuucauuucu

SEQ ID NO: 748594 - RNA, 22 nt, Human
ggaucauuaagaauagcuacua

SEQ ID NO: 748595 - RNA, 22 nt, Human
aagaacuaucucuggcuguagg

SEQ ID NO: 748596 - RNA, 19 nt, Human
auggccaguuuagagguuu

SEQ ID NO: 748597 - RNA, 22 nt, Human
agcacaaauauaaaaaugucug

SEQ ID NO: 748598 - RNA, 22 nt, Human
aguguguagcaauaugcuggca

SEQ ID NO: 748599 - RNA, 22 nt, Human
guccaagagucaagaagggggc

SEQ ID NO: 748600 - RNA, 18 nt, Human
cugugggcuggugcauga

SEQ ID NO: 748601 - RNA, 22 nt, Human
gauuuccaggucauuaauaaag

SEQ ID NO: 748602 - RNA, 22 nt, Human
acuugaaaggaagcucuaaaac

SEQ ID NO: 748603 - RNA, 22 nt, Human
aaucuuuugauucuagggcugu

SEQ ID NO: 748604 - RNA, 22 nt, Human
cucucagacugaagggccugug

SEQ ID NO: 748605 - RNA, 17 nt, Human
uuacaacaauucaugag

SEQ ID NO: 748606 - RNA, 22 nt, Human
gugucuuagaaagacugaaugc

SEQ ID NO: 748607 - RNA, 22 nt, Human
ggggaagauggcccuccaugug

SEQ ID NO: 748608 - RNA, 22 nt, Human
aguguuuccugaguguuaucau

SEQ ID NO: 748609 - RNA, 22 nt, Human
cuuuagaauuucauguuugguc

SEQ ID NO: 748610 - RNA, 22 nt, Human
cugggagucuaagcuagcaccg

SEQ ID NO: 748611 - RNA, 22 nt, Human
auuucccagauaaacagcugga

SEQ ID NO: 748612 - RNA, 22 nt, Human
cugaggaaggcugggggcaucc

SEQ ID NO: 748613 - RNA, 22 nt, Human
gacccuggggaccaucuagccc

SEQ ID NO: 748614 - RNA, 20 nt, Human
uguuucuuuuaaugagcggc

SEQ ID NO: 748615 - RNA, 22 nt, Human
uggugcugacaguucugagugc

SEQ ID NO: 748616 - RNA, 22 nt, Human
uuucucaucuggaaacagugcu

SEQ ID NO: 748617 - RNA, 22 nt, Human
cacauauaugaaaugaggaauu

SEQ ID NO: 748618 - RNA, 18 nt, Human
caaagcucacguuccauc

SEQ ID NO: 748619 - RNA, 22 nt, Human
augaugcuguuuaucauauacu

SEQ ID NO: 748620 - RNA, 22 nt, Human
acuuuuuacaggguguauacca

SEQ ID NO: 748621 - RNA, 22 nt, Human
ugcagcugaggccagcuaugcc

SEQ ID NO: 748622 - RNA, 22 nt, Human
uagcagggagggccagugucaa

SEQ ID NO: 748623 - RNA, 23 nt, Human
agccagggcacugguggagauug

SEQ ID NO: 748624 - RNA, 22 nt, Human
caagagcauuuaguuagcuggu

SEQ ID NO: 748625 - RNA, 22 nt, Human
uucuuucccuuccagcagcucc

SEQ ID NO: 748626 - RNA, 22 nt, Human
ggcugccuuuagaacggaugcu

SEQ ID NO: 748627 - RNA, 22 nt, Human
uguguccacgcacuggcaugau

SEQ ID NO: 748628 - RNA, 22 nt, Human
cagcacugcuucgcagccaggg

SEQ ID NO: 748629 - RNA, 22 nt, Human
acagcuuuugaaaaauuacugg

SEQ ID NO: 748630 - RNA, 22 nt, Human
uggcccugcacccagagcaguu

SEQ ID NO: 748631 - RNA, 22 nt, Human
ugccaggcugaacagggucuua

SEQ ID NO: 748632 - RNA, 22 nt, Human
aaauuguaaugacuucacuuga

SEQ ID NO: 748633 - RNA, 22 nt, Human
ugcugccaccccucaccagagc

SEQ ID NO: 748634 - RNA, 22 nt, Human
caugccuguauuucugaucuau

SEQ ID NO: 748635 - RNA, 22 nt, Human
ccacuguaaguuugaaaauaac

SEQ ID NO: 748636 - RNA, 22 nt, Human
cauccugagaggucucucuacc

SEQ ID NO: 748637 - RNA, 22 nt, Human
gcaguguggcguggggaccuaa

SEQ ID NO: 748638 - RNA, 22 nt, Human
uagaaagcuugggguguuuaaa

SEQ ID NO: 748639 - RNA, 22 nt, Human
uuuauguaauuucauaggugug

SEQ ID NO: 748640 - RNA, 22 nt, Human
auuacaacuacauaaucucaga

SEQ ID NO: 748641 - RNA, 22 nt, Human
uguuuauaccugcaaccuguca

SEQ ID NO: 748642 - RNA, 22 nt, Human
gacagggcugugggaggagcag

SEQ ID NO: 748643 - RNA, 22 nt, Human
aggcagugcucaagacagcagc

SEQ ID NO: 748644 - RNA, 23 nt, Human
ucugggcaccuuguugacaugau

SEQ ID NO: 748645 - RNA, 22 nt, Human
gagcccaguaggcaaagcugca

SEQ ID NO: 748646 - RNA, 20 nt, Human
ugucugcucauaauaaaccc

SEQ ID NO: 748647 - RNA, 22 nt, Human
cuggccagugccugugggcccc

SEQ ID NO: 748648 - RNA, 22 nt, Human
ggggggugcugaucaguggagc

SEQ ID NO: 748649 - RNA, 22 nt, Human
ucccugaaacaucucuguggau

SEQ ID NO: 748650 - RNA, 22 nt, Human
uccaggcugacgcagcuauuua

SEQ ID NO: 748651 - RNA, 22 nt, Human
gagggcuuccauggggagcccc

SEQ ID NO: 748652 - RNA, 22 nt, Human
cuggccagaguuggagggugug

SEQ ID NO: 748653 - RNA, 22 nt, Human
gucagaucuuuggggaugcugu

SEQ ID NO: 748654 - RNA, 22 nt, Human
uauaaagagucuaucugguggc

SEQ ID NO: 748655 - RNA, 22 nt, Human
gaaccugagcccagguggcauu

SEQ ID NO: 748656 - RNA, 22 nt, Human
ucuuuccuuagaauaauucuuu

SEQ ID NO: 748657 - RNA, 22 nt, Human
aucuagaaaguguugaagauca

SEQ ID NO: 748658 - RNA, 22 nt, Human
aucuggcucucucauuuacaaa

SEQ ID NO: 748659 - RNA, 22 nt, Human
uccuggcuaacacggugacacc

SEQ ID NO: 748660 - RNA, 22 nt, Human
caaggcuugaauucugaugggu

SEQ ID NO: 748661 - RNA, 22 nt, Human
uuuagcuugaaaguuuuggagg

SEQ ID NO: 748662 - RNA, 22 nt, Human
gcccagcccagaaagguucgga

SEQ ID NO: 748663 - RNA, 22 nt, Human
gaggaggcacuugagcagaugu

SEQ ID NO: 748664 - RNA, 22 nt, Human
cauuuguagcuauuuacuguau

SEQ ID NO: 748665 - RNA, 22 nt, Human
ucagaaguccccagucaaggag

SEQ ID NO: 748666 - RNA, 22 nt, Human
cagcagagaugagauuccuaua

SEQ ID NO: 748667 - RNA, 22 nt, Human
uccagcagccacaccucuggac

SEQ ID NO: 748668 - RNA, 22 nt, Human
aggccuguuccuuccugggcac

SEQ ID NO: 748669 - RNA, 22 nt, Human
ugaggauggucccgaggacacu

SEQ ID NO: 748670 - RNA, 22 nt, Human
uccagcccugcuuccugccuca

SEQ ID NO: 748671 - RNA, 22 nt, Human
aacuuuguuuuauucacugcug

SEQ ID NO: 748672 - RNA, 22 nt, Human
ucccuccaggcagcuggguacu

SEQ ID NO: 748673 - RNA, 22 nt, Human
gcagauggacuguaugaccuga

SEQ ID NO: 748674 - RNA, 16 nt, Human
agccaggcugccucgg

SEQ ID NO: 748675 - RNA, 22 nt, Human
accaggcuccccuuggauccug

SEQ ID NO: 748676 - RNA, 17 nt, Human
gagacagcaggagcccc

SEQ ID NO: 748677 - RNA, 22 nt, Human
ugugaaaucaauuagcugcaga

SEQ ID NO: 748678 - RNA, 22 nt, Human
aaaugaacaucaagaauagccu

SEQ ID NO: 748679 - RNA, 22 nt, Human
agcuguguagggaaucagagaa

SEQ ID NO: 748680 - RNA, 22 nt, Human
cccagcaggcauguugggagga

SEQ ID NO: 748681 - RNA, 22 nt, Human
auuccuucuaaaacgcugcccu

SEQ ID NO: 748682 - RNA, 22 nt, Human
ucuccucucuuaccugguacaa

SEQ ID NO: 748683 - RNA, 22 nt, Human
gaggagaagggcacggagaaaa

SEQ ID NO: 748684 - RNA, 22 nt, Human
agccucucuguuagucacuggg

SEQ ID NO: 748685 - RNA, 22 nt, Human
uauauuguaggugcuauuugaa

SEQ ID NO: 748686 - RNA, 22 nt, Human
aggcuaagauguggucugagca

SEQ ID NO: 748687 - RNA, 22 nt, Human
gcuggagauaguaggauccaua

SEQ ID NO: 748688 - RNA, 22 nt, Human
uuauggaauacuuaugcugcag

SEQ ID NO: 748689 - RNA, 22 nt, Human
agaagugagacucaguugauga

SEQ ID NO: 748690 - RNA, 22 nt, Human
ugcuauaagaauuauauuacuc

SEQ ID NO: 748691 - RNA, 22 nt, Human
aaggugguuguaggcuggucug

SEQ ID NO: 748692 - RNA, 22 nt, Human
ugcuggaauuugccuucuggaa

SEQ ID NO: 748693 - RNA, 21 nt, Human
agaagucaauugaacugaaau

SEQ ID NO: 748694 - RNA, 22 nt, Human
auuuuaucugcuuacuuucagg

SEQ ID NO: 748695 - RNA, 23 nt, Human
ucucaggcaaaccaggacaaguu

SEQ ID NO: 748696 - RNA, 22 nt, Human
uuaauguuuuaaguuauagaga

SEQ ID NO: 748697 - RNA, 22 nt, Human
aacaugauggggaagaacaaga

SEQ ID NO: 748698 - RNA, 22 nt, Human
ugcuuugccagacaguucccuu

SEQ ID NO: 748699 - RNA, 22 nt, Human
uggcacugaccccaggccugug

SEQ ID NO: 748700 - RNA, 22 nt, Human
gcccaggaguuggaggcugcag

SEQ ID NO: 748701 - RNA, 22 nt, Human
caggcuuggcagggaggcuggu

SEQ ID NO: 748702 - RNA, 22 nt, Human
ggcucagagguugaggccggca

SEQ ID NO: 748703 - RNA, 20 nt, Human
cgcagcaguggaaguggaau

SEQ ID NO: 748704 - RNA, 20 nt, Human
ucaagaugaggucauacugg

SEQ ID NO: 748705 - RNA, 22 nt, Human
uggcuucuggcuggugagaaau

SEQ ID NO: 748706 - RNA, 22 nt, Human
uaagcauuaugguaaagaagua

SEQ ID NO: 748707 - RNA, 22 nt, Human
acaguguucucuuccuguauag

SEQ ID NO: 748708 - RNA, 22 nt, Human
acuggcuugaaguagauucaaa

SEQ ID NO: 748709 - RNA, 22 nt, Human
accagggcaaauguuuguacuc

SEQ ID NO: 748710 - RNA, 22 nt, Human
gcucccuguucucagccaugau

SEQ ID NO: 748711 - RNA, 22 nt, Human
gaaagcuuccauuuuguacauu

SEQ ID NO: 748712 - RNA, 22 nt, Human
cuuggccucuucucaggguggg

SEQ ID NO: 748713 - RNA, 22 nt, Human
uccagagcagguggucagaagg

SEQ ID NO: 748714 - RNA, 22 nt, Human
ggucuagaucaagaacagaacu

SEQ ID NO: 748715 - RNA, 18 nt, Human
aacuguugaaauagcuug

SEQ ID NO: 748716 - RNA, 22 nt, Human
aagagcaucuauuucacagugg

SEQ ID NO: 748717 - RNA, 22 nt, Human
uagcacacgcauuagcaaauca

SEQ ID NO: 748718 - RNA, 22 nt, Human
ccagcaagugcagauggccaag

SEQ ID NO: 748719 - RNA, 22 nt, Human
auuagagguuguuuuguaaaga

SEQ ID NO: 748720 - RNA, 23 nt, Human
acagcugcaccuggccgccuggc

SEQ ID NO: 748721 - RNA, 22 nt, Human
gccaccuccuuauuccaccugu

SEQ ID NO: 748722 - RNA, 22 nt, Human
guacacaaaagaggaaaccgga

SEQ ID NO: 748723 - RNA, 22 nt, Human
cuggaucuugcugcauugagaa

SEQ ID NO: 748724 - RNA, 22 nt, Human
gccugggauagaggcaaugcau

SEQ ID NO: 748725 - RNA, 22 nt, Human
aucuguacaagauuuuaugcgu

SEQ ID NO: 748726 - RNA, 22 nt, Human
cugcagcuuucgcuccaucagc

SEQ ID NO: 748727 - RNA, 22 nt, Human
aauaucagaauguaaugguccu

SEQ ID NO: 748728 - RNA, 22 nt, Human
ugauggaacagccuuugccaaa

SEQ ID NO: 748729 - RNA, 22 nt, Human
cacgugagaccuugcagaggug

SEQ ID NO: 748730 - RNA, 22 nt, Human
aaaaccaggcuugcugugcucg

SEQ ID NO: 748731 - RNA, 22 nt, Human
acagucaagaaauggcagagcc

SEQ ID NO: 748732 - RNA, 22 nt, Human
ugguccagcuugauucucuucu

SEQ ID NO: 748733 - RNA, 22 nt, Human
cagccccauggugugcuccagc

SEQ ID NO: 748734 - RNA, 22 nt, Human
caaguauuuccugauggccugu

SEQ ID NO: 748735 - RNA, 22 nt, Human
acuuucugccuuacaggagucc

SEQ ID NO: 748736 - RNA, 22 nt, Human
aaagucauuggaauauuaauga

SEQ ID NO: 748737 - RNA, 22 nt, Human
uuucuagucuucccuaccuccc

SEQ ID NO: 748738 - RNA, 22 nt, Human
agacacuuauuuagugggaguu

SEQ ID NO: 748739 - RNA, 22 nt, Human
agcagcuguuuguugaauuggu

SEQ ID NO: 748740 - RNA, 22 nt, Human
uuggcuuccaggggcuuuuaca

SEQ ID NO: 748741 - RNA, 22 nt, Human
uacuuucuuucugauccuuaug

SEQ ID NO: 748742 - RNA, 22 nt, Human
acaaauuguugcuucaugaaug

SEQ ID NO: 748743 - RNA, 22 nt, Human
ucagagagccucaggcacugcc

SEQ ID NO: 748744 - RNA, 22 nt, Human
uuggaaauggcuguaguuauga

SEQ ID NO: 748745 - RNA, 22 nt, Human
ggucuggccaauagacagcccc

SEQ ID NO: 748746 - RNA, 22 nt, Human
auagauuagcccuauaguuuua

SEQ ID NO: 748747 - RNA, 21 nt, Human
ucucugggaggacuugugaga

SEQ ID NO: 748748 - RNA, 22 nt, Human
gagcugcuggcuccucagguua

SEQ ID NO: 748749 - RNA, 22 nt, Human
cuguuuccauacagguuuuugg

SEQ ID NO: 748750 - RNA, 22 nt, Human
ucaggacaaccuguuuucagac

SEQ ID NO: 748751 - RNA, 22 nt, Human
uuucuucucacccaggacagag

SEQ ID NO: 748752 - RNA, 22 nt, Human
ugugaguucuuagaaagucagu

SEQ ID NO: 748753 - RNA, 22 nt, Human
ucagaggcuggaagagccuccu

SEQ ID NO: 748754 - RNA, 22 nt, Human
gcccaaagagcuuugaucucag

SEQ ID NO: 748755 - RNA, 22 nt, Human
caggugggcugccucuccagcu

SEQ ID NO: 748756 - RNA, 22 nt, Human
uacaucuagccuuacaauuauu

SEQ ID NO: 748757 - RNA, 22 nt, Human
cugccuggaaggagcaagggga

SEQ ID NO: 748758 - RNA, 18 nt, Human
gagguggcugggccaucu

SEQ ID NO: 748759 - RNA, 22 nt, Human
gaaagugccucaguccucuuau

SEQ ID NO: 748760 - RNA, 22 nt, Human
gcucugagacaguagagauggc

SEQ ID NO: 748761 - RNA, 22 nt, Human
aacacaggggcguggcucuuac

SEQ ID NO: 748762 - RNA, 22 nt, Human
gcugaauacagcaugccuuaug

SEQ ID NO: 748763 - RNA, 23 nt, Human
gggcuucauuuuaauucagcugc

SEQ ID NO: 748764 - RNA, 23 nt, Human
aggaaagcauucauuuuuaccau

SEQ ID NO: 748765 - RNA, 22 nt, Human
uccucagucguuugagccaaaa

SEQ ID NO: 748766 - RNA, 22 nt, Human
aucacagagauugcuuuuaaaa

SEQ ID NO: 748767 - RNA, 22 nt, Human
uuauugaaggaacugaaauaaa

SEQ ID NO: 748768 - RNA, 22 nt, Human
gcugucugucucugugacuuaa

SEQ ID NO: 748769 - RNA, 22 nt, Human
uggcacugccaaccugcuaggu

SEQ ID NO: 748770 - RNA, 22 nt, Human
ucauugaacgaagagcuccauu

SEQ ID NO: 748771 - RNA, 22 nt, Human
gaauaaucaugaaauucaguga

SEQ ID NO: 748772 - RNA, 23 nt, Human
cugggacaugguaggggcacaac

SEQ ID NO: 748773 - RNA, 22 nt, Human
uggcagcuggagggcaauggcc

SEQ ID NO: 748774 - RNA, 22 nt, Human
uaggccuaagagauacuacugu

SEQ ID NO: 748775 - RNA, 22 nt, Human
gagcugggauuugaaccuggga

SEQ ID NO: 748776 - RNA, 22 nt, Human
ggggccagcacugugccuuugu

SEQ ID NO: 748777 - RNA, 22 nt, Human
ugugugaauagcaguggcuggu

SEQ ID NO: 748778 - RNA, 22 nt, Human
ggagagguguauucaguggguc

SEQ ID NO: 748779 - RNA, 22 nt, Human
ugucagcucccagucagagaga

SEQ ID NO: 748780 - RNA, 22 nt, Human
gaugauuuucuguguuagaaga

SEQ ID NO: 748781 - RNA, 22 nt, Human
acacuaaaugagucuacaguac

SEQ ID NO: 748782 - RNA, 22 nt, Human
uauugaagauuuugugguugcu

SEQ ID NO: 748783 - RNA, 22 nt, Human
acaauagugccuggcauagagu

SEQ ID NO: 748784 - RNA, 22 nt, Human
auucuacacaaagcaagaagac

SEQ ID NO: 748785 - RNA, 22 nt, Human
uaaacagaaagcagauguacuu

SEQ ID NO: 748786 - RNA, 22 nt, Human
ggcuuaaaucacagugacuuuu

SEQ ID NO: 748787 - RNA, 22 nt, Human
aaagugacaaccagcaggacuu

SEQ ID NO: 748788 - RNA, 22 nt, Human
agggcagaccacgugcaaggau

SEQ ID NO: 748789 - RNA, 22 nt, Human
augcaacauacauucugaagcu

SEQ ID NO: 748790 - RNA, 21 nt, Human
uuacuuuugcagcaaccuaau

SEQ ID NO: 748791 - RNA, 22 nt, Human
gaggagcccagcaccaucacuu

SEQ ID NO: 748792 - RNA, 20 nt, Human
uuuauugagcacguacugug

SEQ ID NO: 748793 - RNA, 22 nt, Human
uagcaacaccaucuggugagaa

SEQ ID NO: 748794 - RNA, 22 nt, Human
ggggugagugcucagccccgga

SEQ ID NO: 748795 - RNA, 18 nt, Human
cugcccagagcauuucau

SEQ ID NO: 748796 - RNA, 22 nt, Human
cagaugcugguaugggggaggu

SEQ ID NO: 748797 - RNA, 22 nt, Human
ucuucaggaagggaaaucaucc

SEQ ID NO: 748798 - RNA, 22 nt, Human
uacaugcucuucaaggacucau

SEQ ID NO: 748799 - RNA, 22 nt, Human
augcccaggcccauaccuagau

SEQ ID NO: 748800 - RNA, 22 nt, Human
gaaggaggucugauacaauaug

SEQ ID NO: 748801 - RNA, 20 nt, Human
auaauuauuuacuuuugugc

SEQ ID NO: 748802 - RNA, 22 nt, Human
uauggcuucuuguguuacugug

SEQ ID NO: 748803 - RNA, 22 nt, Human
guagauuccaguggucuguguc

SEQ ID NO: 748804 - RNA, 22 nt, Human
uguaaaaccaaaucaaucuagu

SEQ ID NO: 748805 - RNA, 22 nt, Human
ucacaaugaaaaacacuacaua

SEQ ID NO: 748806 - RNA, 19 nt, Human
ucccaguggggagaggugu

SEQ ID NO: 748807 - RNA, 22 nt, Human
gcuuccuucuaccacaucaugc

SEQ ID NO: 748808 - RNA, 22 nt, Human
uuauucacucauuaaagcagga

SEQ ID NO: 748809 - RNA, 22 nt, Human
ugggccucaugcccagccaccc

SEQ ID NO: 748810 - RNA, 22 nt, Human
agcagcagcucaguucucagcu

SEQ ID NO: 748811 - RNA, 22 nt, Human
ccacccagaccagggaucuggg

SEQ ID NO: 748812 - RNA, 22 nt, Human
uggcaggguacaccuuaacacc

SEQ ID NO: 748813 - RNA, 22 nt, Human
agccuggagaggcgccauacac

SEQ ID NO: 748814 - RNA, 22 nt, Human
gcagcagagcuuuguccuggcu

SEQ ID NO: 748815 - RNA, 21 nt, Human
cuacccucacucccauuccuc

SEQ ID NO: 748816 - RNA, 22 nt, Human
uuaggaaaaucaugagagauga

SEQ ID NO: 748817 - RNA, 22 nt, Human
guggcagaaauauucuugcucu

SEQ ID NO: 748818 - RNA, 22 nt, Human
ugcggcaggagaagguguuaug

SEQ ID NO: 748819 - RNA, 22 nt, Human
agucaccaacaugguucccagg

SEQ ID NO: 748820 - RNA, 22 nt, Human
agcugagaaucuuccccagugu

SEQ ID NO: 748821 - RNA, 22 nt, Human
ccaggaagccugugucucugga

SEQ ID NO: 748822 - RNA, 22 nt, Human
caguuuaguaggugauaucaau

SEQ ID NO: 748823 - RNA, 22 nt, Human
uaagaguuagggcuagcaauau

SEQ ID NO: 748824 - RNA, 21 nt, Human
gcucugucccugcuguguguc

SEQ ID NO: 748825 - RNA, 22 nt, Human
uggaaagaggaagugcccagca

SEQ ID NO: 748826 - RNA, 22 nt, Human
ggggucugggcuuagcuggaau

SEQ ID NO: 748827 - RNA, 22 nt, Human
gcauuguccugcuucugagugu

SEQ ID NO: 748828 - RNA, 22 nt, Human
acugggcagcagcucgagccgc

SEQ ID NO: 748829 - RNA, 22 nt, Human
ucuuuucuagcaaauccaggag

SEQ ID NO: 748830 - RNA, 19 nt, Human
cuggggcuuugguacugcc

SEQ ID NO: 748831 - RNA, 22 nt, Human
cucagggauggugaagcaccca

SEQ ID NO: 748832 - RNA, 22 nt, Human
uuugauauccuauacaaguaaa

SEQ ID NO: 748833 - RNA, 22 nt, Human
cagcccugcuuccccgcuaguu

SEQ ID NO: 748834 - RNA, 22 nt, Human
ccagcagcgauagggugagugc

SEQ ID NO: 748835 - RNA, 22 nt, Human
guucuguccuccuaccaggcau

SEQ ID NO: 748836 - RNA, 22 nt, Human
ucaggucuguacuauugucuug

SEQ ID NO: 748837 - RNA, 22 nt, Human
ucuggaguggagcugaucauuu

SEQ ID NO: 748838 - RNA, 22 nt, Human
gaaauucugugucccagagugc

SEQ ID NO: 748839 - RNA, 22 nt, Human
auagaauuacaguguguuugga

SEQ ID NO: 748840 - RNA, 20 nt, Human
cagcaaaaugaaaauggauu

SEQ ID NO: 748841 - RNA, 22 nt, Human
ucuucuuugaaucauagugacc

SEQ ID NO: 748842 - RNA, 22 nt, Human
ggacaggugugaggcuggcaca

SEQ ID NO: 748843 - RNA, 22 nt, Human
ccaggcucugcgcuggacaugg

SEQ ID NO: 748844 - RNA, 22 nt, Human
gccagccacuucccagacuggc

SEQ ID NO: 748845 - RNA, 22 nt, Human
ucacugggagaugugggaaggg

SEQ ID NO: 748846 - RNA, 20 nt, Human
guuuuaugccaguucugugu

SEQ ID NO: 748847 - RNA, 19 nt, Human
gaggagcuaucggagacag

SEQ ID NO: 748848 - RNA, 22 nt, Human
cugcuuugaaaauaaacuuguc

SEQ ID NO: 748849 - RNA, 22 nt, Human
augcagcuucaggauuaugaug

SEQ ID NO: 748850 - RNA, 17 nt, Human
uagcagcaguaauugug

SEQ ID NO: 748851 - RNA, 23 nt, Human
auaucacacccaguacagucucc

SEQ ID NO: 748852 - RNA, 22 nt, Human
agguggcagagugacaggcuga

SEQ ID NO: 748853 - RNA, 22 nt, Human
ucuggcucuauaacuccuagcu

SEQ ID NO: 748854 - RNA, 22 nt, Human
gaacacaugauuauaaaugcua

SEQ ID NO: 748855 - RNA, 22 nt, Human
uuuacagagguguccugcauug

SEQ ID NO: 748856 - RNA, 21 nt, Human
ugggcgcuugaccucugcacu

SEQ ID NO: 748857 - RNA, 22 nt, Human
uucucuggauguuucucaguca

SEQ ID NO: 748858 - RNA, 21 nt, Human
ugcagcagaguaagcagggga

SEQ ID NO: 748859 - RNA, 22 nt, Human
ccuugcagacaucaguaguggc

SEQ ID NO: 748860 - RNA, 22 nt, Human
ucuccccagggguauggguauu

SEQ ID NO: 748861 - RNA, 22 nt, Human
cuuguacacucaguacuucuag

SEQ ID NO: 748862 - RNA, 22 nt, Human
agggcuccgggcaggcgaugga

SEQ ID NO: 748863 - RNA, 22 nt, Human
uuacaucuaaacugugaacaau

SEQ ID NO: 748864 - RNA, 22 nt, Human
uguacaggagaacaaugagaaa

SEQ ID NO: 748865 - RNA, 22 nt, Human
cauuucacuauucacuaaaagg

SEQ ID NO: 748866 - RNA, 22 nt, Human
ggguggcugagaacaggacccc

SEQ ID NO: 748867 - RNA, 22 nt, Human
cauggaggaguuaggugugagu

SEQ ID NO: 748868 - RNA, 22 nt, Human
caggcaccugugugucucaggg

SEQ ID NO: 748869 - RNA, 22 nt, Human
agguacaguagacagacaguua

SEQ ID NO: 748870 - RNA, 22 nt, Human
aggcuggcugacuucugaagca

SEQ ID NO: 748871 - RNA, 22 nt, Human
auuauaaaccuuugaggguggg

SEQ ID NO: 748872 - RNA, 22 nt, Human
cucuuaaaauuaccuuugcaaa

SEQ ID NO: 748873 - RNA, 22 nt, Human
ugccuugguucucuacuuggag

SEQ ID NO: 748874 - RNA, 20 nt, Human
gaaucuuuccccaugcaaug

SEQ ID NO: 748875 - RNA, 22 nt, Human
uuucuuagggacuguaaaauag

SEQ ID NO: 748876 - RNA, 22 nt, Human
caacauucuuaucacuauaagc

SEQ ID NO: 748877 - RNA, 22 nt, Human
augccaggccccacgcugggca

SEQ ID NO: 748878 - RNA, 22 nt, Human
cccuggcugcuaccagguagcu

SEQ ID NO: 748879 - RNA, 22 nt, Human
cugugcacacgugcccaacagu

SEQ ID NO: 748880 - RNA, 22 nt, Human
ccucagcauccucaugcucagu

SEQ ID NO: 748881 - RNA, 22 nt, Human
agcacaaaaacauucccagagu

SEQ ID NO: 748882 - RNA, 23 nt, Human
uuuccaggugaccgucagaauua

SEQ ID NO: 748883 - RNA, 21 nt, Human
cagagagcuagaacuucauga

SEQ ID NO: 748884 - RNA, 22 nt, Human
ucucacuggguauaaaugagua

SEQ ID NO: 748885 - RNA, 22 nt, Human
gagaggcccugaagcccacaga

SEQ ID NO: 748886 - RNA, 18 nt, Human
caagagcugcuccuggcc

SEQ ID NO: 748887 - RNA, 22 nt, Human
uugaaaagcaaaugauggguag

SEQ ID NO: 748888 - RNA, 22 nt, Human
aggcucaggcaggaauggcgga

SEQ ID NO: 748889 - RNA, 22 nt, Human
aguuuagaguucaaauuaguuc

SEQ ID NO: 748890 - RNA, 22 nt, Human
cugugugucauuugucaauccu

SEQ ID NO: 748891 - RNA, 22 nt, Human
ucuuggcugcguccuggcugug

SEQ ID NO: 748892 - RNA, 22 nt, Human
ugacuuuaauaggauuuugcau

SEQ ID NO: 748893 - RNA, 22 nt, Human
acagcaggcccauacuggaagg

SEQ ID NO: 748894 - RNA, 22 nt, Human
guggcgcagaggguggcagaga

SEQ ID NO: 748895 - RNA, 22 nt, Human
gcagcuggaagugacacucugu

SEQ ID NO: 748896 - RNA, 22 nt, Human
agcagauaggacauuucauucu

SEQ ID NO: 748897 - RNA, 22 nt, Human
ucugaagagcuuuggaaguaug

SEQ ID NO: 748898 - RNA, 22 nt, Human
agagacugucacauaacagagg

SEQ ID NO: 748899 - RNA, 22 nt, Human
cuauaucauaaaucugaagagg

SEQ ID NO: 748900 - RNA, 22 nt, Human
gcaggccucuguugagggccuu

SEQ ID NO: 748901 - RNA, 22 nt, Human
uuucuacuucuccugaaugucu

SEQ ID NO: 748902 - RNA, 22 nt, Human
uuacaguaacauuuucagucug

SEQ ID NO: 748903 - RNA, 22 nt, Human
auuacagaagauaugcucaaca

SEQ ID NO: 748904 - RNA, 22 nt, Human
cacucugggggcugccgcugcc

SEQ ID NO: 748905 - RNA, 22 nt, Human
ccaaguacucucaccaaagcuu

SEQ ID NO: 748906 - RNA, 22 nt, Human
ucacaggguuuggaagccuccu

SEQ ID NO: 748907 - RNA, 22 nt, Human
ggcugcacgccucucagcuugc

SEQ ID NO: 748908 - RNA, 22 nt, Human
ucuccuuuaagauuuccucagg

SEQ ID NO: 748909 - RNA, 22 nt, Human
gguggggucacgacagagggaa

SEQ ID NO: 748910 - RNA, 22 nt, Human
ccaggaccacacgacaggagag

SEQ ID NO: 748911 - RNA, 22 nt, Human
aagaugcuggcaggaauagcua

SEQ ID NO: 748912 - RNA, 22 nt, Human
agcuaaggaacucuguaacacc

SEQ ID NO: 748913 - RNA, 22 nt, Human
gcccagcuuuuugaggcaggca

SEQ ID NO: 748914 - RNA, 22 nt, Human
ucagacuugacuuuguaaguuu

SEQ ID NO: 748915 - RNA, 21 nt, Human
ggugcuccuccaugcugcucu

SEQ ID NO: 748916 - RNA, 22 nt, Human
ggcaaccugagcuuguggagaa

SEQ ID NO: 748917 - RNA, 22 nt, Human
ugaaguggacccuggacagacc

SEQ ID NO: 748918 - RNA, 22 nt, Human
ccuuggcuugcacacggccacc

SEQ ID NO: 748919 - RNA, 22 nt, Human
agggccaguucuaccucugaau

SEQ ID NO: 748920 - RNA, 22 nt, Human
aagaaagguguguuugcagaug

SEQ ID NO: 748921 - RNA, 22 nt, Human
ucacccagcagcugcuucugcu

SEQ ID NO: 748922 - RNA, 22 nt, Human
gaggcugcggggaggagccugc

SEQ ID NO: 748923 - RNA, 22 nt, Human
uucaacuagauuuauacaauuc

SEQ ID NO: 748924 - RNA, 22 nt, Human
uucuguuugccauauauaguag

SEQ ID NO: 748925 - RNA, 22 nt, Human
uuucuauuggcgucacuguugu

SEQ ID NO: 748926 - RNA, 22 nt, Human
cccugcagccuugcaugccuuc

SEQ ID NO: 748927 - RNA, 22 nt, Human
uguauuuccugguuuagaucaa

SEQ ID NO: 748928 - RNA, 18 nt, Human
gacaggugggugagacca

SEQ ID NO: 748929 - RNA, 22 nt, Human
cagccagguucaaguccuuaua

SEQ ID NO: 748930 - RNA, 22 nt, Human
gaggacucugcaggcugcuccu

SEQ ID NO: 748931 - RNA, 19 nt, Human
aggucuaaucauaagacaa

SEQ ID NO: 748932 - RNA, 22 nt, Human
ugaggcagguaagcaaguuuug

SEQ ID NO: 748933 - RNA, 22 nt, Human
agccagagauugagaugcaggc

SEQ ID NO: 748934 - RNA, 22 nt, Human
acuugggucaaguagcucacag

SEQ ID NO: 748935 - RNA, 22 nt, Human
aggaauuuggaauuuuuccugu

SEQ ID NO: 748936 - RNA, 22 nt, Human
cacaugcccagaacuucucauu

SEQ ID NO: 748937 - RNA, 22 nt, Human
gcuccuggcucuggccaaggga

SEQ ID NO: 748938 - RNA, 22 nt, Human
gcaaagaaaguuuuaaugaggu

SEQ ID NO: 748939 - RNA, 22 nt, Human
agacaauggagagcagaguacu

SEQ ID NO: 748940 - RNA, 22 nt, Human
uccacccagcacacugugguag

SEQ ID NO: 748941 - RNA, 22 nt, Human
gggcugcuguagagaacauguu

SEQ ID NO: 748942 - RNA, 22 nt, Human
cuucuuuuacaggucuuggguu

SEQ ID NO: 748943 - RNA, 22 nt, Human
gcuccagggaacagaauguacu

SEQ ID NO: 748944 - RNA, 22 nt, Human
aagaucagaacuuuauacagga

SEQ ID NO: 748945 - RNA, 22 nt, Human
gaggcuccgugcugcugcccug

SEQ ID NO: 748946 - RNA, 20 nt, Human
aguacaauguaugauucaga

SEQ ID NO: 748947 - RNA, 22 nt, Human
cucugagggucuaaggagucac

SEQ ID NO: 748948 - RNA, 22 nt, Human
ccugccuggaucagccauccug

SEQ ID NO: 748949 - RNA, 22 nt, Human
uagacaacuggagauagucuga

SEQ ID NO: 748950 - RNA, 22 nt, Human
aguuauuucaguaacauaauag

SEQ ID NO: 748951 - RNA, 22 nt, Human
uuucuaauucuaacuggcagag

SEQ ID NO: 748952 - RNA, 22 nt, Human
cugcugugcaggugccuaugau

SEQ ID NO: 748953 - RNA, 22 nt, Human
gccuugcugauuaccuuccuuu

SEQ ID NO: 748954 - RNA, 22 nt, Human
ucaaugauagacaagaucuaag

SEQ ID NO: 748955 - RNA, 22 nt, Human
cccagcccaucucaaaggucua

SEQ ID NO: 748956 - RNA, 22 nt, Human
gagacugggggcuuggccuuuu

SEQ ID NO: 748957 - RNA, 22 nt, Human
guuuaaguuucagaagcuaaga

SEQ ID NO: 748958 - RNA, 22 nt, Human
uuugcuuugggagguugucugg

SEQ ID NO: 748959 - RNA, 22 nt, Human
cagcuuucuuuccauaagguuu

SEQ ID NO: 748960 - RNA, 22 nt, Human
cagaagcugcagugaucuggga

SEQ ID NO: 748961 - RNA, 19 nt, Human
uucucagagcuugcagcac

SEQ ID NO: 748962 - RNA, 22 nt, Human
gagcauggauagaaggugggau

SEQ ID NO: 748963 - RNA, 22 nt, Human
uuucugcugugcuuucuugcgu

SEQ ID NO: 748964 - RNA, 22 nt, Human
auauuucaugggguuccauacu

SEQ ID NO: 748965 - RNA, 18 nt, Human
ggaaaccacaggguucug

SEQ ID NO: 748966 - RNA, 22 nt, Human
ggugaggaauuggggacugacc

SEQ ID NO: 748967 - RNA, 22 nt, Human
ucagcaagcagggggauguuca

SEQ ID NO: 748968 - RNA, 22 nt, Human
guccugugucccagagaaagag

SEQ ID NO: 748969 - RNA, 22 nt, Human
guuuagacuccuuggucuucug

SEQ ID NO: 748970 - RNA, 22 nt, Human
aauaauccugcccgucucuccg

SEQ ID NO: 748971 - RNA, 22 nt, Human
aguacccuagggugggagcuca

SEQ ID NO: 748972 - RNA, 22 nt, Human
gcagggcucauucuaguacaau

SEQ ID NO: 748973 - RNA, 22 nt, Human
uuacacaugucucaguggaaau

SEQ ID NO: 748974 - RNA, 22 nt, Human
gggcaggugcccagggccagag

SEQ ID NO: 748975 - RNA, 17 nt, Human
cuguuccccacuacuca

SEQ ID NO: 748976 - RNA, 22 nt, Human
ggauccagaggugaagauggga

SEQ ID NO: 748977 - RNA, 22 nt, Human
gcucuucucagauuguacacuc

SEQ ID NO: 748978 - RNA, 22 nt, Human
agccuggcuguaaccucauggu

SEQ ID NO: 748979 - RNA, 18 nt, Human
gucuggaggucaggagcu

SEQ ID NO: 748980 - RNA, 22 nt, Human
caggucagagucccccuguccu

SEQ ID NO: 748981 - RNA, 22 nt, Human
acacaguucuuagcaggugucu

SEQ ID NO: 748982 - RNA, 22 nt, Human
ucuuagcaugcauguauaaaua

SEQ ID NO: 748983 - RNA, 22 nt, Human
cagagguaccagcagccucugg

SEQ ID NO: 748984 - RNA, 22 nt, Human
caugcauuuucuauucacucag

SEQ ID NO: 748985 - RNA, 22 nt, Human
gagcugccugugugccaugaug

SEQ ID NO: 748986 - RNA, 22 nt, Human
augaauuuuucuaagcuuuugu

SEQ ID NO: 748987 - RNA, 22 nt, Human
aagcuucuuagaaugcaugugc

SEQ ID NO: 748988 - RNA, 22 nt, Human
agcugcagguucagcauuccac

SEQ ID NO: 748989 - RNA, 22 nt, Human
uggggcagggaugggaaacuau

SEQ ID NO: 748990 - RNA, 22 nt, Human
agugucugcuuaucaguucuug

SEQ ID NO: 748991 - RNA, 22 nt, Human
agccagccaguucacuaggaaa

SEQ ID NO: 748992 - RNA, 22 nt, Human
aggggauggagcuggaaggcag

SEQ ID NO: 748993 - RNA, 22 nt, Human
uccagcccuguggcuuccaccc

SEQ ID NO: 748994 - RNA, 22 nt, Human
cuggccuggggggacacauccc

SEQ ID NO: 748995 - RNA, 22 nt, Human
gaacaaacacaucccagcagug

SEQ ID NO: 748996 - RNA, 22 nt, Human
aagugaaugaugugaaguguaa

SEQ ID NO: 748997 - RNA, 22 nt, Human
ugacaauugugggcaguuugug

SEQ ID NO: 748998 - RNA, 21 nt, Human
uggccaaggaauagaagcucu

SEQ ID NO: 748999 - RNA, 22 nt, Human
uuccauaacugaccgaaugcau

SEQ ID NO: 749000 - RNA, 22 nt, Human
agcuguuuaaaugacuuacuuu

SEQ ID NO: 749001 - RNA, 22 nt, Human
aauuuagauugauaaacaugga

SEQ ID NO: 749002 - RNA, 18 nt, Human
aaggcacaggagaacauu

SEQ ID NO: 749003 - RNA, 22 nt, Human
gccaccaggagcccaguccaaa

SEQ ID NO: 749004 - RNA, 22 nt, Human
aagcugugagcuggaugcucca

SEQ ID NO: 749005 - RNA, 22 nt, Human
ucauaguuuuacuuaguggugu

SEQ ID NO: 749006 - RNA, 22 nt, Human
uuuuuacacuuagcauugagcg

SEQ ID NO: 749007 - RNA, 22 nt, Human
uaggaauuuugcaugggaauuu

SEQ ID NO: 749008 - RNA, 20 nt, Human
cccuggccuguuucaugccc

SEQ ID NO: 749009 - RNA, 22 nt, Human
acagaugaggaauuuauuuggu

SEQ ID NO: 749010 - RNA, 22 nt, Human
ccucggaggcggaggcugcagu

SEQ ID NO: 749011 - RNA, 22 nt, Human
uaccuucaggcugcccuuugau

SEQ ID NO: 749012 - RNA, 20 nt, Human
agagagcacaggcaggaaag

SEQ ID NO: 749013 - RNA, 22 nt, Human
aggccacaagaacuaccccauc

SEQ ID NO: 749014 - RNA, 20 nt, Human
gugcuucagaagccauugcu

SEQ ID NO: 749015 - RNA, 22 nt, Human
cagagugaaaacugagcucaaa

SEQ ID NO: 749016 - RNA, 22 nt, Human
ggagguggcagggaacauaauu

SEQ ID NO: 749017 - RNA, 22 nt, Human
ggucauugucagagccuguacu

SEQ ID NO: 749018 - RNA, 22 nt, Human
ucucuacaaaaauuagcaugca

SEQ ID NO: 749019 - RNA, 22 nt, Human
acacugucugggacucaggagu

SEQ ID NO: 749020 - RNA, 22 nt, Human
ugcuggccggccaggugcugag

SEQ ID NO: 749021 - RNA, 22 nt, Human
uugcagacagugagagugaaag

SEQ ID NO: 749022 - RNA, 22 nt, Human
ucccaaggcacagggcagggac

SEQ ID NO: 749023 - RNA, 22 nt, Human
gagaacacaugcagacugggua

SEQ ID NO: 749024 - RNA, 22 nt, Human
agcaaauaccaaaggcugaugu

SEQ ID NO: 749025 - RNA, 22 nt, Human
uguuuucauuugauguaacaaa

SEQ ID NO: 749026 - RNA, 22 nt, Human
agucuucccugugccagagugu

SEQ ID NO: 749027 - RNA, 22 nt, Human
ucacccaggcuggacugcagug

SEQ ID NO: 749028 - RNA, 22 nt, Human
cugucugucccgucaccgcccc

SEQ ID NO: 749029 - RNA, 22 nt, Human
uuuggcucugcgucuucaccca

SEQ ID NO: 749030 - RNA, 22 nt, Human
accaggcuggagugcaguggcg

SEQ ID NO: 749031 - RNA, 22 nt, Human
ugggaggucucuugcggccuag

SEQ ID NO: 749032 - RNA, 20 nt, Human
aggaagcugagauguagagg

SEQ ID NO: 749033 - RNA, 22 nt, Human
augucaaaucaguuuuaucaga

SEQ ID NO: 749034 - RNA, 22 nt, Human
cacugagccaggagcaauauca

SEQ ID NO: 749035 - RNA, 22 nt, Human
cugcacccucaaacuccugggc

SEQ ID NO: 749036 - RNA, 22 nt, Human
agguccuggacugcucuuguua

SEQ ID NO: 749037 - RNA, 22 nt, Human
aggguggagggagucccugagc

SEQ ID NO: 749038 - RNA, 22 nt, Human
augcuuuuccuaaaaugaugcc

SEQ ID NO: 749039 - RNA, 22 nt, Human
aucuguguguugaguucucagc

SEQ ID NO: 749040 - RNA, 22 nt, Human
ucucuucugaccuagccuugga

SEQ ID NO: 749041 - RNA, 22 nt, Human
uggagcugguaaacagugacau

SEQ ID NO: 749042 - RNA, 22 nt, Human
cauguacacucauguaacuaua

SEQ ID NO: 749043 - RNA, 22 nt, Human
ugucauuaguuucagccauucu

SEQ ID NO: 749044 - RNA, 22 nt, Human
cuuaauuucaaacugcuaguga

SEQ ID NO: 749045 - RNA, 17 nt, Human
uuaguguaucuguuuug

SEQ ID NO: 749046 - RNA, 22 nt, Human
uuccacaaugguuaagcucguu

SEQ ID NO: 749047 - RNA, 22 nt, Human
ggcacagggaggcccuggugug

SEQ ID NO: 749048 - RNA, 22 nt, Human
uggcccagagcacugcugggca

SEQ ID NO: 749049 - RNA, 21 nt, Human
uuauugaauguuuaccgugug

SEQ ID NO: 749050 - RNA, 22 nt, Human
acuuccugcagcuucucagccc

SEQ ID NO: 749051 - RNA, 22 nt, Human
ugagaaugaaucuuuugcuuuc

SEQ ID NO: 749052 - RNA, 22 nt, Human
aucugucuuccaccacacaucc

SEQ ID NO: 749053 - RNA, 22 nt, Human
agaaagggcuauuuugagguag

SEQ ID NO: 749054 - RNA, 22 nt, Human
gauacaguauuuaaagagcaac

SEQ ID NO: 749055 - RNA, 20 nt, Human
caggucuucauguggcuguc

SEQ ID NO: 749056 - RNA, 22 nt, Human
aagagguugucugugaugaguu

SEQ ID NO: 749057 - RNA, 22 nt, Human
uacuuguuuuguguuccuaaac

SEQ ID NO: 749058 - RNA, 22 nt, Human
uauagauagacugacgauacag

SEQ ID NO: 749059 - RNA, 22 nt, Human
acagcuuuucugauagauccug

SEQ ID NO: 749060 - RNA, 22 nt, Human
uccucccuucucacugggaagg

SEQ ID NO: 749061 - RNA, 22 nt, Human
ccacagagucuuccuucucuuc

SEQ ID NO: 749062 - RNA, 22 nt, Human
gcuggguccuaugcugguagag

SEQ ID NO: 749063 - RNA, 22 nt, Human
uucaguaugauuccuccaguag

SEQ ID NO: 749064 - RNA, 19 nt, Human
ucugggaaugaugccagca

SEQ ID NO: 749065 - RNA, 22 nt, Human
uuccuugaaugagucauggaaa

SEQ ID NO: 749066 - RNA, 21 nt, Human
ccauaauuuuguuucagaagu

SEQ ID NO: 749067 - RNA, 22 nt, Human
ccacauggagcaggaggugggg

SEQ ID NO: 749068 - RNA, 23 nt, Human
gggaccugguaggaggugauugg

SEQ ID NO: 749069 - RNA, 22 nt, Human
aaaaaggcuaagcaucuugugc

SEQ ID NO: 749070 - RNA, 22 nt, Human
uugaaauauggauugaccuuga

SEQ ID NO: 749071 - RNA, 22 nt, Human
cacagugucugugcuucagugu

SEQ ID NO: 749072 - RNA, 22 nt, Human
auuuuguuauagaacucuguga

SEQ ID NO: 749073 - RNA, 22 nt, Human
agaaauguuacaguuguuauuu

SEQ ID NO: 749074 - RNA, 22 nt, Human
cucuggcuggcugggccucagu

SEQ ID NO: 749075 - RNA, 21 nt, Human
cagagccuguguugacaguug

SEQ ID NO: 749076 - RNA, 22 nt, Human
acacagguacacauauguaccu

SEQ ID NO: 749077 - RNA, 22 nt, Human
cauaucuucugacaugaucagg

SEQ ID NO: 749078 - RNA, 22 nt, Human
caaauaagcaauuccauucuuc

SEQ ID NO: 749079 - RNA, 22 nt, Human
uuuagugagugugaaucaaaug

SEQ ID NO: 749080 - RNA, 22 nt, Human
uauauuaacacccacuugccuc

SEQ ID NO: 749081 - RNA, 22 nt, Human
ugcggaggucggugcugcgggc

SEQ ID NO: 749082 - RNA, 22 nt, Human
auucagaauugugggcaguaca

SEQ ID NO: 749083 - RNA, 22 nt, Human
gugacaaaggucaagcuuuuga

SEQ ID NO: 749084 - RNA, 22 nt, Human
agggagcuauuucaggguuauu

SEQ ID NO: 749085 - RNA, 22 nt, Human
uccacuucauccagggucacca

SEQ ID NO: 749086 - RNA, 22 nt, Human
uccaaaggcccugaguucacuu

SEQ ID NO: 749087 - RNA, 22 nt, Human
guguuaaaaaucccaugauaug

SEQ ID NO: 749088 - RNA, 22 nt, Human
cugugugugagaagcagguuga

SEQ ID NO: 749089 - RNA, 22 nt, Human
guccaugauucugugacacccu

SEQ ID NO: 749090 - RNA, 22 nt, Human
cagugccucuuaagugucaccc

SEQ ID NO: 749091 - RNA, 22 nt, Human
caucaucucuggcccuugaagu

SEQ ID NO: 749092 - RNA, 22 nt, Human
ugaagccauaggacagaggaua

SEQ ID NO: 749093 - RNA, 18 nt, Human
ugaggcccgcagaggugg

SEQ ID NO: 749094 - RNA, 22 nt, Human
uauaacaggaaguauucaaaca

SEQ ID NO: 749095 - RNA, 22 nt, Human
aaacucuaagacacuguacaau

SEQ ID NO: 749096 - RNA, 22 nt, Human
cagcaggacccaggaauccugc

SEQ ID NO: 749097 - RNA, 22 nt, Human
cuucagcaucuuuuucuugggg

SEQ ID NO: 749098 - RNA, 20 nt, Human
ggcaccaggcuaggauugga

SEQ ID NO: 749099 - RNA, 22 nt, Human
aagggcugagaaguggggcugg

SEQ ID NO: 749100 - RNA, 22 nt, Human
gagagaagaacaaugucauuca

SEQ ID NO: 749101 - RNA, 22 nt, Human
gaaaguaugccaucuaccucuu

SEQ ID NO: 749102 - RNA, 22 nt, Human
caagucaagcaugcccuuauuu

SEQ ID NO: 749103 - RNA, 22 nt, Human
cagggcucccaaauaucucuuc

SEQ ID NO: 749104 - RNA, 22 nt, Human
uuacaguuacugguacuguuaa

SEQ ID NO: 749105 - RNA, 20 nt, Human
aagagcauaguacaggaaga

SEQ ID NO: 749106 - RNA, 22 nt, Human
agaagccucauccucucuagug

SEQ ID NO: 749107 - RNA, 22 nt, Human
aguucucuuuagcucauauggu

SEQ ID NO: 749108 - RNA, 22 nt, Human
ucauuuucccacugaagcuguc

SEQ ID NO: 749109 - RNA, 21 nt, Human
aggcagcucaggcccagagag

SEQ ID NO: 749110 - RNA, 22 nt, Human
uuguagaauuuggaucucggca

SEQ ID NO: 749111 - RNA, 22 nt, Human
aagagagaacacagcuugggca

SEQ ID NO: 749112 - RNA, 22 nt, Human
auucugaugccuggguacugcc

SEQ ID NO: 749113 - RNA, 22 nt, Human
aagaauguucauuaaacuguug

SEQ ID NO: 749114 - RNA, 22 nt, Human
uccacauccauugcuugacuuu

SEQ ID NO: 749115 - RNA, 22 nt, Human
cuucaguuaugugccaaggaca

SEQ ID NO: 749116 - RNA, 22 nt, Human
cauaucuuaugguuuucuaagu

SEQ ID NO: 749117 - RNA, 22 nt, Human
uaacuguauuuuaggucucauu

SEQ ID NO: 749118 - RNA, 22 nt, Human
ucucuuaaauacuucacaucuc

SEQ ID NO: 749119 - RNA, 22 nt, Human
cugggcucuucccagauccaga

SEQ ID NO: 749120 - RNA, 22 nt, Human
ugggcaggugcuauuuuccaug

SEQ ID NO: 749121 - RNA, 22 nt, Human
ggcagcaaguaggauucuuauu

SEQ ID NO: 749122 - RNA, 17 nt, Human
auuucacuuagcaugag

SEQ ID NO: 749123 - RNA, 22 nt, Human
uggcugagaccaucagggugua

SEQ ID NO: 749124 - RNA, 22 nt, Human
uuguauuucuuccggucucauu

SEQ ID NO: 749125 - RNA, 22 nt, Human
uucuccacccacucuuuuguug

SEQ ID NO: 749126 - RNA, 22 nt, Human
gggauggcucaaaggagucagg

SEQ ID NO: 749127 - RNA, 22 nt, Human
gcuccaggaggcucccgcgucu

SEQ ID NO: 749128 - RNA, 22 nt, Human
gcugccuguggcccuucugggu

SEQ ID NO: 749129 - RNA, 22 nt, Human
ggcucaguguuuguggaacaua

SEQ ID NO: 749130 - RNA, 22 nt, Human
acagagcaauaacagggagagg

SEQ ID NO: 749131 - RNA, 22 nt, Human
gcuugcaagauagguuacuuaa

SEQ ID NO: 749132 - RNA, 22 nt, Human
ccggcgggcagcggcagugagc

SEQ ID NO: 749133 - RNA, 22 nt, Human
uagaggcauuaaugaauaaaca

SEQ ID NO: 749134 - RNA, 22 nt, Human
uuucagaauagcaaagcaagcu

SEQ ID NO: 749135 - RNA, 19 nt, Human
gcuguuaaggacccucgga

SEQ ID NO: 749136 - RNA, 22 nt, Human
auacauauaugguacuuccugg

SEQ ID NO: 749137 - RNA, 22 nt, Human
gcugucuugaugauuggaugcu

SEQ ID NO: 749138 - RNA, 22 nt, Human
ucagaacagguuguacuauguc

SEQ ID NO: 749139 - RNA, 22 nt, Human
cagagccagcuguccuuggcau

SEQ ID NO: 749140 - RNA, 22 nt, Human
cagccuggacagcgaccagagu

SEQ ID NO: 749141 - RNA, 22 nt, Human
ugcaguguggccaugucagcua

SEQ ID NO: 749142 - RNA, 22 nt, Human
ugccccagaccuacugaauggg

SEQ ID NO: 749143 - RNA, 22 nt, Human
ccaggagagcaggcgugcagcu

SEQ ID NO: 749144 - RNA, 22 nt, Human
ucugaggaauaagaaggaagug

SEQ ID NO: 749145 - RNA, 22 nt, Human
uaugcauauguguucauuggag

SEQ ID NO: 749146 - RNA, 22 nt, Human
ugccccucagggaacggguauc

SEQ ID NO: 749147 - RNA, 22 nt, Human
uaccuugggagacgccaggccc

SEQ ID NO: 749148 - RNA, 22 nt, Human
ucaggaggaugucggcaaauuu

SEQ ID NO: 749149 - RNA, 22 nt, Human
aggcuccuuguucaucauccau

SEQ ID NO: 749150 - RNA, 22 nt, Human
agcagcaauggaaagcaacaca

SEQ ID NO: 749151 - RNA, 22 nt, Human
ucugggggcgaccagggacugc

SEQ ID NO: 749152 - RNA, 22 nt, Human
aacucacuuuguggcuucugaa

SEQ ID NO: 749153 - RNA, 22 nt, Human
cagaggcauuacugaaaaggug

SEQ ID NO: 749154 - RNA, 22 nt, Human
cuguaaauaaugacaguugacu

SEQ ID NO: 749155 - RNA, 22 nt, Human
gcaaagucugcaucuggaucag

SEQ ID NO: 749156 - RNA, 22 nt, Human
auguggauuugggagugaucag

SEQ ID NO: 749157 - RNA, 22 nt, Human
uaguuuaggugggguagacaga

SEQ ID NO: 749158 - RNA, 22 nt, Human
agugucaaugcucuguuaaaaa

SEQ ID NO: 749159 - RNA, 22 nt, Human
acagggcuggcguugggacaga

SEQ ID NO: 749160 - RNA, 22 nt, Human
auucuuuucccaacugcuuuaa

SEQ ID NO: 749161 - RNA, 22 nt, Human
acuguaauauuuuaagaugucu

SEQ ID NO: 749162 - RNA, 22 nt, Human
aggauuucugugccuggaaaau

SEQ ID NO: 749163 - RNA, 22 nt, Human
uagcaucugaacuguugaaaag

SEQ ID NO: 749164 - RNA, 22 nt, Human
auuuagcaaaaaaugaugaagc

SEQ ID NO: 749165 - RNA, 22 nt, Human
caguaacuaggacaaggaggaa

SEQ ID NO: 749166 - RNA, 22 nt, Human
auuguauuuccagcuugaaugu

SEQ ID NO: 749167 - RNA, 22 nt, Human
gaagauuuucuccuuuaaauga

SEQ ID NO: 749168 - RNA, 22 nt, Human
gggcuccagccacuggcugagg

SEQ ID NO: 749169 - RNA, 22 nt, Human
aaagagcucacaguccacugga

SEQ ID NO: 749170 - RNA, 22 nt, Human
uuuuuccuaagcaguggagcug

SEQ ID NO: 749171 - RNA, 18 nt, Human
auggcuucugaguggagg

SEQ ID NO: 749172 - RNA, 18 nt, Human
gagcagaggaggguuuuu

SEQ ID NO: 749173 - RNA, 22 nt, Human
agguggcaggaggucagagaaa

SEQ ID NO: 749174 - RNA, 22 nt, Human
guuuugaagaagaccuugaaac

SEQ ID NO: 749175 - RNA, 22 nt, Human
gcaggaugggagcuucacucug

SEQ ID NO: 749176 - RNA, 20 nt, Human
uguccccaccaaaauuucau

SEQ ID NO: 749177 - RNA, 22 nt, Human
aaauaguaaagugguagccauc

SEQ ID NO: 749178 - RNA, 22 nt, Human
gcacagaaccagacaugaggca

SEQ ID NO: 749179 - RNA, 22 nt, Human
guccagcaggaugcaagugcca

SEQ ID NO: 749180 - RNA, 22 nt, Human
cauuuguaguuaaaaaugucuc

SEQ ID NO: 749181 - RNA, 22 nt, Human
uuacaguaauguauuauuuaac

SEQ ID NO: 749182 - RNA, 22 nt, Human
cuccagcucgcgagcucugcuc

SEQ ID NO: 749183 - RNA, 22 nt, Human
ugcugggcuucaacugccugag

SEQ ID NO: 749184 - RNA, 22 nt, Human
ugaggaaggaauugagguuuua

SEQ ID NO: 749185 - RNA, 22 nt, Human
ggccuugagagccagugcaggc

SEQ ID NO: 749186 - RNA, 22 nt, Human
uuugaaagagcugauacaugaa

SEQ ID NO: 749187 - RNA, 22 nt, Human
gccaggcagacaggucaucagg

SEQ ID NO: 749188 - RNA, 19 nt, Human
aggaauggaauuaauucug

SEQ ID NO: 749189 - RNA, 22 nt, Human
gaggaaacauuguagaagcagu

SEQ ID NO: 749190 - RNA, 22 nt, Human
ucuacugugguccuuguaacca

SEQ ID NO: 749191 - RNA, 22 nt, Human
uucauucuguuuggaaaggugg

SEQ ID NO: 749192 - RNA, 21 nt, Human
guauucuuuaugaagugaaaa

SEQ ID NO: 749193 - RNA, 22 nt, Human
auaaagcaaauaggacuauugc

SEQ ID NO: 749194 - RNA, 22 nt, Human
ucacauucucagcaucuauaca

SEQ ID NO: 749195 - RNA, 22 nt, Human
ucuucuaguaggccaagaagcu

SEQ ID NO: 749196 - RNA, 22 nt, Human
guuuauaaggcccaauauuucu

SEQ ID NO: 749197 - RNA, 22 nt, Human
ucauggaaacaaugcggaaaaa

SEQ ID NO: 749198 - RNA, 22 nt, Human
cagggugcagagcuaggguagu

SEQ ID NO: 749199 - RNA, 22 nt, Human
uucugggggaauacagcuauga

SEQ ID NO: 749200 - RNA, 22 nt, Human
ucauagaaguaguauccacauu

SEQ ID NO: 749201 - RNA, 22 nt, Human
agaaagugugucauacuaagug

SEQ ID NO: 749202 - RNA, 22 nt, Human
uuuaguguagcauucagaguca

SEQ ID NO: 749203 - RNA, 22 nt, Human
cacuuggaggaaggccuauuca

SEQ ID NO: 749204 - RNA, 22 nt, Human
aaggugcucacgggcucaggga

SEQ ID NO: 749205 - RNA, 22 nt, Human
gaaugaauuuuggauggugaag

SEQ ID NO: 749206 - RNA, 18 nt, Human
gccacccuccucgucucc

SEQ ID NO: 749207 - RNA, 22 nt, Human
aggcuggcagccaccucagcag

SEQ ID NO: 749208 - RNA, 22 nt, Human
auuccaguuaguggcagcuuau

SEQ ID NO: 749209 - RNA, 18 nt, Human
gcacucugacugcagagc

SEQ ID NO: 749210 - RNA, 22 nt, Human
gcccaggaguucaaggcugcag

SEQ ID NO: 749211 - RNA, 22 nt, Human
cauguggauaugaauuguagaa

SEQ ID NO: 749212 - RNA, 19 nt, Human
uccuuucuguuccugagau

SEQ ID NO: 749213 - RNA, 22 nt, Human
uaguaaacagcucugccacaau

SEQ ID NO: 749214 - RNA, 22 nt, Human
gaaucucaaggcuugugaggau

SEQ ID NO: 749215 - RNA, 22 nt, Human
aauguucaaaagcaucagugaa

SEQ ID NO: 749216 - RNA, 22 nt, Human
guggcagagccuugcggcuuug

SEQ ID NO: 749217 - RNA, 22 nt, Human
uucagagguuagagcaguggga

SEQ ID NO: 749218 - RNA, 22 nt, Human
ggagaggguagggguccugccc

SEQ ID NO: 749219 - RNA, 22 nt, Human
caagguuucgaguucccaacca

SEQ ID NO: 749220 - RNA, 22 nt, Human
cugccagcucaccggcucagac

SEQ ID NO: 749221 - RNA, 22 nt, Human
uuucaggagagaccagaaauga

SEQ ID NO: 749222 - RNA, 22 nt, Human
uuguuuaauaucgugaaguacu

SEQ ID NO: 749223 - RNA, 22 nt, Human
ccaaaguccacaguuuacauua

SEQ ID NO: 749224 - RNA, 22 nt, Human
cugcaugagcugucaguggagg

SEQ ID NO: 749225 - RNA, 22 nt, Human
gggccuggggacaccaccauga

SEQ ID NO: 749226 - RNA, 18 nt, Human
ucaggagacacagacgca

SEQ ID NO: 749227 - RNA, 22 nt, Human
acacuucauagcaagguuggag

SEQ ID NO: 749228 - RNA, 22 nt, Human
aagcucagcaugucuccuagaa

SEQ ID NO: 749229 - RNA, 22 nt, Human
aagugucuacauuugcuaacca

SEQ ID NO: 749230 - RNA, 22 nt, Human
agaucacagagccaagauucca

SEQ ID NO: 749231 - RNA, 22 nt, Human
agggccaguucagaggacaugg

SEQ ID NO: 749232 - RNA, 22 nt, Human
uauggaaauaauuagacaagug

SEQ ID NO: 749233 - RNA, 22 nt, Human
uuauuccauucaguucaacaag

SEQ ID NO: 749234 - RNA, 20 nt, Human
guauuagguguuccucuuuc

SEQ ID NO: 749235 - RNA, 22 nt, Human
cucucuucccgugaguguugca

SEQ ID NO: 749236 - RNA, 22 nt, Human
uagaacacuugaccacugcucc

SEQ ID NO: 749237 - RNA, 22 nt, Human
acuaagaccuagauacuagggg

SEQ ID NO: 749238 - RNA, 22 nt, Human
ucugucucuuuguucugugagu

SEQ ID NO: 749239 - RNA, 22 nt, Human
ugaggcaggaguucaggcugcg

SEQ ID NO: 749240 - RNA, 22 nt, Human
gaaaguauuuaaguccauauuu

SEQ ID NO: 749241 - RNA, 22 nt, Human
ucaucaaagcgcuuggaguagg

SEQ ID NO: 749242 - RNA, 22 nt, Human
auuugucucugcacuuuacuca

SEQ ID NO: 749243 - RNA, 22 nt, Human
gcagcaggagaguaauagcggu

SEQ ID NO: 749244 - RNA, 22 nt, Human
cauggaucauaaaugugcuaaa

SEQ ID NO: 749245 - RNA, 22 nt, Human
ugcucugggcuaucugagaaag

SEQ ID NO: 749246 - RNA, 22 nt, Human
gagcuccacuuagcaaggccac

SEQ ID NO: 749247 - RNA, 22 nt, Human
cccucaguuuuccagugugggc

SEQ ID NO: 749248 - RNA, 22 nt, Human
gugcaaaaauaauugugguuuu

SEQ ID NO: 749249 - RNA, 23 nt, Human
ccuggcuguggauuugggccugc

SEQ ID NO: 749250 - RNA, 22 nt, Human
cguggcaguggaaggcugggug

SEQ ID NO: 749251 - RNA, 22 nt, Human
cucacaguuuucuguaguccaa

SEQ ID NO: 749252 - RNA, 22 nt, Human
uuguaguggccaaagaacucuu

SEQ ID NO: 749253 - RNA, 22 nt, Human
acugucaucugguagaugaugg

SEQ ID NO: 749254 - RNA, 22 nt, Human
uuugaaagcaccauuugaguag

SEQ ID NO: 749255 - RNA, 22 nt, Human
ggcugugccucaaggcuacuca

SEQ ID NO: 749256 - RNA, 22 nt, Human
ugccaauuugccccuuugcuga

SEQ ID NO: 749257 - RNA, 20 nt, Human
agugagauugcugcucuagc

SEQ ID NO: 749258 - RNA, 18 nt, Human
gccagcugcacggcccuc

SEQ ID NO: 749259 - RNA, 22 nt, Human
caucuuugaacucuguauaaac

SEQ ID NO: 749260 - RNA, 22 nt, Human
ugaggagcuucuggaaagugca

SEQ ID NO: 749261 - RNA, 22 nt, Human
ucucuggcuccugccgggucca

SEQ ID NO: 749262 - RNA, 18 nt, Human
gagcugggagaaggaagg

SEQ ID NO: 749263 - RNA, 22 nt, Human
aaaucguggaagacaccagugg

SEQ ID NO: 749264 - RNA, 22 nt, Human
gaggccaggagugcuguaaguu

SEQ ID NO: 749265 - RNA, 22 nt, Human
aacuucucagccugcaccuggc

SEQ ID NO: 749266 - RNA, 22 nt, Human
agagacauggagaggcaaaguu

SEQ ID NO: 749267 - RNA, 22 nt, Human
uuucaugugcaauuagcaauau

SEQ ID NO: 749268 - RNA, 22 nt, Human
aagccacuauuaaauaaugauu

SEQ ID NO: 749269 - RNA, 17 nt, Human
cccuggcaaagaauggc

SEQ ID NO: 749270 - RNA, 22 nt, Human
cccagcaguacccaagcccuug

SEQ ID NO: 749271 - RNA, 22 nt, Human
cuggaauggguuucaggcacug

SEQ ID NO: 749272 - RNA, 22 nt, Human
ggugcauggaaagaguaaguaa

SEQ ID NO: 749273 - RNA, 22 nt, Human
uaugucuuguguuugcuaaucu

SEQ ID NO: 749274 - RNA, 22 nt, Human
ggacauggaaaucggcuugcuc

SEQ ID NO: 749275 - RNA, 22 nt, Human
aacaaacaguuaaguguggaug

SEQ ID NO: 749276 - RNA, 22 nt, Human
guauaguuugcgauuugugguu

SEQ ID NO: 749277 - RNA, 22 nt, Human
cagagagaggccacugcuauua

SEQ ID NO: 749278 - RNA, 17 nt, Human
cuagagagaaagagcua

SEQ ID NO: 749279 - RNA, 22 nt, Human
agcacagacuggucccaggucu

SEQ ID NO: 749280 - RNA, 22 nt, Human
uauuaaauuauggauuuaggag

SEQ ID NO: 749281 - RNA, 22 nt, Human
acagccugacuuuuguugucac

SEQ ID NO: 749282 - RNA, 22 nt, Human
uacauugugauaggaagucacc

SEQ ID NO: 749283 - RNA, 22 nt, Human
uggcucacaggacucucugggc

SEQ ID NO: 749284 - RNA, 22 nt, Human
uuccaguucuggcuuugccacu

SEQ ID NO: 749285 - RNA, 22 nt, Human
gauuucuugauaauucaaaucc

SEQ ID NO: 749286 - RNA, 22 nt, Human
gcuguggaguacagagcugguu

SEQ ID NO: 749287 - RNA, 17 nt, Human
gggcugacaguggccuc

SEQ ID NO: 749288 - RNA, 22 nt, Human
cuggcaugcccaggguaugugg

SEQ ID NO: 749289 - RNA, 21 nt, Human
uccaggcugaugaugucaacu

SEQ ID NO: 749290 - RNA, 22 nt, Human
ccuucugucucccucauauuga

SEQ ID NO: 749291 - RNA, 22 nt, Human
ugaggccaagaaaagcugggug

SEQ ID NO: 749292 - RNA, 22 nt, Human
uggggagagauugaggaguuuu

SEQ ID NO: 749293 - RNA, 21 nt, Human
aggucccagguuugggcagca

SEQ ID NO: 749294 - RNA, 22 nt, Human
aagaccauuuaauggagaaaga

SEQ ID NO: 749295 - RNA, 22 nt, Human
guagcaucuguuggcugcuccu

SEQ ID NO: 749296 - RNA, 21 nt, Human
cacaccaaacaggaacaggga

SEQ ID NO: 749297 - RNA, 22 nt, Human
cuccaagggcucccagacgucu

SEQ ID NO: 749298 - RNA, 22 nt, Human
gagugugucggucagcguggcg

SEQ ID NO: 749299 - RNA, 19 nt, Human
acuggcaguuucugcaugg

SEQ ID NO: 749300 - RNA, 22 nt, Human
aaagauuugaaauuaggcauca

SEQ ID NO: 749301 - RNA, 22 nt, Human
ccuggagggcgccgcacagucc

SEQ ID NO: 749302 - RNA, 22 nt, Human
uauggcuuucuccauagggcag

SEQ ID NO: 749303 - RNA, 22 nt, Human
ucugucuuugagaucucagccu

SEQ ID NO: 749304 - RNA, 22 nt, Human
uccuugacugugaggaacuagc

SEQ ID NO: 749305 - RNA, 22 nt, Human
auugcaaaauuguccuguggaa

SEQ ID NO: 749306 - RNA, 22 nt, Human
uccugcugggucuaacucuggu

SEQ ID NO: 749307 - RNA, 22 nt, Human
aaugagacacgugaagcagaug

SEQ ID NO: 749308 - RNA, 22 nt, Human
cagaagcacuaggaggaaacgu

SEQ ID NO: 749309 - RNA, 22 nt, Human
acaucuuuauacuaguccuuga

SEQ ID NO: 749310 - RNA, 23 nt, Human
agagcuuucuaaaauguaaaucu

SEQ ID NO: 749311 - RNA, 22 nt, Human
agcugauuccacuuuuucccca

SEQ ID NO: 749312 - RNA, 22 nt, Human
ugcuuggcuucauuuaaguuuu

SEQ ID NO: 749313 - RNA, 22 nt, Human
auguccagagccggccugcuga

SEQ ID NO: 749314 - RNA, 23 nt, Human
ugaacaguaugugggacauugag

SEQ ID NO: 749315 - RNA, 22 nt, Human
uucaagucuguuucauugcaug

SEQ ID NO: 749316 - RNA, 21 nt, Human
acauguaagagaguuucaaga

SEQ ID NO: 749317 - RNA, 20 nt, Human
uucuuaaagaccucacuuug

SEQ ID NO: 749318 - RNA, 22 nt, Human
gguggagagcuggaugagaggu

SEQ ID NO: 749319 - RNA, 22 nt, Human
agggccagggaaacgaucagca

SEQ ID NO: 749320 - RNA, 19 nt, Human
ugcuuugccuugauuagcu

SEQ ID NO: 749321 - RNA, 22 nt, Human
auucucucuagaagcugagaug

SEQ ID NO: 749322 - RNA, 23 nt, Human
ugacacaggucaaaaauaagaug

SEQ ID NO: 749323 - RNA, 22 nt, Human
gaaaagggcaagagagagggca

SEQ ID NO: 749324 - RNA, 22 nt, Human
aaggugggcagaucacaagguc

SEQ ID NO: 749325 - RNA, 22 nt, Human
cauuauauuacagcacuguuaa

SEQ ID NO: 749326 - RNA, 22 nt, Human
accaguggaauuauucuguggu

SEQ ID NO: 749327 - RNA, 22 nt, Human
caacugccauacagcuccaugg

SEQ ID NO: 749328 - RNA, 22 nt, Human
ugcagagagauccucaggguuu

SEQ ID NO: 749329 - RNA, 20 nt, Human
uucuuaguagagcauguauu

SEQ ID NO: 749330 - RNA, 22 nt, Human
cuggggaacaauuugccacacu

SEQ ID NO: 749331 - RNA, 22 nt, Human
ucagugcaggaaucucuagcca

SEQ ID NO: 749332 - RNA, 22 nt, Human
uacaguuaaaaaguucaauggu

SEQ ID NO: 749333 - RNA, 22 nt, Human
agucuguguacuggguuucugu

SEQ ID NO: 749334 - RNA, 22 nt, Human
uguguguaaggaagcuuuaugg

SEQ ID NO: 749335 - RNA, 22 nt, Human
uuuuuguauagaaaugaacuaa

SEQ ID NO: 749336 - RNA, 22 nt, Human
acacagauuuuacauguuaugc

SEQ ID NO: 749337 - RNA, 22 nt, Human
cugccugggccggccacccucu

SEQ ID NO: 749338 - RNA, 22 nt, Human
aaauacaguguguguucuuuga

SEQ ID NO: 749339 - RNA, 22 nt, Human
gauuucaaguaucuugggcgag

SEQ ID NO: 749340 - RNA, 22 nt, Human
uuucaguucaguuuauuauauc

SEQ ID NO: 749341 - RNA, 22 nt, Human
uguaagauauucagcuuauuga

SEQ ID NO: 749342 - RNA, 22 nt, Human
ucugcuggccuuagcaggucua

SEQ ID NO: 749343 - RNA, 22 nt, Human
aauaaacaaauccuuccuuccc

SEQ ID NO: 749344 - RNA, 22 nt, Human
ccaccuggggcuguggccccuu

SEQ ID NO: 749345 - RNA, 22 nt, Human
cagagaaagggugaauuccuuc

SEQ ID NO: 749346 - RNA, 22 nt, Human
ccagccucaucauauuccugcu

SEQ ID NO: 749347 - RNA, 22 nt, Human
acaguuaagcaguaugaucaca

SEQ ID NO: 749348 - RNA, 22 nt, Human
aaaaaugugaccacaggguguu

SEQ ID NO: 749349 - RNA, 22 nt, Human
aguuaaacuugccuuuauuccu

SEQ ID NO: 749350 - RNA, 22 nt, Human
uaucgguaagauggaaaucagg

SEQ ID NO: 749351 - RNA, 22 nt, Human
uagaggaaauuuccaaggugag

SEQ ID NO: 749352 - RNA, 22 nt, Human
ugugcauagacuuucaccaccu

SEQ ID NO: 749353 - RNA, 22 nt, Human
uuugcauuucucguaaggaaac

SEQ ID NO: 749354 - RNA, 22 nt, Human
agagagcucuggcugggugacc

SEQ ID NO: 749355 - RNA, 22 nt, Human
cuucuggguugcaggucuuggc

SEQ ID NO: 749356 - RNA, 22 nt, Human
ucacuuuuggguuuccaguaga

SEQ ID NO: 749357 - RNA, 22 nt, Human
gcuucauuacugacagucugug

SEQ ID NO: 749358 - RNA, 22 nt, Human
ucauauuaggguaaugauaaga

SEQ ID NO: 749359 - RNA, 20 nt, Human
ucccaggcugggcuccagcu

SEQ ID NO: 749360 - RNA, 22 nt, Human
uuuucaucucugcuuuguaccu

SEQ ID NO: 749361 - RNA, 21 nt, Human
cgggcuggccgggcccucacc

SEQ ID NO: 749362 - RNA, 18 nt, Human
ucuggaacaacuucaugu

SEQ ID NO: 749363 - RNA, 22 nt, Human
ugcaauuucaaauaucagaaag

SEQ ID NO: 749364 - RNA, 22 nt, Human
ggaaggaggggcaaagcaguuc

SEQ ID NO: 749365 - RNA, 22 nt, Human
auguggcuccuuacucaucagc

SEQ ID NO: 749366 - RNA, 22 nt, Human
auaccucuggcacucaagacuu

SEQ ID NO: 749367 - RNA, 22 nt, Human
caaacauagugaagcaaugaca

SEQ ID NO: 749368 - RNA, 22 nt, Human
uuaguugacccccaguccuggc

SEQ ID NO: 749369 - RNA, 22 nt, Human
guuacacaggaaaacauuagca

SEQ ID NO: 749370 - RNA, 22 nt, Human
auugagcaccuacaguauuacc

SEQ ID NO: 749371 - RNA, 22 nt, Human
ucuucuguuaccacagcgauga

SEQ ID NO: 749372 - RNA, 22 nt, Human
cuguuuauuacguaauuaauau

SEQ ID NO: 749373 - RNA, 22 nt, Human
ugcuuugcucucacuguaaggu

SEQ ID NO: 749374 - RNA, 22 nt, Human
uccaucacuauuaucuacaaca

SEQ ID NO: 749375 - RNA, 22 nt, Human
uucaccagauuuuguauaguca

SEQ ID NO: 749376 - RNA, 22 nt, Human
cugccccugccaggcagcuguc

SEQ ID NO: 749377 - RNA, 22 nt, Human
cuuccugggucagccuggaggu

SEQ ID NO: 749378 - RNA, 21 nt, Human
gggcgaggccugauguggcuc

SEQ ID NO: 749379 - RNA, 22 nt, Human
ccagccagaaguccgggcuucu

SEQ ID NO: 749380 - RNA, 22 nt, Human
aggggagccagggcugcgaguu

SEQ ID NO: 749381 - RNA, 22 nt, Human
agguuucaugggagacaacuca

SEQ ID NO: 749382 - RNA, 18 nt, Human
caaauacuguugucuuau

SEQ ID NO: 749383 - RNA, 22 nt, Human
ucaggcuugaggucuguaugug

SEQ ID NO: 749384 - RNA, 22 nt, Human
uacauucccccaauuaccaaug

SEQ ID NO: 749385 - RNA, 22 nt, Human
aggcacagagagguuaaaugca

SEQ ID NO: 749386 - RNA, 22 nt, Human
ggugaggcuaagugacacaggg

SEQ ID NO: 749387 - RNA, 19 nt, Human
uagcucugucuuauuccaa

SEQ ID NO: 749388 - RNA, 22 nt, Human
aagucacauucugagguauugg

SEQ ID NO: 749389 - RNA, 22 nt, Human
caggcuguguuccuggaacccc

SEQ ID NO: 749390 - RNA, 22 nt, Human
gacagccaucagcacacgcugc

SEQ ID NO: 749391 - RNA, 22 nt, Human
gccagcugaggccgugcaggcu

SEQ ID NO: 749392 - RNA, 22 nt, Human
uccaggcuggacaugaggcggg

SEQ ID NO: 749393 - RNA, 22 nt, Human
ugcaggugugggcaggggagca

SEQ ID NO: 749394 - RNA, 22 nt, Human
uucccucuccuacucaggaaag

SEQ ID NO: 749395 - RNA, 22 nt, Human
caggcagccuucucgucucaca

SEQ ID NO: 749396 - RNA, 22 nt, Human
acugaaggcuuaacucuuucau

SEQ ID NO: 749397 - RNA, 22 nt, Human
uaauccaggguauucuaguuuc

SEQ ID NO: 749398 - RNA, 22 nt, Human
ucacauuuuaucugagauugac

SEQ ID NO: 749399 - RNA, 22 nt, Human
gaggcugggaaguccaagacca

SEQ ID NO: 749400 - RNA, 21 nt, Human
ugagccaggcugacggcugug

SEQ ID NO: 749401 - RNA, 17 nt, Human
gccaaaggguuccaauc

SEQ ID NO: 749402 - RNA, 22 nt, Human
aaacugcaauuacuuuugcagc

SEQ ID NO: 749403 - RNA, 22 nt, Human
guuauuuuaacuucucaguaau

SEQ ID NO: 749404 - RNA, 22 nt, Human
ucuuugaugugguuaauuauga

SEQ ID NO: 749405 - RNA, 22 nt, Human
cagcuugggucaggugccugcu

SEQ ID NO: 749406 - RNA, 22 nt, Human
ucugggcucugucagcaccucu

SEQ ID NO: 749407 - RNA, 22 nt, Human
ugggcagagaguagaggcaacg

SEQ ID NO: 749408 - RNA, 22 nt, Human
agcacagauggauguauucauu

SEQ ID NO: 749409 - RNA, 20 nt, Human
acauugauuauguuuguaga

SEQ ID NO: 749410 - RNA, 22 nt, Human
uucuccagaccacugccucugu

SEQ ID NO: 749411 - RNA, 22 nt, Human
uggagcuggaagacagugauau

SEQ ID NO: 749412 - RNA, 22 nt, Human
uuucuguuguacuuaaacuagg

SEQ ID NO: 749413 - RNA, 22 nt, Human
acaguuugcacuguucaucaaa

SEQ ID NO: 749414 - RNA, 22 nt, Human
ggucccugcccaaagcccuugg

SEQ ID NO: 749415 - RNA, 22 nt, Human
ucuugauuuuguuaaaauuaga

SEQ ID NO: 749416 - RNA, 22 nt, Human
caggagguacauagauucagau

SEQ ID NO: 749417 - RNA, 20 nt, Human
ugacaacaaaaugguaauuu

SEQ ID NO: 749418 - RNA, 22 nt, Human
acauuugucuggcuagaaaguu

SEQ ID NO: 749419 - RNA, 22 nt, Human
gcuacagguauauagaugaaac

SEQ ID NO: 749420 - RNA, 22 nt, Human
uuucacauguggaaugccaggu

SEQ ID NO: 749421 - RNA, 22 nt, Human
gggcuaaguggaucagucagga

SEQ ID NO: 749422 - RNA, 22 nt, Human
uuuuauugggaguccucuacug

SEQ ID NO: 749423 - RNA, 22 nt, Human
auuaaguguauugcugagggua

SEQ ID NO: 749424 - RNA, 22 nt, Human
cagcaucucuuuuugcauuccu

SEQ ID NO: 749425 - RNA, 22 nt, Human
ucugucaccgagggcauccaaa

SEQ ID NO: 749426 - RNA, 22 nt, Human
gccugucugcgucacgcuuauu

SEQ ID NO: 749427 - RNA, 22 nt, Human
agggaagcugcuggguccaccu

SEQ ID NO: 749428 - RNA, 22 nt, Human
ugcaacauuauuaaacuaagca

SEQ ID NO: 749429 - RNA, 20 nt, Human
cuacuuuaggcacugagaau

SEQ ID NO: 749430 - RNA, 20 nt, Human
cuguaucagguuacaaagua

SEQ ID NO: 749431 - RNA, 22 nt, Human
auguagcugcagaugauaaugc

SEQ ID NO: 749432 - RNA, 22 nt, Human
agagggggcagcggaccaguga

SEQ ID NO: 749433 - RNA, 22 nt, Human
uugcagggcuuggggauuacag

SEQ ID NO: 749434 - RNA, 22 nt, Human
ucaggcaaucugacagcuggag

SEQ ID NO: 749435 - RNA, 22 nt, Human
uugaaugcaugguucacucugu

SEQ ID NO: 749436 - RNA, 22 nt, Human
ucaugguauauuucacucuuua

SEQ ID NO: 749437 - RNA, 22 nt, Human
ggacagcauaucagcagggcag

SEQ ID NO: 749438 - RNA, 22 nt, Human
cugggcauuuuucucuguuaca

SEQ ID NO: 749439 - RNA, 22 nt, Human
agccaugauuuucucauuuuca

SEQ ID NO: 749440 - RNA, 22 nt, Human
aauucacauauacauuauuccu

SEQ ID NO: 749441 - RNA, 22 nt, Human
ccugcacccaggccgcaccucu

SEQ ID NO: 749442 - RNA, 18 nt, Human
ggccagcuccugaggcag

SEQ ID NO: 749443 - RNA, 22 nt, Human
cugcccugacugaccuuuugaa

SEQ ID NO: 749444 - RNA, 22 nt, Human
uuaacuguaucauacuguuuca

SEQ ID NO: 749445 - RNA, 22 nt, Human
agaaaucauucccaaacccaua

SEQ ID NO: 749446 - RNA, 22 nt, Human
cauguguagugaaauaagcagu

SEQ ID NO: 749447 - RNA, 23 nt, Human
ccuggcagcaaacgaggagguua

SEQ ID NO: 749448 - RNA, 22 nt, Human
gcaagcaagcagguagagcuga

SEQ ID NO: 749449 - RNA, 22 nt, Human
cuagccagaugauucccaaaua

SEQ ID NO: 749450 - RNA, 22 nt, Human
aguguacauaguuaggaacauc

SEQ ID NO: 749451 - RNA, 23 nt, Human
cagaaaugacaguaagcacccug

SEQ ID NO: 749452 - RNA, 17 nt, Human
cucuguacaggaaagag

SEQ ID NO: 749453 - RNA, 22 nt, Human
gugugucuuucauuucaugagg

SEQ ID NO: 749454 - RNA, 21 nt, Human
gcccucaggggaggauggccu

SEQ ID NO: 749455 - RNA, 22 nt, Human
uuacuacagagagagcuccagu

SEQ ID NO: 749456 - RNA, 22 nt, Human
acaguguguccuaaaggucugg

SEQ ID NO: 749457 - RNA, 22 nt, Human
ccagugugaaaggucauuuauc

SEQ ID NO: 749458 - RNA, 22 nt, Human
gcccugagacugaagaacuguc

SEQ ID NO: 749459 - RNA, 22 nt, Human
guguggucgaaguucucccgga

SEQ ID NO: 749460 - RNA, 22 nt, Human
ugcuuucauauugccuaugacu

SEQ ID NO: 749461 - RNA, 22 nt, Human
uaaugcuaacaucauaucacug

SEQ ID NO: 749462 - RNA, 22 nt, Human
cugggcccacgagggcucuggg

SEQ ID NO: 749463 - RNA, 22 nt, Human
uccucacagucaacacuuugag

SEQ ID NO: 749464 - RNA, 22 nt, Human
aauggcuuugaguauuuucugg

SEQ ID NO: 749465 - RNA, 22 nt, Human
acuucaugaacuaagggaucgg

SEQ ID NO: 749466 - RNA, 22 nt, Human
agagcauccauuuuugucacau

SEQ ID NO: 749467 - RNA, 22 nt, Human
ucagacaggcuucuuucucccu

SEQ ID NO: 749468 - RNA, 22 nt, Human
ggguacaaagauuucauaagau

SEQ ID NO: 749469 - RNA, 17 nt, Human
uguucucuucagaaauc

SEQ ID NO: 749470 - RNA, 20 nt, Human
ggagcuggcauccagccucu

SEQ ID NO: 749471 - RNA, 22 nt, Human
ugaaacuugcuaauugcacgua

SEQ ID NO: 749472 - RNA, 21 nt, Human
ucugucuuccucagccuaagg

SEQ ID NO: 749473 - RNA, 22 nt, Human
uagaggagaguugcuggaugga

SEQ ID NO: 749474 - RNA, 22 nt, Human
uguauuuugugaggaucacucu

SEQ ID NO: 749475 - RNA, 22 nt, Human
caacugaaaagauucuacgcag

SEQ ID NO: 749476 - RNA, 22 nt, Human
gcucugagugauuaaggagcuu

SEQ ID NO: 749477 - RNA, 22 nt, Human
aacagaaggggguauuuacauu

SEQ ID NO: 749478 - RNA, 22 nt, Human
aaagugcuaaauaagcccugaa

SEQ ID NO: 749479 - RNA, 22 nt, Human
uugccuggagggacauggagac

SEQ ID NO: 749480 - RNA, 22 nt, Human
ucacuggcaacuugugcucccu

SEQ ID NO: 749481 - RNA, 22 nt, Human
aggcugcuggcaggcguggacg

SEQ ID NO: 749482 - RNA, 22 nt, Human
gcugggagccguaccugucacg

SEQ ID NO: 749483 - RNA, 22 nt, Human
agcacauuuaaguaugaaauau

SEQ ID NO: 749484 - RNA, 22 nt, Human
cagaagaauggugucugagcuc

SEQ ID NO: 749485 - RNA, 22 nt, Human
aaacagcaauggagaagccagg

SEQ ID NO: 749486 - RNA, 22 nt, Human
auucuggaaagcuauucucucu

SEQ ID NO: 749487 - RNA, 22 nt, Human
uacuucauuccuuuguaaaaug

SEQ ID NO: 749488 - RNA, 22 nt, Human
cuuguacaggaauccaugguau

SEQ ID NO: 749489 - RNA, 22 nt, Human
cagcaucaccgccauuucugau

SEQ ID NO: 749490 - RNA, 22 nt, Human
aguccguuucuccuugaaggca

SEQ ID NO: 749491 - RNA, 22 nt, Human
aagccagugggcauagcaguug

SEQ ID NO: 749492 - RNA, 22 nt, Human
gcuccugggcucuaccuugcua

SEQ ID NO: 749493 - RNA, 22 nt, Human
ugaggcagccugcauuaaagag

SEQ ID NO: 749494 - RNA, 22 nt, Human
auuaguguacaucucacacgca

SEQ ID NO: 749495 - RNA, 22 nt, Human
ugaacacugccauauuuaagaa

SEQ ID NO: 749496 - RNA, 22 nt, Human
cagaaugaguagcaucuucacc

SEQ ID NO: 749497 - RNA, 22 nt, Human
gaggcugguaggaaaggaaaca

SEQ ID NO: 749498 - RNA, 22 nt, Human
ucaggggcagcugugcuuugug

SEQ ID NO: 749499 - RNA, 22 nt, Human
gggaggugaaaggucaugugug

SEQ ID NO: 749500 - RNA, 22 nt, Human
uugacucuaaauuuacuuuucc

SEQ ID NO: 749501 - RNA, 22 nt, Human
uaaauaaguucuucauuguuug

SEQ ID NO: 749502 - RNA, 22 nt, Human
acaggggauugauuggaagucu

SEQ ID NO: 749503 - RNA, 22 nt, Human
ucucuggaguauaaccagggau

SEQ ID NO: 749504 - RNA, 22 nt, Human
ucaauguucugauucuuuugca

SEQ ID NO: 749505 - RNA, 22 nt, Human
gacacucuccuccaguggauag

SEQ ID NO: 749506 - RNA, 22 nt, Human
ucuagagacuauaauguguccu

SEQ ID NO: 749507 - RNA, 22 nt, Human
aaacaguuuucucauuuagugu

SEQ ID NO: 749508 - RNA, 22 nt, Human
gagggaguaacguacuacagug

SEQ ID NO: 749509 - RNA, 22 nt, Human
agcccuggggcuggucuuggaa

SEQ ID NO: 749510 - RNA, 22 nt, Human
aauccugaggcaaagagaugag

SEQ ID NO: 749511 - RNA, 22 nt, Human
aagccagggauuccugagggag

SEQ ID NO: 749512 - RNA, 22 nt, Human
cacaggcaccccugacugcuca

SEQ ID NO: 749513 - RNA, 22 nt, Human
gaaaauuuaauucucuucugug

SEQ ID NO: 749514 - RNA, 22 nt, Human
caaauccuggagccaugguaac

SEQ ID NO: 749515 - RNA, 22 nt, Human
cgcuuaauuuucuauagaaaag

SEQ ID NO: 749516 - RNA, 22 nt, Human
uagaggcacagucuauguagag

SEQ ID NO: 749517 - RNA, 22 nt, Human
aagggagacaguugugugagga

SEQ ID NO: 749518 - RNA, 22 nt, Human
gcagaggugaguuucucagcug

SEQ ID NO: 749519 - RNA, 22 nt, Human
auccccagaaaauaggugccua

SEQ ID NO: 749520 - RNA, 22 nt, Human
uauauucaaugauuaguaucag

SEQ ID NO: 749521 - RNA, 22 nt, Human
agcaggcacuaugccaggaucu

SEQ ID NO: 749522 - RNA, 22 nt, Human
gcccaagaucacacuggaaauc

SEQ ID NO: 749523 - RNA, 22 nt, Human
uggcagugaugcuuaugguuug

SEQ ID NO: 749524 - RNA, 21 nt, Human
agguggucugcagcagcugaa

SEQ ID NO: 749525 - RNA, 22 nt, Human
cuugagucauauaaagacagag

SEQ ID NO: 749526 - RNA, 22 nt, Human
ucugugucagcagcacucagcc

SEQ ID NO: 749527 - RNA, 22 nt, Human
gcucagcacuuucuccaaccac

SEQ ID NO: 749528 - RNA, 20 nt, Human
gcuaccagaacaaggccauu

SEQ ID NO: 749529 - RNA, 22 nt, Human
ucucuggcuuagguugagugca

SEQ ID NO: 749530 - RNA, 22 nt, Human
aagauugacggcuuugagugcu

SEQ ID NO: 749531 - RNA, 22 nt, Human
aucugaaaagccucuuacuccu

SEQ ID NO: 749532 - RNA, 22 nt, Human
aggguagggcccggagacagac

SEQ ID NO: 749533 - RNA, 22 nt, Human
cuggagucucuucuguagcuac

SEQ ID NO: 749534 - RNA, 22 nt, Human
acuuuacaggcacuucaaguau

SEQ ID NO: 749535 - RNA, 19 nt, Human
ucuuuggcuucuggaucag

SEQ ID NO: 749536 - RNA, 22 nt, Human
gcugugugaccugggcaagucu

SEQ ID NO: 749537 - RNA, 22 nt, Human
uuuuaguuacugcaguagcaaa

SEQ ID NO: 749538 - RNA, 22 nt, Human
ucucacugauuugagaccaagg

SEQ ID NO: 749539 - RNA, 22 nt, Human
ccuguuuaucuaucuagagaug

SEQ ID NO: 749540 - RNA, 22 nt, Human
ucuuugcaugcauuuucccuua

SEQ ID NO: 749541 - RNA, 20 nt, Human
uucaugguguauuucuuucu

SEQ ID NO: 749542 - RNA, 22 nt, Human
ucuguccuguuuccuccugaca

SEQ ID NO: 749543 - RNA, 22 nt, Human
cccagagccgcuccccuacuuc

SEQ ID NO: 749544 - RNA, 22 nt, Human
ucaggaaagaguaauguauaca

SEQ ID NO: 749545 - RNA, 22 nt, Human
ugggcucugaagucagucugcu

SEQ ID NO: 749546 - RNA, 22 nt, Human
uacagugacuggacuuugucau

SEQ ID NO: 749547 - RNA, 22 nt, Human
acagcagcuuccugacuguacu

SEQ ID NO: 749548 - RNA, 22 nt, Human
gaagccaggggccugacaggca

SEQ ID NO: 749549 - RNA, 22 nt, Human
gcaggcacaugggcgggucugg

SEQ ID NO: 749550 - RNA, 19 nt, Human
cuuuucaagccaucaguuu

SEQ ID NO: 749551 - RNA, 22 nt, Human
ucacuuugacggccaacuucua

SEQ ID NO: 749552 - RNA, 22 nt, Human
uuuucaguaaugucuacauaau

SEQ ID NO: 749553 - RNA, 22 nt, Human
gcuucccaaacuuguggauaga

SEQ ID NO: 749554 - RNA, 22 nt, Human
ugaaaguugcacauaagagaau

SEQ ID NO: 749555 - RNA, 22 nt, Human
uuuucaugucauguccuugagg

SEQ ID NO: 749556 - RNA, 22 nt, Human
ggcagcucgucaggcugcggcg

SEQ ID NO: 749557 - RNA, 22 nt, Human
ggcgccgcacucggugcagccg

SEQ ID NO: 749558 - RNA, 22 nt, Human
gagcaaagcuuuuagggccuuu

SEQ ID NO: 749559 - RNA, 22 nt, Human
cccuuccugggugucccggagu

SEQ ID NO: 749560 - RNA, 22 nt, Human
ucccugggagaugaugaugagg

SEQ ID NO: 749561 - RNA, 22 nt, Human
uggcuacaaguguguuuaguuu

SEQ ID NO: 749562 - RNA, 22 nt, Human
ugaagagauagaaguacaugcu

SEQ ID NO: 749563 - RNA, 22 nt, Human
aucuggaguuucaguuuucugg

SEQ ID NO: 749564 - RNA, 22 nt, Human
uuucuaggcacagugucuuccc

SEQ ID NO: 749565 - RNA, 22 nt, Human
ucaggaacuucuaggaaagcug

SEQ ID NO: 749566 - RNA, 22 nt, Human
uccucaggugacuagguaucuu

SEQ ID NO: 749567 - RNA, 22 nt, Human
auacauacauguacacauaaau

SEQ ID NO: 749568 - RNA, 22 nt, Human
agacccccuuuaauggaagugc

SEQ ID NO: 749569 - RNA, 22 nt, Human
ugcugcuggaucuuacucaucu

SEQ ID NO: 749570 - RNA, 22 nt, Human
uuugggcaguagauguaucacu

SEQ ID NO: 749571 - RNA, 22 nt, Human
aacacaguuucugcauugguag

SEQ ID NO: 749572 - RNA, 22 nt, Human
cuguguuuggacaacuuuucag

SEQ ID NO: 749573 - RNA, 22 nt, Human
uugcaggggagaggaacaaaca

SEQ ID NO: 749574 - RNA, 22 nt, Human
cagaagucuuucuguuucaccu

SEQ ID NO: 749575 - RNA, 22 nt, Human
ucacaaaagcuuuugaauuugg

SEQ ID NO: 749576 - RNA, 22 nt, Human
uucauuacauucaaaaggcauu

SEQ ID NO: 749577 - RNA, 22 nt, Human
uucuauguuaguaugggucucc

SEQ ID NO: 749578 - RNA, 22 nt, Human
uucauggcaggagucagaagcu

SEQ ID NO: 749579 - RNA, 22 nt, Human
aggaggccccuccuggguugcu

SEQ ID NO: 749580 - RNA, 22 nt, Human
cagacuguggcuucuuggaggg

SEQ ID NO: 749581 - RNA, 22 nt, Human
uguuaaacagauauugcccaca

SEQ ID NO: 749582 - RNA, 22 nt, Human
gggcuggcuaagacuuuucugu

SEQ ID NO: 749583 - RNA, 22 nt, Human
aaacuaaggugcuguggacuga

SEQ ID NO: 749584 - RNA, 22 nt, Human
ccuccuggcuuuucccauugaa

SEQ ID NO: 749585 - RNA, 22 nt, Human
uaacucucacagugcaacauga

SEQ ID NO: 749586 - RNA, 22 nt, Human
acugggaaggaaaggaauguaa

SEQ ID NO: 749587 - RNA, 22 nt, Human
cucuucucugcagccuuugaag

SEQ ID NO: 749588 - RNA, 20 nt, Human
ggcagcucacuacuuucugu

SEQ ID NO: 749589 - RNA, 22 nt, Human
augguuuauccuuuaccagucg

SEQ ID NO: 749590 - RNA, 22 nt, Human
acuguacauauggauucuaaga

SEQ ID NO: 749591 - RNA, 22 nt, Human
cggggcuguagcacagcugagc

SEQ ID NO: 749592 - RNA, 22 nt, Human
uggggugggcaugcgcuguccu

SEQ ID NO: 749593 - RNA, 22 nt, Human
cugcuggggucagagcacuggg

SEQ ID NO: 749594 - RNA, 22 nt, Human
uaaaugcagauuccugagccua

SEQ ID NO: 749595 - RNA, 22 nt, Human
cagcaguggaacuacccaggga

SEQ ID NO: 749596 - RNA, 20 nt, Human
uuuuccagaaaguaucauug

SEQ ID NO: 749597 - RNA, 22 nt, Human
cucugggguuagaucugaugcu

SEQ ID NO: 749598 - RNA, 22 nt, Human
agaggccagaucaucauagaug

SEQ ID NO: 749599 - RNA, 22 nt, Human
auaacagacuuagaguuacaag

SEQ ID NO: 749600 - RNA, 22 nt, Human
agccaucauuucugucacuggc

SEQ ID NO: 749601 - RNA, 22 nt, Human
gaggcccaaugcuucccuccuu

SEQ ID NO: 749602 - RNA, 22 nt, Human
uauacacaccuccaaagcagga

SEQ ID NO: 749603 - RNA, 22 nt, Human
aagcacaucucaaacuucaucu

SEQ ID NO: 749604 - RNA, 22 nt, Human
ccacagaagauggggagagugg

SEQ ID NO: 749605 - RNA, 22 nt, Human
ccucugggcuggaaaauuaaug

SEQ ID NO: 749606 - RNA, 22 nt, Human
ucugagcagggcaguguccaug

SEQ ID NO: 749607 - RNA, 22 nt, Human
cagcucugccaucaucugccuu

SEQ ID NO: 749608 - RNA, 22 nt, Human
cacuucaauuaacuucagcauu

SEQ ID NO: 749609 - RNA, 21 nt, Human
ugcgugugcauggccuucggg

SEQ ID NO: 749610 - RNA, 22 nt, Human
cacacuuugugcuaaucuauuu

SEQ ID NO: 749611 - RNA, 22 nt, Human
uugcaacuucucccaucacucu

SEQ ID NO: 749612 - RNA, 22 nt, Human
uugcuuuacaaaaauugauggu

SEQ ID NO: 749613 - RNA, 22 nt, Human
guuuacacuccaggcuggggug

SEQ ID NO: 749614 - RNA, 22 nt, Human
ucuuuccacauucucuguuuag

SEQ ID NO: 749615 - RNA, 22 nt, Human
gggcagguuauuggaguaggga

SEQ ID NO: 749616 - RNA, 22 nt, Human
gguggccugaauuagcucaggg

SEQ ID NO: 749617 - RNA, 22 nt, Human
cagagagaggggcugccuggcc

SEQ ID NO: 749618 - RNA, 22 nt, Human
agcacacaucacuucugcucau

SEQ ID NO: 749619 - RNA, 22 nt, Human
gaucuuuucagucuugguaguu

SEQ ID NO: 749620 - RNA, 22 nt, Human
aaagauuucacaucccaagccu

SEQ ID NO: 749621 - RNA, 22 nt, Human
uggccugcccagagcagcucug

SEQ ID NO: 749622 - RNA, 22 nt, Human
gcagggcugauguuauugacga

SEQ ID NO: 749623 - RNA, 22 nt, Human
gcaugcagggagggucuggcug

SEQ ID NO: 749624 - RNA, 22 nt, Human
aaaagucagucucuccuagcuc

SEQ ID NO: 749625 - RNA, 22 nt, Human
uuagucacuucuuccuucauca

SEQ ID NO: 749626 - RNA, 22 nt, Human
cucuggaguuagugaucugggc

SEQ ID NO: 749627 - RNA, 22 nt, Human
uguuuacauggagguuuucagc

SEQ ID NO: 749628 - RNA, 22 nt, Human
cagagugauggcaccugcuggg

SEQ ID NO: 749629 - RNA, 22 nt, Human
ggcacugaaccaggacacaagc

SEQ ID NO: 749630 - RNA, 22 nt, Human
gcaagcuguccuuuugcauggc

SEQ ID NO: 749631 - RNA, 22 nt, Human
agagcuuauaucuuggccaucc

SEQ ID NO: 749632 - RNA, 22 nt, Human
ugcaggagggaggguuacaguu

SEQ ID NO: 749633 - RNA, 22 nt, Human
gcacugaacuuuaaucauuucu

SEQ ID NO: 749634 - RNA, 22 nt, Human
ugucaucucacugauauagaug

SEQ ID NO: 749635 - RNA, 22 nt, Human
guggaguggccuggcccugaga

SEQ ID NO: 749636 - RNA, 22 nt, Human
ucuuuggauaucgcuagaccgu

SEQ ID NO: 749637 - RNA, 22 nt, Human
cugacagaugcugcuggcagua

SEQ ID NO: 749638 - RNA, 22 nt, Human
uauuaugaggacugguguaagg

SEQ ID NO: 749639 - RNA, 22 nt, Human
aaacuagauuaccacugcuaga

SEQ ID NO: 749640 - RNA, 22 nt, Human
acacaaauuguaggauaauugc

SEQ ID NO: 749641 - RNA, 22 nt, Human
cuggagucuuagguuaugguga

SEQ ID NO: 749642 - RNA, 22 nt, Human
acaugcaugguguuggguugga

SEQ ID NO: 749643 - RNA, 22 nt, Human
auggcugggaggagaguaugau

SEQ ID NO: 749644 - RNA, 22 nt, Human
cucagccccaauuugcccucuu

SEQ ID NO: 749645 - RNA, 22 nt, Human
ucaccaggcuccuguuaagaug

SEQ ID NO: 749646 - RNA, 22 nt, Human
cuucuucacacuggucugaagc

SEQ ID NO: 749647 - RNA, 22 nt, Human
aauguuaugugguucaacuuaa

SEQ ID NO: 749648 - RNA, 22 nt, Human
cacuuuauuauaaauuugagag

SEQ ID NO: 749649 - RNA, 22 nt, Human
gcaggaguuaggguaaaaauga

SEQ ID NO: 749650 - RNA, 22 nt, Human
gaggaaccaaaucagcuugcac

SEQ ID NO: 749651 - RNA, 22 nt, Human
ugcauauaucuuauuuuucugu

SEQ ID NO: 749652 - RNA, 22 nt, Human
cugugggaauacugcgagugua

SEQ ID NO: 749653 - RNA, 22 nt, Human
acagucugucccccaggugcua

SEQ ID NO: 749654 - RNA, 22 nt, Human
uuguaacuugugauuauaaucu

SEQ ID NO: 749655 - RNA, 22 nt, Human
acagggagugcaauucauauug

SEQ ID NO: 749656 - RNA, 22 nt, Human
aagagcuguaugccauaugauu

SEQ ID NO: 749657 - RNA, 22 nt, Human
aagaaccuauaugcugaugaau

SEQ ID NO: 749658 - RNA, 22 nt, Human
aggcagguccccuggaaggcac

SEQ ID NO: 749659 - RNA, 22 nt, Human
aaacacugauggauauuuuucc

SEQ ID NO: 749660 - RNA, 20 nt, Human
caggcagaggaugcugacca

SEQ ID NO: 749661 - RNA, 22 nt, Human
agucacauagaaguggguuuaa

SEQ ID NO: 749662 - RNA, 22 nt, Human
ugccuuuaaccagucuagacag

SEQ ID NO: 749663 - RNA, 22 nt, Human
aacagcaauagcacuauucauu

SEQ ID NO: 749664 - RNA, 22 nt, Human
guucuugccagcauccucaggu

SEQ ID NO: 749665 - RNA, 22 nt, Human
auuucaaguguugagcucauaa

SEQ ID NO: 749666 - RNA, 22 nt, Human
acauggguuauugugagguuaa

SEQ ID NO: 749667 - RNA, 22 nt, Human
aaagccuggguuccucacuauc

SEQ ID NO: 749668 - RNA, 22 nt, Human
ucuuagaugaauaaaaaguuau

SEQ ID NO: 749669 - RNA, 22 nt, Human
ugcuucuccauugaugcuaagu

SEQ ID NO: 749670 - RNA, 22 nt, Human
uugcuuuuuaauuaggaggcag

SEQ ID NO: 749671 - RNA, 22 nt, Human
caggcagcaucagucugcugua

SEQ ID NO: 749672 - RNA, 22 nt, Human
auuuauugaacacugacuaugu

SEQ ID NO: 749673 - RNA, 22 nt, Human
ugcaagugccaugugcacagug

SEQ ID NO: 749674 - RNA, 22 nt, Human
ccuggagcucacugggagccgg

SEQ ID NO: 749675 - RNA, 22 nt, Human
cuggcugguaauggaacgacag

SEQ ID NO: 749676 - RNA, 22 nt, Human
cagggucuuauaaggccaauuu

SEQ ID NO: 749677 - RNA, 22 nt, Human
ggagagcuuggagugcgauuuu

SEQ ID NO: 749678 - RNA, 22 nt, Human
uaccaugucuucaauaagucua

SEQ ID NO: 749679 - RNA, 22 nt, Human
aaacucugccauuuuuggccug

SEQ ID NO: 749680 - RNA, 21 nt, Human
acccaggggaagcagaaacug

SEQ ID NO: 749681 - RNA, 22 nt, Human
ucagcagagcgagaccaaguca

SEQ ID NO: 749682 - RNA, 22 nt, Human
uguccuggugcuccagguggcu

SEQ ID NO: 749683 - RNA, 22 nt, Human
cagcucugagacugaggcuaug

SEQ ID NO: 749684 - RNA, 22 nt, Human
uagcauuuggacauugucaccu

SEQ ID NO: 749685 - RNA, 22 nt, Human
ggguaccaagcugcuugggggc

SEQ ID NO: 749686 - RNA, 22 nt, Human
acauguuuugugccuugacuag

SEQ ID NO: 749687 - RNA, 21 nt, Human
ucagcaggcaccagaaggcug

SEQ ID NO: 749688 - RNA, 22 nt, Human
uggcucaguuucaguccugguu

SEQ ID NO: 749689 - RNA, 22 nt, Human
gagggggacguauccugguaug

SEQ ID NO: 749690 - RNA, 22 nt, Human
acaaggcuaauuuggaagauac

SEQ ID NO: 749691 - RNA, 22 nt, Human
cugggagcuuuuagaaaugcag

SEQ ID NO: 749692 - RNA, 22 nt, Human
aacccaggguggagguugcagu

SEQ ID NO: 749693 - RNA, 22 nt, Human
ccagaaaagcaucugguucuuu

SEQ ID NO: 749694 - RNA, 17 nt, Human
agucauauugugcaguu

SEQ ID NO: 749695 - RNA, 22 nt, Human
gacauugaguauuucuuuucuc

SEQ ID NO: 749696 - RNA, 19 nt, Human
uaaugcacuuaacacaugg

SEQ ID NO: 749697 - RNA, 22 nt, Human
ugucacaaggccaugaaaagaa

SEQ ID NO: 749698 - RNA, 22 nt, Human
ccucaggcaggaaacugucccg

SEQ ID NO: 749699 - RNA, 22 nt, Human
ugagaccuguaaugagaaauug

SEQ ID NO: 749700 - RNA, 21 nt, Human
ccugggagaauuggguguggc

SEQ ID NO: 749701 - RNA, 22 nt, Human
ucauguuugcccuaagaaaaag

SEQ ID NO: 749702 - RNA, 18 nt, Human
uuuauauggauagagacc

SEQ ID NO: 749703 - RNA, 22 nt, Human
uuucagcugguaaaggaguagc

SEQ ID NO: 749704 - RNA, 22 nt, Human
cucuggagaacgcuauggaucu

SEQ ID NO: 749705 - RNA, 22 nt, Human
uacaguguauguauuuguaggu

SEQ ID NO: 749706 - RNA, 22 nt, Human
uggagggcucuuucaccuggua

SEQ ID NO: 749707 - RNA, 22 nt, Human
gaggcucaccuagggagcacug

SEQ ID NO: 749708 - RNA, 22 nt, Human
cugugucccuugucccagagcc

SEQ ID NO: 749709 - RNA, 22 nt, Human
gacagcuucuaugugacgagca

SEQ ID NO: 749710 - RNA, 22 nt, Human
ugaggaaguugaucucaucagu

SEQ ID NO: 749711 - RNA, 22 nt, Human
caucugagggaaaacauguagu

SEQ ID NO: 749712 - RNA, 22 nt, Human
uuuuuuguagcaagcgcagaua

SEQ ID NO: 749713 - RNA, 22 nt, Human
gaauaaucauaucgucucacau

SEQ ID NO: 749714 - RNA, 22 nt, Human
auguuucaccagcaaauuaccu

SEQ ID NO: 749715 - RNA, 22 nt, Human
cagaugugauucuucccucagc

SEQ ID NO: 749716 - RNA, 22 nt, Human
gggcauggcgugugcuggauuc

SEQ ID NO: 749717 - RNA, 22 nt, Human
aaugccguguuucuuacguuca

SEQ ID NO: 749718 - RNA, 22 nt, Human
aguacugucagcaggguguuga

SEQ ID NO: 749719 - RNA, 22 nt, Human
cuguuucaauuugaggaucagc

SEQ ID NO: 749720 - RNA, 22 nt, Human
cucugggaugaggccuaggcac

SEQ ID NO: 749721 - RNA, 22 nt, Human
ccaguccugggagcuugcacug

SEQ ID NO: 749722 - RNA, 22 nt, Human
ggacaaagggcuagccacaacu

SEQ ID NO: 749723 - RNA, 22 nt, Human
cuggugggaggcaagguggaag

SEQ ID NO: 749724 - RNA, 22 nt, Human
gggggcgcacagucaccacaaa

SEQ ID NO: 749725 - RNA, 22 nt, Human
cuggaggaccccugccuggaag

SEQ ID NO: 749726 - RNA, 22 nt, Human
aguuucuaacauauagcauugg

SEQ ID NO: 749727 - RNA, 22 nt, Human
gggagcuggaugauugaggcaa

SEQ ID NO: 749728 - RNA, 22 nt, Human
gauucugagcugguguuuuacg

SEQ ID NO: 749729 - RNA, 22 nt, Human
gcagaggauagcauaugaaccu

SEQ ID NO: 749730 - RNA, 22 nt, Human
augcuuuagugucaaguuuggg

SEQ ID NO: 749731 - RNA, 22 nt, Human
aagauauagauggugguauaaa

SEQ ID NO: 749732 - RNA, 22 nt, Human
ucccucagucccuggacaggca

SEQ ID NO: 749733 - RNA, 19 nt, Human
aaggcuuggcugagcuggg

SEQ ID NO: 749734 - RNA, 17 nt, Human
agccccucagcgucacc

SEQ ID NO: 749735 - RNA, 22 nt, Human
uaaaguguuuguaugcagauaa

SEQ ID NO: 749736 - RNA, 22 nt, Human
uggugcaguagagcugucuggg

SEQ ID NO: 749737 - RNA, 22 nt, Human
agcagcaggguguaauugggca

SEQ ID NO: 749738 - RNA, 22 nt, Human
caaucacuccacaauaugguuc

SEQ ID NO: 749739 - RNA, 22 nt, Human
gccacagucacugcugcagggg

SEQ ID NO: 749740 - RNA, 22 nt, Human
uuugaagaagcugaccuauuuu

SEQ ID NO: 749741 - RNA, 22 nt, Human
aacuccaugguucucagauucu

SEQ ID NO: 749742 - RNA, 22 nt, Human
caguggaaacuaugcugcugga

SEQ ID NO: 749743 - RNA, 22 nt, Human
aagguccuguagccacagagcc

SEQ ID NO: 749744 - RNA, 21 nt, Human
ccagggauguugaacugaaag

SEQ ID NO: 749745 - RNA, 22 nt, Human
acacaggggaaaguggagcuga

SEQ ID NO: 749746 - RNA, 22 nt, Human
cccagcuccgagcuccgagccg

SEQ ID NO: 749747 - RNA, 22 nt, Human
aaggaggcacccugagccugcc

SEQ ID NO: 749748 - RNA, 22 nt, Human
aggcgcugcaugugaaggaguu

SEQ ID NO: 749749 - RNA, 22 nt, Human
ugugaaauauuggcaauuucau

SEQ ID NO: 749750 - RNA, 22 nt, Human
uuuuccucuguauuugaaaugc

SEQ ID NO: 749751 - RNA, 22 nt, Human
cugggcuaauuaagcacagcug

SEQ ID NO: 749752 - RNA, 22 nt, Human
cuggcuggguuccaggauucca

SEQ ID NO: 749753 - RNA, 22 nt, Human
uuuuucuuaaauguggguuggc

SEQ ID NO: 749754 - RNA, 22 nt, Human
ggguggguggcagcaccgaggc

SEQ ID NO: 749755 - RNA, 22 nt, Human
uaucuguuccaggcacucagcu

SEQ ID NO: 749756 - RNA, 22 nt, Human
agcucuaucaccugucaguugc

SEQ ID NO: 749757 - RNA, 22 nt, Human
ugaaaauuguuguacuugauaa

SEQ ID NO: 749758 - RNA, 22 nt, Human
uuauacgcucaauccuaucauc

SEQ ID NO: 749759 - RNA, 22 nt, Human
auugaguauuguaaauaaaaca

SEQ ID NO: 749760 - RNA, 22 nt, Human
agugcuguaacaacuuauuugg

SEQ ID NO: 749761 - RNA, 18 nt, Human
cagugaggaugaaggguu

SEQ ID NO: 749762 - RNA, 22 nt, Human
gugcaggagcuucuggccugac

SEQ ID NO: 749763 - RNA, 22 nt, Human
uccaggcacgaggcccugugca

SEQ ID NO: 749764 - RNA, 22 nt, Human
auacaagacucagcacagacgg

SEQ ID NO: 749765 - RNA, 19 nt, Human
ccugugacuaucuuuguaa

SEQ ID NO: 749766 - RNA, 22 nt, Human
auauguauagccagucuuuagg

SEQ ID NO: 749767 - RNA, 22 nt, Human
guggccugaugccagcccugug

SEQ ID NO: 749768 - RNA, 22 nt, Human
agagagaauuggauaaauuggu

SEQ ID NO: 749769 - RNA, 22 nt, Human
uauauuaccugccugaucuaua

SEQ ID NO: 749770 - RNA, 22 nt, Human
uggaggcaguaacugagcaaca

SEQ ID NO: 749771 - RNA, 22 nt, Human
uuaugaaaacaaucaguaggca

SEQ ID NO: 749772 - RNA, 22 nt, Human
ugcagcugaccagcaaguccug

SEQ ID NO: 749773 - RNA, 22 nt, Human
aaaguucauugaugacugaggu

SEQ ID NO: 749774 - RNA, 22 nt, Human
agggccugggccagcacccuuu

SEQ ID NO: 749775 - RNA, 22 nt, Human
cugccucagcguuguggcccua

SEQ ID NO: 749776 - RNA, 22 nt, Human
aaaagucucucugaguaaaagu

SEQ ID NO: 749777 - RNA, 22 nt, Human
cugguuuagcuguaagguuccc

SEQ ID NO: 749778 - RNA, 22 nt, Human
gcacagaacccuaucuuucgga

SEQ ID NO: 749779 - RNA, 22 nt, Human
cccaggaguaagugacauuguu

SEQ ID NO: 749780 - RNA, 22 nt, Human
uugcagggcaaauggucagaua

SEQ ID NO: 749781 - RNA, 22 nt, Human
uugcaagggcaugugugcgugu

SEQ ID NO: 749782 - RNA, 22 nt, Human
ucacugcuuaacucaagaucuc

SEQ ID NO: 749783 - RNA, 22 nt, Human
ucacugcucucuaagcaucgcc

SEQ ID NO: 749784 - RNA, 22 nt, Human
caaaacugucuagagagagaag

SEQ ID NO: 749785 - RNA, 22 nt, Human
cugagcagcuguuacagagugu

SEQ ID NO: 749786 - RNA, 22 nt, Human
ggagccugguuacuagagccug

SEQ ID NO: 749787 - RNA, 19 nt, Human
uucugggcagcacaugaau

SEQ ID NO: 749788 - RNA, 22 nt, Human
aaugaugaguucuaauagaccc

SEQ ID NO: 749789 - RNA, 20 nt, Human
cagaugcuggaucuuggucc

SEQ ID NO: 749790 - RNA, 22 nt, Human
guucauccaugucagcguauau

SEQ ID NO: 749791 - RNA, 22 nt, Human
cucacaguuucacaguguagau

SEQ ID NO: 749792 - RNA, 22 nt, Human
caaguuuuagcaaguggaaagg

SEQ ID NO: 749793 - RNA, 22 nt, Human
uuccaaacucauaguauggugu

SEQ ID NO: 749794 - RNA, 22 nt, Human
ugggcagaauugugguaguuaa

SEQ ID NO: 749795 - RNA, 22 nt, Human
agucauauuuagcuuguggaau

SEQ ID NO: 749796 - RNA, 22 nt, Human
ccuccugggcuccugucugcac

SEQ ID NO: 749797 - RNA, 22 nt, Human
uaaguucaguuggucgaaguag

SEQ ID NO: 749798 - RNA, 22 nt, Human
cccucccugugugccucauuug

SEQ ID NO: 749799 - RNA, 22 nt, Human
auggagggugucagagagcgaa

SEQ ID NO: 749800 - RNA, 22 nt, Human
aucucucugcccaggggcugug

SEQ ID NO: 749801 - RNA, 22 nt, Human
aucauuuggggaauuguggaca

SEQ ID NO: 749802 - RNA, 22 nt, Human
caugcaaacacguaaacauuca

SEQ ID NO: 749803 - RNA, 22 nt, Human
cagugaacuugaguacuucauu

SEQ ID NO: 749804 - RNA, 22 nt, Human
uuguuucuccuggugccugaua

SEQ ID NO: 749805 - RNA, 22 nt, Human
agaggucuuaagaucuagacug

SEQ ID NO: 749806 - RNA, 22 nt, Human
caggggcgguggcucacgccug

SEQ ID NO: 749807 - RNA, 22 nt, Human
aacccauuaauccuugcaagca

SEQ ID NO: 749808 - RNA, 18 nt, Human
ccagauggccagucugcu

SEQ ID NO: 749809 - RNA, 22 nt, Human
cgugggaguggugggugcucag

SEQ ID NO: 749810 - RNA, 22 nt, Human
ucuggccaacaaaaacuaaguc

SEQ ID NO: 749811 - RNA, 22 nt, Human
cuggagagaauguggaaugauu

SEQ ID NO: 749812 - RNA, 22 nt, Human
gaggcucacuaggcauccuggg

SEQ ID NO: 749813 - RNA, 22 nt, Human
gcuggcacagguggaugcuggc

SEQ ID NO: 749814 - RNA, 22 nt, Human
agaggccuaauugcuacccuuu

SEQ ID NO: 749815 - RNA, 22 nt, Human
ugaaguuauauauguugaaaau

SEQ ID NO: 749816 - RNA, 22 nt, Human
uccagguccuacuggcccauag

SEQ ID NO: 749817 - RNA, 20 nt, Human
uucagaaauaaggaaugagg

SEQ ID NO: 749818 - RNA, 22 nt, Human
agccacagagagggagcugcaa

SEQ ID NO: 749819 - RNA, 22 nt, Human
acaguggaaagaacauggauuu

SEQ ID NO: 749820 - RNA, 21 nt, Human
ugugugggcauaucugcugca

SEQ ID NO: 749821 - RNA, 22 nt, Human
uaaagguuaguagcagggaaac

SEQ ID NO: 749822 - RNA, 20 nt, Human
agcuggagaagggcccuucc

SEQ ID NO: 749823 - RNA, 22 nt, Human
gaaauguuuuacaaggcauacu

SEQ ID NO: 749824 - RNA, 22 nt, Human
cagcaucuguuuuucugaccca

SEQ ID NO: 749825 - RNA, 22 nt, Human
augcuuccuuaccagaagauga

SEQ ID NO: 749826 - RNA, 22 nt, Human
caaagguuaugaaccacuugua

SEQ ID NO: 749827 - RNA, 22 nt, Human
ugcccucagccaccuccaaguu

SEQ ID NO: 749828 - RNA, 22 nt, Human
gggcagaggcucuggcccaucc

SEQ ID NO: 749829 - RNA, 20 nt, Human
ugguggccagugcugcaggc

SEQ ID NO: 749830 - RNA, 22 nt, Human
caggggcuuuuccucuauaagg

SEQ ID NO: 749831 - RNA, 22 nt, Human
aaggaguuuggguagucauaca

SEQ ID NO: 749832 - RNA, 21 nt, Human
ucuuccugacauaugcaaggc

SEQ ID NO: 749833 - RNA, 22 nt, Human
cucuuuucaaaccuguuuaugg

SEQ ID NO: 749834 - RNA, 22 nt, Human
gccucugccaagggggcugcgg

SEQ ID NO: 749835 - RNA, 22 nt, Human
gaaucaauuauccaggcuguug

SEQ ID NO: 749836 - RNA, 22 nt, Human
ugcuuucaaaggcuuucuagau

SEQ ID NO: 749837 - RNA, 22 nt, Human
ucagagugaccuuacauggucu

SEQ ID NO: 749838 - RNA, 22 nt, Human
agcuggaagcugaugagcacag

SEQ ID NO: 749839 - RNA, 22 nt, Human
gcuguguugggaaucauguggg

SEQ ID NO: 749840 - RNA, 22 nt, Human
acagaaauaacuuuuuauguuu

SEQ ID NO: 749841 - RNA, 22 nt, Human
cagaugcagcaaaaugacaggc

SEQ ID NO: 749842 - RNA, 22 nt, Human
acuucuugaugaaaaugguacu

SEQ ID NO: 749843 - RNA, 22 nt, Human
uggcugcaguugggcccucaga

SEQ ID NO: 749844 - RNA, 20 nt, Human
acugagcugcauggagagga

SEQ ID NO: 749845 - RNA, 22 nt, Human
ugagucucgguuuccccuccaa

SEQ ID NO: 749846 - RNA, 22 nt, Human
ucauuucaguggcacagaagau

SEQ ID NO: 749847 - RNA, 22 nt, Human
aguggaaggcugggaaaugcgg

SEQ ID NO: 749848 - RNA, 22 nt, Human
ucuaaagagaaccuuuucucau

SEQ ID NO: 749849 - RNA, 22 nt, Human
gugugcagaacagggagugggu

SEQ ID NO: 749850 - RNA, 22 nt, Human
agguccagguuccguuucugcg

SEQ ID NO: 749851 - RNA, 22 nt, Human
aggcagcuggcagcacccaggg

SEQ ID NO: 749852 - RNA, 22 nt, Human
gcucugagccgggggccugucc

SEQ ID NO: 749853 - RNA, 22 nt, Human
ugaugacaaacuuuccugaugc

SEQ ID NO: 749854 - RNA, 22 nt, Human
cugcagagcauaaaucugaaua

SEQ ID NO: 749855 - RNA, 22 nt, Human
gugggcagaggagagaacauua

SEQ ID NO: 749856 - RNA, 22 nt, Human
aaaggauaagguuaucaauuuu

SEQ ID NO: 749857 - RNA, 22 nt, Human
aaagacugguguguuacauaua

SEQ ID NO: 749858 - RNA, 22 nt, Human
gcccugagcacacaguagcaaa

SEQ ID NO: 749859 - RNA, 22 nt, Human
ggacuccucuagaaguugaggc

SEQ ID NO: 749860 - RNA, 22 nt, Human
uucugucuggaaaaggacauag

SEQ ID NO: 749861 - RNA, 22 nt, Human
acauacauggugcuuucuuggu

SEQ ID NO: 749862 - RNA, 22 nt, Human
uuauggagugcuuaccugccag

SEQ ID NO: 749863 - RNA, 22 nt, Human
ccaaggcuucccagagaugcuc

SEQ ID NO: 749864 - RNA, 22 nt, Human
aaggcuggaccuggaugaaucu

SEQ ID NO: 749865 - RNA, 22 nt, Human
ggugaagggccuuaggagacag

SEQ ID NO: 749866 - RNA, 22 nt, Human
ucacgagggcccugggcagcug

SEQ ID NO: 749867 - RNA, 22 nt, Human
aagggcucugugcuugucccau

SEQ ID NO: 749868 - RNA, 22 nt, Human
ugcagagaucugggcgucggcu

SEQ ID NO: 749869 - RNA, 22 nt, Human
gcugggagucgcgucuguggcc

SEQ ID NO: 749870 - RNA, 22 nt, Human
gugcuucacugaccuguuuuca

SEQ ID NO: 749871 - RNA, 22 nt, Human
ugccucugguuaucugguaccu

SEQ ID NO: 749872 - RNA, 22 nt, Human
uagcagagaggggacaguggca

SEQ ID NO: 749873 - RNA, 23 nt, Human
ccucaggggaccugugagccuga

SEQ ID NO: 749874 - RNA, 22 nt, Human
aauuugaugaguuuguaagucu

SEQ ID NO: 749875 - RNA, 22 nt, Human
acacauucuuuaaaugucuguu

SEQ ID NO: 749876 - RNA, 22 nt, Human
acucaggcuacaggggcagaag

SEQ ID NO: 749877 - RNA, 22 nt, Human
ggggcugaaccuggaggugguc

SEQ ID NO: 749878 - RNA, 19 nt, Human
ggcugcugguuacagaggc

SEQ ID NO: 749879 - RNA, 22 nt, Human
guaucuguggauuuugguaucc

SEQ ID NO: 749880 - RNA, 22 nt, Human
uaaucacagaaacagacuguuu

SEQ ID NO: 749881 - RNA, 22 nt, Human
aagacaauaauuuuugggcagg

SEQ ID NO: 749882 - RNA, 22 nt, Human
augugugccccuuuuacucuuu

SEQ ID NO: 749883 - RNA, 22 nt, Human
ucugcccuggggucagccucca

SEQ ID NO: 749884 - RNA, 22 nt, Human
aaggcugagacagcacaggucc

SEQ ID NO: 749885 - RNA, 22 nt, Human
agaggcacaaacuggaaaggac

SEQ ID NO: 749886 - RNA, 22 nt, Human
caggaagaccagggcuguggcu

SEQ ID NO: 749887 - RNA, 22 nt, Human
cuacuuuaacauggaggcacuu

SEQ ID NO: 749888 - RNA, 22 nt, Human
auagacuugguuaguaaauuug

SEQ ID NO: 749889 - RNA, 22 nt, Human
cuuguugcuaacauaugcuucu

SEQ ID NO: 749890 - RNA, 23 nt, Human
ucggugggcguggaggccgaggc

SEQ ID NO: 749891 - RNA, 22 nt, Human
ugcuguguggaugugaagaauc

SEQ ID NO: 749892 - RNA, 22 nt, Human
cuguggagguaggagcaggaca

SEQ ID NO: 749893 - RNA, 22 nt, Human
guuauauugccaaguauauugu

SEQ ID NO: 749894 - RNA, 22 nt, Human
ggagggcccugggugcagcucu

SEQ ID NO: 749895 - RNA, 22 nt, Human
ggcuuucuaugaacucaaaggc

SEQ ID NO: 749896 - RNA, 22 nt, Human
gaaagcaaguugacugcagaau

SEQ ID NO: 749897 - RNA, 22 nt, Human
ucuguacaaaggcuauuuggag

SEQ ID NO: 749898 - RNA, 22 nt, Human
gcucccagucugauggaggaga

SEQ ID NO: 749899 - RNA, 22 nt, Human
uuucuugagcuaggaaccuggg

SEQ ID NO: 749900 - RNA, 22 nt, Human
gagggcucacugagaaagcagu

SEQ ID NO: 749901 - RNA, 22 nt, Human
ggguaggagaggugucugugug

SEQ ID NO: 749902 - RNA, 22 nt, Human
ugggccagggcacccaguccag

SEQ ID NO: 749903 - RNA, 22 nt, Human
aacaucaggaucuuguuacagu

SEQ ID NO: 749904 - RNA, 22 nt, Human
aaaaugagccaugaaccaacca

SEQ ID NO: 749905 - RNA, 22 nt, Human
acucuggccccaggaucugugu

SEQ ID NO: 749906 - RNA, 22 nt, Human
cucuuuggauguuuaugauaag

SEQ ID NO: 749907 - RNA, 22 nt, Human
cacauuuacauauaaaacuuuc

SEQ ID NO: 749908 - RNA, 22 nt, Human
ugcaggcugcuggcaguagcuu

SEQ ID NO: 749909 - RNA, 22 nt, Human
auuugauuagcuguguaauuuu

SEQ ID NO: 749910 - RNA, 22 nt, Human
ucagcagcagcucagcauguuu

SEQ ID NO: 749911 - RNA, 22 nt, Human
agcaguauucuccuguggugga

SEQ ID NO: 749912 - RNA, 23 nt, Human
ucuuuacagcagcaggauuugga

SEQ ID NO: 749913 - RNA, 22 nt, Human
ggaaagggaguuuugcuuauga

SEQ ID NO: 749914 - RNA, 22 nt, Human
auacaaguggccacuugaauuc

SEQ ID NO: 749915 - RNA, 22 nt, Human
gcaagcaggguuccuuagggca

SEQ ID NO: 749916 - RNA, 22 nt, Human
cugugugagcaucacuucagau

SEQ ID NO: 749917 - RNA, 21 nt, Human
caguagugagguauuugccaa

SEQ ID NO: 749918 - RNA, 16 nt, Human
agcagggcgggaagga

SEQ ID NO: 749919 - RNA, 22 nt, Human
agcugaguuaauucaucacuua

SEQ ID NO: 749920 - RNA, 22 nt, Human
agaaguaucaggaagauucuca

SEQ ID NO: 749921 - RNA, 22 nt, Human
cagcagcaggcgcacggccguc

SEQ ID NO: 749922 - RNA, 22 nt, Human
ccuuuucuacaagcaaaugugc

SEQ ID NO: 749923 - RNA, 23 nt, Human
acccugggcaagucaccuaaccu

SEQ ID NO: 749924 - RNA, 22 nt, Human
acauuuaggauguuuugagaga

SEQ ID NO: 749925 - RNA, 22 nt, Human
ggcaauauggugaaaccccauc

SEQ ID NO: 749926 - RNA, 22 nt, Human
uugaucuucaucgaaauauugu

SEQ ID NO: 749927 - RNA, 22 nt, Human
caugaugguucuuacaaaggug

SEQ ID NO: 749928 - RNA, 22 nt, Human
aaauacagauucugacucagag

SEQ ID NO: 749929 - RNA, 22 nt, Human
ggcucuggaaaguguccuugau

SEQ ID NO: 749930 - RNA, 22 nt, Human
uuugaagucaggcuuucuaccc

SEQ ID NO: 749931 - RNA, 22 nt, Human
uauuuauguggaccauaagccu

SEQ ID NO: 749932 - RNA, 22 nt, Human
gagucagaaacucacucuauag

SEQ ID NO: 749933 - RNA, 22 nt, Human
acaguaaaucaacagaauaucu

SEQ ID NO: 749934 - RNA, 22 nt, Human
caauaguucgguccugaaggcc

SEQ ID NO: 749935 - RNA, 22 nt, Human
gguuuguugggguccaggccca

SEQ ID NO: 749936 - RNA, 22 nt, Human
ugucuuuaugcacacugacuug

SEQ ID NO: 749937 - RNA, 22 nt, Human
cagcuugcaguacuuguuuuug

SEQ ID NO: 749938 - RNA, 22 nt, Human
aaauccauucuguuuuaaaagu

SEQ ID NO: 749939 - RNA, 22 nt, Human
ucuucacaugaccuucaugucu

SEQ ID NO: 749940 - RNA, 22 nt, Human
ucauugaaagugccuccucgga

SEQ ID NO: 749941 - RNA, 22 nt, Human
gauucauguuauagagagucag

SEQ ID NO: 749942 - RNA, 22 nt, Human
uucuuggaaacugauuccuugu

SEQ ID NO: 749943 - RNA, 22 nt, Human
gaagaggaugacaggagccggu

SEQ ID NO: 749944 - RNA, 22 nt, Human
gccaccuggacagcugugcccu

SEQ ID NO: 749945 - RNA, 22 nt, Human
ggcacagcaagaagggaaauga

SEQ ID NO: 749946 - RNA, 22 nt, Human
agcacuuugugcauuucugaag

SEQ ID NO: 749947 - RNA, 22 nt, Human
aguguuuagaggaggaaagaug

SEQ ID NO: 749948 - RNA, 22 nt, Human
uuggcaguaaaagaaaaugcuu

SEQ ID NO: 749949 - RNA, 22 nt, Human
aacaggaggccuuccaguccag

SEQ ID NO: 749950 - RNA, 22 nt, Human
cugaggcaucauggagaacagu

SEQ ID NO: 749951 - RNA, 21 nt, Human
augcauguuccauaaaguggg

SEQ ID NO: 749952 - RNA, 22 nt, Human
gaugauuuuguuggugauucaa

SEQ ID NO: 749953 - RNA, 21 nt, Human
agcaucugaggcaguuuccua

SEQ ID NO: 749954 - RNA, 22 nt, Human
aacugcaagaguaaaugucuag

SEQ ID NO: 749955 - RNA, 22 nt, Human
cuuuccaacucuagugaaauuu

SEQ ID NO: 749956 - RNA, 22 nt, Human
gacaacaauaauguggagcuga

SEQ ID NO: 749957 - RNA, 22 nt, Human
guugacagcuggugagcugcua

SEQ ID NO: 749958 - RNA, 22 nt, Human
aaaacuguaucuucuugggacu

SEQ ID NO: 749959 - RNA, 22 nt, Human
cccugcccaucggggcggccug

SEQ ID NO: 749960 - RNA, 22 nt, Human
uaccagccucaguugugagccc

SEQ ID NO: 749961 - RNA, 22 nt, Human
ugaaugaugcaguauaaugaua

SEQ ID NO: 749962 - RNA, 22 nt, Human
gacagcuucuagaggaauuggu

SEQ ID NO: 749963 - RNA, 22 nt, Human
ucaguggaguauggaugaaguc

SEQ ID NO: 749964 - RNA, 22 nt, Human
auuuugacagaagaggcccuaa

SEQ ID NO: 749965 - RNA, 20 nt, Human
auguaugcaaaugucuucca

SEQ ID NO: 749966 - RNA, 22 nt, Human
caauucaaccuaagugcaucca

SEQ ID NO: 749967 - RNA, 22 nt, Human
uccucaggucaaagcaggagaa

SEQ ID NO: 749968 - RNA, 22 nt, Human
gcagccuuccguggaccuggac

SEQ ID NO: 749969 - RNA, 22 nt, Human
agagggaucacccuguuucugg

SEQ ID NO: 749970 - RNA, 22 nt, Human
caaauauuccagguacaucccu

SEQ ID NO: 749971 - RNA, 22 nt, Human
gcacugugaucaaggcuaagca

SEQ ID NO: 749972 - RNA, 22 nt, Human
ugauggaauauaccuucgggag

SEQ ID NO: 749973 - RNA, 23 nt, Human
agagcaaggaaaugaggugugau

SEQ ID NO: 749974 - RNA, 22 nt, Human
gccacagcggggccgcuagagc

SEQ ID NO: 749975 - RNA, 22 nt, Human
gugcucuguguauuaggauguc

SEQ ID NO: 749976 - RNA, 22 nt, Human
aaaguuacacaucuaguaagug

SEQ ID NO: 749977 - RNA, 22 nt, Human
caggccagggagaauaugaagc

SEQ ID NO: 749978 - RNA, 19 nt, Human
uccaaaggacccaccucca

SEQ ID NO: 749979 - RNA, 22 nt, Human
auuugcaaagguuaacagcagu

SEQ ID NO: 749980 - RNA, 22 nt, Human
gugugucagagcucagagaagu

SEQ ID NO: 749981 - RNA, 22 nt, Human
uucuuugaaauacuguuuugcc

SEQ ID NO: 749982 - RNA, 22 nt, Human
ucuguugacuccuagcagccau

SEQ ID NO: 749983 - RNA, 22 nt, Human
ugcuucagaggaaaggcaaaag

SEQ ID NO: 749984 - RNA, 18 nt, Human
ucugucuguacaaguauc

SEQ ID NO: 749985 - RNA, 22 nt, Human
ucaaaauuuuauuucucaagga

SEQ ID NO: 749986 - RNA, 23 nt, Human
agcuuccuagugaccuggagucu

SEQ ID NO: 749987 - RNA, 22 nt, Human
uaauuauaacaguuacaucuua

SEQ ID NO: 749988 - RNA, 22 nt, Human
aagauguuuuaauauuucgagg

SEQ ID NO: 749989 - RNA, 22 nt, Human
cuguuacauagcuuuucuuaac

SEQ ID NO: 749990 - RNA, 22 nt, Human
augagcuuccagacaaaggcau

SEQ ID NO: 749991 - RNA, 22 nt, Human
cacaagaaauaagcugccuuuc

SEQ ID NO: 749992 - RNA, 22 nt, Human
ugggccacugcuccaaguagcu

SEQ ID NO: 749993 - RNA, 22 nt, Human
ccagagcccagggucaugcagg

SEQ ID NO: 749994 - RNA, 22 nt, Human
uaaaggcaugcaggugaaugua

SEQ ID NO: 749995 - RNA, 22 nt, Human
gccucugauggaggccagcgcu

SEQ ID NO: 749996 - RNA, 22 nt, Human
ccuucauugcaucuuuaagaga

SEQ ID NO: 749997 - RNA, 22 nt, Human
aggcugagacugugcauuagug

SEQ ID NO: 749998 - RNA, 22 nt, Human
gacacuucaccuuucccagccu

SEQ ID NO: 749999 - RNA, 22 nt, Human
gcuuuaugcuacgauuucuagu

SEQ ID NO: 750000 - RNA, 22 nt, Human
cccaguggcuguccccaugggc

SEQ ID NO: 750001 - RNA, 22 nt, Human
ccaguccacgucaagaagaggu

SEQ ID NO: 750002 - RNA, 22 nt, Human
ugaaggugagcauuugcugauu

SEQ ID NO: 750003 - RNA, 22 nt, Human
cagagaccccgcugcccuucug

SEQ ID NO: 750004 - RNA, 22 nt, Human
cucugggcuuguugaccugcac

SEQ ID NO: 750005 - RNA, 22 nt, Human
acacagggaggaggugcugugc

SEQ ID NO: 750006 - RNA, 22 nt, Human
uggucccuuucuacugagcaca

SEQ ID NO: 750007 - RNA, 22 nt, Human
cuggcuggagcaggcaucuugu

SEQ ID NO: 750008 - RNA, 22 nt, Human
gcaggacaaaauuuccagggug

SEQ ID NO: 750009 - RNA, 22 nt, Human
cccucugccucugaguaggaca

SEQ ID NO: 750010 - RNA, 22 nt, Human
caggguggggaaauagcgcccu

SEQ ID NO: 750011 - RNA, 22 nt, Human
aagagggcugcaaucuuauugc

SEQ ID NO: 750012 - RNA, 21 nt, Human
ugcuggcugaaaggcacagag

SEQ ID NO: 750013 - RNA, 22 nt, Human
aaccguuuuaccauuuguaacu

SEQ ID NO: 750014 - RNA, 22 nt, Human
cuauuuuaagaggccauuaggu

SEQ ID NO: 750015 - RNA, 22 nt, Human
aguucucuggcuccuuuccaga

SEQ ID NO: 750016 - RNA, 22 nt, Human
ggagcucucuugugguacuccc

SEQ ID NO: 750017 - RNA, 22 nt, Human
augcgcuuugugugaagcagug

SEQ ID NO: 750018 - RNA, 22 nt, Human
uuccacaagugauaucuagcug

SEQ ID NO: 750019 - RNA, 22 nt, Human
acagguacauacuugggaucca

SEQ ID NO: 750020 - RNA, 22 nt, Human
aaguguuaaaagauuaaaugcu

SEQ ID NO: 750021 - RNA, 22 nt, Human
ggcacacauggugguuggugaa

SEQ ID NO: 750022 - RNA, 22 nt, Human
agcagcccagauaaagcucagg

SEQ ID NO: 750023 - RNA, 17 nt, Human
aguguguaacuugugua

SEQ ID NO: 750024 - RNA, 22 nt, Human
caugcacaacauacucaagagg

SEQ ID NO: 750025 - RNA, 22 nt, Human
gguuggggcgagcuggaggccc

SEQ ID NO: 750026 - RNA, 22 nt, Human
acacauuucucuuuuuguaagu

SEQ ID NO: 750027 - RNA, 22 nt, Human
auauuaaauggauuuugggagc

SEQ ID NO: 750028 - RNA, 22 nt, Human
aggcugucucaccucaggaggg

SEQ ID NO: 750029 - RNA, 22 nt, Human
cuccaggaaagucaggcuuaga

SEQ ID NO: 750030 - RNA, 22 nt, Human
ugggaaauauucuaaaagucuu

SEQ ID NO: 750031 - RNA, 22 nt, Human
ccucacagcccuccucuagcac

SEQ ID NO: 750032 - RNA, 22 nt, Human
uuuauuauucuguucucucuac

SEQ ID NO: 750033 - RNA, 22 nt, Human
ggccacucggccaccccugccg

SEQ ID NO: 750034 - RNA, 22 nt, Human
cugcuuuguaaaauagacauaa

SEQ ID NO: 750035 - RNA, 22 nt, Human
agacacuguucucacaugcuug

SEQ ID NO: 750036 - RNA, 22 nt, Human
caggucucugcagccccucugu

SEQ ID NO: 750037 - RNA, 22 nt, Human
cccugaggcacaggccacguau

SEQ ID NO: 750038 - RNA, 22 nt, Human
auaacagaguugggaagugaaa

SEQ ID NO: 750039 - RNA, 22 nt, Human
cuacugucuuccuugguaacaa

SEQ ID NO: 750040 - RNA, 18 nt, Human
ugagagugugugcucuug

SEQ ID NO: 750041 - RNA, 22 nt, Human
ucucuggggaugcuuauucuug

SEQ ID NO: 750042 - RNA, 22 nt, Human
ugagcucuguuagggcuggaac

SEQ ID NO: 750043 - RNA, 22 nt, Human
aaugaagauuauggugauuaag

SEQ ID NO: 750044 - RNA, 22 nt, Human
cauaauuaggcaguugaucauu

SEQ ID NO: 750045 - RNA, 22 nt, Human
uuucaauugacuuuggaagaaa

SEQ ID NO: 750046 - RNA, 22 nt, Human
gggaaggacacagccaugacug

SEQ ID NO: 750047 - RNA, 21 nt, Human
cacacagcugcccuuagguag

SEQ ID NO: 750048 - RNA, 22 nt, Human
auacagguguacacacaugcaa

SEQ ID NO: 750049 - RNA, 22 nt, Human
ucugaauuuuaacuacacaaag

SEQ ID NO: 750050 - RNA, 22 nt, Human
uguagaagcuagccuggagcca

SEQ ID NO: 750051 - RNA, 22 nt, Human
aauaucuucuaaggauagaacu

SEQ ID NO: 750052 - RNA, 22 nt, Human
aagucaucacuccucugaacuu

SEQ ID NO: 750053 - RNA, 22 nt, Human
aggcugcuuucauggccgcccc

SEQ ID NO: 750054 - RNA, 22 nt, Human
ccccugagauucuggcuuggga

SEQ ID NO: 750055 - RNA, 23 nt, Human
ugauuuuaaaaaguaaguuauca

SEQ ID NO: 750056 - RNA, 22 nt, Human
cuucugggccauggccuuccuc

SEQ ID NO: 750057 - RNA, 17 nt, Human
uucucugagcuguauug

SEQ ID NO: 750058 - RNA, 22 nt, Human
gaucuguuucauucacagucug

SEQ ID NO: 750059 - RNA, 20 nt, Human
caguuuaucuuuccggagcu

SEQ ID NO: 750060 - RNA, 22 nt, Human
ggucuucaggucuaguugguau

SEQ ID NO: 750061 - RNA, 22 nt, Human
cgcaggaagacaaggguggaaa

SEQ ID NO: 750062 - RNA, 19 nt, Human
cagcccucuuaccacugug

SEQ ID NO: 750063 - RNA, 22 nt, Human
gauuaagauuacauauuuaagu

SEQ ID NO: 750064 - RNA, 22 nt, Human
aagaacaugaguuaugaugauu

SEQ ID NO: 750065 - RNA, 21 nt, Human
ugucagcacgcaugaggccag

SEQ ID NO: 750066 - RNA, 22 nt, Human
gaagcagccacggggagacaga

SEQ ID NO: 750067 - RNA, 22 nt, Human
ccucaggcugggcugccccugg

SEQ ID NO: 750068 - RNA, 22 nt, Human
ugaacuuucacaagaauaugcu

SEQ ID NO: 750069 - RNA, 22 nt, Human
ucuuguauuugauuccuuccaa

SEQ ID NO: 750070 - RNA, 22 nt, Human
cagucccacuagugccaauacc

SEQ ID NO: 750071 - RNA, 22 nt, Human
acagagcacugcccugugccgc

SEQ ID NO: 750072 - RNA, 22 nt, Human
aaaugcaaggauuuuguuaggc

SEQ ID NO: 750073 - RNA, 22 nt, Human
acugggagaaacugacaccuua

SEQ ID NO: 750074 - RNA, 22 nt, Human
acauaugcucaucugcauuccc

SEQ ID NO: 750075 - RNA, 22 nt, Human
uaacuuuugugaucugucgauu

SEQ ID NO: 750076 - RNA, 22 nt, Human
acuccaggguuuugcaccugga

SEQ ID NO: 750077 - RNA, 22 nt, Human
ugacauaaugcuuugaaguugc

SEQ ID NO: 750078 - RNA, 22 nt, Human
ugugaaaagcaggcuacuuucu

SEQ ID NO: 750079 - RNA, 22 nt, Human
caggaaaugaggcugaagggug

SEQ ID NO: 750080 - RNA, 22 nt, Human
ugggcugcacuccauuuucugc

SEQ ID NO: 750081 - RNA, 22 nt, Human
uuccagaaaucuuucagcucaa

SEQ ID NO: 750082 - RNA, 22 nt, Human
aaacagcugggagguagaggcg

SEQ ID NO: 750083 - RNA, 22 nt, Human
uuacauguauuuuggaaaaagu

SEQ ID NO: 750084 - RNA, 22 nt, Human
uuacuuuagaucauacugugug

SEQ ID NO: 750085 - RNA, 22 nt, Human
ugggcugcccugaugguccuca

SEQ ID NO: 750086 - RNA, 22 nt, Human
uccucagauauaaaugagggug

SEQ ID NO: 750087 - RNA, 22 nt, Human
uggccagguugggcuuugcagc

SEQ ID NO: 750088 - RNA, 22 nt, Human
aauuuuacaagaaggccucgua

SEQ ID NO: 750089 - RNA, 22 nt, Human
ucuguuuuggucaccuuuauau

SEQ ID NO: 750090 - RNA, 22 nt, Human
gugacucucacuuuaccugacu

SEQ ID NO: 750091 - RNA, 22 nt, Human
gccugccuucggugcgcagcgg

SEQ ID NO: 750092 - RNA, 22 nt, Human
agcacagguacggagaugcuac

SEQ ID NO: 750093 - RNA, 22 nt, Human
ugagcaggugagucuagggcag

SEQ ID NO: 750094 - RNA, 22 nt, Human
cugggccucacacccaccaaau

SEQ ID NO: 750095 - RNA, 22 nt, Human
uucaggaauauaggcauugaca

SEQ ID NO: 750096 - RNA, 22 nt, Human
uguauguguauguacauaugca

SEQ ID NO: 750097 - RNA, 17 nt, Human
gcugagugcagggaguc

SEQ ID NO: 750098 - RNA, 22 nt, Human
accgggaaguccugcacugggc

SEQ ID NO: 750099 - RNA, 22 nt, Human
auugaagauucugacaucagaa

SEQ ID NO: 750100 - RNA, 22 nt, Human
ggcucagagaccugcgaucuga

SEQ ID NO: 750101 - RNA, 22 nt, Human
acagauacucagcucuaugcuu

SEQ ID NO: 750102 - RNA, 22 nt, Human
cugagcagcguggggagcuggc

SEQ ID NO: 750103 - RNA, 22 nt, Human
ccaggaaggcguuguuccucuc

SEQ ID NO: 750104 - RNA, 22 nt, Human
gauucccaugucugaggaggug

SEQ ID NO: 750105 - RNA, 22 nt, Human
ccugaaaugaguucugcucacu

SEQ ID NO: 750106 - RNA, 22 nt, Human
uacagaggguaauugaucaagg

SEQ ID NO: 750107 - RNA, 22 nt, Human
uggcacccugaaguuggucacu

SEQ ID NO: 750108 - RNA, 22 nt, Human
cuucccccaaaucaagagaccu

SEQ ID NO: 750109 - RNA, 22 nt, Human
acuggcagagguuggacaccau

SEQ ID NO: 750110 - RNA, 22 nt, Human
uguuugguuccagagggccucu

SEQ ID NO: 750111 - RNA, 22 nt, Human
uuagauaaaaguguucaauaaa

SEQ ID NO: 750112 - RNA, 22 nt, Human
uguucugcaaugcugccuccuu

SEQ ID NO: 750113 - RNA, 22 nt, Human
ggcugccucuggaagcuggaga

SEQ ID NO: 750114 - RNA, 22 nt, Human
uuucugaauaacucuaugauau

SEQ ID NO: 750115 - RNA, 22 nt, Human
gcccaagaucaguggggcagau

SEQ ID NO: 750116 - RNA, 22 nt, Human
guggcccugucccaggccuccu

SEQ ID NO: 750117 - RNA, 22 nt, Human
uugcauugcuuggucuucaaga

SEQ ID NO: 750118 - RNA, 22 nt, Human
uucugggccaaucucuuaaucu

SEQ ID NO: 750119 - RNA, 22 nt, Human
uuauauaacucaggugggcuca

SEQ ID NO: 750120 - RNA, 22 nt, Human
uccagaaaaaguaauuuauuug

SEQ ID NO: 750121 - RNA, 22 nt, Human
uggaagggaaaguuuggggucc

SEQ ID NO: 750122 - RNA, 22 nt, Human
accguggauuuguagucauuuc

SEQ ID NO: 750123 - RNA, 22 nt, Human
uugaagauggaucgccacucuc

SEQ ID NO: 750124 - RNA, 17 nt, Human
ugcacaagagacaauag

SEQ ID NO: 750125 - RNA, 22 nt, Human
caccagcuacagacuacugugu

SEQ ID NO: 750126 - RNA, 17 nt, Human
gggcgcggguagagccc

SEQ ID NO: 750127 - RNA, 22 nt, Human
aaauguaguauguugcauguau

SEQ ID NO: 750128 - RNA, 22 nt, Human
aagugcuuuaaaauuuccugag

SEQ ID NO: 750129 - RNA, 22 nt, Human
gggucugagggccuuaccacuc

SEQ ID NO: 750130 - RNA, 22 nt, Human
uuagauaauguagagauaugag

SEQ ID NO: 750131 - RNA, 22 nt, Human
ugggaagggccugcccuuccuc

SEQ ID NO: 750132 - RNA, 22 nt, Human
cuuauuaauggaauccuaauga

SEQ ID NO: 750133 - RNA, 22 nt, Human
cagcagcuccucugcggcuaug

SEQ ID NO: 750134 - RNA, 22 nt, Human
ucucaggaucuaauacauggua

SEQ ID NO: 750135 - RNA, 20 nt, Human
accuaguacaaucuguuucu

SEQ ID NO: 750136 - RNA, 22 nt, Human
aggaagagcauucacaugguag

SEQ ID NO: 750137 - RNA, 22 nt, Human
agcccgagcgcaccuguggaaa

SEQ ID NO: 750138 - RNA, 22 nt, Human
acuuuguucuaauaguaucucu

SEQ ID NO: 750139 - RNA, 22 nt, Human
ugcuucugcaggagcuccugau

SEQ ID NO: 750140 - RNA, 22 nt, Human
auucuucaccauggauaauuug

SEQ ID NO: 750141 - RNA, 18 nt, Human
cuccagguaauucugaua

SEQ ID NO: 750142 - RNA, 20 nt, Human
uccuggaggcuucauccaua

SEQ ID NO: 750143 - RNA, 22 nt, Human
uuccagagucugguuccauggu

SEQ ID NO: 750144 - RNA, 22 nt, Human
cagaauaugacaagauuuuccu

SEQ ID NO: 750145 - RNA, 22 nt, Human
ucuuuuaaaagcccugcugucu

SEQ ID NO: 750146 - RNA, 22 nt, Human
gagugucucacaguagcauuuu

SEQ ID NO: 750147 - RNA, 22 nt, Human
acagagguaggacaugagauau

SEQ ID NO: 750148 - RNA, 22 nt, Human
uacagcauauacagaaugaaca

SEQ ID NO: 750149 - RNA, 22 nt, Human
uagaacuaaagaacaacuuuga

SEQ ID NO: 750150 - RNA, 22 nt, Human
aaugugauuagccucuacugga

SEQ ID NO: 750151 - RNA, 22 nt, Human
cauggugaggggugaagggcag

SEQ ID NO: 750152 - RNA, 22 nt, Human
gcuuuagaaauaucacugugga

SEQ ID NO: 750153 - RNA, 18 nt, Human
aaguaacagaagagcaca

SEQ ID NO: 750154 - RNA, 22 nt, Human
uuaagaagguacucaaagaucu

SEQ ID NO: 750155 - RNA, 22 nt, Human
ucugagcugggcacagaaggcg

SEQ ID NO: 750156 - RNA, 22 nt, Human
gccagagacacuuggagguaga

SEQ ID NO: 750157 - RNA, 22 nt, Human
ucaaaguuuguggcaauuuauu

SEQ ID NO: 750158 - RNA, 22 nt, Human
ugaaauggcaaggcagagcuuu

SEQ ID NO: 750159 - RNA, 22 nt, Human
ggugaggggcaccucugcccgg

SEQ ID NO: 750160 - RNA, 22 nt, Human
aggcuucaauuccuuacccagu

SEQ ID NO: 750161 - RNA, 22 nt, Human
gcuuaaaguuguaaauuagaga

SEQ ID NO: 750162 - RNA, 22 nt, Human
ugucaucugcggguggcacugc

SEQ ID NO: 750163 - RNA, 22 nt, Human
acacuucucuuugaagaacaau

SEQ ID NO: 750164 - RNA, 20 nt, Human
uggcugugggcaucuguuuc

SEQ ID NO: 750165 - RNA, 22 nt, Human
uggcucugcagcagugugcgug

SEQ ID NO: 750166 - RNA, 22 nt, Human
aagaacauuuuguagaaugaca

SEQ ID NO: 750167 - RNA, 22 nt, Human
aagucaaucacaugcacacuga

SEQ ID NO: 750168 - RNA, 22 nt, Human
uggcagaauuucuagcagauuc

SEQ ID NO: 750169 - RNA, 22 nt, Human
ccacagagacucugcaggacug

SEQ ID NO: 750170 - RNA, 22 nt, Human
auuuagaaguuggagggcaaga

SEQ ID NO: 750171 - RNA, 20 nt, Human
accucugcaucaauccuuug

SEQ ID NO: 750172 - RNA, 20 nt, Human
ggcaggacccgguagggagc

SEQ ID NO: 750173 - RNA, 22 nt, Human
agugugggccacgcagcugagc

SEQ ID NO: 750174 - RNA, 22 nt, Human
ugccccucuugcuggcccuguc

SEQ ID NO: 750175 - RNA, 22 nt, Human
aaaggucagacuuaggcugggc

SEQ ID NO: 750176 - RNA, 20 nt, Human
gccauccagccucccaggag

SEQ ID NO: 750177 - RNA, 22 nt, Human
cugucauuucuauuauagagga

SEQ ID NO: 750178 - RNA, 22 nt, Human
uugcuuggcaggcuuccagucu

SEQ ID NO: 750179 - RNA, 22 nt, Human
ccagagacuggcugagagaucu

SEQ ID NO: 750180 - RNA, 22 nt, Human
cuccaguggcaaguccgggcgg

SEQ ID NO: 750181 - RNA, 22 nt, Human
gggcucagcugggcgugcuggu

SEQ ID NO: 750182 - RNA, 22 nt, Human
ccagagguuccaggcuagggag

SEQ ID NO: 750183 - RNA, 22 nt, Human
agcccuuaguacauuucucaag

SEQ ID NO: 750184 - RNA, 22 nt, Human
uucucagaugauucagauaaac

SEQ ID NO: 750185 - RNA, 22 nt, Human
aaaagugaugggauggcacuuc

SEQ ID NO: 750186 - RNA, 22 nt, Human
uguguguguaaaagcauuuaua

SEQ ID NO: 750187 - RNA, 22 nt, Human
uggggagcacgguagggaaaug

SEQ ID NO: 750188 - RNA, 22 nt, Human
acagcucugagauauuacuauu

SEQ ID NO: 750189 - RNA, 22 nt, Human
agcccaaggcuucccugcuggc

SEQ ID NO: 750190 - RNA, 22 nt, Human
cagcagcaucaggucugugguu

SEQ ID NO: 750191 - RNA, 22 nt, Human
caggaguccagagugucauuuu

SEQ ID NO: 750192 - RNA, 23 nt, Human
ucucuguacagaugaggacacac

SEQ ID NO: 750193 - RNA, 22 nt, Human
gagcuggcugugguugagugca

SEQ ID NO: 750194 - RNA, 22 nt, Human
gugcaaagugcauggggaaggg

SEQ ID NO: 750195 - RNA, 22 nt, Human
aggucccugcagcagacugcca

SEQ ID NO: 750196 - RNA, 22 nt, Human
uauuuccaaaaaggccauauuc

SEQ ID NO: 750197 - RNA, 22 nt, Human
gccugggaacucugaucuccug

SEQ ID NO: 750198 - RNA, 20 nt, Human
uggcuccagccuccccuacc

SEQ ID NO: 750199 - RNA, 22 nt, Human
aggucucaaacuggcacccugu

SEQ ID NO: 750200 - RNA, 22 nt, Human
auaucacagaugcagaaagaga

SEQ ID NO: 750201 - RNA, 22 nt, Human
aguguuugucccguuagaaaug

SEQ ID NO: 750202 - RNA, 22 nt, Human
aagcaggagaugcaggaaugua

SEQ ID NO: 750203 - RNA, 19 nt, Human
uucagcauuauauucuagc

SEQ ID NO: 750204 - RNA, 22 nt, Human
caguucacacugugcuaucugc

SEQ ID NO: 750205 - RNA, 22 nt, Human
ggaguggcagcuaggcugucag

SEQ ID NO: 750206 - RNA, 22 nt, Human
aggacaauuagucuggcuuggc

SEQ ID NO: 750207 - RNA, 22 nt, Human
ucucuuccuagugaugggcuuu

SEQ ID NO: 750208 - RNA, 22 nt, Human
caacagaaggaagcagggucag

SEQ ID NO: 750209 - RNA, 22 nt, Human
gaaggagacccugaagaugcug

SEQ ID NO: 750210 - RNA, 22 nt, Human
ugggcccagguccugggagaag

SEQ ID NO: 750211 - RNA, 22 nt, Human
cugacuguugcuguugaugagg

SEQ ID NO: 750212 - RNA, 23 nt, Human
cagaucauauauccagcuguaag

SEQ ID NO: 750213 - RNA, 20 nt, Human
ccacaggaguccagucgacc

SEQ ID NO: 750214 - RNA, 22 nt, Human
ucugcaacauuccucuccccac

SEQ ID NO: 750215 - RNA, 22 nt, Human
gucugagcuacuuaggauauaa

SEQ ID NO: 750216 - RNA, 22 nt, Human
ugggaagaggaugaggcauaug

SEQ ID NO: 750217 - RNA, 22 nt, Human
accuuugguaaguuuccaaaac

SEQ ID NO: 750218 - RNA, 22 nt, Human
uccuugaggaggugacacugga

SEQ ID NO: 750219 - RNA, 22 nt, Human
gccagggagucugggccacaga

SEQ ID NO: 750220 - RNA, 22 nt, Human
caugcacacacaguucuaauua

SEQ ID NO: 750221 - RNA, 22 nt, Human
cuuucacagucauaugaugaau

SEQ ID NO: 750222 - RNA, 22 nt, Human
aacaugauuggaaaaugcuguc

SEQ ID NO: 750223 - RNA, 22 nt, Human
uggcucagccuggcccuuucau

SEQ ID NO: 750224 - RNA, 22 nt, Human
cuccucaguugucccauggaga

SEQ ID NO: 750225 - RNA, 22 nt, Human
aucagaaacucuuagagcaggg

SEQ ID NO: 750226 - RNA, 22 nt, Human
accugaauugucauaucuuauu

SEQ ID NO: 750227 - RNA, 22 nt, Human
aagagcuuggacuuucaaguca

SEQ ID NO: 750228 - RNA, 22 nt, Human
cagcagguccugggcguggccu

SEQ ID NO: 750229 - RNA, 22 nt, Human
ucuacaugauguaccaucuaag

SEQ ID NO: 750230 - RNA, 22 nt, Human
cuucaaggcuuauuccaguugu

SEQ ID NO: 750231 - RNA, 21 nt, Human
gcagcaugagaaagccccaaa

SEQ ID NO: 750232 - RNA, 22 nt, Human
acaguuaccacuuagcaguuac

SEQ ID NO: 750233 - RNA, 22 nt, Human
aaucacaguuaguaagggagaa

SEQ ID NO: 750234 - RNA, 22 nt, Human
acugagagaacgggcugcuccc

SEQ ID NO: 750235 - RNA, 22 nt, Human
auuuccuucccagauuugguuc

SEQ ID NO: 750236 - RNA, 22 nt, Human
ugcccaggcuggagugcagagg

SEQ ID NO: 750237 - RNA, 18 nt, Human
uucucugguggauguuau

SEQ ID NO: 750238 - RNA, 21 nt, Human
guacacagugguucugaggga

SEQ ID NO: 750239 - RNA, 22 nt, Human
cagggccugcaagagaccuggg

SEQ ID NO: 750240 - RNA, 22 nt, Human
cugcguguuugcacccugucug

SEQ ID NO: 750241 - RNA, 22 nt, Human
ucagagaagguaagugaccugc

SEQ ID NO: 750242 - RNA, 22 nt, Human
guguucuuuugcuucacagaaa

SEQ ID NO: 750243 - RNA, 22 nt, Human
gcaggauggguguagcccagca

SEQ ID NO: 750244 - RNA, 22 nt, Human
agugugggggcuuuggugucac

SEQ ID NO: 750245 - RNA, 22 nt, Human
gaaugaguagaguauaaacaaa

SEQ ID NO: 750246 - RNA, 18 nt, Human
ucugccugcagggcaucu

SEQ ID NO: 750247 - RNA, 22 nt, Human
aacuguuuggaacucuuccaca

SEQ ID NO: 750248 - RNA, 22 nt, Human
gggaaggccgguccagucaggu

SEQ ID NO: 750249 - RNA, 22 nt, Human
gcagcugucgcuaggagcugug

SEQ ID NO: 750250 - RNA, 22 nt, Human
augaugugugcugaucaagcuu

SEQ ID NO: 750251 - RNA, 22 nt, Human
uagcagagcagggaucagagcc

SEQ ID NO: 750252 - RNA, 22 nt, Human
ggccagaggccacagcuguguc

SEQ ID NO: 750253 - RNA, 22 nt, Human
auggcugcagagaccugaagaa

SEQ ID NO: 750254 - RNA, 22 nt, Human
ccuggacuuucauuuccccuug

SEQ ID NO: 750255 - RNA, 22 nt, Human
aggccagugcagcuggaacaga

SEQ ID NO: 750256 - RNA, 20 nt, Human
uugaggucaaggacuaggcc

SEQ ID NO: 750257 - RNA, 22 nt, Human
uggcucucaauggcuguacuau

SEQ ID NO: 750258 - RNA, 22 nt, Human
uaagguuugaagaagacugagc

SEQ ID NO: 750259 - RNA, 21 nt, Human
auguuuacacugacuacugug

SEQ ID NO: 750260 - RNA, 22 nt, Human
aaaugcuugcucuugauuauuu

SEQ ID NO: 750261 - RNA, 22 nt, Human
guuaaagugagcuacuuuaggu

SEQ ID NO: 750262 - RNA, 19 nt, Human
uugguggugguuuugguuc

SEQ ID NO: 750263 - RNA, 22 nt, Human
uacaaagugaaauaauucugag

SEQ ID NO: 750264 - RNA, 22 nt, Human
cuuaggaacgcucugccuagug

SEQ ID NO: 750265 - RNA, 22 nt, Human
cugugugcaacuugcaguuuug

SEQ ID NO: 750266 - RNA, 22 nt, Human
agcccugcucaucuggaucccg

SEQ ID NO: 750267 - RNA, 22 nt, Human
uuauagcagcaugauuuacaau

SEQ ID NO: 750268 - RNA, 19 nt, Human
cugccuguuauggagagaa

SEQ ID NO: 750269 - RNA, 22 nt, Human
aauuaaaaaaggagagcuugcu

SEQ ID NO: 750270 - RNA, 22 nt, Human
cuaauuauguuguuauaaucaa

SEQ ID NO: 750271 - RNA, 22 nt, Human
gacauagucucugucuucaugg

SEQ ID NO: 750272 - RNA, 22 nt, Human
agggucagcuggcugucagggg

SEQ ID NO: 750273 - RNA, 22 nt, Human
auggcuguaaauucagagaugg

SEQ ID NO: 750274 - RNA, 22 nt, Human
aaccuggcccuaaucccaguag

SEQ ID NO: 750275 - RNA, 22 nt, Human
cagcugggugaucuugggcagg

SEQ ID NO: 750276 - RNA, 22 nt, Human
caugucuuucucaucacaucua

SEQ ID NO: 750277 - RNA, 22 nt, Human
gagcugguucuguccagggaau

SEQ ID NO: 750278 - RNA, 22 nt, Human
ccaccccuguagagggacagac

SEQ ID NO: 750279 - RNA, 22 nt, Human
ucacuuuacagcuaagguuguu

SEQ ID NO: 750280 - RNA, 22 nt, Human
cacaggcacgccucuggccagg

SEQ ID NO: 750281 - RNA, 18 nt, Human
cugugggaagaguuuggg

SEQ ID NO: 750282 - RNA, 19 nt, Human
gcccuccucacugagcucu

SEQ ID NO: 750283 - RNA, 22 nt, Human
auugucuuguacguuugccugu

SEQ ID NO: 750284 - RNA, 22 nt, Human
uuguuacuguucuacauacagu

SEQ ID NO: 750285 - RNA, 22 nt, Human
ucaggagcuauggacugucaaa

SEQ ID NO: 750286 - RNA, 17 nt, Human
uuuagaauacaauguuu

SEQ ID NO: 750287 - RNA, 22 nt, Human
ggggacgggacuuagcaugagu

SEQ ID NO: 750288 - RNA, 22 nt, Human
aggcaacaggaaaccacaugau

SEQ ID NO: 750289 - RNA, 22 nt, Human
ggcugcuuuaucggcugcugaa

SEQ ID NO: 750290 - RNA, 22 nt, Human
ggccagaaaguuaagcuguggc

SEQ ID NO: 750291 - RNA, 17 nt, Human
uguuuucauucauugcu

SEQ ID NO: 750292 - RNA, 22 nt, Human
gagcccuguucaggccuccuca

SEQ ID NO: 750293 - RNA, 22 nt, Human
uuguuucaugaguguaaaggga

SEQ ID NO: 750294 - RNA, 22 nt, Human
uuuauugggugcagugcccaca

SEQ ID NO: 750295 - RNA, 22 nt, Human
auacaacuuuacaugcaauucc

SEQ ID NO: 750296 - RNA, 22 nt, Human
uuugacaaauauuuauuggcac

SEQ ID NO: 750297 - RNA, 22 nt, Human
aaugcuuauaccuaaugaucuu

SEQ ID NO: 750298 - RNA, 22 nt, Human
ugggagagugcucaaugugcaa

SEQ ID NO: 750299 - RNA, 22 nt, Human
acuugaauaggugucaaggcca

SEQ ID NO: 750300 - RNA, 22 nt, Human
ccacacugaccagcugugagac

SEQ ID NO: 750301 - RNA, 22 nt, Human
guccacagggauggccacacau

SEQ ID NO: 750302 - RNA, 22 nt, Human
aggacaguauaggcuuuaggag

SEQ ID NO: 750303 - RNA, 20 nt, Human
ccacccacgcgggcucugcc

SEQ ID NO: 750304 - RNA, 22 nt, Human
uuugauucuguaaaauaacagg

SEQ ID NO: 750305 - RNA, 20 nt, Human
gcugagguuucuuccuauau

SEQ ID NO: 750306 - RNA, 22 nt, Human
uacaugcaauuaagagggugaa

SEQ ID NO: 750307 - RNA, 22 nt, Human
ugguccuggagaucaauaugca

SEQ ID NO: 750308 - RNA, 22 nt, Human
ucugaccugcaggcacagcaau

SEQ ID NO: 750309 - RNA, 22 nt, Human
uuggcaauucaccaaggcucgc

SEQ ID NO: 750310 - RNA, 22 nt, Human
cugucuuuaguacaaaaaaugu

SEQ ID NO: 750311 - RNA, 22 nt, Human
uuguuuaucgcuugcucacaua

SEQ ID NO: 750312 - RNA, 22 nt, Human
ucauccauccucgccuuugcuu

SEQ ID NO: 750313 - RNA, 22 nt, Human
cucaggccaauaagcuccagcc

SEQ ID NO: 750314 - RNA, 22 nt, Human
auguuuauggagcagguauuag

SEQ ID NO: 750315 - RNA, 22 nt, Human
uccucauacauaucucagucuu

SEQ ID NO: 750316 - RNA, 20 nt, Human
acacuugacaccagaaaugg

SEQ ID NO: 750317 - RNA, 22 nt, Human
uuguguaacuugagcaaacaca

SEQ ID NO: 750318 - RNA, 22 nt, Human
uaggccacucuccuuugucuca

SEQ ID NO: 750319 - RNA, 22 nt, Human
caucccugauuccuaguacagu

SEQ ID NO: 750320 - RNA, 20 nt, Human
ucucuauucccacgaggaaa

SEQ ID NO: 750321 - RNA, 22 nt, Human
aacacuucccaucagagggaca

SEQ ID NO: 750322 - RNA, 20 nt, Human
ggaaggggcaaaguguguga

SEQ ID NO: 750323 - RNA, 16 nt, Human
uggaggcaucuggccc

SEQ ID NO: 750324 - RNA, 23 nt, Human
aauaucaaggugauguucccaga

SEQ ID NO: 750325 - RNA, 22 nt, Human
gagagggcaagguagaugcuac

SEQ ID NO: 750326 - RNA, 17 nt, Human
gcccugccugcugcccu

SEQ ID NO: 750327 - RNA, 22 nt, Human
caugcaguauucaggacaguuc

SEQ ID NO: 750328 - RNA, 22 nt, Human
ugcugaggaauaauuguuccug

SEQ ID NO: 750329 - RNA, 22 nt, Human
cccaguaagaagcuggcaccag

SEQ ID NO: 750330 - RNA, 19 nt, Human
uacaugcucuugguucagg

SEQ ID NO: 750331 - RNA, 22 nt, Human
ggagccugacagugcccagcau

SEQ ID NO: 750332 - RNA, 22 nt, Human
cugcagggguguccuguauugg

SEQ ID NO: 750333 - RNA, 22 nt, Human
acacauauaugugcguguauau

SEQ ID NO: 750334 - RNA, 22 nt, Human
ucuugacaacuauacuacuuac

SEQ ID NO: 750335 - RNA, 22 nt, Human
uguccuuuuggcugucuauggu

SEQ ID NO: 750336 - RNA, 22 nt, Human
cugcagaaauauggaugugaua

SEQ ID NO: 750337 - RNA, 22 nt, Human
uuuagaguugguccccugugag

SEQ ID NO: 750338 - RNA, 22 nt, Human
ugcagcucauugcuggggucug

SEQ ID NO: 750339 - RNA, 22 nt, Human
acuccaaggccacaugcauucc

SEQ ID NO: 750340 - RNA, 22 nt, Human
ccucucuccaauuuucaccuca

SEQ ID NO: 750341 - RNA, 22 nt, Human
agguauuuaugagagcacauau

SEQ ID NO: 750342 - RNA, 22 nt, Human
aaggaaaugugccugacacugc

SEQ ID NO: 750343 - RNA, 22 nt, Human
gcaggaguaucuauacauuaaa

SEQ ID NO: 750344 - RNA, 22 nt, Human
uaguagcaggaaucugaaggua

SEQ ID NO: 750345 - RNA, 22 nt, Human
agccaaagaucagugugcaagu

SEQ ID NO: 750346 - RNA, 22 nt, Human
aagauguuaaaucuguagaauu

SEQ ID NO: 750347 - RNA, 22 nt, Human
cuuuaauuaggaaguauaauga

SEQ ID NO: 750348 - RNA, 21 nt, Human
aaucagaggcuuccuaguugg

SEQ ID NO: 750349 - RNA, 22 nt, Human
ccaggagaauaauggcagauua

SEQ ID NO: 750350 - RNA, 22 nt, Human
ucaggagguguaacgaauacag

SEQ ID NO: 750351 - RNA, 23 nt, Human
cccaggucaaaauucacaggccu

SEQ ID NO: 750352 - RNA, 22 nt, Human
ucuuuuguugccuacuuauuaa

SEQ ID NO: 750353 - RNA, 22 nt, Human
aaguaugucuuuggguauuauu

SEQ ID NO: 750354 - RNA, 22 nt, Human
uuuagucauagauacccaaggu

SEQ ID NO: 750355 - RNA, 22 nt, Human
uuucuuuugcugagaggggcac

SEQ ID NO: 750356 - RNA, 22 nt, Human
uccugggacaagccguggaagu

SEQ ID NO: 750357 - RNA, 22 nt, Human
ugugugaaggaauauauacuca

SEQ ID NO: 750358 - RNA, 22 nt, Human
acagauuuuaaauuuguaguug

SEQ ID NO: 750359 - RNA, 22 nt, Human
aauguacaccguggguuuuuua

SEQ ID NO: 750360 - RNA, 22 nt, Human
caagcccaggauuccccaguua

SEQ ID NO: 750361 - RNA, 22 nt, Human
cauggccucucuccuggaaugg

SEQ ID NO: 750362 - RNA, 22 nt, Human
ggcacugagaggcucuuccuaa

SEQ ID NO: 750363 - RNA, 22 nt, Human
ugucuuuaaaauuaaacacauc

SEQ ID NO: 750364 - RNA, 22 nt, Human
ucagcauuccugaagacaagca

SEQ ID NO: 750365 - RNA, 22 nt, Human
uagggcuuugcgauggcuauuc

SEQ ID NO: 750366 - RNA, 22 nt, Human
guagaacuaggacuucagguau

SEQ ID NO: 750367 - RNA, 22 nt, Human
gcugggaggcagcaccuuuagc

SEQ ID NO: 750368 - RNA, 22 nt, Human
uaauuucuucaucucugcagcu

SEQ ID NO: 750369 - RNA, 22 nt, Human
aaugucuugagaagagaaaucu

SEQ ID NO: 750370 - RNA, 23 nt, Human
gcucuuuguucauguggaugccu

SEQ ID NO: 750371 - RNA, 22 nt, Human
ugcauuuaagaaaacaugaguc

SEQ ID NO: 750372 - RNA, 19 nt, Human
acacauguguguuaugugc

SEQ ID NO: 750373 - RNA, 21 nt, Human
ucugcacagccccgcaggagg

SEQ ID NO: 750374 - RNA, 22 nt, Human
gcuuuuaauuaguugcuuccau

SEQ ID NO: 750375 - RNA, 22 nt, Human
uuuuccugccugucucuagagg

SEQ ID NO: 750376 - RNA, 22 nt, Human
aaauaguucagcuuguaaaccc

SEQ ID NO: 750377 - RNA, 22 nt, Human
uuaaaggaucuuugucauuaau

SEQ ID NO: 750378 - RNA, 22 nt, Human
ccugggcucaccaugccuugga

SEQ ID NO: 750379 - RNA, 22 nt, Human
cccagguggguuggccucuguc

SEQ ID NO: 750380 - RNA, 22 nt, Human
cugagccaugggucuaagcacu

SEQ ID NO: 750381 - RNA, 22 nt, Human
cccagaguuggucaggggaccc

SEQ ID NO: 750382 - RNA, 22 nt, Human
ugacaggauugguugcuucuga

SEQ ID NO: 750383 - RNA, 22 nt, Human
cuguuuaucucuaaccuguuua

SEQ ID NO: 750384 - RNA, 22 nt, Human
gaagagcauuugcccaggcugu

SEQ ID NO: 750385 - RNA, 22 nt, Human
ucagcagggcauacugagccua

SEQ ID NO: 750386 - RNA, 22 nt, Human
ugggccugggcuccuguccucu

SEQ ID NO: 750387 - RNA, 22 nt, Human
acagugcaaauaggacugucuu

SEQ ID NO: 750388 - RNA, 22 nt, Human
ucugauaaugugcuucgugacc

SEQ ID NO: 750389 - RNA, 21 nt, Human
ugcagcugacacccuuuggga

SEQ ID NO: 750390 - RNA, 22 nt, Human
uucuguauuuaguuugaggaca

SEQ ID NO: 750391 - RNA, 22 nt, Human
ugaucuucaccuuguucuuugg

SEQ ID NO: 750392 - RNA, 22 nt, Human
acacuuguggccuuucuaguaa

SEQ ID NO: 750393 - RNA, 22 nt, Human
aggucugguauuuuucuauacu

SEQ ID NO: 750394 - RNA, 22 nt, Human
aagucagaaaacagagcaauua

SEQ ID NO: 750395 - RNA, 22 nt, Human
aagaaaccuagucuggagcagc

SEQ ID NO: 750396 - RNA, 22 nt, Human
uaugaaaagguggccaauguag

SEQ ID NO: 750397 - RNA, 22 nt, Human
aggaccuuggaauaacaaauuc

SEQ ID NO: 750398 - RNA, 22 nt, Human
cuggaucaugcauugcuugucc

SEQ ID NO: 750399 - RNA, 22 nt, Human
ugaguggagacuguguguagag

SEQ ID NO: 750400 - RNA, 22 nt, Human
cagagccucuaaaauuucuauc

SEQ ID NO: 750401 - RNA, 22 nt, Human
augggcaacagcagucacaaug

SEQ ID NO: 750402 - RNA, 22 nt, Human
gaagggagaagguugggugacg

SEQ ID NO: 750403 - RNA, 21 nt, Human
agcugugguuuuacaucuuuu

SEQ ID NO: 750404 - RNA, 22 nt, Human
ucagaguuggccuuucuguauu

SEQ ID NO: 750405 - RNA, 22 nt, Human
cagaaagcucuuucaaucuugc

SEQ ID NO: 750406 - RNA, 22 nt, Human
ucagaaaccccaacaauggaga

SEQ ID NO: 750407 - RNA, 22 nt, Human
cugcuucugggaugauggagua

SEQ ID NO: 750408 - RNA, 20 nt, Human
gggcuccagcugugauucuu

SEQ ID NO: 750409 - RNA, 22 nt, Human
caaugacaucucccugcucuaa

SEQ ID NO: 750410 - RNA, 21 nt, Human
ugugaaauagcuaugcuacau

SEQ ID NO: 750411 - RNA, 22 nt, Human
gugcuuuagcugaguuggucaa

SEQ ID NO: 750412 - RNA, 22 nt, Human
auacauacguacauacguaugu

SEQ ID NO: 750413 - RNA, 23 nt, Human
aguuaggucaaguuaggucaauu

SEQ ID NO: 750414 - RNA, 22 nt, Human
ucucuuccauguuucagcccca

SEQ ID NO: 750415 - RNA, 22 nt, Human
caaugcacauggacaucaggcu

SEQ ID NO: 750416 - RNA, 19 nt, Human
ugacaggcuguugccuuga

SEQ ID NO: 750417 - RNA, 22 nt, Human
ggaguuccagaaucugcuuuuu

SEQ ID NO: 750418 - RNA, 22 nt, Human
ugccugcgaggcaugggugaga

SEQ ID NO: 750419 - RNA, 15 nt, Human
gcuucuccagaugac

SEQ ID NO: 750420 - RNA, 22 nt, Human
aaucacaaauuuagacagagcu

SEQ ID NO: 750421 - RNA, 22 nt, Human
aggcccuggcacugccugggag

SEQ ID NO: 750422 - RNA, 22 nt, Human
ggcugggagccccacagaguca

SEQ ID NO: 750423 - RNA, 22 nt, Human
aggccuugccaaugagagaacu

SEQ ID NO: 750424 - RNA, 22 nt, Human
uaaagcaggcaucucucuccuc

SEQ ID NO: 750425 - RNA, 22 nt, Human
accuccccgggagcagccuccu

SEQ ID NO: 750426 - RNA, 22 nt, Human
agcuuuuaguacguuaaaauug

SEQ ID NO: 750427 - RNA, 22 nt, Human
aggagcagauugguaagaucau

SEQ ID NO: 750428 - RNA, 22 nt, Human
ccccagaaggggacagagggua

SEQ ID NO: 750429 - RNA, 22 nt, Human
ucuuucaauccauucauauguc

SEQ ID NO: 750430 - RNA, 22 nt, Human
ucagaaaugaucguuauucauu

SEQ ID NO: 750431 - RNA, 22 nt, Human
cagccuugauggaugaggaagu

SEQ ID NO: 750432 - RNA, 22 nt, Human
gauuucaauccagcuuucuucu

SEQ ID NO: 750433 - RNA, 22 nt, Human
gcagugaaucuggcaagaauuu

SEQ ID NO: 750434 - RNA, 22 nt, Human
auucuggacaaugagaaacugg

SEQ ID NO: 750435 - RNA, 22 nt, Human
aagacgggagucaggugagcuc

SEQ ID NO: 750436 - RNA, 22 nt, Human
ucccucagggugcaguugcuuu

SEQ ID NO: 750437 - RNA, 22 nt, Human
aacaaccaaaaagaugaaugua

SEQ ID NO: 750438 - RNA, 21 nt, Human
ucucugugucuuuaagcugga

SEQ ID NO: 750439 - RNA, 22 nt, Human
uuacuuuaagggugucuuauua

SEQ ID NO: 750440 - RNA, 17 nt, Human
cagaccucugugaagcc

SEQ ID NO: 750441 - RNA, 22 nt, Human
auucuucaccugagucagucua

SEQ ID NO: 750442 - RNA, 23 nt, Human
agcacaaaguguuuuccuuguag

SEQ ID NO: 750443 - RNA, 21 nt, Human
agaaacugacuccuagaggca

SEQ ID NO: 750444 - RNA, 22 nt, Human
uucuccuaggaucagggguccu

SEQ ID NO: 750445 - RNA, 22 nt, Human
ugcuucugucucuuaugccuug

SEQ ID NO: 750446 - RNA, 22 nt, Human
ucaggcacugcuuucugauaug

SEQ ID NO: 750447 - RNA, 22 nt, Human
aaucacauuacagcauaucugu

SEQ ID NO: 750448 - RNA, 22 nt, Human
cugucaggggcggguggagcgg

SEQ ID NO: 750449 - RNA, 22 nt, Human
gcucccagcauugcugcugaau

SEQ ID NO: 750450 - RNA, 22 nt, Human
ugggaaggacagaacauaauug

SEQ ID NO: 750451 - RNA, 22 nt, Human
gcugggucuggaugcucaggug

SEQ ID NO: 750452 - RNA, 22 nt, Human
guuuuagauaaagcuguccuug

SEQ ID NO: 750453 - RNA, 22 nt, Human
uucucuggguuaggggaacuau

SEQ ID NO: 750454 - RNA, 22 nt, Human
agucucagcaagcauggcuagu

SEQ ID NO: 750455 - RNA, 22 nt, Human
ggcucccuggcccuggggacac

SEQ ID NO: 750456 - RNA, 22 nt, Human
augaucugauaaucauccacua

SEQ ID NO: 750457 - RNA, 22 nt, Human
acagaagaaguucaaggugaag

SEQ ID NO: 750458 - RNA, 22 nt, Human
gagagugaggccugggaaucua

SEQ ID NO: 750459 - RNA, 22 nt, Human
gcugggcaagugccuuggguuu

SEQ ID NO: 750460 - RNA, 22 nt, Human
gcaggaaagguugagacuuugc

SEQ ID NO: 750461 - RNA, 22 nt, Human
agaugauauacuacauggcuuc

SEQ ID NO: 750462 - RNA, 22 nt, Human
agucuucugaauaagaaucacu

SEQ ID NO: 750463 - RNA, 22 nt, Human
ucagagaaucucuccuuaguuu

SEQ ID NO: 750464 - RNA, 22 nt, Human
uuucccaagaaaaauaauugga

SEQ ID NO: 750465 - RNA, 22 nt, Human
auaguggggacaggaugguugg

SEQ ID NO: 750466 - RNA, 22 nt, Human
cuggccccaggcagccugcugg

SEQ ID NO: 750467 - RNA, 22 nt, Human
aagcuucacauugaacuugggu

SEQ ID NO: 750468 - RNA, 22 nt, Human
aaauguuuugcucccauguggu

SEQ ID NO: 750469 - RNA, 23 nt, Human
ucccugagaugcugcucuguccc

SEQ ID NO: 750470 - RNA, 22 nt, Human
uaagagaauguuguggcuaggu

SEQ ID NO: 750471 - RNA, 23 nt, Human
uuggaagccagacagcugugcag

SEQ ID NO: 750472 - RNA, 22 nt, Human
acugggccaggggcuuuggagc

SEQ ID NO: 750473 - RNA, 23 nt, Human
uguuccugucaaauuuucuuccc

SEQ ID NO: 750474 - RNA, 22 nt, Human
caacagucagaaugaagcugag

SEQ ID NO: 750475 - RNA, 15 nt, Human
cuccaugauuuugca

SEQ ID NO: 750476 - RNA, 22 nt, Human
agaaaucuuggagucuguggua

SEQ ID NO: 750477 - RNA, 22 nt, Human
cuucacauaaacaaagggccau

SEQ ID NO: 750478 - RNA, 22 nt, Human
auuaaggagggcugggcaugau

SEQ ID NO: 750479 - RNA, 22 nt, Human
accaagcuagaacauuacaggc

SEQ ID NO: 750480 - RNA, 22 nt, Human
ugggaagggagaguguccugga

SEQ ID NO: 750481 - RNA, 22 nt, Human
agcaauguuggccuauauaccu

SEQ ID NO: 750482 - RNA, 18 nt, Human
aggucugaggaagagccu

SEQ ID NO: 750483 - RNA, 22 nt, Human
caucauuguuagggacucuaac

SEQ ID NO: 750484 - RNA, 22 nt, Human
cugaggaagacagcagcugugu

SEQ ID NO: 750485 - RNA, 22 nt, Human
caguagccuuauuuggaucauu

SEQ ID NO: 750486 - RNA, 22 nt, Human
gcagcugaaagggaucucuaca

SEQ ID NO: 750487 - RNA, 22 nt, Human
cugaggcuucucuaguucagcu

SEQ ID NO: 750488 - RNA, 22 nt, Human
uggccucugugggagcugagca

SEQ ID NO: 750489 - RNA, 22 nt, Human
ucaggccaagguagacaugacu

SEQ ID NO: 750490 - RNA, 22 nt, Human
cugcaguaucuuaaaauuugua

SEQ ID NO: 750491 - RNA, 22 nt, Human
agccaggaauuggacaacacau

SEQ ID NO: 750492 - RNA, 22 nt, Human
gggaggcugccauccuucagga

SEQ ID NO: 750493 - RNA, 23 nt, Human
ucugucuuguuuaggccacuguu

SEQ ID NO: 750494 - RNA, 22 nt, Human
acagcaugagaguagcaaaagg

SEQ ID NO: 750495 - RNA, 22 nt, Human
ccuguguucuaauccaucucag

SEQ ID NO: 750496 - RNA, 22 nt, Human
aguucugaaugaggaaucuggg

SEQ ID NO: 750497 - RNA, 22 nt, Human
ugccuaggcuggaaugcagugg

SEQ ID NO: 750498 - RNA, 22 nt, Human
cacacuguccccuucuccccag

SEQ ID NO: 750499 - RNA, 22 nt, Human
ugaugagggggaacagagauuu

SEQ ID NO: 750500 - RNA, 22 nt, Human
cagaaagaccugggcucaagag

SEQ ID NO: 750501 - RNA, 22 nt, Human
caugaguucaaaaugccugccu

SEQ ID NO: 750502 - RNA, 22 nt, Human
gcuccucuuauuucaucagggc

SEQ ID NO: 750503 - RNA, 22 nt, Human
aucugcuuccugggcuccauga

SEQ ID NO: 750504 - RNA, 22 nt, Human
cuucuucauguauugauagucu

SEQ ID NO: 750505 - RNA, 22 nt, Human
gcugauagacugaauguuggga

SEQ ID NO: 750506 - RNA, 22 nt, Human
ucuacaaagaagaauuaauguc

SEQ ID NO: 750507 - RNA, 23 nt, Human
uuuauuuauuuaggcugagggau

SEQ ID NO: 750508 - RNA, 22 nt, Human
agcuccuugaagggcucuggga

SEQ ID NO: 750509 - RNA, 22 nt, Human
agccucaguuucaggccuccuc

SEQ ID NO: 750510 - RNA, 22 nt, Human
uucaugaaagacagcaacugug

SEQ ID NO: 750511 - RNA, 22 nt, Human
cugggugaguauaggaaaggga

SEQ ID NO: 750512 - RNA, 17 nt, Human
agucagaggaguaucug

SEQ ID NO: 750513 - RNA, 22 nt, Human
ucacauuucuuuauguagucuu

SEQ ID NO: 750514 - RNA, 22 nt, Human
uugcuuauagagaguuucauac

SEQ ID NO: 750515 - RNA, 22 nt, Human
ggacugggcaugggugcucugc

SEQ ID NO: 750516 - RNA, 22 nt, Human
uggcagcaaguucuugggaggu

SEQ ID NO: 750517 - RNA, 22 nt, Human
uuccucuuuagggcuggccagg

SEQ ID NO: 750518 - RNA, 19 nt, Human
cucuccagcuccaguagcu

SEQ ID NO: 750519 - RNA, 22 nt, Human
gguggggcccuggcacugguau

SEQ ID NO: 750520 - RNA, 23 nt, Human
ugucuuuguuaggacuguguuua

SEQ ID NO: 750521 - RNA, 22 nt, Human
uagggcucagagaaguggggcc

SEQ ID NO: 750522 - RNA, 22 nt, Human
ugauuugagguacauaaaucca

SEQ ID NO: 750523 - RNA, 22 nt, Human
aucagagaaguuucacuggcau

SEQ ID NO: 750524 - RNA, 22 nt, Human
gcucacagcccaggccagcgug

SEQ ID NO: 750525 - RNA, 22 nt, Human
aggaagaugugcaaaguuggaa

SEQ ID NO: 750526 - RNA, 22 nt, Human
ucucugaguuuuaaggaugaug

SEQ ID NO: 750527 - RNA, 22 nt, Human
uggguccuugccaucuuggagu

SEQ ID NO: 750528 - RNA, 22 nt, Human
uagaaacccauguuuauucagu

SEQ ID NO: 750529 - RNA, 22 nt, Human
ugccaggcuaaguggaggacuu

SEQ ID NO: 750530 - RNA, 22 nt, Human
acagggauuuuccaggcuaccc

SEQ ID NO: 750531 - RNA, 22 nt, Human
ugauuaaagguggaaggcaggu

SEQ ID NO: 750532 - RNA, 22 nt, Human
guugaauaucccguaucuuaaa

SEQ ID NO: 750533 - RNA, 22 nt, Human
auguaagacuuuaagaaccuaa

SEQ ID NO: 750534 - RNA, 22 nt, Human
cagcauuuggugaucaucuuaa

SEQ ID NO: 750535 - RNA, 22 nt, Human
ccagcugacgaugccuggucuc

SEQ ID NO: 750536 - RNA, 22 nt, Human
uguaggucucagugucugagcu

SEQ ID NO: 750537 - RNA, 22 nt, Human
auuucagcuaaaauucuuaauu

SEQ ID NO: 750538 - RNA, 22 nt, Human
aggucaugauccauuggugagu

SEQ ID NO: 750539 - RNA, 22 nt, Human
auggcuucgaguauauacauag

SEQ ID NO: 750540 - RNA, 23 nt, Human
uguaccaggaguuucagcagacu

SEQ ID NO: 750541 - RNA, 22 nt, Human
cuucauuaaccaaaaugcaaua

SEQ ID NO: 750542 - RNA, 22 nt, Human
gggcagguggcagggucucugg

SEQ ID NO: 750543 - RNA, 22 nt, Human
ucaaugaugcugaagguagcgu

SEQ ID NO: 750544 - RNA, 22 nt, Human
aaacacugcgugguggcaacuc

SEQ ID NO: 750545 - RNA, 22 nt, Human
agugaauguccccgcgggucag

SEQ ID NO: 750546 - RNA, 22 nt, Human
ugcugcugaugcauagucugcu

SEQ ID NO: 750547 - RNA, 22 nt, Human
guggcagugccagcuccgacaa

SEQ ID NO: 750548 - RNA, 22 nt, Human
aagcagggugucuugacccaug

SEQ ID NO: 750549 - RNA, 22 nt, Human
uuuccuaaggcucauuuuaaaa

SEQ ID NO: 750550 - RNA, 22 nt, Human
uucucucuuccaguucccacuu

SEQ ID NO: 750551 - RNA, 21 nt, Human
cagugcugccuaauagggagu

SEQ ID NO: 750552 - RNA, 22 nt, Human
uguaggaauuccagugacuuca

SEQ ID NO: 750553 - RNA, 22 nt, Human
ccugagaauguuuaacagagaa

SEQ ID NO: 750554 - RNA, 22 nt, Human
gagcucagcaaaggucugugug

SEQ ID NO: 750555 - RNA, 22 nt, Human
ugugguuuuucaguugcuggag

SEQ ID NO: 750556 - RNA, 22 nt, Human
aaguguccucauucaacaugca

SEQ ID NO: 750557 - RNA, 22 nt, Human
agaacaucuaaauaucugagac

SEQ ID NO: 750558 - RNA, 22 nt, Human
uauuagcagccaacuuagcugu

SEQ ID NO: 750559 - RNA, 22 nt, Human
aagacacuggguuaggcacgug

SEQ ID NO: 750560 - RNA, 22 nt, Human
ccaugggaauugggagguccca

SEQ ID NO: 750561 - RNA, 22 nt, Human
uuuguacauauauaaaaucugu

SEQ ID NO: 750562 - RNA, 22 nt, Human
uucagggcagagaguucaggga

SEQ ID NO: 750563 - RNA, 22 nt, Human
uaguuaaugcuaauuaacaaau

SEQ ID NO: 750564 - RNA, 19 nt, Human
cucugccauuugcugccug

SEQ ID NO: 750565 - RNA, 19 nt, Human
ggccaggcugacugugguc

SEQ ID NO: 750566 - RNA, 22 nt, Human
ucuggcugacauccuguaugag

SEQ ID NO: 750567 - RNA, 22 nt, Human
cucuucaggaauaugucaguca

SEQ ID NO: 750568 - RNA, 22 nt, Human
cuucccuuuuuaugucuucagc

SEQ ID NO: 750569 - RNA, 22 nt, Human
ugggaugagaagugcgaggguu

SEQ ID NO: 750570 - RNA, 22 nt, Human
guggcccucugauagggucagg

SEQ ID NO: 750571 - RNA, 22 nt, Human
gacacugugcuagcugggcuua

SEQ ID NO: 750572 - RNA, 22 nt, Human
cacagaggcaugacccugcccu

SEQ ID NO: 750573 - RNA, 22 nt, Human
gcagaagguuguuugggaaagg

SEQ ID NO: 750574 - RNA, 22 nt, Human
cacaggaccaauucacauucca

SEQ ID NO: 750575 - RNA, 22 nt, Human
acaggcugggcgcuuccugcgg

SEQ ID NO: 750576 - RNA, 22 nt, Human
cuuuacaccaagcagaucuuuc

SEQ ID NO: 750577 - RNA, 22 nt, Human
ggcagagaaucuggcuguuuac

SEQ ID NO: 750578 - RNA, 22 nt, Human
cacucacuuauuucuaacagaa

SEQ ID NO: 750579 - RNA, 22 nt, Human
uccagggcgugugugaaggaaa

SEQ ID NO: 750580 - RNA, 22 nt, Human
gacagaggagaagaugcugugg

SEQ ID NO: 750581 - RNA, 22 nt, Human
uuggcucacaaggacgguugcu

SEQ ID NO: 750582 - RNA, 22 nt, Human
agcuggugcugaagcucuugag

SEQ ID NO: 750583 - RNA, 22 nt, Human
ugaagauugugcuuggccugua

SEQ ID NO: 750584 - RNA, 22 nt, Human
ggggguaggcagacaaggacau

SEQ ID NO: 750585 - RNA, 22 nt, Human
cagacuguagaguuugagaagu

SEQ ID NO: 750586 - RNA, 19 nt, Human
cagcucaggacucagcccc

SEQ ID NO: 750587 - RNA, 22 nt, Human
ugucagcagaucuccugcagcc

SEQ ID NO: 750588 - RNA, 20 nt, Human
guggcaggcagugaaggagc

SEQ ID NO: 750589 - RNA, 22 nt, Human
acucaucugccauuccuguacc

SEQ ID NO: 750590 - RNA, 22 nt, Human
cccaggagagaggccaguuggc

SEQ ID NO: 750591 - RNA, 20 nt, Human
ucauccaggacaggaguggc

SEQ ID NO: 750592 - RNA, 17 nt, Human
uuccccugaccaagccu

SEQ ID NO: 750593 - RNA, 22 nt, Human
cagggccauaucuugugcacca

SEQ ID NO: 750594 - RNA, 22 nt, Human
cauuaaaucuuccagaccucac

SEQ ID NO: 750595 - RNA, 22 nt, Human
agcagggcaugaauaaggguuu

SEQ ID NO: 750596 - RNA, 22 nt, Human
gagcuguucaaggacaggcacg

SEQ ID NO: 750597 - RNA, 22 nt, Human
uucuaacucuguuauguguuuc

SEQ ID NO: 750598 - RNA, 22 nt, Human
ucagccuuguggcccugcucca

SEQ ID NO: 750599 - RNA, 22 nt, Human
aaaaggauguuuucaugaaaca

SEQ ID NO: 750600 - RNA, 22 nt, Human
aaugaucuacucucauuaucuc

SEQ ID NO: 750601 - RNA, 22 nt, Human
cuggcucucugauuucacauuc

SEQ ID NO: 750602 - RNA, 20 nt, Human
uuguuagaggaaugccauag

SEQ ID NO: 750603 - RNA, 22 nt, Human
accuuucauuaaagucuguagu

SEQ ID NO: 750604 - RNA, 22 nt, Human
cagcagcccuuuggcugaacug

SEQ ID NO: 750605 - RNA, 21 nt, Human
gcuguugcccgccgccucuuc

SEQ ID NO: 750606 - RNA, 22 nt, Human
agacccagagggcugcugggag

SEQ ID NO: 750607 - RNA, 23 nt, Human
agggcugaugccauugcagcucu

SEQ ID NO: 750608 - RNA, 21 nt, Human
agcuggccugguuugagcucc

SEQ ID NO: 750609 - RNA, 22 nt, Human
cuguaugaacccauauacuuau

SEQ ID NO: 750610 - RNA, 22 nt, Human
uccagcagguuggucaggugca

SEQ ID NO: 750611 - RNA, 22 nt, Human
gugagcaggauuucauggugua

SEQ ID NO: 750612 - RNA, 22 nt, Human
gagaggaguaggcugauggugc

SEQ ID NO: 750613 - RNA, 22 nt, Human
gccuaggagacaagcgugaaag

SEQ ID NO: 750614 - RNA, 22 nt, Human
ugcuucuuuaugauguaugauu

SEQ ID NO: 750615 - RNA, 22 nt, Human
uuggccaguggaaagaggagga

SEQ ID NO: 750616 - RNA, 22 nt, Human
ucucacucauuuccuaggucuu

SEQ ID NO: 750617 - RNA, 22 nt, Human
gucugcugugccuuggggaaaa

SEQ ID NO: 750618 - RNA, 22 nt, Human
cugugaucauucuugauuuaag

SEQ ID NO: 750619 - RNA, 22 nt, Human
gugaauaaucacccuucuggau

SEQ ID NO: 750620 - RNA, 22 nt, Human
gccaacaggccuugcucugcuc

SEQ ID NO: 750621 - RNA, 22 nt, Human
uacaguauguucuugaauuugg

SEQ ID NO: 750622 - RNA, 22 nt, Human
cagcagagacgguaagcagaac

SEQ ID NO: 750623 - RNA, 21 nt, Human
gcuccuggugcugcguggcgc

SEQ ID NO: 750624 - RNA, 22 nt, Human
uuucuccuccagagagacacag

SEQ ID NO: 750625 - RNA, 22 nt, Human
gcucucagggugauggcauacu

SEQ ID NO: 750626 - RNA, 22 nt, Human
ugguaaaauauuacaaggcacu

SEQ ID NO: 750627 - RNA, 22 nt, Human
gcagaagcagggcaggggcaaa

SEQ ID NO: 750628 - RNA, 22 nt, Human
agcuuuaugggagcuuagauaa

SEQ ID NO: 750629 - RNA, 22 nt, Human
aaauuguugaucuacaguaagg

SEQ ID NO: 750630 - RNA, 22 nt, Human
uuccgcuggggccgccuggcgg

SEQ ID NO: 750631 - RNA, 22 nt, Human
uggcugcaggggugucugacau

SEQ ID NO: 750632 - RNA, 22 nt, Human
ugaggaacucaccaggcagaga

SEQ ID NO: 750633 - RNA, 22 nt, Human
gaaagcugaaccaggaaccaug

SEQ ID NO: 750634 - RNA, 20 nt, Human
aagggagaauaaugauugua

SEQ ID NO: 750635 - RNA, 22 nt, Human
augcaaaauuaccauucuguuc

SEQ ID NO: 750636 - RNA, 22 nt, Human
gucugcccugcugaucucaccc

SEQ ID NO: 750637 - RNA, 22 nt, Human
cugagaaaauuucaggaagugu

SEQ ID NO: 750638 - RNA, 23 nt, Human
uugucugugcuuuuccaguugcu

SEQ ID NO: 750639 - RNA, 22 nt, Human
cgagcagaauggagggugccga

SEQ ID NO: 750640 - RNA, 22 nt, Human
ucuugacauugcaaucuucaga

SEQ ID NO: 750641 - RNA, 22 nt, Human
aagaguauagcuuuaggauuga

SEQ ID NO: 750642 - RNA, 22 nt, Human
agugucacaaaccugccuugua

SEQ ID NO: 750643 - RNA, 22 nt, Human
uaagaaacuuaacugggaacua

SEQ ID NO: 750644 - RNA, 22 nt, Human
cuccaagucggcugcagcugga

SEQ ID NO: 750645 - RNA, 22 nt, Human
ucuggcuuggcuggcaucucug

SEQ ID NO: 750646 - RNA, 22 nt, Human
cucacaccagcuuacaagacuu

SEQ ID NO: 750647 - RNA, 22 nt, Human
gccugguggacacugggcauca

SEQ ID NO: 750648 - RNA, 19 nt, Human
acugugcucgggaaccacu

SEQ ID NO: 750649 - RNA, 22 nt, Human
uagauguugaagucauauuugg

SEQ ID NO: 750650 - RNA, 17 nt, Human
uuacaacgucaucucug

SEQ ID NO: 750651 - RNA, 21 nt, Human
gccugccccauguuucuguug

SEQ ID NO: 750652 - RNA, 22 nt, Human
agggccugcucuaucacucuca

SEQ ID NO: 750653 - RNA, 20 nt, Human
cucuuauugcauuaguuucu

SEQ ID NO: 750654 - RNA, 22 nt, Human
gaccagcugguccuguccuggg

SEQ ID NO: 750655 - RNA, 19 nt, Human
agucucuucggaggagguu

SEQ ID NO: 750656 - RNA, 19 nt, Human
acaauaacucauugauugc

SEQ ID NO: 750657 - RNA, 22 nt, Human
ggucucagugaaggagugugcu

SEQ ID NO: 750658 - RNA, 15 nt, Human
gcucuggguauuuga

SEQ ID NO: 750659 - RNA, 22 nt, Human
uggucucugacucugaagaccc

SEQ ID NO: 750660 - RNA, 22 nt, Human
acccucagcuggagauugaauu

SEQ ID NO: 750661 - RNA, 22 nt, Human
aggucuccuugugggucuugcc

SEQ ID NO: 750662 - RNA, 22 nt, Human
uuucagacucaucucaagcuuu

SEQ ID NO: 750663 - RNA, 22 nt, Human
uauucuacaguguuaguguuag

SEQ ID NO: 750664 - RNA, 22 nt, Human
ugucccucauugacgcugugcc

SEQ ID NO: 750665 - RNA, 22 nt, Human
uccaggccaggguaagaggaga

SEQ ID NO: 750666 - RNA, 22 nt, Human
cagaugcuauguauuauguaug

SEQ ID NO: 750667 - RNA, 18 nt, Human
agcaagcaguuuucaugu

SEQ ID NO: 750668 - RNA, 22 nt, Human
guuggaauuugcucauccauuu

SEQ ID NO: 750669 - RNA, 22 nt, Human
uagaccauuuuacaauagugug

SEQ ID NO: 750670 - RNA, 22 nt, Human
aucugcugucacauguuugaag

SEQ ID NO: 750671 - RNA, 22 nt, Human
gugggccaggcgucuaggcccu

SEQ ID NO: 750672 - RNA, 22 nt, Human
uuugaagacauauuguuacaua

SEQ ID NO: 750673 - RNA, 22 nt, Human
cauucauuuaugaaauaucuau

SEQ ID NO: 750674 - RNA, 22 nt, Human
gauuucaaagguucugcaugcc

SEQ ID NO: 750675 - RNA, 22 nt, Human
cagguagguuuuaggcuaaaca

SEQ ID NO: 750676 - RNA, 22 nt, Human
gacuuuaaaaguuugugcuugg

SEQ ID NO: 750677 - RNA, 22 nt, Human
uggagauguaaagcaaggcuua

SEQ ID NO: 750678 - RNA, 20 nt, Human
gcagggcaucuuggccccca

SEQ ID NO: 750679 - RNA, 22 nt, Human
caggaaugccaaccagugcaug

SEQ ID NO: 750680 - RNA, 22 nt, Human
aaagucauuuagccuuaucucc

SEQ ID NO: 750681 - RNA, 22 nt, Human
ggagcugucuguagggcacagg

SEQ ID NO: 750682 - RNA, 22 nt, Human
auacaguauguaggcuuuucag

SEQ ID NO: 750683 - RNA, 22 nt, Human
aagagcauauuaauaguggaga

SEQ ID NO: 750684 - RNA, 22 nt, Human
uuuucucuccagguggggugau

SEQ ID NO: 750685 - RNA, 22 nt, Human
uuccucagagagacagaaacua

SEQ ID NO: 750686 - RNA, 22 nt, Human
gugugcaugugcuugcacagau

SEQ ID NO: 750687 - RNA, 22 nt, Human
aagagcaggcugcuguggagua

SEQ ID NO: 750688 - RNA, 22 nt, Human
gguuuuaacuacagaauugcaa

SEQ ID NO: 750689 - RNA, 22 nt, Human
aaaaucuaaguagcgaguaagg

SEQ ID NO: 750690 - RNA, 22 nt, Human
gagaggcugguaaagucugaac

SEQ ID NO: 750691 - RNA, 22 nt, Human
ucacaucacaugacaguaggcc

SEQ ID NO: 750692 - RNA, 19 nt, Human
gaguccugugcuccuuguu

SEQ ID NO: 750693 - RNA, 22 nt, Human
acaaaaccagaaaaucucuacc

SEQ ID NO: 750694 - RNA, 22 nt, Human
agggcaugaagcaguggacagc

SEQ ID NO: 750695 - RNA, 22 nt, Human
ucaguguaaguuauguagaugu

SEQ ID NO: 750696 - RNA, 22 nt, Human
uucaacuauuaugaauaaaauu

SEQ ID NO: 750697 - RNA, 22 nt, Human
aguguuuagugaugaaagagaa

SEQ ID NO: 750698 - RNA, 22 nt, Human
uauauacuaugcgauuccugcc

SEQ ID NO: 750699 - RNA, 22 nt, Human
gggugggguucaggaaucuuca

SEQ ID NO: 750700 - RNA, 22 nt, Human
gaggauggugagcaggacccag

SEQ ID NO: 750701 - RNA, 22 nt, Human
agcaggaguuugaugcuuuuau

SEQ ID NO: 750702 - RNA, 22 nt, Human
uucugccuuacgauauuuucaa

SEQ ID NO: 750703 - RNA, 22 nt, Human
ucuucaucucagauuaacagga

SEQ ID NO: 750704 - RNA, 22 nt, Human
ugccugcugcuaagcucuuugu

SEQ ID NO: 750705 - RNA, 22 nt, Human
auaucacaggaaaggaagauac

SEQ ID NO: 750706 - RNA, 22 nt, Human
gcuggagaccucagagaaccca

SEQ ID NO: 750707 - RNA, 22 nt, Human
acaggcaauuagcaagcuguua

SEQ ID NO: 750708 - RNA, 22 nt, Human
cuggcucugugggaccuggccu

SEQ ID NO: 750709 - RNA, 22 nt, Human
ggacaguccaccucagugaaga

SEQ ID NO: 750710 - RNA, 22 nt, Human
aaacugcaugaagcugauuuua

SEQ ID NO: 750711 - RNA, 22 nt, Human
uucugcucuaauguacaccagc

SEQ ID NO: 750712 - RNA, 22 nt, Human
guucugaguggcccaagcccug

SEQ ID NO: 750713 - RNA, 22 nt, Human
aaagaacaauguggaaucuccu

SEQ ID NO: 750714 - RNA, 20 nt, Human
uaaucacuuauaagacaaug

SEQ ID NO: 750715 - RNA, 22 nt, Human
acguggagagaauagggcacca

SEQ ID NO: 750716 - RNA, 22 nt, Human
ugucucagaguaucccugaacu

SEQ ID NO: 750717 - RNA, 22 nt, Human
cuuggcagagggcugggcucag

SEQ ID NO: 750718 - RNA, 22 nt, Human
ucccacugugccuguuguaauc

SEQ ID NO: 750719 - RNA, 22 nt, Human
auaguacauggguguccucaca

SEQ ID NO: 750720 - RNA, 22 nt, Human
gaaccuggaaucuauuacaagg

SEQ ID NO: 750721 - RNA, 22 nt, Human
agguccugacgcccuuugaaau

SEQ ID NO: 750722 - RNA, 20 nt, Human
aguuauaguaucuagccaug

SEQ ID NO: 750723 - RNA, 22 nt, Human
gaggaagaugguugaguggucc

SEQ ID NO: 750724 - RNA, 22 nt, Human
aaggcacauauuuuagagucac

SEQ ID NO: 750725 - RNA, 22 nt, Human
auucuggggcugguuauuuuga

SEQ ID NO: 750726 - RNA, 22 nt, Human
accagcaucaccuggaggccug

SEQ ID NO: 750727 - RNA, 22 nt, Human
ugagaguucucucuucaggugg

SEQ ID NO: 750728 - RNA, 22 nt, Human
cucugcccucgcacaucugcca

SEQ ID NO: 750729 - RNA, 22 nt, Human
cuccagcugccaccagauguuu

SEQ ID NO: 750730 - RNA, 20 nt, Human
ggaccagcugucugaggggc

SEQ ID NO: 750731 - RNA, 22 nt, Human
gcagccacacuguuacagaaug

SEQ ID NO: 750732 - RNA, 22 nt, Human
acuggggcaggaaaguaugcug

SEQ ID NO: 750733 - RNA, 19 nt, Human
uccucaggggcucacagac

SEQ ID NO: 750734 - RNA, 22 nt, Human
agcacagugcugggcacacagu

SEQ ID NO: 750735 - RNA, 22 nt, Human
uucauucuucagagcugcgcuu

SEQ ID NO: 750736 - RNA, 16 nt, Human
aggcagagauuuaccc

SEQ ID NO: 750737 - RNA, 22 nt, Human
caggccucaccagcggagcugc

SEQ ID NO: 750738 - RNA, 22 nt, Human
augucacauggccuguacuuug

SEQ ID NO: 750739 - RNA, 20 nt, Human
ucugugcuacacuccagauu

SEQ ID NO: 750740 - RNA, 22 nt, Human
ggugacgaauccauagcaucga

SEQ ID NO: 750741 - RNA, 22 nt, Human
cugccuuuggggaguuagaggg

SEQ ID NO: 750742 - RNA, 22 nt, Human
aaugaugguuucaucacuugaa

SEQ ID NO: 750743 - RNA, 22 nt, Human
ggcacagcacuguaggccuggg

SEQ ID NO: 750744 - RNA, 22 nt, Human
gacuauugcacacuucucucac

SEQ ID NO: 750745 - RNA, 22 nt, Human
agugacaggggaggcaggugug

SEQ ID NO: 750746 - RNA, 22 nt, Human
gaggcagagugcaccccaggag

SEQ ID NO: 750747 - RNA, 22 nt, Human
ucaagacauauuaaaugugcga

SEQ ID NO: 750748 - RNA, 22 nt, Human
gugccugccccacuccucagca

SEQ ID NO: 750749 - RNA, 22 nt, Human
uuucucaaguacugcacaugaa

SEQ ID NO: 750750 - RNA, 22 nt, Human
agaggucugagcaaucucaagc

SEQ ID NO: 750751 - RNA, 21 nt, Human
aaucugcuucccugugacuug

SEQ ID NO: 750752 - RNA, 22 nt, Human
ugccagcuuguggucagaggcu

SEQ ID NO: 750753 - RNA, 18 nt, Human
gcuuuauuucuuggggaa

SEQ ID NO: 750754 - RNA, 22 nt, Human
ugacaauugcagacacagaagu

SEQ ID NO: 750755 - RNA, 22 nt, Human
uucauuugucugcuauagaucc

SEQ ID NO: 750756 - RNA, 22 nt, Human
ucucugagacaguagccucugc

SEQ ID NO: 750757 - RNA, 22 nt, Human
ugagguaggagggugaucagca

SEQ ID NO: 750758 - RNA, 22 nt, Human
aaucuguuuccaauacuugcua

SEQ ID NO: 750759 - RNA, 22 nt, Human
guccacucuagggcagcucucg

SEQ ID NO: 750760 - RNA, 22 nt, Human
ucugggccgcugcguuccauga

SEQ ID NO: 750761 - RNA, 22 nt, Human
ggcugguguugagugccuguag

SEQ ID NO: 750762 - RNA, 22 nt, Human
auagauguuuuaguaauacugu

SEQ ID NO: 750763 - RNA, 22 nt, Human
ggcccugugauggauguauuag

SEQ ID NO: 750764 - RNA, 22 nt, Human
acagcauucccuuuggcugcuu

SEQ ID NO: 750765 - RNA, 22 nt, Human
ugucaugccauuuaaaauguuu

SEQ ID NO: 750766 - RNA, 22 nt, Human
cuuccugcaacaccuguguugc

SEQ ID NO: 750767 - RNA, 22 nt, Human
uuucaguuuaugucuugaauua

SEQ ID NO: 750768 - RNA, 22 nt, Human
gagaaacaggaauugagucgcu

SEQ ID NO: 750769 - RNA, 19 nt, Human
gggcuccuugggccucucu

SEQ ID NO: 750770 - RNA, 22 nt, Human
acuuucugcaguguuggaaaug

SEQ ID NO: 750771 - RNA, 22 nt, Human
cagagcagggugcaccuugggc

SEQ ID NO: 750772 - RNA, 22 nt, Human
ccaguccuggccaguaacauga

SEQ ID NO: 750773 - RNA, 22 nt, Human
cauggccagauucuuucuucuc

SEQ ID NO: 750774 - RNA, 22 nt, Human
aaugguuugauggacaaaauga

SEQ ID NO: 750775 - RNA, 22 nt, Human
uuaaauuauugagggauuguca

SEQ ID NO: 750776 - RNA, 22 nt, Human
gaguagaaggaaguuaucuacc

SEQ ID NO: 750777 - RNA, 22 nt, Human
uagaaacauguucuguucuguu

SEQ ID NO: 750778 - RNA, 22 nt, Human
gaaggccuaggaaggaagccuu

SEQ ID NO: 750779 - RNA, 22 nt, Human
agagcugaggauccagcugagc

SEQ ID NO: 750780 - RNA, 22 nt, Human
acaaaagcacugcagaguaagc

SEQ ID NO: 750781 - RNA, 22 nt, Human
cagaauuuaaguggauuauucu

SEQ ID NO: 750782 - RNA, 22 nt, Human
cacaugggugugccuggaggaa

SEQ ID NO: 750783 - RNA, 22 nt, Human
uauaaacuccucuugcauuccu

SEQ ID NO: 750784 - RNA, 22 nt, Human
guaauugaaauugccuuggguu

SEQ ID NO: 750785 - RNA, 22 nt, Human
aaggcauaggacaaaucaguga

SEQ ID NO: 750786 - RNA, 17 nt, Human
augcuccauucagaagc

SEQ ID NO: 750787 - RNA, 22 nt, Human
gucacacucagaaugacuagag

SEQ ID NO: 750788 - RNA, 22 nt, Human
acugccugugcacuggucuuuu

SEQ ID NO: 750789 - RNA, 23 nt, Human
agugcugaauugaaagcuccagg

SEQ ID NO: 750790 - RNA, 22 nt, Human
uggccacccacccuaaucuuuc

SEQ ID NO: 750791 - RNA, 22 nt, Human
cuguuuauagcagagcaagccu

SEQ ID NO: 750792 - RNA, 22 nt, Human
aggcuucuacguggucccaggg

SEQ ID NO: 750793 - RNA, 22 nt, Human
uaucagcucggaaucuguugaa

SEQ ID NO: 750794 - RNA, 22 nt, Human
gaaagcaguauuuaguucuguu

SEQ ID NO: 750795 - RNA, 22 nt, Human
cagauuccaguuuguggcuccc

SEQ ID NO: 750796 - RNA, 22 nt, Human
ggcggcccugcacgugcugagg

SEQ ID NO: 750797 - RNA, 22 nt, Human
uaauacauuaccuaaccucucu

SEQ ID NO: 750798 - RNA, 22 nt, Human
ucccauggucuauauagaggca

SEQ ID NO: 750799 - RNA, 22 nt, Human
cugcugugccuuaaaaugcaag

SEQ ID NO: 750800 - RNA, 22 nt, Human
uaugagaagaacaggugacuuu

SEQ ID NO: 750801 - RNA, 22 nt, Human
ucacuguugaccuggaaguggg

SEQ ID NO: 750802 - RNA, 22 nt, Human
uucuuuagcaacuuggauuuag

SEQ ID NO: 750803 - RNA, 22 nt, Human
uucugcugguguuuugugaggc

SEQ ID NO: 750804 - RNA, 21 nt, Human
cacauuccaugggucuauuua

SEQ ID NO: 750805 - RNA, 22 nt, Human
gcuucagauucuuuucaugucu

SEQ ID NO: 750806 - RNA, 22 nt, Human
gaauuaaaauaguuuuggucga

SEQ ID NO: 750807 - RNA, 22 nt, Human
ucacagaaguguguuucaggag

SEQ ID NO: 750808 - RNA, 22 nt, Human
gaagccacguuaaauuggcugu

SEQ ID NO: 750809 - RNA, 22 nt, Human
ucucccaaggcacagaaagagu

SEQ ID NO: 750810 - RNA, 22 nt, Human
guuaaaugcacuauugaaagcu

SEQ ID NO: 750811 - RNA, 22 nt, Human
aggggaggagcuuuucuugccu

SEQ ID NO: 750812 - RNA, 22 nt, Human
aaagugaugccaggagucuggu

SEQ ID NO: 750813 - RNA, 21 nt, Human
uguuccuguucucuaggaucc

SEQ ID NO: 750814 - RNA, 22 nt, Human
ggugggaucaaagagucauucg

SEQ ID NO: 750815 - RNA, 22 nt, Human
gggccagagcuuggcagcuggg

SEQ ID NO: 750816 - RNA, 22 nt, Human
aaugccuuuccacuggguauca

SEQ ID NO: 750817 - RNA, 22 nt, Human
uuuucuuaggugcuccaaguag

SEQ ID NO: 750818 - RNA, 20 nt, Human
ucuagcuuagugccugccuc

SEQ ID NO: 750819 - RNA, 22 nt, Human
aaaguguaggcuucaaagaggg

SEQ ID NO: 750820 - RNA, 22 nt, Human
uuaccaauucagacaucucuuc

SEQ ID NO: 750821 - RNA, 22 nt, Human
gccagccccuccauccuguuca

SEQ ID NO: 750822 - RNA, 22 nt, Human
ccaagaggaccuugccagggca

SEQ ID NO: 750823 - RNA, 22 nt, Human
caggccaauuucuugucauuua

SEQ ID NO: 750824 - RNA, 19 nt, Human
uuucaggagcuaugcaggg

SEQ ID NO: 750825 - RNA, 22 nt, Human
uuucaaagaguuguaaauuacu

SEQ ID NO: 750826 - RNA, 22 nt, Human
ccucccuuccccaguagucaag

SEQ ID NO: 750827 - RNA, 19 nt, Human
uccugcagguggcuugcag

SEQ ID NO: 750828 - RNA, 22 nt, Human
uagucaccuuuggcaccugcaa

SEQ ID NO: 750829 - RNA, 22 nt, Human
uuacaguuuaccaagaauauug

SEQ ID NO: 750830 - RNA, 22 nt, Human
gcugccaugccacagcacucac

SEQ ID NO: 750831 - RNA, 22 nt, Human
cauuaggguaauugaacacuua

SEQ ID NO: 750832 - RNA, 22 nt, Human
uugagguaauaaacagccauuc

SEQ ID NO: 750833 - RNA, 16 nt, Human
ucucccuguucuccaa

SEQ ID NO: 750834 - RNA, 22 nt, Human
ugucaugucuguaaauacacca

SEQ ID NO: 750835 - RNA, 22 nt, Human
ugccugucucugacugccauua

SEQ ID NO: 750836 - RNA, 22 nt, Human
uggagucaugauggcugcugau

SEQ ID NO: 750837 - RNA, 22 nt, Human
ucacccuugauaauguucuucu

SEQ ID NO: 750838 - RNA, 20 nt, Human
auagauccugguucuuugca

SEQ ID NO: 750839 - RNA, 22 nt, Human
agcugggcugggcugagcugag

SEQ ID NO: 750840 - RNA, 22 nt, Human
uagagcuauuuagagcauuuua

SEQ ID NO: 750841 - RNA, 22 nt, Human
cacccaggcuggauugcagugg

SEQ ID NO: 750842 - RNA, 22 nt, Human
uggagcagggcaucacugugcg

SEQ ID NO: 750843 - RNA, 22 nt, Human
auuguucuggauauuuacauug

SEQ ID NO: 750844 - RNA, 22 nt, Human
cagccaagaaccacagacccag

SEQ ID NO: 750845 - RNA, 21 nt, Human
uucuccuguuuugcaccacag

SEQ ID NO: 750846 - RNA, 22 nt, Human
agcacauuuuauuuaagaaaau

SEQ ID NO: 750847 - RNA, 20 nt, Human
acacaguagaugagugacug

SEQ ID NO: 750848 - RNA, 22 nt, Human
augggaggcagacacuaaguuc

SEQ ID NO: 750849 - RNA, 22 nt, Human
cagcccuucuuccaaccagcuu

SEQ ID NO: 750850 - RNA, 22 nt, Human
gcucgaccgccagaaacuuccu

SEQ ID NO: 750851 - RNA, 22 nt, Human
guauagguuuggcucucuccag

SEQ ID NO: 750852 - RNA, 22 nt, Human
cugcagcaucgccaccugccuc

SEQ ID NO: 750853 - RNA, 22 nt, Human
uucugucacuuaggaggucaua

SEQ ID NO: 750854 - RNA, 22 nt, Human
gggcacuggccgcccaucccug

SEQ ID NO: 750855 - RNA, 22 nt, Human
ggugaacauugaugugguuaca

SEQ ID NO: 750856 - RNA, 22 nt, Human
cccuccagggagccaugcuggg

SEQ ID NO: 750857 - RNA, 22 nt, Human
cuucuuccugaaagcuggcucu

SEQ ID NO: 750858 - RNA, 22 nt, Human
aaucauaauucaaauaagcuua

SEQ ID NO: 750859 - RNA, 22 nt, Human
ugucuucaucuccaugcacaga

SEQ ID NO: 750860 - RNA, 22 nt, Human
uaaguucauaagcuuauucuua

SEQ ID NO: 750861 - RNA, 22 nt, Human
uuacaauguaaggcaugguucu

SEQ ID NO: 750862 - RNA, 22 nt, Human
gguccagggaacuuugaaggau

SEQ ID NO: 750863 - RNA, 22 nt, Human
auuuacagaaacuuaaucauag

SEQ ID NO: 750864 - RNA, 22 nt, Human
uagugcuuuggagcuuucuccu

SEQ ID NO: 750865 - RNA, 22 nt, Human
ucacaauugagauccucccacc

SEQ ID NO: 750866 - RNA, 23 nt, Human
agggaaauacugcaauuuuugga

SEQ ID NO: 750867 - RNA, 22 nt, Human
cugggagaugacucagagcagg

SEQ ID NO: 750868 - RNA, 22 nt, Human
aacuguggacuugagacugaug

SEQ ID NO: 750869 - RNA, 21 nt, Human
uagguauuucuaucaugucuc

SEQ ID NO: 750870 - RNA, 22 nt, Human
acaugaguacagauggauguaa

SEQ ID NO: 750871 - RNA, 20 nt, Human
ccucaggaugagggugagca

SEQ ID NO: 750872 - RNA, 20 nt, Human
cauauggaaagauauuguuc

SEQ ID NO: 750873 - RNA, 22 nt, Human
guccuggggauacagaagugaa

SEQ ID NO: 750874 - RNA, 22 nt, Human
ucuggcagcuauccucuggcca

SEQ ID NO: 750875 - RNA, 22 nt, Human
aaagaauacccugggucauaaa

SEQ ID NO: 750876 - RNA, 22 nt, Human
cagaagagaugaaauaguauua

SEQ ID NO: 750877 - RNA, 22 nt, Human
gaauucugguuuugaaaugaau

SEQ ID NO: 750878 - RNA, 22 nt, Human
acauacauguaaaggaaauuau

SEQ ID NO: 750879 - RNA, 22 nt, Human
cucuagaguacgggcuggcaug

SEQ ID NO: 750880 - RNA, 22 nt, Human
ucacuuuggauuauguaauuuc

SEQ ID NO: 750881 - RNA, 22 nt, Human
gacuguggcaggcucagcacug

SEQ ID NO: 750882 - RNA, 22 nt, Human
acagaauauuguaagugccacu

SEQ ID NO: 750883 - RNA, 22 nt, Human
ccacagcuagggcaaucugauu

SEQ ID NO: 750884 - RNA, 22 nt, Human
acaggccugugugcacacgagg

SEQ ID NO: 750885 - RNA, 22 nt, Human
aaauacauaaagguuguaccag

SEQ ID NO: 750886 - RNA, 19 nt, Human
ucccgcccacugagcgugc

SEQ ID NO: 750887 - RNA, 22 nt, Human
gcucaggccuggcuauccauug

SEQ ID NO: 750888 - RNA, 22 nt, Human
agccuggaguucccaggagaag

SEQ ID NO: 750889 - RNA, 22 nt, Human
uuuacuaacaccauacaugcug

SEQ ID NO: 750890 - RNA, 22 nt, Human
uugacuuuacaguuuucuuagg

SEQ ID NO: 750891 - RNA, 22 nt, Human
acaacaaagacacuugaaauga

SEQ ID NO: 750892 - RNA, 22 nt, Human
uaaagaauagauggguagggag

SEQ ID NO: 750893 - RNA, 22 nt, Human
ugguggcuguugcagaacugag

SEQ ID NO: 750894 - RNA, 22 nt, Human
acagaaagauaggcacaagguc

SEQ ID NO: 750895 - RNA, 22 nt, Human
uaacuuugaagggaauuuuacu

SEQ ID NO: 750896 - RNA, 20 nt, Human
ucuuauacagaaaacauuuu

SEQ ID NO: 750897 - RNA, 21 nt, Human
cugcaaauaccuaguuaucug

SEQ ID NO: 750898 - RNA, 22 nt, Human
agguggguccuggcucugccau

SEQ ID NO: 750899 - RNA, 22 nt, Human
uccaguccauggccucagucuu

SEQ ID NO: 750900 - RNA, 22 nt, Human
acagauguaccuuagugauggg

SEQ ID NO: 750901 - RNA, 22 nt, Human
aucuacucaguaacugcuuagg

SEQ ID NO: 750902 - RNA, 21 nt, Human
ggauaaauggucugguuucuc

SEQ ID NO: 750903 - RNA, 22 nt, Human
uaauucaugggcccagugauau

SEQ ID NO: 750904 - RNA, 22 nt, Human
uaaagacaauuucgagcuguag

SEQ ID NO: 750905 - RNA, 22 nt, Human
cugacaggguagacagagggca

SEQ ID NO: 750906 - RNA, 22 nt, Human
caagaaaucuagaagucagugg

SEQ ID NO: 750907 - RNA, 22 nt, Human
cucacugcaaguuccaccuacc

SEQ ID NO: 750908 - RNA, 22 nt, Human
ggccucuggucaagacaagcau

SEQ ID NO: 750909 - RNA, 22 nt, Human
ucagugucaucacuuaauauaa

SEQ ID NO: 750910 - RNA, 19 nt, Human
ggaaggagagaaaugcaug

SEQ ID NO: 750911 - RNA, 22 nt, Human
uaugucuucgucaccuaucuca

SEQ ID NO: 750912 - RNA, 22 nt, Human
ggcuucccaaggagccaggaug

SEQ ID NO: 750913 - RNA, 18 nt, Human
acuggagcauuagcagcu

SEQ ID NO: 750914 - RNA, 22 nt, Human
gcucuuccauuucucuugaacu

SEQ ID NO: 750915 - RNA, 22 nt, Human
ucagccagcaucagcuaagugc

SEQ ID NO: 750916 - RNA, 22 nt, Human
aucacuguggcccaaaaccuca

SEQ ID NO: 750917 - RNA, 22 nt, Human
auaacucuguuuuuuucaugca

SEQ ID NO: 750918 - RNA, 22 nt, Human
aaucccuuuuucauuuaauaga

SEQ ID NO: 750919 - RNA, 22 nt, Human
uucucucugugucauuauggac

SEQ ID NO: 750920 - RNA, 22 nt, Human
aggugccaccucuggugcuguc

SEQ ID NO: 750921 - RNA, 22 nt, Human
agcugcagauaggauguuauuu

SEQ ID NO: 750922 - RNA, 18 nt, Human
uagaguuacuacaugauu

SEQ ID NO: 750923 - RNA, 22 nt, Human
uuggugugacuaaggcagugug

SEQ ID NO: 750924 - RNA, 22 nt, Human
gcaggagcagucaggggcagcu

SEQ ID NO: 750925 - RNA, 22 nt, Human
guccacucacucuuagucacuc

SEQ ID NO: 750926 - RNA, 22 nt, Human
cauaauuucccaagagauugaa

SEQ ID NO: 750927 - RNA, 22 nt, Human
cuccuguauguugggcuucaca

SEQ ID NO: 750928 - RNA, 23 nt, Human
ugucuuugaaugggcuguagaca

SEQ ID NO: 750929 - RNA, 22 nt, Human
agcaugcuuggcauuugucaga

SEQ ID NO: 750930 - RNA, 22 nt, Human
uauuguucuucacuggucuuau

SEQ ID NO: 750931 - RNA, 21 nt, Human
ucagcuuugcaacugcacauc

SEQ ID NO: 750932 - RNA, 22 nt, Human
ccacagaaagccugggaagugg

SEQ ID NO: 750933 - RNA, 22 nt, Human
uuuuaaaggauacucuugucua

SEQ ID NO: 750934 - RNA, 21 nt, Human
gcauguguggugugcuccaca

SEQ ID NO: 750935 - RNA, 22 nt, Human
ccaggucuuggcccccggaccu

SEQ ID NO: 750936 - RNA, 22 nt, Human
cuggccugagaaugcuacccuu

SEQ ID NO: 750937 - RNA, 22 nt, Human
cuccaggagguugcugcuuccu

SEQ ID NO: 750938 - RNA, 22 nt, Human
aaagcaguaguuuucaaauagu

SEQ ID NO: 750939 - RNA, 22 nt, Human
augcagggauuaaaugacugcc

SEQ ID NO: 750940 - RNA, 22 nt, Human
ugcuuuauaggggauugcaggc

SEQ ID NO: 750941 - RNA, 22 nt, Human
ccacagccauuccagggaggcu

SEQ ID NO: 750942 - RNA, 21 nt, Human
aggaggcugucucuuucagcu

SEQ ID NO: 750943 - RNA, 22 nt, Human
agcagccuggacuuggaugugg

SEQ ID NO: 750944 - RNA, 22 nt, Human
aaaagucuuggggaaggccagg

SEQ ID NO: 750945 - RNA, 22 nt, Human
ugcaggaacuugguuuuacuca

SEQ ID NO: 750946 - RNA, 22 nt, Human
ugcccuggcuccucccacgcug

SEQ ID NO: 750947 - RNA, 22 nt, Human
gcugccaccguggagaugagug

SEQ ID NO: 750948 - RNA, 22 nt, Human
uuugcauuuuagauuuaggccu

SEQ ID NO: 750949 - RNA, 22 nt, Human
cucccucauauacccagcgaga

SEQ ID NO: 750950 - RNA, 22 nt, Human
aaauggcuuugaggguaggaca

SEQ ID NO: 750951 - RNA, 22 nt, Human
uuuacagaugaggaaacugaga

SEQ ID NO: 750952 - RNA, 22 nt, Human
ucaccagaugauuuuucuucag

SEQ ID NO: 750953 - RNA, 22 nt, Human
aagggagaaaacuuguggcuua

SEQ ID NO: 750954 - RNA, 19 nt, Human
auaaggcaauuggauuugg

SEQ ID NO: 750955 - RNA, 22 nt, Human
uucuuacaucaguuuauuuugu

SEQ ID NO: 750956 - RNA, 22 nt, Human
ggagccagagcacuggggagcc

SEQ ID NO: 750957 - RNA, 22 nt, Human
uggaagugccuugcuggcugug

SEQ ID NO: 750958 - RNA, 22 nt, Human
agucauaugacccuucacaaac

SEQ ID NO: 750959 - RNA, 22 nt, Human
gcaccagagggggcucugcagg

SEQ ID NO: 750960 - RNA, 22 nt, Human
uggcucucccaauaccuuucug

SEQ ID NO: 750961 - RNA, 20 nt, Human
agccugccagcuggcccaga

SEQ ID NO: 750962 - RNA, 21 nt, Human
aggaguugagugcacaguugg

SEQ ID NO: 750963 - RNA, 22 nt, Human
gguguggcaguggaccugugaa

SEQ ID NO: 750964 - RNA, 22 nt, Human
aggagaccuucaccacuuccac

SEQ ID NO: 750965 - RNA, 22 nt, Human
auccccuugugggcuggcagca

SEQ ID NO: 750966 - RNA, 19 nt, Human
uuuuuacaaguagguguga

SEQ ID NO: 750967 - RNA, 22 nt, Human
uaugaguuuaaggcuaaaauag

SEQ ID NO: 750968 - RNA, 22 nt, Human
acaaaauuaccuaguuauuuuc

SEQ ID NO: 750969 - RNA, 22 nt, Human
ggcuucuuaaucaugagaguga

SEQ ID NO: 750970 - RNA, 22 nt, Human
ggggugagguuuauguucuggg

SEQ ID NO: 750971 - RNA, 22 nt, Human
aaggcuuguguguucagugagg

SEQ ID NO: 750972 - RNA, 22 nt, Human
auuuccaugaaguuuaguuaua

SEQ ID NO: 750973 - RNA, 22 nt, Human
cugcuuuagugugguguuagag

SEQ ID NO: 750974 - RNA, 22 nt, Human
uucauacauuuuuacuaacagc

SEQ ID NO: 750975 - RNA, 22 nt, Human
augagguauucguaauauuucc

SEQ ID NO: 750976 - RNA, 22 nt, Human
gggcacagaagucuaagacauc

SEQ ID NO: 750977 - RNA, 20 nt, Human
ggugcagguaacgcugugcu

SEQ ID NO: 750978 - RNA, 22 nt, Human
acugggaagauggaggcaagca

SEQ ID NO: 750979 - RNA, 22 nt, Human
ccugugacgugucuccuggcac

SEQ ID NO: 750980 - RNA, 22 nt, Human
augugcuugagggaaaucaguu

SEQ ID NO: 750981 - RNA, 23 nt, Human
uaaagucacauauuagagugagc

SEQ ID NO: 750982 - RNA, 22 nt, Human
cuugcuucugcugcacuauccu

SEQ ID NO: 750983 - RNA, 22 nt, Human
auaacagaauaagucauuaccg

SEQ ID NO: 750984 - RNA, 22 nt, Human
acagugcucaugugacauggug

SEQ ID NO: 750985 - RNA, 22 nt, Human
uugagaggauggauuagacaaa

SEQ ID NO: 750986 - RNA, 22 nt, Human
uggcuuggugagcagaguguag

SEQ ID NO: 750987 - RNA, 22 nt, Human
cggaagagggacagcgccagcc

SEQ ID NO: 750988 - RNA, 22 nt, Human
acacuguucuuugcacugagaa

SEQ ID NO: 750989 - RNA, 22 nt, Human
gcugucgugugcaagugacaga

SEQ ID NO: 750990 - RNA, 22 nt, Human
gaggggggcgcccugcagugca

SEQ ID NO: 750991 - RNA, 22 nt, Human
uccaggcccgagaugggcugga

SEQ ID NO: 750992 - RNA, 22 nt, Human
agguggggaggagugucucuuu

SEQ ID NO: 750993 - RNA, 22 nt, Human
cagcugccaagaaucuuuucua

SEQ ID NO: 750994 - RNA, 22 nt, Human
aaccuguaaauccaaacaaucu

SEQ ID NO: 750995 - RNA, 22 nt, Human
guacacauauuuccaaggguaa

SEQ ID NO: 750996 - RNA, 23 nt, Human
caucuagcauccagugaguagug

SEQ ID NO: 750997 - RNA, 22 nt, Human
agcucagggcuccaggaccgcu

SEQ ID NO: 750998 - RNA, 19 nt, Human
uacauccucuuccucuuug

SEQ ID NO: 750999 - RNA, 20 nt, Human
cugggcucgguggcccuggc

SEQ ID NO: 751000 - RNA, 22 nt, Human
uaacagaauccuguuauugcca

SEQ ID NO: 751001 - RNA, 22 nt, Human
ucagggcauacucuucaagguc

SEQ ID NO: 751002 - RNA, 22 nt, Human
auguuucaaugcacuuuagccu

SEQ ID NO: 751003 - RNA, 20 nt, Human
aauagcugagggcaagagua

SEQ ID NO: 751004 - RNA, 22 nt, Human
cucaggcacgggucagugagcg

SEQ ID NO: 751005 - RNA, 22 nt, Human
ucaggaggcggugcugccuuug

SEQ ID NO: 751006 - RNA, 22 nt, Human
aacccaggaguuggaggcugug

SEQ ID NO: 751007 - RNA, 22 nt, Human
ucuccucuacugggucugcaga

SEQ ID NO: 751008 - RNA, 21 nt, Human
agaauucuuaaguauucuaau

SEQ ID NO: 751009 - RNA, 22 nt, Human
agaagccaaaugccagugaccu

SEQ ID NO: 751010 - RNA, 22 nt, Human
ugggcacauaguuuuaugguca

SEQ ID NO: 751011 - RNA, 22 nt, Human
aaucuuaagcugaauucucucc

SEQ ID NO: 751012 - RNA, 22 nt, Human
ugccuggcucuaucaguggugg

SEQ ID NO: 751013 - RNA, 22 nt, Human
gcuggugugugaaccuagggac

SEQ ID NO: 751014 - RNA, 22 nt, Human
ucugagggcuugaggggaagua

SEQ ID NO: 751015 - RNA, 22 nt, Human
uucugauaccuugcaggauccu

SEQ ID NO: 751016 - RNA, 22 nt, Human
aaagcaaugaugguagacacgu

SEQ ID NO: 751017 - RNA, 19 nt, Human
cucucacucgccacauccu

SEQ ID NO: 751018 - RNA, 22 nt, Human
cauuaagauuuuuuucuacugg

SEQ ID NO: 751019 - RNA, 22 nt, Human
acuguacacacuucucugucuu

SEQ ID NO: 751020 - RNA, 22 nt, Human
cgcagcagccccgugguaggug

SEQ ID NO: 751021 - RNA, 22 nt, Human
ucuaaacuuguaaacaagcaua

SEQ ID NO: 751022 - RNA, 22 nt, Human
augugcuucauucuacaugaca

SEQ ID NO: 751023 - RNA, 22 nt, Human
ugcuaucucuauauccauuuau

SEQ ID NO: 751024 - RNA, 22 nt, Human
ugggaccucucuugagagagca

SEQ ID NO: 751025 - RNA, 22 nt, Human
auacaauuauucugcagauauu

SEQ ID NO: 751026 - RNA, 22 nt, Human
aacaugaagguaggaugguuuu

SEQ ID NO: 751027 - RNA, 22 nt, Human
ugcugccuuucaauguugucau

SEQ ID NO: 751028 - RNA, 20 nt, Human
aaacauaguggauaccacag

SEQ ID NO: 751029 - RNA, 22 nt, Human
acaaggcauuccggaaguaacc

SEQ ID NO: 751030 - RNA, 22 nt, Human
uccuugagaggacagagccaua

SEQ ID NO: 751031 - RNA, 22 nt, Human
uuugcagugucagcuucugugu

SEQ ID NO: 751032 - RNA, 22 nt, Human
uccaggcagucauuaaucucua

SEQ ID NO: 751033 - RNA, 22 nt, Human
uggccuggaaccuggcagggac

SEQ ID NO: 751034 - RNA, 22 nt, Human
gugccaucauucaauaaauuca

SEQ ID NO: 751035 - RNA, 23 nt, Human
gcagagguuuuucaguaugguuu

SEQ ID NO: 751036 - RNA, 22 nt, Human
agccucucuuucugguggcuaa

SEQ ID NO: 751037 - RNA, 22 nt, Human
ggcacacagauggagcacuagc

SEQ ID NO: 751038 - RNA, 22 nt, Human
gucccagggcaaggcuguuucu

SEQ ID NO: 751039 - RNA, 22 nt, Human
uguuuacagcugaucaggcauc

SEQ ID NO: 751040 - RNA, 20 nt, Human
gaaauguacacauuaccaca

SEQ ID NO: 751041 - RNA, 22 nt, Human
aggcaguguauugcuagcggcu

SEQ ID NO: 751042 - RNA, 22 nt, Human
ucauuuaauagcuuuugucuuu

SEQ ID NO: 751043 - RNA, 22 nt, Human
uccccaggaguuuuacuuugca

SEQ ID NO: 751044 - RNA, 22 nt, Human
ucaaugacugguccaagguggc

SEQ ID NO: 751045 - RNA, 22 nt, Human
uggaguggacuucaugaggcca

SEQ ID NO: 751046 - RNA, 21 nt, Human
accagcaggagaucagaagga

SEQ ID NO: 751047 - RNA, 22 nt, Human
gucuccagauauccuacacaac

SEQ ID NO: 751048 - RNA, 22 nt, Human
uggaaacuaggauggaagaaau

SEQ ID NO: 751049 - RNA, 22 nt, Human
uauugcugaugcugaagggaag

SEQ ID NO: 751050 - RNA, 22 nt, Human
uuauuuccaguccagaaauuua

SEQ ID NO: 751051 - RNA, 22 nt, Human
aacaucuucagagaagcuaagu

SEQ ID NO: 751052 - RNA, 22 nt, Human
uuagcaaaaauaucucauauua

SEQ ID NO: 751053 - RNA, 22 nt, Human
uaugccuggggugcucaggcca

SEQ ID NO: 751054 - RNA, 22 nt, Human
gaguguccgugcagccccagac

SEQ ID NO: 751055 - RNA, 22 nt, Human
gcaguacuuuaagggaugaagc

SEQ ID NO: 751056 - RNA, 22 nt, Human
ggcucagcuuggugcgcagaaa

SEQ ID NO: 751057 - RNA, 22 nt, Human
ugacagaaagaauaugucaauc

SEQ ID NO: 751058 - RNA, 22 nt, Human
aguucagaggcaggagaaggcu

SEQ ID NO: 751059 - RNA, 22 nt, Human
gccuucaggugcugccaggcua

SEQ ID NO: 751060 - RNA, 22 nt, Human
guuuacaaauauuuuaaauggu

SEQ ID NO: 751061 - RNA, 22 nt, Human
aggagccaugagugacaucaca

SEQ ID NO: 751062 - RNA, 22 nt, Human
cagcuuuaguaacccacugcuc

SEQ ID NO: 751063 - RNA, 22 nt, Human
aaccugaauuuaauugaaauga

SEQ ID NO: 751064 - RNA, 22 nt, Human
ccugccacuucuugcuauggag

SEQ ID NO: 751065 - RNA, 19 nt, Human
aaggacacaacagagauag

SEQ ID NO: 751066 - RNA, 22 nt, Human
gaaaccugagugcagaucagga

SEQ ID NO: 751067 - RNA, 22 nt, Human
uuuaggcagaacauggacuuug

SEQ ID NO: 751068 - RNA, 22 nt, Human
cuggagggcuucugcagguuac

SEQ ID NO: 751069 - RNA, 22 nt, Human
ucugggugucacuccugccugc

SEQ ID NO: 751070 - RNA, 22 nt, Human
guacauuucaguuuccuuaaga

SEQ ID NO: 751071 - RNA, 22 nt, Human
ucugucugccuugugagggcac

SEQ ID NO: 751072 - RNA, 23 nt, Human
aucugaaaaggcauuuucuuccc

SEQ ID NO: 751073 - RNA, 22 nt, Human
uggcagagaacacacaugauuc

SEQ ID NO: 751074 - RNA, 22 nt, Human
uuucuuccaaaggcacguucuc

SEQ ID NO: 751075 - RNA, 22 nt, Human
ggccugagucacaucaggagag

SEQ ID NO: 751076 - RNA, 22 nt, Human
uugaaaugagacuaauugauug

SEQ ID NO: 751077 - RNA, 17 nt, Human
ccuggcugggaaucuga

SEQ ID NO: 751078 - RNA, 22 nt, Human
cccuuuggguuccccaagccug

SEQ ID NO: 751079 - RNA, 22 nt, Human
gucugaauucuguguaacucua

SEQ ID NO: 751080 - RNA, 22 nt, Human
cuuucuuaauuuuuaaggacac

SEQ ID NO: 751081 - RNA, 22 nt, Human
aauacuguaugagcuaugguag

SEQ ID NO: 751082 - RNA, 22 nt, Human
gaggcaagagaagccagcuuuc

SEQ ID NO: 751083 - RNA, 22 nt, Human
uuguuuucuccacugcaucuua

SEQ ID NO: 751084 - RNA, 22 nt, Human
ccaguguuagagacugauacag

SEQ ID NO: 751085 - RNA, 22 nt, Human
gcuaggaaucggacccaggaag

SEQ ID NO: 751086 - RNA, 22 nt, Human
aagaaaacaugaucuaauuuaa

SEQ ID NO: 751087 - RNA, 20 nt, Human
ucagugcucaggcaccaggu

SEQ ID NO: 751088 - RNA, 22 nt, Human
aggacccaagcacaguuccugg

SEQ ID NO: 751089 - RNA, 22 nt, Human
aaagcaauuacaaaagggauaa

SEQ ID NO: 751090 - RNA, 22 nt, Human
uccagguacucauuggcuguua

SEQ ID NO: 751091 - RNA, 19 nt, Human
ucauuuacgguuuugauga

SEQ ID NO: 751092 - RNA, 22 nt, Human
ugggcagagucauacaggagac

SEQ ID NO: 751093 - RNA, 22 nt, Human
ucuagguuagaacccagaaaag

SEQ ID NO: 751094 - RNA, 22 nt, Human
aguuuccacuggagacacugug

SEQ ID NO: 751095 - RNA, 22 nt, Human
agucacagaaugauggcuccag

SEQ ID NO: 751096 - RNA, 22 nt, Human
aagcugucaauguaucuagucu

SEQ ID NO: 751097 - RNA, 22 nt, Human
cuuccucccggcccaugcucug

SEQ ID NO: 751098 - RNA, 22 nt, Human
aggaauguuaagaaggucuacc

SEQ ID NO: 751099 - RNA, 22 nt, Human
gauucauaccguuucuucucca

SEQ ID NO: 751100 - RNA, 22 nt, Human
auauucacugagcauaaagcca

SEQ ID NO: 751101 - RNA, 17 nt, Human
ccaggcuccaucacugu

SEQ ID NO: 751102 - RNA, 22 nt, Human
accaggaacucacccgcagagg

SEQ ID NO: 751103 - RNA, 22 nt, Human
uuccugugaagccgguggucuc

SEQ ID NO: 751104 - RNA, 22 nt, Human
aacaucuacuaagugccaggca

SEQ ID NO: 751105 - RNA, 22 nt, Human
guacaaaguggaccugauagua

SEQ ID NO: 751106 - RNA, 22 nt, Human
uuaguuuucucaucuaucucac

SEQ ID NO: 751107 - RNA, 22 nt, Human
gccacagucaggacggggagag

SEQ ID NO: 751108 - RNA, 22 nt, Human
ccugggcuugcaucugugcugg

SEQ ID NO: 751109 - RNA, 22 nt, Human
cuguggaaggccuguccugaaa

SEQ ID NO: 751110 - RNA, 22 nt, Human
aggagcugcaaauauuaguaau

SEQ ID NO: 751111 - RNA, 22 nt, Human
ggcaugugccugaggucacaca

SEQ ID NO: 751112 - RNA, 22 nt, Human
uguccugggaggcgggguccag

SEQ ID NO: 751113 - RNA, 22 nt, Human
uacauccaaaugaauuagaauu

SEQ ID NO: 751114 - RNA, 22 nt, Human
uuacagagauaaacuguaagug

SEQ ID NO: 751115 - RNA, 22 nt, Human
uuacaaugaugggauucagcca

SEQ ID NO: 751116 - RNA, 18 nt, Human
agcucacagaucuguuuu

SEQ ID NO: 751117 - RNA, 22 nt, Human
gccucagagggcagggugguga

SEQ ID NO: 751118 - RNA, 22 nt, Human
ggggaggccaguggaccguccc

SEQ ID NO: 751119 - RNA, 22 nt, Human
cuugggcucugugggccuuagu

SEQ ID NO: 751120 - RNA, 23 nt, Human
auugaccagcugucucauuuuca

SEQ ID NO: 751121 - RNA, 22 nt, Human
gcauggcuauucuaacucacau

SEQ ID NO: 751122 - RNA, 22 nt, Human
aagccauggcaugccaggauca

SEQ ID NO: 751123 - RNA, 22 nt, Human
ugcccuggggucuggagcagca

SEQ ID NO: 751124 - RNA, 22 nt, Human
cagaucauaacagauacauaga

SEQ ID NO: 751125 - RNA, 22 nt, Human
aaacuacuaugggaauguacuu

SEQ ID NO: 751126 - RNA, 22 nt, Human
gaacugaagacuuuuacuguac

SEQ ID NO: 751127 - RNA, 22 nt, Human
ugcccucagaauugcucccugc

SEQ ID NO: 751128 - RNA, 22 nt, Human
aguuaucagguguuuucaugga

SEQ ID NO: 751129 - RNA, 22 nt, Human
auuagugucauguugaggacuu

SEQ ID NO: 751130 - RNA, 22 nt, Human
aagggugcaaagcacucuagcu

SEQ ID NO: 751131 - RNA, 22 nt, Human
ccaaaaaguacauuuaggugug

SEQ ID NO: 751132 - RNA, 20 nt, Human
agcccuguaaauccccugga

SEQ ID NO: 751133 - RNA, 22 nt, Human
cugggaagaauccaagggcccu

SEQ ID NO: 751134 - RNA, 22 nt, Human
agcagcagggugauagugccca

SEQ ID NO: 751135 - RNA, 22 nt, Human
cacagguguccaauaccugcuu

SEQ ID NO: 751136 - RNA, 22 nt, Human
uuaguagaauguuauagcaauu

SEQ ID NO: 751137 - RNA, 22 nt, Human
ucccagggugcgccugcccucg

SEQ ID NO: 751138 - RNA, 22 nt, Human
uacaaaacagugcucugguccu

SEQ ID NO: 751139 - RNA, 22 nt, Human
gaaacuucuugucucacaguuc

SEQ ID NO: 751140 - RNA, 22 nt, Human
aggaaaauuaucaugagagcca

SEQ ID NO: 751141 - RNA, 22 nt, Human
uccagggcauggggagagagug

SEQ ID NO: 751142 - RNA, 22 nt, Human
ggcagaagaaaggcuaagucuc

SEQ ID NO: 751143 - RNA, 22 nt, Human
uggucagguaccucuggcuguc

SEQ ID NO: 751144 - RNA, 22 nt, Human
agcuccugugugcccaccugcu

SEQ ID NO: 751145 - RNA, 22 nt, Human
ggucagcagugcagggcagagc

SEQ ID NO: 751146 - RNA, 22 nt, Human
ugcuucuggggacaggcugccu

SEQ ID NO: 751147 - RNA, 22 nt, Human
gaagccagauuaucacaagcca

SEQ ID NO: 751148 - RNA, 22 nt, Human
agaaguaguccaguggaaagua

SEQ ID NO: 751149 - RNA, 22 nt, Human
agcaaugcuuauugcugacuau

SEQ ID NO: 751150 - RNA, 22 nt, Human
caaggcaaucucauggcuucuu

SEQ ID NO: 751151 - RNA, 22 nt, Human
gcuuccugauauucauacuguu

SEQ ID NO: 751152 - RNA, 22 nt, Human
aguuugaauugaaaugcagaug

SEQ ID NO: 751153 - RNA, 22 nt, Human
gggagagaaauuauagcaauga

SEQ ID NO: 751154 - RNA, 22 nt, Human
gauagucaccucccuuaacuuu

SEQ ID NO: 751155 - RNA, 22 nt, Human
cuuccucaggcauuagcuggac

SEQ ID NO: 751156 - RNA, 22 nt, Human
gcucugugccccugccguggac

SEQ ID NO: 751157 - RNA, 22 nt, Human
uuauucagcauuuagaggaagg

SEQ ID NO: 751158 - RNA, 21 nt, Human
ucuuucugaaaucucagucug

SEQ ID NO: 751159 - RNA, 22 nt, Human
acaguuuauugcacagguaacc

SEQ ID NO: 751160 - RNA, 22 nt, Human
cucugggguuaagcuuccaugg

SEQ ID NO: 751161 - RNA, 22 nt, Human
uuggaucaaauuucaugcuguc

SEQ ID NO: 751162 - RNA, 20 nt, Human
uauuuugcaauuaugguuca

SEQ ID NO: 751163 - RNA, 19 nt, Human
gcaggcaguggcauucgga

SEQ ID NO: 751164 - RNA, 23 nt, Human
cucucucuaccaugugaggacac

SEQ ID NO: 751165 - RNA, 22 nt, Human
ccagguacauggagaagaacag

SEQ ID NO: 751166 - RNA, 22 nt, Human
cuguuaauucuagauggugagu

SEQ ID NO: 751167 - RNA, 22 nt, Human
uuugcauuucuaaugagcuccg

SEQ ID NO: 751168 - RNA, 22 nt, Human
aacagcagcuuucaggaucauc

SEQ ID NO: 751169 - RNA, 22 nt, Human
caaggcagcguuccuuucugga

SEQ ID NO: 751170 - RNA, 22 nt, Human
ggggggcuguucuggacaggaa

SEQ ID NO: 751171 - RNA, 23 nt, Human
aguuucacauuuuacauguggcu

SEQ ID NO: 751172 - RNA, 22 nt, Human
uucugagaaauggguucacaua

SEQ ID NO: 751173 - RNA, 22 nt, Human
cuccuuugaucccaaaugaccc

SEQ ID NO: 751174 - RNA, 22 nt, Human
aaguauauuuuuugaagcauau

SEQ ID NO: 751175 - RNA, 22 nt, Human
auguguaggugaaucgaggcug

SEQ ID NO: 751176 - RNA, 22 nt, Human
cacaacuuuaggaaccacauuc

SEQ ID NO: 751177 - RNA, 22 nt, Human
uguauucuuaguuuuaaucaga

SEQ ID NO: 751178 - RNA, 22 nt, Human
ucucagugguggcauuccagac

SEQ ID NO: 751179 - RNA, 21 nt, Human
gagcaucuccuuccuccugcu

SEQ ID NO: 751180 - RNA, 22 nt, Human
ugagcaucuucgugaaagcuuc

SEQ ID NO: 751181 - RNA, 22 nt, Human
aucugcauuuacauugcuugua

SEQ ID NO: 751182 - RNA, 21 nt, Human
cagggcuagagagaaugacaa

SEQ ID NO: 751183 - RNA, 22 nt, Human
cugugacuuccacuacugauca

SEQ ID NO: 751184 - RNA, 22 nt, Human
agguuccagguucgaaucccau

SEQ ID NO: 751185 - RNA, 22 nt, Human
aguuuucuguucuacaauuuga

SEQ ID NO: 751186 - RNA, 22 nt, Human
uggucaaaaaggccuagacaca

SEQ ID NO: 751187 - RNA, 22 nt, Human
gcccugcugcuggcagaggcgc

SEQ ID NO: 751188 - RNA, 22 nt, Human
gaggggcaaugagggaaagagu

SEQ ID NO: 751189 - RNA, 22 nt, Human
aagguuuuuuuccaguaucucu

SEQ ID NO: 751190 - RNA, 22 nt, Human
ucacagaaggagggaagcuagu

SEQ ID NO: 751191 - RNA, 22 nt, Human
cugccuggucucaggcaugggg

SEQ ID NO: 751192 - RNA, 22 nt, Human
agugggagagaagcaaguagua

SEQ ID NO: 751193 - RNA, 22 nt, Human
agccagggaggauuacacccca

SEQ ID NO: 751194 - RNA, 22 nt, Human
uugcacagaugcacaugguugc

SEQ ID NO: 751195 - RNA, 22 nt, Human
ggaggaaaggcucccucccucu

SEQ ID NO: 751196 - RNA, 22 nt, Human
cucagggcaguauggcugagag

SEQ ID NO: 751197 - RNA, 22 nt, Human
uagacaaucucagcaaacacac

SEQ ID NO: 751198 - RNA, 21 nt, Human
aauccuuaaugaggaguuggu

SEQ ID NO: 751199 - RNA, 22 nt, Human
agcugcucaggagagccagguc

SEQ ID NO: 751200 - RNA, 22 nt, Human
gcugggccagacuuucaauguc

SEQ ID NO: 751201 - RNA, 22 nt, Human
gcauccucccggugcugcuggc

SEQ ID NO: 751202 - RNA, 22 nt, Human
uggaccagggucccagaguaug

SEQ ID NO: 751203 - RNA, 22 nt, Human
ucccagccuccugacaguuuug

SEQ ID NO: 751204 - RNA, 22 nt, Human
uucaauucugaugaaggcaaua

SEQ ID NO: 751205 - RNA, 22 nt, Human
agcagcaagcagugcacggguu

SEQ ID NO: 751206 - RNA, 22 nt, Human
aguuuccaaauauuguuuuagc

SEQ ID NO: 751207 - RNA, 22 nt, Human
ugcccaagguggccuuuuacuc

SEQ ID NO: 751208 - RNA, 22 nt, Human
uucuccugaguucccaggucua

SEQ ID NO: 751209 - RNA, 22 nt, Human
agcaacauuuuucaauuaacau

SEQ ID NO: 751210 - RNA, 22 nt, Human
uggaggccacaugaacgcugcg

SEQ ID NO: 751211 - RNA, 21 nt, Human
ugguccuucuuuacugccucc

SEQ ID NO: 751212 - RNA, 22 nt, Human
acccaggccugagagacaggag

SEQ ID NO: 751213 - RNA, 22 nt, Human
uuugucuuaaaucuuguuacug

SEQ ID NO: 751214 - RNA, 22 nt, Human
uguucagaacaaagguaaauga

SEQ ID NO: 751215 - RNA, 22 nt, Human
cucuuugaaauccaucacugcu

SEQ ID NO: 751216 - RNA, 22 nt, Human
ggcaagaguugaagcuccagga

SEQ ID NO: 751217 - RNA, 22 nt, Human
agaugggcgcgcugcucugaug

SEQ ID NO: 751218 - RNA, 22 nt, Human
caccagcugcaacaccaucucc

SEQ ID NO: 751219 - RNA, 22 nt, Human
uccugcagacauuuacaccuuu

SEQ ID NO: 751220 - RNA, 17 nt, Human
uggggaagcucagauuu

SEQ ID NO: 751221 - RNA, 22 nt, Human
gggugguggcggaggcuccagg

SEQ ID NO: 751222 - RNA, 22 nt, Human
ucauugaauacauauuugggau

SEQ ID NO: 751223 - RNA, 22 nt, Human
uucugggaggcuggcugucaua

SEQ ID NO: 751224 - RNA, 22 nt, Human
uuuagagcccaugugaguguga

SEQ ID NO: 751225 - RNA, 22 nt, Human
gucagcuaauaggguguguguc

SEQ ID NO: 751226 - RNA, 22 nt, Human
ugcagagaccacugugccuucc

SEQ ID NO: 751227 - RNA, 22 nt, Human
ucucugugcaggaugcugaguu

SEQ ID NO: 751228 - RNA, 22 nt, Human
cgaggccaauguguuuuaugaa

SEQ ID NO: 751229 - RNA, 22 nt, Human
cuucuucaaccugaaaguuuca

SEQ ID NO: 751230 - RNA, 22 nt, Human
ucaguuuuuaaaugauauaauu

SEQ ID NO: 751231 - RNA, 22 nt, Human
auugcugaaaguauuuuaugac

SEQ ID NO: 751232 - RNA, 22 nt, Human
gcuauacacauuucuugguagu

SEQ ID NO: 751233 - RNA, 22 nt, Human
ucuggcucaucucuccagguaa

SEQ ID NO: 751234 - RNA, 22 nt, Human
cucagucucuugggcugugaag

SEQ ID NO: 751235 - RNA, 22 nt, Human
uucaguucacauguaucauggc

SEQ ID NO: 751236 - RNA, 22 nt, Human
agaucaguuagauagcuugaug

SEQ ID NO: 751237 - RNA, 22 nt, Human
agcccucaggcuuugcugggcc

SEQ ID NO: 751238 - RNA, 22 nt, Human
acaagauguguuuauacaagcu

SEQ ID NO: 751239 - RNA, 22 nt, Human
aucuuaugagacccauaaagau

SEQ ID NO: 751240 - RNA, 22 nt, Human
acuguuaacgguaugaugcucg

SEQ ID NO: 751241 - RNA, 22 nt, Human
agaccucuggauagaugugagg

SEQ ID NO: 751242 - RNA, 22 nt, Human
uuccaaggccagacagggcagu

SEQ ID NO: 751243 - RNA, 22 nt, Human
acagggcuuguugaaagcggag

SEQ ID NO: 751244 - RNA, 18 nt, Human
aguuuuuaggaagaaaug

SEQ ID NO: 751245 - RNA, 22 nt, Human
uggagaagcuguagguggacuc

SEQ ID NO: 751246 - RNA, 22 nt, Human
aaauuacuuuacacuuucaucu

SEQ ID NO: 751247 - RNA, 19 nt, Human
uuacaauggugauuagguu

SEQ ID NO: 751248 - RNA, 22 nt, Human
cugagcugcggcaggcaccugg

SEQ ID NO: 751249 - RNA, 22 nt, Human
gugcccugacacaccuggugug

SEQ ID NO: 751250 - RNA, 22 nt, Human
ggaccugaacauaaaacgaggc

SEQ ID NO: 751251 - RNA, 22 nt, Human
acauuucuccuacuuguuauuu

SEQ ID NO: 751252 - RNA, 22 nt, Human
gcgcgcuaccgccagggcugca

SEQ ID NO: 751253 - RNA, 22 nt, Human
ucaugcagguuuccagccagau

SEQ ID NO: 751254 - RNA, 22 nt, Human
ugucucaggggcauugaaauaa

SEQ ID NO: 751255 - RNA, 21 nt, Human
agcuguuugaagcuauauugg

SEQ ID NO: 751256 - RNA, 22 nt, Human
caguaguaguuaaacuguguau

SEQ ID NO: 751257 - RNA, 22 nt, Human
cugcagggcuuaccuugcucug

SEQ ID NO: 751258 - RNA, 22 nt, Human
auauuagguuggugcaaaagua

SEQ ID NO: 751259 - RNA, 22 nt, Human
aaagcacuauagccaaauagcc

SEQ ID NO: 751260 - RNA, 22 nt, Human
ucucucuucaugcuuuuagaau

SEQ ID NO: 751261 - RNA, 22 nt, Human
aacugagggcccugcugaagca

SEQ ID NO: 751262 - RNA, 22 nt, Human
gccaagcucaccuucugaugga

SEQ ID NO: 751263 - RNA, 22 nt, Human
cccaagggugcccagcagagga

SEQ ID NO: 751264 - RNA, 20 nt, Human
agggucugaugugguggccc

SEQ ID NO: 751265 - RNA, 22 nt, Human
gcugugagggucuagugaggug

SEQ ID NO: 751266 - RNA, 22 nt, Human
agcacaguuucuuuuccuuguc

SEQ ID NO: 751267 - RNA, 22 nt, Human
ggcuguaguuaccugaugaaau

SEQ ID NO: 751268 - RNA, 22 nt, Human
uguccucaggaccuggcacagu

SEQ ID NO: 751269 - RNA, 22 nt, Human
agggaucacgguggacuuggau

SEQ ID NO: 751270 - RNA, 22 nt, Human
uugcuuuaccugugguauauuu

SEQ ID NO: 751271 - RNA, 22 nt, Human
gggcugagggccaauuccuacu

SEQ ID NO: 751272 - RNA, 19 nt, Human
accuuuccuuucucagaug

SEQ ID NO: 751273 - RNA, 22 nt, Human
uuaucuacguauuuaaacucuu

SEQ ID NO: 751274 - RNA, 22 nt, Human
uggaaagucucuuuugacugua

SEQ ID NO: 751275 - RNA, 22 nt, Human
aacaggagaggggaauguagag

SEQ ID NO: 751276 - RNA, 22 nt, Human
gaugcugaagugaagugaucuu

SEQ ID NO: 751277 - RNA, 22 nt, Human
ucugggcagcagcagcuaguag

SEQ ID NO: 751278 - RNA, 22 nt, Human
uugcugccuugucucagggucu

SEQ ID NO: 751279 - RNA, 22 nt, Human
auaugaaaguaagcaugugugu

SEQ ID NO: 751280 - RNA, 22 nt, Human
aacuuuacuugaaagaacaugu

SEQ ID NO: 751281 - RNA, 22 nt, Human
auuuuccagccuuucuagaacu

SEQ ID NO: 751282 - RNA, 22 nt, Human
aggcagacuuccugcuuggauc

SEQ ID NO: 751283 - RNA, 22 nt, Human
uagaaagcuggaggaauucuuu

SEQ ID NO: 751284 - RNA, 22 nt, Human
gguuugacagcuuggggcuguc

SEQ ID NO: 751285 - RNA, 22 nt, Human
ucagcuuucuauguugcuaaac

SEQ ID NO: 751286 - RNA, 22 nt, Human
ggucucagacuggcaggcagug

SEQ ID NO: 751287 - RNA, 22 nt, Human
cuacagaaaccuuuuucauaca

SEQ ID NO: 751288 - RNA, 22 nt, Human
uacugaaagacugaauauuuag

SEQ ID NO: 751289 - RNA, 22 nt, Human
ccauggccucgcucuacguggg

SEQ ID NO: 751290 - RNA, 22 nt, Human
ucugaggcccaguucaacucuu

SEQ ID NO: 751291 - RNA, 20 nt, Human
ugcugggcaugcaguggaaa

SEQ ID NO: 751292 - RNA, 22 nt, Human
ucucuggcagaggcccuauccc

SEQ ID NO: 751293 - RNA, 22 nt, Human
aaauguguuucgaaaacuggug

SEQ ID NO: 751294 - RNA, 22 nt, Human
agcaggaccaagaaggggaaaa

SEQ ID NO: 751295 - RNA, 22 nt, Human
uuuaucacagaauaagaaguca

SEQ ID NO: 751296 - RNA, 18 nt, Human
gaugucucgaggagacua

SEQ ID NO: 751297 - RNA, 22 nt, Human
gcaggcaggaaggacuaaguaa

SEQ ID NO: 751298 - RNA, 17 nt, Human
agcaggcacgucagcac

SEQ ID NO: 751299 - RNA, 22 nt, Human
auucauagcucaguacagacuc

SEQ ID NO: 751300 - RNA, 22 nt, Human
accauccaaacugcuuucugug

SEQ ID NO: 751301 - RNA, 22 nt, Human
aucaggaaauacuuauuuauaa

SEQ ID NO: 751302 - RNA, 22 nt, Human
uccagcccgacugggccugccg

SEQ ID NO: 751303 - RNA, 22 nt, Human
aggaauaaccucauugcuuuuu

SEQ ID NO: 751304 - RNA, 22 nt, Human
ugccauauuauugagcauauua

SEQ ID NO: 751305 - RNA, 22 nt, Human
aguuucacagaauaugaagguu

SEQ ID NO: 751306 - RNA, 22 nt, Human
uuacacaucuagacccauuuuu

SEQ ID NO: 751307 - RNA, 22 nt, Human
gaugaggaauuugagguuagaa

SEQ ID NO: 751308 - RNA, 22 nt, Human
uguaugaaaaggaauagauuga

SEQ ID NO: 751309 - RNA, 22 nt, Human
ccagggugaccagcuggccuag

SEQ ID NO: 751310 - RNA, 21 nt, Human
ccagagccugcugagcccccu

SEQ ID NO: 751311 - RNA, 22 nt, Human
gacuacaggugugugccaccau

SEQ ID NO: 751312 - RNA, 22 nt, Human
accaggcccgcugcuauggugg

SEQ ID NO: 751313 - RNA, 22 nt, Human
agaucagaaauguaauggcagu

SEQ ID NO: 751314 - RNA, 22 nt, Human
caugcuccaaaaacaagagaau

SEQ ID NO: 751315 - RNA, 22 nt, Human
aggcccuggcuggguuucuuua

SEQ ID NO: 751316 - RNA, 22 nt, Human
augccaauaaauguuaauaucu

SEQ ID NO: 751317 - RNA, 22 nt, Human
uugcauaaaagaguauaucuua

SEQ ID NO: 751318 - RNA, 22 nt, Human
ggcagggaaacagcugauccca

SEQ ID NO: 751319 - RNA, 22 nt, Human
aaaugaaaugagugccuggagg

SEQ ID NO: 751320 - RNA, 22 nt, Human
uaaagaauaauacccauggagc

SEQ ID NO: 751321 - RNA, 22 nt, Human
gucucugcucuagagucuguga

SEQ ID NO: 751322 - RNA, 22 nt, Human
uuuuaaguuaauauaauugagg

SEQ ID NO: 751323 - RNA, 22 nt, Human
caggccucccggugcacacuga

SEQ ID NO: 751324 - RNA, 22 nt, Human
ugacccauggucugaucauagg

SEQ ID NO: 751325 - RNA, 22 nt, Human
acagaguacagacaaaggucag

SEQ ID NO: 751326 - RNA, 21 nt, Human
aggggcccuugccaggacgcc

SEQ ID NO: 751327 - RNA, 22 nt, Human
uauggguaucaaugacaaacau

SEQ ID NO: 751328 - RNA, 22 nt, Human
ugcccacugugucaaagaaaua

SEQ ID NO: 751329 - RNA, 22 nt, Human
auuugaaugcagguagcugagu

SEQ ID NO: 751330 - RNA, 22 nt, Human
cggccaagccggggccccgaag

SEQ ID NO: 751331 - RNA, 22 nt, Human
auuugcuggugaauguauagcu

SEQ ID NO: 751332 - RNA, 22 nt, Human
uucuuaagcguaugauaaugaa

SEQ ID NO: 751333 - RNA, 22 nt, Human
uucagagggacauucaagggaa

SEQ ID NO: 751334 - RNA, 22 nt, Human
uacaugcuuaaaaugcaauguu

SEQ ID NO: 751335 - RNA, 22 nt, Human
cucugcuuuuuagggagccuag

SEQ ID NO: 751336 - RNA, 22 nt, Human
ugcccccugguggccagagccg

SEQ ID NO: 751337 - RNA, 22 nt, Human
uaaacaugugagugugcauaua

SEQ ID NO: 751338 - RNA, 22 nt, Human
auggcuggaggccgggcuuccu

SEQ ID NO: 751339 - RNA, 22 nt, Human
gagagggcuggaaacuuccugg

SEQ ID NO: 751340 - RNA, 22 nt, Human
ccaagcuacuuaggagucugag

SEQ ID NO: 751341 - RNA, 22 nt, Human
acaguaaugcauacaaguuagu

SEQ ID NO: 751342 - RNA, 22 nt, Human
uuccaauuuguggugaguuaau

SEQ ID NO: 751343 - RNA, 18 nt, Human
gcagagcaucaaggguua

SEQ ID NO: 751344 - RNA, 22 nt, Human
cuggugccauucuguggccuag

SEQ ID NO: 751345 - RNA, 22 nt, Human
caggcucggaagugcuggcuuu

SEQ ID NO: 751346 - RNA, 22 nt, Human
cugagcagcaauugcuggccca

SEQ ID NO: 751347 - RNA, 22 nt, Human
cugucuuuuacuaucauuuacu

SEQ ID NO: 751348 - RNA, 22 nt, Human
uggcuaagcaugcuccagcugc

SEQ ID NO: 751349 - RNA, 22 nt, Human
uuucacaaacugaggagacaau

SEQ ID NO: 751350 - RNA, 22 nt, Human
uccuguuuuuguaaucgacucu

SEQ ID NO: 751351 - RNA, 22 nt, Human
caucacaccacaggcauuuucu

SEQ ID NO: 751352 - RNA, 22 nt, Human
cuacaugaauggguguauuacu

SEQ ID NO: 751353 - RNA, 22 nt, Human
uaauuuaauccaaguguuacau

SEQ ID NO: 751354 - RNA, 22 nt, Human
aaggaaagauucucucucuaga

SEQ ID NO: 751355 - RNA, 22 nt, Human
uuacuucuuuggccuucagcca

SEQ ID NO: 751356 - RNA, 22 nt, Human
uaggcagauuccauauuuuggc

SEQ ID NO: 751357 - RNA, 22 nt, Human
accccaagacaguagaagagaa

SEQ ID NO: 751358 - RNA, 22 nt, Human
ugaaagcagcaccaauaccauu

SEQ ID NO: 751359 - RNA, 22 nt, Human
agauucauuauuaaugugaucu

SEQ ID NO: 751360 - RNA, 22 nt, Human
gaggccucugucccaccaggga

SEQ ID NO: 751361 - RNA, 22 nt, Human
acagugcaaacuuuugucuccu

SEQ ID NO: 751362 - RNA, 22 nt, Human
gagagcuguaauagucaugucu

SEQ ID NO: 751363 - RNA, 23 nt, Human
acagggaaaagucaucaguguga

SEQ ID NO: 751364 - RNA, 19 nt, Human
ccagugcaagguaagauag

SEQ ID NO: 751365 - RNA, 22 nt, Human
caaggacacugauguucauccu

SEQ ID NO: 751366 - RNA, 22 nt, Human
gggcacuggaaggcucucaggc

SEQ ID NO: 751367 - RNA, 22 nt, Human
auuccuucuuugagaauaagca

SEQ ID NO: 751368 - RNA, 22 nt, Human
aaagaugucaguuugaaauaac

SEQ ID NO: 751369 - RNA, 22 nt, Human
acagcucuguugccagaucugc

SEQ ID NO: 751370 - RNA, 22 nt, Human
ugugcccucagaagaguacauc

SEQ ID NO: 751371 - RNA, 18 nt, Human
ucucuaccagaagugacg

SEQ ID NO: 751372 - RNA, 20 nt, Human
gaugucuuggucacaguggc

SEQ ID NO: 751373 - RNA, 22 nt, Human
agcuuauuaauuuuucugcaug

SEQ ID NO: 751374 - RNA, 23 nt, Human
aaccuagacuacuuacuaugugg

SEQ ID NO: 751375 - RNA, 22 nt, Human
ccaggcucuaucccuccuucuu

SEQ ID NO: 751376 - RNA, 22 nt, Human
caccagcuugggcuguggaaau

SEQ ID NO: 751377 - RNA, 22 nt, Human
gaagcagcaaaucugcaguauc

SEQ ID NO: 751378 - RNA, 20 nt, Human
ugaggcucagagagguugag

SEQ ID NO: 751379 - RNA, 22 nt, Human
agcugccaucagccuuuggaug

SEQ ID NO: 751380 - RNA, 22 nt, Human
ugcaugcacgugcuauguauga

SEQ ID NO: 751381 - RNA, 20 nt, Human
ggaggucaaaugaugagaag

SEQ ID NO: 751382 - RNA, 19 nt, Human
ucaggaaguugaugaggug

SEQ ID NO: 751383 - RNA, 17 nt, Human
ugcaaacaaucacauau

SEQ ID NO: 751384 - RNA, 23 nt, Human
uccagucuccugaaaggcagcgu

SEQ ID NO: 751385 - RNA, 22 nt, Human
uuauuccaaaucaugguugcau

SEQ ID NO: 751386 - RNA, 22 nt, Human
ggcaguguccuugcagcucuac

SEQ ID NO: 751387 - RNA, 22 nt, Human
gaaggccucacucugcagcaua

SEQ ID NO: 751388 - RNA, 22 nt, Human
caggcuguggaucaggagccuu

SEQ ID NO: 751389 - RNA, 19 nt, Human
uccagaacugcccuggccu

SEQ ID NO: 751390 - RNA, 22 nt, Human
cuccagaagacccauccucaug

SEQ ID NO: 751391 - RNA, 22 nt, Human
cauggcagagccugcagguggg

SEQ ID NO: 751392 - RNA, 22 nt, Human
ccaggagcagggcuggcugcac

SEQ ID NO: 751393 - RNA, 22 nt, Human
uguuaucugguugucugauuac

SEQ ID NO: 751394 - RNA, 22 nt, Human
aagcugaggucaaguagcuagu

SEQ ID NO: 751395 - RNA, 22 nt, Human
aucuuucagggccauuuguauu

SEQ ID NO: 751396 - RNA, 22 nt, Human
ggaguauuguagcuuccaguuc

SEQ ID NO: 751397 - RNA, 22 nt, Human
gaaugcaaauauauggaucagu

SEQ ID NO: 751398 - RNA, 22 nt, Human
cagcacaguacaaggcacggau

SEQ ID NO: 751399 - RNA, 22 nt, Human
ccucacccacuacacucaaggg

SEQ ID NO: 751400 - RNA, 22 nt, Human
uuugaagacagaucaauauaag

SEQ ID NO: 751401 - RNA, 22 nt, Human
acaugaggaaacaaggguauau

SEQ ID NO: 751402 - RNA, 22 nt, Human
acagagcaugauggaagaucga

SEQ ID NO: 751403 - RNA, 22 nt, Human
aaagaaggaccuggaggaggau

SEQ ID NO: 751404 - RNA, 22 nt, Human
caguggagagacuuuuacucuu

SEQ ID NO: 751405 - RNA, 22 nt, Human
acuacugaauauuaguucugaa

SEQ ID NO: 751406 - RNA, 22 nt, Human
ugaggggaaggcaugauaaaua

SEQ ID NO: 751407 - RNA, 22 nt, Human
uuuaacagauaguuucuucugu

SEQ ID NO: 751408 - RNA, 22 nt, Human
uggcauguaguaggugcuauaa

SEQ ID NO: 751409 - RNA, 22 nt, Human
ugcuccuggcuccuucccuaac

SEQ ID NO: 751410 - RNA, 22 nt, Human
auguacauacugcauuuucaaa

SEQ ID NO: 751411 - RNA, 22 nt, Human
ugcuugacuuugucacagcaug

SEQ ID NO: 751412 - RNA, 21 nt, Human
ucaggcagugcaaauacaugg

SEQ ID NO: 751413 - RNA, 22 nt, Human
augucuuuuauggagaugucau

SEQ ID NO: 751414 - RNA, 22 nt, Human
uggggcugugagacuacaggau

SEQ ID NO: 751415 - RNA, 22 nt, Human
ucugaaagucugaaacaguguc

SEQ ID NO: 751416 - RNA, 20 nt, Human
aguguaugaacagaugcggg

SEQ ID NO: 751417 - RNA, 22 nt, Human
cagagguguuggugaauggaga

SEQ ID NO: 751418 - RNA, 22 nt, Human
uuucccuucuuuccugaguaau

SEQ ID NO: 751419 - RNA, 22 nt, Human
ccugagagugagugccaccuua

SEQ ID NO: 751420 - RNA, 22 nt, Human
gaggaaagcugguuuaaaguau

SEQ ID NO: 751421 - RNA, 22 nt, Human
uucuaacuuuugaggcaaugug

SEQ ID NO: 751422 - RNA, 22 nt, Human
uccuggagaauggacaaugcac

SEQ ID NO: 751423 - RNA, 22 nt, Human
accugauauguuugaucacccu

SEQ ID NO: 751424 - RNA, 22 nt, Human
uaaacauggauucugaucacag

SEQ ID NO: 751425 - RNA, 21 nt, Human
guuuagaaguagucuggcuca

SEQ ID NO: 751426 - RNA, 22 nt, Human
aaucacacaaaggcaacuuuug

SEQ ID NO: 751427 - RNA, 22 nt, Human
uaauacuugucauaaaggcauu

SEQ ID NO: 751428 - RNA, 22 nt, Human
aaggcaguuugggccaccaucu

SEQ ID NO: 751429 - RNA, 22 nt, Human
uccguucucuaggagaaacuuc

SEQ ID NO: 751430 - RNA, 22 nt, Human
aauauuauacagucaaccucuu

SEQ ID NO: 751431 - RNA, 22 nt, Human
guuuccuaggcuuauacagcug

SEQ ID NO: 751432 - RNA, 22 nt, Human
ugggugagugggaaaagcccag

SEQ ID NO: 751433 - RNA, 22 nt, Human
ggugaagggugucauggcauuu

SEQ ID NO: 751434 - RNA, 22 nt, Human
agcuugauuucucugcagugug

SEQ ID NO: 751435 - RNA, 22 nt, Human
agcaauaugacauugcuacauc

SEQ ID NO: 751436 - RNA, 22 nt, Human
cauggggaugaggcugagacuu

SEQ ID NO: 751437 - RNA, 22 nt, Human
auauccaagaaacaauuaauuc

SEQ ID NO: 751438 - RNA, 22 nt, Human
gcacccacuuaggccagucaau

SEQ ID NO: 751439 - RNA, 19 nt, Human
uuuggcucuggucagagag

SEQ ID NO: 751440 - RNA, 18 nt, Human
aggcaggugcuggaaguc

SEQ ID NO: 751441 - RNA, 22 nt, Human
ccacccagccagaugcaggaag

SEQ ID NO: 751442 - RNA, 22 nt, Human
ucucaggggccuggaguccugg

SEQ ID NO: 751443 - RNA, 22 nt, Human
ggcaggugcgcauguugcauua

SEQ ID NO: 751444 - RNA, 22 nt, Human
uucuccuuauucauaguugucu

SEQ ID NO: 751445 - RNA, 21 nt, Human
gggaggaagcugcuucucucu

SEQ ID NO: 751446 - RNA, 22 nt, Human
ugacaguauacuugugauggga

SEQ ID NO: 751447 - RNA, 22 nt, Human
cugugucucguuaaagcauugg

SEQ ID NO: 751448 - RNA, 22 nt, Human
cuuuuccucaggaggagacgcg

SEQ ID NO: 751449 - RNA, 22 nt, Human
ugcuucagugcucugagccugu

SEQ ID NO: 751450 - RNA, 22 nt, Human
ugggacagugugccuugcuccu

SEQ ID NO: 751451 - RNA, 22 nt, Human
ugucuguguccaaauuuccucu

SEQ ID NO: 751452 - RNA, 21 nt, Human
uuagacuuggguuuuuccugg

SEQ ID NO: 751453 - RNA, 22 nt, Human
uuaaaaugcagauucugauuca

SEQ ID NO: 751454 - RNA, 22 nt, Human
agggaggaccaaugugugguua

SEQ ID NO: 751455 - RNA, 22 nt, Human
agcccuccaaagguugggggag

SEQ ID NO: 751456 - RNA, 22 nt, Human
uuccuucuaauauucugccugu

SEQ ID NO: 751457 - RNA, 22 nt, Human
cugucugcaggauaguacccuc

SEQ ID NO: 751458 - RNA, 22 nt, Human
cagucccagaagagccugggag

SEQ ID NO: 751459 - RNA, 22 nt, Human
ccuaagaucugguaugugacag

SEQ ID NO: 751460 - RNA, 22 nt, Human
cccagugucauucuaagggagg

SEQ ID NO: 751461 - RNA, 22 nt, Human
ugagguuagcugggauuucaug

SEQ ID NO: 751462 - RNA, 22 nt, Human
acccuguaugcuauaucccuaa

SEQ ID NO: 751463 - RNA, 22 nt, Human
gcuuucugugcagugaacacua

SEQ ID NO: 751464 - RNA, 19 nt, Human
acccaggguugauguccag

SEQ ID NO: 751465 - RNA, 22 nt, Human
acugaacauccauaagauuuuu

SEQ ID NO: 751466 - RNA, 22 nt, Human
ugauuuugagguuucaggucuu

SEQ ID NO: 751467 - RNA, 22 nt, Human
ucucucucagccauuacagaac

SEQ ID NO: 751468 - RNA, 22 nt, Human
agggucuguggaugcaucuggg

SEQ ID NO: 751469 - RNA, 22 nt, Human
gaacuuuaccauuuagguaacu

SEQ ID NO: 751470 - RNA, 22 nt, Human
gcaggugaaugauggacuagga

SEQ ID NO: 751471 - RNA, 23 nt, Human
acagggcuagcugacagugguau

SEQ ID NO: 751472 - RNA, 22 nt, Human
aaguauacuuaggcauaauggu

SEQ ID NO: 751473 - RNA, 22 nt, Human
ggcucccuagggagagugggag

SEQ ID NO: 751474 - RNA, 22 nt, Human
gggggcucugacucccucagcu

SEQ ID NO: 751475 - RNA, 22 nt, Human
guggcagaacuaugugauugcu

SEQ ID NO: 751476 - RNA, 22 nt, Human
uucucuuucuacagugugauug

SEQ ID NO: 751477 - RNA, 22 nt, Human
acugagggccaaaggcacugag

SEQ ID NO: 751478 - RNA, 18 nt, Human
ugacauuuccagagugua

SEQ ID NO: 751479 - RNA, 22 nt, Human
agguaagggucacaguucauau

SEQ ID NO: 751480 - RNA, 22 nt, Human
cauugcuugauagcugaaaauu

SEQ ID NO: 751481 - RNA, 22 nt, Human
auuacacuuguucaucaucacc

SEQ ID NO: 751482 - RNA, 22 nt, Human
agucccagugagaugaaccagg

SEQ ID NO: 751483 - RNA, 22 nt, Human
ucauaaagugaaggaugauggg

SEQ ID NO: 751484 - RNA, 22 nt, Human
cagaggccuggcuuggacaccu

SEQ ID NO: 751485 - RNA, 22 nt, Human
uuccauacgacugaggucucgg

SEQ ID NO: 751486 - RNA, 22 nt, Human
uucauuguacuuuaagagaugc

SEQ ID NO: 751487 - RNA, 22 nt, Human
guagucugaacaguaauuuugu

SEQ ID NO: 751488 - RNA, 22 nt, Human
agagguguggccaggacucaag

SEQ ID NO: 751489 - RNA, 22 nt, Human
cuaaggguugaaacagcaagaa

SEQ ID NO: 751490 - RNA, 22 nt, Human
aagugucuuuauauuugagaaa

SEQ ID NO: 751491 - RNA, 22 nt, Human
ucuggggugcagccuggacaua

SEQ ID NO: 751492 - RNA, 22 nt, Human
ugagaggcgcucacucucaggu

SEQ ID NO: 751493 - RNA, 22 nt, Human
cuggccacuggagguggcaccc

SEQ ID NO: 751494 - RNA, 22 nt, Human
ugagugugcuaggugucucggu

SEQ ID NO: 751495 - RNA, 22 nt, Human
auccaggcugucuaaugggaga

SEQ ID NO: 751496 - RNA, 22 nt, Human
uuuccugcacccgcugaugcca

SEQ ID NO: 751497 - RNA, 22 nt, Human
cugguucugauguucuuggcuu

SEQ ID NO: 751498 - RNA, 22 nt, Human
acauuuguauauaugcagcaua

SEQ ID NO: 751499 - RNA, 22 nt, Human
aggccagcagcaugacggcauc

SEQ ID NO: 751500 - RNA, 22 nt, Human
aaugaucuggcucaggauauca

SEQ ID NO: 751501 - RNA, 22 nt, Human
acagcuaaucccccuagauucu

SEQ ID NO: 751502 - RNA, 22 nt, Human
uuuuggaacacagacauuagaa

SEQ ID NO: 751503 - RNA, 22 nt, Human
uggaggccuagguugaugugug

SEQ ID NO: 751504 - RNA, 21 nt, Human
aaccagagccaggcucucagc

SEQ ID NO: 751505 - RNA, 22 nt, Human
guaauugacucagcucuguuca

SEQ ID NO: 751506 - RNA, 22 nt, Human
gcccucagcauccucagggcca

SEQ ID NO: 751507 - RNA, 22 nt, Human
gagaaggagcuccuuggggucu

SEQ ID NO: 751508 - RNA, 22 nt, Human
cccagcauggagugaggacuca

SEQ ID NO: 751509 - RNA, 22 nt, Human
cccgaggaaccagagguagcuc

SEQ ID NO: 751510 - RNA, 22 nt, Human
ggcccugcugaguggaguggag

SEQ ID NO: 751511 - RNA, 22 nt, Human
uucuccuggagugcuuguuggg

SEQ ID NO: 751512 - RNA, 20 nt, Human
gaggaugcagacagagggca

SEQ ID NO: 751513 - RNA, 20 nt, Human
ucaaaggcaaaggugggugu

SEQ ID NO: 751514 - RNA, 22 nt, Human
acagaugaaaaagcuuguggau

SEQ ID NO: 751515 - RNA, 21 nt, Human
agaccucuucccuucaugcac

SEQ ID NO: 751516 - RNA, 22 nt, Human
uccugaggccucugugauguga

SEQ ID NO: 751517 - RNA, 22 nt, Human
cugggccucacccuagaccaau

SEQ ID NO: 751518 - RNA, 22 nt, Human
ugaaagaacuagcaucuucaag

SEQ ID NO: 751519 - RNA, 22 nt, Human
cuccagauuccguuuauucagg

SEQ ID NO: 751520 - RNA, 22 nt, Human
ucuucacagaugcauauacuuc

SEQ ID NO: 751521 - RNA, 22 nt, Human
aaagauuucagaagccugugcc

SEQ ID NO: 751522 - RNA, 22 nt, Human
acagaauagguacagucaguca

SEQ ID NO: 751523 - RNA, 17 nt, Human
ccaggucuccuugcuuu

SEQ ID NO: 751524 - RNA, 22 nt, Human
agacugugagaagauggcugcg

SEQ ID NO: 751525 - RNA, 22 nt, Human
uagcauuucacugaucuucacu

SEQ ID NO: 751526 - RNA, 22 nt, Human
ugucacuuuggggagaguuuug

SEQ ID NO: 751527 - RNA, 22 nt, Human
auucuggauauuacuuaucuau

SEQ ID NO: 751528 - RNA, 22 nt, Human
cacagggcagaggguccguggc

SEQ ID NO: 751529 - RNA, 22 nt, Human
aggucaagaguaaauuugggua

SEQ ID NO: 751530 - RNA, 22 nt, Human
ucaugucucuaugugccuauua

SEQ ID NO: 751531 - RNA, 22 nt, Human
gcugggacaggcuuggcccugu

SEQ ID NO: 751532 - RNA, 22 nt, Human
aagagagggacuuauuaaaguc

SEQ ID NO: 751533 - RNA, 22 nt, Human
ugucagcaccauggguagugau

SEQ ID NO: 751534 - RNA, 22 nt, Human
ugaaaggugacauuucuuggau

SEQ ID NO: 751535 - RNA, 22 nt, Human
cuggagggcuggacuaaggaaa

SEQ ID NO: 751536 - RNA, 22 nt, Human
acauuuauuuuggcacggcaca

SEQ ID NO: 751537 - RNA, 22 nt, Human
cccacccagccuggcugagggg

SEQ ID NO: 751538 - RNA, 22 nt, Human
cuggccuuucgugagagcuggg

SEQ ID NO: 751539 - RNA, 22 nt, Human
gagcucaguguagucauggcuu

SEQ ID NO: 751540 - RNA, 22 nt, Human
ggugcagagcagugucagagca

SEQ ID NO: 751541 - RNA, 22 nt, Human
cacauacaagccauggggggau

SEQ ID NO: 751542 - RNA, 22 nt, Human
aacauauaaacucuuaaguuca

SEQ ID NO: 751543 - RNA, 20 nt, Human
ggcuuaaggaauucuuuucu

SEQ ID NO: 751544 - RNA, 22 nt, Human
aaaacacaagaagcaggguaca

SEQ ID NO: 751545 - RNA, 22 nt, Human
aguaaacaauguaugaggacag

SEQ ID NO: 751546 - RNA, 22 nt, Human
cagaggguugaugugaggcuua

SEQ ID NO: 751547 - RNA, 22 nt, Human
caggaagcacagugaggagacc

SEQ ID NO: 751548 - RNA, 22 nt, Human
ucuucuccaguucauccuacca

SEQ ID NO: 751549 - RNA, 22 nt, Human
augauauacuuccuagaacagu

SEQ ID NO: 751550 - RNA, 22 nt, Human
ccuggagaccagaggauacuuc

SEQ ID NO: 751551 - RNA, 22 nt, Human
uggcagugucuuaucaggagug

SEQ ID NO: 751552 - RNA, 22 nt, Human
cuguccuguggaccugaggacg

SEQ ID NO: 751553 - RNA, 22 nt, Human
uuagcaucugcuguaagcuuau

SEQ ID NO: 751554 - RNA, 22 nt, Human
uugcauuuuuacaaguagccag

SEQ ID NO: 751555 - RNA, 22 nt, Human
uggcuagaauuggguucacagg

SEQ ID NO: 751556 - RNA, 22 nt, Human
cccagggauguggcagauguua

SEQ ID NO: 751557 - RNA, 21 nt, Human
cagugaggcccuccuguuccc

SEQ ID NO: 751558 - RNA, 21 nt, Human
cuucaucccggagauucuggu

SEQ ID NO: 751559 - RNA, 22 nt, Human
aggcagguguuaccucugguuu

SEQ ID NO: 751560 - RNA, 22 nt, Human
uucaguguuuguagagauaacu

SEQ ID NO: 751561 - RNA, 22 nt, Human
uauauuaaacccucucuguagg

SEQ ID NO: 751562 - RNA, 22 nt, Human
aggaccaacauagcagcagugg

SEQ ID NO: 751563 - RNA, 22 nt, Human
acacacagaguuuauacaggca

SEQ ID NO: 751564 - RNA, 22 nt, Human
ggcaggugcuugucgaaggccu

SEQ ID NO: 751565 - RNA, 22 nt, Human
uguaaaguaucugugagcucuc

SEQ ID NO: 751566 - RNA, 22 nt, Human
cugagaauuacucugaugagua

SEQ ID NO: 751567 - RNA, 22 nt, Human
agggcuuucggcacucugaggg

SEQ ID NO: 751568 - RNA, 22 nt, Human
auuuuacuucauuugaaaugcc

SEQ ID NO: 751569 - RNA, 22 nt, Human
ggauggcagucugcaugagaaa

SEQ ID NO: 751570 - RNA, 22 nt, Human
gugauggagucaaggcuagaac

SEQ ID NO: 751571 - RNA, 22 nt, Human
ccacaguacaggaaaucuuguu

SEQ ID NO: 751572 - RNA, 22 nt, Human
gcagagaaaguuuuguccucag

SEQ ID NO: 751573 - RNA, 22 nt, Human
aagaguaaaugucuaauuagga

SEQ ID NO: 751574 - RNA, 20 nt, Human
gcuuagcaggcauaguagcu

SEQ ID NO: 751575 - RNA, 22 nt, Human
uucucuuuuagaggcuccauga

SEQ ID NO: 751576 - RNA, 18 nt, Human
agggagcaucugguugcc

SEQ ID NO: 751577 - RNA, 23 nt, Human
gcuggcuggcaguaaagguuguu

SEQ ID NO: 751578 - RNA, 22 nt, Human
aagcacauuguacauuugugcu

SEQ ID NO: 751579 - RNA, 22 nt, Human
uucauugaguauagggguauac

SEQ ID NO: 751580 - RNA, 22 nt, Human
ugcucuggaaauaaaugauuua

SEQ ID NO: 751581 - RNA, 22 nt, Human
gcccagagugaguccugggccc

SEQ ID NO: 751582 - RNA, 22 nt, Human
agaaggcuuaaaacauggaaua

SEQ ID NO: 751583 - RNA, 22 nt, Human
agguaaugcauauaaagugcuu

SEQ ID NO: 751584 - RNA, 23 nt, Human
gagcugaguguagggagacuagg

SEQ ID NO: 751585 - RNA, 22 nt, Human
cagaguguggcaucuuccaacu

SEQ ID NO: 751586 - RNA, 22 nt, Human
gcuguggucugugagcuccaaa

SEQ ID NO: 751587 - RNA, 22 nt, Human
gggaugagagcugggacagaag

SEQ ID NO: 751588 - RNA, 22 nt, Human
agaagugucucaucaggcaaua

SEQ ID NO: 751589 - RNA, 22 nt, Human
cagggcucaucugugugaccag

SEQ ID NO: 751590 - RNA, 22 nt, Human
gaggguggccuuuagagcccau

SEQ ID NO: 751591 - RNA, 22 nt, Human
cggggacacacuggcagcuccu

SEQ ID NO: 751592 - RNA, 22 nt, Human
aucuggaauuaagagaaaguga

SEQ ID NO: 751593 - RNA, 23 nt, Human
ugggcuucugagaaagcaccuaa

SEQ ID NO: 751594 - RNA, 22 nt, Human
cauugcacuucugcuuuuccuc

SEQ ID NO: 751595 - RNA, 22 nt, Human
gaauuuaucuacguuaaguaug

SEQ ID NO: 751596 - RNA, 22 nt, Human
uucuaaagccuguccuaucaga

SEQ ID NO: 751597 - RNA, 22 nt, Human
uuccugaauauaaagacacuag

SEQ ID NO: 751598 - RNA, 22 nt, Human
uucuuuacaguggguuuugaau

SEQ ID NO: 751599 - RNA, 22 nt, Human
gcaauaaacucucucaagccac

SEQ ID NO: 751600 - RNA, 22 nt, Human
uacaagagacaccagggaggcu

SEQ ID NO: 751601 - RNA, 22 nt, Human
uuuuguauccucccuuucacug

SEQ ID NO: 751602 - RNA, 22 nt, Human
cauucagucaugcugguuuuga

SEQ ID NO: 751603 - RNA, 22 nt, Human
aaugcucugucucugacagugg

SEQ ID NO: 751604 - RNA, 22 nt, Human
gauaauuuuagucugaaaauug

SEQ ID NO: 751605 - RNA, 22 nt, Human
uucuucagacuacugaugauug

SEQ ID NO: 751606 - RNA, 22 nt, Human
uuccuggcaaagugagcaucac

SEQ ID NO: 751607 - RNA, 19 nt, Human
ugaggcacuagucuggucc

SEQ ID NO: 751608 - RNA, 22 nt, Human
cuuguuuucuucugcagucuau

SEQ ID NO: 751609 - RNA, 22 nt, Human
acacauuaggcagugcuuaaau

SEQ ID NO: 751610 - RNA, 22 nt, Human
aucccuggacggcgccucccca

SEQ ID NO: 751611 - RNA, 22 nt, Human
ugggucuguagggcuguccaau

SEQ ID NO: 751612 - RNA, 22 nt, Human
gaauacaaacuuaaggcuuuac

SEQ ID NO: 751613 - RNA, 22 nt, Human
cauuugaaccuggauguucuua

SEQ ID NO: 751614 - RNA, 22 nt, Human
ccuggcugguggcagcgacaag

SEQ ID NO: 751615 - RNA, 18 nt, Human
aggggcagcuugugugga

SEQ ID NO: 751616 - RNA, 22 nt, Human
uagcugcugcagcacagggagg

SEQ ID NO: 751617 - RNA, 22 nt, Human
ccaggguggaggcuggauggag

SEQ ID NO: 751618 - RNA, 22 nt, Human
ugccuaggaaaccucaugcuuc

SEQ ID NO: 751619 - RNA, 22 nt, Human
aauccuguagauucuaauuccu

SEQ ID NO: 751620 - RNA, 22 nt, Human
ucaauagcauagcaauuaaugu

SEQ ID NO: 751621 - RNA, 22 nt, Human
gcuuguuugugauuucuccaga

SEQ ID NO: 751622 - RNA, 22 nt, Human
aaguaacuaaagauauccauuu

SEQ ID NO: 751623 - RNA, 22 nt, Human
agugcgugggcaggcauggaag

SEQ ID NO: 751624 - RNA, 22 nt, Human
uuucauuuugguuaugccauaa

SEQ ID NO: 751625 - RNA, 22 nt, Human
agcaguggccuggggcucugug

SEQ ID NO: 751626 - RNA, 22 nt, Human
ucuuggcuauccaaguuaucca

SEQ ID NO: 751627 - RNA, 22 nt, Human
cuauauauaucaucuuccaguu

SEQ ID NO: 751628 - RNA, 22 nt, Human
gaccuggaauuuguguguguuc

SEQ ID NO: 751629 - RNA, 22 nt, Human
acacaguauuacaauaggugcu

SEQ ID NO: 751630 - RNA, 19 nt, Human
ggcagguagagggccaguc

SEQ ID NO: 751631 - RNA, 22 nt, Human
uggcccugaaucaaggccagca

SEQ ID NO: 751632 - RNA, 22 nt, Human
gggcuggcugauuuuccucucu

SEQ ID NO: 751633 - RNA, 22 nt, Human
uuacuuugaugaucaaugagcg

SEQ ID NO: 751634 - RNA, 22 nt, Human
aauccauucagaaauugggaau

SEQ ID NO: 751635 - RNA, 22 nt, Human
guccucagagugggcagguccu

SEQ ID NO: 751636 - RNA, 22 nt, Human
cucccagagagcaggugggccg

SEQ ID NO: 751637 - RNA, 22 nt, Human
aaauagacaggcuuaaauagga

SEQ ID NO: 751638 - RNA, 22 nt, Human
ucacaaagggagggauagcugg

SEQ ID NO: 751639 - RNA, 22 nt, Human
aagcaaaagguuacacuucugg

SEQ ID NO: 751640 - RNA, 22 nt, Human
cacagggcuucucauggggugc

SEQ ID NO: 751641 - RNA, 22 nt, Human
aaaaccagacacuguuucuggg

SEQ ID NO: 751642 - RNA, 22 nt, Human
caauuucaucuugugcuucaau

SEQ ID NO: 751643 - RNA, 22 nt, Human
gaagacgagauaaaaugguguc

SEQ ID NO: 751644 - RNA, 22 nt, Human
gggcagcugccaagugcaucgc

SEQ ID NO: 751645 - RNA, 22 nt, Human
ggccuggcugguucaguacccu

SEQ ID NO: 751646 - RNA, 22 nt, Human
agaauucuggaguugggaggaa

SEQ ID NO: 751647 - RNA, 22 nt, Human
gcucugaaucaaucagauaagg

SEQ ID NO: 751648 - RNA, 22 nt, Human
uccugcagccaagggucaucga

SEQ ID NO: 751649 - RNA, 22 nt, Human
ggagggagcauccccuugcuga

SEQ ID NO: 751650 - RNA, 22 nt, Human
ucaggagagagaaauuggggcu

SEQ ID NO: 751651 - RNA, 22 nt, Human
aguaacaaauagcugccuuuaa

SEQ ID NO: 751652 - RNA, 22 nt, Human
ugcuccugagcgguuuccauga

SEQ ID NO: 751653 - RNA, 22 nt, Human
aguugcugggaaagauuucagu

SEQ ID NO: 751654 - RNA, 23 nt, Human
caaagaugauuggaacauggcuu

SEQ ID NO: 751655 - RNA, 17 nt, Human
cugggauguggacucuu

SEQ ID NO: 751656 - RNA, 22 nt, Human
caaugaacacagcaauuucaua

SEQ ID NO: 751657 - RNA, 22 nt, Human
gagcaggccagcaauggaaggg

SEQ ID NO: 751658 - RNA, 22 nt, Human
aagacaggaaaagcuccaggcc

SEQ ID NO: 751659 - RNA, 22 nt, Human
augcucugggcaggagcccugg

SEQ ID NO: 751660 - RNA, 22 nt, Human
cauuuagacauuugauuugggg

SEQ ID NO: 751661 - RNA, 22 nt, Human
aacuguacgauaauaaauuugu

SEQ ID NO: 751662 - RNA, 22 nt, Human
ucugggggaggaggcauggccc

SEQ ID NO: 751663 - RNA, 22 nt, Human
gccuucugaucgcuggacugac

SEQ ID NO: 751664 - RNA, 22 nt, Human
agcagcucuggcacuguagcau

SEQ ID NO: 751665 - RNA, 22 nt, Human
uaagacaaauacuauuucaaga

SEQ ID NO: 751666 - RNA, 22 nt, Human
acaacaggguaaggcaggccau

SEQ ID NO: 751667 - RNA, 22 nt, Human
aacaguuuaugagauaugcuau

SEQ ID NO: 751668 - RNA, 22 nt, Human
gaggagguggaauuccaggaau

SEQ ID NO: 751669 - RNA, 22 nt, Human
uucugcugcugcugcacccaau

SEQ ID NO: 751670 - RNA, 22 nt, Human
ucuucagagugagcagugucau

SEQ ID NO: 751671 - RNA, 22 nt, Human
ccagcaucagucagauuuugcu

SEQ ID NO: 751672 - RNA, 22 nt, Human
cuggucaugccagguuugcugc

SEQ ID NO: 751673 - RNA, 22 nt, Human
gagaguggauggagcugcgaag

SEQ ID NO: 751674 - RNA, 22 nt, Human
ccugaguucuuauuuccaguca

SEQ ID NO: 751675 - RNA, 22 nt, Human
ucaucaguguccuuaucacuua

SEQ ID NO: 751676 - RNA, 22 nt, Human
cuggcuggccggaggcaucccu

SEQ ID NO: 751677 - RNA, 21 nt, Human
auuugcauuaaaauauuacgc

SEQ ID NO: 751678 - RNA, 22 nt, Human
auuccucaaagguagcccauua

SEQ ID NO: 751679 - RNA, 22 nt, Human
gaggacaaagcccaggugcugg

SEQ ID NO: 751680 - RNA, 22 nt, Human
ccugugggagggagcggcugga

SEQ ID NO: 751681 - RNA, 22 nt, Human
gcuaggcucggaagcagcaggg

SEQ ID NO: 751682 - RNA, 22 nt, Human
cugugcauugucuugucuguag

SEQ ID NO: 751683 - RNA, 19 nt, Human
ccagagucaugucuccccc

SEQ ID NO: 751684 - RNA, 22 nt, Human
cugggcucugcaguugauguuu

SEQ ID NO: 751685 - RNA, 22 nt, Human
ccaagggcugcugaggugucca

SEQ ID NO: 751686 - RNA, 22 nt, Human
cuagucacucagcacugacaaa

SEQ ID NO: 751687 - RNA, 22 nt, Human
acauuuacagugcuagacaauc

SEQ ID NO: 751688 - RNA, 22 nt, Human
guguccagggccguguugucuu

SEQ ID NO: 751689 - RNA, 22 nt, Human
acuggaaaauucaaaugggguc

SEQ ID NO: 751690 - RNA, 22 nt, Human
gccuguuuacuuugccgcagga

SEQ ID NO: 751691 - RNA, 22 nt, Human
gggagcuguaagggacagguag

SEQ ID NO: 751692 - RNA, 22 nt, Human
uacguuuuaaacacggagccag

SEQ ID NO: 751693 - RNA, 23 nt, Human
ugugcacaucugacgggugaagg

SEQ ID NO: 751694 - RNA, 22 nt, Human
caucacaucuacuauaagugau

SEQ ID NO: 751695 - RNA, 22 nt, Human
agguaaagacagugaaagaggg

SEQ ID NO: 751696 - RNA, 22 nt, Human
ccccaaagccucagccugccug

SEQ ID NO: 751697 - RNA, 23 nt, Human
caugccaguuugugcaggcagau

SEQ ID NO: 751698 - RNA, 19 nt, Human
auguaugaggucuucugcu

SEQ ID NO: 751699 - RNA, 22 nt, Human
gcuccaggcugcucugucccau

SEQ ID NO: 751700 - RNA, 19 nt, Human
ucuccaggcaggugagcga

SEQ ID NO: 751701 - RNA, 22 nt, Human
agagcccugaagcagagcuaaa

SEQ ID NO: 751702 - RNA, 19 nt, Human
uguccucacagagcauaac

SEQ ID NO: 751703 - RNA, 22 nt, Human
ggcuucuccccuuugagucuuc

SEQ ID NO: 751704 - RNA, 22 nt, Human
gcuccagagcagagacuagguu

SEQ ID NO: 751705 - RNA, 22 nt, Human
aggcccugcuuuccagagcuca

SEQ ID NO: 751706 - RNA, 22 nt, Human
aaagcaauggaugagaaucugu

SEQ ID NO: 751707 - RNA, 22 nt, Human
cacuggaagagcaucugagcca

SEQ ID NO: 751708 - RNA, 22 nt, Human
ggcccaggaugcaagaacugaa

SEQ ID NO: 751709 - RNA, 22 nt, Human
gaacaugaaaagucuuacacgc

SEQ ID NO: 751710 - RNA, 22 nt, Human
gggcaggaugcaguuucagaga

SEQ ID NO: 751711 - RNA, 22 nt, Human
gcagccaggaagccuuucccuc

SEQ ID NO: 751712 - RNA, 22 nt, Human
uaaagcaaaaaugaacugccau

SEQ ID NO: 751713 - RNA, 22 nt, Human
ugggccugaguuugggaacugg

SEQ ID NO: 751714 - RNA, 22 nt, Human
cccaguggaaggaguagaagac

SEQ ID NO: 751715 - RNA, 22 nt, Human
guuuccugaaauagaguacugg

SEQ ID NO: 751716 - RNA, 23 nt, Human
uuguuucuuuguauugucucuau

SEQ ID NO: 751717 - RNA, 22 nt, Human
caucauuuuuguaagcugguag

SEQ ID NO: 751718 - RNA, 22 nt, Human
cuggcuggaaguuagagaacuu

SEQ ID NO: 751719 - RNA, 22 nt, Human
cacuguacccauuuaaauaaau

SEQ ID NO: 751720 - RNA, 22 nt, Human
agccacagugggcuaccagcuc

SEQ ID NO: 751721 - RNA, 22 nt, Human
gccccugggagcagagccacca

SEQ ID NO: 751722 - RNA, 22 nt, Human
uaggguccauauggaugaaugg

SEQ ID NO: 751723 - RNA, 22 nt, Human
gaggaugccugggucggggaag

SEQ ID NO: 751724 - RNA, 17 nt, Human
agacugaggacacagga

SEQ ID NO: 751725 - RNA, 21 nt, Human
aguauguguuagggauaauuu

SEQ ID NO: 751726 - RNA, 22 nt, Human
gucuguggcaggggagaaguuu

SEQ ID NO: 751727 - RNA, 22 nt, Human
uuaaaccacuuuguugcaagua

SEQ ID NO: 751728 - RNA, 22 nt, Human
ugggcagucaucagcacaccgg

SEQ ID NO: 751729 - RNA, 22 nt, Human
uuccagccaugguuucccuaug

SEQ ID NO: 751730 - RNA, 22 nt, Human
ggucacccaugaucacaucacc

SEQ ID NO: 751731 - RNA, 22 nt, Human
ucuuaucuuauaccuaacagcc

SEQ ID NO: 751732 - RNA, 22 nt, Human
ggugcagggagaggcaggcccc

SEQ ID NO: 751733 - RNA, 22 nt, Human
gucugccugcaauccagagacu

SEQ ID NO: 751734 - RNA, 22 nt, Human
uugaaaggugaacaugaugcac

SEQ ID NO: 751735 - RNA, 22 nt, Human
aagcaggcccugggccagggga

SEQ ID NO: 751736 - RNA, 22 nt, Human
cucugugugguccucuguauug

SEQ ID NO: 751737 - RNA, 22 nt, Human
aauugcuuaguugcaacuaugc

SEQ ID NO: 751738 - RNA, 19 nt, Human
uggcuaauuuuauagaggc

SEQ ID NO: 751739 - RNA, 22 nt, Human
guucugucacacacugguacuu

SEQ ID NO: 751740 - RNA, 22 nt, Human
cacauauaaccuagacaaggcc

SEQ ID NO: 751741 - RNA, 22 nt, Human
cccaggaggcagauguugcagu

SEQ ID NO: 751742 - RNA, 22 nt, Human
acugaauauauuccauugcaug

SEQ ID NO: 751743 - RNA, 22 nt, Human
ugggucaggcugggaguccuga

SEQ ID NO: 751744 - RNA, 22 nt, Human
acaggccucaaauagggugccu

SEQ ID NO: 751745 - RNA, 22 nt, Human
acucacugggucccggaagccc

SEQ ID NO: 751746 - RNA, 22 nt, Human
aaagaagggacagacugccucu

SEQ ID NO: 751747 - RNA, 22 nt, Human
aaccggagugauucccaccucu

SEQ ID NO: 751748 - RNA, 22 nt, Human
cagagcauuaaaaccagcucug

SEQ ID NO: 751749 - RNA, 22 nt, Human
gcuggcuccaaaagcaggggcu

SEQ ID NO: 751750 - RNA, 22 nt, Human
gagagagaaggccugugggugu

SEQ ID NO: 751751 - RNA, 23 nt, Human
acaugauacacaauuagcaaacc

SEQ ID NO: 751752 - RNA, 19 nt, Human
aucacagacgugccucauc

SEQ ID NO: 751753 - RNA, 22 nt, Human
gggagucaggcucccucagaga

SEQ ID NO: 751754 - RNA, 22 nt, Human
aaacacagauuucuuuguccca

SEQ ID NO: 751755 - RNA, 22 nt, Human
augagcuucccagacaggaugg

SEQ ID NO: 751756 - RNA, 22 nt, Human
augcagauguuccuacuguguu

SEQ ID NO: 751757 - RNA, 22 nt, Human
gcagcugagcgugaggaagagu

SEQ ID NO: 751758 - RNA, 22 nt, Human
gagguggccucaagcagucuuc

SEQ ID NO: 751759 - RNA, 22 nt, Human
gccucccuggcccacagcagcg

SEQ ID NO: 751760 - RNA, 22 nt, Human
aggcacugcagauuacaggcgc

SEQ ID NO: 751761 - RNA, 22 nt, Human
guaacagaaagucaugcucauu

SEQ ID NO: 751762 - RNA, 22 nt, Human
agguaaagacugcaaggagaau

SEQ ID NO: 751763 - RNA, 22 nt, Human
ggagugaguggccuugucacug

SEQ ID NO: 751764 - RNA, 22 nt, Human
aagcagcuggaagaguaagaug

SEQ ID NO: 751765 - RNA, 22 nt, Human
uuuggaagggaaagaaaguacu

SEQ ID NO: 751766 - RNA, 22 nt, Human
cagcagggcccccgggugcgcc

SEQ ID NO: 751767 - RNA, 22 nt, Human
agaggggcucaagcaguggucu

SEQ ID NO: 751768 - RNA, 22 nt, Human
ugcauuuaugucucccaccagc

SEQ ID NO: 751769 - RNA, 22 nt, Human
gugacagaaacagggcuagaau

SEQ ID NO: 751770 - RNA, 22 nt, Human
uggccugaauuauggcagaucu

SEQ ID NO: 751771 - RNA, 19 nt, Human
aaaggcaguggguggcgug

SEQ ID NO: 751772 - RNA, 22 nt, Human
caucaaugugcagagaugaacg

SEQ ID NO: 751773 - RNA, 22 nt, Human
cagggcaguuuuacuucucucu

SEQ ID NO: 751774 - RNA, 22 nt, Human
gaggguggcuccucccugggcc

SEQ ID NO: 751775 - RNA, 22 nt, Human
ugccuugcacauaauauacauu

SEQ ID NO: 751776 - RNA, 22 nt, Human
ucuuggaguauugggccucagg

SEQ ID NO: 751777 - RNA, 22 nt, Human
cagccccuuccuggcaucugga

SEQ ID NO: 751778 - RNA, 22 nt, Human
auuguagcaauuucucuuaauu

SEQ ID NO: 751779 - RNA, 22 nt, Human
aagaguuuccaugcucugugcu

SEQ ID NO: 751780 - RNA, 22 nt, Human
uuccuuucucuggacugcagcc

SEQ ID NO: 751781 - RNA, 22 nt, Human
aaauuuucagagcacuagagaa

SEQ ID NO: 751782 - RNA, 22 nt, Human
ugggcuggcguggagaguuuag

SEQ ID NO: 751783 - RNA, 22 nt, Human
gaugagaaauggacaggagugg

SEQ ID NO: 751784 - RNA, 22 nt, Human
acuccuggggcugccaucacag

SEQ ID NO: 751785 - RNA, 22 nt, Human
uugcagggucccagaggccugg

SEQ ID NO: 751786 - RNA, 22 nt, Human
accugcccuuaacacugugugc

SEQ ID NO: 751787 - RNA, 22 nt, Human
ggaggagguggguuaaguugua

SEQ ID NO: 751788 - RNA, 21 nt, Human
agucuguuaggaugacucuga

SEQ ID NO: 751789 - RNA, 22 nt, Human
cugggaccagugaagcaacuca

SEQ ID NO: 751790 - RNA, 23 nt, Human
agguucaggagauggaggaacaa

SEQ ID NO: 751791 - RNA, 22 nt, Human
ucuucagauugcacugagcaag

SEQ ID NO: 751792 - RNA, 22 nt, Human
ugauuagcuuugaaugugcugc

SEQ ID NO: 751793 - RNA, 20 nt, Human
ucagggcaugggacagcccc

SEQ ID NO: 751794 - RNA, 22 nt, Human
cagcugagaccagaaugcaggu

SEQ ID NO: 751795 - RNA, 22 nt, Human
uccaggcaaggauaauaaacau

SEQ ID NO: 751796 - RNA, 22 nt, Human
ugauuuccuggcuuuggaguuc

SEQ ID NO: 751797 - RNA, 22 nt, Human
aaggcaaguuuuaguuuucugg

SEQ ID NO: 751798 - RNA, 22 nt, Human
uaucagaaaugccuuaaauugg

SEQ ID NO: 751799 - RNA, 18 nt, Human
uggccuggagacaacucu

SEQ ID NO: 751800 - RNA, 22 nt, Human
gcacauaaagggcaugggaggu

SEQ ID NO: 751801 - RNA, 21 nt, Human
cucugggccauuuucuuccac

SEQ ID NO: 751802 - RNA, 22 nt, Human
agggggcauuaugaggcuuuuc

SEQ ID NO: 751803 - RNA, 22 nt, Human
aaucacaucacugagaaugagg

SEQ ID NO: 751804 - RNA, 22 nt, Human
ccuuucucuggcagcaggacag

SEQ ID NO: 751805 - RNA, 22 nt, Human
cuggcccugcuccgcgccgcgg

SEQ ID NO: 751806 - RNA, 22 nt, Human
auguuccugguauaucaugacc

SEQ ID NO: 751807 - RNA, 22 nt, Human
aaggccacugaagaaaucacaa

SEQ ID NO: 751808 - RNA, 22 nt, Human
aaacuucagacuccccacuucu

SEQ ID NO: 751809 - RNA, 22 nt, Human
gagcugugagggacacauugcu

SEQ ID NO: 751810 - RNA, 22 nt, Human
aaaaugugaucuacaaaugcaa

SEQ ID NO: 751811 - RNA, 19 nt, Human
cuuccccuguuaccucacu

SEQ ID NO: 751812 - RNA, 22 nt, Human
agcaucuguugaauauaauauu

SEQ ID NO: 751813 - RNA, 22 nt, Human
aauugcacuuuagcaaugguga

SEQ ID NO: 751814 - RNA, 22 nt, Human
auauauucuuaaagaaucugac

SEQ ID NO: 751815 - RNA, 22 nt, Human
caacaauaugccagacucaauu

SEQ ID NO: 751816 - RNA, 22 nt, Human
auuucacagcgugguugacugc

SEQ ID NO: 751817 - RNA, 22 nt, Human
cacaugaguccugccagguaug

SEQ ID NO: 751818 - RNA, 22 nt, Human
augugagcaggugcuggcugcu

SEQ ID NO: 751819 - RNA, 21 nt, Human
ugcugccuguggguguuuacc

SEQ ID NO: 751820 - RNA, 22 nt, Human
ucuuagaaauuccccaguggcu

SEQ ID NO: 751821 - RNA, 23 nt, Human
uacuguauauuacuguguuauac

SEQ ID NO: 751822 - RNA, 19 nt, Human
uauguguauauguaucugu

SEQ ID NO: 751823 - RNA, 22 nt, Human
acacuuuaucaauauucaaaaa

SEQ ID NO: 751824 - RNA, 22 nt, Human
uagacagauuuaaaggaaugga

SEQ ID NO: 751825 - RNA, 22 nt, Human
cccugugccagagaggcaggag

SEQ ID NO: 751826 - RNA, 22 nt, Human
augggaggcaggcucagaaccg

SEQ ID NO: 751827 - RNA, 23 nt, Human
guccucuggagagaaaggcagua

SEQ ID NO: 751828 - RNA, 22 nt, Human
ucagggcugccgggcagaccgu

SEQ ID NO: 751829 - RNA, 22 nt, Human
uguacacaaugauaaauuauua

SEQ ID NO: 751830 - RNA, 21 nt, Human
acacugagugaauuagcacau

SEQ ID NO: 751831 - RNA, 22 nt, Human
ccuggcugcugucacugaccau

SEQ ID NO: 751832 - RNA, 22 nt, Human
acuguuggcuucugguagugac

SEQ ID NO: 751833 - RNA, 22 nt, Human
uuaaguaacuuguccaaaugag

SEQ ID NO: 751834 - RNA, 22 nt, Human
cauuaaguauuucaguuacugu

SEQ ID NO: 751835 - RNA, 22 nt, Human
uccaccccugggaaugucaaua

SEQ ID NO: 751836 - RNA, 22 nt, Human
gcagggcucaacaggacacccc

SEQ ID NO: 751837 - RNA, 22 nt, Human
uuccaaauguuggacaacugua

SEQ ID NO: 751838 - RNA, 22 nt, Human
auggauaagaacaaauaucuga

SEQ ID NO: 751839 - RNA, 22 nt, Human
agcugggaggugggcagugaga

SEQ ID NO: 751840 - RNA, 22 nt, Human
auucauaucauagaguuauuga

SEQ ID NO: 751841 - RNA, 22 nt, Human
uuucuguaaguggcaaauaaug

SEQ ID NO: 751842 - RNA, 22 nt, Human
gucaccaggucugaugcagcca

SEQ ID NO: 751843 - RNA, 22 nt, Human
auuuguaucuucuaauauuauc

SEQ ID NO: 751844 - RNA, 22 nt, Human
ggcuuaagauauuucugauucc

SEQ ID NO: 751845 - RNA, 22 nt, Human
caauugucagugcuguuuaaau

SEQ ID NO: 751846 - RNA, 22 nt, Human
ugccugccuugcugcuggacag

SEQ ID NO: 751847 - RNA, 22 nt, Human
ugggaggcuuccagaccuugcu

SEQ ID NO: 751848 - RNA, 23 nt, Human
uaggcucuguagguagagauggg

SEQ ID NO: 751849 - RNA, 22 nt, Human
ugucuguauaucacuuuugucc

SEQ ID NO: 751850 - RNA, 22 nt, Human
acucuucacacuugucuccagg

SEQ ID NO: 751851 - RNA, 22 nt, Human
ggcacugcuguaggcagugagg

SEQ ID NO: 751852 - RNA, 22 nt, Human
gggcaggagagaacagucaugg

SEQ ID NO: 751853 - RNA, 22 nt, Human
gcagagugguuucagaguugag

SEQ ID NO: 751854 - RNA, 19 nt, Human
gggaucagcccagggcucu

SEQ ID NO: 751855 - RNA, 22 nt, Human
ggggauggauuccgggucccug

SEQ ID NO: 751856 - RNA, 22 nt, Human
acauucuuugaguuuuguuaaa

SEQ ID NO: 751857 - RNA, 22 nt, Human
auucccaucgucaacuucacug

SEQ ID NO: 751858 - RNA, 22 nt, Human
uccucuggaaccucacccuugc

SEQ ID NO: 751859 - RNA, 23 nt, Human
agguucagcuuucuuacucuggg

SEQ ID NO: 751860 - RNA, 22 nt, Human
auuucccuccagggaaagcuua

SEQ ID NO: 751861 - RNA, 22 nt, Human
uacagcauuaacaggcuguuua

SEQ ID NO: 751862 - RNA, 22 nt, Human
ucugucugacuaccaugaggca

SEQ ID NO: 751863 - RNA, 22 nt, Human
uaauuuuaacugugcuguuugg

SEQ ID NO: 751864 - RNA, 22 nt, Human
cauggcagcaauuuuccugacu

SEQ ID NO: 751865 - RNA, 22 nt, Human
uggagauggccucaggcccuca

SEQ ID NO: 751866 - RNA, 22 nt, Human
acagugcauaaaaacaacuuuu

SEQ ID NO: 751867 - RNA, 22 nt, Human
ucacaugacuuuuugguggccu

SEQ ID NO: 751868 - RNA, 23 nt, Human
ggacacugcuauaaaggaucugc

SEQ ID NO: 751869 - RNA, 22 nt, Human
auuauuucucacucacauaaua

SEQ ID NO: 751870 - RNA, 22 nt, Human
uaaggcaccuguccaggcuggg

SEQ ID NO: 751871 - RNA, 20 nt, Human
aagcauggucaaaacuuaug

SEQ ID NO: 751872 - RNA, 22 nt, Human
aagaugguaaggcagcuggcag

SEQ ID NO: 751873 - RNA, 22 nt, Human
caggauggccccggggcugugc

SEQ ID NO: 751874 - RNA, 22 nt, Human
gacuccagguguccaggccucc

SEQ ID NO: 751875 - RNA, 22 nt, Human
uggcucagcuuuccccaucugg

SEQ ID NO: 751876 - RNA, 22 nt, Human
gauggcagguaguggucucauc

SEQ ID NO: 751877 - RNA, 22 nt, Human
acaguguuuaaaauaauaugcu

SEQ ID NO: 751878 - RNA, 22 nt, Human
acaucauucagggccucguugg

SEQ ID NO: 751879 - RNA, 22 nt, Human
auaucuucuuuauuuugugagg

SEQ ID NO: 751880 - RNA, 22 nt, Human
aggucugagcuccuuccucuga

SEQ ID NO: 751881 - RNA, 22 nt, Human
uggacaaauagcaugacacuug

SEQ ID NO: 751882 - RNA, 22 nt, Human
aagauuucugcuuuuggaggca

SEQ ID NO: 751883 - RNA, 22 nt, Human
acccagcuggaugcauggaggc

SEQ ID NO: 751884 - RNA, 22 nt, Human
gcagugcaggacaaaucagugc

SEQ ID NO: 751885 - RNA, 22 nt, Human
uaagaacaagcuggggguucca

SEQ ID NO: 751886 - RNA, 22 nt, Human
aaccucgaaugccuuccugagg

SEQ ID NO: 751887 - RNA, 20 nt, Human
gccuggaguuaguuuuccuu

SEQ ID NO: 751888 - RNA, 22 nt, Human
uggagcccagacacuggcauug

SEQ ID NO: 751889 - RNA, 22 nt, Human
cuggucagcugaagccccacac

SEQ ID NO: 751890 - RNA, 22 nt, Human
gaacucuagguaaaugagauau

SEQ ID NO: 751891 - RNA, 22 nt, Human
cagaaauacccagcauuuggag

SEQ ID NO: 751892 - RNA, 22 nt, Human
gaaacauucauaugagaaaccu

SEQ ID NO: 751893 - RNA, 22 nt, Human
gcucagagaaguuaaggaauuu

SEQ ID NO: 751894 - RNA, 22 nt, Human
uaugcaacagcauuauuacaau

SEQ ID NO: 751895 - RNA, 22 nt, Human
cacauuuaucuguucuuucuag

SEQ ID NO: 751896 - RNA, 22 nt, Human
cauaauccugguguagcccucu

SEQ ID NO: 751897 - RNA, 23 nt, Human
uucaaagaucuucugaaaucugu

SEQ ID NO: 751898 - RNA, 22 nt, Human
uauuuggacaccaaguagaagu

SEQ ID NO: 751899 - RNA, 22 nt, Human
uggcagcagggccccuggagga

SEQ ID NO: 751900 - RNA, 22 nt, Human
acagcuuuguuuucccugcuga

SEQ ID NO: 751901 - RNA, 20 nt, Human
ucacaugagcuggggcaggc

SEQ ID NO: 751902 - RNA, 22 nt, Human
uaucacauaguguuuaguaaau

SEQ ID NO: 751903 - RNA, 22 nt, Human
gucaggagagaucaggacagca

SEQ ID NO: 751904 - RNA, 22 nt, Human
uuacaucagaaggaaacagcgu

SEQ ID NO: 751905 - RNA, 22 nt, Human
gaauuccacuuuggcuuuuggg

SEQ ID NO: 751906 - RNA, 22 nt, Human
ugccgcugucgccaccauggcu

SEQ ID NO: 751907 - RNA, 22 nt, Human
aacagaauauuuugccuuucuc

SEQ ID NO: 751908 - RNA, 22 nt, Human
aaauggugagggaauugaacag

SEQ ID NO: 751909 - RNA, 22 nt, Human
cuacuuuaacaauucgcaagaa

SEQ ID NO: 751910 - RNA, 22 nt, Human
gacagcugaaggaugauucagg

SEQ ID NO: 751911 - RNA, 22 nt, Human
ggccugagggugggcucucagu

SEQ ID NO: 751912 - RNA, 22 nt, Human
gccagcuccgcaggauggcgcg

SEQ ID NO: 751913 - RNA, 22 nt, Human
uguuuacuucuuuccauggcuu

SEQ ID NO: 751914 - RNA, 22 nt, Human
uccaggccugcaaugacaaagc

SEQ ID NO: 751915 - RNA, 20 nt, Human
gcaaggcacagugaggaggg

SEQ ID NO: 751916 - RNA, 18 nt, Human
uuggaccugugucagggc

SEQ ID NO: 751917 - RNA, 22 nt, Human
acucaguacaucuggaguuggc

SEQ ID NO: 751918 - RNA, 22 nt, Human
ucucacagcaggggccaggucu

SEQ ID NO: 751919 - RNA, 22 nt, Human
uuucaaaguugggaauuguaau

SEQ ID NO: 751920 - RNA, 22 nt, Human
aggcaguguggagggcuguugc

SEQ ID NO: 751921 - RNA, 22 nt, Human
uuugucaucccuuuugaaacug

SEQ ID NO: 751922 - RNA, 22 nt, Human
caggaggcgucuucaguuuguu

SEQ ID NO: 751923 - RNA, 22 nt, Human
uggaaaggaggcuuguggaaua

SEQ ID NO: 751924 - RNA, 21 nt, Human
ucaaauccugcuguuaccacu

SEQ ID NO: 751925 - RNA, 22 nt, Human
ugcaaagaagccuuugccuucu

SEQ ID NO: 751926 - RNA, 21 nt, Human
agggaaagaaaaugagcuaau

SEQ ID NO: 751927 - RNA, 22 nt, Human
ugugcuuugguuuuacaggaug

SEQ ID NO: 751928 - RNA, 22 nt, Human
cugaggccucuguucaccagaa

SEQ ID NO: 751929 - RNA, 22 nt, Human
aggagccaaaagcugaacaaga

SEQ ID NO: 751930 - RNA, 22 nt, Human
aagacaacagagaugacagacu

SEQ ID NO: 751931 - RNA, 22 nt, Human
agcuacaugaaauugcugauau

SEQ ID NO: 751932 - RNA, 22 nt, Human
guaaauauuaaaggcugcuaga

SEQ ID NO: 751933 - RNA, 22 nt, Human
gugggcagugccugacggauga

SEQ ID NO: 751934 - RNA, 22 nt, Human
uuagggaaauauuuauauacuu

SEQ ID NO: 751935 - RNA, 17 nt, Human
accagccucuccugggg

SEQ ID NO: 751936 - RNA, 22 nt, Human
uugucucuacagagaguaguag

SEQ ID NO: 751937 - RNA, 22 nt, Human
uaaacuguguaauaugaugucu

SEQ ID NO: 751938 - RNA, 23 nt, Human
cugcuccaggacagcauggaggu

SEQ ID NO: 751939 - RNA, 22 nt, Human
uuaauauguugaaauuuauuag

SEQ ID NO: 751940 - RNA, 22 nt, Human
accaggagacaugaccaaugag

SEQ ID NO: 751941 - RNA, 22 nt, Human
acaguagacccuggauaaacau

SEQ ID NO: 751942 - RNA, 22 nt, Human
agugucugaagccucagcccga

SEQ ID NO: 751943 - RNA, 22 nt, Human
ugucucugaagcccccuccuuu

SEQ ID NO: 751944 - RNA, 22 nt, Human
guguaauguugucagcaucauc

SEQ ID NO: 751945 - RNA, 22 nt, Human
ggagcuguguuauccauuccca

SEQ ID NO: 751946 - RNA, 22 nt, Human
caggguggggcuggcuaucaaa

SEQ ID NO: 751947 - RNA, 22 nt, Human
agggggcuggagacaccuccuc

SEQ ID NO: 751948 - RNA, 22 nt, Human
guuuggaaguuaagugcagcag

SEQ ID NO: 751949 - RNA, 22 nt, Human
ugcaguguuuggaugcugaguc

SEQ ID NO: 751950 - RNA, 22 nt, Human
cagcuauuuucucauuaaggau

SEQ ID NO: 751951 - RNA, 22 nt, Human
ugugugugacaaccuaguucag

SEQ ID NO: 751952 - RNA, 23 nt, Human
ucacuuugauguaauugaaaagc

SEQ ID NO: 751953 - RNA, 17 nt, Human
cugcagcuggagggcca

SEQ ID NO: 751954 - RNA, 22 nt, Human
gcagccagguuugaggaccacu

SEQ ID NO: 751955 - RNA, 22 nt, Human
cuguggcuccagugaaccaaug

SEQ ID NO: 751956 - RNA, 22 nt, Human
auguguaugcaugcacuaagau

SEQ ID NO: 751957 - RNA, 22 nt, Human
agcugggaugaggagcauccuu

SEQ ID NO: 751958 - RNA, 22 nt, Human
auacagugccccuuuucacaug

SEQ ID NO: 751959 - RNA, 22 nt, Human
uggaauguuuuccuaaaucaga

SEQ ID NO: 751960 - RNA, 22 nt, Human
aguguggggucaccggcccagg

SEQ ID NO: 751961 - RNA, 22 nt, Human
ucagagcugcccaugcaagggg

SEQ ID NO: 751962 - RNA, 22 nt, Human
gagggcucuacucaccacccug

SEQ ID NO: 751963 - RNA, 22 nt, Human
ccugcccacugcccggucagcc

SEQ ID NO: 751964 - RNA, 22 nt, Human
uugguuuagcaacuuccugugu

SEQ ID NO: 751965 - RNA, 19 nt, Human
aggcagaggcuuggcuagc

SEQ ID NO: 751966 - RNA, 22 nt, Human
cugcuguggaugcaggaccuca

SEQ ID NO: 751967 - RNA, 22 nt, Human
uaaaaugcacagcaguugaaag

SEQ ID NO: 751968 - RNA, 22 nt, Human
aagaaucuaugguacauccaag

SEQ ID NO: 751969 - RNA, 22 nt, Human
gccuggcucugaguuucucucc

SEQ ID NO: 751970 - RNA, 22 nt, Human
cuugcuuggagaagagaucagu

SEQ ID NO: 751971 - RNA, 22 nt, Human
ucuggccccuggcaguccugga

SEQ ID NO: 751972 - RNA, 22 nt, Human
caguuuuaaauuguuagauaau

SEQ ID NO: 751973 - RNA, 22 nt, Human
agccccacacucucucugagaa

SEQ ID NO: 751974 - RNA, 22 nt, Human
auacaaugauaauaguacuuua

SEQ ID NO: 751975 - RNA, 22 nt, Human
guaucuuugucuucauguugga

SEQ ID NO: 751976 - RNA, 22 nt, Human
uagagcauucuaucuccaacag

SEQ ID NO: 751977 - RNA, 22 nt, Human
gcagcugggacacugaggccag

SEQ ID NO: 751978 - RNA, 22 nt, Human
aaugcuguugaguuguuccugu

SEQ ID NO: 751979 - RNA, 22 nt, Human
uucucagagcucacuguaguaa

SEQ ID NO: 751980 - RNA, 22 nt, Human
acucuuauucccucagaaauau

SEQ ID NO: 751981 - RNA, 22 nt, Human
uauucuagaaguccaccagucu

SEQ ID NO: 751982 - RNA, 22 nt, Human
uguuugcauuguuaauucaguc

SEQ ID NO: 751983 - RNA, 22 nt, Human
guuucuguguuagaugagucuu

SEQ ID NO: 751984 - RNA, 22 nt, Human
cauaaacucuugagauucuugu

SEQ ID NO: 751985 - RNA, 22 nt, Human
uauguuuacgcugguagaauua

SEQ ID NO: 751986 - RNA, 18 nt, Human
cucaccauucugcccaau

SEQ ID NO: 751987 - RNA, 22 nt, Human
cggggcagaaaguugucuuuug

SEQ ID NO: 751988 - RNA, 22 nt, Human
ugcccugccaagaccaaguggu

SEQ ID NO: 751989 - RNA, 22 nt, Human
ggugugugguuuugauacaguc

SEQ ID NO: 751990 - RNA, 22 nt, Human
ccuuggcccuagccucaggcaa

SEQ ID NO: 751991 - RNA, 20 nt, Human
ucugguccaggucuucaugg

SEQ ID NO: 751992 - RNA, 22 nt, Human
uuguaugagcuccaggaacuca

SEQ ID NO: 751993 - RNA, 22 nt, Human
caaauguaucagcccagggauu

SEQ ID NO: 751994 - RNA, 22 nt, Human
gagcccagcugcggcccucagc

SEQ ID NO: 751995 - RNA, 22 nt, Human
acuccaggaaacuuaggggaaa

SEQ ID NO: 751996 - RNA, 23 nt, Human
ucugggcugcuuaaggaucaagg

SEQ ID NO: 751997 - RNA, 22 nt, Human
aggaaagccaaucucucuugac

SEQ ID NO: 751998 - RNA, 22 nt, Human
agcuggaggggccagcaggugu

SEQ ID NO: 751999 - RNA, 22 nt, Human
aggcucaagcacugauauuuuu

SEQ ID NO: 752000 - RNA, 22 nt, Human
ugagaaaacaguuuguaauaau

SEQ ID NO: 752001 - RNA, 22 nt, Human
ugagccuggccugcagagacca

SEQ ID NO: 752002 - RNA, 22 nt, Human
aacuuucugucugagcugcaga

SEQ ID NO: 752003 - RNA, 22 nt, Human
ugggagcaguugcaucuccagu

SEQ ID NO: 752004 - RNA, 22 nt, Human
ggcaccaggacaugacucccag

SEQ ID NO: 752005 - RNA, 22 nt, Human
ugaggaaguuguuucucuucua

SEQ ID NO: 752006 - RNA, 22 nt, Human
caucaauaggguuugaaagcaa

SEQ ID NO: 752007 - RNA, 22 nt, Human
ccucacagcaaggauuucagug

SEQ ID NO: 752008 - RNA, 22 nt, Human
ugcugggcacugucucugggga

SEQ ID NO: 752009 - RNA, 22 nt, Human
acaugcacggcaccaucuucug

SEQ ID NO: 752010 - RNA, 22 nt, Human
ucaaaucagcaagcagcuuccc

SEQ ID NO: 752011 - RNA, 22 nt, Human
agcagccucuguagaggucucc

SEQ ID NO: 752012 - RNA, 22 nt, Human
ucaugcaaaagacuugaacuuu

SEQ ID NO: 752013 - RNA, 22 nt, Human
aagaugguguggucaaggacca

SEQ ID NO: 752014 - RNA, 22 nt, Human
cauauacacuuccaccucugug

SEQ ID NO: 752015 - RNA, 22 nt, Human
uagguaagauguuaacagcuga

SEQ ID NO: 752016 - RNA, 22 nt, Human
ugugcugugggacucaggcucc

SEQ ID NO: 752017 - RNA, 22 nt, Human
ugcuuggccuacuuguccuuug

SEQ ID NO: 752018 - RNA, 22 nt, Human
guauuagggccaaaggcaggaa

SEQ ID NO: 752019 - RNA, 22 nt, Human
ggcagucaagagggagucugaa

SEQ ID NO: 752020 - RNA, 22 nt, Human
auuagggaaacugacuugucuc

SEQ ID NO: 752021 - RNA, 22 nt, Human
agcaggaacugacaccaagcca

SEQ ID NO: 752022 - RNA, 22 nt, Human
cugugaaaucaaccuugagccc

SEQ ID NO: 752023 - RNA, 22 nt, Human
uuccucaugggguuccuucaga

SEQ ID NO: 752024 - RNA, 22 nt, Human
agcaugcaggaaccacauggca

SEQ ID NO: 752025 - RNA, 22 nt, Human
uggcuggggccacaguuuuccu

SEQ ID NO: 752026 - RNA, 22 nt, Human
uggcugagaaugggaugaugcc

SEQ ID NO: 752027 - RNA, 22 nt, Human
ccuggcuuccuucaugaccugg

SEQ ID NO: 752028 - RNA, 22 nt, Human
uuaacacaucccugcucuaccc

SEQ ID NO: 752029 - RNA, 22 nt, Human
accaaggagaaggugcaagcuu

SEQ ID NO: 752030 - RNA, 22 nt, Human
uguauguauguauguauuuggg

SEQ ID NO: 752031 - RNA, 18 nt, Human
gagacacaagggccugga

SEQ ID NO: 752032 - RNA, 22 nt, Human
uuccuucccucaguggcugaag

SEQ ID NO: 752033 - RNA, 22 nt, Human
agggggugaucaaggugcggcg

SEQ ID NO: 752034 - RNA, 22 nt, Human
ugccugagggaguaagaguccu

SEQ ID NO: 752035 - RNA, 22 nt, Human
ucagccaggccaccuucagcuu

SEQ ID NO: 752036 - RNA, 22 nt, Human
gaugcaaacugugacauagagu

SEQ ID NO: 752037 - RNA, 22 nt, Human
gugaagcagggaaggaaaggau

SEQ ID NO: 752038 - RNA, 22 nt, Human
auggucaggcaaggagggcugg

SEQ ID NO: 752039 - RNA, 22 nt, Human
aggacaggauugagcugaacug

SEQ ID NO: 752040 - RNA, 22 nt, Human
augcaacaauguauuuauguau

SEQ ID NO: 752041 - RNA, 22 nt, Human
aacauucagcuggguggagcag

SEQ ID NO: 752042 - RNA, 22 nt, Human
cuuuaucauggagguaaauaug

SEQ ID NO: 752043 - RNA, 22 nt, Human
caggaggaaaugugacccugcu

SEQ ID NO: 752044 - RNA, 22 nt, Human
cugagcugggaguagagacucu

SEQ ID NO: 752045 - RNA, 22 nt, Human
agcuuaaacucuuugaaguuau

SEQ ID NO: 752046 - RNA, 22 nt, Human
uguuuaaucuauaaaauggaga

SEQ ID NO: 752047 - RNA, 22 nt, Human
ugacaacaaggauccugccugg

SEQ ID NO: 752048 - RNA, 22 nt, Human
uaucucuuucauuuuagaguca

SEQ ID NO: 752049 - RNA, 23 nt, Human
gcccucccucccagguggguguu

SEQ ID NO: 752050 - RNA, 22 nt, Human
gaaauguuaugagauauguacu

SEQ ID NO: 752051 - RNA, 22 nt, Human
ucuccagguagauaugucagga

SEQ ID NO: 752052 - RNA, 22 nt, Human
ucuccagaaauggggcugggga

SEQ ID NO: 752053 - RNA, 22 nt, Human
cacagccuccuucagagagcau

SEQ ID NO: 752054 - RNA, 22 nt, Human
aaccuuucaauuauccucaucu

SEQ ID NO: 752055 - RNA, 22 nt, Human
aggaacagaagagcaaugcagg

SEQ ID NO: 752056 - RNA, 22 nt, Human
cugcaggguuuuucaaggacaa

SEQ ID NO: 752057 - RNA, 22 nt, Human
cucagugcagcuaggcaugaga

SEQ ID NO: 752058 - RNA, 22 nt, Human
uagucagcaugaaauaagcagc

SEQ ID NO: 752059 - RNA, 22 nt, Human
uuggcucaggcuuucauuguaa

SEQ ID NO: 752060 - RNA, 22 nt, Human
uugaagacuaauuuagauaaug

SEQ ID NO: 752061 - RNA, 20 nt, Human
uggccaccugcgucccagcc

SEQ ID NO: 752062 - RNA, 19 nt, Human
gccaggacauccuccugcu

SEQ ID NO: 752063 - RNA, 22 nt, Human
ggcacuuggaucuuaguugggg

SEQ ID NO: 752064 - RNA, 17 nt, Human
uccuccccgcaguugca

SEQ ID NO: 752065 - RNA, 22 nt, Human
uucuccaagaugaagcugugua

SEQ ID NO: 752066 - RNA, 19 nt, Human
uuccugggguuccauugug

SEQ ID NO: 752067 - RNA, 22 nt, Human
augucuguguuaucuguagaau

SEQ ID NO: 752068 - RNA, 22 nt, Human
gagggggcucugccaaccuguc

SEQ ID NO: 752069 - RNA, 22 nt, Human
cuggucaauaaucauguaguac

SEQ ID NO: 752070 - RNA, 22 nt, Human
uuuauugaauuguaacccuauu

SEQ ID NO: 752071 - RNA, 22 nt, Human
ucauccauacuauugagaggca

SEQ ID NO: 752072 - RNA, 22 nt, Human
cugcuucuaagaaccugcagcu

SEQ ID NO: 752073 - RNA, 22 nt, Human
uaugagaaauugcugauauuug

SEQ ID NO: 752074 - RNA, 22 nt, Human
acagacauuuaauaaaugcuga

SEQ ID NO: 752075 - RNA, 22 nt, Human
ggaaaacaagagaaugauguuu

SEQ ID NO: 752076 - RNA, 23 nt, Human
ggguccagagacaggcaugggug

SEQ ID NO: 752077 - RNA, 22 nt, Human
acacaugcagguauacauguuc

SEQ ID NO: 752078 - RNA, 22 nt, Human
gugauaauugcagagaaaggag

SEQ ID NO: 752079 - RNA, 19 nt, Human
uaucuuuaugcaguggugg

SEQ ID NO: 752080 - RNA, 22 nt, Human
aagggagguaaagcuauuuaaa

SEQ ID NO: 752081 - RNA, 22 nt, Human
cuguguagccucaugugggcuu

SEQ ID NO: 752082 - RNA, 22 nt, Human
uuucagacaggcucagagccgu

SEQ ID NO: 752083 - RNA, 22 nt, Human
uuuucuauucauugucuauggu

SEQ ID NO: 752084 - RNA, 22 nt, Human
uuggagguuucccaacuguggg

SEQ ID NO: 752085 - RNA, 22 nt, Human
uaagugaauuguccgaggacac

SEQ ID NO: 752086 - RNA, 22 nt, Human
ugcucugcaagcaggagcaaga

SEQ ID NO: 752087 - RNA, 22 nt, Human
ucuccacaccagaaggagcuga

SEQ ID NO: 752088 - RNA, 22 nt, Human
aagucacagaacccauuguaac

SEQ ID NO: 752089 - RNA, 22 nt, Human
cugggcagaauuuuaggauggc

SEQ ID NO: 752090 - RNA, 22 nt, Human
uuucucagcucagcaucugggu

SEQ ID NO: 752091 - RNA, 22 nt, Human
aggcagcaauugaaaucauugu

SEQ ID NO: 752092 - RNA, 22 nt, Human
gggcagguggccucuuguacua

SEQ ID NO: 752093 - RNA, 22 nt, Human
cugcccucuagaggaggacuga

SEQ ID NO: 752094 - RNA, 22 nt, Human
cugaagucauacacuguucuga

SEQ ID NO: 752095 - RNA, 22 nt, Human
cugcuuuggcucagugacauca

SEQ ID NO: 752096 - RNA, 22 nt, Human
ccagggugagugucauggguua

SEQ ID NO: 752097 - RNA, 22 nt, Human
uuccaaaguuauucaagcagua

SEQ ID NO: 752098 - RNA, 22 nt, Human
ggcuuuaucaaaugagacccug

SEQ ID NO: 752099 - RNA, 22 nt, Human
agucaaauaucuuaaaaggcua

SEQ ID NO: 752100 - RNA, 22 nt, Human
gcugagagcacauagaaggggc

SEQ ID NO: 752101 - RNA, 22 nt, Human
acaguuuggcgugauugauagu

SEQ ID NO: 752102 - RNA, 22 nt, Human
cuggaacaaguggccuugcaag

SEQ ID NO: 752103 - RNA, 18 nt, Human
caggagcaggaguugaac

SEQ ID NO: 752104 - RNA, 22 nt, Human
aagcacagauaaaacaggauuc

SEQ ID NO: 752105 - RNA, 22 nt, Human
cuuguggccaauguuuguuaua

SEQ ID NO: 752106 - RNA, 16 nt, Human
ucaguguuccagaaua

SEQ ID NO: 752107 - RNA, 21 nt, Human
gagaaucaggaaggauugaug

SEQ ID NO: 752108 - RNA, 22 nt, Human
uauaguacauggaaucuucaua

SEQ ID NO: 752109 - RNA, 22 nt, Human
gguguggcugugaguuuuugau

SEQ ID NO: 752110 - RNA, 23 nt, Human
acucacaaagcaggaucauguug

SEQ ID NO: 752111 - RNA, 23 nt, Human
uuuuuaguuacaccucugccacc

SEQ ID NO: 752112 - RNA, 22 nt, Human
gcucagggccuggcugcggacu

SEQ ID NO: 752113 - RNA, 22 nt, Human
cucacagguuaguuguguggau

SEQ ID NO: 752114 - RNA, 21 nt, Human
acugugggucugaccaccugg

SEQ ID NO: 752115 - RNA, 22 nt, Human
gacuuggguggauugugacucu

SEQ ID NO: 752116 - RNA, 22 nt, Human
guucaaaucucaggacuucaga

SEQ ID NO: 752117 - RNA, 22 nt, Human
uccauggagauggaugacugua

SEQ ID NO: 752118 - RNA, 22 nt, Human
uaacuugaacauggagaguaag

SEQ ID NO: 752119 - RNA, 22 nt, Human
uucuauguaccuagcguuguau

SEQ ID NO: 752120 - RNA, 22 nt, Human
guguaugauuucaaauggcuag

SEQ ID NO: 752121 - RNA, 22 nt, Human
uaaagcagugguucucaaacuu

SEQ ID NO: 752122 - RNA, 22 nt, Human
guguuaaugguagaaucugagu

SEQ ID NO: 752123 - RNA, 22 nt, Human
uuccccaguaacauacauguga

SEQ ID NO: 752124 - RNA, 20 nt, Human
agucacaggccuggaacaug

SEQ ID NO: 752125 - RNA, 22 nt, Human
caccuuugcaaaccaaaucuga

SEQ ID NO: 752126 - RNA, 17 nt, Human
uaggagacuggcugucc

SEQ ID NO: 752127 - RNA, 22 nt, Human
gccauggggacuucauggauuu

SEQ ID NO: 752128 - RNA, 22 nt, Human
cagcaggauuggauacaucuca

SEQ ID NO: 752129 - RNA, 22 nt, Human
ugcucccaggcucuguggucug

SEQ ID NO: 752130 - RNA, 22 nt, Human
aaggacagguuggggcuucagg

SEQ ID NO: 752131 - RNA, 22 nt, Human
guguccugcauuggcucugccc

SEQ ID NO: 752132 - RNA, 22 nt, Human
ugugacagaucucuauacauga

SEQ ID NO: 752133 - RNA, 18 nt, Human
ucucugaauauuuuaugu

SEQ ID NO: 752134 - RNA, 22 nt, Human
ugugaggagaggcccagcuccc

SEQ ID NO: 752135 - RNA, 20 nt, Human
agcaaagccuuuagaguuug

SEQ ID NO: 752136 - RNA, 22 nt, Human
agggcaguucaacuucauagug

SEQ ID NO: 752137 - RNA, 22 nt, Human
aaagggaggggcgauaagccgg

SEQ ID NO: 752138 - RNA, 22 nt, Human
uacugcugagcuggguagaagg

SEQ ID NO: 752139 - RNA, 22 nt, Human
ucuuuccuaggugauaugcaau

SEQ ID NO: 752140 - RNA, 22 nt, Human
uuucacagcgucuuucucuugc

SEQ ID NO: 752141 - RNA, 22 nt, Human
gcagccaggcuacagcgggcuu

SEQ ID NO: 752142 - RNA, 22 nt, Human
uagacaauauuugaaaguagug

SEQ ID NO: 752143 - RNA, 22 nt, Human
uccagggaguuggcuggauagu

SEQ ID NO: 752144 - RNA, 22 nt, Human
aggugucuggacuugugaagca

SEQ ID NO: 752145 - RNA, 22 nt, Human
aaauaacuugguuucaucagag

SEQ ID NO: 752146 - RNA, 22 nt, Human
aucauccaucuagcgcgggggg

SEQ ID NO: 752147 - RNA, 22 nt, Human
uaggcuggaacuuaggcagagg

SEQ ID NO: 752148 - RNA, 22 nt, Human
ccuuucugacagugaugggggg

SEQ ID NO: 752149 - RNA, 22 nt, Human
uguuugaauaacuuggauauau

SEQ ID NO: 752150 - RNA, 22 nt, Human
ucuucuuaugugccauuaucuc

SEQ ID NO: 752151 - RNA, 22 nt, Human
uauuaauuuaaucuccauggua

SEQ ID NO: 752152 - RNA, 22 nt, Human
aaggagguuaucccaguggacu

SEQ ID NO: 752153 - RNA, 22 nt, Human
ggcuugaacucccaaucauuua

SEQ ID NO: 752154 - RNA, 22 nt, Human
ccucaggaaaugaauaaauggc

SEQ ID NO: 752155 - RNA, 22 nt, Human
auucaguagaaguuagcuauua

SEQ ID NO: 752156 - RNA, 22 nt, Human
ucugccagcccugugagucuug

SEQ ID NO: 752157 - RNA, 23 nt, Human
cagcccuggagaugugggaggca

SEQ ID NO: 752158 - RNA, 22 nt, Human
ugaggcugacaaaagaugaggu

SEQ ID NO: 752159 - RNA, 19 nt, Human
aaaguuuuauucucauuug

SEQ ID NO: 752160 - RNA, 20 nt, Human
gucuuauuuaacacaugacu

SEQ ID NO: 752161 - RNA, 22 nt, Human
uugcugaucugugaaucagcca

SEQ ID NO: 752162 - RNA, 20 nt, Human
uaagaacaagacuaggaagc

SEQ ID NO: 752163 - RNA, 22 nt, Human
cuggccugcugggugagguccu

SEQ ID NO: 752164 - RNA, 22 nt, Human
gucaaguuaagauaaggucaug

SEQ ID NO: 752165 - RNA, 22 nt, Human
aaggucauuuaacaauuuauga

SEQ ID NO: 752166 - RNA, 22 nt, Human
cagaaggcaaggccugccacgc

SEQ ID NO: 752167 - RNA, 19 nt, Human
auuuccaagaauuggagag

SEQ ID NO: 752168 - RNA, 20 nt, Human
auggcucuguuuggcaguga

SEQ ID NO: 752169 - RNA, 22 nt, Human
ggccuaggauucugcauuucua

SEQ ID NO: 752170 - RNA, 22 nt, Human
aaguauuauuuaacaaauuugu

SEQ ID NO: 752171 - RNA, 22 nt, Human
caggccugguugagcccugaga

SEQ ID NO: 752172 - RNA, 22 nt, Human
aggguaggguaaaugaugcauc

SEQ ID NO: 752173 - RNA, 22 nt, Human
ugaguccuggcuuugggaugua

SEQ ID NO: 752174 - RNA, 22 nt, Human
ucacaggaggacugaaagauau

SEQ ID NO: 752175 - RNA, 22 nt, Human
uacaaagcuguauagccugguc

SEQ ID NO: 752176 - RNA, 22 nt, Human
ucuuugauggagagauagauau

SEQ ID NO: 752177 - RNA, 22 nt, Human
uuaaaacagcgugaaucuggca

SEQ ID NO: 752178 - RNA, 22 nt, Human
aagcuggacucugccauuuacu

SEQ ID NO: 752179 - RNA, 22 nt, Human
uaaauacuuuacaggaugucuc

SEQ ID NO: 752180 - RNA, 22 nt, Human
acaauguaggauauguacuugu

SEQ ID NO: 752181 - RNA, 22 nt, Human
ugugaaaugaguauauuugaau

SEQ ID NO: 752182 - RNA, 22 nt, Human
accugagcaugccaggagagug

SEQ ID NO: 752183 - RNA, 19 nt, Human
ugaguucugugguucucaa

SEQ ID NO: 752184 - RNA, 22 nt, Human
uggaauuaucugaagugauuug

SEQ ID NO: 752185 - RNA, 22 nt, Human
uuuccaaagguggcaggaacaa

SEQ ID NO: 752186 - RNA, 23 nt, Human
cccaagccugugcccucugacuc

SEQ ID NO: 752187 - RNA, 22 nt, Human
cuggcacaggauccgagaccuu

SEQ ID NO: 752188 - RNA, 22 nt, Human
uccugguguaaugguaagcaug

SEQ ID NO: 752189 - RNA, 22 nt, Human
cucucugaggaaggagcaucug

SEQ ID NO: 752190 - RNA, 19 nt, Human
augcaacaaaaguguaaga

SEQ ID NO: 752191 - RNA, 22 nt, Human
cugccuuggcccuaguucaugg

SEQ ID NO: 752192 - RNA, 22 nt, Human
ucuucaugcaccucacagcuag

SEQ ID NO: 752193 - RNA, 22 nt, Human
acuguggagcaguggcuaggga

SEQ ID NO: 752194 - RNA, 22 nt, Human
aauucauuaagaaagagcuaaa

SEQ ID NO: 752195 - RNA, 20 nt, Human
uagaggugggauuuggguuu

SEQ ID NO: 752196 - RNA, 22 nt, Human
aggaagccuggggcugcccucg

SEQ ID NO: 752197 - RNA, 22 nt, Human
uggagcagaguucagcggggag

SEQ ID NO: 752198 - RNA, 22 nt, Human
caucacauuagucucaagagaa

SEQ ID NO: 752199 - RNA, 22 nt, Human
acauucaugucccacuucuagc

SEQ ID NO: 752200 - RNA, 22 nt, Human
ucacaggaggaaccuggccugg

SEQ ID NO: 752201 - RNA, 19 nt, Human
ugagacugggugcaguacu

SEQ ID NO: 752202 - RNA, 22 nt, Human
ccagccagccuugaucugagua

SEQ ID NO: 752203 - RNA, 22 nt, Human
ccaggagacuguacugauauuu

SEQ ID NO: 752204 - RNA, 22 nt, Human
ugaggugggugucaggucagag

SEQ ID NO: 752205 - RNA, 22 nt, Human
gggcugagugaccucaggccaa

SEQ ID NO: 752206 - RNA, 20 nt, Human
aggcucugccugcaggccca

SEQ ID NO: 752207 - RNA, 22 nt, Human
aaggcagcccuggcucagccug

SEQ ID NO: 752208 - RNA, 22 nt, Human
uuguccuuggaugaagcuggga

SEQ ID NO: 752209 - RNA, 22 nt, Human
gaggagcaagaaauagugccca

SEQ ID NO: 752210 - RNA, 22 nt, Human
gauggcaggugauagccgaguc

SEQ ID NO: 752211 - RNA, 22 nt, Human
ugcaggagagugagucaguagg

SEQ ID NO: 752212 - RNA, 22 nt, Human
agcuccuggggguuccaagcag

SEQ ID NO: 752213 - RNA, 22 nt, Human
ggugacaguuccggagguacag

SEQ ID NO: 752214 - RNA, 22 nt, Human
cugaagcugaaaacuuccagca

SEQ ID NO: 752215 - RNA, 18 nt, Human
ucaggcugcccugugucu

SEQ ID NO: 752216 - RNA, 22 nt, Human
ucugagcccagugagucucgca

SEQ ID NO: 752217 - RNA, 22 nt, Human
gaggguggggaauagacugcua

SEQ ID NO: 752218 - RNA, 22 nt, Human
aguuucauuucuuaguaccagu

SEQ ID NO: 752219 - RNA, 22 nt, Human
gaccauuuguugaaaagauuau

SEQ ID NO: 752220 - RNA, 22 nt, Human
ucugggucaugacucagcguga

SEQ ID NO: 752221 - RNA, 22 nt, Human
gaagagcugucagaaaagcuaa

SEQ ID NO: 752222 - RNA, 22 nt, Human
caggcagugucccaggaagcca

SEQ ID NO: 752223 - RNA, 22 nt, Human
ucccugcagacguccugcgggu

SEQ ID NO: 752224 - RNA, 22 nt, Human
ccacagaauucugucuccagga

SEQ ID NO: 752225 - RNA, 22 nt, Human
ccaggccauucccagaguugcu

SEQ ID NO: 752226 - RNA, 22 nt, Human
gacuccugggccucugagaggc

SEQ ID NO: 752227 - RNA, 22 nt, Human
ggugcaggagcggggugcucgg

SEQ ID NO: 752228 - RNA, 22 nt, Human
cugcagggccauggguucuaua

SEQ ID NO: 752229 - RNA, 20 nt, Human
uacauucaaaacaaacucug

SEQ ID NO: 752230 - RNA, 22 nt, Human
aucuuugaugacuaaugcuuug

SEQ ID NO: 752231 - RNA, 22 nt, Human
gcagauggaaagugcuugaggg

SEQ ID NO: 752232 - RNA, 22 nt, Human
augcauauuucaugaaucuuug

SEQ ID NO: 752233 - RNA, 22 nt, Human
uccuguggcuuccacgaccuaa

SEQ ID NO: 752234 - RNA, 22 nt, Human
guacuuuaaaucaauguagauu

SEQ ID NO: 752235 - RNA, 22 nt, Human
aggcacugcuucuaaguaggaa

SEQ ID NO: 752236 - RNA, 22 nt, Human
guguuguggagcuugucagggg

SEQ ID NO: 752237 - RNA, 22 nt, Human
gagaaguuguaggagaauuuug

SEQ ID NO: 752238 - RNA, 22 nt, Human
cugucugugccucuucucccag

SEQ ID NO: 752239 - RNA, 22 nt, Human
ugaggccccgaagcugagguuu

SEQ ID NO: 752240 - RNA, 22 nt, Human
ucauuguauacuuuauuuauga

SEQ ID NO: 752241 - RNA, 22 nt, Human
uugagacucgagucucucagac

SEQ ID NO: 752242 - RNA, 22 nt, Human
ugggcuucuggaguggggcaga

SEQ ID NO: 752243 - RNA, 22 nt, Human
agaugaaaagauaagcagcaau

SEQ ID NO: 752244 - RNA, 22 nt, Human
uggucugauauuuuuucuuacc

SEQ ID NO: 752245 - RNA, 22 nt, Human
cuaccuucaaguuccucccucu

SEQ ID NO: 752246 - RNA, 22 nt, Human
gccaguggagacugaaacccau

SEQ ID NO: 752247 - RNA, 22 nt, Human
ggcugugggugugacaggccuc

SEQ ID NO: 752248 - RNA, 19 nt, Human
cuuuagacacaccuggaca

SEQ ID NO: 752249 - RNA, 22 nt, Human
aaaacauuuuacugccaucuca

SEQ ID NO: 752250 - RNA, 23 nt, Human
uguugaaguaacuguuacauaga

SEQ ID NO: 752251 - RNA, 22 nt, Human
ugcucucucaggccuggcccac

SEQ ID NO: 752252 - RNA, 22 nt, Human
agugucugggcucccuuggagc

SEQ ID NO: 752253 - RNA, 18 nt, Human
gagagcugcuaccuagcu

SEQ ID NO: 752254 - RNA, 18 nt, Human
guuuggcauaacugaugc

SEQ ID NO: 752255 - RNA, 22 nt, Human
gcgcgccucugcccgguguucc

SEQ ID NO: 752256 - RNA, 22 nt, Human
acauuguacucuuagcguuguu

SEQ ID NO: 752257 - RNA, 22 nt, Human
uagaucauuugaauugagguag

SEQ ID NO: 752258 - RNA, 22 nt, Human
cacagugcuuuaugagagaucu

SEQ ID NO: 752259 - RNA, 22 nt, Human
caggcacuucugcugcuugucu

SEQ ID NO: 752260 - RNA, 22 nt, Human
agcaauuuucccuuagucuuug

SEQ ID NO: 752261 - RNA, 22 nt, Human
cuuugaaaacuuaaauaacagc

SEQ ID NO: 752262 - RNA, 22 nt, Human
acauuguuccagcgauagagaa

SEQ ID NO: 752263 - RNA, 22 nt, Human
gucugagggguuucccaggaca

SEQ ID NO: 752264 - RNA, 22 nt, Human
aggccucaggaagguaaagaag

SEQ ID NO: 752265 - RNA, 22 nt, Human
cugcccgucccuuugcucucgc

SEQ ID NO: 752266 - RNA, 22 nt, Human
auugaauagaugcauuauacua

SEQ ID NO: 752267 - RNA, 22 nt, Human
auauuaggcaaggagauuauuu

SEQ ID NO: 752268 - RNA, 18 nt, Human
ucauuuguuuugcaugaa

SEQ ID NO: 752269 - RNA, 23 nt, Human
cagcagagagcagaccuuugugu

SEQ ID NO: 752270 - RNA, 22 nt, Human
auuguacaaugcugagguuugg

SEQ ID NO: 752271 - RNA, 22 nt, Human
ugugagugacaguucccuuggu

SEQ ID NO: 752272 - RNA, 22 nt, Human
uagcaaagcuccguaguuauuu

SEQ ID NO: 752273 - RNA, 22 nt, Human
ucaggcaguagaauugcuugaa

SEQ ID NO: 752274 - RNA, 23 nt, Human
augggccaagcaagacccaugac

SEQ ID NO: 752275 - RNA, 22 nt, Human
gagcaguggucacagggaggga

SEQ ID NO: 752276 - RNA, 22 nt, Human
aggaaugacuuguagcucugag

SEQ ID NO: 752277 - RNA, 22 nt, Human
acacaugaggaaggccucaccc

SEQ ID NO: 752278 - RNA, 22 nt, Human
uuuagcacgguaacacauaaag

SEQ ID NO: 752279 - RNA, 22 nt, Human
ugggagcaguugugaagcucag

SEQ ID NO: 752280 - RNA, 22 nt, Human
acuucacaacuguacauggcag

SEQ ID NO: 752281 - RNA, 22 nt, Human
agcagcagcucuguugcccuac

SEQ ID NO: 752282 - RNA, 22 nt, Human
acuuuugaggacuuuauuguau

SEQ ID NO: 752283 - RNA, 22 nt, Human
uagcuguguaagcuugguaaga

SEQ ID NO: 752284 - RNA, 22 nt, Human
uuacacuuguaauuauauaacg

SEQ ID NO: 752285 - RNA, 22 nt, Human
ucauuacagagauauaaucuac

SEQ ID NO: 752286 - RNA, 22 nt, Human
gggugggugguccgcagacaua

SEQ ID NO: 752287 - RNA, 22 nt, Human
aucauagguauaaguaaauuag

SEQ ID NO: 752288 - RNA, 22 nt, Human
uggagagaagaggcagugugcu

SEQ ID NO: 752289 - RNA, 22 nt, Human
gaacuugagcaacacugaguga

SEQ ID NO: 752290 - RNA, 22 nt, Human
gagaaaccuguaaggaaggaag

SEQ ID NO: 752291 - RNA, 22 nt, Human
ucaucacauguguagucauccc

SEQ ID NO: 752292 - RNA, 22 nt, Human
ggaaagaaucaagugauccugu

SEQ ID NO: 752293 - RNA, 22 nt, Human
uagcaacaagugacuaucuaua

SEQ ID NO: 752294 - RNA, 22 nt, Human
ggaagaguaacaggagguggaa

SEQ ID NO: 752295 - RNA, 22 nt, Human
uggagcauauucuggagcuugg

SEQ ID NO: 752296 - RNA, 22 nt, Human
uucaaggaaaccagcauuuggu

SEQ ID NO: 752297 - RNA, 22 nt, Human
gggaagcagcauugugcuggcu

SEQ ID NO: 752298 - RNA, 22 nt, Human
ucugagcucuaucugugggaau

SEQ ID NO: 752299 - RNA, 22 nt, Human
gaaucagacugaccugaguuca

SEQ ID NO: 752300 - RNA, 22 nt, Human
cugacuguaauucuguucuuaa

SEQ ID NO: 752301 - RNA, 22 nt, Human
uacagagggauuaucuaagggu

SEQ ID NO: 752302 - RNA, 22 nt, Human
ucuuggagacucuuguauauuu

SEQ ID NO: 752303 - RNA, 22 nt, Human
cuggagggugagccucaucucu

SEQ ID NO: 752304 - RNA, 22 nt, Human
acaucugauuacaugagaauau

SEQ ID NO: 752305 - RNA, 22 nt, Human
ugcaugcaacaauucuucuaua

SEQ ID NO: 752306 - RNA, 22 nt, Human
augaggcagguggaggcugcca

SEQ ID NO: 752307 - RNA, 22 nt, Human
ggcaagguacucuagagcacau

SEQ ID NO: 752308 - RNA, 22 nt, Human
gguccucuccagcgccacagug

SEQ ID NO: 752309 - RNA, 22 nt, Human
agcacaguggcuucuaugucua

SEQ ID NO: 752310 - RNA, 22 nt, Human
agagcugggaccgucuggaagu

SEQ ID NO: 752311 - RNA, 22 nt, Human
uccagagcucugggcauagcug

SEQ ID NO: 752312 - RNA, 23 nt, Human
agucugugcuuggugggagggcc

SEQ ID NO: 752313 - RNA, 22 nt, Human
ugggaagcauuaaugauagggg

SEQ ID NO: 752314 - RNA, 22 nt, Human
ccaggcaccauguucuuaggac

SEQ ID NO: 752315 - RNA, 19 nt, Human
cuugguuaugguaugaugc

SEQ ID NO: 752316 - RNA, 22 nt, Human
aaaggugacugcagcagcuauu

SEQ ID NO: 752317 - RNA, 22 nt, Human
caaagcaguauuggauucuuua

SEQ ID NO: 752318 - RNA, 22 nt, Human
agcauugccugccuauugcuaa

SEQ ID NO: 752319 - RNA, 22 nt, Human
aguuucauauuaccaugucacc

SEQ ID NO: 752320 - RNA, 22 nt, Human
cccagcagaccgcugugauggc

SEQ ID NO: 752321 - RNA, 22 nt, Human
acuguucugccaagaucaacgu

SEQ ID NO: 752322 - RNA, 22 nt, Human
uguaccaagacaaaucagaaac

SEQ ID NO: 752323 - RNA, 22 nt, Human
ugcauuuccagauuucuggagu

SEQ ID NO: 752324 - RNA, 22 nt, Human
ugaguuuaauuggagccugaau

SEQ ID NO: 752325 - RNA, 22 nt, Human
aacaaauggggccuuguaugaa

SEQ ID NO: 752326 - RNA, 22 nt, Human
guccuucagcaccucccucggc

SEQ ID NO: 752327 - RNA, 22 nt, Human
cugaguggaacauaggaugaua

SEQ ID NO: 752328 - RNA, 22 nt, Human
agacacuuggcagagagcuguu

SEQ ID NO: 752329 - RNA, 22 nt, Human
aggaauuuuucuagccggaguu

SEQ ID NO: 752330 - RNA, 22 nt, Human
agcagcauauugugucuucaua

SEQ ID NO: 752331 - RNA, 22 nt, Human
uuacagcuagccaauuauuuag

SEQ ID NO: 752332 - RNA, 22 nt, Human
cugccuccugccgugcagcuuc

SEQ ID NO: 752333 - RNA, 22 nt, Human
uugcugggugcuauuaugaaca

SEQ ID NO: 752334 - RNA, 22 nt, Human
ugaucuuugguaaucuggcaca

SEQ ID NO: 752335 - RNA, 17 nt, Human
gacuuuggaguuucaua

SEQ ID NO: 752336 - RNA, 22 nt, Human
cucccguggauguucuucaguc

SEQ ID NO: 752337 - RNA, 22 nt, Human
ucuccuuucuuuuaaaauguca

SEQ ID NO: 752338 - RNA, 22 nt, Human
ucagaggaacuggacuaaagcc

SEQ ID NO: 752339 - RNA, 22 nt, Human
ccagagcccgggaccuggacuu

SEQ ID NO: 752340 - RNA, 22 nt, Human
gaaaugugaccuacuuccuugu

SEQ ID NO: 752341 - RNA, 22 nt, Human
cuaacuuugucaucuucccuuu

SEQ ID NO: 752342 - RNA, 22 nt, Human
ccuccugcacuugcuuuccuuc

SEQ ID NO: 752343 - RNA, 22 nt, Human
caccucaggcagcaaagucuca

SEQ ID NO: 752344 - RNA, 22 nt, Human
gaauguuugacuaaagguagcu

SEQ ID NO: 752345 - RNA, 22 nt, Human
ucuucagucaauccagauguuu

SEQ ID NO: 752346 - RNA, 22 nt, Human
gcaggugguuaaggucccaugu

SEQ ID NO: 752347 - RNA, 22 nt, Human
agaggccaagccagacugugca

SEQ ID NO: 752348 - RNA, 22 nt, Human
aaagauuaagguauuguuagcu

SEQ ID NO: 752349 - RNA, 23 nt, Human
gacacaggagcacccagcugagc

SEQ ID NO: 752350 - RNA, 22 nt, Human
auggccagcuagcacuugcauu

SEQ ID NO: 752351 - RNA, 22 nt, Human
agcuguguaggaucauaacacg

SEQ ID NO: 752352 - RNA, 22 nt, Human
cucaucugauaaaucacucuua

SEQ ID NO: 752353 - RNA, 20 nt, Human
aguuuaagaaaaagcuccag

SEQ ID NO: 752354 - RNA, 22 nt, Human
auguuaugacaagcaugacaga

SEQ ID NO: 752355 - RNA, 22 nt, Human
aacaugcauuugugggauggaa

SEQ ID NO: 752356 - RNA, 22 nt, Human
augcauauagaacauuugacau

SEQ ID NO: 752357 - RNA, 22 nt, Human
uggaagagguggaaguggcuuc

SEQ ID NO: 752358 - RNA, 22 nt, Human
ccugccacuguaggugacaguu

SEQ ID NO: 752359 - RNA, 21 nt, Human
auggacaauugagugucuguc

SEQ ID NO: 752360 - RNA, 18 nt, Human
ugaggcucagagacggug

SEQ ID NO: 752361 - RNA, 22 nt, Human
gcuggccaaaguguaccuggag

SEQ ID NO: 752362 - RNA, 22 nt, Human
gaacagaugccugauucauagg

SEQ ID NO: 752363 - RNA, 21 nt, Human
gcaggggauagaaauggucug

SEQ ID NO: 752364 - RNA, 19 nt, Human
cugucugugcagagaugug

SEQ ID NO: 752365 - RNA, 22 nt, Human
cuaucuuuuguucauuuugagu

SEQ ID NO: 752366 - RNA, 22 nt, Human
ccucugagagaaggccuucagc

SEQ ID NO: 752367 - RNA, 22 nt, Human
ugaaacauuugaugaucuuugg

SEQ ID NO: 752368 - RNA, 22 nt, Human
auacagguaauuugaauaauag

SEQ ID NO: 752369 - RNA, 22 nt, Human
uugaacagcuguuacauuguua

SEQ ID NO: 752370 - RNA, 19 nt, Human
acacagggcuagaguuaca

SEQ ID NO: 752371 - RNA, 22 nt, Human
ugagcugugugacauugagcca

SEQ ID NO: 752372 - RNA, 22 nt, Human
ucccucuaaacuguaagauucu

SEQ ID NO: 752373 - RNA, 22 nt, Human
cuggcaucuagugcguugaggu

SEQ ID NO: 752374 - RNA, 22 nt, Human
gccugcucuccggaucccugau

SEQ ID NO: 752375 - RNA, 22 nt, Human
cccugauggcacaguggcaggc

SEQ ID NO: 752376 - RNA, 22 nt, Human
gaggagggagaauuaggcuuaa

SEQ ID NO: 752377 - RNA, 22 nt, Human
uggcagugggaauggacaaaca

SEQ ID NO: 752378 - RNA, 22 nt, Human
caggauauuaguuuucuuguua

SEQ ID NO: 752379 - RNA, 22 nt, Human
uaauaauagcaguagcugccac

SEQ ID NO: 752380 - RNA, 22 nt, Human
uggggaaggaucaccacaaucu

SEQ ID NO: 752381 - RNA, 20 nt, Human
agucccagaucaaauuucug

SEQ ID NO: 752382 - RNA, 22 nt, Human
cccagaggaggcaaagcucugu

SEQ ID NO: 752383 - RNA, 22 nt, Human
aucuacuccugaauauaucuag

SEQ ID NO: 752384 - RNA, 22 nt, Human
auuuagaagcuaauuuuucaga

SEQ ID NO: 752385 - RNA, 22 nt, Human
gagaagguggaccugaaggagc

SEQ ID NO: 752386 - RNA, 22 nt, Human
aguuacaaacacuaucaguucu

SEQ ID NO: 752387 - RNA, 22 nt, Human
ccugauggagcccugcugcaug

SEQ ID NO: 752388 - RNA, 22 nt, Human
ucccagcgcggggggaggaucc

SEQ ID NO: 752389 - RNA, 20 nt, Human
uggagcuccagcguccaugu

SEQ ID NO: 752390 - RNA, 22 nt, Human
cgaggugggcagaucacagagu

SEQ ID NO: 752391 - RNA, 22 nt, Human
aggacaguggcaaggcaggaca

SEQ ID NO: 752392 - RNA, 22 nt, Human
caccugcccagcaccugggauc

SEQ ID NO: 752393 - RNA, 22 nt, Human
ccaguuuauaagaaagaaaacc

SEQ ID NO: 752394 - RNA, 22 nt, Human
ggcccagcaucuugugaaguuu

SEQ ID NO: 752395 - RNA, 22 nt, Human
agggauggaagcucgucugcaa

SEQ ID NO: 752396 - RNA, 22 nt, Human
ggcuuggcccaggccucacucc

SEQ ID NO: 752397 - RNA, 17 nt, Human
ucauuugggccucacaa

SEQ ID NO: 752398 - RNA, 22 nt, Human
uggcacaggaauuuagaugcag

SEQ ID NO: 752399 - RNA, 22 nt, Human
uacaagagguauauagaaacag

SEQ ID NO: 752400 - RNA, 22 nt, Human
gagcugaaggagaaagcagggg

SEQ ID NO: 752401 - RNA, 22 nt, Human
cugucccaggauccugacucca

SEQ ID NO: 752402 - RNA, 22 nt, Human
gaagggggagcucuuccuaauu

SEQ ID NO: 752403 - RNA, 22 nt, Human
caguaaugggcaagacaauaug

SEQ ID NO: 752404 - RNA, 20 nt, Human
aaaggaauauaugaaguaua

SEQ ID NO: 752405 - RNA, 22 nt, Human
gggagccagcagggcauggagc

SEQ ID NO: 752406 - RNA, 22 nt, Human
cuguguuucugagaagugggga

SEQ ID NO: 752407 - RNA, 22 nt, Human
gcagggcugauggcuucccuca

SEQ ID NO: 752408 - RNA, 22 nt, Human
ugucuucagcaaaugccuuucu

SEQ ID NO: 752409 - RNA, 22 nt, Human
aacccagggugaggggagucua

SEQ ID NO: 752410 - RNA, 22 nt, Human
aaucacaguggguacuagauug

SEQ ID NO: 752411 - RNA, 22 nt, Human
agcagcuccugccaugagugcu

SEQ ID NO: 752412 - RNA, 22 nt, Human
aaagccagguugugugcaggaa

SEQ ID NO: 752413 - RNA, 21 nt, Human
gauauuuaugacucauuccuu

SEQ ID NO: 752414 - RNA, 22 nt, Human
gcguuauuuccugucugauuuc

SEQ ID NO: 752415 - RNA, 22 nt, Human
uacuggagucagaaaugccuug

SEQ ID NO: 752416 - RNA, 22 nt, Human
guuagugcuuauuaaauaguau

SEQ ID NO: 752417 - RNA, 20 nt, Human
aucccucuuccuagaguccc

SEQ ID NO: 752418 - RNA, 22 nt, Human
uggcucuguugagguauggauu

SEQ ID NO: 752419 - RNA, 22 nt, Human
caucagcugagggugagcagaa

SEQ ID NO: 752420 - RNA, 23 nt, Human
uggggagaguuacccuggaagcg

SEQ ID NO: 752421 - RNA, 21 nt, Human
uccagcugugauuaugaaugu

SEQ ID NO: 752422 - RNA, 22 nt, Human
agcaauauuuaaagguuugcaa

SEQ ID NO: 752423 - RNA, 22 nt, Human
ucaugcucaucauuagagugac

SEQ ID NO: 752424 - RNA, 22 nt, Human
aggccagcucacccuggcuccu

SEQ ID NO: 752425 - RNA, 22 nt, Human
cugaggagagguggccuguguu

SEQ ID NO: 752426 - RNA, 22 nt, Human
gggaaccagccgcuuccgccuc

SEQ ID NO: 752427 - RNA, 22 nt, Human
aaaggccaagcaugagguggac

SEQ ID NO: 752428 - RNA, 22 nt, Human
gggucugaccugggcacaccau

SEQ ID NO: 752429 - RNA, 22 nt, Human
gaggccaggacaugaaagcuga

SEQ ID NO: 752430 - RNA, 22 nt, Human
ccaguggccaugcacgagcagc

SEQ ID NO: 752431 - RNA, 22 nt, Human
uccagagauaacuauuuaggag

SEQ ID NO: 752432 - RNA, 22 nt, Human
augcuucaugauuuggccaugu

SEQ ID NO: 752433 - RNA, 22 nt, Human
aaaguuacuaucacaaugaaau

SEQ ID NO: 752434 - RNA, 22 nt, Human
uagugcuuauuacugugcuguc

SEQ ID NO: 752435 - RNA, 22 nt, Human
ucaagucccagcucuucacuua

SEQ ID NO: 752436 - RNA, 22 nt, Human
ggucacugagcuguaauucugu

SEQ ID NO: 752437 - RNA, 22 nt, Human
cuggccucuguguucaccauag

SEQ ID NO: 752438 - RNA, 22 nt, Human
ucacagcauuuuuagaaagauu

SEQ ID NO: 752439 - RNA, 22 nt, Human
uuacagcauuuaaugagaucug

SEQ ID NO: 752440 - RNA, 22 nt, Human
agccugugugcuuuggacaggg

SEQ ID NO: 752441 - RNA, 22 nt, Human
cuucaucuuucugagccucagu

SEQ ID NO: 752442 - RNA, 22 nt, Human
aguggagacaggacagucgaua

SEQ ID NO: 752443 - RNA, 22 nt, Human
gccuuggcuguuggagcuugau

SEQ ID NO: 752444 - RNA, 22 nt, Human
uugcucaggcuggugugcagug

SEQ ID NO: 752445 - RNA, 22 nt, Human
uuuagcaaauauuucuguugau

SEQ ID NO: 752446 - RNA, 22 nt, Human
uccaggcaugguguaauuuugc

SEQ ID NO: 752447 - RNA, 22 nt, Human
agcucccagggcugggcaaguu

SEQ ID NO: 752448 - RNA, 22 nt, Human
gcuuuuggccagauggggaaac

SEQ ID NO: 752449 - RNA, 22 nt, Human
ugggcagagucguggggaauag

SEQ ID NO: 752450 - RNA, 22 nt, Human
uccauacucagaaaguauugca

SEQ ID NO: 752451 - RNA, 22 nt, Human
gcaauagagcagcuaauggaaa

SEQ ID NO: 752452 - RNA, 22 nt, Human
uaacacuugaagccauuuuugc

SEQ ID NO: 752453 - RNA, 22 nt, Human
ccaucagugaaggagacagauu

SEQ ID NO: 752454 - RNA, 22 nt, Human
ggaggugguggcagugacaauu

SEQ ID NO: 752455 - RNA, 22 nt, Human
ccuggcugaaccaaugaagugg

SEQ ID NO: 752456 - RNA, 22 nt, Human
gcacuuaugcucaccuuguucu

SEQ ID NO: 752457 - RNA, 22 nt, Human
ccugucugcggaggaguggaag

SEQ ID NO: 752458 - RNA, 22 nt, Human
cuccagcuucugcccagagacu

SEQ ID NO: 752459 - RNA, 22 nt, Human
agaaggcccuguguggucugag

SEQ ID NO: 752460 - RNA, 23 nt, Human
agcugaaagcuugcaacgaggca

SEQ ID NO: 752461 - RNA, 22 nt, Human
uuaaugaauaugacaggagagg

SEQ ID NO: 752462 - RNA, 22 nt, Human
cuggaacaguguuggagcuuga

SEQ ID NO: 752463 - RNA, 22 nt, Human
ucauuauuugcuuuaguuaugu

SEQ ID NO: 752464 - RNA, 22 nt, Human
ccuguauuagguagacaacuau

SEQ ID NO: 752465 - RNA, 22 nt, Human
ggcuucagaggagaagagggug

SEQ ID NO: 752466 - RNA, 22 nt, Human
aucagcaagcauuuauugagug

SEQ ID NO: 752467 - RNA, 22 nt, Human
uggcugucagcugccuggugcg

SEQ ID NO: 752468 - RNA, 22 nt, Human
uguaggauuuucaccagaccuu

SEQ ID NO: 752469 - RNA, 22 nt, Human
ucauuucagccauuuuuaaaug

SEQ ID NO: 752470 - RNA, 22 nt, Human
aaugucuuucuguucuaugaga

SEQ ID NO: 752471 - RNA, 18 nt, Human
gauucugauucuggaggc

SEQ ID NO: 752472 - RNA, 22 nt, Human
gucaauauauucugucucuuug

SEQ ID NO: 752473 - RNA, 22 nt, Human
augaaaugagucaaugcgacua

SEQ ID NO: 752474 - RNA, 22 nt, Human
agaguuucuugugagcacugac

SEQ ID NO: 752475 - RNA, 19 nt, Human
agagaggcugugugaggga

SEQ ID NO: 752476 - RNA, 22 nt, Human
ucccuggcuguguucaggugcg

SEQ ID NO: 752477 - RNA, 22 nt, Human
aaacucuagcuacuaggauaac

SEQ ID NO: 752478 - RNA, 22 nt, Human
caggucugcagacagggccaug

SEQ ID NO: 752479 - RNA, 22 nt, Human
augauggugggagaugacccag

SEQ ID NO: 752480 - RNA, 22 nt, Human
gccuggcucccucugcagcucc

SEQ ID NO: 752481 - RNA, 22 nt, Human
gugcuuccucaguguuuaagga

SEQ ID NO: 752482 - RNA, 19 nt, Human
agcuagugcucagcuguca

SEQ ID NO: 752483 - RNA, 22 nt, Human
aucuggcucauucagggaacgg

SEQ ID NO: 752484 - RNA, 22 nt, Human
acggggcuagagaagguuucuu

SEQ ID NO: 752485 - RNA, 23 nt, Human
ucauggaaugaauucuucuguua

SEQ ID NO: 752486 - RNA, 22 nt, Human
uuggauccaucucaggcauagg

SEQ ID NO: 752487 - RNA, 22 nt, Human
uggcuccacuacuggguguguu

SEQ ID NO: 752488 - RNA, 22 nt, Human
cagagagcacauaggauacuuu

SEQ ID NO: 752489 - RNA, 17 nt, Human
agaaagaggauccacag

SEQ ID NO: 752490 - RNA, 23 nt, Human
uuacaacuauuugccauguuguu

SEQ ID NO: 752491 - RNA, 22 nt, Human
agcccuucaaccugccuacucc

SEQ ID NO: 752492 - RNA, 22 nt, Human
gccaggagaaugcuagcagagg

SEQ ID NO: 752493 - RNA, 22 nt, Human
aauguacaaaagucagccaacu

SEQ ID NO: 752494 - RNA, 22 nt, Human
gccagccagagaggcaugguua

SEQ ID NO: 752495 - RNA, 22 nt, Human
gagccacagugguggcccacgu

SEQ ID NO: 752496 - RNA, 22 nt, Human
gcugcucucucccuaaguuggg

SEQ ID NO: 752497 - RNA, 22 nt, Human
ccucagagcagcacccagauga

SEQ ID NO: 752498 - RNA, 22 nt, Human
cguuaguggaguuugaagcugu

SEQ ID NO: 752499 - RNA, 22 nt, Human
auucauucugaccucaagagaa

SEQ ID NO: 752500 - RNA, 22 nt, Human
uggcuggggagccccgacuccc

SEQ ID NO: 752501 - RNA, 22 nt, Human
cugcaucaguggauaugauggu

SEQ ID NO: 752502 - RNA, 22 nt, Human
auuacaguucuacacauccuuu

SEQ ID NO: 752503 - RNA, 22 nt, Human
aacaugugucuggcuagauugu

SEQ ID NO: 752504 - RNA, 22 nt, Human
uccucccugggagcuucugagu

SEQ ID NO: 752505 - RNA, 22 nt, Human
cuauaucuacauuugcuguuug

SEQ ID NO: 752506 - RNA, 22 nt, Human
cccugcagccggccagcucauu

SEQ ID NO: 752507 - RNA, 21 nt, Human
caaggacagguugcagggcaa

SEQ ID NO: 752508 - RNA, 22 nt, Human
auuaaagaaacccagcauguga

SEQ ID NO: 752509 - RNA, 22 nt, Human
ccuggagauuauuugguccaau

SEQ ID NO: 752510 - RNA, 22 nt, Human
ccagcugagaaguguaaaguga

SEQ ID NO: 752511 - RNA, 22 nt, Human
ggcacagcccucucuguggaca

SEQ ID NO: 752512 - RNA, 18 nt, Human
gagaggagccagaauuuu

SEQ ID NO: 752513 - RNA, 22 nt, Human
uuagauaccuuuguguuguaga

SEQ ID NO: 752514 - RNA, 22 nt, Human
uauuuagaugcauuuggauugc

SEQ ID NO: 752515 - RNA, 22 nt, Human
augcaggagaccaauuggaugg

SEQ ID NO: 752516 - RNA, 22 nt, Human
gcuggcugcgucaucacagggc

SEQ ID NO: 752517 - RNA, 22 nt, Human
uuucagacuguacuuugggguu

SEQ ID NO: 752518 - RNA, 19 nt, Human
ucccaggcaaaggcuucuc

SEQ ID NO: 752519 - RNA, 22 nt, Human
uuaaagucccugccuuaauucc

SEQ ID NO: 752520 - RNA, 22 nt, Human
auuuuaauaagauucccaagua

SEQ ID NO: 752521 - RNA, 22 nt, Human
uacuaggaagcagcugcauugg

SEQ ID NO: 752522 - RNA, 22 nt, Human
aaggcacugaacuuaaauucug

SEQ ID NO: 752523 - RNA, 22 nt, Human
gugggcaguggggucuucugcc

SEQ ID NO: 752524 - RNA, 22 nt, Human
ucagaaagcuuagugucuugca

SEQ ID NO: 752525 - RNA, 22 nt, Human
ugguuccaagauggcugccaca

SEQ ID NO: 752526 - RNA, 22 nt, Human
ucacagaaugucuagcauaauu

SEQ ID NO: 752527 - RNA, 22 nt, Human
aaucaugaaauaucaguucuuu

SEQ ID NO: 752528 - RNA, 22 nt, Human
ugauuacaauugucuuagauuu

SEQ ID NO: 752529 - RNA, 21 nt, Human
aggcccuggaggucagagaaa

SEQ ID NO: 752530 - RNA, 22 nt, Human
guacaacaggauugauguacca

SEQ ID NO: 752531 - RNA, 22 nt, Human
ucugaagugaucaucauuucuc

SEQ ID NO: 752532 - RNA, 22 nt, Human
caggcagcugacugucagauau

SEQ ID NO: 752533 - RNA, 18 nt, Human
uaacauguuuucauuaag

SEQ ID NO: 752534 - RNA, 22 nt, Human
gagagcuaacuaccuggaaaug

SEQ ID NO: 752535 - RNA, 22 nt, Human
cugcucuagagagcauuaguca

SEQ ID NO: 752536 - RNA, 22 nt, Human
gugcaaaagcaguuggauuuuu

SEQ ID NO: 752537 - RNA, 22 nt, Human
agugagggaugaagaacugcgg

SEQ ID NO: 752538 - RNA, 20 nt, Human
agcaccagugggggcagccc

SEQ ID NO: 752539 - RNA, 22 nt, Human
ucccaggaugugcgugccgccg

SEQ ID NO: 752540 - RNA, 22 nt, Human
agcccagugggccgaggcgggg

SEQ ID NO: 752541 - RNA, 22 nt, Human
gaagaucaagugucauucugug

SEQ ID NO: 752542 - RNA, 22 nt, Human
cugcagcagugugucucauuuu

SEQ ID NO: 752543 - RNA, 22 nt, Human
ggaagaaagguggacaacaggu

SEQ ID NO: 752544 - RNA, 22 nt, Human
gaggcuaagcacuggcauuucu

SEQ ID NO: 752545 - RNA, 22 nt, Human
gagccagguuggaggcugcagu

SEQ ID NO: 752546 - RNA, 22 nt, Human
uagggcaguuauaacauuagug

SEQ ID NO: 752547 - RNA, 22 nt, Human
ucucuguggugggaggcugagu

SEQ ID NO: 752548 - RNA, 22 nt, Human
auaauaucgcuccuuuuuuuga

SEQ ID NO: 752549 - RNA, 22 nt, Human
agccuggagguaaugaggaaac

SEQ ID NO: 752550 - RNA, 22 nt, Human
gaaugauauuauuucgugcugg

SEQ ID NO: 752551 - RNA, 22 nt, Human
ugaagcaggguggccagauugu

SEQ ID NO: 752552 - RNA, 22 nt, Human
gggccuguguguucaggagccu

SEQ ID NO: 752553 - RNA, 22 nt, Human
cagaguuuuaucauacguggau

SEQ ID NO: 752554 - RNA, 22 nt, Human
gaaaugucaagauauguuugga

SEQ ID NO: 752555 - RNA, 22 nt, Human
gaagagcuggaauccagucugg

SEQ ID NO: 752556 - RNA, 22 nt, Human
cagcaggccaugcugcuuuuca

SEQ ID NO: 752557 - RNA, 22 nt, Human
uaugugaauacagcaguggaug

SEQ ID NO: 752558 - RNA, 22 nt, Human
ucucuguagagacagcacugug

SEQ ID NO: 752559 - RNA, 22 nt, Human
auuuccauacacccauuucuga

SEQ ID NO: 752560 - RNA, 22 nt, Human
acugugugaggcugggugaguc

SEQ ID NO: 752561 - RNA, 22 nt, Human
ugagagccuguguucaaaugcc

SEQ ID NO: 752562 - RNA, 22 nt, Human
cccacccagcugagccgcucac

SEQ ID NO: 752563 - RNA, 22 nt, Human
ccugccugcagaaaguaucucc

SEQ ID NO: 752564 - RNA, 22 nt, Human
ggcauuaacucuguuucaauuu

SEQ ID NO: 752565 - RNA, 22 nt, Human
gcaguacuuuaucacauggaau

SEQ ID NO: 752566 - RNA, 22 nt, Human
acuguggcucaucaggcuggug

SEQ ID NO: 752567 - RNA, 23 nt, Human
aaacuacaacgccaggcacugag

SEQ ID NO: 752568 - RNA, 22 nt, Human
gcaacagcauucucauugacau

SEQ ID NO: 752569 - RNA, 22 nt, Human
uuggaaggguuucaguuagucu

SEQ ID NO: 752570 - RNA, 23 nt, Human
cacuccuguuucuaagccagcau

SEQ ID NO: 752571 - RNA, 22 nt, Human
agaaaugcucaggucaacuuaa

SEQ ID NO: 752572 - RNA, 22 nt, Human
gcucccagcuggagccucaaca

SEQ ID NO: 752573 - RNA, 22 nt, Human
ugugugucacugaaagaaaucu

SEQ ID NO: 752574 - RNA, 22 nt, Human
uguagcaguuuuucauuaucca

SEQ ID NO: 752575 - RNA, 22 nt, Human
cuggcagguccagcuggacuca

SEQ ID NO: 752576 - RNA, 20 nt, Human
acuuucucgguuucucaccu

SEQ ID NO: 752577 - RNA, 22 nt, Human
accagcugaguaggggagggcc

SEQ ID NO: 752578 - RNA, 22 nt, Human
agauaacauguugcagauucug

SEQ ID NO: 752579 - RNA, 22 nt, Human
uuagaggacaagaggccuggcu

SEQ ID NO: 752580 - RNA, 22 nt, Human
ugaguuacugccuaguaacuug

SEQ ID NO: 752581 - RNA, 19 nt, Human
uuccugugcugcugugucc

SEQ ID NO: 752582 - RNA, 22 nt, Human
gaggccuggguuggaggugcau

SEQ ID NO: 752583 - RNA, 22 nt, Human
cuguauaacaucuuuuguuucc

SEQ ID NO: 752584 - RNA, 22 nt, Human
ucugcugcuacagacucucuag

SEQ ID NO: 752585 - RNA, 21 nt, Human
aggcaugagcccugcauggac

SEQ ID NO: 752586 - RNA, 23 nt, Human
uugaaggagaaagcuuucuuggu

SEQ ID NO: 752587 - RNA, 22 nt, Human
caucaaaauuagacauuguuga

SEQ ID NO: 752588 - RNA, 22 nt, Human
guggugaguucaggcuggggug

SEQ ID NO: 752589 - RNA, 22 nt, Human
ccagcaggacuuuggaaauaug

SEQ ID NO: 752590 - RNA, 22 nt, Human
agcuucugcccguguuugcucu

SEQ ID NO: 752591 - RNA, 22 nt, Human
gugugugcaagagguuuauuga

SEQ ID NO: 752592 - RNA, 22 nt, Human
augaauuguccgauguugugca

SEQ ID NO: 752593 - RNA, 22 nt, Human
gaucaauacuauuaagaucaua

SEQ ID NO: 752594 - RNA, 22 nt, Human
uguaacagagcuuuuuuauagc

SEQ ID NO: 752595 - RNA, 22 nt, Human
uuuccacuccuauugcaucuca

SEQ ID NO: 752596 - RNA, 22 nt, Human
gauccuugcacuugacuuggca

SEQ ID NO: 752597 - RNA, 22 nt, Human
cuguucacagaauccuccccug

SEQ ID NO: 752598 - RNA, 22 nt, Human
ugugaaagagucuuauaguuuc

SEQ ID NO: 752599 - RNA, 22 nt, Human
gucauuuaucuucagaauuucu

SEQ ID NO: 752600 - RNA, 22 nt, Human
uggcaagaauauuggaccagaa

SEQ ID NO: 752601 - RNA, 22 nt, Human
auagcauggccugugacacuuu

SEQ ID NO: 752602 - RNA, 22 nt, Human
cacugucccuguuuccuggaaa

SEQ ID NO: 752603 - RNA, 22 nt, Human
gcucaggcauguaugugguugc

SEQ ID NO: 752604 - RNA, 22 nt, Human
gcccccagaagggccacagauu

SEQ ID NO: 752605 - RNA, 22 nt, Human
agcuagaauauugaucugaaau

SEQ ID NO: 752606 - RNA, 22 nt, Human
auguuauuuauuauccucgguu

SEQ ID NO: 752607 - RNA, 22 nt, Human
uuauuugaaaagaagguuacgu

SEQ ID NO: 752608 - RNA, 22 nt, Human
uggagcugaggggaaugcugag

SEQ ID NO: 752609 - RNA, 22 nt, Human
gcaugcauuuucugagagucag

SEQ ID NO: 752610 - RNA, 20 nt, Human
gcuuucuaugagauggacug

SEQ ID NO: 752611 - RNA, 22 nt, Human
uuucagacugcccauguuugcc

SEQ ID NO: 752612 - RNA, 22 nt, Human
gcucagugaauuuuugcccaug

SEQ ID NO: 752613 - RNA, 22 nt, Human
ggaaagcuuuguuuuccucacc

SEQ ID NO: 752614 - RNA, 22 nt, Human
ugaaagaagccucccuuuggag

SEQ ID NO: 752615 - RNA, 22 nt, Human
aacuaaaucuggcauuuagagc

SEQ ID NO: 752616 - RNA, 22 nt, Human
acaaaaguaguugcgguuuuug

SEQ ID NO: 752617 - RNA, 22 nt, Human
agugcugacucugggcacagug

SEQ ID NO: 752618 - RNA, 22 nt, Human
agugagggacuagugcugggga

SEQ ID NO: 752619 - RNA, 22 nt, Human
gugacagaguuuuagaucucau

SEQ ID NO: 752620 - RNA, 22 nt, Human
ugccugugucacagugauguuu

SEQ ID NO: 752621 - RNA, 22 nt, Human
aaauucagauggcuuucuuuuc

SEQ ID NO: 752622 - RNA, 22 nt, Human
gcccacucuggagccuguuccc

SEQ ID NO: 752623 - RNA, 22 nt, Human
uggccaggggaguuccccucca

SEQ ID NO: 752624 - RNA, 22 nt, Human
ucucaaauucccuuuuccuccu

SEQ ID NO: 752625 - RNA, 22 nt, Human
uccagcacucgcccagggcuug

SEQ ID NO: 752626 - RNA, 22 nt, Human
aaaccuuugccuggaagggagu

SEQ ID NO: 752627 - RNA, 22 nt, Human
ugcauccuccuuuguccucuug

SEQ ID NO: 752628 - RNA, 22 nt, Human
acugggcuucacuuggcacauc

SEQ ID NO: 752629 - RNA, 22 nt, Human
ccuggacuaaaaucuuuucuua

SEQ ID NO: 752630 - RNA, 19 nt, Human
ugcauugagggcugucuca

SEQ ID NO: 752631 - RNA, 22 nt, Human
aaugaacuguguuaacugaaua

SEQ ID NO: 752632 - RNA, 22 nt, Human
uagggcuucaggugugaggcag

SEQ ID NO: 752633 - RNA, 22 nt, Human
uuucacauguauauaggcauua

SEQ ID NO: 752634 - RNA, 22 nt, Human
aggaauuccugggaaggcacag

SEQ ID NO: 752635 - RNA, 22 nt, Human
ccugaggucuagagucagggug

SEQ ID NO: 752636 - RNA, 22 nt, Human
uaugugaagagauuaaaaaaua

SEQ ID NO: 752637 - RNA, 22 nt, Human
cauucaaacauuaauuuauuca

SEQ ID NO: 752638 - RNA, 22 nt, Human
uggguccacaaacaucagauau

SEQ ID NO: 752639 - RNA, 22 nt, Human
acugcuuuucagagucugccug

SEQ ID NO: 752640 - RNA, 22 nt, Human
ugugggcucuaauggcagcaga

SEQ ID NO: 752641 - RNA, 22 nt, Human
uacacaaugacuuaagauguca

SEQ ID NO: 752642 - RNA, 19 nt, Human
acaagggcaggcaagguga

SEQ ID NO: 752643 - RNA, 23 nt, Human
aauagcugguaaugauagcacaa

SEQ ID NO: 752644 - RNA, 22 nt, Human
gaugccucuuuuggcugaauua

SEQ ID NO: 752645 - RNA, 22 nt, Human
uccagccaugacucggacagug

SEQ ID NO: 752646 - RNA, 22 nt, Human
gcuguucuuugcaucucuggug

SEQ ID NO: 752647 - RNA, 21 nt, Human
gccugggauaguggccuccgg

SEQ ID NO: 752648 - RNA, 22 nt, Human
auaaauuaugaauggcccuuuu

SEQ ID NO: 752649 - RNA, 22 nt, Human
auucuacaccucucucauuuag

SEQ ID NO: 752650 - RNA, 22 nt, Human
aaacugugagcuaguaaauagg

SEQ ID NO: 752651 - RNA, 22 nt, Human
cagcucugcugggaggaugcag

SEQ ID NO: 752652 - RNA, 19 nt, Human
ccugcagggaugagagguu

SEQ ID NO: 752653 - RNA, 22 nt, Human
cugugucuaaucaggucaguca

SEQ ID NO: 752654 - RNA, 22 nt, Human
aucuucucauguguaaugaggu

SEQ ID NO: 752655 - RNA, 19 nt, Human
agucauauuguucaucuug

SEQ ID NO: 752656 - RNA, 22 nt, Human
aaaacccuucugcagacucuga

SEQ ID NO: 752657 - RNA, 22 nt, Human
aaccugaagaaaauauuugcug

SEQ ID NO: 752658 - RNA, 22 nt, Human
uaagagauucuaaagcuacugg

SEQ ID NO: 752659 - RNA, 22 nt, Human
aggcagugagaaauagcaagau

SEQ ID NO: 752660 - RNA, 22 nt, Human
agcugggugcccgaagccacgu

SEQ ID NO: 752661 - RNA, 22 nt, Human
uuuagggaagaagcccauggcc

SEQ ID NO: 752662 - RNA, 22 nt, Human
uucucucauucaaauuaaagug

SEQ ID NO: 752663 - RNA, 20 nt, Human
guacacauauauguaugugu

SEQ ID NO: 752664 - RNA, 22 nt, Human
gcagcauccuuggccuccaccc

SEQ ID NO: 752665 - RNA, 21 nt, Human
ugguuaaaguugugucauccc

SEQ ID NO: 752666 - RNA, 22 nt, Human
aaagcuaugaggcaugcauuuc

SEQ ID NO: 752667 - RNA, 22 nt, Human
aaggcugccucugccagaggag

SEQ ID NO: 752668 - RNA, 22 nt, Human
ggccuuggcuccugcagggagu

SEQ ID NO: 752669 - RNA, 22 nt, Human
ggugagaguuaugauuccaauu

SEQ ID NO: 752670 - RNA, 22 nt, Human
uuuaauuuucugggcccagcag

SEQ ID NO: 752671 - RNA, 22 nt, Human
ggcagcagggcugucucccuac

SEQ ID NO: 752672 - RNA, 21 nt, Human
cugcuuuacuucagaggaucu

SEQ ID NO: 752673 - RNA, 22 nt, Human
ggcccuuccugcucucuuagcu

SEQ ID NO: 752674 - RNA, 22 nt, Human
gugacagagauuaauagcuugg

SEQ ID NO: 752675 - RNA, 22 nt, Human
caugcuaaaccagaacauagga

SEQ ID NO: 752676 - RNA, 22 nt, Human
agcaaagaaauggaggcucaga

SEQ ID NO: 752677 - RNA, 22 nt, Human
ggugggguauuugguacuugua

SEQ ID NO: 752678 - RNA, 22 nt, Human
uuucaucuaacacuacauaggg

SEQ ID NO: 752679 - RNA, 22 nt, Human
aaaggcaugcauggucugcucc

SEQ ID NO: 752680 - RNA, 22 nt, Human
guacagaaggauuucuaguagu

SEQ ID NO: 752681 - RNA, 22 nt, Human
agcauauuguaugucuauaugu

SEQ ID NO: 752682 - RNA, 22 nt, Human
gccacuauuuucccaccuuucu

SEQ ID NO: 752683 - RNA, 22 nt, Human
auucuuaauugccaugcuguau

SEQ ID NO: 752684 - RNA, 22 nt, Human
ccugugccugccugugaguucu

SEQ ID NO: 752685 - RNA, 22 nt, Human
gagcucagcccaaagagcagug

SEQ ID NO: 752686 - RNA, 22 nt, Human
ccgcggggcgugggcucuuacc

SEQ ID NO: 752687 - RNA, 21 nt, Human
uauacagcaaagucuggagca

SEQ ID NO: 752688 - RNA, 22 nt, Human
uggaggcaucagagugcuuggc

SEQ ID NO: 752689 - RNA, 22 nt, Human
ugcagcugcucauucucucagu

SEQ ID NO: 752690 - RNA, 22 nt, Human
acaucuauuuuuuucuguccau

SEQ ID NO: 752691 - RNA, 22 nt, Human
ucaggaagauuaguuuccuacc

SEQ ID NO: 752692 - RNA, 22 nt, Human
auguuauuucaaaauucccuug

SEQ ID NO: 752693 - RNA, 23 nt, Human
cuucacagguucaggggauuaag

SEQ ID NO: 752694 - RNA, 22 nt, Human
agaauguguuuuaacaugggaa

SEQ ID NO: 752695 - RNA, 22 nt, Human
auauuaaaacuaugguuuucag

SEQ ID NO: 752696 - RNA, 22 nt, Human
auuauuuagaaaucgauugaaa

SEQ ID NO: 752697 - RNA, 22 nt, Human
cauccuucucaaagagugcaug

SEQ ID NO: 752698 - RNA, 22 nt, Human
acccagcuaacccuacccugga

SEQ ID NO: 752699 - RNA, 23 nt, Human
cacaucaguuuaggucagauuuu

SEQ ID NO: 752700 - RNA, 22 nt, Human
uuuguuuucuguaggccuuucc

SEQ ID NO: 752701 - RNA, 22 nt, Human
aagcacagugccaaguucuauu

SEQ ID NO: 752702 - RNA, 22 nt, Human
acagaacauauugcuucucuca

SEQ ID NO: 752703 - RNA, 22 nt, Human
gagcuaagaacugugccaggug

SEQ ID NO: 752704 - RNA, 22 nt, Human
uuuggaaugaaacagcagagcc

SEQ ID NO: 752705 - RNA, 22 nt, Human
uaaaccuugguagcaucuugcu

SEQ ID NO: 752706 - RNA, 22 nt, Human
ugucuuuacuuagaaguucagg

SEQ ID NO: 752707 - RNA, 22 nt, Human
auugaacagaaaccaucagagu

SEQ ID NO: 752708 - RNA, 22 nt, Human
agguaucugguaagaggcagac

SEQ ID NO: 752709 - RNA, 22 nt, Human
uuuuacaccucagaugagcaga

SEQ ID NO: 752710 - RNA, 22 nt, Human
gucaggaugagggaugaggagu

SEQ ID NO: 752711 - RNA, 22 nt, Human
gacagagaggcugagcaguaca

SEQ ID NO: 752712 - RNA, 22 nt, Human
caggcggccaugaucuggcagg

SEQ ID NO: 752713 - RNA, 22 nt, Human
gcuggccaguguggugaccacc

SEQ ID NO: 752714 - RNA, 20 nt, Human
ucuuccagcuucugguagaa

SEQ ID NO: 752715 - RNA, 22 nt, Human
agcugagcacauucaaacaggu

SEQ ID NO: 752716 - RNA, 22 nt, Human
gcaggggaguccacucuaugca

SEQ ID NO: 752717 - RNA, 22 nt, Human
uucauuuuauaaacccugcuga

SEQ ID NO: 752718 - RNA, 22 nt, Human
caucagcuaaacuuagugaaau

SEQ ID NO: 752719 - RNA, 22 nt, Human
caaauagacaagauggcaggaa

SEQ ID NO: 752720 - RNA, 22 nt, Human
uggagaugaggacauggacguc

SEQ ID NO: 752721 - RNA, 23 nt, Human
uggacaggacccccuucggaccc

SEQ ID NO: 752722 - RNA, 21 nt, Human
cuggaucugucaucgaguuuu

SEQ ID NO: 752723 - RNA, 20 nt, Human
cagaacaugagcaucgagcc

SEQ ID NO: 752724 - RNA, 22 nt, Human
augucagucuuucugucucaga

SEQ ID NO: 752725 - RNA, 22 nt, Human
uagauguuuuaacucuugguua

SEQ ID NO: 752726 - RNA, 22 nt, Human
aaagcagagguugcagugagcu

SEQ ID NO: 752727 - RNA, 22 nt, Human
uuccaaauuaaaauguacaaug

SEQ ID NO: 752728 - RNA, 22 nt, Human
ggcuucagaagacuggacaggu

SEQ ID NO: 752729 - RNA, 22 nt, Human
aaaucagagucugauuuuaagg

SEQ ID NO: 752730 - RNA, 22 nt, Human
uucaaguaacacaaaugcaccc

SEQ ID NO: 752731 - RNA, 22 nt, Human
ugaauucuuaaugaaaucuacu

SEQ ID NO: 752732 - RNA, 22 nt, Human
ugagggaauccucacaucaauc

SEQ ID NO: 752733 - RNA, 22 nt, Human
cacugugcuccuaacuagcugu

SEQ ID NO: 752734 - RNA, 22 nt, Human
gcaguggcuaagcucgcaugca

SEQ ID NO: 752735 - RNA, 22 nt, Human
aggcugaggagggauguugcuu

SEQ ID NO: 752736 - RNA, 22 nt, Human
uggaaucuguauguauguauaa

SEQ ID NO: 752737 - RNA, 22 nt, Human
gugaccaucaucucagcuaguu

SEQ ID NO: 752738 - RNA, 22 nt, Human
agaagugaggaaauccucuuua

SEQ ID NO: 752739 - RNA, 22 nt, Human
gccuccacuuuugcuggcuucu

SEQ ID NO: 752740 - RNA, 22 nt, Human
ugcccuugaaauacgcuugggg

SEQ ID NO: 752741 - RNA, 22 nt, Human
uuggggucccacaggcugccug

SEQ ID NO: 752742 - RNA, 22 nt, Human
gagaaacuuggaguuauucugg

SEQ ID NO: 752743 - RNA, 22 nt, Human
ugcuaaauaacuuacauagugg

SEQ ID NO: 752744 - RNA, 22 nt, Human
ugggaugauagguaaguaauua

SEQ ID NO: 752745 - RNA, 22 nt, Human
gugggcugaggggacaccaagg

SEQ ID NO: 752746 - RNA, 22 nt, Human
ggcgcccaucggugcagagggc

SEQ ID NO: 752747 - RNA, 20 nt, Human
uacaguucuguagaaguaga

SEQ ID NO: 752748 - RNA, 22 nt, Human
guguaugcaauugagucauaga

SEQ ID NO: 752749 - RNA, 22 nt, Human
uacuccaggacuccauuugaaa

SEQ ID NO: 752750 - RNA, 21 nt, Human
auugaaagucaacaaucaguu

SEQ ID NO: 752751 - RNA, 20 nt, Human
gacuuuacaucagcacucuu

SEQ ID NO: 752752 - RNA, 22 nt, Human
gaggacacggccuuuuggaaaa

SEQ ID NO: 752753 - RNA, 22 nt, Human
cgagauccuucagagcgcggac

SEQ ID NO: 752754 - RNA, 22 nt, Human
uucaaacacugcuuugagaggg

SEQ ID NO: 752755 - RNA, 22 nt, Human
cucagaguccccacaucugggu

SEQ ID NO: 752756 - RNA, 22 nt, Human
ugugagacaauugcaucagggc

SEQ ID NO: 752757 - RNA, 22 nt, Human
agcagccauuuaaaaugaauug

SEQ ID NO: 752758 - RNA, 22 nt, Human
cagccucucuguaucucaggau

SEQ ID NO: 752759 - RNA, 22 nt, Human
cuguggcagaggugacaccucu

SEQ ID NO: 752760 - RNA, 22 nt, Human
uggauuuauuagguuggugaaa

SEQ ID NO: 752761 - RNA, 22 nt, Human
guuucuaagggagagcugccag

SEQ ID NO: 752762 - RNA, 22 nt, Human
caggcagcagaggaguguggga

SEQ ID NO: 752763 - RNA, 19 nt, Human
cauaaauguacaagauaca

SEQ ID NO: 752764 - RNA, 16 nt, Human
cuggcccuggcucugg

SEQ ID NO: 752765 - RNA, 22 nt, Human
ggcucauguuucagaaagugga

SEQ ID NO: 752766 - RNA, 22 nt, Human
ugggccaguuauuucaccucug

SEQ ID NO: 752767 - RNA, 22 nt, Human
cuucccugguguuagcccaaug

SEQ ID NO: 752768 - RNA, 22 nt, Human
auuuagucucccuuaucaagga

SEQ ID NO: 752769 - RNA, 22 nt, Human
ucucaaauguaaagcaugauuu

SEQ ID NO: 752770 - RNA, 22 nt, Human
uuuagacauuugugguuugcaa

SEQ ID NO: 752771 - RNA, 22 nt, Human
aggugcaggagcugugcaggga

SEQ ID NO: 752772 - RNA, 22 nt, Human
uggcaaagcuagacauucccuc

SEQ ID NO: 752773 - RNA, 17 nt, Human
uguccauuugccuggag

SEQ ID NO: 752774 - RNA, 19 nt, Human
ccacagagcaugcugaggc

SEQ ID NO: 752775 - RNA, 22 nt, Human
agcugugggauuugggugugcc

SEQ ID NO: 752776 - RNA, 22 nt, Human
uguugauuaguguuuagacuua

SEQ ID NO: 752777 - RNA, 22 nt, Human
cacagaugaaguaaacaacucu

SEQ ID NO: 752778 - RNA, 22 nt, Human
agccuggauucgugcauccaca

SEQ ID NO: 752779 - RNA, 22 nt, Human
uacaucauguaagcagaaucau

SEQ ID NO: 752780 - RNA, 22 nt, Human
gaacuauaucuucaagaaaaug

SEQ ID NO: 752781 - RNA, 22 nt, Human
uugccuuuaaguauaacugcug

SEQ ID NO: 752782 - RNA, 22 nt, Human
uggaaauagcuccaguuucauu

SEQ ID NO: 752783 - RNA, 22 nt, Human
cagagaaacucagauagcugau

SEQ ID NO: 752784 - RNA, 21 nt, Human
cagaaguaaggguaacuucuc

SEQ ID NO: 752785 - RNA, 22 nt, Human
acaauaauguauugccaaaagu

SEQ ID NO: 752786 - RNA, 22 nt, Human
auucaguuguaaucuuuguuag

SEQ ID NO: 752787 - RNA, 22 nt, Human
acuucacagauauuuauuuggu

SEQ ID NO: 752788 - RNA, 22 nt, Human
uuuuacaggucauagguauagu

SEQ ID NO: 752789 - RNA, 22 nt, Human
cugagcugcaguccuggcucug

SEQ ID NO: 752790 - RNA, 22 nt, Human
gcagcuggagccagccagacac

SEQ ID NO: 752791 - RNA, 22 nt, Human
ggcucugcuucagaaggcucau

SEQ ID NO: 752792 - RNA, 22 nt, Human
uuguucaucguccuugcucugu

SEQ ID NO: 752793 - RNA, 22 nt, Human
agcacagaguugcucacugccg

SEQ ID NO: 752794 - RNA, 22 nt, Human
ucccugagcuucucugaaaugg

SEQ ID NO: 752795 - RNA, 22 nt, Human
auucaguucuaaggucagugcc

SEQ ID NO: 752796 - RNA, 22 nt, Human
ggccuuggauccaagcugcggc

SEQ ID NO: 752797 - RNA, 22 nt, Human
gugccugguuuggggaguguuc

SEQ ID NO: 752798 - RNA, 22 nt, Human
gugaaaaaucaucaugacuuga

SEQ ID NO: 752799 - RNA, 22 nt, Human
cugcuuuaccaaacucuuggau

SEQ ID NO: 752800 - RNA, 22 nt, Human
auacaguaauugcccugcaaug

SEQ ID NO: 752801 - RNA, 22 nt, Human
gccuugccucagccauggaaac

SEQ ID NO: 752802 - RNA, 22 nt, Human
cugcugcugagagcucagccug

SEQ ID NO: 752803 - RNA, 22 nt, Human
cuuccagaggaacucugcagug

SEQ ID NO: 752804 - RNA, 22 nt, Human
aggagaaagacuggacagccaa

SEQ ID NO: 752805 - RNA, 22 nt, Human
uuuuaaacugcagaauuuagaa

SEQ ID NO: 752806 - RNA, 22 nt, Human
acaggagcccaggaugggcgga

SEQ ID NO: 752807 - RNA, 21 nt, Human
agaggcaggcauuaaguacac

SEQ ID NO: 752808 - RNA, 22 nt, Human
agccagaguugaaugugagucu

SEQ ID NO: 752809 - RNA, 22 nt, Human
ugcuggcuguguaccaucucaa

SEQ ID NO: 752810 - RNA, 22 nt, Human
uaccuucucuagaucuuuauuc

SEQ ID NO: 752811 - RNA, 22 nt, Human
agugcugggauugcaggcauga

SEQ ID NO: 752812 - RNA, 22 nt, Human
uguaucuguuuagcacccagcc

SEQ ID NO: 752813 - RNA, 22 nt, Human
uuccaaagaaauugaccaagac

SEQ ID NO: 752814 - RNA, 22 nt, Human
agugcugggauuacaggcauaa

SEQ ID NO: 752815 - RNA, 22 nt, Human
caaggcaggucugaggagguug

SEQ ID NO: 752816 - RNA, 23 nt, Human
agcauucucuccaacauuuaaca

SEQ ID NO: 752817 - RNA, 22 nt, Human
auggucuugugagaguaacagu

SEQ ID NO: 752818 - RNA, 22 nt, Human
uacagccuccacaggccaagug

SEQ ID NO: 752819 - RNA, 20 nt, Human
ugucagugccugaggcacag

SEQ ID NO: 752820 - RNA, 22 nt, Human
cucuuccaccuccuucaggaga

SEQ ID NO: 752821 - RNA, 22 nt, Human
auuaacacuuuggagucugcuc

SEQ ID NO: 752822 - RNA, 22 nt, Human
uagcuauuguugguaguuaccc

SEQ ID NO: 752823 - RNA, 22 nt, Human
ggcaccugguaagugcucagua

SEQ ID NO: 752824 - RNA, 22 nt, Human
guggagccaggggcuguaggua

SEQ ID NO: 752825 - RNA, 22 nt, Human
agcugagcuaguaguuccagug

SEQ ID NO: 752826 - RNA, 22 nt, Human
uggacucuaugaugcgccagca

SEQ ID NO: 752827 - RNA, 22 nt, Human
agauggaggaaggcugaacuca

SEQ ID NO: 752828 - RNA, 22 nt, Human
uucagagaagcaaaggcagauu

SEQ ID NO: 752829 - RNA, 23 nt, Human
acugauucuugaaguugacaagu

SEQ ID NO: 752830 - RNA, 22 nt, Human
aguaaaaucaccaucucuuugu

SEQ ID NO: 752831 - RNA, 22 nt, Human
gcucuguacgcaggaugagggg

SEQ ID NO: 752832 - RNA, 22 nt, Human
cagcccugcugacacugucuga

SEQ ID NO: 752833 - RNA, 21 nt, Human
ugucugccccuguuuaccaga

SEQ ID NO: 752834 - RNA, 22 nt, Human
acaggucuccagagugagagga

SEQ ID NO: 752835 - RNA, 22 nt, Human
auguuucaguucuaaaguuaga

SEQ ID NO: 752836 - RNA, 22 nt, Human
ccaggguuggaugagucacuua

SEQ ID NO: 752837 - RNA, 22 nt, Human
guuccugaagggacuggugcag

SEQ ID NO: 752838 - RNA, 22 nt, Human
acacagcuaugggguaggaaac

SEQ ID NO: 752839 - RNA, 22 nt, Human
auccaaaccuggacaugagugg

SEQ ID NO: 752840 - RNA, 22 nt, Human
uucuaaagugcaaucugacaga

SEQ ID NO: 752841 - RNA, 22 nt, Human
cuggauggucccaugagcagcu

SEQ ID NO: 752842 - RNA, 22 nt, Human
cacaaugucugguaggccacuu

SEQ ID NO: 752843 - RNA, 22 nt, Human
uaauguguugaauauuuguaca

SEQ ID NO: 752844 - RNA, 22 nt, Human
caauucaaaugcauaguucaca

SEQ ID NO: 752845 - RNA, 22 nt, Human
uggcucuguggucuuagcaugc

SEQ ID NO: 752846 - RNA, 22 nt, Human
uagaacauaagucauucauuug

SEQ ID NO: 752847 - RNA, 22 nt, Human
acacaggcaagagugcaggucu

SEQ ID NO: 752848 - RNA, 22 nt, Human
aaggaagaagggaaguuacuua

SEQ ID NO: 752849 - RNA, 22 nt, Human
agcagccacagcagaucugagu

SEQ ID NO: 752850 - RNA, 22 nt, Human
gcugaagcccacguggcuugua

SEQ ID NO: 752851 - RNA, 22 nt, Human
uucugugauugacauguggcuu

SEQ ID NO: 752852 - RNA, 22 nt, Human
ugacugccgauuguccuucucu

SEQ ID NO: 752853 - RNA, 22 nt, Human
uuuaauggcaagaaggcugcag

SEQ ID NO: 752854 - RNA, 19 nt, Human
aggcccagcgcugggggcu

SEQ ID NO: 752855 - RNA, 19 nt, Human
ucugggcagggccagcacc

SEQ ID NO: 752856 - RNA, 22 nt, Human
caaguuuugauuuugcaguaaa

SEQ ID NO: 752857 - RNA, 22 nt, Human
uuucagacauaccaguuauuga

SEQ ID NO: 752858 - RNA, 22 nt, Human
acucccuccaaaucugcacagu

SEQ ID NO: 752859 - RNA, 22 nt, Human
agcugccagaugacagugcuau

SEQ ID NO: 752860 - RNA, 22 nt, Human
acugagguuguaguaggaauuc

SEQ ID NO: 752861 - RNA, 22 nt, Human
agagccaggaucuguuuugggg

SEQ ID NO: 752862 - RNA, 22 nt, Human
uauaggaaggcagauuuuagcu

SEQ ID NO: 752863 - RNA, 22 nt, Human
uccugcagagucccacugauuu

SEQ ID NO: 752864 - RNA, 22 nt, Human
aaguucaaucagaugaaaaagc

SEQ ID NO: 752865 - RNA, 22 nt, Human
ugagccagguuaagacaggagc

SEQ ID NO: 752866 - RNA, 22 nt, Human
guuaaauaaccucauguccguu

SEQ ID NO: 752867 - RNA, 22 nt, Human
ugccauuugcugguuuucugau

SEQ ID NO: 752868 - RNA, 22 nt, Human
gucugaaauggaggugggaacu

SEQ ID NO: 752869 - RNA, 22 nt, Human
uggcucuguuuuaugaguacca

SEQ ID NO: 752870 - RNA, 20 nt, Human
uagauccuggggauuuauug

SEQ ID NO: 752871 - RNA, 22 nt, Human
ugggaagauggagugacaggca

SEQ ID NO: 752872 - RNA, 22 nt, Human
aaaugcaugagaaaguauucug

SEQ ID NO: 752873 - RNA, 22 nt, Human
ggccaagauggaaggagagaug

SEQ ID NO: 752874 - RNA, 22 nt, Human
aaacuuuugguccucauggguu

SEQ ID NO: 752875 - RNA, 22 nt, Human
aacaaugcacuaucguaagugg

SEQ ID NO: 752876 - RNA, 22 nt, Human
gcagcccaaaaaagagguagau

SEQ ID NO: 752877 - RNA, 22 nt, Human
gcccaagguauaucagagacag

SEQ ID NO: 752878 - RNA, 22 nt, Human
cuggcagcaggucacacgcaga

SEQ ID NO: 752879 - RNA, 22 nt, Human
gaacuuuaauuagcuuuugucu

SEQ ID NO: 752880 - RNA, 22 nt, Human
ucugucaucuguucagugcuca

SEQ ID NO: 752881 - RNA, 22 nt, Human
augcauauugauuauagauuca

SEQ ID NO: 752882 - RNA, 22 nt, Human
uucaauucuaaacuaauauucu

SEQ ID NO: 752883 - RNA, 22 nt, Human
cugagaggcagccagagaaaau

SEQ ID NO: 752884 - RNA, 22 nt, Human
auuauuacuccugauuguacug

SEQ ID NO: 752885 - RNA, 22 nt, Human
cagcauauuacuuuaaaaaauc

SEQ ID NO: 752886 - RNA, 22 nt, Human
gggugggccacugagcagcgug

SEQ ID NO: 752887 - RNA, 22 nt, Human
aggcaggcccugggccaucccg

SEQ ID NO: 752888 - RNA, 22 nt, Human
ccugcuccugcuauucuucugg

SEQ ID NO: 752889 - RNA, 22 nt, Human
ggagcagagcucuucaucugca

SEQ ID NO: 752890 - RNA, 22 nt, Human
cagacacacaagcaaucuaagu

SEQ ID NO: 752891 - RNA, 22 nt, Human
ucucaggcaugguuuguucauc

SEQ ID NO: 752892 - RNA, 21 nt, Human
uuagaagcuaaugcagcuggu

SEQ ID NO: 752893 - RNA, 23 nt, Human
agacugaggcugccagggucaga

SEQ ID NO: 752894 - RNA, 21 nt, Human
guggcccugguguggcugcac

SEQ ID NO: 752895 - RNA, 22 nt, Human
gcaaggagacuguagggccaag

SEQ ID NO: 752896 - RNA, 22 nt, Human
ucuggagagucacagugccaga

SEQ ID NO: 752897 - RNA, 22 nt, Human
gcaggagucacugacuuggucc

SEQ ID NO: 752898 - RNA, 22 nt, Human
cugggccuugccuugcccacag

SEQ ID NO: 752899 - RNA, 22 nt, Human
uuucugcuuaggacucugugga

SEQ ID NO: 752900 - RNA, 22 nt, Human
auacuaagcucauuacauuuug

SEQ ID NO: 752901 - RNA, 22 nt, Human
aggcagagcuggguuuugaaau

SEQ ID NO: 752902 - RNA, 22 nt, Human
uagaaaagccccagcuggaggg

SEQ ID NO: 752903 - RNA, 21 nt, Human
acccugcuuuaugccguccuc

SEQ ID NO: 752904 - RNA, 22 nt, Human
ccauuuuauuagugacauuuag

SEQ ID NO: 752905 - RNA, 22 nt, Human
uccggggcuuccccgcagugcc

SEQ ID NO: 752906 - RNA, 22 nt, Human
gcuggcaggguucucacugaaa

SEQ ID NO: 752907 - RNA, 22 nt, Human
accuggagucauuugaggagua

SEQ ID NO: 752908 - RNA, 22 nt, Human
ggagcugugcagugacuacaga

SEQ ID NO: 752909 - RNA, 22 nt, Human
uuuuuccuagcgauuugucagc

SEQ ID NO: 752910 - RNA, 22 nt, Human
uccugccuagcaggugaccuau

SEQ ID NO: 752911 - RNA, 22 nt, Human
uugaaguucuaagccccaguac

SEQ ID NO: 752912 - RNA, 22 nt, Human
gcgugcauggccguguguaugc

SEQ ID NO: 752913 - RNA, 22 nt, Human
ggacaggccuggcacaguacug

SEQ ID NO: 752914 - RNA, 22 nt, Human
caugcuaagucauaaaagagua

SEQ ID NO: 752915 - RNA, 18 nt, Human
guaggucaguaccaagca

SEQ ID NO: 752916 - RNA, 20 nt, Human
aaaguucauguuugcacuuu

SEQ ID NO: 752917 - RNA, 23 nt, Human
ucugagggagugggcaguggcac

SEQ ID NO: 752918 - RNA, 22 nt, Human
uacuagaaugccacuguuagug

SEQ ID NO: 752919 - RNA, 22 nt, Human
cuggaguguaaagagcauagaa

SEQ ID NO: 752920 - RNA, 22 nt, Human
gcuuggcuggagaaaguuaccu

SEQ ID NO: 752921 - RNA, 22 nt, Human
cugagugauagcgauggggaac

SEQ ID NO: 752922 - RNA, 22 nt, Human
gcuucugguagaauucaauaga

SEQ ID NO: 752923 - RNA, 22 nt, Human
cugagagguaagcagcgcagug

SEQ ID NO: 752924 - RNA, 22 nt, Human
gggggacuggaccguccugggu

SEQ ID NO: 752925 - RNA, 22 nt, Human
ugauucaagagaguugggguau

SEQ ID NO: 752926 - RNA, 19 nt, Human
uuuagcuuacguuucauug

SEQ ID NO: 752927 - RNA, 22 nt, Human
aaugucauagcauuucuucaau

SEQ ID NO: 752928 - RNA, 22 nt, Human
uaugucuggaauuugagguuca

SEQ ID NO: 752929 - RNA, 22 nt, Human
cauggcaggugcagauucugug

SEQ ID NO: 752930 - RNA, 22 nt, Human
agcagugaguaacacagaccag

SEQ ID NO: 752931 - RNA, 23 nt, Human
uucagaagaaaugaguacaggag

SEQ ID NO: 752932 - RNA, 22 nt, Human
gaucagaauuuacuuauaauug

SEQ ID NO: 752933 - RNA, 22 nt, Human
agccaggaagagaggccucacc

SEQ ID NO: 752934 - RNA, 22 nt, Human
cagcacaugcucaucagggaag

SEQ ID NO: 752935 - RNA, 20 nt, Human
uuuucugugccaagaaaacu

SEQ ID NO: 752936 - RNA, 22 nt, Human
uguuuaauucaccaucauguuc

SEQ ID NO: 752937 - RNA, 22 nt, Human
uacuuguucuuucaagagauag

SEQ ID NO: 752938 - RNA, 22 nt, Human
cuguauucaagcuucugcccaa

SEQ ID NO: 752939 - RNA, 22 nt, Human
uugcuguuucucugugucuggu

SEQ ID NO: 752940 - RNA, 22 nt, Human
auacauguaacugcauuguaau

SEQ ID NO: 752941 - RNA, 22 nt, Human
auggaguucugccagcgcugcu

SEQ ID NO: 752942 - RNA, 22 nt, Human
aaaucucuggucacagaacuua

SEQ ID NO: 752943 - RNA, 22 nt, Human
uagguucacacaucuuccagau

SEQ ID NO: 752944 - RNA, 22 nt, Human
guggucaggggcugaggugccc

SEQ ID NO: 752945 - RNA, 22 nt, Human
agaggagcuuuuggaaaaggcc

SEQ ID NO: 752946 - RNA, 22 nt, Human
gccucugaguuuggagaagagc

SEQ ID NO: 752947 - RNA, 22 nt, Human
caggcacuucggcagcguggua

SEQ ID NO: 752948 - RNA, 21 nt, Human
gugcucugggcagcagagggc

SEQ ID NO: 752949 - RNA, 22 nt, Human
uaggccuauuguauucuuaucu

SEQ ID NO: 752950 - RNA, 22 nt, Human
ggcuacagaggccgugagccug

SEQ ID NO: 752951 - RNA, 22 nt, Human
aagacauuacuggaaucugacu

SEQ ID NO: 752952 - RNA, 22 nt, Human
cuacacuugcaugagucuugaa

SEQ ID NO: 752953 - RNA, 22 nt, Human
ugcucuguaggggaaagagagc

SEQ ID NO: 752954 - RNA, 22 nt, Human
cuccaaguauguuaaaaucuaa

SEQ ID NO: 752955 - RNA, 22 nt, Human
cagugagguagacagcuuuuuc

SEQ ID NO: 752956 - RNA, 22 nt, Human
cugacccuggucaaguugccuc

SEQ ID NO: 752957 - RNA, 22 nt, Human
uggcccuucaaauucccuaguc

SEQ ID NO: 752958 - RNA, 22 nt, Human
aguugcagacgcagagauguug

SEQ ID NO: 752959 - RNA, 22 nt, Human
cagaggcuaaggguagcuuggg

SEQ ID NO: 752960 - RNA, 22 nt, Human
ucuccugaugaugguacuggca

SEQ ID NO: 752961 - RNA, 22 nt, Human
ccugccuauguaagugguuucu

SEQ ID NO: 752962 - RNA, 22 nt, Human
cugggccuaggauggaagggcc

SEQ ID NO: 752963 - RNA, 22 nt, Human
agaucuuuagaagauagaauca

SEQ ID NO: 752964 - RNA, 22 nt, Human
uaggcuccaguguguggcgagu

SEQ ID NO: 752965 - RNA, 22 nt, Human
agguggcuguauucagcuguaa

SEQ ID NO: 752966 - RNA, 22 nt, Human
aguggcugagugacugugacuc

SEQ ID NO: 752967 - RNA, 22 nt, Human
augaagcaacagcccuccuauu

SEQ ID NO: 752968 - RNA, 22 nt, Human
caguauauuuuagagaaguccc

SEQ ID NO: 752969 - RNA, 22 nt, Human
cagucuccugggggcuguuguu

SEQ ID NO: 752970 - RNA, 22 nt, Human
auuauauaggacuugcccuucc

SEQ ID NO: 752971 - RNA, 22 nt, Human
gcucaggccucggacacacaau

SEQ ID NO: 752972 - RNA, 22 nt, Human
ucucuggccgagagucccuggg

SEQ ID NO: 752973 - RNA, 22 nt, Human
augucugguggucgaugcuaca

SEQ ID NO: 752974 - RNA, 22 nt, Human
uacauagaggguaauagcauca

SEQ ID NO: 752975 - RNA, 22 nt, Human
uacagauauuguacaguuauag

SEQ ID NO: 752976 - RNA, 22 nt, Human
uucugggcuguccagaggguga

SEQ ID NO: 752977 - RNA, 23 nt, Human
gcagacagagcagacuaagacaa

SEQ ID NO: 752978 - RNA, 22 nt, Human
gugcaaaaguaauugcgguuuu

SEQ ID NO: 752979 - RNA, 22 nt, Human
aggacuaaaaagaugcucuccc

SEQ ID NO: 752980 - RNA, 22 nt, Human
guacaaguguauuuggcuugau

SEQ ID NO: 752981 - RNA, 22 nt, Human
ggagacacccacauugcugggu

SEQ ID NO: 752982 - RNA, 22 nt, Human
uuuagcaauuagaauccagcau

SEQ ID NO: 752983 - RNA, 22 nt, Human
uacaguaaaugugguagaaacu

SEQ ID NO: 752984 - RNA, 18 nt, Human
acuguuaucugauaaggc

SEQ ID NO: 752985 - RNA, 22 nt, Human
agcugggcagugcuuggauuca

SEQ ID NO: 752986 - RNA, 22 nt, Human
gcugcucuguuaauugcuguaa

SEQ ID NO: 752987 - RNA, 22 nt, Human
aggggcuggcuuaucugagagu

SEQ ID NO: 752988 - RNA, 22 nt, Human
gccucccuguucuuccacaaua

SEQ ID NO: 752989 - RNA, 22 nt, Human
ucagccuggcaggauggccugg

SEQ ID NO: 752990 - RNA, 23 nt, Human
acacugucucauggauagacugc

SEQ ID NO: 752991 - RNA, 22 nt, Human
ucugguuagccaauaaugccaa

SEQ ID NO: 752992 - RNA, 22 nt, Human
ucaagucuggagaucuggaacu

SEQ ID NO: 752993 - RNA, 22 nt, Human
caucaucaaaagugacagagaa

SEQ ID NO: 752994 - RNA, 22 nt, Human
agcugaaguccucgcggugcua

SEQ ID NO: 752995 - RNA, 20 nt, Human
agcacugucugaccaguggc

SEQ ID NO: 752996 - RNA, 22 nt, Human
uguuuacaugcauaagcuuaag

SEQ ID NO: 752997 - RNA, 22 nt, Human
auucuauuaauauuucuaggaa

SEQ ID NO: 752998 - RNA, 22 nt, Human
cuuuacaauucaagggaacucu

SEQ ID NO: 752999 - RNA, 22 nt, Human
cuggaccagaaaggacauggcu

SEQ ID NO: 753000 - RNA, 17 nt, Human
agagggaaaaugcgguu

SEQ ID NO: 753001 - RNA, 22 nt, Human
cugggccuuuaccuacggaguu

SEQ ID NO: 753002 - RNA, 22 nt, Human
uugacagcuauuuugcuuugau

SEQ ID NO: 753003 - RNA, 22 nt, Human
uagugucuguugcuuuuguuca

SEQ ID NO: 753004 - RNA, 22 nt, Human
aggcacagcacaccuggccccc

SEQ ID NO: 753005 - RNA, 22 nt, Human
auguauuuuaagauuugccuca

SEQ ID NO: 753006 - RNA, 22 nt, Human
gccugcuggauguggccaggcc

SEQ ID NO: 753007 - RNA, 22 nt, Human
uccuggccuuagcgaggcgguc

SEQ ID NO: 753008 - RNA, 22 nt, Human
acauucaacauggcuggucuag

SEQ ID NO: 753009 - RNA, 22 nt, Human
cugaaaagugucuguugaguua

SEQ ID NO: 753010 - RNA, 22 nt, Human
gcagcucuggggcaggccugag

SEQ ID NO: 753011 - RNA, 22 nt, Human
uacaaaguagaaauucaguaaa

SEQ ID NO: 753012 - RNA, 22 nt, Human
ucucugagcugcuucuugcaua

SEQ ID NO: 753013 - RNA, 22 nt, Human
cuggagccgcauggagcaggga

SEQ ID NO: 753014 - RNA, 22 nt, Human
ugcacauggccugagugccuga

SEQ ID NO: 753015 - RNA, 21 nt, Human
cagagcugaaggguguagugu

SEQ ID NO: 753016 - RNA, 22 nt, Human
uuuucugugcccugcuagcugg

SEQ ID NO: 753017 - RNA, 22 nt, Human
acuugguggcgaacgaggguca

SEQ ID NO: 753018 - RNA, 22 nt, Human
ccugcucagcuguccucacgcu

SEQ ID NO: 753019 - RNA, 22 nt, Human
ucauguguguuucauguaugga

SEQ ID NO: 753020 - RNA, 22 nt, Human
acagguggccccgagggagugg

SEQ ID NO: 753021 - RNA, 22 nt, Human
uucuucuugucugcccucacau

SEQ ID NO: 753022 - RNA, 22 nt, Human
ucaaaauuagugaccaaaggca

SEQ ID NO: 753023 - RNA, 22 nt, Human
ugcuggcuuugcgagaugcauu

SEQ ID NO: 753024 - RNA, 22 nt, Human
gaauuagacaugcuuugcuuuu

SEQ ID NO: 753025 - RNA, 22 nt, Human
uuauccaacaugacuuaugucc

SEQ ID NO: 753026 - RNA, 22 nt, Human
gugagggguggcugagcaguuu

SEQ ID NO: 753027 - RNA, 22 nt, Human
cagucccuaguggagcucacag

SEQ ID NO: 753028 - RNA, 22 nt, Human
uuucucauggacccuucaugau

SEQ ID NO: 753029 - RNA, 21 nt, Human
ucuagaauccuguauaagacu

SEQ ID NO: 753030 - RNA, 22 nt, Human
aggcacagccucccccaacucc

SEQ ID NO: 753031 - RNA, 22 nt, Human
uguuuacagggugauuuuaccu

SEQ ID NO: 753032 - RNA, 22 nt, Human
guggucauggaagguccuaccu

SEQ ID NO: 753033 - RNA, 22 nt, Human
cucaguguuaaauauaagguau

SEQ ID NO: 753034 - RNA, 22 nt, Human
agaaggaguguacaggucaugc

SEQ ID NO: 753035 - RNA, 22 nt, Human
gcaguguugcuaggugcgguga

SEQ ID NO: 753036 - RNA, 22 nt, Human
ccucaggcucugggugccuacc

SEQ ID NO: 753037 - RNA, 22 nt, Human
accugggaacgcuuuguggagg

SEQ ID NO: 753038 - RNA, 22 nt, Human
guuucgucaggcuuauucuauc

SEQ ID NO: 753039 - RNA, 22 nt, Human
ccuggcaccuguguuuucugga

SEQ ID NO: 753040 - RNA, 22 nt, Human
cacuucaagagcaagggugcca

SEQ ID NO: 753041 - RNA, 23 nt, Human
gagcucagguagggcucgcccgc

SEQ ID NO: 753042 - RNA, 22 nt, Human
uaucucuugucuguuuugcaaa

SEQ ID NO: 753043 - RNA, 22 nt, Human
ggcugaggguauagcuguccca

SEQ ID NO: 753044 - RNA, 22 nt, Human
ucuggcagaagugcugucagua

SEQ ID NO: 753045 - RNA, 22 nt, Human
uugaagcaaauucugugcagua

SEQ ID NO: 753046 - RNA, 22 nt, Human
ccagugugggcccggccuccuc

SEQ ID NO: 753047 - RNA, 22 nt, Human
acuacaauacucuuaguaaaag

SEQ ID NO: 753048 - RNA, 22 nt, Human
aggaaaauggaccagaguuguu

SEQ ID NO: 753049 - RNA, 22 nt, Human
uaugagguagguauuauacuua

SEQ ID NO: 753050 - RNA, 22 nt, Human
cucucugggggccaugccaaga

SEQ ID NO: 753051 - RNA, 22 nt, Human
uuguuucagcccagaucuuuac

SEQ ID NO: 753052 - RNA, 22 nt, Human
cuuggagagagccucagcuguu

SEQ ID NO: 753053 - RNA, 22 nt, Human
ccagaagaccggggagucaggg

SEQ ID NO: 753054 - RNA, 22 nt, Human
aucuuucacuuuuuguggauga

SEQ ID NO: 753055 - RNA, 22 nt, Human
acuggagcccguggaggcgcag

SEQ ID NO: 753056 - RNA, 20 nt, Human
augaggccagcagggcucag

SEQ ID NO: 753057 - RNA, 22 nt, Human
ugucauuuaguccucugugugu

SEQ ID NO: 753058 - RNA, 22 nt, Human
ucaaacaggacuacauucucau

SEQ ID NO: 753059 - RNA, 22 nt, Human
aauccauuaaaaacaagcgcau

SEQ ID NO: 753060 - RNA, 22 nt, Human
accaugcacagcuguucuauua

SEQ ID NO: 753061 - RNA, 22 nt, Human
uggggaaggcggagcuugcagc

SEQ ID NO: 753062 - RNA, 22 nt, Human
aguuuauguguaagacagcugu

SEQ ID NO: 753063 - RNA, 22 nt, Human
gccuggagaccugcuccucuac

SEQ ID NO: 753064 - RNA, 22 nt, Human
cuuuccccaagcaccacagugc

SEQ ID NO: 753065 - RNA, 22 nt, Human
gugccagccuggugcgccuggg

SEQ ID NO: 753066 - RNA, 22 nt, Human
uuucuacaguacugauuucaua

SEQ ID NO: 753067 - RNA, 22 nt, Human
ggccugcugcuaugacuuccug

SEQ ID NO: 753068 - RNA, 22 nt, Human
gaggcagcugaaggagugacag

SEQ ID NO: 753069 - RNA, 22 nt, Human
uuauuauugugaccugagaaug

SEQ ID NO: 753070 - RNA, 22 nt, Human
ugggccuccgcauggcccagcg

SEQ ID NO: 753071 - RNA, 22 nt, Human
auuucuuuucaagagggugcuu

SEQ ID NO: 753072 - RNA, 22 nt, Human
uguggacuuuaguaggugagag

SEQ ID NO: 753073 - RNA, 22 nt, Human
ggcuagggaaauccugauccaa

SEQ ID NO: 753074 - RNA, 22 nt, Human
ucacagaauagcacuguaagcg

SEQ ID NO: 753075 - RNA, 22 nt, Human
aacuuuuacaaauugucaucau

SEQ ID NO: 753076 - RNA, 22 nt, Human
agaucaaaucugggauuucuaa

SEQ ID NO: 753077 - RNA, 22 nt, Human
ucacaacugggugucuucauca

SEQ ID NO: 753078 - RNA, 20 nt, Human
cacagacuguaugggcacca

SEQ ID NO: 753079 - RNA, 22 nt, Human
gaggccuggcugucagucccca

SEQ ID NO: 753080 - RNA, 22 nt, Human
uuccaaacugccaauucagaag

SEQ ID NO: 753081 - RNA, 22 nt, Human
auauaguuggguuucauucuac

SEQ ID NO: 753082 - RNA, 21 nt, Human
ccuauugaauauaggaagauu

SEQ ID NO: 753083 - RNA, 22 nt, Human
agaagcacaccugaccucuagc

SEQ ID NO: 753084 - RNA, 22 nt, Human
cagugagaccuucuaagguggu

SEQ ID NO: 753085 - RNA, 22 nt, Human
cucuggcuggcauugcuggacu

SEQ ID NO: 753086 - RNA, 22 nt, Human
uucuaguguccuuggacuugcu

SEQ ID NO: 753087 - RNA, 22 nt, Human
acuuuccuagacuucagugaca

SEQ ID NO: 753088 - RNA, 22 nt, Human
aaguagaaaaccgcacuggacu

SEQ ID NO: 753089 - RNA, 22 nt, Human
ggagcuguuaaaugcagaauuu

SEQ ID NO: 753090 - RNA, 22 nt, Human
gcaucuaagguggauaacuucu

SEQ ID NO: 753091 - RNA, 22 nt, Human
ucacaggguaucugggauggau

SEQ ID NO: 753092 - RNA, 22 nt, Human
accugccuaguugguucugccc

SEQ ID NO: 753093 - RNA, 22 nt, Human
aggcuacauguugggguggaag

SEQ ID NO: 753094 - RNA, 22 nt, Human
acuuucucccacccacccgucu

SEQ ID NO: 753095 - RNA, 22 nt, Human
agcccugagcuggccugggcuu

SEQ ID NO: 753096 - RNA, 22 nt, Human
ccucucuuggauguggaugggu

SEQ ID NO: 753097 - RNA, 22 nt, Human
uaccagcaauguaugaguguuu

SEQ ID NO: 753098 - RNA, 22 nt, Human
uagacuuuacuaaggcucauuu

SEQ ID NO: 753099 - RNA, 17 nt, Human
ugggguccccgauggug

SEQ ID NO: 753100 - RNA, 22 nt, Human
ccuaggcuuguuuucaucagcu

SEQ ID NO: 753101 - RNA, 22 nt, Human
ggcagggugccuggcuccuguu

SEQ ID NO: 753102 - RNA, 22 nt, Human
aagcuguuggcagauagcucug

SEQ ID NO: 753103 - RNA, 22 nt, Human
gucuccucuucauauaccuguu

SEQ ID NO: 753104 - RNA, 22 nt, Human
uacaggcaugaaugaaaucugu

SEQ ID NO: 753105 - RNA, 22 nt, Human
cagggagcuggugccagccgac

SEQ ID NO: 753106 - RNA, 22 nt, Human
uaacauuuaaauuuuucacaua

SEQ ID NO: 753107 - RNA, 22 nt, Human
acuuagcagguacuuucauauu

SEQ ID NO: 753108 - RNA, 22 nt, Human
gaauacaagccugccaccugga

SEQ ID NO: 753109 - RNA, 22 nt, Human
gacaggcaauuaccagcgccca

SEQ ID NO: 753110 - RNA, 22 nt, Human
gcuauuuauuaaaauggugaag

SEQ ID NO: 753111 - RNA, 23 nt, Human
cagcccugaaaucgaggugacac

SEQ ID NO: 753112 - RNA, 22 nt, Human
uacaaugaugauacuuuacugg

SEQ ID NO: 753113 - RNA, 22 nt, Human
ugucugagucaugcagagauau

SEQ ID NO: 753114 - RNA, 22 nt, Human
gugacucuccacuaguaugaaa

SEQ ID NO: 753115 - RNA, 22 nt, Human
ugguuuucuggugguggcagug

SEQ ID NO: 753116 - RNA, 22 nt, Human
gcccaguaguucaagguugcag

SEQ ID NO: 753117 - RNA, 22 nt, Human
acagaccuauggcagcugccau

SEQ ID NO: 753118 - RNA, 22 nt, Human
ugggaggaucgcuugagcccag

SEQ ID NO: 753119 - RNA, 23 nt, Human
aguggcugagaguguuucauaug

SEQ ID NO: 753120 - RNA, 22 nt, Human
gagccaaggguugccauggaga

SEQ ID NO: 753121 - RNA, 22 nt, Human
cugucuguccugaguucaacca

SEQ ID NO: 753122 - RNA, 22 nt, Human
agcucacagaaauccugcagga

SEQ ID NO: 753123 - RNA, 22 nt, Human
uggagagguuuaaacaaaaguu

SEQ ID NO: 753124 - RNA, 22 nt, Human
ggacacaguggaagacagcuug

SEQ ID NO: 753125 - RNA, 22 nt, Human
ugccccucgacgcaaugaaggg

SEQ ID NO: 753126 - RNA, 22 nt, Human
guccagggggcuuaagcaaacu

SEQ ID NO: 753127 - RNA, 22 nt, Human
guccugggaacuggacagcuaa

SEQ ID NO: 753128 - RNA, 22 nt, Human
uggguccacuucugcacugugg

SEQ ID NO: 753129 - RNA, 22 nt, Human
gucugggucuccacagucagca

SEQ ID NO: 753130 - RNA, 22 nt, Human
ucugagcuucugcauuuccaac

SEQ ID NO: 753131 - RNA, 21 nt, Human
uccauuguuuucccaggguuu

SEQ ID NO: 753132 - RNA, 22 nt, Human
gugcugaguagaaugaaugccu

SEQ ID NO: 753133 - RNA, 22 nt, Human
acacaguuuaaacgauuaguac

SEQ ID NO: 753134 - RNA, 22 nt, Human
agugacagcugggaaggugaaa

SEQ ID NO: 753135 - RNA, 22 nt, Human
acaauuuuaagccagagugggu

SEQ ID NO: 753136 - RNA, 17 nt, Human
ucacaucacacaagcaa

SEQ ID NO: 753137 - RNA, 22 nt, Human
ucagugcuuuugucacaugguc

SEQ ID NO: 753138 - RNA, 22 nt, Human
gcagaggacagggauuuagauu

SEQ ID NO: 753139 - RNA, 22 nt, Human
uucugaaggucagcagcuuggu

SEQ ID NO: 753140 - RNA, 22 nt, Human
caggccagcguccagaacaagc

SEQ ID NO: 753141 - RNA, 22 nt, Human
cacaaggcuuucaucuggcaua

SEQ ID NO: 753142 - RNA, 22 nt, Human
accauuuacucccauuggaagu

SEQ ID NO: 753143 - RNA, 17 nt, Human
aguguuuccuuaucauu

SEQ ID NO: 753144 - RNA, 18 nt, Human
uggagucagugacaccag

SEQ ID NO: 753145 - RNA, 22 nt, Human
ugcucaguuccaugaguggagu

SEQ ID NO: 753146 - RNA, 22 nt, Human
gaaaauacuucaguguucuggc

SEQ ID NO: 753147 - RNA, 22 nt, Human
acagaggccaugagcugccacc

SEQ ID NO: 753148 - RNA, 22 nt, Human
ucaggccuuucuucagagcuuc

SEQ ID NO: 753149 - RNA, 22 nt, Human
acaggaguucagaggacacccc

SEQ ID NO: 753150 - RNA, 20 nt, Human
agggucagagagcgugagug

SEQ ID NO: 753151 - RNA, 22 nt, Human
gcagggcuggguccugucucau

SEQ ID NO: 753152 - RNA, 22 nt, Human
cagccucuaagcacagccucuc

SEQ ID NO: 753153 - RNA, 22 nt, Human
uucauuuucuuucacgcugcug

SEQ ID NO: 753154 - RNA, 22 nt, Human
gaugaaaaauugcugugucaua

SEQ ID NO: 753155 - RNA, 18 nt, Human
gauggguaaaggcauaaa

SEQ ID NO: 753156 - RNA, 22 nt, Human
uucauucccaagaguaaacaua

SEQ ID NO: 753157 - RNA, 22 nt, Human
uuuggcagagucauuucagaaa

SEQ ID NO: 753158 - RNA, 22 nt, Human
ugcagggccuuguugaugugcu

SEQ ID NO: 753159 - RNA, 22 nt, Human
cugguguggcggcgcccuguag

SEQ ID NO: 753160 - RNA, 22 nt, Human
cuugagguuuugacucagcuuu

SEQ ID NO: 753161 - RNA, 22 nt, Human
uggcagaugagccgcgcuccaa

SEQ ID NO: 753162 - RNA, 22 nt, Human
cguguacacgcacacguguccu

SEQ ID NO: 753163 - RNA, 22 nt, Human
ggaggccaggaaggcucggaga

SEQ ID NO: 753164 - RNA, 22 nt, Human
caucagcagucacaugaugcug

SEQ ID NO: 753165 - RNA, 22 nt, Human
ucccagggacugggcuaggcuu

SEQ ID NO: 753166 - RNA, 22 nt, Human
uugcaaauauuguuuaccuuuc

SEQ ID NO: 753167 - RNA, 22 nt, Human
acuguaauuggauugucugacu

SEQ ID NO: 753168 - RNA, 22 nt, Human
gagaagggggcucgaguguccu

SEQ ID NO: 753169 - RNA, 22 nt, Human
cauguucaccuguggcacuagu

SEQ ID NO: 753170 - RNA, 22 nt, Human
ucuuuagaguuaacaauaauga

SEQ ID NO: 753171 - RNA, 23 nt, Human
uuuagcaugaagcagcuggagaa

SEQ ID NO: 753172 - RNA, 22 nt, Human
cugggacugccauucacagcca

SEQ ID NO: 753173 - RNA, 22 nt, Human
caggccucgaggagacagcuac

SEQ ID NO: 753174 - RNA, 22 nt, Human
aagugcuuaaaaggguggucua

SEQ ID NO: 753175 - RNA, 22 nt, Human
uaucaugaucagcaacuaauca

SEQ ID NO: 753176 - RNA, 22 nt, Human
uuucucaaggugucauguauuu

SEQ ID NO: 753177 - RNA, 22 nt, Human
cuggccagcauggcugaaguac

SEQ ID NO: 753178 - RNA, 22 nt, Human
cucagaaacggagcugccauuu

SEQ ID NO: 753179 - RNA, 22 nt, Human
agaguguuuuucugucaaggac

SEQ ID NO: 753180 - RNA, 22 nt, Human
uacuguuaauguuaaauucagg

SEQ ID NO: 753181 - RNA, 22 nt, Human
gaaaucacuuuuuucauaguug

SEQ ID NO: 753182 - RNA, 22 nt, Human
uaaguucaaaucaucccaacuu

SEQ ID NO: 753183 - RNA, 22 nt, Human
cagcuccccaugguuccugaag

SEQ ID NO: 753184 - RNA, 22 nt, Human
ucaauucauagaguugacacag

SEQ ID NO: 753185 - RNA, 22 nt, Human
uucccuuuguuaaauuggaaga

SEQ ID NO: 753186 - RNA, 22 nt, Human
agccucugaugaucacaggggg

SEQ ID NO: 753187 - RNA, 22 nt, Human
ucuggagcuggcagggcccugg

SEQ ID NO: 753188 - RNA, 22 nt, Human
ugaacacacacaucuuaauaau

SEQ ID NO: 753189 - RNA, 22 nt, Human
ugcugugucuuucugugaaaag

SEQ ID NO: 753190 - RNA, 22 nt, Human
cuuucacacacauacauuugga

SEQ ID NO: 753191 - RNA, 22 nt, Human
aaggauugucuggcuauuuaug

SEQ ID NO: 753192 - RNA, 22 nt, Human
uggaaagugcucuagacuuucu

SEQ ID NO: 753193 - RNA, 22 nt, Human
uucccauuugugguagugaauu

SEQ ID NO: 753194 - RNA, 22 nt, Human
ugaugcacaaagucagcauccu

SEQ ID NO: 753195 - RNA, 22 nt, Human
ggaaggugcucccuggacagag

SEQ ID NO: 753196 - RNA, 22 nt, Human
aacuagaaccacuuguauuucc

SEQ ID NO: 753197 - RNA, 22 nt, Human
gccccagguugccugucccagg

SEQ ID NO: 753198 - RNA, 22 nt, Human
auggcuguguuguuccucugaa

SEQ ID NO: 753199 - RNA, 22 nt, Human
ggcuugcuucuuguccaggaau

SEQ ID NO: 753200 - RNA, 18 nt, Human
ccucaggggaccuggcag

SEQ ID NO: 753201 - RNA, 22 nt, Human
uuauucaccgcaggugcuuccc

SEQ ID NO: 753202 - RNA, 22 nt, Human
ccauuacugaaauaaagagaau

SEQ ID NO: 753203 - RNA, 22 nt, Human
aguccucuggaguaugccuuau

SEQ ID NO: 753204 - RNA, 22 nt, Human
caaaguccauaguuuacaauag

SEQ ID NO: 753205 - RNA, 22 nt, Human
uugcugagcuuuggcaaggaag

SEQ ID NO: 753206 - RNA, 22 nt, Human
gcuuucugcucuguaaaauggg

SEQ ID NO: 753207 - RNA, 22 nt, Human
uuuacauguaauguuauacaaa

SEQ ID NO: 753208 - RNA, 22 nt, Human
uggucagcuucagaguguucca

SEQ ID NO: 753209 - RNA, 22 nt, Human
aucaguuuuguucacuacuaua

SEQ ID NO: 753210 - RNA, 22 nt, Human
gugaaaauaaggcugguucuug

SEQ ID NO: 753211 - RNA, 22 nt, Human
cugcuguguuucugcuagaaaa

SEQ ID NO: 753212 - RNA, 18 nt, Human
uguguaugucucagggaa

SEQ ID NO: 753213 - RNA, 22 nt, Human
gcuaggaagcuggggagaaguc

SEQ ID NO: 753214 - RNA, 22 nt, Human
ucccagcccagacuucuccagu

SEQ ID NO: 753215 - RNA, 22 nt, Human
uuuuauagcugaauaguauucc

SEQ ID NO: 753216 - RNA, 22 nt, Human
ggcccaaggugccaaggccucc

SEQ ID NO: 753217 - RNA, 22 nt, Human
guggcacagccaagccucacuc

SEQ ID NO: 753218 - RNA, 18 nt, Human
aaggucugucugguaggu

SEQ ID NO: 753219 - RNA, 22 nt, Human
ucaggagaaucagggcuguccu

SEQ ID NO: 753220 - RNA, 22 nt, Human
gaggggcaguugauugugcuau

SEQ ID NO: 753221 - RNA, 22 nt, Human
uggcucaugccuguaaucuuag

SEQ ID NO: 753222 - RNA, 22 nt, Human
uuccucucucuugccagaaugu

SEQ ID NO: 753223 - RNA, 22 nt, Human
uuccaggacaagauguuucagg

SEQ ID NO: 753224 - RNA, 22 nt, Human
cuagggagacucgcaggacuca

SEQ ID NO: 753225 - RNA, 22 nt, Human
agcagagaccauauagcccaga

SEQ ID NO: 753226 - RNA, 22 nt, Human
acucuggcuugaggaccagguc

SEQ ID NO: 753227 - RNA, 22 nt, Human
uggcuuucgcuauagagcacgg

SEQ ID NO: 753228 - RNA, 20 nt, Human
gcacagagaugagcaaagua

SEQ ID NO: 753229 - RNA, 22 nt, Human
acaugcagacgggauccuggca

SEQ ID NO: 753230 - RNA, 22 nt, Human
agcugccauccgaggugucaga

SEQ ID NO: 753231 - RNA, 22 nt, Human
uacuucaugaguuaauaugcag

SEQ ID NO: 753232 - RNA, 22 nt, Human
ucuuuaacaggaauuauuacag

SEQ ID NO: 753233 - RNA, 16 nt, Human
cuguggcucccagguu

SEQ ID NO: 753234 - RNA, 22 nt, Human
aaagggaauguguaggacaugu

SEQ ID NO: 753235 - RNA, 20 nt, Human
agauuauuccuaagauuucu

SEQ ID NO: 753236 - RNA, 22 nt, Human
cuguccuugcuggccagguaug

SEQ ID NO: 753237 - RNA, 22 nt, Human
caagggcagaggcagggccccg

SEQ ID NO: 753238 - RNA, 22 nt, Human
ccagcugcuuuuugucacaugg

SEQ ID NO: 753239 - RNA, 22 nt, Human
caaugucagucaagcagcaaau

SEQ ID NO: 753240 - RNA, 23 nt, Human
ucucugugugccucaguuucuuc

SEQ ID NO: 753241 - RNA, 22 nt, Human
aaucauguuucagaugaguuuu

SEQ ID NO: 753242 - RNA, 19 nt, Human
gggaugggcccucacccuc

SEQ ID NO: 753243 - RNA, 22 nt, Human
caccagagugaguggacugucg

SEQ ID NO: 753244 - RNA, 22 nt, Human
cguggcuggggaggucagccag

SEQ ID NO: 753245 - RNA, 22 nt, Human
agaauaaucacugaaguucaaa

SEQ ID NO: 753246 - RNA, 22 nt, Human
cuauauacuuuucacagauguu

SEQ ID NO: 753247 - RNA, 22 nt, Human
aggacauguaaauggagaggga

SEQ ID NO: 753248 - RNA, 22 nt, Human
gcaguguugugauccaggucuu

SEQ ID NO: 753249 - RNA, 22 nt, Human
ugaguggacgugaggcugagua

SEQ ID NO: 753250 - RNA, 22 nt, Human
ucucuaagauaggaauacaguu

SEQ ID NO: 753251 - RNA, 22 nt, Human
auucagcacaucuuuguacagc

SEQ ID NO: 753252 - RNA, 22 nt, Human
ugcuuucugcucuuguccacac

SEQ ID NO: 753253 - RNA, 20 nt, Human
guggaugaucaguguagugg

SEQ ID NO: 753254 - RNA, 22 nt, Human
aacaugucuggguauucacaag

SEQ ID NO: 753255 - RNA, 22 nt, Human
aguucacaagugcauuucagga

SEQ ID NO: 753256 - RNA, 22 nt, Human
gcugugcuugggaagaaucucu

SEQ ID NO: 753257 - RNA, 22 nt, Human
gggcuucuggcuacuguaugag

SEQ ID NO: 753258 - RNA, 22 nt, Human
cugaaggauuagagagcacuua

SEQ ID NO: 753259 - RNA, 22 nt, Human
ugcaguuagccuaggauugagc

SEQ ID NO: 753260 - RNA, 22 nt, Human
gaaauguaugucuucccccauu

SEQ ID NO: 753261 - RNA, 22 nt, Human
uauagagguggaaacugagguu

SEQ ID NO: 753262 - RNA, 22 nt, Human
guugaaacuuaguugaaauuua

SEQ ID NO: 753263 - RNA, 22 nt, Human
agugcaauguguacagaaaaau

SEQ ID NO: 753264 - RNA, 22 nt, Human
ugauuugcgucucauuugaaau

SEQ ID NO: 753265 - RNA, 22 nt, Human
cugugccaggcccagcugacuu

SEQ ID NO: 753266 - RNA, 19 nt, Human
ucacagacagagcaaucac

SEQ ID NO: 753267 - RNA, 22 nt, Human
augcaacaggguugggaggcgg

SEQ ID NO: 753268 - RNA, 20 nt, Human
agcaggcugcagggugaaau

SEQ ID NO: 753269 - RNA, 22 nt, Human
aacaugaaaguugcuaagugca

SEQ ID NO: 753270 - RNA, 22 nt, Human
acauuucuuccacaugcugcug

SEQ ID NO: 753271 - RNA, 22 nt, Human
ugucaaaaugacuuuacuacag

SEQ ID NO: 753272 - RNA, 18 nt, Human
acagugauuguucuaugc

SEQ ID NO: 753273 - RNA, 22 nt, Human
cccuccagccauggacccaggu

SEQ ID NO: 753274 - RNA, 22 nt, Human
cugcuguggugucaagcaucuc

SEQ ID NO: 753275 - RNA, 20 nt, Human
gggcugugccuccucguggu

SEQ ID NO: 753276 - RNA, 22 nt, Human
ugcuugcuaugcauccugaacu

SEQ ID NO: 753277 - RNA, 22 nt, Human
gacauuuagguagcuuccaguu

SEQ ID NO: 753278 - RNA, 22 nt, Human
gaggcucaaaccuggacagagc

SEQ ID NO: 753279 - RNA, 22 nt, Human
uuccccaguagugacaaucaaa

SEQ ID NO: 753280 - RNA, 22 nt, Human
cacugagaaagugaccugccaa

SEQ ID NO: 753281 - RNA, 20 nt, Human
uuaagaaaagcacauccugc

SEQ ID NO: 753282 - RNA, 22 nt, Human
aaaggcuggauucagagaggug

SEQ ID NO: 753283 - RNA, 22 nt, Human
agggaagaggcaagguuuaugg

SEQ ID NO: 753284 - RNA, 22 nt, Human
agccuggaggaggaguugagca

SEQ ID NO: 753285 - RNA, 22 nt, Human
aaaucaguucucccuuucuuca

SEQ ID NO: 753286 - RNA, 21 nt, Human
uucucuccauaugcccagccc

SEQ ID NO: 753287 - RNA, 22 nt, Human
ccaggcucugucuggucagaag

SEQ ID NO: 753288 - RNA, 22 nt, Human
aacuguaauuuuuacauaguaa

SEQ ID NO: 753289 - RNA, 22 nt, Human
aagaauaaauuaagauacuuag

SEQ ID NO: 753290 - RNA, 22 nt, Human
cauaagaagguaacauccuuaa

SEQ ID NO: 753291 - RNA, 22 nt, Human
aaagaaguguugaauuugcaag

SEQ ID NO: 753292 - RNA, 22 nt, Human
cuggcacauaguaggugcacag

SEQ ID NO: 753293 - RNA, 22 nt, Human
uuagcacuggauuaaucaaagu

SEQ ID NO: 753294 - RNA, 22 nt, Human
ugggccagaaguaugcauguuu

SEQ ID NO: 753295 - RNA, 22 nt, Human
aaguugaaugcguacgugacau

SEQ ID NO: 753296 - RNA, 22 nt, Human
auacuucucaugggcucugagc

SEQ ID NO: 753297 - RNA, 22 nt, Human
aaggcuggucagauguggugaa

SEQ ID NO: 753298 - RNA, 22 nt, Human
uugacacuaagauuuccaaaca

SEQ ID NO: 753299 - RNA, 22 nt, Human
ugccugugcccuuugcugggag

SEQ ID NO: 753300 - RNA, 22 nt, Human
uccuggucagcuuugagguugu

SEQ ID NO: 753301 - RNA, 23 nt, Human
ggcuccaggccugacgggcgcgg

SEQ ID NO: 753302 - RNA, 22 nt, Human
cuggggcccaucgagggcugag

SEQ ID NO: 753303 - RNA, 18 nt, Human
uggcugcuuccagguaca

SEQ ID NO: 753304 - RNA, 22 nt, Human
agagaucccuucugccugggga

SEQ ID NO: 753305 - RNA, 22 nt, Human
cccaggaggguggccucugccc

SEQ ID NO: 753306 - RNA, 22 nt, Human
gcagcuuuguaaaguaugaagc

SEQ ID NO: 753307 - RNA, 22 nt, Human
aauagcaaacacugguaaaguu

SEQ ID NO: 753308 - RNA, 22 nt, Human
cugggguggauggguccaaguu

SEQ ID NO: 753309 - RNA, 22 nt, Human
cagagcuggggacuguuggaug

SEQ ID NO: 753310 - RNA, 22 nt, Human
uugauucuuagcuggugauaau

SEQ ID NO: 753311 - RNA, 22 nt, Human
gcccuuccuuagacagcaggau

SEQ ID NO: 753312 - RNA, 22 nt, Human
cuuuaguugucuccucaagggu

SEQ ID NO: 753313 - RNA, 22 nt, Human
uggagcagcacaagaaagggga

SEQ ID NO: 753314 - RNA, 22 nt, Human
agcagguguuggcugggccauc

SEQ ID NO: 753315 - RNA, 22 nt, Human
uguagcuucagucugaucucau

SEQ ID NO: 753316 - RNA, 22 nt, Human
ccagaaaguucagcugugaaug

SEQ ID NO: 753317 - RNA, 22 nt, Human
uuggcaaaggacucaaagcagg

SEQ ID NO: 753318 - RNA, 22 nt, Human
ccaacacagauguguuaguguu

SEQ ID NO: 753319 - RNA, 22 nt, Human
uuugaauguuuuagguacuuaa

SEQ ID NO: 753320 - RNA, 22 nt, Human
aacuuucucuggauggcuuccu

SEQ ID NO: 753321 - RNA, 22 nt, Human
agaggcccucucucuccugaug

SEQ ID NO: 753322 - RNA, 22 nt, Human
acugccauuggucaaaugagug

SEQ ID NO: 753323 - RNA, 22 nt, Human
ggucaggguuccagguaucuuc

SEQ ID NO: 753324 - RNA, 22 nt, Human
acaugagaucacaaagauaaau

SEQ ID NO: 753325 - RNA, 22 nt, Human
uguuugugguuauaauaaguau

SEQ ID NO: 753326 - RNA, 20 nt, Human
aacacaggguuaccaucaga

SEQ ID NO: 753327 - RNA, 22 nt, Human
ugcauguguuucccagcaagcu

SEQ ID NO: 753328 - RNA, 22 nt, Human
cacagaggugauaguggucaag

SEQ ID NO: 753329 - RNA, 22 nt, Human
uguaaucaugcaucaguuaguu

SEQ ID NO: 753330 - RNA, 22 nt, Human
auucagcaaugagcuuggauuu

SEQ ID NO: 753331 - RNA, 22 nt, Human
agauggggcugaaaguuccaau

SEQ ID NO: 753332 - RNA, 22 nt, Human
agagucuguuacuuguccccua

SEQ ID NO: 753333 - RNA, 22 nt, Human
acugagcauaaauaugugucca

SEQ ID NO: 753334 - RNA, 22 nt, Human
gagagcugugguuugaccaggc

SEQ ID NO: 753335 - RNA, 22 nt, Human
gccauaaauugcuggucaaaau

SEQ ID NO: 753336 - RNA, 22 nt, Human
cuucaggauuuaggaagaugaa

SEQ ID NO: 753337 - RNA, 22 nt, Human
cacauuguagagauuagaaaga

SEQ ID NO: 753338 - RNA, 20 nt, Human
gaaauucucguauuaguuua

SEQ ID NO: 753339 - RNA, 20 nt, Human
gcuguggcaaagcuuugugu

SEQ ID NO: 753340 - RNA, 22 nt, Human
aauaagaacaacuaagguuuau

SEQ ID NO: 753341 - RNA, 22 nt, Human
cuguugaucucaguuagcuaga

SEQ ID NO: 753342 - RNA, 23 nt, Human
uucaucaguugcuguugcagaac

SEQ ID NO: 753343 - RNA, 22 nt, Human
cuggacuuuggcccaucugcca

SEQ ID NO: 753344 - RNA, 22 nt, Human
aauacagaggaaacauuuaaua

SEQ ID NO: 753345 - RNA, 22 nt, Human
aauguuguuuuucugcaugucu

SEQ ID NO: 753346 - RNA, 22 nt, Human
gugcuuggcuuggugugaccug

SEQ ID NO: 753347 - RNA, 22 nt, Human
augaggccauggcugucacuaa

SEQ ID NO: 753348 - RNA, 22 nt, Human
guauuuuacuuacgcaugacuu

SEQ ID NO: 753349 - RNA, 22 nt, Human
cuccuccacuaggcaaaaugug

SEQ ID NO: 753350 - RNA, 22 nt, Human
cagugauguuucugcaucagag

SEQ ID NO: 753351 - RNA, 21 nt, Human
ucagcagaaagcaaggucagu

SEQ ID NO: 753352 - RNA, 22 nt, Human
agugucuuaguccauuugggcu

SEQ ID NO: 753353 - RNA, 22 nt, Human
gcugggcuucucaaugcugccu

SEQ ID NO: 753354 - RNA, 22 nt, Human
cugccuggcccagggaugggcc

SEQ ID NO: 753355 - RNA, 20 nt, Human
cugggaggucuuccaaauca

SEQ ID NO: 753356 - RNA, 22 nt, Human
agccugagagccaagcugugca

SEQ ID NO: 753357 - RNA, 23 nt, Human
ugucuggcucauggugggucuca

SEQ ID NO: 753358 - RNA, 22 nt, Human
aaaaccacaaaaguggcuuggu

SEQ ID NO: 753359 - RNA, 20 nt, Human
agcugcagaacccacuggac

SEQ ID NO: 753360 - RNA, 22 nt, Human
acuguagagaaucugagaaaaa

SEQ ID NO: 753361 - RNA, 22 nt, Human
auagcaaauucuuuaggugcuu

SEQ ID NO: 753362 - RNA, 22 nt, Human
gaugauuuugaugcaguaaaga

SEQ ID NO: 753363 - RNA, 21 nt, Human
ucugaacaacauacgaaucuu

SEQ ID NO: 753364 - RNA, 22 nt, Human
caagguuugaaaacgccauggc

SEQ ID NO: 753365 - RNA, 22 nt, Human
uuugaaauaugaggcauuauga

SEQ ID NO: 753366 - RNA, 22 nt, Human
acugcacacauguuuaagugga

SEQ ID NO: 753367 - RNA, 22 nt, Human
cucacagcagcucugcgagaua

SEQ ID NO: 753368 - RNA, 22 nt, Human
gccuggugucuccccaaggaag

SEQ ID NO: 753369 - RNA, 22 nt, Human
cuacuguaauagaugaauuuga

SEQ ID NO: 753370 - RNA, 22 nt, Human
auacagaauuugcccuuuucau

SEQ ID NO: 753371 - RNA, 22 nt, Human
agugucugaugcacaguugucc

SEQ ID NO: 753372 - RNA, 22 nt, Human
uccagcagugcucaggacucac

SEQ ID NO: 753373 - RNA, 22 nt, Human
cuccugggagcuguggcagagc

SEQ ID NO: 753374 - RNA, 22 nt, Human
cauggcaggcuucuucagccuu

SEQ ID NO: 753375 - RNA, 21 nt, Human
ugggcacugagggugcugcuc

SEQ ID NO: 753376 - RNA, 22 nt, Human
agucuucagagaaauuaacucu

SEQ ID NO: 753377 - RNA, 22 nt, Human
ugaagcuggaaguuagguagac

SEQ ID NO: 753378 - RNA, 22 nt, Human
cuguuuuucagaagguaaggga

SEQ ID NO: 753379 - RNA, 22 nt, Human
ucugagaggcagaccuuccuaa

SEQ ID NO: 753380 - RNA, 22 nt, Human
uaggacaggugaggggcugugg

SEQ ID NO: 753381 - RNA, 19 nt, Human
agcuccaggccuggaugcu

SEQ ID NO: 753382 - RNA, 22 nt, Human
aucaucuggguuaaugugcuca

SEQ ID NO: 753383 - RNA, 22 nt, Human
acuaaagucaucaaagaacuuu

SEQ ID NO: 753384 - RNA, 22 nt, Human
ggagagcauucuuagucuguuu

SEQ ID NO: 753385 - RNA, 22 nt, Human
cucauagacaagccucuuuuaa

SEQ ID NO: 753386 - RNA, 19 nt, Human
cugugcaggccgggcugag

SEQ ID NO: 753387 - RNA, 22 nt, Human
ggcaccagggacaauccucuuc

SEQ ID NO: 753388 - RNA, 22 nt, Human
gugagugucagucaaagguuuu

SEQ ID NO: 753389 - RNA, 22 nt, Human
cuucuuugugccuauuggugac

SEQ ID NO: 753390 - RNA, 22 nt, Human
aaagacauauuucuaaguuuau

SEQ ID NO: 753391 - RNA, 22 nt, Human
uggguaggccaggaagcagugu

SEQ ID NO: 753392 - RNA, 22 nt, Human
ucagagaggauuuuaauaagug

SEQ ID NO: 753393 - RNA, 22 nt, Human
ugguccugguagcggugugcuu

SEQ ID NO: 753394 - RNA, 22 nt, Human
caaggcagcuguagggauuugg

SEQ ID NO: 753395 - RNA, 22 nt, Human
ggcucagauuccgaguggcccu

SEQ ID NO: 753396 - RNA, 22 nt, Human
uuacagauucaagcucuuugaa

SEQ ID NO: 753397 - RNA, 22 nt, Human
guuguacagcauuccauauagg

SEQ ID NO: 753398 - RNA, 19 nt, Human
ucacaggcaucuccccaga

SEQ ID NO: 753399 - RNA, 22 nt, Human
uuucaguggguuuauuucaugu

SEQ ID NO: 753400 - RNA, 22 nt, Human
gcagcuuggugaaaggugaugg

SEQ ID NO: 753401 - RNA, 22 nt, Human
ugaggaacugccagacuguuuu

SEQ ID NO: 753402 - RNA, 22 nt, Human
uuccagggcuagguaaugggua

SEQ ID NO: 753403 - RNA, 21 nt, Human
cagcuucugaagguguaggaa

SEQ ID NO: 753404 - RNA, 22 nt, Human
gcuggcugcuguugagacuugu

SEQ ID NO: 753405 - RNA, 22 nt, Human
ugagccuguccugugcauguga

SEQ ID NO: 753406 - RNA, 22 nt, Human
ugccuugcgggcguuucuguug

SEQ ID NO: 753407 - RNA, 22 nt, Human
agagaagggguaaagaguccug

SEQ ID NO: 753408 - RNA, 22 nt, Human
aaucauuguucuucagauuuga

SEQ ID NO: 753409 - RNA, 22 nt, Human
ugccuugggagccagcaugcca

SEQ ID NO: 753410 - RNA, 22 nt, Human
uaucaguagaacaauggacauu

SEQ ID NO: 753411 - RNA, 22 nt, Human
agcaccuccgugcagcguggcc

SEQ ID NO: 753412 - RNA, 23 nt, Human
acuagacuucaucgaagguuacc

SEQ ID NO: 753413 - RNA, 22 nt, Human
ggaagaggcugaggccaugcug

SEQ ID NO: 753414 - RNA, 22 nt, Human
uaucuguucugcuugauuuuga

SEQ ID NO: 753415 - RNA, 22 nt, Human
uuugacauuauccuguuacugg

SEQ ID NO: 753416 - RNA, 22 nt, Human
aaggacagaaacagauugcugg

SEQ ID NO: 753417 - RNA, 22 nt, Human
cagccugcucucagauguugag

SEQ ID NO: 753418 - RNA, 22 nt, Human
aggaccaguaugagagcaucug

SEQ ID NO: 753419 - RNA, 20 nt, Human
aucaggauucuugcuuuguu

SEQ ID NO: 753420 - RNA, 22 nt, Human
cuauuuugccugccuagaaauc

SEQ ID NO: 753421 - RNA, 22 nt, Human
ggcagguacagcaagaggacaa

SEQ ID NO: 753422 - RNA, 22 nt, Human
gccuggcuugccagcccuggcg

SEQ ID NO: 753423 - RNA, 22 nt, Human
uaaagcacgucuauuuaaugau

SEQ ID NO: 753424 - RNA, 22 nt, Human
uguuacaaacuguuguuucuau

SEQ ID NO: 753425 - RNA, 22 nt, Human
gaacacauuagucugaguuggc

SEQ ID NO: 753426 - RNA, 22 nt, Human
gcugccagcacaguucagcugu

SEQ ID NO: 753427 - RNA, 22 nt, Human
gggcccagcgugguuccaucug

SEQ ID NO: 753428 - RNA, 22 nt, Human
cauuuuaccuagaagcugaaag

SEQ ID NO: 753429 - RNA, 22 nt, Human
aggcugaaaacgagauggcaau

SEQ ID NO: 753430 - RNA, 22 nt, Human
cauuuggaccaaaauagccaac

SEQ ID NO: 753431 - RNA, 21 nt, Human
cugcaggaugcugaagccagg

SEQ ID NO: 753432 - RNA, 22 nt, Human
ccaggccagcgcuggcuggagg

SEQ ID NO: 753433 - RNA, 22 nt, Human
ccucucccgggugccgcugggc

SEQ ID NO: 753434 - RNA, 22 nt, Human
uuuuacaccuguuaacucuaag

SEQ ID NO: 753435 - RNA, 20 nt, Human
ccagagaguagguuagugau

SEQ ID NO: 753436 - RNA, 22 nt, Human
ugauaaauccauguaaauggua

SEQ ID NO: 753437 - RNA, 22 nt, Human
uagggugggcaguucuugggga

SEQ ID NO: 753438 - RNA, 22 nt, Human
gggacagaaggaagugagcaca

SEQ ID NO: 753439 - RNA, 22 nt, Human
cagugguugcuugcauggcucc

SEQ ID NO: 753440 - RNA, 22 nt, Human
acaauuguggcaauuuguaugu

SEQ ID NO: 753441 - RNA, 22 nt, Human
cccagccuuugcuuccugguuc

SEQ ID NO: 753442 - RNA, 22 nt, Human
cucaggauggaagccuacagga

SEQ ID NO: 753443 - RNA, 22 nt, Human
ucucagaacuuuauauguauca

SEQ ID NO: 753444 - RNA, 22 nt, Human
auacaugcuuggguguagugcg

SEQ ID NO: 753445 - RNA, 23 nt, Human
cauaugaaaguagacacuuucca

SEQ ID NO: 753446 - RNA, 22 nt, Human
ccugugcuggacagggcugggc

SEQ ID NO: 753447 - RNA, 22 nt, Human
ccaggaggcagagguuguagug

SEQ ID NO: 753448 - RNA, 22 nt, Human
agucagagugugcaggccggcu

SEQ ID NO: 753449 - RNA, 22 nt, Human
uacugugguaacauuuuaaauu

SEQ ID NO: 753450 - RNA, 22 nt, Human
uuuggcuuuagugccuucugau

SEQ ID NO: 753451 - RNA, 22 nt, Human
gaggagcuucagaggaaucuua

SEQ ID NO: 753452 - RNA, 22 nt, Human
gcacauauguaaauagcugccu

SEQ ID NO: 753453 - RNA, 22 nt, Human
uaauccaauggcacaauguaug

SEQ ID NO: 753454 - RNA, 22 nt, Human
ucugcguggcgugguucugugc

SEQ ID NO: 753455 - RNA, 22 nt, Human
ugauggcuuauggagagagcaa

SEQ ID NO: 753456 - RNA, 22 nt, Human
cugugggcauuugagugugggu

SEQ ID NO: 753457 - RNA, 22 nt, Human
ucuuccucaauguaacaacccc

SEQ ID NO: 753458 - RNA, 22 nt, Human
ggagaagguggcucagcaaagg

SEQ ID NO: 753459 - RNA, 22 nt, Human
ggcuccagggaguggagagaag

SEQ ID NO: 753460 - RNA, 22 nt, Human
uccacaucucucgccaaccaau

SEQ ID NO: 753461 - RNA, 22 nt, Human
caauauucaguggaaaagccau

SEQ ID NO: 753462 - RNA, 22 nt, Human
uggcuccagcguccacguccug

SEQ ID NO: 753463 - RNA, 22 nt, Human
gcggcaggaagagcgcagcccc

SEQ ID NO: 753464 - RNA, 22 nt, Human
gaagccaagggcugcuuuuccu

SEQ ID NO: 753465 - RNA, 22 nt, Human
acacuuaacuucugagaauaaa

SEQ ID NO: 753466 - RNA, 22 nt, Human
gcagggaaggggcaugcuggag

SEQ ID NO: 753467 - RNA, 22 nt, Human
aagccacuuucagcugucucag

SEQ ID NO: 753468 - RNA, 21 nt, Human
agaauaaugguaucauuugcu

SEQ ID NO: 753469 - RNA, 22 nt, Human
uccguugacagggcacuugaca

SEQ ID NO: 753470 - RNA, 22 nt, Human
cugaggcuuggaggggucuggu

SEQ ID NO: 753471 - RNA, 22 nt, Human
uucugcuuucaguucuucuggg

SEQ ID NO: 753472 - RNA, 22 nt, Human
augcacauacauaugcucuaua

SEQ ID NO: 753473 - RNA, 22 nt, Human
uagcauuccaucacucagcacc

SEQ ID NO: 753474 - RNA, 20 nt, Human
auaugggugaugaugucugu

SEQ ID NO: 753475 - RNA, 22 nt, Human
gcagagcugggucuguauccaa

SEQ ID NO: 753476 - RNA, 22 nt, Human
auaaagcaauagauuguguaau

SEQ ID NO: 753477 - RNA, 22 nt, Human
cuguguucagugcuacugaguu

SEQ ID NO: 753478 - RNA, 22 nt, Human
ccagaaaaggagcugcaggaug

SEQ ID NO: 753479 - RNA, 22 nt, Human
gagcgauugcgggggucagagg

SEQ ID NO: 753480 - RNA, 22 nt, Human
aaggcaauaguauuaaacugga

SEQ ID NO: 753481 - RNA, 23 nt, Human
ucugucacuuucugcuguggagu

SEQ ID NO: 753482 - RNA, 22 nt, Human
ucaggaucggccuuuuuuuaag

SEQ ID NO: 753483 - RNA, 17 nt, Human
ggacaccuggagucucc

SEQ ID NO: 753484 - RNA, 22 nt, Human
aaggaagacacagaugaaguga

SEQ ID NO: 753485 - RNA, 22 nt, Human
agcagccuggucucucgccaau

SEQ ID NO: 753486 - RNA, 17 nt, Human
ccagcugcucccucaga

SEQ ID NO: 753487 - RNA, 22 nt, Human
gggcucuguuuagaucagagau

SEQ ID NO: 753488 - RNA, 22 nt, Human
uuguauucuuuaugacuucccu

SEQ ID NO: 753489 - RNA, 22 nt, Human
uggggccagggaggaccagaca

SEQ ID NO: 753490 - RNA, 22 nt, Human
uuagauauguuuuugcuaaugc

SEQ ID NO: 753491 - RNA, 22 nt, Human
uauggcuugucuuuauaccagg

SEQ ID NO: 753492 - RNA, 22 nt, Human
ugcccugggaacacagaugcca

SEQ ID NO: 753493 - RNA, 19 nt, Human
ucuccaggugccccaaaca

SEQ ID NO: 753494 - RNA, 22 nt, Human
aaaagcaguuuauagucaguug

SEQ ID NO: 753495 - RNA, 22 nt, Human
caaaaguaauugcgguuuuugc

SEQ ID NO: 753496 - RNA, 22 nt, Human
ucccagccggugccuggguccc

SEQ ID NO: 753497 - RNA, 23 nt, Human
gagaaaccucgguaagcaggagg

SEQ ID NO: 753498 - RNA, 22 nt, Human
ucagggucaggacccagcuguu

SEQ ID NO: 753499 - RNA, 22 nt, Human
ugcuccguucuucugcuucuug

SEQ ID NO: 753500 - RNA, 22 nt, Human
acucuggggugaugucucugag

SEQ ID NO: 753501 - RNA, 22 nt, Human
guaugcaucgacucaagucuga

SEQ ID NO: 753502 - RNA, 22 nt, Human
aagggccauugcugagagcagu

SEQ ID NO: 753503 - RNA, 19 nt, Human
agauggggaagagugugag

SEQ ID NO: 753504 - RNA, 22 nt, Human
gggcaggagaagguggaugucc

SEQ ID NO: 753505 - RNA, 17 nt, Human
aggugcuggagcaucag

SEQ ID NO: 753506 - RNA, 22 nt, Human
uggcugagggggcaguucagga

SEQ ID NO: 753507 - RNA, 22 nt, Human
ggagagcugguagcuggcucca

SEQ ID NO: 753508 - RNA, 23 nt, Human
ggcuucagugagagucccugcug

SEQ ID NO: 753509 - RNA, 22 nt, Human
gagcugggagcugggauuugga

SEQ ID NO: 753510 - RNA, 20 nt, Human
ugggcugaggaucaggugcc

SEQ ID NO: 753511 - RNA, 22 nt, Human
ccaccaggacagcccugagggg

SEQ ID NO: 753512 - RNA, 20 nt, Human
ugcagcugguuucacaggga

SEQ ID NO: 753513 - RNA, 22 nt, Human
ucucuuaauucagaggcaguua

SEQ ID NO: 753514 - RNA, 22 nt, Human
uccucuccauauuuucugauuu

SEQ ID NO: 753515 - RNA, 23 nt, Human
agaguuuguuucuaaugagugag

SEQ ID NO: 753516 - RNA, 22 nt, Human
ucuuuauugcuacugguuuguc

SEQ ID NO: 753517 - RNA, 22 nt, Human
caaaagaagcucuuggggcuag

SEQ ID NO: 753518 - RNA, 22 nt, Human
aauucucaggaauuucaucugu

SEQ ID NO: 753519 - RNA, 22 nt, Human
uaggaaaauaucucuuauuggg

SEQ ID NO: 753520 - RNA, 22 nt, Human
gccugccuuugugaggaagcgg

SEQ ID NO: 753521 - RNA, 22 nt, Human
cuaggcugagcugggcugagcu

SEQ ID NO: 753522 - RNA, 22 nt, Human
caguguuuaaucauugugaauu

SEQ ID NO: 753523 - RNA, 22 nt, Human
ccucuguggcccugacucucuu

SEQ ID NO: 753524 - RNA, 22 nt, Human
auguauuugcuuguuauggauu

SEQ ID NO: 753525 - RNA, 19 nt, Human
gggacuggaggauguggag

SEQ ID NO: 753526 - RNA, 22 nt, Human
gcugagucuugagcacugagca

SEQ ID NO: 753527 - RNA, 22 nt, Human
ccagggcuuaacuuuucaggag

SEQ ID NO: 753528 - RNA, 22 nt, Human
uuuguaaaggccugaauuucag

SEQ ID NO: 753529 - RNA, 22 nt, Human
guagaaaaagcaguaagucuca

SEQ ID NO: 753530 - RNA, 22 nt, Human
agauuucagguuggggcagaag

SEQ ID NO: 753531 - RNA, 22 nt, Human
cuuuggaauauuuuauugagaa

SEQ ID NO: 753532 - RNA, 22 nt, Human
uuucauucagcacccugaggug

SEQ ID NO: 753533 - RNA, 22 nt, Human
uaaagaugcuauagugaaggag

SEQ ID NO: 753534 - RNA, 22 nt, Human
agauauuaggaggauucauaau

SEQ ID NO: 753535 - RNA, 22 nt, Human
uggcucuggauuaaucuaggaa

SEQ ID NO: 753536 - RNA, 22 nt, Human
gccaggagaaaaggcgaaugau

SEQ ID NO: 753537 - RNA, 22 nt, Human
uuacacagaugguuaguagagg

SEQ ID NO: 753538 - RNA, 22 nt, Human
cuuuaacaaaugacucuugucu

SEQ ID NO: 753539 - RNA, 22 nt, Human
cacaggaauuagcagccuaaaa

SEQ ID NO: 753540 - RNA, 22 nt, Human
agaugguuuugucuuuaugauu

SEQ ID NO: 753541 - RNA, 22 nt, Human
acagucaaucagaacagcaugu

SEQ ID NO: 753542 - RNA, 19 nt, Human
aaguguguugagccaggau

SEQ ID NO: 753543 - RNA, 22 nt, Human
gggcaccuugggucucaggcaa

SEQ ID NO: 753544 - RNA, 22 nt, Human
agagaguuguaccacacucaua

SEQ ID NO: 753545 - RNA, 22 nt, Human
agcuaaugaaauauuuucugau

SEQ ID NO: 753546 - RNA, 22 nt, Human
cgcauacauagaaacacacaga

SEQ ID NO: 753547 - RNA, 22 nt, Human
acagaacugcagacagugccaa

SEQ ID NO: 753548 - RNA, 22 nt, Human
cucuggcuauggcacggcgcuc

SEQ ID NO: 753549 - RNA, 22 nt, Human
gcuggcuguuggagguaccugc

SEQ ID NO: 753550 - RNA, 22 nt, Human
aucuccuuggucucguuccagg

SEQ ID NO: 753551 - RNA, 22 nt, Human
ucugcacagagacccuugccag

SEQ ID NO: 753552 - RNA, 21 nt, Human
gcugcucgagauccagugcuu

SEQ ID NO: 753553 - RNA, 22 nt, Human
ucucccacgguacaggauaaac

SEQ ID NO: 753554 - RNA, 22 nt, Human
cccaggcucccaggugggacaa

SEQ ID NO: 753555 - RNA, 22 nt, Human
ugucucaucucuuaaccccacu

SEQ ID NO: 753556 - RNA, 22 nt, Human
uccaagcuguauguuccuagag

SEQ ID NO: 753557 - RNA, 22 nt, Human
uuacaugggccauuuagacaug

SEQ ID NO: 753558 - RNA, 22 nt, Human
gcugcugucucaugcgaugcgg

SEQ ID NO: 753559 - RNA, 22 nt, Human
aggccuguuggcgugggcucua

SEQ ID NO: 753560 - RNA, 20 nt, Human
cuucaggacccauccucccc

SEQ ID NO: 753561 - RNA, 22 nt, Human
aagucacacugcugggaacucu

SEQ ID NO: 753562 - RNA, 22 nt, Human
caggagccgccaggcacguugg

SEQ ID NO: 753563 - RNA, 22 nt, Human
cauggcugcgagaagagugggu

SEQ ID NO: 753564 - RNA, 22 nt, Human
gcauugaucuguaugcauuaag

SEQ ID NO: 753565 - RNA, 22 nt, Human
gucuuguuugggauguggaugg

SEQ ID NO: 753566 - RNA, 22 nt, Human
acucagaaccauuuacucugag

SEQ ID NO: 753567 - RNA, 20 nt, Human
ggcacuggaagcacacagga

SEQ ID NO: 753568 - RNA, 22 nt, Human
acaggcauugggauggagguug

SEQ ID NO: 753569 - RNA, 22 nt, Human
gauuuccauuuucaacuccugc

SEQ ID NO: 753570 - RNA, 22 nt, Human
gaggagggcuuuguugauguua

SEQ ID NO: 753571 - RNA, 22 nt, Human
guaugaaggcgagagcccacua

SEQ ID NO: 753572 - RNA, 21 nt, Human
uaauuuauucagcacaguguu

SEQ ID NO: 753573 - RNA, 22 nt, Human
agcugcugggauacaguaguga

SEQ ID NO: 753574 - RNA, 22 nt, Human
uggccucagauuucaggggugg

SEQ ID NO: 753575 - RNA, 22 nt, Human
agccuucauaaucuugggcuuu

SEQ ID NO: 753576 - RNA, 22 nt, Human
agcucugggcugacaugcuccc

SEQ ID NO: 753577 - RNA, 22 nt, Human
agaugcugcuccacaggccagg

SEQ ID NO: 753578 - RNA, 22 nt, Human
ucaugcaguuacuguuaugcaa

SEQ ID NO: 753579 - RNA, 22 nt, Human
gagaagcaaucaguggccaccc

SEQ ID NO: 753580 - RNA, 22 nt, Human
ugggcucugugccagguuggug

SEQ ID NO: 753581 - RNA, 22 nt, Human
ucuuugcauggacauguguuuu

SEQ ID NO: 753582 - RNA, 22 nt, Human
uccagacccaugacccugggga

SEQ ID NO: 753583 - RNA, 21 nt, Human
uggcucuggguaggagagugc

SEQ ID NO: 753584 - RNA, 22 nt, Human
auuuggauucuuauuuagcacu

SEQ ID NO: 753585 - RNA, 22 nt, Human
agcuguggccagaugugagcgg

SEQ ID NO: 753586 - RNA, 20 nt, Human
cagaugggacguggaggagu

SEQ ID NO: 753587 - RNA, 22 nt, Human
gccucaguaaccuuaggggaua

SEQ ID NO: 753588 - RNA, 22 nt, Human
gaggcuccagcgacaccuaggc

SEQ ID NO: 753589 - RNA, 22 nt, Human
cuuccagcuuguggcgcuuucc

SEQ ID NO: 753590 - RNA, 22 nt, Human
uugugcuccuaugagaaucuaa

SEQ ID NO: 753591 - RNA, 22 nt, Human
acacugacugggacagaagacc

SEQ ID NO: 753592 - RNA, 22 nt, Human
uuggaaacgucaccuuuuccuu

SEQ ID NO: 753593 - RNA, 22 nt, Human
uuccucagcuggccugauuggg

SEQ ID NO: 753594 - RNA, 22 nt, Human
cagcuccuguuggucuugagga

SEQ ID NO: 753595 - RNA, 22 nt, Human
agaguacacuguacacacaauu

SEQ ID NO: 753596 - RNA, 22 nt, Human
augcaguacauacaaacacuga

SEQ ID NO: 753597 - RNA, 22 nt, Human
ugccaggcaacugcccagccau

SEQ ID NO: 753598 - RNA, 22 nt, Human
ggcacauguaugugggagugug

SEQ ID NO: 753599 - RNA, 22 nt, Human
gguugccggggcaggacuggaa

SEQ ID NO: 753600 - RNA, 22 nt, Human
cugcaguaguuuuugacucuag

SEQ ID NO: 753601 - RNA, 22 nt, Human
ccaggcagagggauccccaucc

SEQ ID NO: 753602 - RNA, 22 nt, Human
gcacacuuaauacucacugugc

SEQ ID NO: 753603 - RNA, 22 nt, Human
aaagccagagcaagcugucaca

SEQ ID NO: 753604 - RNA, 22 nt, Human
ucauuuaauugguuuugcucgu

SEQ ID NO: 753605 - RNA, 22 nt, Human
ccucucuuuccuacaccuugga

SEQ ID NO: 753606 - RNA, 22 nt, Human
gagagaauguacaugcuagggg

SEQ ID NO: 753607 - RNA, 22 nt, Human
uuauuaggaaaaggucagaugu

SEQ ID NO: 753608 - RNA, 22 nt, Human
ccagaaaaugcagaacauagaa

SEQ ID NO: 753609 - RNA, 22 nt, Human
gaaggcauuucagagaucucug

SEQ ID NO: 753610 - RNA, 22 nt, Human
aucugggcucgaauccuagcuc

SEQ ID NO: 753611 - RNA, 22 nt, Human
uuauguacaauguuaauguaaa

SEQ ID NO: 753612 - RNA, 19 nt, Human
gucuucugaauguggcugc

SEQ ID NO: 753613 - RNA, 22 nt, Human
aaacacucauguguuacucucc

SEQ ID NO: 753614 - RNA, 22 nt, Human
ugucugugcccaaggcucccgg

SEQ ID NO: 753615 - RNA, 22 nt, Human
aguuuuucugggaggcacugcu

SEQ ID NO: 753616 - RNA, 20 nt, Human
agcaggaaugaugcuuucau

SEQ ID NO: 753617 - RNA, 22 nt, Human
ucauuucacuucucuagggaga

SEQ ID NO: 753618 - RNA, 22 nt, Human
uguuuucagaugcagggacaca

SEQ ID NO: 753619 - RNA, 22 nt, Human
ucuguaaagacuccaaaagcca

SEQ ID NO: 753620 - RNA, 22 nt, Human
acaguguuguggcucuuaauag

SEQ ID NO: 753621 - RNA, 22 nt, Human
ucuucagcagagaauuaugaug

SEQ ID NO: 753622 - RNA, 16 nt, Human
ggcaccagugaacaca

SEQ ID NO: 753623 - RNA, 22 nt, Human
aagcugaggcuccccugaggga

SEQ ID NO: 753624 - RNA, 22 nt, Human
aaagcacaugaguaguguagua

SEQ ID NO: 753625 - RNA, 22 nt, Human
aucaccuggccauuggguuaac

SEQ ID NO: 753626 - RNA, 22 nt, Human
cacagucaauguagaaauauga

SEQ ID NO: 753627 - RNA, 22 nt, Human
agcaguuauauugaaauaaaaa

SEQ ID NO: 753628 - RNA, 22 nt, Human
uuucugcuuccuugagaaggag

SEQ ID NO: 753629 - RNA, 22 nt, Human
ccauccaggcugugggugagcu

SEQ ID NO: 753630 - RNA, 22 nt, Human
agcugccugggcuuguacaccu

SEQ ID NO: 753631 - RNA, 22 nt, Human
acaugcuuugcacuuacaucau

SEQ ID NO: 753632 - RNA, 22 nt, Human
cugaaaaacgggauuuggcugg

SEQ ID NO: 753633 - RNA, 22 nt, Human
ggcagggcccugauuccugggg

SEQ ID NO: 753634 - RNA, 22 nt, Human
uuggaucuuaugaagguggcau

SEQ ID NO: 753635 - RNA, 22 nt, Human
acaggacagguaggauucgcag

SEQ ID NO: 753636 - RNA, 22 nt, Human
ucacaugcagucacugagcagg

SEQ ID NO: 753637 - RNA, 22 nt, Human
gauacagcucuggccagaugug

SEQ ID NO: 753638 - RNA, 22 nt, Human
aaaugcagguucuugagccaag

SEQ ID NO: 753639 - RNA, 20 nt, Human
cugcugugugugccucagcc

SEQ ID NO: 753640 - RNA, 22 nt, Human
gcccuccauggugauccaggcc

SEQ ID NO: 753641 - RNA, 22 nt, Human
cucccucacaaagcauucucuu

SEQ ID NO: 753642 - RNA, 22 nt, Human
gcugccugcccugggucaucug

SEQ ID NO: 753643 - RNA, 22 nt, Human
acuuuaaagcagaauggcuaug

SEQ ID NO: 753644 - RNA, 22 nt, Human
ggagccagcagggugacacuga

SEQ ID NO: 753645 - RNA, 22 nt, Human
aagcaggcauuccagagacaau

SEQ ID NO: 753646 - RNA, 22 nt, Human
aguuuuauaucuuccauugguu

SEQ ID NO: 753647 - RNA, 22 nt, Human
cacauuguauuguggaaaguua

SEQ ID NO: 753648 - RNA, 22 nt, Human
uaccuggaaucacagaggcuga

SEQ ID NO: 753649 - RNA, 22 nt, Human
agaccaagugcaggugccacua

SEQ ID NO: 753650 - RNA, 22 nt, Human
ucauacaauucaaucucugauu

SEQ ID NO: 753651 - RNA, 22 nt, Human
caggaaugacccaacaguuuca

SEQ ID NO: 753652 - RNA, 22 nt, Human
uauuuucuggacagucuugcuu

SEQ ID NO: 753653 - RNA, 22 nt, Human
ucagaguggugguuuugccuuc

SEQ ID NO: 753654 - RNA, 19 nt, Human
agugaguggggaaggcccu

SEQ ID NO: 753655 - RNA, 22 nt, Human
gcucuugggggacagauggagu

SEQ ID NO: 753656 - RNA, 22 nt, Human
gcauggcuuccaaaagugcuaa

SEQ ID NO: 753657 - RNA, 22 nt, Human
ccagugugccaauuuacagcug

SEQ ID NO: 753658 - RNA, 22 nt, Human
gcagcugcucacauucucacaa

SEQ ID NO: 753659 - RNA, 22 nt, Human
augauauagagaguagauuaaa

SEQ ID NO: 753660 - RNA, 22 nt, Human
uccaaagaaccuggcuacuguc

SEQ ID NO: 753661 - RNA, 22 nt, Human
ccugugucaccggaacggagga

SEQ ID NO: 753662 - RNA, 22 nt, Human
uccuggcugccgucguccugcg

SEQ ID NO: 753663 - RNA, 22 nt, Human
uaugcaaaucauuagauuuccu

SEQ ID NO: 753664 - RNA, 22 nt, Human
aaacugagaccgaaagggguag

SEQ ID NO: 753665 - RNA, 23 nt, Human
cccagcagagaugaggagggguc

SEQ ID NO: 753666 - RNA, 22 nt, Human
ugcuccagggccuccagugggg

SEQ ID NO: 753667 - RNA, 22 nt, Human
uccugggagcacaugguccugc

SEQ ID NO: 753668 - RNA, 22 nt, Human
auuuggaagaaaucugucacag

SEQ ID NO: 753669 - RNA, 22 nt, Human
acuuagugcccuggcccuuaca

SEQ ID NO: 753670 - RNA, 22 nt, Human
aacacuuaaggagagaucaaau

SEQ ID NO: 753671 - RNA, 22 nt, Human
uuaaucacagcucugccaugag

SEQ ID NO: 753672 - RNA, 22 nt, Human
cauuuucucaaugaacccucuu

SEQ ID NO: 753673 - RNA, 22 nt, Human
cugggucugugcccagggaccu

SEQ ID NO: 753674 - RNA, 22 nt, Human
uuaugcuaagugcaacaagcca

SEQ ID NO: 753675 - RNA, 22 nt, Human
gugcccaguugaggccaggacu

SEQ ID NO: 753676 - RNA, 23 nt, Human
agcagcuggggugcucuuuuguc

SEQ ID NO: 753677 - RNA, 21 nt, Human
gcaggcuggucaaaccucagu

SEQ ID NO: 753678 - RNA, 22 nt, Human
ugcaugauagagaugguauuag

SEQ ID NO: 753679 - RNA, 22 nt, Human
uucuuuuuaucuucccauaaga

SEQ ID NO: 753680 - RNA, 22 nt, Human
uuauacaguuuauacuuagaau

SEQ ID NO: 753681 - RNA, 22 nt, Human
aggcugccuguuccaaucuccu

SEQ ID NO: 753682 - RNA, 22 nt, Human
ugggaagggccgauggagccuc

SEQ ID NO: 753683 - RNA, 22 nt, Human
ucagcaaaggaccagcacaggc

SEQ ID NO: 753684 - RNA, 22 nt, Human
ggggcuccagucuucacauuuu

SEQ ID NO: 753685 - RNA, 22 nt, Human
aaggcagagauauucuugaucu

SEQ ID NO: 753686 - RNA, 22 nt, Human
agaagccaccagcugaggaaga

SEQ ID NO: 753687 - RNA, 19 nt, Human
ugggcagcucccucugucc

SEQ ID NO: 753688 - RNA, 22 nt, Human
cacagcuucuccccgcugcggc

SEQ ID NO: 753689 - RNA, 23 nt, Human
uggcuucaacucugucggcagcc

SEQ ID NO: 753690 - RNA, 19 nt, Human
uucacaauuaugaaauuag

SEQ ID NO: 753691 - RNA, 22 nt, Human
uuucucuccuccaaaccaaaga

SEQ ID NO: 753692 - RNA, 22 nt, Human
uaggcucccagaucguuugcug

SEQ ID NO: 753693 - RNA, 22 nt, Human
cuguuauuuggaggaugcuugg

SEQ ID NO: 753694 - RNA, 22 nt, Human
ucugaggucauaaagcaacuuu

SEQ ID NO: 753695 - RNA, 22 nt, Human
gcugcaggggggucuggacuug

SEQ ID NO: 753696 - RNA, 22 nt, Human
acaguggaaaugugggagggga

SEQ ID NO: 753697 - RNA, 22 nt, Human
ugaaaauucucaggcucacccc

SEQ ID NO: 753698 - RNA, 22 nt, Human
cccagccuacucugccauagca

SEQ ID NO: 753699 - RNA, 19 nt, Human
ccuuggaguuccaggugga

SEQ ID NO: 753700 - RNA, 22 nt, Human
ucucuucuaauuuucccgagua

SEQ ID NO: 753701 - RNA, 22 nt, Human
uaccaguaauugcuugugcugu

SEQ ID NO: 753702 - RNA, 22 nt, Human
ucugccuguucccgauuccaug

SEQ ID NO: 753703 - RNA, 22 nt, Human
uggggaggaagucagauuucag

SEQ ID NO: 753704 - RNA, 22 nt, Human
ccugcagaggucaggccagaaa

SEQ ID NO: 753705 - RNA, 22 nt, Human
uauacacauguguguauucaua

SEQ ID NO: 753706 - RNA, 22 nt, Human
guauaggcauuuugauuagagu

SEQ ID NO: 753707 - RNA, 22 nt, Human
cagguugggcugcgaggaggag

SEQ ID NO: 753708 - RNA, 22 nt, Human
uuauagcaggugacuaaugagu

SEQ ID NO: 753709 - RNA, 21 nt, Human
caggucuggugaacacucuca

SEQ ID NO: 753710 - RNA, 22 nt, Human
acugccagaggagguaucugaa

SEQ ID NO: 753711 - RNA, 22 nt, Human
uuccauuuauucuuguccagau

SEQ ID NO: 753712 - RNA, 21 nt, Human
agcaggcuuuggaguggggcu

SEQ ID NO: 753713 - RNA, 22 nt, Human
cuuguaauggcagagaccuguc

SEQ ID NO: 753714 - RNA, 23 nt, Human
ucucagaggauuccugggccuug

SEQ ID NO: 753715 - RNA, 22 nt, Human
acauagaaccuggcacauagua

SEQ ID NO: 753716 - RNA, 22 nt, Human
ucagccaggcagcccccugguc

SEQ ID NO: 753717 - RNA, 22 nt, Human
agggccugucagcgguguccug

SEQ ID NO: 753718 - RNA, 22 nt, Human
uacagaaucuaugcuucacagu

SEQ ID NO: 753719 - RNA, 20 nt, Human
cacagaacaaauugcaggac

SEQ ID NO: 753720 - RNA, 22 nt, Human
cacuuuauaaaauuggugugag

SEQ ID NO: 753721 - RNA, 22 nt, Human
uucacagugguagugcauuuag

SEQ ID NO: 753722 - RNA, 22 nt, Human
uacagccaugguuaauuuaccu

SEQ ID NO: 753723 - RNA, 22 nt, Human
aaagcagcggugucuuuacugc

SEQ ID NO: 753724 - RNA, 21 nt, Human
ugguacaccuugccugucaga

SEQ ID NO: 753725 - RNA, 22 nt, Human
ggcaggugcccagagagcacga

SEQ ID NO: 753726 - RNA, 22 nt, Human
auggcauucacauuuccagaga

SEQ ID NO: 753727 - RNA, 22 nt, Human
cuggccuuguuccuccccaagu

SEQ ID NO: 753728 - RNA, 22 nt, Human
ugcauauuuuauaaagauggaa

SEQ ID NO: 753729 - RNA, 22 nt, Human
ggcugggcugcggcuguaccug

SEQ ID NO: 753730 - RNA, 22 nt, Human
ucauuuacaugucuuucucuga

SEQ ID NO: 753731 - RNA, 22 nt, Human
uacaacacugguucgacaugug

SEQ ID NO: 753732 - RNA, 22 nt, Human
uaaaugucaaugugauuuauaa

SEQ ID NO: 753733 - RNA, 22 nt, Human
ugugccugaguuggcugaguac

SEQ ID NO: 753734 - RNA, 22 nt, Human
auugacaauucuaugcagagca

SEQ ID NO: 753735 - RNA, 22 nt, Human
acuuaucaguugucucuaaugu

SEQ ID NO: 753736 - RNA, 18 nt, Human
ccagcaugccagaggcug

SEQ ID NO: 753737 - RNA, 22 nt, Human
uucacaagucuggaauaugcua

SEQ ID NO: 753738 - RNA, 22 nt, Human
ugcaaacaauuuccuauaaagu

SEQ ID NO: 753739 - RNA, 17 nt, Human
aaguccagccugcagcu

SEQ ID NO: 753740 - RNA, 20 nt, Human
gaggagccaccuugagcugg

SEQ ID NO: 753741 - RNA, 22 nt, Human
auuugcuuguccuggugacugu

SEQ ID NO: 753742 - RNA, 20 nt, Human
agguggcuccugcugggggu

SEQ ID NO: 753743 - RNA, 22 nt, Human
uucagaaaugaauauugguauu

SEQ ID NO: 753744 - RNA, 22 nt, Human
aaugccguagacuuuuacuuau

SEQ ID NO: 753745 - RNA, 23 nt, Human
acauuucauauaaaagggaucag

SEQ ID NO: 753746 - RNA, 22 nt, Human
agaguucacacucagugcaccc

SEQ ID NO: 753747 - RNA, 22 nt, Human
ucagccaggcacaauggcagcu

SEQ ID NO: 753748 - RNA, 22 nt, Human
agcugaggguucgguguccaca

SEQ ID NO: 753749 - RNA, 22 nt, Human
uguaugcuugaguguguauacu

SEQ ID NO: 753750 - RNA, 18 nt, Human
ucagagagcagcuuuauu

SEQ ID NO: 753751 - RNA, 22 nt, Human
ugggaagacuccucaggaggcg

SEQ ID NO: 753752 - RNA, 23 nt, Human
gggaccaggcccuuccugguuug

SEQ ID NO: 753753 - RNA, 22 nt, Human
cacaugcuuagauuucagugga

SEQ ID NO: 753754 - RNA, 22 nt, Human
ggaaggaucuggcugaaaucca

SEQ ID NO: 753755 - RNA, 22 nt, Human
agaagccacuggagguugagau

SEQ ID NO: 753756 - RNA, 22 nt, Human
ggccagcuucucugcugccugu

SEQ ID NO: 753757 - RNA, 22 nt, Human
cuccacucuggggugggugaga

SEQ ID NO: 753758 - RNA, 22 nt, Human
gacagcauggugucuguucagg

SEQ ID NO: 753759 - RNA, 22 nt, Human
ucacaugagucacuaucuuaau

SEQ ID NO: 753760 - RNA, 22 nt, Human
ugccugcauuuuguggcuggcu

SEQ ID NO: 753761 - RNA, 22 nt, Human
uggcauuuggcuuacuuauguu

SEQ ID NO: 753762 - RNA, 22 nt, Human
gcugaauaggggucccaaagau

SEQ ID NO: 753763 - RNA, 22 nt, Human
ucauuuaaaauguaccaggauu

SEQ ID NO: 753764 - RNA, 22 nt, Human
aguguuaaugguguauauuagg

SEQ ID NO: 753765 - RNA, 22 nt, Human
ccagcucucugcagaaaggacu

SEQ ID NO: 753766 - RNA, 22 nt, Human
gccagcugguaggcaccuagcc

SEQ ID NO: 753767 - RNA, 21 nt, Human
aguggcugucaagggggccuu

SEQ ID NO: 753768 - RNA, 22 nt, Human
aggaacuggggcuauucacccu

SEQ ID NO: 753769 - RNA, 22 nt, Human
uuagcaaaguuugccaucuagu

SEQ ID NO: 753770 - RNA, 22 nt, Human
uuaacacuccuaacuacagucu

SEQ ID NO: 753771 - RNA, 22 nt, Human
aagcuggagugcagugcaaugg

SEQ ID NO: 753772 - RNA, 22 nt, Human
ggagagccugugcagccggguu

SEQ ID NO: 753773 - RNA, 17 nt, Human
caagagagaugacugga

SEQ ID NO: 753774 - RNA, 22 nt, Human
auauuauagacagagucuucug

SEQ ID NO: 753775 - RNA, 21 nt, Human
ugcauuucuaacuaguugacc

SEQ ID NO: 753776 - RNA, 22 nt, Human
caagguuuugcuuguaagggaa

SEQ ID NO: 753777 - RNA, 22 nt, Human
cugcuucauauuucauagugau

SEQ ID NO: 753778 - RNA, 22 nt, Human
ggccucugcuuaugcugaugac

SEQ ID NO: 753779 - RNA, 22 nt, Human
cagagguacaagcuaaguuggg

SEQ ID NO: 753780 - RNA, 22 nt, Human
accaggagccauagagucaggc

SEQ ID NO: 753781 - RNA, 22 nt, Human
uucuuuuuggauagcugaugaa

SEQ ID NO: 753782 - RNA, 22 nt, Human
auuaugaaguugagggacccug

SEQ ID NO: 753783 - RNA, 22 nt, Human
acagaaggacuugagaaagaca

SEQ ID NO: 753784 - RNA, 22 nt, Human
ugcagggcuacaggacuacaac

SEQ ID NO: 753785 - RNA, 22 nt, Human
ccuguggcugccccgcuguugg

SEQ ID NO: 753786 - RNA, 22 nt, Human
cucugcuuuuaugugccggcgc

SEQ ID NO: 753787 - RNA, 22 nt, Human
ugugaugcuggagugcgaauau

SEQ ID NO: 753788 - RNA, 22 nt, Human
aaugcagugagccauuaaaugg

SEQ ID NO: 753789 - RNA, 23 nt, Human
gcucccugugcuccaggagaugc

SEQ ID NO: 753790 - RNA, 22 nt, Human
aaagauuaaaucaaauugguca

SEQ ID NO: 753791 - RNA, 22 nt, Human
guuuccuagaucaguguucuua

SEQ ID NO: 753792 - RNA, 19 nt, Human
uuuccuaaaaagcugugcu

SEQ ID NO: 753793 - RNA, 22 nt, Human
agggcccauagaucgucagcuu

SEQ ID NO: 753794 - RNA, 20 nt, Human
acacauagauaagaagcuga

SEQ ID NO: 753795 - RNA, 22 nt, Human
gagagcacaugaacauggagga

SEQ ID NO: 753796 - RNA, 22 nt, Human
auggcccaggccaggauccagc

SEQ ID NO: 753797 - RNA, 22 nt, Human
uuagcagcaauggcaucaacua

SEQ ID NO: 753798 - RNA, 22 nt, Human
uccugacuuggcuguuggcccu

SEQ ID NO: 753799 - RNA, 22 nt, Human
cugggccuggcguuccaggcug

SEQ ID NO: 753800 - RNA, 22 nt, Human
gcacugaaaauguuggauucca

SEQ ID NO: 753801 - RNA, 22 nt, Human
cagugguugguagauacuugag

SEQ ID NO: 753802 - RNA, 22 nt, Human
ucagcugaguucuagagcacuc

SEQ ID NO: 753803 - RNA, 20 nt, Human
ggcaugagaugugagggagg

SEQ ID NO: 753804 - RNA, 22 nt, Human
augcacaauuaggauauagcuu

SEQ ID NO: 753805 - RNA, 22 nt, Human
uucucuucuguucagugcccaa

SEQ ID NO: 753806 - RNA, 22 nt, Human
ucaaggaggugcuuggcuucac

SEQ ID NO: 753807 - RNA, 22 nt, Human
ugggaagcuacucaugcaggca

SEQ ID NO: 753808 - RNA, 22 nt, Human
uaagacacaguccgcacucucu

SEQ ID NO: 753809 - RNA, 22 nt, Human
ugaggggagaagcagcagccug

SEQ ID NO: 753810 - RNA, 22 nt, Human
gcugcaggagcuggagcugugg

SEQ ID NO: 753811 - RNA, 22 nt, Human
aucaggaugaagcuguagcgaa

SEQ ID NO: 753812 - RNA, 22 nt, Human
ggaugggaacuugguagggcau

SEQ ID NO: 753813 - RNA, 22 nt, Human
cagugccucaggccagccugca

SEQ ID NO: 753814 - RNA, 22 nt, Human
gcucugggaacugacugccuuc

SEQ ID NO: 753815 - RNA, 22 nt, Human
ucuguguauuugugaccuguau

SEQ ID NO: 753816 - RNA, 22 nt, Human
uagacuauuucuuuugcauagg

SEQ ID NO: 753817 - RNA, 22 nt, Human
ccuuuguggggcgguggguaau

SEQ ID NO: 753818 - RNA, 22 nt, Human
uucugccuucaguccucugacu

SEQ ID NO: 753819 - RNA, 22 nt, Human
uugcuauaaaugguuucauauu

SEQ ID NO: 753820 - RNA, 22 nt, Human
ucagugguuaaguucuguccac

SEQ ID NO: 753821 - RNA, 22 nt, Human
cucagagcaaugaacaugcaaa

SEQ ID NO: 753822 - RNA, 22 nt, Human
augucuuucucacagccaguuc

SEQ ID NO: 753823 - RNA, 22 nt, Human
acagcugggugcugcucagagc

SEQ ID NO: 753824 - RNA, 22 nt, Human
uccugcgagugcgcuuuugguc

SEQ ID NO: 753825 - RNA, 22 nt, Human
aucugcuucagugauaugugaa

SEQ ID NO: 753826 - RNA, 22 nt, Human
ggcaggcuguucaccugcuuuu

SEQ ID NO: 753827 - RNA, 22 nt, Human
ucuuuaauauaaaggaaugaau

SEQ ID NO: 753828 - RNA, 20 nt, Human
acaauuuccucacuauaugc

SEQ ID NO: 753829 - RNA, 22 nt, Human
uggaggaauaacagcaaccuua

SEQ ID NO: 753830 - RNA, 22 nt, Human
caaauacucuggauguguuugu

SEQ ID NO: 753831 - RNA, 22 nt, Human
uaggucuccuggccuagagauu

SEQ ID NO: 753832 - RNA, 22 nt, Human
aauuggaaaaugcuacauauca

SEQ ID NO: 753833 - RNA, 22 nt, Human
ugguggccaauucacagggcuc

SEQ ID NO: 753834 - RNA, 22 nt, Human
aauagcaugcauccugcauaga

SEQ ID NO: 753835 - RNA, 22 nt, Human
agguggggcugggaaagauucc

SEQ ID NO: 753836 - RNA, 22 nt, Human
uauuccugggccccauuccaga

SEQ ID NO: 753837 - RNA, 22 nt, Human
uaugaaauuucuaguucugcuu

SEQ ID NO: 753838 - RNA, 22 nt, Human
auacaaugggugcaaagaugug

SEQ ID NO: 753839 - RNA, 22 nt, Human
uauaggaaguaauuguugccug

SEQ ID NO: 753840 - RNA, 22 nt, Human
agacauaagccagucacucacu

SEQ ID NO: 753841 - RNA, 22 nt, Human
uucuuuucugcagcugguauuu

SEQ ID NO: 753842 - RNA, 22 nt, Human
agccugccuugggcugcuugag

SEQ ID NO: 753843 - RNA, 22 nt, Human
gcauuaauguaagacccacucc

SEQ ID NO: 753844 - RNA, 22 nt, Human
ccguauuauaaguuuuuccuuc

SEQ ID NO: 753845 - RNA, 22 nt, Human
accaggggaugguuggcacugu

SEQ ID NO: 753846 - RNA, 22 nt, Human
uacacaggggagcaugguugac

SEQ ID NO: 753847 - RNA, 22 nt, Human
caggcacacaggcucccugggc

SEQ ID NO: 753848 - RNA, 23 nt, Human
guccuauuuuuugaaauacugag

SEQ ID NO: 753849 - RNA, 23 nt, Human
caugggagugagaaugccagcuc

SEQ ID NO: 753850 - RNA, 22 nt, Human
agcccuggggcuggugcuuacc

SEQ ID NO: 753851 - RNA, 22 nt, Human
agccagcaggaacgucuagguu

SEQ ID NO: 753852 - RNA, 22 nt, Human
caggagcuucugcccauggcca

SEQ ID NO: 753853 - RNA, 22 nt, Human
aucucagggcuggagcccugga

SEQ ID NO: 753854 - RNA, 22 nt, Human
uuuaaauguucaugauacugaa

SEQ ID NO: 753855 - RNA, 22 nt, Human
aaaucaacuugugacguuaggu

SEQ ID NO: 753856 - RNA, 22 nt, Human
cugagcagaagggugcacgugc

SEQ ID NO: 753857 - RNA, 22 nt, Human
aagcagcagcaggauuaaagag

SEQ ID NO: 753858 - RNA, 22 nt, Human
gcaugggcaagaggacuggggg

SEQ ID NO: 753859 - RNA, 22 nt, Human
gucuugucaguguuggcagcuu

SEQ ID NO: 753860 - RNA, 22 nt, Human
ccugcccagcuucccgagugca

SEQ ID NO: 753861 - RNA, 22 nt, Human
gaccuggcuuugggccccggca

SEQ ID NO: 753862 - RNA, 20 nt, Human
ggaaacauuuuuauuuccau

SEQ ID NO: 753863 - RNA, 22 nt, Human
uauguacucuaauuugucucau

SEQ ID NO: 753864 - RNA, 22 nt, Human
acacauuuauggaucgcagaaa

SEQ ID NO: 753865 - RNA, 22 nt, Human
caggaggcagaggaugcccagu

SEQ ID NO: 753866 - RNA, 22 nt, Human
auacuucaugcuucaugucugu

SEQ ID NO: 753867 - RNA, 22 nt, Human
gucuccaguuacagcagccagg

SEQ ID NO: 753868 - RNA, 22 nt, Human
gagcucuguccacacuuggaga

SEQ ID NO: 753869 - RNA, 22 nt, Human
ccucaguguguuuggggugagg

SEQ ID NO: 753870 - RNA, 22 nt, Human
uggaagacagugacugguugug

SEQ ID NO: 753871 - RNA, 22 nt, Human
ugggucagaggaccucguggcc

SEQ ID NO: 753872 - RNA, 22 nt, Human
accugaauuugaaauguuuauu

SEQ ID NO: 753873 - RNA, 22 nt, Human
ggcccagcuuucauuccuugcu

SEQ ID NO: 753874 - RNA, 22 nt, Human
ugucuugacuuuagagccagga

SEQ ID NO: 753875 - RNA, 22 nt, Human
aaaggccuugagcugggugcca

SEQ ID NO: 753876 - RNA, 22 nt, Human
cuagguggugguggguugacau

SEQ ID NO: 753877 - RNA, 22 nt, Human
aauguuaaaaccuucagugcuu

SEQ ID NO: 753878 - RNA, 19 nt, Human
uggcagccuccacuuuugc

SEQ ID NO: 753879 - RNA, 22 nt, Human
aaggcugauuagacugauagcu

SEQ ID NO: 753880 - RNA, 22 nt, Human
ggcaaggccuugcccagcauuc

SEQ ID NO: 753881 - RNA, 22 nt, Human
cagaugcuuuugauucuggggu

SEQ ID NO: 753882 - RNA, 22 nt, Human
agugccuugugugugggcagcc

SEQ ID NO: 753883 - RNA, 22 nt, Human
auaagguuaacaucaucaguga

SEQ ID NO: 753884 - RNA, 22 nt, Human
auucugaguacaacaagauguu

SEQ ID NO: 753885 - RNA, 22 nt, Human
cagcugccacaccucuuucucu

SEQ ID NO: 753886 - RNA, 22 nt, Human
auccagagacccaaggacagaa

SEQ ID NO: 753887 - RNA, 23 nt, Human
uggaaucagccuuuuuuccaagg

SEQ ID NO: 753888 - RNA, 22 nt, Human
ucaggcucaaagggccggauga

SEQ ID NO: 753889 - RNA, 19 nt, Human
acccucugccacaagccuc

SEQ ID NO: 753890 - RNA, 22 nt, Human
uccugagcaacacagcuaagug

SEQ ID NO: 753891 - RNA, 22 nt, Human
cagcuggcagaaccugcaucca

SEQ ID NO: 753892 - RNA, 22 nt, Human
augaagcugguuuuggcuuggg

SEQ ID NO: 753893 - RNA, 22 nt, Human
ccagaucuucuuuucagugucu

SEQ ID NO: 753894 - RNA, 22 nt, Human
ugagcccagagcccuuguaggg

SEQ ID NO: 753895 - RNA, 22 nt, Human
uggagagcagggcuggaguuca

SEQ ID NO: 753896 - RNA, 22 nt, Human
ucuuccucucuaauugaucaga

SEQ ID NO: 753897 - RNA, 22 nt, Human
ugucuuuguuauuguggacagg

SEQ ID NO: 753898 - RNA, 22 nt, Human
ugcacagcugccuccucucugc

SEQ ID NO: 753899 - RNA, 17 nt, Human
gucuggaguggccuuca

SEQ ID NO: 753900 - RNA, 21 nt, Human
aggcucucauccagggaccca

SEQ ID NO: 753901 - RNA, 22 nt, Human
uacugcauagacacugggauau

SEQ ID NO: 753902 - RNA, 22 nt, Human
ucaaagcaauuucaccagugcc

SEQ ID NO: 753903 - RNA, 22 nt, Human
gcugcaggaugaggcucugcuc

SEQ ID NO: 753904 - RNA, 22 nt, Human
gcucacaggucuguggcuauug

SEQ ID NO: 753905 - RNA, 22 nt, Human
aaauaacagucagggacaacau

SEQ ID NO: 753906 - RNA, 22 nt, Human
ucagagaacacagaggugaugu

SEQ ID NO: 753907 - RNA, 22 nt, Human
caggaggccaacugugggacuu

SEQ ID NO: 753908 - RNA, 22 nt, Human
uugguuuguucaccaucaagca

SEQ ID NO: 753909 - RNA, 22 nt, Human
uguuuucagucauauagcaggu

SEQ ID NO: 753910 - RNA, 22 nt, Human
ggugguugcauaggccagcagc

SEQ ID NO: 753911 - RNA, 22 nt, Human
agauaucaccaguuuuacauac

SEQ ID NO: 753912 - RNA, 22 nt, Human
gaaauauacaugaagucggcug

SEQ ID NO: 753913 - RNA, 22 nt, Human
aaggcagcaagaauuccagguu

SEQ ID NO: 753914 - RNA, 21 nt, Human
uggacuggugaguuuaggcug

SEQ ID NO: 753915 - RNA, 22 nt, Human
ugcucuucggggccacugcuug

SEQ ID NO: 753916 - RNA, 21 nt, Human
uuguucuuccagaagcaaagu

SEQ ID NO: 753917 - RNA, 22 nt, Human
ggggauggugggaaggcaaucu

SEQ ID NO: 753918 - RNA, 22 nt, Human
aacauauucagaugccaagucc

SEQ ID NO: 753919 - RNA, 22 nt, Human
aaugcaaagugaggugaguggc

SEQ ID NO: 753920 - RNA, 22 nt, Human
uuuacagaaugucaauuucuau

SEQ ID NO: 753921 - RNA, 22 nt, Human
gauacaagacuaauaggaaaca

SEQ ID NO: 753922 - RNA, 22 nt, Human
cauucaaauuaagauuuuguua

SEQ ID NO: 753923 - RNA, 22 nt, Human
acugagggugcacaggcaggca

SEQ ID NO: 753924 - RNA, 22 nt, Human
agacaguggaucgggaugcacu

SEQ ID NO: 753925 - RNA, 22 nt, Human
caggcccucaggcaagggcucu

SEQ ID NO: 753926 - RNA, 22 nt, Human
acuuuggacgccaugcuguuug

SEQ ID NO: 753927 - RNA, 22 nt, Human
ugcuuugcaaauaauagaaugu

SEQ ID NO: 753928 - RNA, 22 nt, Human
gcagaaguaggcucuguguagg

SEQ ID NO: 753929 - RNA, 22 nt, Human
gaacagggaguacggcacauuu

SEQ ID NO: 753930 - RNA, 22 nt, Human
agugcgugguuuacagcuaguu

SEQ ID NO: 753931 - RNA, 22 nt, Human
aacuacauuguccuuucugaag

SEQ ID NO: 753932 - RNA, 22 nt, Human
ggcagcugauuagcaucaagga

SEQ ID NO: 753933 - RNA, 22 nt, Human
cucuauuuuucuuggcuagugu

SEQ ID NO: 753934 - RNA, 22 nt, Human
gaaggcaagcagcauaaauguc

SEQ ID NO: 753935 - RNA, 22 nt, Human
gcccugaauaauagagugggga

SEQ ID NO: 753936 - RNA, 22 nt, Human
ugucaauaacuggagucauuau

SEQ ID NO: 753937 - RNA, 22 nt, Human
ugagcagacuugaugaggcagc

SEQ ID NO: 753938 - RNA, 22 nt, Human
cauuggaaugaucguuuugcug

SEQ ID NO: 753939 - RNA, 22 nt, Human
agagucagaaccaagaugaggc

SEQ ID NO: 753940 - RNA, 22 nt, Human
caaagguuguugagagugcagg

SEQ ID NO: 753941 - RNA, 22 nt, Human
uccagagggcgauggcuggggg

SEQ ID NO: 753942 - RNA, 22 nt, Human
ugaaauagacuugcacuauaug

SEQ ID NO: 753943 - RNA, 16 nt, Human
guaaaggcagggaauu

SEQ ID NO: 753944 - RNA, 22 nt, Human
uuuuaaugggcgacuauuaugg

SEQ ID NO: 753945 - RNA, 19 nt, Human
agguuucuaacuauucaag

SEQ ID NO: 753946 - RNA, 22 nt, Human
guagcuauuuaugauacucaug

SEQ ID NO: 753947 - RNA, 22 nt, Human
cugcccugugguuguggguucu

SEQ ID NO: 753948 - RNA, 22 nt, Human
uugcucuccagaggcucacagc

SEQ ID NO: 753949 - RNA, 23 nt, Human
uggcagauacaggcaugacuucu

SEQ ID NO: 753950 - RNA, 22 nt, Human
agaauguguuauuagagaagga

SEQ ID NO: 753951 - RNA, 22 nt, Human
gaaauauuucucuugagccccu

SEQ ID NO: 753952 - RNA, 22 nt, Human
cugcaucacagcaggaggcaca

SEQ ID NO: 753953 - RNA, 20 nt, Human
acaguguuuuugaguagagc

SEQ ID NO: 753954 - RNA, 22 nt, Human
acagagccuccaggagugcugg

SEQ ID NO: 753955 - RNA, 22 nt, Human
uauauaauuuguaaaagcaccu

SEQ ID NO: 753956 - RNA, 22 nt, Human
agguucucacacgucuacaccc

SEQ ID NO: 753957 - RNA, 22 nt, Human
aggcuucagcagcccucucuug

SEQ ID NO: 753958 - RNA, 22 nt, Human
uggcucaggguccccaaauggu

SEQ ID NO: 753959 - RNA, 22 nt, Human
aaauucuaaggucacaauguug

SEQ ID NO: 753960 - RNA, 22 nt, Human
cuguguacccacgugggcaccc

SEQ ID NO: 753961 - RNA, 22 nt, Human
acugugaaucacuacuaguaga

SEQ ID NO: 753962 - RNA, 22 nt, Human
augccuggauuugggacucaaa

SEQ ID NO: 753963 - RNA, 22 nt, Human
agaggugggagccuggucacau

SEQ ID NO: 753964 - RNA, 22 nt, Human
cccagugucugggccugcaggg

SEQ ID NO: 753965 - RNA, 21 nt, Human
ugacuuuauuugacagcccag

SEQ ID NO: 753966 - RNA, 22 nt, Human
uggcagcuccuggggccagcac

SEQ ID NO: 753967 - RNA, 22 nt, Human
ucugcccauucuuagagucuag

SEQ ID NO: 753968 - RNA, 22 nt, Human
cucuggaggucagguguggugg

SEQ ID NO: 753969 - RNA, 22 nt, Human
uguccugggucaaauccugguc

SEQ ID NO: 753970 - RNA, 22 nt, Human
gcucugcucuaacauuccugac

SEQ ID NO: 753971 - RNA, 23 nt, Human
ccaccuggacucugggcaggugc

SEQ ID NO: 753972 - RNA, 22 nt, Human
ucuuugcaugugcuucuuggcc

SEQ ID NO: 753973 - RNA, 22 nt, Human
cagagccugcucacgucucugu

SEQ ID NO: 753974 - RNA, 22 nt, Human
augaaagcacgugggaagauaa

SEQ ID NO: 753975 - RNA, 22 nt, Human
uauuauuuuagcacugaggauu

SEQ ID NO: 753976 - RNA, 22 nt, Human
ggcauagcggcucagcguccag

SEQ ID NO: 753977 - RNA, 22 nt, Human
cagauguaguagcuuuauugca

SEQ ID NO: 753978 - RNA, 22 nt, Human
aauacauauggaauuccauguu

SEQ ID NO: 753979 - RNA, 22 nt, Human
gccuggccgcuccgagcuccgc

SEQ ID NO: 753980 - RNA, 22 nt, Human
caucaaaucugacuuuucuucc

SEQ ID NO: 753981 - RNA, 22 nt, Human
uugccucccagcaugggcagcu

SEQ ID NO: 753982 - RNA, 22 nt, Human
uggcagagucaucacaucugga

SEQ ID NO: 753983 - RNA, 22 nt, Human
gggguggauuccuacaggucca

SEQ ID NO: 753984 - RNA, 22 nt, Human
gugcuccaggucgcucagagag

SEQ ID NO: 753985 - RNA, 22 nt, Human
uaaguaacugcauaauuaaauu

SEQ ID NO: 753986 - RNA, 22 nt, Human
cagcuuuggagugugagugcug

SEQ ID NO: 753987 - RNA, 22 nt, Human
augacagacccucuaaagacaa

SEQ ID NO: 753988 - RNA, 22 nt, Human
cauauuuauagaucuggcauuu

SEQ ID NO: 753989 - RNA, 22 nt, Human
ccagcugcauccuauucacugc

SEQ ID NO: 753990 - RNA, 22 nt, Human
ucucuacagacacuguugacuu

SEQ ID NO: 753991 - RNA, 22 nt, Human
agcagauaugauacuuaauuua

SEQ ID NO: 753992 - RNA, 22 nt, Human
cuagaauacucguauuauuccc

SEQ ID NO: 753993 - RNA, 22 nt, Human
ucuucacauggaacaugaagcu

SEQ ID NO: 753994 - RNA, 22 nt, Human
caggagaugacagggaagaacc

SEQ ID NO: 753995 - RNA, 22 nt, Human
aguuaagagugugaaaauguua

SEQ ID NO: 753996 - RNA, 22 nt, Human
cuuccagagauccaugaauacc

SEQ ID NO: 753997 - RNA, 22 nt, Human
acagggcuccuugggcugacac

SEQ ID NO: 753998 - RNA, 22 nt, Human
cacccuggcuggaggugcagug

SEQ ID NO: 753999 - RNA, 22 nt, Human
ugggauggcauccugggccuug

SEQ ID NO: 754000 - RNA, 20 nt, Human
uguuaaaggacacuugcuuu

SEQ ID NO: 754001 - RNA, 22 nt, Human
acugaggcgcaguccggcuguc

SEQ ID NO: 754002 - RNA, 22 nt, Human
gcccugagccaccaaugccauu

SEQ ID NO: 754003 - RNA, 22 nt, Human
uucaucaggcaucaugcucaag

SEQ ID NO: 754004 - RNA, 18 nt, Human
gccugcucugcucucccc

SEQ ID NO: 754005 - RNA, 22 nt, Human
cacauggcagaaucaugcaucu

SEQ ID NO: 754006 - RNA, 22 nt, Human
uuguccagcagcucagucuacg

SEQ ID NO: 754007 - RNA, 22 nt, Human
gagugcugaaugcgagaacaga

SEQ ID NO: 754008 - RNA, 22 nt, Human
uuagauaaauuaagacuuuaca

SEQ ID NO: 754009 - RNA, 23 nt, Human
uguauacacccugugcaucuggg

SEQ ID NO: 754010 - RNA, 22 nt, Human
uguuuaauugggccaacagcgg

SEQ ID NO: 754011 - RNA, 22 nt, Human
cugggugcuuacuuugugcuag

SEQ ID NO: 754012 - RNA, 22 nt, Human
cuuccugagcaaggaacuauag

SEQ ID NO: 754013 - RNA, 22 nt, Human
ucuaaugagggugaaggcccag

SEQ ID NO: 754014 - RNA, 22 nt, Human
ggcaggcacuguguuuuguguu

SEQ ID NO: 754015 - RNA, 22 nt, Human
cuggaggcuggcuuccccuggc

SEQ ID NO: 754016 - RNA, 20 nt, Human
accccacagaguccauugca

SEQ ID NO: 754017 - RNA, 22 nt, Human
aauuugauucagcaaauguuca

SEQ ID NO: 754018 - RNA, 19 nt, Human
ggucacagggguuacaagg

SEQ ID NO: 754019 - RNA, 22 nt, Human
gcaaagggaaaguggcaggguc

SEQ ID NO: 754020 - RNA, 22 nt, Human
cauugcacagcccuguggugau

SEQ ID NO: 754021 - RNA, 22 nt, Human
acuguuggucagggauauugug

SEQ ID NO: 754022 - RNA, 22 nt, Human
uucgacucugugccugaagagc

SEQ ID NO: 754023 - RNA, 22 nt, Human
augaagcuaaacccugcagcca

SEQ ID NO: 754024 - RNA, 22 nt, Human
uuuuauacuuaagacagaguuu

SEQ ID NO: 754025 - RNA, 22 nt, Human
gagcuuccucagccuuucucac

SEQ ID NO: 754026 - RNA, 20 nt, Human
aagauucauuguaauuaggg

SEQ ID NO: 754027 - RNA, 22 nt, Human
uuaaacugcagacucaguguuc

SEQ ID NO: 754028 - RNA, 21 nt, Human
caguuuaauaacaaagaagga

SEQ ID NO: 754029 - RNA, 22 nt, Human
agaaggccaagaagaagccuau

SEQ ID NO: 754030 - RNA, 22 nt, Human
ugauucuguaagucauauuguu

SEQ ID NO: 754031 - RNA, 22 nt, Human
ucacaggcuccagggccuggau

SEQ ID NO: 754032 - RNA, 22 nt, Human
gaggccagcgcgcagcacuuuu

SEQ ID NO: 754033 - RNA, 22 nt, Human
gggcaagcacagcgagcgugcg

SEQ ID NO: 754034 - RNA, 21 nt, Human
uuucccagcagagauagcugg

SEQ ID NO: 754035 - RNA, 22 nt, Human
guucuccaggggcuguucaucu

SEQ ID NO: 754036 - RNA, 22 nt, Human
agacucugcauuucuaauaagc

SEQ ID NO: 754037 - RNA, 22 nt, Human
ugcgagaguggaaaggaagccu

SEQ ID NO: 754038 - RNA, 22 nt, Human
cgagaguuagcuaggagucaca

SEQ ID NO: 754039 - RNA, 22 nt, Human
ucuggcccaaguuuucggugag

SEQ ID NO: 754040 - RNA, 22 nt, Human
uguucucacuggaugcuucaca

SEQ ID NO: 754041 - RNA, 22 nt, Human
cuggucugaaaaggaggcaugc

SEQ ID NO: 754042 - RNA, 22 nt, Human
guuccuuguauuucagacauga

SEQ ID NO: 754043 - RNA, 22 nt, Human
aaguuauugcagcaauccaagu

SEQ ID NO: 754044 - RNA, 22 nt, Human
aagauaaguaacgagccucagu

SEQ ID NO: 754045 - RNA, 22 nt, Human
augcacaggugcugaugcacgc

SEQ ID NO: 754046 - RNA, 22 nt, Human
aguuucucuagagucuuugaaa

SEQ ID NO: 754047 - RNA, 22 nt, Human
agauggcaggcccugugggggu

SEQ ID NO: 754048 - RNA, 22 nt, Human
agccagcagggcuuagaggaca

SEQ ID NO: 754049 - RNA, 22 nt, Human
gcagggugacguugcccaccuc

SEQ ID NO: 754050 - RNA, 22 nt, Human
cugaaguuaguuaugccuaaaa

SEQ ID NO: 754051 - RNA, 22 nt, Human
uuuacacaaaauguuaguagau

SEQ ID NO: 754052 - RNA, 22 nt, Human
augucugcaaauaucugccagu

SEQ ID NO: 754053 - RNA, 22 nt, Human
gcagaugcuguggugauagaag

SEQ ID NO: 754054 - RNA, 22 nt, Human
gcugggaguuugauuugacugg

SEQ ID NO: 754055 - RNA, 22 nt, Human
augggcaugauauuaguaccua

SEQ ID NO: 754056 - RNA, 22 nt, Human
uucucuggacagugaagagagg

SEQ ID NO: 754057 - RNA, 22 nt, Human
ggauggccuucuugcucaggaa

SEQ ID NO: 754058 - RNA, 22 nt, Human
uucaggaagccuuucuuggucu

SEQ ID NO: 754059 - RNA, 22 nt, Human
cuggagugaagucuggcagcuu

SEQ ID NO: 754060 - RNA, 22 nt, Human
uacaguagcuacucaauaacua

SEQ ID NO: 754061 - RNA, 22 nt, Human
agugucugugaugaggucagga

SEQ ID NO: 754062 - RNA, 22 nt, Human
auccaaauauauuuuauucacu

SEQ ID NO: 754063 - RNA, 22 nt, Human
ccuugacugccuucaggcuggg

SEQ ID NO: 754064 - RNA, 22 nt, Human
aacauguaucgcuuuuuaauau

SEQ ID NO: 754065 - RNA, 22 nt, Human
ucagaacaugaagguuaauuug

SEQ ID NO: 754066 - RNA, 20 nt, Human
cccagggguuguggugagga

SEQ ID NO: 754067 - RNA, 21 nt, Human
ugguuaguuauuggcagugcc

SEQ ID NO: 754068 - RNA, 22 nt, Human
cagcaucucugggagaagcauc

SEQ ID NO: 754069 - RNA, 22 nt, Human
aaugcaaauuaucaggcuucuc

SEQ ID NO: 754070 - RNA, 22 nt, Human
agccaagcaccacuggcacucg

SEQ ID NO: 754071 - RNA, 22 nt, Human
cauuccaaguauauacaugaua

SEQ ID NO: 754072 - RNA, 22 nt, Human
agggccaguaaauguuuccuca

SEQ ID NO: 754073 - RNA, 22 nt, Human
uuuaaggauguaaaggaagaag

SEQ ID NO: 754074 - RNA, 22 nt, Human
ucaaaccugcugucuuguucau

SEQ ID NO: 754075 - RNA, 22 nt, Human
uaaagccacuucauucuagucu

SEQ ID NO: 754076 - RNA, 22 nt, Human
uuugcaaaccggagcucugcaa

SEQ ID NO: 754077 - RNA, 22 nt, Human
cucaggauucucgacacucaca

SEQ ID NO: 754078 - RNA, 22 nt, Human
ucugaggccccagcccugcaca

SEQ ID NO: 754079 - RNA, 22 nt, Human
gccuggggggcaugucauaaua

SEQ ID NO: 754080 - RNA, 22 nt, Human
ggcugaaauucagaguaaauuc

SEQ ID NO: 754081 - RNA, 22 nt, Human
cuggagaaacaucaggcauagg

SEQ ID NO: 754082 - RNA, 22 nt, Human
aggcacagguggacuucacagu

SEQ ID NO: 754083 - RNA, 22 nt, Human
gcucuggaagcaucugagagga

SEQ ID NO: 754084 - RNA, 18 nt, Human
uguagcuggaggccaggc

SEQ ID NO: 754085 - RNA, 19 nt, Human
gguguuucuucauuuucca

SEQ ID NO: 754086 - RNA, 22 nt, Human
ggagcugggacccugucaucug

SEQ ID NO: 754087 - RNA, 22 nt, Human
cagcuuugcaggcuggucagug

SEQ ID NO: 754088 - RNA, 22 nt, Human
uucugugacuccucagagauuu

SEQ ID NO: 754089 - RNA, 20 nt, Human
cccacacccuucccacuugg

SEQ ID NO: 754090 - RNA, 22 nt, Human
cagcagguggacacacucaccu

SEQ ID NO: 754091 - RNA, 22 nt, Human
uuuaaacuaacaguacacguug

SEQ ID NO: 754092 - RNA, 22 nt, Human
augcagaagcagaacuuacaca

SEQ ID NO: 754093 - RNA, 23 nt, Human
uuggcaaagccuaugaaguccuc

SEQ ID NO: 754094 - RNA, 22 nt, Human
uggcccaggugcacccagaggc

SEQ ID NO: 754095 - RNA, 22 nt, Human
ucagauuuagggugauuaccuu

SEQ ID NO: 754096 - RNA, 22 nt, Human
uuuucuccagggaacaagguga

SEQ ID NO: 754097 - RNA, 22 nt, Human
ccagcccuguaaggaugaggca

SEQ ID NO: 754098 - RNA, 22 nt, Human
gcuucccacagcuggacugggg

SEQ ID NO: 754099 - RNA, 22 nt, Human
uaauuuugcugugaccauugaa

SEQ ID NO: 754100 - RNA, 22 nt, Human
uggccugcagaggcuguggggc

SEQ ID NO: 754101 - RNA, 22 nt, Human
auucuauagacagaaggucaau

SEQ ID NO: 754102 - RNA, 22 nt, Human
cucuagcuuuugauaccagugu

SEQ ID NO: 754103 - RNA, 20 nt, Human
guguggccaggagcugcgcu

SEQ ID NO: 754104 - RNA, 22 nt, Human
aaacucuaguaaaauguauuca

SEQ ID NO: 754105 - RNA, 22 nt, Human
cugaagcucuccaguuuguuuc

SEQ ID NO: 754106 - RNA, 22 nt, Human
cacaaugugguuugucaucuuu

SEQ ID NO: 754107 - RNA, 22 nt, Human
aaucagcaguuggaauuagaua

SEQ ID NO: 754108 - RNA, 22 nt, Human
uagggcagccacccaggcugcu

SEQ ID NO: 754109 - RNA, 18 nt, Human
uguggcaggggugggaga

SEQ ID NO: 754110 - RNA, 22 nt, Human
ccagugcuaagguagccucugc

SEQ ID NO: 754111 - RNA, 22 nt, Human
ggccacagcaaugcugugaugu

SEQ ID NO: 754112 - RNA, 22 nt, Human
ucugggagagcacguggcugac

SEQ ID NO: 754113 - RNA, 22 nt, Human
ccucagugaguguuuccuucuu

SEQ ID NO: 754114 - RNA, 22 nt, Human
ucucugugacagcuggguaugu

SEQ ID NO: 754115 - RNA, 22 nt, Human
guguggcccugcguccugaguc

SEQ ID NO: 754116 - RNA, 22 nt, Human
acucaucugaaaaaugaggaga

SEQ ID NO: 754117 - RNA, 22 nt, Human
ucugagguuauugucugccauu

SEQ ID NO: 754118 - RNA, 22 nt, Human
guugcaggaagcacacacaugu

SEQ ID NO: 754119 - RNA, 22 nt, Human
gcuucugccuugcacuuuguca

SEQ ID NO: 754120 - RNA, 22 nt, Human
uuauauaaagauaacuuuucuu

SEQ ID NO: 754121 - RNA, 22 nt, Human
gcucagggagagagggcagccg

SEQ ID NO: 754122 - RNA, 22 nt, Human
aguuuauguagaauuggcaaua

SEQ ID NO: 754123 - RNA, 22 nt, Human
aggccaggguagggcccauugu

SEQ ID NO: 754124 - RNA, 22 nt, Human
cgcaggcugcagccaagaagag

SEQ ID NO: 754125 - RNA, 22 nt, Human
gccuucaggaggguuccagaca

SEQ ID NO: 754126 - RNA, 22 nt, Human
uaugcaugugguauaugcuuau

SEQ ID NO: 754127 - RNA, 23 nt, Human
aguguucagcauguaguaaauac

SEQ ID NO: 754128 - RNA, 22 nt, Human
cagggcuggauuucauuucuag

SEQ ID NO: 754129 - RNA, 22 nt, Human
gccaugaggcuccgagaaguca

SEQ ID NO: 754130 - RNA, 22 nt, Human
gggacugggagauccuccuggc

SEQ ID NO: 754131 - RNA, 22 nt, Human
uggcaccaucaaggcugagaac

SEQ ID NO: 754132 - RNA, 16 nt, Human
cuucacagaggagagu

SEQ ID NO: 754133 - RNA, 22 nt, Human
caggccgggcacugcgcuaggu

SEQ ID NO: 754134 - RNA, 22 nt, Human
aggccuuggaagccagggagcc

SEQ ID NO: 754135 - RNA, 22 nt, Human
agugucugaacugggugcugac

SEQ ID NO: 754136 - RNA, 22 nt, Human
gagucagaagaaacuauuuaca

SEQ ID NO: 754137 - RNA, 22 nt, Human
uguggcagaggaggcagcgucc

SEQ ID NO: 754138 - RNA, 22 nt, Human
gauaaaagaggaaauuuguuca

SEQ ID NO: 754139 - RNA, 22 nt, Human
uauguucuagacuuuugcugug

SEQ ID NO: 754140 - RNA, 22 nt, Human
gagaggugaaggcugcccuggg

SEQ ID NO: 754141 - RNA, 22 nt, Human
ccugagguuuuuggauaguugu

SEQ ID NO: 754142 - RNA, 22 nt, Human
aaguuucuuuauuagcuugucc

SEQ ID NO: 754143 - RNA, 22 nt, Human
cuggcuuucauucauucaggcc

SEQ ID NO: 754144 - RNA, 22 nt, Human
aaagcauagaauuagaguuagg

SEQ ID NO: 754145 - RNA, 22 nt, Human
uaacucuuuacuauacauuuau

SEQ ID NO: 754146 - RNA, 22 nt, Human
uguacaaauucauugaacugua

SEQ ID NO: 754147 - RNA, 22 nt, Human
gguuugaacagcuuuggagaag

SEQ ID NO: 754148 - RNA, 22 nt, Human
aguaugaaucucuuuauucugc

SEQ ID NO: 754149 - RNA, 22 nt, Human
guccagccacccuggaggcacg

SEQ ID NO: 754150 - RNA, 22 nt, Human
acccaggagacggaggugcagu

SEQ ID NO: 754151 - RNA, 22 nt, Human
ggcagucacaggggagacuggg

SEQ ID NO: 754152 - RNA, 22 nt, Human
ggagugcuuugaagccuucauu

SEQ ID NO: 754153 - RNA, 22 nt, Human
auuccuugggaauuauugaaug

SEQ ID NO: 754154 - RNA, 22 nt, Human
uugugagcauuuuggugagcuu

SEQ ID NO: 754155 - RNA, 22 nt, Human
augaaucaaaguucauuugauc

SEQ ID NO: 754156 - RNA, 22 nt, Human
augcaggagagcauguuuaaga

SEQ ID NO: 754157 - RNA, 22 nt, Human
uuaguguuuaaagguuucagag

SEQ ID NO: 754158 - RNA, 22 nt, Human
ccagaggggcacaaaaguagaa

SEQ ID NO: 754159 - RNA, 22 nt, Human
cauucacauucuucuuacuguu

SEQ ID NO: 754160 - RNA, 22 nt, Human
aggccuagaggaauggccaggg

SEQ ID NO: 754161 - RNA, 22 nt, Human
auuguacuacaccauaguacug

SEQ ID NO: 754162 - RNA, 22 nt, Human
cuggcucuuucagccgcuggag

SEQ ID NO: 754163 - RNA, 22 nt, Human
uggcuucucccuacaacaugcc

SEQ ID NO: 754164 - RNA, 22 nt, Human
cucucuccuuagcugcagacca

SEQ ID NO: 754165 - RNA, 19 nt, Human
acaguuugggaaaugagca

SEQ ID NO: 754166 - RNA, 22 nt, Human
aacagcauaaguauuuauuuca

SEQ ID NO: 754167 - RNA, 22 nt, Human
ucggagcuguagaugaaacccu

SEQ ID NO: 754168 - RNA, 22 nt, Human
uacaagaaggaaaacuagcaau

SEQ ID NO: 754169 - RNA, 22 nt, Human
gaaaucuacgauuagugaaaau

SEQ ID NO: 754170 - RNA, 22 nt, Human
ugcugcagggauuucagagaca

SEQ ID NO: 754171 - RNA, 22 nt, Human
aagauauaauaacuguugucau

SEQ ID NO: 754172 - RNA, 22 nt, Human
caugacagaugcaaaggauugg

SEQ ID NO: 754173 - RNA, 22 nt, Human
uccagaccauggauggcugcaa

SEQ ID NO: 754174 - RNA, 22 nt, Human
cggccaggcacaguggcccacg

SEQ ID NO: 754175 - RNA, 22 nt, Human
gugucauggaaaauugcaaugg

SEQ ID NO: 754176 - RNA, 22 nt, Human
uguacaugacagagagagccaa

SEQ ID NO: 754177 - RNA, 22 nt, Human
cuggagauuaaguucucagcca

SEQ ID NO: 754178 - RNA, 22 nt, Human
guggcaggagagacacagccau

SEQ ID NO: 754179 - RNA, 19 nt, Human
uagaaagccagaaaacaga

SEQ ID NO: 754180 - RNA, 22 nt, Human
acauuuaaguuaaaaccucagu

SEQ ID NO: 754181 - RNA, 22 nt, Human
uagcagcaagaaugggaugugu

SEQ ID NO: 754182 - RNA, 22 nt, Human
agcuggucugcugcauggagug

SEQ ID NO: 754183 - RNA, 22 nt, Human
ugagaagcugcuugugcuguau

SEQ ID NO: 754184 - RNA, 22 nt, Human
gggcuccuccucugacuguggc

SEQ ID NO: 754185 - RNA, 22 nt, Human
caaggcaugaaaggagugagug

SEQ ID NO: 754186 - RNA, 22 nt, Human
cucuuugccuaacuguuuucaa

SEQ ID NO: 754187 - RNA, 22 nt, Human
uucucagaaaauguagagaaaa

SEQ ID NO: 754188 - RNA, 22 nt, Human
acugggcaugaugagucaccua

SEQ ID NO: 754189 - RNA, 22 nt, Human
guguagcuuuggagugggaggc

SEQ ID NO: 754190 - RNA, 22 nt, Human
gaaguuacauacugucacuucu

SEQ ID NO: 754191 - RNA, 22 nt, Human
ggggagaauaaaucagauuuua

SEQ ID NO: 754192 - RNA, 22 nt, Human
gcugcccaggcaacauugacuu

SEQ ID NO: 754193 - RNA, 22 nt, Human
aagggagcuuaggagaucaggc

SEQ ID NO: 754194 - RNA, 22 nt, Human
aucuggcucccuuggaauccgu

SEQ ID NO: 754195 - RNA, 22 nt, Human
agcaggcaggcugccagugaau

SEQ ID NO: 754196 - RNA, 22 nt, Human
auuuauugguuugcauggugaa

SEQ ID NO: 754197 - RNA, 22 nt, Human
uagaggaaccaggcaggcugag

SEQ ID NO: 754198 - RNA, 22 nt, Human
ggagagcaggguccugagauac

SEQ ID NO: 754199 - RNA, 22 nt, Human
uuagagaaauucugguaaugua

SEQ ID NO: 754200 - RNA, 22 nt, Human
cagguacacucccuugugcuga

SEQ ID NO: 754201 - RNA, 22 nt, Human
uucuacacagugcggguuaaca

SEQ ID NO: 754202 - RNA, 22 nt, Human
acuugaauuauauuucuagaga

SEQ ID NO: 754203 - RNA, 17 nt, Human
gcagccucuugguagug

SEQ ID NO: 754204 - RNA, 22 nt, Human
ccagaggugguggugucuagaa

SEQ ID NO: 754205 - RNA, 22 nt, Human
cagguucccagguccagggcuu

SEQ ID NO: 754206 - RNA, 22 nt, Human
ugaagcaaacgcuucuguuccu

SEQ ID NO: 754207 - RNA, 22 nt, Human
gugcuguaacaacagagugucu

SEQ ID NO: 754208 - RNA, 22 nt, Human
acagagagaaacaaucagcagc

SEQ ID NO: 754209 - RNA, 22 nt, Human
gcaccagccugagccucuugca

SEQ ID NO: 754210 - RNA, 20 nt, Human
acauaugugugcauaucuuu

SEQ ID NO: 754211 - RNA, 22 nt, Human
ucugaggcccuacccugagccu

SEQ ID NO: 754212 - RNA, 22 nt, Human
ggguccugcgugggcccaggac

SEQ ID NO: 754213 - RNA, 22 nt, Human
uuccaaguagaagcauuugcau

SEQ ID NO: 754214 - RNA, 22 nt, Human
uuuucugcggugugaauggccu

SEQ ID NO: 754215 - RNA, 22 nt, Human
auugaccugauuguuccuggaa

SEQ ID NO: 754216 - RNA, 22 nt, Human
ucuccugauaucugcagaccua

SEQ ID NO: 754217 - RNA, 22 nt, Human
agggagccagaguugggagcuc

SEQ ID NO: 754218 - RNA, 22 nt, Human
uauauguagucagucagaguaa

SEQ ID NO: 754219 - RNA, 22 nt, Human
ugggaguagaugaggagugggc

SEQ ID NO: 754220 - RNA, 20 nt, Human
aggcaagguagaugucugcu

SEQ ID NO: 754221 - RNA, 22 nt, Human
ggagcccugaagcaagaaagua

SEQ ID NO: 754222 - RNA, 22 nt, Human
uucagugcuuacagguuucuuu

SEQ ID NO: 754223 - RNA, 22 nt, Human
aggcuguggugcugaaggaggg

SEQ ID NO: 754224 - RNA, 22 nt, Human
uccagaguuugagucuccuucc

SEQ ID NO: 754225 - RNA, 22 nt, Human
gccagagcugagacacgagucc

SEQ ID NO: 754226 - RNA, 22 nt, Human
cagagggguguagagaucacug

SEQ ID NO: 754227 - RNA, 22 nt, Human
gcugcuguugauuuaguccaau

SEQ ID NO: 754228 - RNA, 22 nt, Human
ccacuggcauccagcugccauc

SEQ ID NO: 754229 - RNA, 22 nt, Human
auuugaggauaguuggguacuc

SEQ ID NO: 754230 - RNA, 22 nt, Human
ccuagcaauaaagauaucauuu

SEQ ID NO: 754231 - RNA, 17 nt, Human
ucuuuccugccaugcuc

SEQ ID NO: 754232 - RNA, 22 nt, Human
uggcuccugcauuugugcuaac

SEQ ID NO: 754233 - RNA, 22 nt, Human
ugggaaauuguauuucuauuuc

SEQ ID NO: 754234 - RNA, 22 nt, Human
gccccaccugcuaccuuccagc

SEQ ID NO: 754235 - RNA, 22 nt, Human
caguaaguauucgagucuccau

SEQ ID NO: 754236 - RNA, 22 nt, Human
gccagguggagguugcagugag

SEQ ID NO: 754237 - RNA, 22 nt, Human
gccaggaauuucaagagccacu

SEQ ID NO: 754238 - RNA, 22 nt, Human
caccagggcagcagccuagucu

SEQ ID NO: 754239 - RNA, 22 nt, Human
agcucucccauagggcaagauc

SEQ ID NO: 754240 - RNA, 22 nt, Human
ugcccuggcuggagugcagugg

SEQ ID NO: 754241 - RNA, 22 nt, Human
cagaggucccuguucuuaagga

SEQ ID NO: 754242 - RNA, 22 nt, Human
uaauaauuuuaaagaaggcuag

SEQ ID NO: 754243 - RNA, 22 nt, Human
uacauucagaagaauggacacg

SEQ ID NO: 754244 - RNA, 22 nt, Human
gcccaggauggcuggaggugcu

SEQ ID NO: 754245 - RNA, 22 nt, Human
uagggcugcugcagaugacagg

SEQ ID NO: 754246 - RNA, 22 nt, Human
aaagguuuucaucacagcaaga

SEQ ID NO: 754247 - RNA, 22 nt, Human
uaucaucuuguugucaugcagc

SEQ ID NO: 754248 - RNA, 22 nt, Human
caacaccuugaucuuggacuuc

SEQ ID NO: 754249 - RNA, 22 nt, Human
uuauugaagcaagcuuuucuga

SEQ ID NO: 754250 - RNA, 22 nt, Human
ucaggaagcuacugccagcagc

SEQ ID NO: 754251 - RNA, 22 nt, Human
cugcuugggguuaggguguccu

SEQ ID NO: 754252 - RNA, 22 nt, Human
agaacagcaggaaggccaggua

SEQ ID NO: 754253 - RNA, 22 nt, Human
uucuauguagauaaggcugcuc

SEQ ID NO: 754254 - RNA, 22 nt, Human
aaaaccacaauuauuuuugcac

SEQ ID NO: 754255 - RNA, 22 nt, Human
aaacacaucauucaugucguca

SEQ ID NO: 754256 - RNA, 22 nt, Human
aaguucuugcugugugucagau

SEQ ID NO: 754257 - RNA, 20 nt, Human
cuguggaauuuuaccaugcg

SEQ ID NO: 754258 - RNA, 22 nt, Human
augccuuauuccaacaaucuag

SEQ ID NO: 754259 - RNA, 22 nt, Human
gugcaaaaguaauugcaguuuu

SEQ ID NO: 754260 - RNA, 22 nt, Human
ggcagcuucucccaggcuguuu

SEQ ID NO: 754261 - RNA, 22 nt, Human
aaugcacauauauuuccuuauu

SEQ ID NO: 754262 - RNA, 22 nt, Human
uucccuucuaguuuugagagac

SEQ ID NO: 754263 - RNA, 22 nt, Human
gcagcaaggaugaagcacuugg

SEQ ID NO: 754264 - RNA, 22 nt, Human
uucuuugcccauguuuccuaag

SEQ ID NO: 754265 - RNA, 22 nt, Human
ucuuaaugcuagccaauagaga

SEQ ID NO: 754266 - RNA, 22 nt, Human
guucaaccccuugaugguacag

SEQ ID NO: 754267 - RNA, 22 nt, Human
cuagggaccucagcuccuggag

SEQ ID NO: 754268 - RNA, 22 nt, Human
aacacuguaucagucuucaaua

SEQ ID NO: 754269 - RNA, 22 nt, Human
aggagaaauccaucgagaaugg

SEQ ID NO: 754270 - RNA, 22 nt, Human
aauguaugaagguuccaguuuc

SEQ ID NO: 754271 - RNA, 22 nt, Human
ggaaggggugggugagccucag

SEQ ID NO: 754272 - RNA, 22 nt, Human
ucucuaaaucugguucacuugc

SEQ ID NO: 754273 - RNA, 22 nt, Human
acucugacuggagugagagagg

SEQ ID NO: 754274 - RNA, 22 nt, Human
cacagaggacuguagcggggag

SEQ ID NO: 754275 - RNA, 22 nt, Human
uucugcuuauucuguagccuuu

SEQ ID NO: 754276 - RNA, 22 nt, Human
gucuuuuugucuggcagagguc

SEQ ID NO: 754277 - RNA, 22 nt, Human
agccucuggcccuagacugcuu

SEQ ID NO: 754278 - RNA, 22 nt, Human
cuauggcucaauucuagugguu

SEQ ID NO: 754279 - RNA, 20 nt, Human
aucuuugucucuguaguugu

SEQ ID NO: 754280 - RNA, 23 nt, Human
uggcugagauccuacuguuugcu

SEQ ID NO: 754281 - RNA, 22 nt, Human
gugaggaucaaaugaaauagca

SEQ ID NO: 754282 - RNA, 22 nt, Human
uaucacuugcguuuuggcagag

SEQ ID NO: 754283 - RNA, 22 nt, Human
uggagagguugaauaacuuguc

SEQ ID NO: 754284 - RNA, 22 nt, Human
cccuccaugagugugcugcugg

SEQ ID NO: 754285 - RNA, 22 nt, Human
uccagcuguuguuuuaucucag

SEQ ID NO: 754286 - RNA, 22 nt, Human
agccagaggaagccuggcccuc

SEQ ID NO: 754287 - RNA, 22 nt, Human
agaaacuucagcuauucuuuug

SEQ ID NO: 754288 - RNA, 22 nt, Human
guauuucuagaaugguagcacu

SEQ ID NO: 754289 - RNA, 22 nt, Human
gggcagguguugucaaucuaau

SEQ ID NO: 754290 - RNA, 22 nt, Human
gugugugccaucaagagcuuuc

SEQ ID NO: 754291 - RNA, 22 nt, Human
aagaggcuagccggcucacuaa

SEQ ID NO: 754292 - RNA, 22 nt, Human
cagagccuuccuagcagacucu

SEQ ID NO: 754293 - RNA, 22 nt, Human
acagcuggcaggggggcaugaa

SEQ ID NO: 754294 - RNA, 22 nt, Human
ucugagcugccccuuuacuuug

SEQ ID NO: 754295 - RNA, 22 nt, Human
uugaacaaucaaaagaauucau

SEQ ID NO: 754296 - RNA, 22 nt, Human
ugugaggaggcggccagaagag

SEQ ID NO: 754297 - RNA, 22 nt, Human
uccuggggccagcacuggugga

SEQ ID NO: 754298 - RNA, 22 nt, Human
uuacaaugggagcccuuggacu

SEQ ID NO: 754299 - RNA, 22 nt, Human
cugccugcuucugagccagagg

SEQ ID NO: 754300 - RNA, 22 nt, Human
auaaucuuguauuuccuaaagu

SEQ ID NO: 754301 - RNA, 22 nt, Human
auguuuacaauucaguauuaca

SEQ ID NO: 754302 - RNA, 22 nt, Human
aucuuaaucgaguccaugaaaa

SEQ ID NO: 754303 - RNA, 22 nt, Human
uauagcaagcucuuuguaacca

SEQ ID NO: 754304 - RNA, 22 nt, Human
uggcaauuguccacugucugcc

SEQ ID NO: 754305 - RNA, 22 nt, Human
guuuccuauguccauugaggga

SEQ ID NO: 754306 - RNA, 21 nt, Human
cccaggaggcugagaagagca

SEQ ID NO: 754307 - RNA, 22 nt, Human
ugacagacuuuacuucuccuau

SEQ ID NO: 754308 - RNA, 22 nt, Human
cccgacuagcugggauuacagg

SEQ ID NO: 754309 - RNA, 18 nt, Human
cccacuguccccacaggc

SEQ ID NO: 754310 - RNA, 22 nt, Human
acaguuaauaaguaguaaguca

SEQ ID NO: 754311 - RNA, 22 nt, Human
cuccaggacucaggccccuggg

SEQ ID NO: 754312 - RNA, 22 nt, Human
agucugggauguauaaacugaa

SEQ ID NO: 754313 - RNA, 22 nt, Human
ugaggagcgggcagggaugcag

SEQ ID NO: 754314 - RNA, 22 nt, Human
ucccugggccuccugcuaugca

SEQ ID NO: 754315 - RNA, 23 nt, Human
ucagggacaugaugugucauauc

SEQ ID NO: 754316 - RNA, 22 nt, Human
ugcauggaggaagaugaaugca

SEQ ID NO: 754317 - RNA, 22 nt, Human
uuguucuuuugcuuagacagau

SEQ ID NO: 754318 - RNA, 22 nt, Human
cagcacuaugacauuuaauucu

SEQ ID NO: 754319 - RNA, 20 nt, Human
cugugggccucacuuggggu

SEQ ID NO: 754320 - RNA, 22 nt, Human
ccucuggggguccucagagucu

SEQ ID NO: 754321 - RNA, 22 nt, Human
aauuaucagauauaaaacugca

SEQ ID NO: 754322 - RNA, 22 nt, Human
uaagauguaagaucagagcuug

SEQ ID NO: 754323 - RNA, 22 nt, Human
uuagauaauguuauuguaauuu

SEQ ID NO: 754324 - RNA, 22 nt, Human
uaucaacaaaggccuuguguuu

SEQ ID NO: 754325 - RNA, 23 nt, Human
auuagacacuuuggguugucuuc

SEQ ID NO: 754326 - RNA, 22 nt, Human
uuaucugaaaaccucaaaauau

SEQ ID NO: 754327 - RNA, 19 nt, Human
uucuuuccacaucuucucu

SEQ ID NO: 754328 - RNA, 22 nt, Human
aggagucaggaccaaauggaaa

SEQ ID NO: 754329 - RNA, 22 nt, Human
gcaugauaccauagguuuugcc

SEQ ID NO: 754330 - RNA, 20 nt, Human
ugcucaggauggagaggugu

SEQ ID NO: 754331 - RNA, 22 nt, Human
ugcauucaucauuugaaagccc

SEQ ID NO: 754332 - RNA, 20 nt, Human
uguagguguacaguaaggag

SEQ ID NO: 754333 - RNA, 21 nt, Human
auuuccaaggguaccuaagau

SEQ ID NO: 754334 - RNA, 22 nt, Human
augcacacugaaugcuuacuuu

SEQ ID NO: 754335 - RNA, 22 nt, Human
uauacacaaggugugcauuugu

SEQ ID NO: 754336 - RNA, 22 nt, Human
ucagcugccuuucccaugcuag

SEQ ID NO: 754337 - RNA, 22 nt, Human
gaauauauuggugaaaauaguu

SEQ ID NO: 754338 - RNA, 22 nt, Human
auacagccuauucuuaccauug

SEQ ID NO: 754339 - RNA, 22 nt, Human
ucaguuuauaaauuguauuuag

SEQ ID NO: 754340 - RNA, 22 nt, Human
gcuggcacauggcucagggccu

SEQ ID NO: 754341 - RNA, 22 nt, Human
ucaggaugaagucagagggguc

SEQ ID NO: 754342 - RNA, 20 nt, Human
uggagucaugggacacucac

SEQ ID NO: 754343 - RNA, 22 nt, Human
agggccagaggcaccuugcagc

SEQ ID NO: 754344 - RNA, 21 nt, Human
aauaaccacuaauauaguggc

SEQ ID NO: 754345 - RNA, 22 nt, Human
cagugucugaaauaacaccgga

SEQ ID NO: 754346 - RNA, 22 nt, Human
cugagccuugaugucccuuguc

SEQ ID NO: 754347 - RNA, 22 nt, Human
gcagggcucagccgcucccacc

SEQ ID NO: 754348 - RNA, 22 nt, Human
uagaggcuacuagaggcaccug

SEQ ID NO: 754349 - RNA, 22 nt, Human
ugaacuccaaauacugcugauu

SEQ ID NO: 754350 - RNA, 22 nt, Human
uuuugcuugagugcacaaaaug

SEQ ID NO: 754351 - RNA, 18 nt, Human
gccucuguugcuugccug

SEQ ID NO: 754352 - RNA, 22 nt, Human
ucugggagguacugggaggugu

SEQ ID NO: 754353 - RNA, 22 nt, Human
ucauaacaggcugagaggauuu

SEQ ID NO: 754354 - RNA, 22 nt, Human
agauucauugcuuuaggcauug

SEQ ID NO: 754355 - RNA, 22 nt, Human
uuacacaugcuuuguguguaug

SEQ ID NO: 754356 - RNA, 22 nt, Human
acacaggaggaggauggugguc

SEQ ID NO: 754357 - RNA, 16 nt, Human
aagccaguucagcauu

SEQ ID NO: 754358 - RNA, 22 nt, Human
ucagagugugagacauauugga

SEQ ID NO: 754359 - RNA, 22 nt, Human
ucuuuagacauccaguuucucu

SEQ ID NO: 754360 - RNA, 22 nt, Human
agaagccaugguaugcaacuac

SEQ ID NO: 754361 - RNA, 22 nt, Human
uucagaggugggcugagaggau

SEQ ID NO: 754362 - RNA, 22 nt, Human
auaaaacuuauuagaauugugu

SEQ ID NO: 754363 - RNA, 22 nt, Human
cacuggccuaagcgccucagcc

SEQ ID NO: 754364 - RNA, 22 nt, Human
cagcugucugaagcaggagucc

SEQ ID NO: 754365 - RNA, 17 nt, Human
uccaagccagcuugccu

SEQ ID NO: 754366 - RNA, 22 nt, Human
agauauacagagaauuauucac

SEQ ID NO: 754367 - RNA, 22 nt, Human
gcccagagagaugcuguagacc

SEQ ID NO: 754368 - RNA, 22 nt, Human
acuaacuucugagaaccaauug

SEQ ID NO: 754369 - RNA, 22 nt, Human
uuuccucuuuguaccuugacua

SEQ ID NO: 754370 - RNA, 22 nt, Human
aguccaagauuagggugacagc

SEQ ID NO: 754371 - RNA, 22 nt, Human
accuuuauagcugauuaugaca

SEQ ID NO: 754372 - RNA, 22 nt, Human
aggcugggcuccgcccaacucc

SEQ ID NO: 754373 - RNA, 22 nt, Human
uuccugugugacucaagugguu

SEQ ID NO: 754374 - RNA, 22 nt, Human
ugugcccauuacacagaggcau

SEQ ID NO: 754375 - RNA, 22 nt, Human
aagggugcauugcgcggggcug

SEQ ID NO: 754376 - RNA, 22 nt, Human
cugccuugaaaaugaagcuuua

SEQ ID NO: 754377 - RNA, 17 nt, Human
ucuccuggcucuaucag

SEQ ID NO: 754378 - RNA, 22 nt, Human
gaagugcaaccugaaauacuag

SEQ ID NO: 754379 - RNA, 22 nt, Human
cagcaccccuccuggcuaugaa

SEQ ID NO: 754380 - RNA, 22 nt, Human
ggcaggcuuucagcaucaaguc

SEQ ID NO: 754381 - RNA, 22 nt, Human
uagggcuguuaguaauucucag

SEQ ID NO: 754382 - RNA, 22 nt, Human
cagcaaggcauucuguggauua

SEQ ID NO: 754383 - RNA, 21 nt, Human
ugugucacuaacuagaggcua

SEQ ID NO: 754384 - RNA, 23 nt, Human
uguagcugucugagcagacacug

SEQ ID NO: 754385 - RNA, 20 nt, Human
acaucugagaaacacuuaaa

SEQ ID NO: 754386 - RNA, 22 nt, Human
ugaaugcuuuggagccuucuaa

SEQ ID NO: 754387 - RNA, 22 nt, Human
uggggccugagguggagcugca

SEQ ID NO: 754388 - RNA, 23 nt, Human
auuagaaaggcuuucuggugaaa

SEQ ID NO: 754389 - RNA, 22 nt, Human
gucuccuccauggagaugguau

SEQ ID NO: 754390 - RNA, 22 nt, Human
ugagcuaaguacucucaucaag

SEQ ID NO: 754391 - RNA, 22 nt, Human
gagaagcaaucgugacaucucc

SEQ ID NO: 754392 - RNA, 22 nt, Human
aggaagcucggagagggcaaau

SEQ ID NO: 754393 - RNA, 22 nt, Human
accauucuuuacaucagcacag

SEQ ID NO: 754394 - RNA, 22 nt, Human
gaacaaugagucauucagguga

SEQ ID NO: 754395 - RNA, 22 nt, Human
ugcaggagcaccagcucacccu

SEQ ID NO: 754396 - RNA, 22 nt, Human
ugagaaagguauuucaugcacu

SEQ ID NO: 754397 - RNA, 21 nt, Human
aggccucuucauggccaugau

SEQ ID NO: 754398 - RNA, 22 nt, Human
ucugaguuacacaagcaagggu

SEQ ID NO: 754399 - RNA, 22 nt, Human
aggcugccuggcugugagugaa

SEQ ID NO: 754400 - RNA, 22 nt, Human
gagagcuggauucuggauaggu

SEQ ID NO: 754401 - RNA, 22 nt, Human
guuagggagggugcauaugugu

SEQ ID NO: 754402 - RNA, 20 nt, Human
ccugugugguuugcacuaca

SEQ ID NO: 754403 - RNA, 22 nt, Human
ggcugcucugccuuccagcugg

SEQ ID NO: 754404 - RNA, 22 nt, Human
cucugaggucuaggaccauggc

SEQ ID NO: 754405 - RNA, 22 nt, Human
ucccaaagaacugaauaguaau

SEQ ID NO: 754406 - RNA, 17 nt, Human
gcccucagcuuuaacca

SEQ ID NO: 754407 - RNA, 22 nt, Human
ugguuucaugagaugagaauuu

SEQ ID NO: 754408 - RNA, 22 nt, Human
guaguauuuucugugauguagg

SEQ ID NO: 754409 - RNA, 21 nt, Human
uguaaguuucaucugaauugg

SEQ ID NO: 754410 - RNA, 22 nt, Human
aaagaugaccguaugucagagc

SEQ ID NO: 754411 - RNA, 22 nt, Human
cucccaggguagggagagacua

SEQ ID NO: 754412 - RNA, 20 nt, Human
ccaccuggccaaggcugugc

SEQ ID NO: 754413 - RNA, 21 nt, Human
cagugguuuauaaacaacaga

SEQ ID NO: 754414 - RNA, 22 nt, Human
ugacagggggcagagguggcug

SEQ ID NO: 754415 - RNA, 19 nt, Human
ggccugcccaaugucugcu

SEQ ID NO: 754416 - RNA, 22 nt, Human
uucugaggccauuaccaauaaa

SEQ ID NO: 754417 - RNA, 22 nt, Human
ucauuucagaugcauuuagaau

SEQ ID NO: 754418 - RNA, 22 nt, Human
ugcaggguguccggaggaucac

SEQ ID NO: 754419 - RNA, 22 nt, Human
augucauuuaaauguuuguaua

SEQ ID NO: 754420 - RNA, 22 nt, Human
ucugaaauguucucuuguuuug

SEQ ID NO: 754421 - RNA, 22 nt, Human
acagagagcugugauugaguua

SEQ ID NO: 754422 - RNA, 22 nt, Human
agcucucccaccuucuucuuac

SEQ ID NO: 754423 - RNA, 22 nt, Human
acugcagcaaagcccgugucuu

SEQ ID NO: 754424 - RNA, 22 nt, Human
gccaguggagcacauggugaag

SEQ ID NO: 754425 - RNA, 22 nt, Human
aucuuauguuguauucaaaauc

SEQ ID NO: 754426 - RNA, 23 nt, Human
uucugucuugcugucagcuuucu

SEQ ID NO: 754427 - RNA, 21 nt, Human
uauaggcuuccauaugaaggg

SEQ ID NO: 754428 - RNA, 22 nt, Human
cgccaggcuugguagcucaugc

SEQ ID NO: 754429 - RNA, 22 nt, Human
cuccugggucauugccagcaaa

SEQ ID NO: 754430 - RNA, 22 nt, Human
ccugggccugaaaacauuucuc

SEQ ID NO: 754431 - RNA, 22 nt, Human
aagaauguucaacgcuuuuuug

SEQ ID NO: 754432 - RNA, 22 nt, Human
uccaggcugauccaugaagaau

SEQ ID NO: 754433 - RNA, 22 nt, Human
ugcauccuuaaccagcaucacu

SEQ ID NO: 754434 - RNA, 22 nt, Human
cugcucuaauaucagauagacu

SEQ ID NO: 754435 - RNA, 22 nt, Human
ccccacuuugaguagcacuuga

SEQ ID NO: 754436 - RNA, 18 nt, Human
gaucgggggcgccccaag

SEQ ID NO: 754437 - RNA, 22 nt, Human
ugugccugagucucggcccacc

SEQ ID NO: 754438 - RNA, 22 nt, Human
acauagcacgucucaauuugga

SEQ ID NO: 754439 - RNA, 20 nt, Human
agaaguuuggggguguggag

SEQ ID NO: 754440 - RNA, 22 nt, Human
ggccugugcugagaaccuggcu

SEQ ID NO: 754441 - RNA, 22 nt, Human
gcagugugucucuuggcuuccu

SEQ ID NO: 754442 - RNA, 22 nt, Human
uacugccaaauugcagcaaugu

SEQ ID NO: 754443 - RNA, 22 nt, Human
agacacagcagugccugccuca

SEQ ID NO: 754444 - RNA, 22 nt, Human
uguggaagaacuucuugcuugg

SEQ ID NO: 754445 - RNA, 22 nt, Human
aggggcuccuggccuggagagc

SEQ ID NO: 754446 - RNA, 22 nt, Human
caauuauauuuagaaugauaca

SEQ ID NO: 754447 - RNA, 19 nt, Human
ugccccugcagucuaccca

SEQ ID NO: 754448 - RNA, 22 nt, Human
ucuguacauuuguguugugaau

SEQ ID NO: 754449 - RNA, 22 nt, Human
acauucauuccaggucagucag

SEQ ID NO: 754450 - RNA, 22 nt, Human
ggcuuugcuuaacgugcuucua

SEQ ID NO: 754451 - RNA, 22 nt, Human
uggcucagcugucacagccugg

SEQ ID NO: 754452 - RNA, 22 nt, Human
uggcccugcagaacuagccugg

SEQ ID NO: 754453 - RNA, 22 nt, Human
ucauuucucugagucugauaau

SEQ ID NO: 754454 - RNA, 18 nt, Human
guucccagauggugcuga

SEQ ID NO: 754455 - RNA, 22 nt, Human
auuugcuuaucuccacaguugu

SEQ ID NO: 754456 - RNA, 22 nt, Human
gggagggaaagcuugaucuguc

SEQ ID NO: 754457 - RNA, 20 nt, Human
cuuggccuacuuagcuuugu

SEQ ID NO: 754458 - RNA, 22 nt, Human
cuugaaauccagauuucagagg

SEQ ID NO: 754459 - RNA, 22 nt, Human
gcacugcaucuacuggcaagua

SEQ ID NO: 754460 - RNA, 19 nt, Human
gcuggggccugaccagaca

SEQ ID NO: 754461 - RNA, 22 nt, Human
uggcugggggugcuauagcugc

SEQ ID NO: 754462 - RNA, 22 nt, Human
ugucaucuguguuuugcuggag

SEQ ID NO: 754463 - RNA, 22 nt, Human
ugacucucccaaguuugaggga

SEQ ID NO: 754464 - RNA, 22 nt, Human
ugcucuggaauaguccuaggca

SEQ ID NO: 754465 - RNA, 23 nt, Human
gugagucuugccuuugcugugga

SEQ ID NO: 754466 - RNA, 22 nt, Human
ugcuuccaggaauccaucuggc

SEQ ID NO: 754467 - RNA, 22 nt, Human
uccuccagugucuggggccuug

SEQ ID NO: 754468 - RNA, 22 nt, Human
auuucucaguuccuacuguuua

SEQ ID NO: 754469 - RNA, 22 nt, Human
ucacaugagguuaugacaaagc

SEQ ID NO: 754470 - RNA, 22 nt, Human
gggcaagaagcuggaagcauuc

SEQ ID NO: 754471 - RNA, 22 nt, Human
ucugaaauccuuuaucuuggcu

SEQ ID NO: 754472 - RNA, 18 nt, Human
ggcucagcaggcucucuc

SEQ ID NO: 754473 - RNA, 22 nt, Human
uaaggcagguagaugacuacgg

SEQ ID NO: 754474 - RNA, 22 nt, Human
gugagcagcucaggguggucuc

SEQ ID NO: 754475 - RNA, 22 nt, Human
uucaacacaggaacaugauaua

SEQ ID NO: 754476 - RNA, 22 nt, Human
gcagcugggccccagccucucc

SEQ ID NO: 754477 - RNA, 22 nt, Human
cauggauagaugaaugcuuaaa

SEQ ID NO: 754478 - RNA, 22 nt, Human
ccagguggacggcgaguacagg

SEQ ID NO: 754479 - RNA, 22 nt, Human
aaauguuucuacuugugagcau

SEQ ID NO: 754480 - RNA, 22 nt, Human
auguguguaugugccuauaucu

SEQ ID NO: 754481 - RNA, 22 nt, Human
auuugacauugacacaccuaug

SEQ ID NO: 754482 - RNA, 19 nt, Human
ugaguguguguuucucuaa

SEQ ID NO: 754483 - RNA, 22 nt, Human
uacauucuauaucuguuacauc

SEQ ID NO: 754484 - RNA, 22 nt, Human
uaugucaugggucaaaaugaag

SEQ ID NO: 754485 - RNA, 22 nt, Human
uuuacgaaaagugacuaauagg

SEQ ID NO: 754486 - RNA, 22 nt, Human
aucuuuaauuuggaucagggcc

SEQ ID NO: 754487 - RNA, 22 nt, Human
acauguuuaaguuuguuauaug

SEQ ID NO: 754488 - RNA, 22 nt, Human
uguacaaugccagggaacacca

SEQ ID NO: 754489 - RNA, 20 nt, Human
cugaaccaaggcuuucucag

SEQ ID NO: 754490 - RNA, 22 nt, Human
guguggggccaggaucagggcu

SEQ ID NO: 754491 - RNA, 22 nt, Human
agcugcaguuagccccagauga

SEQ ID NO: 754492 - RNA, 22 nt, Human
gcagacacuuuuauucugcaua

SEQ ID NO: 754493 - RNA, 22 nt, Human
aucauguucaucguauuuaggc

SEQ ID NO: 754494 - RNA, 22 nt, Human
gagccaggcccguacuugcugu

SEQ ID NO: 754495 - RNA, 19 nt, Human
aaauaucagagagaugaua

SEQ ID NO: 754496 - RNA, 22 nt, Human
agggcugcugaggaagccuugc

SEQ ID NO: 754497 - RNA, 22 nt, Human
cacugucugagcuggugauuag

SEQ ID NO: 754498 - RNA, 22 nt, Human
agcccuagagaaccagccugug

SEQ ID NO: 754499 - RNA, 22 nt, Human
acuugcauuauauuuaucacaa

SEQ ID NO: 754500 - RNA, 22 nt, Human
aaauguuccggguaaggagaaa

SEQ ID NO: 754501 - RNA, 22 nt, Human
cauuuaguuuugcaguagcagg

SEQ ID NO: 754502 - RNA, 22 nt, Human
uccugaggaaugugaagagaac

SEQ ID NO: 754503 - RNA, 22 nt, Human
ucuaacuuguauguauaguuuu

SEQ ID NO: 754504 - RNA, 22 nt, Human
uuccuaacaagucuaucuuuga

SEQ ID NO: 754505 - RNA, 20 nt, Human
ugagugcuccauucugccca

SEQ ID NO: 754506 - RNA, 22 nt, Human
cugggaagaagggacaacagcg

SEQ ID NO: 754507 - RNA, 22 nt, Human
ccagguguagcacugcucacag

SEQ ID NO: 754508 - RNA, 22 nt, Human
uaguaaucagagguaaacuuua

SEQ ID NO: 754509 - RNA, 22 nt, Human
caggucagcacuuggaggugca

SEQ ID NO: 754510 - RNA, 22 nt, Human
cccugaggaugucuccuuccug

SEQ ID NO: 754511 - RNA, 22 nt, Human
gccacaugcaauugcagcacgu

SEQ ID NO: 754512 - RNA, 22 nt, Human
agggagccuuccuggcuguggu

SEQ ID NO: 754513 - RNA, 22 nt, Human
gcuucaugggugugcaaccugu

SEQ ID NO: 754514 - RNA, 22 nt, Human
cacaggaggaggccagagcgua

SEQ ID NO: 754515 - RNA, 22 nt, Human
acagaacaggcugagaaaaaca

SEQ ID NO: 754516 - RNA, 22 nt, Human
aagucccaucugccuccaugua

SEQ ID NO: 754517 - RNA, 23 nt, Human
aggcuggcuucaggagccucucc

SEQ ID NO: 754518 - RNA, 22 nt, Human
gcaugcauuacaugggauaugc

SEQ ID NO: 754519 - RNA, 19 nt, Human
ggcauccacgaaugcagag

SEQ ID NO: 754520 - RNA, 22 nt, Human
cggggagggcagaggcucccuc

SEQ ID NO: 754521 - RNA, 22 nt, Human
ccugcaggggagagacuucuag

SEQ ID NO: 754522 - RNA, 22 nt, Human
cuuggagaaugacaguggauua

SEQ ID NO: 754523 - RNA, 22 nt, Human
aaugcugucuuuucuacuucau

SEQ ID NO: 754524 - RNA, 22 nt, Human
ggucaguggcaggggguacuuc

SEQ ID NO: 754525 - RNA, 22 nt, Human
uugugcauuucucugagugugu

SEQ ID NO: 754526 - RNA, 22 nt, Human
uccuugggaaacaucauguaau

SEQ ID NO: 754527 - RNA, 22 nt, Human
aaaguugugguuugaugcaguu

SEQ ID NO: 754528 - RNA, 22 nt, Human
ggaggguccccagcagcaugaa

SEQ ID NO: 754529 - RNA, 22 nt, Human
uuugaaugauuaucuuucggca

SEQ ID NO: 754530 - RNA, 22 nt, Human
auuuggaaacaauuauauucuu

SEQ ID NO: 754531 - RNA, 22 nt, Human
uaggauuuggcuuuagucaggu

SEQ ID NO: 754532 - RNA, 22 nt, Human
uggcuccuucauucuccugcca

SEQ ID NO: 754533 - RNA, 22 nt, Human
cauucuaucuuggacuggaucu

SEQ ID NO: 754534 - RNA, 22 nt, Human
aggcuuguggauuggagcgagu

SEQ ID NO: 754535 - RNA, 23 nt, Human
ucucucuggcaaauuucacauau

SEQ ID NO: 754536 - RNA, 22 nt, Human
uuaaauaguaggucuauuuugg

SEQ ID NO: 754537 - RNA, 22 nt, Human
cagccuccugggacacucaccg

SEQ ID NO: 754538 - RNA, 22 nt, Human
uugaaugaauuugagcagagau

SEQ ID NO: 754539 - RNA, 22 nt, Human
ccuguuuauugugaagaaccca

SEQ ID NO: 754540 - RNA, 22 nt, Human
ggcauguaugugcauuuuugua

SEQ ID NO: 754541 - RNA, 22 nt, Human
gcagggaagaucuuggagcugc

SEQ ID NO: 754542 - RNA, 22 nt, Human
ucugagauuaagcagagaugga

SEQ ID NO: 754543 - RNA, 22 nt, Human
gccuucugcgcucgugucuccg

SEQ ID NO: 754544 - RNA, 22 nt, Human
auuauuagauucuuaauuguaa

SEQ ID NO: 754545 - RNA, 22 nt, Human
aaucagagucccaagaucugua

SEQ ID NO: 754546 - RNA, 22 nt, Human
auccugggcagugugucacucu

SEQ ID NO: 754547 - RNA, 22 nt, Human
uuuacacuugaggaaacugagg

SEQ ID NO: 754548 - RNA, 22 nt, Human
aacuguggccagggacuggagu

SEQ ID NO: 754549 - RNA, 22 nt, Human
cuguccaugcauguugucugcu

SEQ ID NO: 754550 - RNA, 22 nt, Human
ugcugagagccagggcuggcau

SEQ ID NO: 754551 - RNA, 20 nt, Human
auuguugcugcugcuguuga

SEQ ID NO: 754552 - RNA, 22 nt, Human
gaguuagagccauagagcacgg

SEQ ID NO: 754553 - RNA, 22 nt, Human
ugucugcagaagauggcauggg

SEQ ID NO: 754554 - RNA, 22 nt, Human
gaguuauuuguagggauuauau

SEQ ID NO: 754555 - RNA, 22 nt, Human
uacagcaugaucacaauggaaa

SEQ ID NO: 754556 - RNA, 22 nt, Human
ucuauaaaugcagauaugugug

SEQ ID NO: 754557 - RNA, 22 nt, Human
aaauugcaaaaguacuuuuagg

SEQ ID NO: 754558 - RNA, 22 nt, Human
ccucagagguuuucauucugua

SEQ ID NO: 754559 - RNA, 22 nt, Human
cugggccaucuccuuugugugg

SEQ ID NO: 754560 - RNA, 22 nt, Human
acugaaaaugaauuagaaacag

SEQ ID NO: 754561 - RNA, 22 nt, Human
aggcagccuuuagacagucugc

SEQ ID NO: 754562 - RNA, 22 nt, Human
gcccaagcuccgccuccugucg

SEQ ID NO: 754563 - RNA, 22 nt, Human
gacccuuagaaugugaucuuau

SEQ ID NO: 754564 - RNA, 21 nt, Human
aggguccuacagggcucagga

SEQ ID NO: 754565 - RNA, 22 nt, Human
aaagugcugggauuacaggugu

SEQ ID NO: 754566 - RNA, 22 nt, Human
cagcuggcuggucagugcacaa

SEQ ID NO: 754567 - RNA, 22 nt, Human
auuacacagcgguuacuacuag

SEQ ID NO: 754568 - RNA, 22 nt, Human
guauuugauacaugaaauggug

SEQ ID NO: 754569 - RNA, 22 nt, Human
ugauauuuuaugagcuuucaua

SEQ ID NO: 754570 - RNA, 22 nt, Human
aaggaaccuggaguagagggag

SEQ ID NO: 754571 - RNA, 22 nt, Human
cagccugggcuccagagucccu

SEQ ID NO: 754572 - RNA, 22 nt, Human
cuuuugauugagcaguuucaaa

SEQ ID NO: 754573 - RNA, 22 nt, Human
uccuguggucuggaaggaaugg

SEQ ID NO: 754574 - RNA, 22 nt, Human
caacacagguucugcaaaggaa

SEQ ID NO: 754575 - RNA, 22 nt, Human
gggagcuccacugccucucauu

SEQ ID NO: 754576 - RNA, 21 nt, Human
uggcucuguucaauauaugga

SEQ ID NO: 754577 - RNA, 22 nt, Human
aagcugucagugucaggcuaaa

SEQ ID NO: 754578 - RNA, 22 nt, Human
auacagaugggucagauuucau

SEQ ID NO: 754579 - RNA, 22 nt, Human
gaugcugugcuaugucuacaga

SEQ ID NO: 754580 - RNA, 22 nt, Human
gagcucagacucgggccugggg

SEQ ID NO: 754581 - RNA, 22 nt, Human
ccaggucccuggaauuuaugag

SEQ ID NO: 754582 - RNA, 19 nt, Human
ugagugggagcccagguau

SEQ ID NO: 754583 - RNA, 22 nt, Human
ggugaccucaccuggucccacc

SEQ ID NO: 754584 - RNA, 22 nt, Human
ggcuuucagccaaaggacaacc

SEQ ID NO: 754585 - RNA, 22 nt, Human
acgauguggccugaaucaggca

SEQ ID NO: 754586 - RNA, 22 nt, Human
gagauuagaguuguuucauugu

SEQ ID NO: 754587 - RNA, 22 nt, Human
gacaggcuuugagucccagaac

SEQ ID NO: 754588 - RNA, 22 nt, Human
cacucuccagcacaccccauuu

SEQ ID NO: 754589 - RNA, 22 nt, Human
aaagaucacgucccaggacucg

SEQ ID NO: 754590 - RNA, 22 nt, Human
gcugagcuagaaaaggaccaca

SEQ ID NO: 754591 - RNA, 22 nt, Human
ggagcugcauuuagggagccuu

SEQ ID NO: 754592 - RNA, 22 nt, Human
cacaguuuugcccagggcuucu

SEQ ID NO: 754593 - RNA, 22 nt, Human
aacaggcuccuugugaauggau

SEQ ID NO: 754594 - RNA, 22 nt, Human
aaauagauuuaacauccauccc

SEQ ID NO: 754595 - RNA, 22 nt, Human
gcagggguuuucugacuugagu

SEQ ID NO: 754596 - RNA, 22 nt, Human
ucugagguucuguuuucaacug

SEQ ID NO: 754597 - RNA, 23 nt, Human
acucaaauuucgcuuggaguuca

SEQ ID NO: 754598 - RNA, 22 nt, Human
caaggcaggcaguucacuugag

SEQ ID NO: 754599 - RNA, 22 nt, Human
uggcagcacauugacccgggcu

SEQ ID NO: 754600 - RNA, 22 nt, Human
caggagcuacucagguuggguu

SEQ ID NO: 754601 - RNA, 22 nt, Human
ccagagagaguacugggcucug

SEQ ID NO: 754602 - RNA, 22 nt, Human
augaguaagaccauaauuuuug

SEQ ID NO: 754603 - RNA, 22 nt, Human
uauguguaaccuugugauuuau

SEQ ID NO: 754604 - RNA, 22 nt, Human
caaagggcucuagacucagcag

SEQ ID NO: 754605 - RNA, 22 nt, Human
uuuauugaacacuugcacuggc

SEQ ID NO: 754606 - RNA, 22 nt, Human
ugcagccuugaccuccagugcu

SEQ ID NO: 754607 - RNA, 22 nt, Human
acaguuuauguaaagcugccaa

SEQ ID NO: 754608 - RNA, 22 nt, Human
ucuauuuucuugccaaaacugc

SEQ ID NO: 754609 - RNA, 22 nt, Human
gucuggguuucaugggcacugg

SEQ ID NO: 754610 - RNA, 22 nt, Human
gugcuuuaaagacaguuaugcu

SEQ ID NO: 754611 - RNA, 22 nt, Human
ugaggaaugcugagcagaggaa

SEQ ID NO: 754612 - RNA, 22 nt, Human
uuaucuguuguuuuaguacaau

SEQ ID NO: 754613 - RNA, 22 nt, Human
ccagaagucaaguaagaugaag

SEQ ID NO: 754614 - RNA, 22 nt, Human
cccugagaugccucacccuagu

SEQ ID NO: 754615 - RNA, 22 nt, Human
auucuuuaauucaauugaagga

SEQ ID NO: 754616 - RNA, 22 nt, Human
uugcuucagucagugcugccca

SEQ ID NO: 754617 - RNA, 22 nt, Human
gacacaugaccauaaaugcuaa

SEQ ID NO: 754618 - RNA, 22 nt, Human
cuaccugaaaagguugugguga

SEQ ID NO: 754619 - RNA, 20 nt, Human
cauuuguuagcuuucuacug

SEQ ID NO: 754620 - RNA, 22 nt, Human
accagccuccuagcugcuccug

SEQ ID NO: 754621 - RNA, 23 nt, Human
ugcuccagccucuuugauagugu

SEQ ID NO: 754622 - RNA, 22 nt, Human
gacagcaaccucaugagaaacu

SEQ ID NO: 754623 - RNA, 22 nt, Human
uucugguguguucucucuaggc

SEQ ID NO: 754624 - RNA, 23 nt, Human
cuuguauucacucauuugggaac

SEQ ID NO: 754625 - RNA, 22 nt, Human
agagauaauuagguuaaaugag

SEQ ID NO: 754626 - RNA, 22 nt, Human
gaggugagaagggggucagaug

SEQ ID NO: 754627 - RNA, 22 nt, Human
uaggcacugaggggagcaaggu

SEQ ID NO: 754628 - RNA, 22 nt, Human
gugugcaggcuugaggauuagg

SEQ ID NO: 754629 - RNA, 22 nt, Human
aaagguuuugcccuggguauuc

SEQ ID NO: 754630 - RNA, 22 nt, Human
aggcuggcaaggcagaugugug

SEQ ID NO: 754631 - RNA, 23 nt, Human
agcuguuucauuauuacaacacc

SEQ ID NO: 754632 - RNA, 22 nt, Human
uuuuaagaugcuaguauuucag

SEQ ID NO: 754633 - RNA, 22 nt, Human
gguggagcuguggacaggaagg

SEQ ID NO: 754634 - RNA, 22 nt, Human
uuagaacauuccaucacugggu

SEQ ID NO: 754635 - RNA, 16 nt, Human
ccacagggcaaggggc

SEQ ID NO: 754636 - RNA, 19 nt, Human
gcauaaaaugucaaugugu

SEQ ID NO: 754637 - RNA, 22 nt, Human
gaacagcagcucguucucgaug

SEQ ID NO: 754638 - RNA, 22 nt, Human
gugucacaugguuuacugcagc

SEQ ID NO: 754639 - RNA, 22 nt, Human
gaagacacucugcagaguuauc

SEQ ID NO: 754640 - RNA, 22 nt, Human
ggcucugggucuguggggagcg

SEQ ID NO: 754641 - RNA, 22 nt, Human
aucugcugcccagccacuugcu

SEQ ID NO: 754642 - RNA, 22 nt, Human
ugcugugcuccauugucuucac

SEQ ID NO: 754643 - RNA, 22 nt, Human
acagaacugcaggaggaaaagc

SEQ ID NO: 754644 - RNA, 22 nt, Human
ccacccugccuugggccaguga

SEQ ID NO: 754645 - RNA, 22 nt, Human
gcguuuaagugaugaucgucuu

SEQ ID NO: 754646 - RNA, 22 nt, Human
gcauccauucacucaacuuaga

SEQ ID NO: 754647 - RNA, 22 nt, Human
aggcccugauccgaauccagau

SEQ ID NO: 754648 - RNA, 22 nt, Human
uggacauguaaaggcucaaggu

SEQ ID NO: 754649 - RNA, 22 nt, Human
uacauauucaacguucaguauu

SEQ ID NO: 754650 - RNA, 22 nt, Human
cugggagcggcugucacugguu

SEQ ID NO: 754651 - RNA, 22 nt, Human
ucucucagaggaagaggcagug

SEQ ID NO: 754652 - RNA, 22 nt, Human
uuuccuguucuaguuguugcca

SEQ ID NO: 754653 - RNA, 22 nt, Human
ugagcuuacuucuguacacaga

SEQ ID NO: 754654 - RNA, 22 nt, Human
gacagcugaaaaauguaaggua

SEQ ID NO: 754655 - RNA, 22 nt, Human
ggagucaggauccuggggaugg

SEQ ID NO: 754656 - RNA, 22 nt, Human
agcagguguagggcucuuugua

SEQ ID NO: 754657 - RNA, 22 nt, Human
agcuccugcuugacagaagagg

SEQ ID NO: 754658 - RNA, 22 nt, Human
ugcuggcuguucuagggaggcc

SEQ ID NO: 754659 - RNA, 22 nt, Human
ggaauagggagagaaucguuug

SEQ ID NO: 754660 - RNA, 22 nt, Human
agagugaucagauaucaggugu

SEQ ID NO: 754661 - RNA, 22 nt, Human
uuacuuuauagaacacuggggg

SEQ ID NO: 754662 - RNA, 22 nt, Human
acucuuuauuguuuguggcuag

SEQ ID NO: 754663 - RNA, 22 nt, Human
agagacuguaaugagagguaca

SEQ ID NO: 754664 - RNA, 22 nt, Human
gguccagaagcugguaggguag

SEQ ID NO: 754665 - RNA, 22 nt, Human
agccuggaggccaggagacagu

SEQ ID NO: 754666 - RNA, 22 nt, Human
cuacuuuaccuccaucagacug

SEQ ID NO: 754667 - RNA, 22 nt, Human
aagcuguuguucauccugaauu

SEQ ID NO: 754668 - RNA, 22 nt, Human
gagcacagggaauagacagaua

SEQ ID NO: 754669 - RNA, 22 nt, Human
uuuccaagagcuuauuucugaa

SEQ ID NO: 754670 - RNA, 22 nt, Human
aaggacaggcuaaccugacauu

SEQ ID NO: 754671 - RNA, 22 nt, Human
ucagacagggcuucucaaacuu

SEQ ID NO: 754672 - RNA, 22 nt, Human
ugaaaucuacccuauucagggu

SEQ ID NO: 754673 - RNA, 22 nt, Human
ucuuuguaagacauguaagucc

SEQ ID NO: 754674 - RNA, 22 nt, Human
uucugguuuaagaaagugcugg

SEQ ID NO: 754675 - RNA, 22 nt, Human
gaggcucacuuucauccucuuc

SEQ ID NO: 754676 - RNA, 22 nt, Human
ggaccaggccagccucccugcg

SEQ ID NO: 754677 - RNA, 22 nt, Human
uacagcgaaaauuuagcuugau

SEQ ID NO: 754678 - RNA, 22 nt, Human
acaauguagaggcugaaagcaa

SEQ ID NO: 754679 - RNA, 22 nt, Human
caguacauuucauaugauucua

SEQ ID NO: 754680 - RNA, 22 nt, Human
gaguguaguucauuccguccua

SEQ ID NO: 754681 - RNA, 22 nt, Human
cacuaaguugguguuaauuagu

SEQ ID NO: 754682 - RNA, 22 nt, Human
gcuucuguuaacuuauguuccc

SEQ ID NO: 754683 - RNA, 22 nt, Human
uacuguacucaacaugugaguu

SEQ ID NO: 754684 - RNA, 22 nt, Human
aagaggugagaagcuacacuua

SEQ ID NO: 754685 - RNA, 22 nt, Human
ggcugagacuagagugaggcau

SEQ ID NO: 754686 - RNA, 19 nt, Human
accugcaguaauaauuccu

SEQ ID NO: 754687 - RNA, 22 nt, Human
gaaggaagugcucauacuaguu

SEQ ID NO: 754688 - RNA, 22 nt, Human
gggcuccaaaauccuguagccu

SEQ ID NO: 754689 - RNA, 22 nt, Human
aagaggagggcagauucaaggc

SEQ ID NO: 754690 - RNA, 18 nt, Human
ccagaggcccgggcaggc

SEQ ID NO: 754691 - RNA, 22 nt, Human
ugcccacauucugaagcucccu

SEQ ID NO: 754692 - RNA, 22 nt, Human
uuccuggcugucaugcccuagu

SEQ ID NO: 754693 - RNA, 22 nt, Human
ggccaggaagggaagaucagca

SEQ ID NO: 754694 - RNA, 18 nt, Human
aucaaggaggggaagguc

SEQ ID NO: 754695 - RNA, 22 nt, Human
gccaagcuuauaugaugcuuga

SEQ ID NO: 754696 - RNA, 22 nt, Human
ggcacugggagaggugagacgg

SEQ ID NO: 754697 - RNA, 22 nt, Human
caggcugauaggguccaaaguu

SEQ ID NO: 754698 - RNA, 22 nt, Human
ugagaugaugggauaagagggc

SEQ ID NO: 754699 - RNA, 22 nt, Human
augucacuuuugagacuagguu

SEQ ID NO: 754700 - RNA, 22 nt, Human
ucuguggaaauuuccugaggca

SEQ ID NO: 754701 - RNA, 22 nt, Human
cagggggugcaggcccugugac

SEQ ID NO: 754702 - RNA, 22 nt, Human
ccaggaucugauauugggcucc

SEQ ID NO: 754703 - RNA, 22 nt, Human
aguaggcauugugaaacugcau

SEQ ID NO: 754704 - RNA, 22 nt, Human
aaaaguaaucgcaguuuuugcc

SEQ ID NO: 754705 - RNA, 22 nt, Human
caacacauugaagcuaugauga

SEQ ID NO: 754706 - RNA, 22 nt, Human
auuucuacaguacacaugcauu

SEQ ID NO: 754707 - RNA, 22 nt, Human
uugaaaugcucuuuggaaucua

SEQ ID NO: 754708 - RNA, 19 nt, Human
ucaaugucuggccaauggu

SEQ ID NO: 754709 - RNA, 22 nt, Human
cacaggcagccuuguagaagaa

SEQ ID NO: 754710 - RNA, 22 nt, Human
cccuugcacauuugucuuuaau

SEQ ID NO: 754711 - RNA, 22 nt, Human
guggcagggugcucaucaugca

SEQ ID NO: 754712 - RNA, 22 nt, Human
uccugaauugaacucaguuaau

SEQ ID NO: 754713 - RNA, 22 nt, Human
aaagucugaaagaugcuaacau

SEQ ID NO: 754714 - RNA, 22 nt, Human
uucagugugugauaccugcugu

SEQ ID NO: 754715 - RNA, 22 nt, Human
gaaagcacuaaaagagaauccu

SEQ ID NO: 754716 - RNA, 22 nt, Human
agcuaggagauuuugugaggcu

SEQ ID NO: 754717 - RNA, 22 nt, Human
ccaugcccuaaaggacuggcag

SEQ ID NO: 754718 - RNA, 22 nt, Human
caucuuuaguuauugaauauag

SEQ ID NO: 754719 - RNA, 22 nt, Human
uacccagggcuuuucugaugca

SEQ ID NO: 754720 - RNA, 22 nt, Human
ucuccuggucaccucagaaguc

SEQ ID NO: 754721 - RNA, 19 nt, Human
acuccagggaugacagaag

SEQ ID NO: 754722 - RNA, 22 nt, Human
aaagcaaugggucuaagguaaa

SEQ ID NO: 754723 - RNA, 19 nt, Human
gcauuucauuuaaccauca

SEQ ID NO: 754724 - RNA, 22 nt, Human
cagucccaucucccagguggcu

SEQ ID NO: 754725 - RNA, 22 nt, Human
agaguauuuugauuauccugga

SEQ ID NO: 754726 - RNA, 22 nt, Human
uugaaaggccuguuuauccagc

SEQ ID NO: 754727 - RNA, 22 nt, Human
uucuaagugauucuagcuggac

SEQ ID NO: 754728 - RNA, 22 nt, Human
ccagagucccuugcagcucagu

SEQ ID NO: 754729 - RNA, 22 nt, Human
ugagucagccagagcugccaug

SEQ ID NO: 754730 - RNA, 22 nt, Human
agggccugacacccuugccagc

SEQ ID NO: 754731 - RNA, 22 nt, Human
cccaggaccgcgcggcugagcg

SEQ ID NO: 754732 - RNA, 22 nt, Human
cugagagucaguggaguggugu

SEQ ID NO: 754733 - RNA, 22 nt, Human
gguggcaccuuacccugcgcag

SEQ ID NO: 754734 - RNA, 22 nt, Human
ccccagcacaggcuccucagau

SEQ ID NO: 754735 - RNA, 22 nt, Human
cagcauuguaagaaugaagacc

SEQ ID NO: 754736 - RNA, 22 nt, Human
uaggguacaugugcacaacaug

SEQ ID NO: 754737 - RNA, 22 nt, Human
auuauccaacacccaguuacau

SEQ ID NO: 754738 - RNA, 22 nt, Human
uuuaauacuauggggaugaaca

SEQ ID NO: 754739 - RNA, 22 nt, Human
acuauucaccuuucaugcagga

SEQ ID NO: 754740 - RNA, 22 nt, Human
uaaugcuuugucagccuaaggg

SEQ ID NO: 754741 - RNA, 22 nt, Human
cagguacaaagcuacugccuga

SEQ ID NO: 754742 - RNA, 22 nt, Human
uacccagcuucaagucaggacu

SEQ ID NO: 754743 - RNA, 22 nt, Human
ucaacucacaagaaugagcaag

SEQ ID NO: 754744 - RNA, 22 nt, Human
augcagagcuuccaguggccug

SEQ ID NO: 754745 - RNA, 22 nt, Human
auucugagaaaugcauugucag

SEQ ID NO: 754746 - RNA, 22 nt, Human
auggcauuauagcaaugguuug

SEQ ID NO: 754747 - RNA, 22 nt, Human
ccuucucccucugagaggaacc

SEQ ID NO: 754748 - RNA, 22 nt, Human
ccacagcaugcaggccugacac

SEQ ID NO: 754749 - RNA, 22 nt, Human
gcucagaaaagugaggcucagu

SEQ ID NO: 754750 - RNA, 21 nt, Human
ucaggaggcucagacuccugc

SEQ ID NO: 754751 - RNA, 22 nt, Human
gaacaguaucaguagugccagu

SEQ ID NO: 754752 - RNA, 22 nt, Human
gaguccagacaccauaccugau

SEQ ID NO: 754753 - RNA, 22 nt, Human
uccaggcuggagugcaguggca

SEQ ID NO: 754754 - RNA, 22 nt, Human
aguaaggcauuuuucauguuua

SEQ ID NO: 754755 - RNA, 22 nt, Human
uucaucuugauggcuuccuaau

SEQ ID NO: 754756 - RNA, 22 nt, Human
caguccuuggcaaguucucagu

SEQ ID NO: 754757 - RNA, 22 nt, Human
aagugcaauuugaaauucugca

SEQ ID NO: 754758 - RNA, 22 nt, Human
agacagcugccuccaccacagc

SEQ ID NO: 754759 - RNA, 22 nt, Human
auuauucagucuuguaaggagu

SEQ ID NO: 754760 - RNA, 22 nt, Human
ucacccagauagugagcauagu

SEQ ID NO: 754761 - RNA, 22 nt, Human
ucauuuuucacacagggucacc

SEQ ID NO: 754762 - RNA, 22 nt, Human
cagcucaaguuucccaggucag

SEQ ID NO: 754763 - RNA, 22 nt, Human
aguauuuccuggcuuaucugcu

SEQ ID NO: 754764 - RNA, 22 nt, Human
agagaggauuuguuuuucuccu

SEQ ID NO: 754765 - RNA, 22 nt, Human
ccaguccagugccaugcauggc

SEQ ID NO: 754766 - RNA, 22 nt, Human
aaagacuagcauuuauauguac

SEQ ID NO: 754767 - RNA, 22 nt, Human
gcagaugccacuaggugaagug

SEQ ID NO: 754768 - RNA, 22 nt, Human
aaugaaauaguuggcuguagag

SEQ ID NO: 754769 - RNA, 22 nt, Human
accugguaaccugccugacuaa

SEQ ID NO: 754770 - RNA, 22 nt, Human
aguuuagaaaaucuguuucuuc

SEQ ID NO: 754771 - RNA, 22 nt, Human
caucuguagcuccaugacaauu

SEQ ID NO: 754772 - RNA, 22 nt, Human
uccagcaugaaggggcuuuuau

SEQ ID NO: 754773 - RNA, 22 nt, Human
uggagaaaagguugaauccauc

SEQ ID NO: 754774 - RNA, 19 nt, Human
aaucagaaauaucgaggcc

SEQ ID NO: 754775 - RNA, 22 nt, Human
uggcaaggccacaggugcaguu

SEQ ID NO: 754776 - RNA, 22 nt, Human
uugauacauagcacaguuuagg

SEQ ID NO: 754777 - RNA, 22 nt, Human
agucuggauuuagaggugggcc

SEQ ID NO: 754778 - RNA, 22 nt, Human
acaguucugccuguuugagaag

SEQ ID NO: 754779 - RNA, 22 nt, Human
gcugcuucagggacgugccagc

SEQ ID NO: 754780 - RNA, 22 nt, Human
aguuuuauggcucaaccuaaua

SEQ ID NO: 754781 - RNA, 22 nt, Human
gacagcagcauaauacaugaac

SEQ ID NO: 754782 - RNA, 22 nt, Human
aaauucuaugucaauguuuauu

SEQ ID NO: 754783 - RNA, 22 nt, Human
ugccccugaugccuagaacaga

SEQ ID NO: 754784 - RNA, 22 nt, Human
auuuacucgugucuccagugcu

SEQ ID NO: 754785 - RNA, 22 nt, Human
agccaaggucgccccagggcaa

SEQ ID NO: 754786 - RNA, 19 nt, Human
uggagaggaaaugcugcuc

SEQ ID NO: 754787 - RNA, 18 nt, Human
agcuccuggucucaggga

SEQ ID NO: 754788 - RNA, 22 nt, Human
aauccgauucguguacauuaau

SEQ ID NO: 754789 - RNA, 22 nt, Human
ucaugcaaauacuguuccagaa

SEQ ID NO: 754790 - RNA, 22 nt, Human
ccagagccggauugugaagugc

SEQ ID NO: 754791 - RNA, 22 nt, Human
gauuuacagaucuaagggucac

SEQ ID NO: 754792 - RNA, 20 nt, Human
gcccaagguccagaaggggg

SEQ ID NO: 754793 - RNA, 22 nt, Human
cacugaaaggaaaccagagcau

SEQ ID NO: 754794 - RNA, 22 nt, Human
cacauucaggauuuuccauguc

SEQ ID NO: 754795 - RNA, 22 nt, Human
cugggccacaagccugugugau

SEQ ID NO: 754796 - RNA, 22 nt, Human
ccauuuguuuucgcuaccaugg

SEQ ID NO: 754797 - RNA, 22 nt, Human
ccacagggcucuaggcgcuucc

SEQ ID NO: 754798 - RNA, 22 nt, Human
ugccaggcaggacccuagaacc

SEQ ID NO: 754799 - RNA, 22 nt, Human
ggcagggaagcuggcaucacgg

SEQ ID NO: 754800 - RNA, 22 nt, Human
agacagcagaaacuagagcacu

SEQ ID NO: 754801 - RNA, 22 nt, Human
gaaaacauccagagauagaccu

SEQ ID NO: 754802 - RNA, 22 nt, Human
cuuuauauauucccaggcugcc

SEQ ID NO: 754803 - RNA, 22 nt, Human
ugcccugucgcucacucccacc

SEQ ID NO: 754804 - RNA, 22 nt, Human
gaagcuucguggcucuucaaau

SEQ ID NO: 754805 - RNA, 22 nt, Human
cugggagagccuuuccugaguc

SEQ ID NO: 754806 - RNA, 22 nt, Human
ggccagcugagcugcugcacag

SEQ ID NO: 754807 - RNA, 22 nt, Human
uagaaacaaaaucugaugacuc

SEQ ID NO: 754808 - RNA, 22 nt, Human
gaaccuguccugagugaggagu

SEQ ID NO: 754809 - RNA, 22 nt, Human
aauccacuaaugaagaaugggc

SEQ ID NO: 754810 - RNA, 22 nt, Human
caguauuuauggcuugaguauu

SEQ ID NO: 754811 - RNA, 22 nt, Human
ucugccuagugggacagcagcc

SEQ ID NO: 754812 - RNA, 22 nt, Human
gaguuuuaaccucagcucucug

SEQ ID NO: 754813 - RNA, 22 nt, Human
caaggccagggaauuuuucugg

SEQ ID NO: 754814 - RNA, 22 nt, Human
ucauuuacuggauccauaagca

SEQ ID NO: 754815 - RNA, 22 nt, Human
caguugaugggacucauguggg

SEQ ID NO: 754816 - RNA, 22 nt, Human
gcugggcugcccaaccucugac

SEQ ID NO: 754817 - RNA, 22 nt, Human
uagaaaggauauugagaugaau

SEQ ID NO: 754818 - RNA, 22 nt, Human
cauguguuuugucauuucaaua

SEQ ID NO: 754819 - RNA, 22 nt, Human
ucugcacauguaguaaauauua

SEQ ID NO: 754820 - RNA, 19 nt, Human
uuuauuugagacaugccuu

SEQ ID NO: 754821 - RNA, 22 nt, Human
agcagcuuaucuuggagaggca

SEQ ID NO: 754822 - RNA, 22 nt, Human
cagggucauggcaccugcacgg

SEQ ID NO: 754823 - RNA, 18 nt, Human
aguggaaaacaaauacac

SEQ ID NO: 754824 - RNA, 22 nt, Human
auguggcuagugcaacugagaa

SEQ ID NO: 754825 - RNA, 22 nt, Human
guguccugagugaggccuggcc

SEQ ID NO: 754826 - RNA, 16 nt, Human
ucucccuugucaccug

SEQ ID NO: 754827 - RNA, 22 nt, Human
ggccucugccucaucugggcac

SEQ ID NO: 754828 - RNA, 22 nt, Human
acaugcuuccaaauuauguugg

SEQ ID NO: 754829 - RNA, 22 nt, Human
gccaggcauuauuccgaucccu

SEQ ID NO: 754830 - RNA, 22 nt, Human
agggcucagccagccugugugc

SEQ ID NO: 754831 - RNA, 21 nt, Human
uacagaugaggagaccaaggc

SEQ ID NO: 754832 - RNA, 22 nt, Human
cuggaaaggguccucauucugu

SEQ ID NO: 754833 - RNA, 22 nt, Human
uguguuuuaucuauuguaucuu

SEQ ID NO: 754834 - RNA, 19 nt, Human
uuccuggcucuucuguuuu

SEQ ID NO: 754835 - RNA, 18 nt, Human
guuggcugcuguggcugg

SEQ ID NO: 754836 - RNA, 22 nt, Human
accauuugacucucuaaggaua

SEQ ID NO: 754837 - RNA, 22 nt, Human
uacauuuucuaggggaccaaga

SEQ ID NO: 754838 - RNA, 21 nt, Human
agccaggcaagcacccccacu

SEQ ID NO: 754839 - RNA, 22 nt, Human
cuguccauauucaagggguagg

SEQ ID NO: 754840 - RNA, 22 nt, Human
accaaauaggcuuccuggguug

SEQ ID NO: 754841 - RNA, 22 nt, Human
aaguugcuaaugauguguuugc

SEQ ID NO: 754842 - RNA, 22 nt, Human
cuucuugguugguuucauucca

SEQ ID NO: 754843 - RNA, 22 nt, Human
gccuggcuucccuuggagcauu

SEQ ID NO: 754844 - RNA, 22 nt, Human
gugugugugcauauaacauaua

SEQ ID NO: 754845 - RNA, 22 nt, Human
cuggucacuggucucauccagc

SEQ ID NO: 754846 - RNA, 22 nt, Human
aaauacuagaauucagaguuga

SEQ ID NO: 754847 - RNA, 22 nt, Human
ugacuccacaauuugacuuaua

SEQ ID NO: 754848 - RNA, 22 nt, Human
caagauuuagccugcugccugu

SEQ ID NO: 754849 - RNA, 22 nt, Human
ggcaugcauguuguuuuaggug

SEQ ID NO: 754850 - RNA, 23 nt, Human
uccuuccuuugagaggcuccauc

SEQ ID NO: 754851 - RNA, 22 nt, Human
aguuucuuauucuuaguuaugu

SEQ ID NO: 754852 - RNA, 22 nt, Human
aaauacauuagacggagaguua

SEQ ID NO: 754853 - RNA, 22 nt, Human
gcaacuuaggaguuagagcaug

SEQ ID NO: 754854 - RNA, 22 nt, Human
cuguuuucccuggaguucagca

SEQ ID NO: 754855 - RNA, 22 nt, Human
ucuugaaacauaugaguaagug

SEQ ID NO: 754856 - RNA, 22 nt, Human
gcuuccuaaaugcacagggcag

SEQ ID NO: 754857 - RNA, 22 nt, Human
uccugagcacagagacaaggaa

SEQ ID NO: 754858 - RNA, 22 nt, Human
acucuacagaaugaauaccugu

SEQ ID NO: 754859 - RNA, 22 nt, Human
caucauauggaauuuaaaguca

SEQ ID NO: 754860 - RNA, 22 nt, Human
uuccaggagccacacaggggcg

SEQ ID NO: 754861 - RNA, 22 nt, Human
uggaaaaaaauuggcuagcuuc

SEQ ID NO: 754862 - RNA, 22 nt, Human
caccaucuagcauuuauuugga

SEQ ID NO: 754863 - RNA, 22 nt, Human
agugggcauaugaagucucaag

SEQ ID NO: 754864 - RNA, 22 nt, Human
gccuccugaagugcugggauua

SEQ ID NO: 754865 - RNA, 22 nt, Human
cuugucugggcagcuugggagu

SEQ ID NO: 754866 - RNA, 22 nt, Human
aaacauugcuaaauaaugcugc

SEQ ID NO: 754867 - RNA, 22 nt, Human
agauauaauaauuuacaagugu

SEQ ID NO: 754868 - RNA, 21 nt, Human
ucuaagaacaugauucucccu

SEQ ID NO: 754869 - RNA, 22 nt, Human
accagcacggauuagaaugcuu

SEQ ID NO: 754870 - RNA, 22 nt, Human
augaaacaacagacuuggucaa

SEQ ID NO: 754871 - RNA, 22 nt, Human
aaaugucaaagacguguuuuug

SEQ ID NO: 754872 - RNA, 22 nt, Human
uaaugccacggcagggaacagc

SEQ ID NO: 754873 - RNA, 22 nt, Human
uuuguagacgucagaaguuacu

SEQ ID NO: 754874 - RNA, 22 nt, Human
aauuacagucggagcagcacug

SEQ ID NO: 754875 - RNA, 22 nt, Human
acauauauuuucacacaugguu

SEQ ID NO: 754876 - RNA, 22 nt, Human
uggcuuggcuaagaucuaagcu

SEQ ID NO: 754877 - RNA, 20 nt, Human
uucauuugggaaaaucugcg

SEQ ID NO: 754878 - RNA, 22 nt, Human
agggcuuuugcaauccaagucu

SEQ ID NO: 754879 - RNA, 22 nt, Human
ucccagacaaucauuggccacc

SEQ ID NO: 754880 - RNA, 22 nt, Human
uagcucuucauuucaucugauu

SEQ ID NO: 754881 - RNA, 21 nt, Human
ccagaugcaaaugcagacauu

SEQ ID NO: 754882 - RNA, 22 nt, Human
ucagauuuuccagccuuucucu

SEQ ID NO: 754883 - RNA, 22 nt, Human
auaaacugaagggaacacugag

SEQ ID NO: 754884 - RNA, 22 nt, Human
cucugacauucugugacucuga

SEQ ID NO: 754885 - RNA, 22 nt, Human
uaacuuuucuaggugugauaau

SEQ ID NO: 754886 - RNA, 22 nt, Human
ggugggaguggaacguggaaga

SEQ ID NO: 754887 - RNA, 22 nt, Human
ugccuggcaaugccagaagcca

SEQ ID NO: 754888 - RNA, 22 nt, Human
ggcugagaaggagugggugagg

SEQ ID NO: 754889 - RNA, 22 nt, Human
aaaggcaucuagccaaguugag

SEQ ID NO: 754890 - RNA, 22 nt, Human
ugagcuggagucuguggcuccu

SEQ ID NO: 754891 - RNA, 21 nt, Human
auuagaagguauuuagggccu

SEQ ID NO: 754892 - RNA, 22 nt, Human
uuucaaggauguuauauaaaug

SEQ ID NO: 754893 - RNA, 22 nt, Human
guccugguccugccuccccaug

SEQ ID NO: 754894 - RNA, 22 nt, Human
aaugaagccagcugggaugcga

SEQ ID NO: 754895 - RNA, 22 nt, Human
uaaaauguuugcaagagaccag

SEQ ID NO: 754896 - RNA, 22 nt, Human
cuguuauuuagaacauggaauc

SEQ ID NO: 754897 - RNA, 22 nt, Human
caggugaguuugcuauuguaca

SEQ ID NO: 754898 - RNA, 22 nt, Human
uaggaacacacauguguagcug

SEQ ID NO: 754899 - RNA, 19 nt, Human
cucugggcaagucacuuaa

SEQ ID NO: 754900 - RNA, 22 nt, Human
ucagaagguacagaagggaggu

SEQ ID NO: 754901 - RNA, 22 nt, Human
cccaccaguacagaugguagau

SEQ ID NO: 754902 - RNA, 19 nt, Human
ccugggacuuaggcugggu

SEQ ID NO: 754903 - RNA, 17 nt, Human
agcaaaaguaucaaagc

SEQ ID NO: 754904 - RNA, 22 nt, Human
ucucuuuaaguauaaucuuaua

SEQ ID NO: 754905 - RNA, 22 nt, Human
augcucuggaguacgugaaauu

SEQ ID NO: 754906 - RNA, 22 nt, Human
uacuuacacugaagcaaagaua

SEQ ID NO: 754907 - RNA, 22 nt, Human
cuucacugaguagucuagacuc

SEQ ID NO: 754908 - RNA, 22 nt, Human
cucuuugugcuauuaugauccu

SEQ ID NO: 754909 - RNA, 22 nt, Human
acagggccuuauauccagaagg

SEQ ID NO: 754910 - RNA, 22 nt, Human
gcuggcagucccaucagcuggg

SEQ ID NO: 754911 - RNA, 22 nt, Human
uaguuuuuaaguguacaauuuc

SEQ ID NO: 754912 - RNA, 21 nt, Human
ggcaggugggucucuguugcu

SEQ ID NO: 754913 - RNA, 22 nt, Human
uucuucaauuuuccauauacug

SEQ ID NO: 754914 - RNA, 22 nt, Human
aauauucauuugcagaagaagu

SEQ ID NO: 754915 - RNA, 22 nt, Human
gcaguaaauaauuuuguguaua

SEQ ID NO: 754916 - RNA, 22 nt, Human
acugcagccuagggaccacagu

SEQ ID NO: 754917 - RNA, 22 nt, Human
uaggacaugcuacauaaauagg

SEQ ID NO: 754918 - RNA, 22 nt, Human
ccaugcaugccugaaauugcug

SEQ ID NO: 754919 - RNA, 22 nt, Human
uuucuuguaagauguuuauuaa

SEQ ID NO: 754920 - RNA, 22 nt, Human
ucauugaaugcucugcagguug

SEQ ID NO: 754921 - RNA, 22 nt, Human
cccuggccccucacuccgaggc

SEQ ID NO: 754922 - RNA, 22 nt, Human
ucugggcccugagauguucuuc

SEQ ID NO: 754923 - RNA, 22 nt, Human
uucuacacuuuucauuagcuag

SEQ ID NO: 754924 - RNA, 22 nt, Human
agguauaagucucauuucuguu

SEQ ID NO: 754925 - RNA, 22 nt, Human
agggagagacauuuccuucuug

SEQ ID NO: 754926 - RNA, 22 nt, Human
auggaguggggacugcagugga

SEQ ID NO: 754927 - RNA, 22 nt, Human
caccacagcauccacuagaagg

SEQ ID NO: 754928 - RNA, 22 nt, Human
uccaggcuagagugcaguggcc

SEQ ID NO: 754929 - RNA, 22 nt, Human
agagacuucugccuuagcaaga

SEQ ID NO: 754930 - RNA, 22 nt, Human
gggugggaacaggaugccagga

SEQ ID NO: 754931 - RNA, 22 nt, Human
acagaugaggcccaucagucug

SEQ ID NO: 754932 - RNA, 22 nt, Human
gacuuuauccugccugaccacg

SEQ ID NO: 754933 - RNA, 22 nt, Human
acaaacugggauaggauccugu

SEQ ID NO: 754934 - RNA, 22 nt, Human
ugggacacacaaggucagcucu

SEQ ID NO: 754935 - RNA, 22 nt, Human
aguaaagcggugucacagaaug

SEQ ID NO: 754936 - RNA, 22 nt, Human
aaggauacuuuuagagccugag

SEQ ID NO: 754937 - RNA, 22 nt, Human
gaggaacaugaggugaccuggg

SEQ ID NO: 754938 - RNA, 22 nt, Human
cacugucuugauuacuaugggu

SEQ ID NO: 754939 - RNA, 22 nt, Human
gagcugugacacgcagcccagg

SEQ ID NO: 754940 - RNA, 22 nt, Human
ucaugcaaagccaauuccagcu

SEQ ID NO: 754941 - RNA, 22 nt, Human
uggcagguagucagaggcgaca

SEQ ID NO: 754942 - RNA, 22 nt, Human
acuguaaaauacauaaguauug

SEQ ID NO: 754943 - RNA, 22 nt, Human
aggcacuguggaagacaugguu

SEQ ID NO: 754944 - RNA, 22 nt, Human
uagcuagcugcacaggcccugg

SEQ ID NO: 754945 - RNA, 22 nt, Human
ugaaagguagcuggccucauag

SEQ ID NO: 754946 - RNA, 22 nt, Human
guccugggcaugcagggcuuuc

SEQ ID NO: 754947 - RNA, 22 nt, Human
ggccugugcaagacagcacccc

SEQ ID NO: 754948 - RNA, 22 nt, Human
ggaaagagaaguugggaggaau

SEQ ID NO: 754949 - RNA, 22 nt, Human
cacaggaagaucucccagaggu

SEQ ID NO: 754950 - RNA, 22 nt, Human
aauaauagcagaguuuacaauc

SEQ ID NO: 754951 - RNA, 22 nt, Human
uuugacaugaaguagcuuauaa

SEQ ID NO: 754952 - RNA, 22 nt, Human
aggcauguauaugugcacaugu

SEQ ID NO: 754953 - RNA, 22 nt, Human
agccuggugauaucagugguuu

SEQ ID NO: 754954 - RNA, 22 nt, Human
gcaggaagggaaagguugacuc

SEQ ID NO: 754955 - RNA, 22 nt, Human
guucacagggauccuuguugaa

SEQ ID NO: 754956 - RNA, 22 nt, Human
uuauuuccaaacuggauauacc

SEQ ID NO: 754957 - RNA, 22 nt, Human
agcugccuuugcaucacuuuaa

SEQ ID NO: 754958 - RNA, 20 nt, Human
agggugagacaugagccucc

SEQ ID NO: 754959 - RNA, 22 nt, Human
aauugcuuuacaagccguuuaa

SEQ ID NO: 754960 - RNA, 22 nt, Human
acugggcuccaaggaccuggag

SEQ ID NO: 754961 - RNA, 22 nt, Human
uauguguguuucaguggaaaug

SEQ ID NO: 754962 - RNA, 22 nt, Human
cugcagaacaauuccugcuguu

SEQ ID NO: 754963 - RNA, 22 nt, Human
ccgcaaggcagagguugcagug

SEQ ID NO: 754964 - RNA, 23 nt, Human
uuuguacauugaggaggcagaau

SEQ ID NO: 754965 - RNA, 22 nt, Human
aguguaugugaaacuuuccaaa

SEQ ID NO: 754966 - RNA, 21 nt, Human
ccauccaucucccuuugcugg

SEQ ID NO: 754967 - RNA, 22 nt, Human
agcuccaggaucugaaaguucg

SEQ ID NO: 754968 - RNA, 22 nt, Human
gucagacacauuucuuucagug

SEQ ID NO: 754969 - RNA, 22 nt, Human
cugagagaugguguguuuauaa

SEQ ID NO: 754970 - RNA, 20 nt, Human
cuucuucauuaacccuacug

SEQ ID NO: 754971 - RNA, 22 nt, Human
aauuaagucacacaccuaaacc

SEQ ID NO: 754972 - RNA, 22 nt, Human
cuccauauguucaguuaugcag

SEQ ID NO: 754973 - RNA, 22 nt, Human
gcuggcuuuugaagucuagcua

SEQ ID NO: 754974 - RNA, 22 nt, Human
gcuucucucaggagcaucagcc

SEQ ID NO: 754975 - RNA, 21 nt, Human
auggcuucucaggugcacuga

SEQ ID NO: 754976 - RNA, 22 nt, Human
guacuucuggccaggcuggcca

SEQ ID NO: 754977 - RNA, 22 nt, Human
caccaggugcuggaggacauca

SEQ ID NO: 754978 - RNA, 22 nt, Human
cuggggaugggaccuggcauaa

SEQ ID NO: 754979 - RNA, 22 nt, Human
guacagaaauggggccccaggu

SEQ ID NO: 754980 - RNA, 22 nt, Human
aguuauuuggcuauagauggua

SEQ ID NO: 754981 - RNA, 22 nt, Human
acagcagguagcuuugugccuc

SEQ ID NO: 754982 - RNA, 22 nt, Human
aaagugcugggauuacaggcuu

SEQ ID NO: 754983 - RNA, 22 nt, Human
gcaaacauaauaugaagacacu

SEQ ID NO: 754984 - RNA, 22 nt, Human
caguuuaaagaaggaugggagu

SEQ ID NO: 754985 - RNA, 22 nt, Human
ugagaggcuagaucagcucugu

SEQ ID NO: 754986 - RNA, 22 nt, Human
aauugcuugaugacuaguaauu

SEQ ID NO: 754987 - RNA, 19 nt, Human
agaugucuauuugacuauc

SEQ ID NO: 754988 - RNA, 22 nt, Human
aaaaagcuuaaaugagcaguuc

SEQ ID NO: 754989 - RNA, 20 nt, Human
ccuucucuggaauugccucc

SEQ ID NO: 754990 - RNA, 22 nt, Human
guuccuaagcacugugcauucu

SEQ ID NO: 754991 - RNA, 22 nt, Human
cuaaaugacagguaccauagug

SEQ ID NO: 754992 - RNA, 22 nt, Human
caugauguuaucuaaaucuggu

SEQ ID NO: 754993 - RNA, 22 nt, Human
gacagacagggguucuccugga

SEQ ID NO: 754994 - RNA, 22 nt, Human
gagcagcuggacaggccucccu

SEQ ID NO: 754995 - RNA, 22 nt, Human
guaaacaaacucucaggccagu

SEQ ID NO: 754996 - RNA, 22 nt, Human
uaggaaacucaaagggaagugg

SEQ ID NO: 754997 - RNA, 22 nt, Human
ggcagccaugcacgcugccugg

SEQ ID NO: 754998 - RNA, 22 nt, Human
agcaccaggaaagaaggggcca

SEQ ID NO: 754999 - RNA, 23 nt, Human
auguuuuaugucucuagcugcca

SEQ ID NO: 755000 - RNA, 22 nt, Human
aggcuccacggucacuggcucu

SEQ ID NO: 755001 - RNA, 22 nt, Human
gaacuucuucuuuaagagacuc

SEQ ID NO: 755002 - RNA, 22 nt, Human
aguggcaucaaaucaagguuug

SEQ ID NO: 755003 - RNA, 22 nt, Human
agucugaaggcaaucugcugac

SEQ ID NO: 755004 - RNA, 22 nt, Human
cuaguccacuguccugccucca

SEQ ID NO: 755005 - RNA, 22 nt, Human
cagcuauuccaggaguagaauc

SEQ ID NO: 755006 - RNA, 22 nt, Human
gcugagguccagcauucgccua

SEQ ID NO: 755007 - RNA, 22 nt, Human
cuuagcuuuguccuaggucucu

SEQ ID NO: 755008 - RNA, 22 nt, Human
ggggaucuaggcuuaugagggc

SEQ ID NO: 755009 - RNA, 22 nt, Human
ucucuggguaaaguucucucau

SEQ ID NO: 755010 - RNA, 22 nt, Human
gauuucuugaccccugucucag

SEQ ID NO: 755011 - RNA, 22 nt, Human
cagcaacuuaggcagaacaucu

SEQ ID NO: 755012 - RNA, 22 nt, Human
gaggcacugagagugggggaug

SEQ ID NO: 755013 - RNA, 22 nt, Human
ucuuacagaaaauagauaacau

SEQ ID NO: 755014 - RNA, 22 nt, Human
uuguauuuggguaguauagaga

SEQ ID NO: 755015 - RNA, 22 nt, Human
acucacucuuaaucagacuccc

SEQ ID NO: 755016 - RNA, 22 nt, Human
gaggggaguaaagucauguuac

SEQ ID NO: 755017 - RNA, 22 nt, Human
gcucagagcagaugguacucag

SEQ ID NO: 755018 - RNA, 22 nt, Human
gugggagaagcccuguucguag

SEQ ID NO: 755019 - RNA, 22 nt, Human
uuucaggaaacauuuaauggca

SEQ ID NO: 755020 - RNA, 22 nt, Human
ggagccuguggccgucacgacu

SEQ ID NO: 755021 - RNA, 22 nt, Human
cuccagggcuaccagguuuuag

SEQ ID NO: 755022 - RNA, 22 nt, Human
ugcagagagccagcucucucgg

SEQ ID NO: 755023 - RNA, 22 nt, Human
cagaccuggggccugggagccc

SEQ ID NO: 755024 - RNA, 22 nt, Human
ucucccagugucuggcagucag

SEQ ID NO: 755025 - RNA, 22 nt, Human
agcuggguguagggcuggacaa

SEQ ID NO: 755026 - RNA, 19 nt, Human
aaaaagaggcuauaauauu

SEQ ID NO: 755027 - RNA, 22 nt, Human
cugcucugagaggcucuuccua

SEQ ID NO: 755028 - RNA, 22 nt, Human
gaucugagaucuaaaccagagg

SEQ ID NO: 755029 - RNA, 22 nt, Human
ugaagcccugucuuauggaaga

SEQ ID NO: 755030 - RNA, 22 nt, Human
gugaagagcuguugcagagauu

SEQ ID NO: 755031 - RNA, 22 nt, Human
gggcuggcaggaccugggcuga

SEQ ID NO: 755032 - RNA, 22 nt, Human
uguaaaagacauuucuaagcaa

SEQ ID NO: 755033 - RNA, 22 nt, Human
cucauaaagugagaauaugacc

SEQ ID NO: 755034 - RNA, 22 nt, Human
uuucuacuaagaaaguugauua

SEQ ID NO: 755035 - RNA, 22 nt, Human
ggguaugauagggaggugaaau

SEQ ID NO: 755036 - RNA, 22 nt, Human
cucauaaacauuauucauuauu

SEQ ID NO: 755037 - RNA, 22 nt, Human
guggggcugcuuaggcugcgca

SEQ ID NO: 755038 - RNA, 22 nt, Human
uggcuucuuugugacagcucuu

SEQ ID NO: 755039 - RNA, 22 nt, Human
ggcugagaguggaucccaggga

SEQ ID NO: 755040 - RNA, 22 nt, Human
uugcauuugcucauuugauaug

SEQ ID NO: 755041 - RNA, 20 nt, Human
aguuuauuccaggagaacug

SEQ ID NO: 755042 - RNA, 17 nt, Human
cauaaaacaguucuauu

SEQ ID NO: 755043 - RNA, 22 nt, Human
agggucaaaugggcaggaagag

SEQ ID NO: 755044 - RNA, 22 nt, Human
gagagaagggacuucuacacuu

SEQ ID NO: 755045 - RNA, 22 nt, Human
aagauugccccauuuacacugc

SEQ ID NO: 755046 - RNA, 22 nt, Human
gagugagggcagcaggggcugc

SEQ ID NO: 755047 - RNA, 22 nt, Human
cuucacauuugcgaaggccaaa

SEQ ID NO: 755048 - RNA, 18 nt, Human
caggaugagugaugggga

SEQ ID NO: 755049 - RNA, 22 nt, Human
ugaggcugagauaucagggagg

SEQ ID NO: 755050 - RNA, 22 nt, Human
acauagaucugugauucauucu

SEQ ID NO: 755051 - RNA, 22 nt, Human
acauuccugaggaaauacauuc

SEQ ID NO: 755052 - RNA, 22 nt, Human
uaaaucacucuucucucaccac

SEQ ID NO: 755053 - RNA, 22 nt, Human
ucagggaaaccuaaggaagcca

SEQ ID NO: 755054 - RNA, 22 nt, Human
ugagccagucugucugggugaa

SEQ ID NO: 755055 - RNA, 22 nt, Human
uuucuuccuuaccuuacuagag

SEQ ID NO: 755056 - RNA, 22 nt, Human
ggcucuguuuacuuucagaggc

SEQ ID NO: 755057 - RNA, 22 nt, Human
uagaaaugcccagauucugcua

SEQ ID NO: 755058 - RNA, 22 nt, Human
gguucauucugaagucuucagc

SEQ ID NO: 755059 - RNA, 22 nt, Human
ccucugugucagggaagagacu

SEQ ID NO: 755060 - RNA, 22 nt, Human
gcaguguuucaaaucaaaggca

SEQ ID NO: 755061 - RNA, 22 nt, Human
uccucaguuauaaauaggaaac

SEQ ID NO: 755062 - RNA, 22 nt, Human
uucugcucugacuugcaaggaa

SEQ ID NO: 755063 - RNA, 22 nt, Human
ccugagccugaguggugcaggg

SEQ ID NO: 755064 - RNA, 22 nt, Human
gcugugggccacacggcugagu

SEQ ID NO: 755065 - RNA, 22 nt, Human
gcuccuccaauauggacuccuc

SEQ ID NO: 755066 - RNA, 18 nt, Human
ugcugcccaacucucccc

SEQ ID NO: 755067 - RNA, 22 nt, Human
ucuggcuccaggaccgggcaca

SEQ ID NO: 755068 - RNA, 22 nt, Human
cucucagauggagugugaaugg

SEQ ID NO: 755069 - RNA, 22 nt, Human
acauggaucaaccuauuuucuu

SEQ ID NO: 755070 - RNA, 22 nt, Human
uagaaaucuacuuagacuuucu

SEQ ID NO: 755071 - RNA, 21 nt, Human
gccuugccgugaaagcccuuu

SEQ ID NO: 755072 - RNA, 22 nt, Human
gaaccucucagcagccaugauc

SEQ ID NO: 755073 - RNA, 22 nt, Human
ucauuuccucaaauucaagguu

SEQ ID NO: 755074 - RNA, 22 nt, Human
gcagaggacacaggagggcaag

SEQ ID NO: 755075 - RNA, 21 nt, Human
ucugggaaauugggaaagaag

SEQ ID NO: 755076 - RNA, 22 nt, Human
uacagaaaaacaucuggagccg

SEQ ID NO: 755077 - RNA, 22 nt, Human
ugcccugcagacccugcagugu

SEQ ID NO: 755078 - RNA, 22 nt, Human
uugacaaaggaccuugcuauuu

SEQ ID NO: 755079 - RNA, 22 nt, Human
uccagucuucuugcagcuacau

SEQ ID NO: 755080 - RNA, 22 nt, Human
ggaacauacuguguagacuuug

SEQ ID NO: 755081 - RNA, 22 nt, Human
ugccuguguccccuucuuggca

SEQ ID NO: 755082 - RNA, 22 nt, Human
ggacccugggcagcuggcugcu

SEQ ID NO: 755083 - RNA, 22 nt, Human
aaggcagcaacuaauggaucuc

SEQ ID NO: 755084 - RNA, 22 nt, Human
accugagagcuauaagguuuua

SEQ ID NO: 755085 - RNA, 22 nt, Human
uaaaacagcagggcagagaagu

SEQ ID NO: 755086 - RNA, 22 nt, Human
guacacaggcagcccagugcug

SEQ ID NO: 755087 - RNA, 22 nt, Human
ucaaagcacacuuagugguaga

SEQ ID NO: 755088 - RNA, 22 nt, Human
ccacuguaguuaugaugaaguu

SEQ ID NO: 755089 - RNA, 22 nt, Human
gcagcugaagcugcaguuccag

SEQ ID NO: 755090 - RNA, 19 nt, Human
uguguucauucaucagagg

SEQ ID NO: 755091 - RNA, 19 nt, Human
caagugaagccugggaugg

SEQ ID NO: 755092 - RNA, 23 nt, Human
uuuuccuguggagacaugacugg

SEQ ID NO: 755093 - RNA, 22 nt, Human
ugaucuuugguaguacgauaau

SEQ ID NO: 755094 - RNA, 22 nt, Human
cucauauucagucacugaugca

SEQ ID NO: 755095 - RNA, 17 nt, Human
uacauguguaucugauu

SEQ ID NO: 755096 - RNA, 22 nt, Human
aauaagauugacacaaguaccu

SEQ ID NO: 755097 - RNA, 22 nt, Human
ucugcccucaggguaaugauca

SEQ ID NO: 755098 - RNA, 22 nt, Human
ucacacuuuauuuauuucaugc

SEQ ID NO: 755099 - RNA, 22 nt, Human
auuugcagauucugucagguuu

SEQ ID NO: 755100 - RNA, 22 nt, Human
gagucccaugaugauagccaca

SEQ ID NO: 755101 - RNA, 22 nt, Human
gugcugagcacaccuuggagca

SEQ ID NO: 755102 - RNA, 22 nt, Human
agcagauauuuguugagcacuu

SEQ ID NO: 755103 - RNA, 22 nt, Human
agauauuuguaucuugcuauug

SEQ ID NO: 755104 - RNA, 22 nt, Human
uacauugaaagucauuuaaucc

SEQ ID NO: 755105 - RNA, 22 nt, Human
ucugggagguaaccaugcugau

SEQ ID NO: 755106 - RNA, 22 nt, Human
aguguuucaagugaugcuuugg

SEQ ID NO: 755107 - RNA, 22 nt, Human
uccagguaggccaagacagcua

SEQ ID NO: 755108 - RNA, 22 nt, Human
agaguguggaaauguucagagu

SEQ ID NO: 755109 - RNA, 22 nt, Human
agccaggcagggcucucgcucu

SEQ ID NO: 755110 - RNA, 22 nt, Human
uaagaacagugacagccaacau

SEQ ID NO: 755111 - RNA, 20 nt, Human
gcaggcagggaaugggggug

SEQ ID NO: 755112 - RNA, 22 nt, Human
ggcaguggguuccccaaggcac

SEQ ID NO: 755113 - RNA, 22 nt, Human
uuacacagugguuaagucuggg

SEQ ID NO: 755114 - RNA, 22 nt, Human
uccugaauaaauuagcugucac

SEQ ID NO: 755115 - RNA, 22 nt, Human
uucagagagaaaccagugggaa

SEQ ID NO: 755116 - RNA, 22 nt, Human
aaucagaaaggcuaaggaagca

SEQ ID NO: 755117 - RNA, 22 nt, Human
cuccaucagcuguugguugagg

SEQ ID NO: 755118 - RNA, 18 nt, Human
aguugcuuauucugugca

SEQ ID NO: 755119 - RNA, 22 nt, Human
acugcaugauaauaauagcaga

SEQ ID NO: 755120 - RNA, 22 nt, Human
agauacaacuguuuaaacauua

SEQ ID NO: 755121 - RNA, 22 nt, Human
cauuuaaugccuuugccaucca

SEQ ID NO: 755122 - RNA, 22 nt, Human
cugaugcucuggauguagucaa

SEQ ID NO: 755123 - RNA, 22 nt, Human
caaugauugcuauuuacauaaa

SEQ ID NO: 755124 - RNA, 22 nt, Human
gaaaccagauaagggaggcuga

SEQ ID NO: 755125 - RNA, 22 nt, Human
cugagcugacaucuuccucuuu

SEQ ID NO: 755126 - RNA, 22 nt, Human
gcaggccaggcuaggggcuguc

SEQ ID NO: 755127 - RNA, 22 nt, Human
gagcuggucaguuucaggagag

SEQ ID NO: 755128 - RNA, 20 nt, Human
ugugggcccuuggcuggcaa

SEQ ID NO: 755129 - RNA, 22 nt, Human
uagcaaagaagauauuauugca

SEQ ID NO: 755130 - RNA, 22 nt, Human
ggaccagagaagugagcaccug

SEQ ID NO: 755131 - RNA, 22 nt, Human
cagagcccauccuauacucucc

SEQ ID NO: 755132 - RNA, 22 nt, Human
agucagagagcucucagcauag

SEQ ID NO: 755133 - RNA, 22 nt, Human
auuucagcagcccauguuugga

SEQ ID NO: 755134 - RNA, 22 nt, Human
gacagcagguaauuaguuaaca

SEQ ID NO: 755135 - RNA, 22 nt, Human
acauguuaaacaucauggaaug

SEQ ID NO: 755136 - RNA, 22 nt, Human
cacucugcgcugggcgccagcg

SEQ ID NO: 755137 - RNA, 17 nt, Human
ucaugcccaacuauuac

SEQ ID NO: 755138 - RNA, 22 nt, Human
aaagccaguucuuagagaaagc

SEQ ID NO: 755139 - RNA, 22 nt, Human
aauccaggguguggccuuucca

SEQ ID NO: 755140 - RNA, 22 nt, Human
uaggaacacagggacuugauga

SEQ ID NO: 755141 - RNA, 22 nt, Human
cuacagcuguguguuuaugugc

SEQ ID NO: 755142 - RNA, 22 nt, Human
uuccaugcaagaaguauggcuc

SEQ ID NO: 755143 - RNA, 22 nt, Human
ugccugucuuuccucccucgua

SEQ ID NO: 755144 - RNA, 22 nt, Human
uguggccugauuuugcaucucu

SEQ ID NO: 755145 - RNA, 22 nt, Human
gguggcaucucuuuccagauuu

SEQ ID NO: 755146 - RNA, 22 nt, Human
gacauucaacuuugaugauuau

SEQ ID NO: 755147 - RNA, 21 nt, Human
agacaggucagggagagguga

SEQ ID NO: 755148 - RNA, 22 nt, Human
uuguaacagcugcuuaauagag

SEQ ID NO: 755149 - RNA, 22 nt, Human
uucagauguggcuuugucaggc

SEQ ID NO: 755150 - RNA, 19 nt, Human
aggcacagguugucuggac

SEQ ID NO: 755151 - RNA, 19 nt, Human
ugggaguggggaagguccu

SEQ ID NO: 755152 - RNA, 22 nt, Human
gcagacuguaucaaugucagua

SEQ ID NO: 755153 - RNA, 21 nt, Human
ucugggcugcugcugcccauc

SEQ ID NO: 755154 - RNA, 17 nt, Human
aauguccuuggaccaca

SEQ ID NO: 755155 - RNA, 22 nt, Human
aaggccaggccagaugacaguc

SEQ ID NO: 755156 - RNA, 22 nt, Human
uuugcauuguuucaaaagugaa

SEQ ID NO: 755157 - RNA, 22 nt, Human
gggcaugccugcgcagugcaug

SEQ ID NO: 755158 - RNA, 22 nt, Human
gcuggccuuugaggaagcugcg

SEQ ID NO: 755159 - RNA, 22 nt, Human
ugggcuuccuggagccugugcu

SEQ ID NO: 755160 - RNA, 22 nt, Human
ggagccuggcccggcccuuggc

SEQ ID NO: 755161 - RNA, 22 nt, Human
aagcagcugaaggauucagggu

SEQ ID NO: 755162 - RNA, 20 nt, Human
gguagcagcugcugucaucc

SEQ ID NO: 755163 - RNA, 22 nt, Human
caggcacuuugcugggggcgca

SEQ ID NO: 755164 - RNA, 22 nt, Human
ucagagcugugcuucaggaaag

SEQ ID NO: 755165 - RNA, 22 nt, Human
uggagggaacaaaggaguccca

SEQ ID NO: 755166 - RNA, 22 nt, Human
uuugaacagggaauguuccaca

SEQ ID NO: 755167 - RNA, 22 nt, Human
aagcagaggaccgacggaggga

SEQ ID NO: 755168 - RNA, 22 nt, Human
ucagcuuuuuacaugugaaaua

SEQ ID NO: 755169 - RNA, 22 nt, Human
gcugagggcauguguggcgacu

SEQ ID NO: 755170 - RNA, 22 nt, Human
gugcagacuuacagauuauccc

SEQ ID NO: 755171 - RNA, 22 nt, Human
gcuuucugggcuauagaacggg

SEQ ID NO: 755172 - RNA, 22 nt, Human
uauugugaguauaacugcauuu

SEQ ID NO: 755173 - RNA, 22 nt, Human
ugcauuaagcacacuuuugaau

SEQ ID NO: 755174 - RNA, 22 nt, Human
cagagccaugguaugggcuugu

SEQ ID NO: 755175 - RNA, 22 nt, Human
gucuuauaguacaauuugaagu

SEQ ID NO: 755176 - RNA, 22 nt, Human
caguuuuacccaagcuuauuuu

SEQ ID NO: 755177 - RNA, 22 nt, Human
uagaaaugauugguugagcucu

SEQ ID NO: 755178 - RNA, 22 nt, Human
gacaguggauucaucuagucaa

SEQ ID NO: 755179 - RNA, 22 nt, Human
ugggccacgugacccuuacccu

SEQ ID NO: 755180 - RNA, 22 nt, Human
gaucaggaauauuggaaaguac

SEQ ID NO: 755181 - RNA, 22 nt, Human
cagagcuuuggcuagaugguug

SEQ ID NO: 755182 - RNA, 22 nt, Human
uuugacagcuuguuacaaaguu

SEQ ID NO: 755183 - RNA, 22 nt, Human
augcaauaaauacuuuccagcu

SEQ ID NO: 755184 - RNA, 22 nt, Human
uggcagaccugaagguucggcg

SEQ ID NO: 755185 - RNA, 23 nt, Human
caugaagguagcacaaagccucu

SEQ ID NO: 755186 - RNA, 22 nt, Human
uggcucaggccuacgacgccuu

SEQ ID NO: 755187 - RNA, 22 nt, Human
cacugaaucucaaggggagggu

SEQ ID NO: 755188 - RNA, 22 nt, Human
cccuggcucuucaccaccugcc

SEQ ID NO: 755189 - RNA, 22 nt, Human
ggcauagauuucuuuagguuua

SEQ ID NO: 755190 - RNA, 20 nt, Human
uguugauuggugucaucuca

SEQ ID NO: 755191 - RNA, 22 nt, Human
aggagccaaggaaaacaguauu

SEQ ID NO: 755192 - RNA, 22 nt, Human
agcucuuccugcaccuguggcu

SEQ ID NO: 755193 - RNA, 22 nt, Human
uacacuuauaacucugugugug

SEQ ID NO: 755194 - RNA, 22 nt, Human
cugaguguuuucagccacggcc

SEQ ID NO: 755195 - RNA, 22 nt, Human
gauggcuucagucuccuugggu

SEQ ID NO: 755196 - RNA, 22 nt, Human
agaccuggaaguucaagagaaa

SEQ ID NO: 755197 - RNA, 22 nt, Human
ccucugaguccucccugguugc

SEQ ID NO: 755198 - RNA, 22 nt, Human
uucaggaagguccuauagcaga

SEQ ID NO: 755199 - RNA, 22 nt, Human
caguagggaaugugggaggcug

SEQ ID NO: 755200 - RNA, 20 nt, Human
caggcuccgcaggacuaggg

SEQ ID NO: 755201 - RNA, 22 nt, Human
ucaggagauggucuuuauaggc

SEQ ID NO: 755202 - RNA, 22 nt, Human
ggcagcugagcauggcuaccuu

SEQ ID NO: 755203 - RNA, 22 nt, Human
aggggagaguuaaugugaaugu

SEQ ID NO: 755204 - RNA, 22 nt, Human
caggagugucuccacacagcaa

SEQ ID NO: 755205 - RNA, 21 nt, Human
aggcagaaagagcccaggcug

SEQ ID NO: 755206 - RNA, 22 nt, Human
uucaagauccagcacaacagug

SEQ ID NO: 755207 - RNA, 22 nt, Human
ugcuacacuuaaaucagucacc

SEQ ID NO: 755208 - RNA, 22 nt, Human
uggcuucuaaaguuucuuuuag

SEQ ID NO: 755209 - RNA, 22 nt, Human
caggccuggcccccggcacacc

SEQ ID NO: 755210 - RNA, 22 nt, Human
auagccuugacucacagcucuu

SEQ ID NO: 755211 - RNA, 17 nt, Human
aaacaaugcagacaagc

SEQ ID NO: 755212 - RNA, 19 nt, Human
acuucugaggaacugcaca

SEQ ID NO: 755213 - RNA, 22 nt, Human
gcauguguuagagugugcaugc

SEQ ID NO: 755214 - RNA, 22 nt, Human
cugaagauucgccuuuguuuau

SEQ ID NO: 755215 - RNA, 22 nt, Human
acagcuaagggcacaggucacc

SEQ ID NO: 755216 - RNA, 22 nt, Human
uagagguuggccuuagaaagau

SEQ ID NO: 755217 - RNA, 22 nt, Human
uucucaggucaccagggugcca

SEQ ID NO: 755218 - RNA, 22 nt, Human
aaacaagguacacaguaauggu

SEQ ID NO: 755219 - RNA, 22 nt, Human
acuuagcagguggugacucgaa

SEQ ID NO: 755220 - RNA, 22 nt, Human
gacaauaaaaugaucuuacagu

SEQ ID NO: 755221 - RNA, 22 nt, Human
guuauauauaguauuucucuga

SEQ ID NO: 755222 - RNA, 22 nt, Human
gccugggauuguguaagugaau

SEQ ID NO: 755223 - RNA, 22 nt, Human
ucacuagcauuguugaaggacu

SEQ ID NO: 755224 - RNA, 22 nt, Human
gcuucuguggugcaucuuugcu

SEQ ID NO: 755225 - RNA, 22 nt, Human
uccuccagggggaucuucagcc

SEQ ID NO: 755226 - RNA, 23 nt, Human
gcagaggagcaagcuggacacca

SEQ ID NO: 755227 - RNA, 22 nt, Human
gcuuaguggugugcaaaggggu

SEQ ID NO: 755228 - RNA, 18 nt, Human
cugucuuuuuucucucca

SEQ ID NO: 755229 - RNA, 22 nt, Human
ggucccugccugaggcuggccu

SEQ ID NO: 755230 - RNA, 18 nt, Human
aguguucucguuuuauaa

SEQ ID NO: 755231 - RNA, 22 nt, Human
aagugaaucuccuuucuuuauu

SEQ ID NO: 755232 - RNA, 22 nt, Human
agggaaggaaaagcugucgcuu

SEQ ID NO: 755233 - RNA, 21 nt, Human
agaaaaaccagcauguuuuca

SEQ ID NO: 755234 - RNA, 22 nt, Human
agccaugggcucccaguccuuu

SEQ ID NO: 755235 - RNA, 22 nt, Human
ccaguucuucuugacacgaaag

SEQ ID NO: 755236 - RNA, 22 nt, Human
caggcaccucacguggguccca

SEQ ID NO: 755237 - RNA, 17 nt, Human
auggcucaccugugggc

SEQ ID NO: 755238 - RNA, 22 nt, Human
uaguuuguagaaaucuagaaau

SEQ ID NO: 755239 - RNA, 22 nt, Human
ucuggcucagggcucugaggga

SEQ ID NO: 755240 - RNA, 22 nt, Human
uaugcacuggauuacaaagcaa

SEQ ID NO: 755241 - RNA, 18 nt, Human
aggcuucccaggcaggcc

SEQ ID NO: 755242 - RNA, 22 nt, Human
gucucucucccaagauuggcua

SEQ ID NO: 755243 - RNA, 22 nt, Human
auuauugugauaggugucagug

SEQ ID NO: 755244 - RNA, 22 nt, Human
ccagaagggcuauugcagugac

SEQ ID NO: 755245 - RNA, 22 nt, Human
gggcuucauucaggcagaauuu

SEQ ID NO: 755246 - RNA, 22 nt, Human
agcuccugggccaagcccaugc

SEQ ID NO: 755247 - RNA, 22 nt, Human
agagggugagcagguacacaug

SEQ ID NO: 755248 - RNA, 22 nt, Human
acucagaggaaaguugagauug

SEQ ID NO: 755249 - RNA, 22 nt, Human
cagccaggggcuggcguguuga

SEQ ID NO: 755250 - RNA, 22 nt, Human
agcagcauuaugauauaucuua

SEQ ID NO: 755251 - RNA, 22 nt, Human
gaacaucugggaucauugcugu

SEQ ID NO: 755252 - RNA, 22 nt, Human
cucaguccuuauuugccucuac

SEQ ID NO: 755253 - RNA, 22 nt, Human
acaggcuuggggcucagacaga

SEQ ID NO: 755254 - RNA, 22 nt, Human
ugccaggcucagccccuaucuu

SEQ ID NO: 755255 - RNA, 22 nt, Human
cucagaggguacaggugaaccc

SEQ ID NO: 755256 - RNA, 22 nt, Human
cuguuccagaucaggacaccgu

SEQ ID NO: 755257 - RNA, 22 nt, Human
augucaggacccuacugcauug

SEQ ID NO: 755258 - RNA, 22 nt, Human
agagccugcuaccucauuccag

SEQ ID NO: 755259 - RNA, 22 nt, Human
acaggcaagucacacaacuugu

SEQ ID NO: 755260 - RNA, 22 nt, Human
ggcuggcuggaugaauggauua

SEQ ID NO: 755261 - RNA, 22 nt, Human
ucaacugcaaguuugcuuaguu

SEQ ID NO: 755262 - RNA, 22 nt, Human
uuaguacauugauucauuaugu

SEQ ID NO: 755263 - RNA, 22 nt, Human
uuccaguucaaauuggccaaua

SEQ ID NO: 755264 - RNA, 22 nt, Human
uuuuucugccauucaaagagga

SEQ ID NO: 755265 - RNA, 22 nt, Human
agcuuuggggguagguauagag

SEQ ID NO: 755266 - RNA, 22 nt, Human
ucauugcagugauguuguaugu

SEQ ID NO: 755267 - RNA, 22 nt, Human
ugcuuuggccacuagaauucag

SEQ ID NO: 755268 - RNA, 22 nt, Human
auuagcauauuaaauagucauu

SEQ ID NO: 755269 - RNA, 22 nt, Human
cugagcuuccaguuccuccagg

SEQ ID NO: 755270 - RNA, 22 nt, Human
ucaggaggcgugcugggguaca

SEQ ID NO: 755271 - RNA, 22 nt, Human
cucuggaauuaaggaagccugu

SEQ ID NO: 755272 - RNA, 22 nt, Human
uggcccuucugagcacagggcc

SEQ ID NO: 755273 - RNA, 22 nt, Human
guuuucuuccugcaauuggcau

SEQ ID NO: 755274 - RNA, 22 nt, Human
agcagaccaggagugcacaggu

SEQ ID NO: 755275 - RNA, 22 nt, Human
gaggccucugucccgccaggga

SEQ ID NO: 755276 - RNA, 22 nt, Human
guuauacauauguguuaacaaa

SEQ ID NO: 755277 - RNA, 22 nt, Human
gcucagaggccacuguuggaaa

SEQ ID NO: 755278 - RNA, 22 nt, Human
aaaaugagacacaugugacucc

SEQ ID NO: 755279 - RNA, 22 nt, Human
ugcugugggcaguacauaagcu

SEQ ID NO: 755280 - RNA, 22 nt, Human
aggcagucagcccugcuagggu

SEQ ID NO: 755281 - RNA, 22 nt, Human
aagugauuuagucuuauaaagg

SEQ ID NO: 755282 - RNA, 22 nt, Human
acugccuuauaugcugugugug

SEQ ID NO: 755283 - RNA, 22 nt, Human
uggcaccaccagacaccaggag

SEQ ID NO: 755284 - RNA, 22 nt, Human
cacuggcaugugaggcgguggc

SEQ ID NO: 755285 - RNA, 22 nt, Human
aagggcugaaagaccuugggca

SEQ ID NO: 755286 - RNA, 22 nt, Human
ugguccacagggaguccgugcu

SEQ ID NO: 755287 - RNA, 22 nt, Human
cccuuucuucuugacugaaaac

SEQ ID NO: 755288 - RNA, 22 nt, Human
acaacuuuaauggguuucagcu

SEQ ID NO: 755289 - RNA, 22 nt, Human
acugugugcccugacgccaggg

SEQ ID NO: 755290 - RNA, 22 nt, Human
cagcucuuugaguauuccauuu

SEQ ID NO: 755291 - RNA, 16 nt, Human
aaauggcuuaggcuua

SEQ ID NO: 755292 - RNA, 22 nt, Human
uuuaguguuugcguguacuccu

SEQ ID NO: 755293 - RNA, 22 nt, Human
acucagagauauggugguugau

SEQ ID NO: 755294 - RNA, 21 nt, Human
ucccugcuuucuggcccaguc

SEQ ID NO: 755295 - RNA, 22 nt, Human
aggaggugcguggugauccccu

SEQ ID NO: 755296 - RNA, 22 nt, Human
cuuucucuucagcacccagccc

SEQ ID NO: 755297 - RNA, 22 nt, Human
uguguacucaauugagccauuu

SEQ ID NO: 755298 - RNA, 22 nt, Human
uggccugguccuugucaaggca

SEQ ID NO: 755299 - RNA, 22 nt, Human
gaaaaguacacagcccaaacau

SEQ ID NO: 755300 - RNA, 22 nt, Human
aagagggaagucaccuggaggu

SEQ ID NO: 755301 - RNA, 22 nt, Human
ggacaggaugcugaagaugaag

SEQ ID NO: 755302 - RNA, 23 nt, Human
ucccuguguacagccugcaugag

SEQ ID NO: 755303 - RNA, 22 nt, Human
augucuuucuuauggucuguug

SEQ ID NO: 755304 - RNA, 20 nt, Human
ggccauggguugccugaggu

SEQ ID NO: 755305 - RNA, 22 nt, Human
ccauuuuucauaaacuauccaa

SEQ ID NO: 755306 - RNA, 22 nt, Human
cugugucuugaguaauucggug

SEQ ID NO: 755307 - RNA, 22 nt, Human
ugugacugaagugucuagaccu

SEQ ID NO: 755308 - RNA, 22 nt, Human
cuacuguccauaaaguauaacu

SEQ ID NO: 755309 - RNA, 23 nt, Human
aaacuucaguagugucaucagcc

SEQ ID NO: 755310 - RNA, 22 nt, Human
uagcaggaggcaguuccucgcu

SEQ ID NO: 755311 - RNA, 22 nt, Human
uuuguacagugaaagcgagguu

SEQ ID NO: 755312 - RNA, 22 nt, Human
uggcaaggaagagccuggugca

SEQ ID NO: 755313 - RNA, 20 nt, Human
cugagccaacucucuucuug

SEQ ID NO: 755314 - RNA, 22 nt, Human
caugcaaaauguauuuuauuag

SEQ ID NO: 755315 - RNA, 22 nt, Human
gcccugcccuguugaaacuaga

SEQ ID NO: 755316 - RNA, 22 nt, Human
uuccagccuuuauccauccaga

SEQ ID NO: 755317 - RNA, 22 nt, Human
acgggugguaaugagaaaagga

SEQ ID NO: 755318 - RNA, 22 nt, Human
aaagguuugaggugggaagagg

SEQ ID NO: 755319 - RNA, 22 nt, Human
agccacugugcaggagcagugu

SEQ ID NO: 755320 - RNA, 21 nt, Human
uccugggagucugagauccug

SEQ ID NO: 755321 - RNA, 22 nt, Human
guccugacggcugauuggccug

SEQ ID NO: 755322 - RNA, 22 nt, Human
cauugcuuauuucagcuaaagu

SEQ ID NO: 755323 - RNA, 22 nt, Human
caggggcggguaaaaggccucc

SEQ ID NO: 755324 - RNA, 21 nt, Human
gugucaugguugacuuuggca

SEQ ID NO: 755325 - RNA, 22 nt, Human
cuggcucagugccuucagaagu

SEQ ID NO: 755326 - RNA, 22 nt, Human
cuguacaggugaggagggggcu

SEQ ID NO: 755327 - RNA, 19 nt, Human
ucucacaucagcuccuagc

SEQ ID NO: 755328 - RNA, 20 nt, Human
ucacuaguaaccaucugcuu

SEQ ID NO: 755329 - RNA, 21 nt, Human
caccuuauagauaaaauuaga

SEQ ID NO: 755330 - RNA, 20 nt, Human
caugagaagggcagugugag

SEQ ID NO: 755331 - RNA, 22 nt, Human
gauuaugguagaaacaagaagu

SEQ ID NO: 755332 - RNA, 22 nt, Human
ugagccagagagguugaggcua

SEQ ID NO: 755333 - RNA, 22 nt, Human
uaugcaguguacgauguuuagu

SEQ ID NO: 755334 - RNA, 22 nt, Human
uagcccagauacaaaucaugau

SEQ ID NO: 755335 - RNA, 22 nt, Human
agggcuccgggccaccggccug

SEQ ID NO: 755336 - RNA, 20 nt, Human
uggacagaauuagacacuuu

SEQ ID NO: 755337 - RNA, 20 nt, Human
aagcagaagcugcucucagc

SEQ ID NO: 755338 - RNA, 19 nt, Human
ucagaggauuuggcuauga

SEQ ID NO: 755339 - RNA, 22 nt, Human
guagcccaccuggggagggcga

SEQ ID NO: 755340 - RNA, 22 nt, Human
ucugccugcggcugcagguggc

SEQ ID NO: 755341 - RNA, 22 nt, Human
augcauaucagugauuguuugc

SEQ ID NO: 755342 - RNA, 22 nt, Human
uggguaaacaauguuugccuaa

SEQ ID NO: 755343 - RNA, 22 nt, Human
agcagggcuucugugccugugc

SEQ ID NO: 755344 - RNA, 22 nt, Human
cagaaguggcaucauucaagag

SEQ ID NO: 755345 - RNA, 22 nt, Human
gcugccugauguccagcaggac

SEQ ID NO: 755346 - RNA, 22 nt, Human
uggcagccaucugagggugggg

SEQ ID NO: 755347 - RNA, 22 nt, Human
cagagcugggaucccaugggcg

SEQ ID NO: 755348 - RNA, 22 nt, Human
gcauucccaaaagacacuuacc

SEQ ID NO: 755349 - RNA, 20 nt, Human
acuaaggugguagcagcagg

SEQ ID NO: 755350 - RNA, 22 nt, Human
cuccaggugcagaaggacucag

SEQ ID NO: 755351 - RNA, 22 nt, Human
ugcaaaucauaaacaauagugu

SEQ ID NO: 755352 - RNA, 22 nt, Human
aaugucaauuaccagaacagaa

SEQ ID NO: 755353 - RNA, 22 nt, Human
gcucugccagacacuguggcca

SEQ ID NO: 755354 - RNA, 22 nt, Human
ggaggccaggaagagccgcccu

SEQ ID NO: 755355 - RNA, 20 nt, Human
caucuccugccuccauguuc

SEQ ID NO: 755356 - RNA, 22 nt, Human
ugagcaggagauaaacagguag

SEQ ID NO: 755357 - RNA, 22 nt, Human
gggcuugcuaagaagagcgcau

SEQ ID NO: 755358 - RNA, 22 nt, Human
ggcaccugcucaucuggacuca

SEQ ID NO: 755359 - RNA, 22 nt, Human
ccacacagucaguuuccaagaa

SEQ ID NO: 755360 - RNA, 22 nt, Human
gagcagcucgagaaggaagcag

SEQ ID NO: 755361 - RNA, 22 nt, Human
gaguagcauucuagaguaugcu

SEQ ID NO: 755362 - RNA, 22 nt, Human
uggcuucuugggaugggucauu

SEQ ID NO: 755363 - RNA, 22 nt, Human
agagugcaaccgaaacaagcag

SEQ ID NO: 755364 - RNA, 22 nt, Human
auauaauacaaccugcuaagug

SEQ ID NO: 755365 - RNA, 22 nt, Human
ugcacacaguggacaagucuug

SEQ ID NO: 755366 - RNA, 22 nt, Human
agaugcagacuugguucaggca

SEQ ID NO: 755367 - RNA, 22 nt, Human
cucucugggcccaguuggcacc

SEQ ID NO: 755368 - RNA, 22 nt, Human
agugcaugaaagcauacaaggc

SEQ ID NO: 755369 - RNA, 22 nt, Human
auuagauuguaaauguuuucac

SEQ ID NO: 755370 - RNA, 22 nt, Human
uuucugaacaaagccauuauca

SEQ ID NO: 755371 - RNA, 22 nt, Human
caggcagcugcgacaagagagc

SEQ ID NO: 755372 - RNA, 22 nt, Human
aaagcacuugaaaucuggcagu

SEQ ID NO: 755373 - RNA, 22 nt, Human
gaggaugcugcagugcaggaca

SEQ ID NO: 755374 - RNA, 22 nt, Human
agcaggugggaucaagcuggca

SEQ ID NO: 755375 - RNA, 22 nt, Human
uccagguaucuuuaugaaacuu

SEQ ID NO: 755376 - RNA, 22 nt, Human
caguaugcaguugaaaauaagc

SEQ ID NO: 755377 - RNA, 22 nt, Human
ucacuguaauagguuugaagau

SEQ ID NO: 755378 - RNA, 22 nt, Human
ugccucagucuaaagucucuca

SEQ ID NO: 755379 - RNA, 22 nt, Human
ucuggaaaagcgauaaaccauu

SEQ ID NO: 755380 - RNA, 22 nt, Human
uauuucccagggagcaacaagc

SEQ ID NO: 755381 - RNA, 22 nt, Human
aauuucaaagcucacuggcaua

SEQ ID NO: 755382 - RNA, 22 nt, Human
cacaggaaggccuucucacaau

SEQ ID NO: 755383 - RNA, 22 nt, Human
acagcaguucaggccgcagagg

SEQ ID NO: 755384 - RNA, 22 nt, Human
ugugaauaccuugaauucauca

SEQ ID NO: 755385 - RNA, 22 nt, Human
ccaguggaaauguggucaggau

SEQ ID NO: 755386 - RNA, 22 nt, Human
gugucgugcuugccauggguac

SEQ ID NO: 755387 - RNA, 22 nt, Human
gggcugugagaguggggcugcu

SEQ ID NO: 755388 - RNA, 22 nt, Human
uuuauuguuguuagucauaagu

SEQ ID NO: 755389 - RNA, 22 nt, Human
cucagagaaccuaagcggagga

SEQ ID NO: 755390 - RNA, 22 nt, Human
uccuuccuggggucucugcugc

SEQ ID NO: 755391 - RNA, 22 nt, Human
auggcagccuguggacagucaa

SEQ ID NO: 755392 - RNA, 22 nt, Human
aaguuuacauaagugaugauga

SEQ ID NO: 755393 - RNA, 22 nt, Human
uucugcauuauacacaaccuaa

SEQ ID NO: 755394 - RNA, 20 nt, Human
ucugccacugcacucugccc

SEQ ID NO: 755395 - RNA, 22 nt, Human
aagugcauauuuuuguuguaga

SEQ ID NO: 755396 - RNA, 23 nt, Human
uugcacauuggagcuggucuucu

SEQ ID NO: 755397 - RNA, 22 nt, Human
gucccuaguggaaagacaugau

SEQ ID NO: 755398 - RNA, 22 nt, Human
auaacuuucuucacccuugcug

SEQ ID NO: 755399 - RNA, 23 nt, Human
ugcguacggcugccagugugacu

SEQ ID NO: 755400 - RNA, 19 nt, Human
uggguuggaagggaaugaa

SEQ ID NO: 755401 - RNA, 22 nt, Human
gccccaggauaaauuuguaaga

SEQ ID NO: 755402 - RNA, 23 nt, Human
ggggaaguggcagugagugaggc

SEQ ID NO: 755403 - RNA, 20 nt, Human
aacuuguuuuguuuucuaau

SEQ ID NO: 755404 - RNA, 22 nt, Human
uuuaaucucccacucucagccu

SEQ ID NO: 755405 - RNA, 22 nt, Human
gggagacaagaaguagccugcu

SEQ ID NO: 755406 - RNA, 22 nt, Human
aucauuaaauauaagcuucaca

SEQ ID NO: 755407 - RNA, 22 nt, Human
caggaggcaguuucagaaguca

SEQ ID NO: 755408 - RNA, 22 nt, Human
caaauaauuacuauccucacuu

SEQ ID NO: 755409 - RNA, 22 nt, Human
auuucucagugaaaugacaggc

SEQ ID NO: 755410 - RNA, 19 nt, Human
gauuucuacaaaugucaga

SEQ ID NO: 755411 - RNA, 22 nt, Human
gugugggugggacaucaucuuu

SEQ ID NO: 755412 - RNA, 22 nt, Human
ugcugcuuuggaacuccacagg

SEQ ID NO: 755413 - RNA, 22 nt, Human
ugcugacuccuggcugugacac

SEQ ID NO: 755414 - RNA, 22 nt, Human
agacaaauggaguaugagcaac

SEQ ID NO: 755415 - RNA, 22 nt, Human
acuaaauauuugagagguguag

SEQ ID NO: 755416 - RNA, 22 nt, Human
ccaugccucgggaagagucugu

SEQ ID NO: 755417 - RNA, 22 nt, Human
gcagacuggucuucagccuugg

SEQ ID NO: 755418 - RNA, 22 nt, Human
uccgggcaacugaagggagguu

SEQ ID NO: 755419 - RNA, 22 nt, Human
acguuuuauucccaugcagcau

SEQ ID NO: 755420 - RNA, 22 nt, Human
uaauuccaaguugagacaugca

SEQ ID NO: 755421 - RNA, 22 nt, Human
caggccagagcgcgugguuggg

SEQ ID NO: 755422 - RNA, 22 nt, Human
gcucccuccaugaggcagaccg

SEQ ID NO: 755423 - RNA, 22 nt, Human
ucugagaacuccggguuagauc

SEQ ID NO: 755424 - RNA, 22 nt, Human
ugagaaccucgaagauuuugcc

SEQ ID NO: 755425 - RNA, 19 nt, Human
gaaagauuucaguugagga

SEQ ID NO: 755426 - RNA, 18 nt, Human
aaugaaauguacaccuuu

SEQ ID NO: 755427 - RNA, 22 nt, Human
caccccagcuucucaggauaga

SEQ ID NO: 755428 - RNA, 22 nt, Human
gaaagaaugcuauagugacuuc

SEQ ID NO: 755429 - RNA, 22 nt, Human
ggucugaaauuaugucacugcu

SEQ ID NO: 755430 - RNA, 22 nt, Human
gaggaggggacaguacuugugc

SEQ ID NO: 755431 - RNA, 22 nt, Human
ucugccuuggcaaccacagcuu

SEQ ID NO: 755432 - RNA, 22 nt, Human
cuauuuguacagcauuaguaau

SEQ ID NO: 755433 - RNA, 22 nt, Human
agguucagaguuguugauguuu

SEQ ID NO: 755434 - RNA, 22 nt, Human
acagaauugggguucuugggga

SEQ ID NO: 755435 - RNA, 22 nt, Human
gaccaggcccaggugcaaggga

SEQ ID NO: 755436 - RNA, 22 nt, Human
cuggagggacuuucucacggau

SEQ ID NO: 755437 - RNA, 22 nt, Human
acacucuguaaugucacacucc

SEQ ID NO: 755438 - RNA, 22 nt, Human
ggagucaccugggaggacuggg

SEQ ID NO: 755439 - RNA, 22 nt, Human
ugggaauugaggugauugugag

SEQ ID NO: 755440 - RNA, 22 nt, Human
gacuucaugacauucaggucag

SEQ ID NO: 755441 - RNA, 18 nt, Human
cucucugggugaggacaa

SEQ ID NO: 755442 - RNA, 22 nt, Human
uccucccuaaauccuagacugu

SEQ ID NO: 755443 - RNA, 20 nt, Human
uuccagccgccacuuccgcc

SEQ ID NO: 755444 - RNA, 18 nt, Human
auccugggagcagacagc

SEQ ID NO: 755445 - RNA, 17 nt, Human
cugaggcccagggccca

SEQ ID NO: 755446 - RNA, 22 nt, Human
ugagcacacuccuggugagcga

SEQ ID NO: 755447 - RNA, 22 nt, Human
uacuuuaucagcgucaaaggua

SEQ ID NO: 755448 - RNA, 22 nt, Human
cugccuguuuucugauagauuu

SEQ ID NO: 755449 - RNA, 22 nt, Human
uaggcaccaccuagggugaccc

SEQ ID NO: 755450 - RNA, 23 nt, Human
ugaagguauuaccugagaugcuc

SEQ ID NO: 755451 - RNA, 22 nt, Human
uaaaggcaguucugauuagguc

SEQ ID NO: 755452 - RNA, 22 nt, Human
uaucuuggcuugaaagaugcuu

SEQ ID NO: 755453 - RNA, 22 nt, Human
aacauuuaugguagucauugca

SEQ ID NO: 755454 - RNA, 22 nt, Human
gcaggcugugaggcucagaugg

SEQ ID NO: 755455 - RNA, 22 nt, Human
acucuaccaugccacuccauag

SEQ ID NO: 755456 - RNA, 22 nt, Human
agauuuguugugagcaggaaua

SEQ ID NO: 755457 - RNA, 22 nt, Human
ugcuauaagcuccacgcuguag

SEQ ID NO: 755458 - RNA, 22 nt, Human
uuccucuguaguugcugaugaa

SEQ ID NO: 755459 - RNA, 22 nt, Human
uggguggcggccugguucugag

SEQ ID NO: 755460 - RNA, 22 nt, Human
augcaugugcauggcucuaucu

SEQ ID NO: 755461 - RNA, 22 nt, Human
ucaggggaaaucucucagcgaa

SEQ ID NO: 755462 - RNA, 22 nt, Human
ugccaguguggaacuaggaaga

SEQ ID NO: 755463 - RNA, 22 nt, Human
uaagccugcaugaaccaugaga

SEQ ID NO: 755464 - RNA, 22 nt, Human
uauuaggguuuugaagguuugu

SEQ ID NO: 755465 - RNA, 22 nt, Human
uccauuggucucugugcccagg

SEQ ID NO: 755466 - RNA, 22 nt, Human
cacauguacagaagcaggcugg

SEQ ID NO: 755467 - RNA, 19 nt, Human
gggcaucaaagugcuggug

SEQ ID NO: 755468 - RNA, 22 nt, Human
cagcaggcccaggugcugguga

SEQ ID NO: 755469 - RNA, 22 nt, Human
agugugagggguucuuugauau

SEQ ID NO: 755470 - RNA, 23 nt, Human
ugggggugcacgggccacaucuu

SEQ ID NO: 755471 - RNA, 22 nt, Human
aggaagaugggagagcucugga

SEQ ID NO: 755472 - RNA, 18 nt, Human
ucugaggaauggaagagc

SEQ ID NO: 755473 - RNA, 22 nt, Human
uacauagaacauguuuaauguc

SEQ ID NO: 755474 - RNA, 22 nt, Human
uagcuacaaucacuguccuuug

SEQ ID NO: 755475 - RNA, 22 nt, Human
agagaagagucuugucaaauua

SEQ ID NO: 755476 - RNA, 22 nt, Human
agguccagagguugaacggugg

SEQ ID NO: 755477 - RNA, 22 nt, Human
gcugggcuguaguuugcugacc

SEQ ID NO: 755478 - RNA, 22 nt, Human
cugagguacaagaaaggcaccu

SEQ ID NO: 755479 - RNA, 22 nt, Human
accuuuggauaaucuuuguguu

SEQ ID NO: 755480 - RNA, 22 nt, Human
agauauucuagaaccuaguaga

SEQ ID NO: 755481 - RNA, 22 nt, Human
uuaaaguaaucugugugaauuu

SEQ ID NO: 755482 - RNA, 23 nt, Human
gccagagcugccugcccuugcug

SEQ ID NO: 755483 - RNA, 22 nt, Human
gcucugucauuuugcagacacu

SEQ ID NO: 755484 - RNA, 22 nt, Human
uggacaggcaagcaagacauac

SEQ ID NO: 755485 - RNA, 19 nt, Human
ucagggccaugagcgccac

SEQ ID NO: 755486 - RNA, 22 nt, Human
uugauuuuuccagcuucuagag

SEQ ID NO: 755487 - RNA, 22 nt, Human
cagcagagguuuugcuccauga

SEQ ID NO: 755488 - RNA, 22 nt, Human
cacauuuagguuccuauagcca

SEQ ID NO: 755489 - RNA, 21 nt, Human
aacugagaccagcuaaagugg

SEQ ID NO: 755490 - RNA, 22 nt, Human
gcaacaaguguaaacaugcauu

SEQ ID NO: 755491 - RNA, 22 nt, Human
gccucuggucccucaugcugug

SEQ ID NO: 755492 - RNA, 22 nt, Human
aagugguugcuugugagucccc

SEQ ID NO: 755493 - RNA, 22 nt, Human
acuuucugucaucuagacaagu

SEQ ID NO: 755494 - RNA, 22 nt, Human
agcugccacaugcccaagggca

SEQ ID NO: 755495 - RNA, 21 nt, Human
auaaacugcaucaaguuggug

SEQ ID NO: 755496 - RNA, 22 nt, Human
aaguaaaccacagagaagccac

SEQ ID NO: 755497 - RNA, 22 nt, Human
uguuuuuguucaaugcuagguc

SEQ ID NO: 755498 - RNA, 22 nt, Human
uugaggucuucaggaucaggcu

SEQ ID NO: 755499 - RNA, 22 nt, Human
caugcuuucuguccaaauguua

SEQ ID NO: 755500 - RNA, 22 nt, Human
uucagggcagacagaagagaug

SEQ ID NO: 755501 - RNA, 22 nt, Human
cucaaguaagaaacagaauugg

SEQ ID NO: 755502 - RNA, 22 nt, Human
uucuacaauaugaauaaugaag

SEQ ID NO: 755503 - RNA, 22 nt, Human
ugcaggucuccauuggcagacu

SEQ ID NO: 755504 - RNA, 22 nt, Human
ucagaagcagaaaauagguggg

SEQ ID NO: 755505 - RNA, 22 nt, Human
gacagacaggaggccaccugcu

SEQ ID NO: 755506 - RNA, 22 nt, Human
gagaaacuaacaucugaaggug

SEQ ID NO: 755507 - RNA, 22 nt, Human
guuuuauaguucgggaccuguu

SEQ ID NO: 755508 - RNA, 22 nt, Human
auuucucacccuaccucacucc

SEQ ID NO: 755509 - RNA, 18 nt, Human
ggagcccagaggugaguu

SEQ ID NO: 755510 - RNA, 22 nt, Human
uuguggcucaucuucagcuccc

SEQ ID NO: 755511 - RNA, 22 nt, Human
cagugcagguggcagaggacag

SEQ ID NO: 755512 - RNA, 22 nt, Human
aaaguagaguuguggaauuacu

SEQ ID NO: 755513 - RNA, 22 nt, Human
guuauucuagugcucagccauu

SEQ ID NO: 755514 - RNA, 22 nt, Human
cuggcagcuuccuuugcaucug

SEQ ID NO: 755515 - RNA, 22 nt, Human
agaauuagguaaguucaucuga

SEQ ID NO: 755516 - RNA, 22 nt, Human
acccagggaccccgcugacgcc

SEQ ID NO: 755517 - RNA, 22 nt, Human
auagcaauuaagcuccagaauu

SEQ ID NO: 755518 - RNA, 22 nt, Human
uacuggagauggaaugcuuuug

SEQ ID NO: 755519 - RNA, 22 nt, Human
ccuugccucauugugcuucucc

SEQ ID NO: 755520 - RNA, 22 nt, Human
uacaagaugacaggugcaugau

SEQ ID NO: 755521 - RNA, 22 nt, Human
auuugcugaaucaaugaauuuu

SEQ ID NO: 755522 - RNA, 22 nt, Human
acucugagccaccagaucccca

SEQ ID NO: 755523 - RNA, 22 nt, Human
ccagggccuacagcuuaagucc

SEQ ID NO: 755524 - RNA, 22 nt, Human
ggaggacucaggucuggccaug

SEQ ID NO: 755525 - RNA, 22 nt, Human
aggcaaagcgauaccagagcua

SEQ ID NO: 755526 - RNA, 22 nt, Human
uuggcgcccaggacgccgccgc

SEQ ID NO: 755527 - RNA, 22 nt, Human
uucccugaagaccucaugugac

SEQ ID NO: 755528 - RNA, 22 nt, Human
acaggaucgcccuguugcccag

SEQ ID NO: 755529 - RNA, 22 nt, Human
acuggcagccacaacuggcagg

SEQ ID NO: 755530 - RNA, 22 nt, Human
gagucaggcuagggugacaggc

SEQ ID NO: 755531 - RNA, 22 nt, Human
uucugauaauaccacaucgcag

SEQ ID NO: 755532 - RNA, 22 nt, Human
gguguccucacuauagcaaguc

SEQ ID NO: 755533 - RNA, 22 nt, Human
aucuguuccccuaugcucucua

SEQ ID NO: 755534 - RNA, 22 nt, Human
acauuuaccuaguuaagucaau

SEQ ID NO: 755535 - RNA, 22 nt, Human
guagaggggugauucugugaga

SEQ ID NO: 755536 - RNA, 19 nt, Human
agcacaguuuccacaugca

SEQ ID NO: 755537 - RNA, 22 nt, Human
agugugagaacggacuaauaaa

SEQ ID NO: 755538 - RNA, 22 nt, Human
acaugcuuucuagguccuucug

SEQ ID NO: 755539 - RNA, 22 nt, Human
agcuccuggcaaggucauggug

SEQ ID NO: 755540 - RNA, 22 nt, Human
agguccuguguccaggggccug

SEQ ID NO: 755541 - RNA, 22 nt, Human
ugauaaacuggagagguggagg

SEQ ID NO: 755542 - RNA, 22 nt, Human
uggagcugagagccaggcuggc

SEQ ID NO: 755543 - RNA, 22 nt, Human
uugacuguacaaccuuuuguag

SEQ ID NO: 755544 - RNA, 22 nt, Human
gcugcagagacagcugccgaug

SEQ ID NO: 755545 - RNA, 20 nt, Human
aucagcaacugccacucagu

SEQ ID NO: 755546 - RNA, 22 nt, Human
uuagaucauuuuagcuaaaugg

SEQ ID NO: 755547 - RNA, 22 nt, Human
uccaggcccacucagcugaaau

SEQ ID NO: 755548 - RNA, 22 nt, Human
agaaucaggaccuguggcuguc

SEQ ID NO: 755549 - RNA, 22 nt, Human
ccuggacuugauauucucuuuc

SEQ ID NO: 755550 - RNA, 22 nt, Human
uggaggcaugacagugucugga

SEQ ID NO: 755551 - RNA, 22 nt, Human
augucucucucugagugccaga

SEQ ID NO: 755552 - RNA, 22 nt, Human
guugucuuagucagaaauaugc

SEQ ID NO: 755553 - RNA, 22 nt, Human
guaucacuuuugagagugagaa

SEQ ID NO: 755554 - RNA, 22 nt, Human
gaaguauuucugaguugcccag

SEQ ID NO: 755555 - RNA, 22 nt, Human
ccagcagccaccuucucgaaau

SEQ ID NO: 755556 - RNA, 22 nt, Human
uucucaggugaggcugaggcug

SEQ ID NO: 755557 - RNA, 22 nt, Human
cacaggaacuuacuggccacuu

SEQ ID NO: 755558 - RNA, 22 nt, Human
gcacaaauacaaaguugagaaa

SEQ ID NO: 755559 - RNA, 22 nt, Human
cugaaugagggauucugagggc

SEQ ID NO: 755560 - RNA, 22 nt, Human
ggugugccacuucacugagcag

SEQ ID NO: 755561 - RNA, 23 nt, Human
ucuuuagaagaacaucagaaaug

SEQ ID NO: 755562 - RNA, 21 nt, Human
aggacacagagacaccuauug

SEQ ID NO: 755563 - RNA, 22 nt, Human
cagggagcggagucccaugccu

SEQ ID NO: 755564 - RNA, 22 nt, Human
cuagcuuuuuaugacaaucuug

SEQ ID NO: 755565 - RNA, 22 nt, Human
ccagaacugggcaacagaaagu

SEQ ID NO: 755566 - RNA, 22 nt, Human
uguaaaaggaaaucaaagcacu

SEQ ID NO: 755567 - RNA, 22 nt, Human
gucagcagaaacgccacaugca

SEQ ID NO: 755568 - RNA, 22 nt, Human
cugggaggcagucucucuagaa

SEQ ID NO: 755569 - RNA, 22 nt, Human
gagcacagugcaguuucugcua

SEQ ID NO: 755570 - RNA, 22 nt, Human
aauaugcagcuuaucuucuagg

SEQ ID NO: 755571 - RNA, 21 nt, Human
agaaggcaaaagcagacaucu

SEQ ID NO: 755572 - RNA, 22 nt, Human
acagaacugagaauucucuauc

SEQ ID NO: 755573 - RNA, 21 nt, Human
aggaaguggccagauugggaa

SEQ ID NO: 755574 - RNA, 22 nt, Human
agucccagugagaugagccacg

SEQ ID NO: 755575 - RNA, 22 nt, Human
ggaaggggagcuaaaucuacug

SEQ ID NO: 755576 - RNA, 22 nt, Human
ccugaguugucaguugcuguag

SEQ ID NO: 755577 - RNA, 22 nt, Human
uuugacagagcucuuagucucu

SEQ ID NO: 755578 - RNA, 22 nt, Human
aaguucuugauaaguccacugu

SEQ ID NO: 755579 - RNA, 22 nt, Human
acaguucaagacaucaguauga

SEQ ID NO: 755580 - RNA, 22 nt, Human
ugcuggguuaccuaagccuaaa

SEQ ID NO: 755581 - RNA, 22 nt, Human
augacagaggauuguaaagagg

SEQ ID NO: 755582 - RNA, 22 nt, Human
ugugaacuuacuguccccacag

SEQ ID NO: 755583 - RNA, 22 nt, Human
ugcaggaauauugaugaacuua

SEQ ID NO: 755584 - RNA, 22 nt, Human
ucccugagcugagcucaacagc

SEQ ID NO: 755585 - RNA, 22 nt, Human
auuuguaagcuagagccaugau

SEQ ID NO: 755586 - RNA, 22 nt, Human
acucuauaaagauaccucaauu

SEQ ID NO: 755587 - RNA, 18 nt, Human
cugcugcaggcacucagg

SEQ ID NO: 755588 - RNA, 22 nt, Human
ccucauggaccucagacugucc

SEQ ID NO: 755589 - RNA, 22 nt, Human
ggcaagaaggcuucagguagcu

SEQ ID NO: 755590 - RNA, 22 nt, Human
cagacaauuaaguaauugaggu

SEQ ID NO: 755591 - RNA, 22 nt, Human
cugagcugggcaacucuuagau

SEQ ID NO: 755592 - RNA, 21 nt, Human
ucagcagcuuuugcagucccu

SEQ ID NO: 755593 - RNA, 22 nt, Human
gagcagaacuacucacauaucg

SEQ ID NO: 755594 - RNA, 22 nt, Human
cucugccaucuuggagcucaag

SEQ ID NO: 755595 - RNA, 22 nt, Human
uucaauaucucuaagaaugagg

SEQ ID NO: 755596 - RNA, 22 nt, Human
aaacugcaauuauguuugcaga

SEQ ID NO: 755597 - RNA, 22 nt, Human
agaaaccagggcuuaccagugc

SEQ ID NO: 755598 - RNA, 22 nt, Human
cuuccagguucugguugggaag

SEQ ID NO: 755599 - RNA, 22 nt, Human
gcuggaaaaggaggcaaaauau

SEQ ID NO: 755600 - RNA, 22 nt, Human
ugggcugaaaugcuguggacua

SEQ ID NO: 755601 - RNA, 22 nt, Human
uacucagagucauugcccuucu

SEQ ID NO: 755602 - RNA, 22 nt, Human
cuucacagucacccugcugugu

SEQ ID NO: 755603 - RNA, 22 nt, Human
cagugagagagaacgcauucau

SEQ ID NO: 755604 - RNA, 22 nt, Human
uuauuaaucuuaucuuuggaaa

SEQ ID NO: 755605 - RNA, 22 nt, Human
ugguggcaaaguacaaagugac

SEQ ID NO: 755606 - RNA, 22 nt, Human
guucaaauuuuggcuguacugc

SEQ ID NO: 755607 - RNA, 22 nt, Human
cauauuucagucuaagaugugu

SEQ ID NO: 755608 - RNA, 22 nt, Human
agccagggaugcagcacaguga

SEQ ID NO: 755609 - RNA, 22 nt, Human
uagauaaauuagaaaguuuacu

SEQ ID NO: 755610 - RNA, 23 nt, Human
cugaggccugcugcguucagguu

SEQ ID NO: 755611 - RNA, 22 nt, Human
ugcuccuggcaucucugcgucc

SEQ ID NO: 755612 - RNA, 22 nt, Human
uggugucuccauccugcccugc

SEQ ID NO: 755613 - RNA, 22 nt, Human
uauuuccaggccccacucuaga

SEQ ID NO: 755614 - RNA, 22 nt, Human
cccugguggggccagacuugcu

SEQ ID NO: 755615 - RNA, 22 nt, Human
uucaggaugaaagugugcaaca

SEQ ID NO: 755616 - RNA, 22 nt, Human
uuuuggcuccagugguuugugc

SEQ ID NO: 755617 - RNA, 22 nt, Human
caauacugaguuuacauucauc

SEQ ID NO: 755618 - RNA, 22 nt, Human
ccagucccagcucugccaugcu

SEQ ID NO: 755619 - RNA, 22 nt, Human
aguucacuuucuguaguggaag

SEQ ID NO: 755620 - RNA, 22 nt, Human
aauacagauauucagugguacu

SEQ ID NO: 755621 - RNA, 22 nt, Human
acuucagagaaagagggaauuc

SEQ ID NO: 755622 - RNA, 22 nt, Human
aguggcugguaguuacugagca

SEQ ID NO: 755623 - RNA, 22 nt, Human
gcugccagccagggugggaucc

SEQ ID NO: 755624 - RNA, 22 nt, Human
cuccucugucuggcccugagcc

SEQ ID NO: 755625 - RNA, 22 nt, Human
uugcuaacgcucacccuuugcc

SEQ ID NO: 755626 - RNA, 22 nt, Human
ggaagagagggcugggccucaa

SEQ ID NO: 755627 - RNA, 19 nt, Human
uggcagggagugauauuag

SEQ ID NO: 755628 - RNA, 21 nt, Human
ggccuuccccugcagucuccg

SEQ ID NO: 755629 - RNA, 22 nt, Human
uuugugaauggaauccacagac

SEQ ID NO: 755630 - RNA, 22 nt, Human
uccaggagguaugaguggcccc

SEQ ID NO: 755631 - RNA, 22 nt, Human
guccuuugaaggcaaaaggaga

SEQ ID NO: 755632 - RNA, 22 nt, Human
acagcuggccgaggcucaggga

SEQ ID NO: 755633 - RNA, 22 nt, Human
aggaaugauucaagacuuggcu

SEQ ID NO: 755634 - RNA, 22 nt, Human
aauuggacugugcugcucaaaa

SEQ ID NO: 755635 - RNA, 22 nt, Human
uuacagagguauguaugucucu

SEQ ID NO: 755636 - RNA, 22 nt, Human
ugccugcugccacugcuguuac

SEQ ID NO: 755637 - RNA, 22 nt, Human
ccuuugggugaauuccucucuu

SEQ ID NO: 755638 - RNA, 22 nt, Human
gaacuagaauguucugauggag

SEQ ID NO: 755639 - RNA, 22 nt, Human
uugcaaaggggaauaaagcaau

SEQ ID NO: 755640 - RNA, 22 nt, Human
cccagccuuccacccuggacua

SEQ ID NO: 755641 - RNA, 22 nt, Human
gaaggcugcugggaaguguggu

SEQ ID NO: 755642 - RNA, 22 nt, Human
ucuucuggaugagagcggaggc

SEQ ID NO: 755643 - RNA, 20 nt, Human
uccaugcaguuuccauacag

SEQ ID NO: 755644 - RNA, 22 nt, Human
uguccugugaccuggcaccaca

SEQ ID NO: 755645 - RNA, 22 nt, Human
agggcuuuggcccccugcugca

SEQ ID NO: 755646 - RNA, 22 nt, Human
aacaacagugagugcugggagg

SEQ ID NO: 755647 - RNA, 22 nt, Human
ggcugugggaugcauaggagcu

SEQ ID NO: 755648 - RNA, 22 nt, Human
gccagagccggcuucacaggau

SEQ ID NO: 755649 - RNA, 22 nt, Human
agcccugguuugcagcauuugc

SEQ ID NO: 755650 - RNA, 23 nt, Human
caggaaaucaauucuuccagcau

SEQ ID NO: 755651 - RNA, 22 nt, Human
cucuccagaauuauuacuauua

SEQ ID NO: 755652 - RNA, 22 nt, Human
gcuggcaccuauuuggaccugg

SEQ ID NO: 755653 - RNA, 22 nt, Human
ucacaugaggcauccccgggca

SEQ ID NO: 755654 - RNA, 22 nt, Human
aggccacaggcacccuguguuc

SEQ ID NO: 755655 - RNA, 22 nt, Human
uuuccaugaucguuauagaacu

SEQ ID NO: 755656 - RNA, 22 nt, Human
aguauauugcucuuaaucauag

SEQ ID NO: 755657 - RNA, 22 nt, Human
aggagacauaacuaugaugaga

SEQ ID NO: 755658 - RNA, 22 nt, Human
ucccagagaagagcuggaugga

SEQ ID NO: 755659 - RNA, 22 nt, Human
gauugaaaggucuuuaaauugg

SEQ ID NO: 755660 - RNA, 22 nt, Human
auggcuugucuaugagugcucu

SEQ ID NO: 755661 - RNA, 22 nt, Human
uaaagucagauaucuggguuga

SEQ ID NO: 755662 - RNA, 22 nt, Human
ccauguacaugaacacggcggc

SEQ ID NO: 755663 - RNA, 22 nt, Human
aucugcuuguugcaugucuguu

SEQ ID NO: 755664 - RNA, 23 nt, Human
uggagcugacagucagagggagg

SEQ ID NO: 755665 - RNA, 22 nt, Human
acucacuucuuuuacuauaaaa

SEQ ID NO: 755666 - RNA, 22 nt, Human
gggcuucugggcaccacucccu

SEQ ID NO: 755667 - RNA, 22 nt, Human
caugcauauuacuagcacagca

SEQ ID NO: 755668 - RNA, 22 nt, Human
acagguguccucacagggggug

SEQ ID NO: 755669 - RNA, 22 nt, Human
gggacgggcacggagggcccuc

SEQ ID NO: 755670 - RNA, 22 nt, Human
aggagugcaaauaguccagaga

SEQ ID NO: 755671 - RNA, 22 nt, Human
ucaccagucuuucuuaccauug

SEQ ID NO: 755672 - RNA, 22 nt, Human
ugugaagaauuaaugugaauca

SEQ ID NO: 755673 - RNA, 22 nt, Human
gcugagaggcagccagacccuc

SEQ ID NO: 755674 - RNA, 22 nt, Human
uugugaguagugccgcaauaaa

SEQ ID NO: 755675 - RNA, 22 nt, Human
uucagcauuucuguuguuggcu

SEQ ID NO: 755676 - RNA, 22 nt, Human
ucucuggguccuggcaagcuca

SEQ ID NO: 755677 - RNA, 19 nt, Human
uagaagcagggaagcugag

SEQ ID NO: 755678 - RNA, 22 nt, Human
ggggugggagugccauccuuga

SEQ ID NO: 755679 - RNA, 22 nt, Human
acuaaagaagccaaaguuuucu

SEQ ID NO: 755680 - RNA, 22 nt, Human
uguccuuuaugaaaugguguuu

SEQ ID NO: 755681 - RNA, 22 nt, Human
ccucagucauuggccuacacuu

SEQ ID NO: 755682 - RNA, 20 nt, Human
ugagucagcugcaugggugg

SEQ ID NO: 755683 - RNA, 22 nt, Human
uuuaggaaguuucagauaggaa

SEQ ID NO: 755684 - RNA, 22 nt, Human
aagaguuuucucugauggcauu

SEQ ID NO: 755685 - RNA, 22 nt, Human
aguuuauagcccagauucaugg

SEQ ID NO: 755686 - RNA, 22 nt, Human
agagccugaggccaggaaaaug

SEQ ID NO: 755687 - RNA, 22 nt, Human
aauagcucacugauuucucuuu

SEQ ID NO: 755688 - RNA, 22 nt, Human
uuauuccagugggugguuucuc

SEQ ID NO: 755689 - RNA, 22 nt, Human
ucaccggcagacguggccugau

SEQ ID NO: 755690 - RNA, 20 nt, Human
aacuugucuuccuguuuggc

SEQ ID NO: 755691 - RNA, 22 nt, Human
gaauacauggcagggagucauc

SEQ ID NO: 755692 - RNA, 19 nt, Human
gccuuugggcguuguuggg

SEQ ID NO: 755693 - RNA, 22 nt, Human
ggaagccuaaagcccaggucuc

SEQ ID NO: 755694 - RNA, 22 nt, Human
cugcagggaccacaagcagguu

SEQ ID NO: 755695 - RNA, 20 nt, Human
cugcugagagccuggcuugc

SEQ ID NO: 755696 - RNA, 22 nt, Human
gggcucagcuccuuccuuccua

SEQ ID NO: 755697 - RNA, 22 nt, Human
gggccugugcacaguucuguua

SEQ ID NO: 755698 - RNA, 22 nt, Human
gaggcaagaaaggacuuucuag

SEQ ID NO: 755699 - RNA, 22 nt, Human
agucucagaaaauaugcuuuuu

SEQ ID NO: 755700 - RNA, 22 nt, Human
uuucuucagccacuccaaacug

SEQ ID NO: 755701 - RNA, 22 nt, Human
ucccagagcccaaguuggagag

SEQ ID NO: 755702 - RNA, 21 nt, Human
auggcugguggcucagccucc

SEQ ID NO: 755703 - RNA, 22 nt, Human
guuugcauguguacuuaauugg

SEQ ID NO: 755704 - RNA, 22 nt, Human
auacaugacacugggcuacagg

SEQ ID NO: 755705 - RNA, 22 nt, Human
cccaggucucccugcagcccug

SEQ ID NO: 755706 - RNA, 22 nt, Human
uacagaauauuucugcccugag

SEQ ID NO: 755707 - RNA, 22 nt, Human
cugggcuggguuuacccucuuc

SEQ ID NO: 755708 - RNA, 22 nt, Human
ucuaggccguaggauacagagc

SEQ ID NO: 755709 - RNA, 22 nt, Human
ucugcagaaggaaucagcugag

SEQ ID NO: 755710 - RNA, 22 nt, Human
aaugugcuccaauugucuacuu

SEQ ID NO: 755711 - RNA, 22 nt, Human
ucaggcugggagacaaucacug

SEQ ID NO: 755712 - RNA, 21 nt, Human
uacaugaguguaugagcauau

SEQ ID NO: 755713 - RNA, 22 nt, Human
aguagauuucugcugaagcuuu

SEQ ID NO: 755714 - RNA, 22 nt, Human
auuuugcuacaguugguggaaa

SEQ ID NO: 755715 - RNA, 22 nt, Human
acagucuaaucuuguguucugu

SEQ ID NO: 755716 - RNA, 22 nt, Human
uacaauacuuaaccuauuuugc

SEQ ID NO: 755717 - RNA, 22 nt, Human
uaucauaaguuaauuaaacagu

SEQ ID NO: 755718 - RNA, 22 nt, Human
acagcagagacacucaggaggc

SEQ ID NO: 755719 - RNA, 22 nt, Human
cugugcauuguugaguguuuag

SEQ ID NO: 755720 - RNA, 22 nt, Human
cuguacuuuugcaggucacagc

SEQ ID NO: 755721 - RNA, 22 nt, Human
aagaacagguucuagaaccauu

SEQ ID NO: 755722 - RNA, 22 nt, Human
uuggcuuccaggaucucagcag

SEQ ID NO: 755723 - RNA, 22 nt, Human
gggcacugugcuaggugcugag

SEQ ID NO: 755724 - RNA, 22 nt, Human
gagcccugcuuccaagggggca

SEQ ID NO: 755725 - RNA, 20 nt, Human
aguaggcaaaggaaagaucu

SEQ ID NO: 755726 - RNA, 22 nt, Human
cacugaagcuuucauucucuug

SEQ ID NO: 755727 - RNA, 22 nt, Human
aagucacagaguuggaagucag

SEQ ID NO: 755728 - RNA, 22 nt, Human
ugcucagagcuccagcucuccu

SEQ ID NO: 755729 - RNA, 22 nt, Human
caaacuuucaguuauaacauga

SEQ ID NO: 755730 - RNA, 22 nt, Human
ucucagagagcuguguuuuccu

SEQ ID NO: 755731 - RNA, 22 nt, Human
cuggcucuaagugucagcuccc

SEQ ID NO: 755732 - RNA, 22 nt, Human
auguuuuaugcuucagaugagg

SEQ ID NO: 755733 - RNA, 22 nt, Human
cagccacuggugccaggcuguu

SEQ ID NO: 755734 - RNA, 22 nt, Human
cacaggaaucagcauuaauggc

SEQ ID NO: 755735 - RNA, 21 nt, Human
uuggaaucuuaggaguguggg

SEQ ID NO: 755736 - RNA, 22 nt, Human
agcagcuggguccggcggagca

SEQ ID NO: 755737 - RNA, 22 nt, Human
ugcauccuguucuagguuuggg

SEQ ID NO: 755738 - RNA, 22 nt, Human
aggcugugcauuuuggagggcc

SEQ ID NO: 755739 - RNA, 22 nt, Human
uguggccucaaggcugcccuca

SEQ ID NO: 755740 - RNA, 22 nt, Human
agaagccaauucugugugaguc

SEQ ID NO: 755741 - RNA, 22 nt, Human
uggagguacauaaugagagggu

SEQ ID NO: 755742 - RNA, 22 nt, Human
aagcuucaguggacuguagugu

SEQ ID NO: 755743 - RNA, 22 nt, Human
cuugguaaaacugucuuaaauu

SEQ ID NO: 755744 - RNA, 22 nt, Human
cagaacauucacucauaugugg

SEQ ID NO: 755745 - RNA, 22 nt, Human
agucucuuauucccuauugcug

SEQ ID NO: 755746 - RNA, 22 nt, Human
cucuguaccuggcauagcaacc

SEQ ID NO: 755747 - RNA, 22 nt, Human
agucaccaucuguggcagccug

SEQ ID NO: 755748 - RNA, 22 nt, Human
cucuuacaagcucccgauauaa

SEQ ID NO: 755749 - RNA, 22 nt, Human
agggugggcuagacucuucccc

SEQ ID NO: 755750 - RNA, 22 nt, Human
uagcagcuggggcuauucauca

SEQ ID NO: 755751 - RNA, 22 nt, Human
gcuggcaggauagaagucuaau

SEQ ID NO: 755752 - RNA, 22 nt, Human
aucaggcuaguguguguguuca

SEQ ID NO: 755753 - RNA, 22 nt, Human
cagagccuaaaacgacuccacu

SEQ ID NO: 755754 - RNA, 22 nt, Human
augggcugaggaagcuccugag

SEQ ID NO: 755755 - RNA, 22 nt, Human
agcagcuggugagcaagcucag

SEQ ID NO: 755756 - RNA, 22 nt, Human
ccaguguuccagagagcugaug

SEQ ID NO: 755757 - RNA, 22 nt, Human
gauucuggguccugugucuugc

SEQ ID NO: 755758 - RNA, 22 nt, Human
cucccuggcagccgcacuccug

SEQ ID NO: 755759 - RNA, 22 nt, Human
gaucauugaacaggcacuggag

SEQ ID NO: 755760 - RNA, 22 nt, Human
acagauuuugguauuugcaaug

SEQ ID NO: 755761 - RNA, 22 nt, Human
cacaauuuuccuuuaaguguau

SEQ ID NO: 755762 - RNA, 22 nt, Human
aguacagaccugucucuuccug

SEQ ID NO: 755763 - RNA, 22 nt, Human
auccugaaaacuuacgaagugg

SEQ ID NO: 755764 - RNA, 22 nt, Human
agcagcagaggucagaaaggua

SEQ ID NO: 755765 - RNA, 22 nt, Human
auccguuuuuaugaaaugucca

SEQ ID NO: 755766 - RNA, 22 nt, Human
acagcucuucuucaagccuggc

SEQ ID NO: 755767 - RNA, 22 nt, Human
uuauccaaacuggugaaucauu

SEQ ID NO: 755768 - RNA, 22 nt, Human
ggcucuggcgagcuuuaguaca

SEQ ID NO: 755769 - RNA, 22 nt, Human
aacugaacagcaggcuucuacc

SEQ ID NO: 755770 - RNA, 23 nt, Human
ccugaagggucaggguccucagc

SEQ ID NO: 755771 - RNA, 22 nt, Human
ucuuugcaguucugauuaaaua

SEQ ID NO: 755772 - RNA, 22 nt, Human
aguggcuguaggcuaugagaga

SEQ ID NO: 755773 - RNA, 22 nt, Human
ccucuggcauagcaaguggccu

SEQ ID NO: 755774 - RNA, 22 nt, Human
cauggcaggaaggacaugcacu

SEQ ID NO: 755775 - RNA, 22 nt, Human
cggggagaacacuguguccuuc

SEQ ID NO: 755776 - RNA, 22 nt, Human
ccaggagguggagauugcagug

SEQ ID NO: 755777 - RNA, 22 nt, Human
cccucccugaagaaguuacucu

SEQ ID NO: 755778 - RNA, 22 nt, Human
guguacaguaagugaaucuagg

SEQ ID NO: 755779 - RNA, 22 nt, Human
aggucuggaggcggagucagga

SEQ ID NO: 755780 - RNA, 22 nt, Human
auguguauuuauuuggggcuua

SEQ ID NO: 755781 - RNA, 22 nt, Human
gcacugggaaugagggcagcuu

SEQ ID NO: 755782 - RNA, 22 nt, Human
gacccaggcccaaggcugccag

SEQ ID NO: 755783 - RNA, 22 nt, Human
agcaggguccugaggugaguca

SEQ ID NO: 755784 - RNA, 22 nt, Human
gcucaggagcugacagccucaa

SEQ ID NO: 755785 - RNA, 22 nt, Human
gggcucuggaaaugggagcucc

SEQ ID NO: 755786 - RNA, 22 nt, Human
ggagcccuugcugaccuuccaa

SEQ ID NO: 755787 - RNA, 22 nt, Human
aacaugucuuacuuugcuuucu

SEQ ID NO: 755788 - RNA, 21 nt, Human
uagagaugacgagcucuagca

SEQ ID NO: 755789 - RNA, 20 nt, Human
cuccucaguuccaugggagg

SEQ ID NO: 755790 - RNA, 22 nt, Human
cccuggcaugcaugucccuggc

SEQ ID NO: 755791 - RNA, 22 nt, Human
agggagaaugaccaagguauau

SEQ ID NO: 755792 - RNA, 22 nt, Human
aagcaacuggcucauugucuca

SEQ ID NO: 755793 - RNA, 22 nt, Human
cuggcucucgcugggaguacuu

SEQ ID NO: 755794 - RNA, 22 nt, Human
aaggcugaggagggccugcagg

SEQ ID NO: 755795 - RNA, 23 nt, Human
agcuccaggugauuguaaugugu

SEQ ID NO: 755796 - RNA, 20 nt, Human
acuccagguggcaugaggac

SEQ ID NO: 755797 - RNA, 22 nt, Human
agucuccacuugacaucagcag

SEQ ID NO: 755798 - RNA, 21 nt, Human
uucaaugaaaacaaagugagg

SEQ ID NO: 755799 - RNA, 16 nt, Human
uaugugugugggagug

SEQ ID NO: 755800 - RNA, 22 nt, Human
aaccucuacauccaggaaagga

SEQ ID NO: 755801 - RNA, 22 nt, Human
uuuggacaaaugucugacuuuc

SEQ ID NO: 755802 - RNA, 20 nt, Human
ccugggcucaaagcauccuc

SEQ ID NO: 755803 - RNA, 22 nt, Human
gggaccugccaaggccacccag

SEQ ID NO: 755804 - RNA, 22 nt, Human
gagccaagcaccacauuaaguu

SEQ ID NO: 755805 - RNA, 22 nt, Human
aacuaguaaaagcaacaguaua

SEQ ID NO: 755806 - RNA, 22 nt, Human
ggcucagaaggccaugcucugc

SEQ ID NO: 755807 - RNA, 22 nt, Human
uuucucuuaaugucucugugcu

SEQ ID NO: 755808 - RNA, 22 nt, Human
acagcaucuaguacagucuagu

SEQ ID NO: 755809 - RNA, 22 nt, Human
uccucuggggcgugguccugga

SEQ ID NO: 755810 - RNA, 22 nt, Human
ucccaagagcucugggauaagg

SEQ ID NO: 755811 - RNA, 22 nt, Human
ccugggcuuccacgagcagagg

SEQ ID NO: 755812 - RNA, 22 nt, Human
ccuggguccacccugugaagua

SEQ ID NO: 755813 - RNA, 22 nt, Human
aacuugcagacaccugucucaa

SEQ ID NO: 755814 - RNA, 22 nt, Human
uggcugagagcaauugacucug

SEQ ID NO: 755815 - RNA, 23 nt, Human
aggaaggagguccuaacaguauc

SEQ ID NO: 755816 - RNA, 22 nt, Human
cuacuagaucaguaugccucaa

SEQ ID NO: 755817 - RNA, 17 nt, Human
ucugcucugccaaucca

SEQ ID NO: 755818 - RNA, 22 nt, Human
agcacagagaaacuaagacauu

SEQ ID NO: 755819 - RNA, 22 nt, Human
cuuuacauccuguuucccguuu

SEQ ID NO: 755820 - RNA, 21 nt, Human
agcugccuccacuucugaggc

SEQ ID NO: 755821 - RNA, 22 nt, Human
ccagcuccucuucccaguguca

SEQ ID NO: 755822 - RNA, 22 nt, Human
gaggaagcagggcuuggcugag

SEQ ID NO: 755823 - RNA, 22 nt, Human
agaggaaacauagguuuuuaaa

SEQ ID NO: 755824 - RNA, 22 nt, Human
uuugaucagcaagauaaauaga

SEQ ID NO: 755825 - RNA, 22 nt, Human
gaggagaggcuggacgcgguga

SEQ ID NO: 755826 - RNA, 22 nt, Human
gcauucuuugaaugcuucuaau

SEQ ID NO: 755827 - RNA, 22 nt, Human
uacaucauaauaauacuuagaa

SEQ ID NO: 755828 - RNA, 22 nt, Human
uacagugcuugguaucuaguaa

SEQ ID NO: 755829 - RNA, 22 nt, Human
cuuuggaagugaccacaauccu

SEQ ID NO: 755830 - RNA, 23 nt, Human
acaguuauagcugugaauaacau

SEQ ID NO: 755831 - RNA, 22 nt, Human
uucagcacccucugaggcaucc

SEQ ID NO: 755832 - RNA, 22 nt, Human
ccuucagccuuuguuuaucaga

SEQ ID NO: 755833 - RNA, 23 nt, Human
agucuuacugucccagaacaggg

SEQ ID NO: 755834 - RNA, 22 nt, Human
cuguuacuaaucuuuucugcua

SEQ ID NO: 755835 - RNA, 22 nt, Human
gaccacacuuuggaaaucacga

SEQ ID NO: 755836 - RNA, 22 nt, Human
ggcugggcuccgggagcaugcg

SEQ ID NO: 755837 - RNA, 22 nt, Human
gugagguccugagaggcuugug

SEQ ID NO: 755838 - RNA, 22 nt, Human
uucaaguuaccuuuaaacagcu

SEQ ID NO: 755839 - RNA, 22 nt, Human
guuucuuauuugcagguugcuu

SEQ ID NO: 755840 - RNA, 22 nt, Human
uuggcagacugacaaucuguuu

SEQ ID NO: 755841 - RNA, 19 nt, Human
agagucugugcucuuccua

SEQ ID NO: 755842 - RNA, 22 nt, Human
uguacaagcaaauagaccuuca

SEQ ID NO: 755843 - RNA, 22 nt, Human
gcccucagcuccuggacacaug

SEQ ID NO: 755844 - RNA, 22 nt, Human
uuccaaggcaacagccuaggcu

SEQ ID NO: 755845 - RNA, 22 nt, Human
gcaugguggagucugagcaggg

SEQ ID NO: 755846 - RNA, 22 nt, Human
aggcuggaaaucacuagauucc

SEQ ID NO: 755847 - RNA, 22 nt, Human
uggcaggauuugcccggaagga

SEQ ID NO: 755848 - RNA, 19 nt, Human
uggaggcaagacauggagg

SEQ ID NO: 755849 - RNA, 22 nt, Human
cagguggaucucuaaggacuga

SEQ ID NO: 755850 - RNA, 22 nt, Human
ucuggagaccugcauuuauauu

SEQ ID NO: 755851 - RNA, 22 nt, Human
cagcugagucugagguucuuug

SEQ ID NO: 755852 - RNA, 22 nt, Human
ccuuggcugaggagggagcuga

SEQ ID NO: 755853 - RNA, 22 nt, Human
ugguggggcuuuccuucugcuu

SEQ ID NO: 755854 - RNA, 22 nt, Human
ggggcuucuuucugccaccgac

SEQ ID NO: 755855 - RNA, 22 nt, Human
gaaaguaacauuucuugaauua

SEQ ID NO: 755856 - RNA, 22 nt, Human
aaauccuaaggagaauaugauu

SEQ ID NO: 755857 - RNA, 22 nt, Human
uuuacaguaagguggaugguac

SEQ ID NO: 755858 - RNA, 22 nt, Human
gauuacacguuuuuaaucacau

SEQ ID NO: 755859 - RNA, 19 nt, Human
augcagagaauggcaguag

SEQ ID NO: 755860 - RNA, 22 nt, Human
gcugacugcucagggccagcug

SEQ ID NO: 755861 - RNA, 22 nt, Human
agagaacaugacguaauagugg

SEQ ID NO: 755862 - RNA, 19 nt, Human
acccucucagugccugagg

SEQ ID NO: 755863 - RNA, 22 nt, Human
guccccagcuaaucucuuugcc

SEQ ID NO: 755864 - RNA, 22 nt, Human
ggaagcuggacaggcuuugagu

SEQ ID NO: 755865 - RNA, 22 nt, Human
uacuuacauaaaaacugaaugu

SEQ ID NO: 755866 - RNA, 22 nt, Human
uuucuacaugucaguaacugau

SEQ ID NO: 755867 - RNA, 22 nt, Human
cauuuaauagaugcuguuucag

SEQ ID NO: 755868 - RNA, 22 nt, Human
uucauugaguuacugccugggc

SEQ ID NO: 755869 - RNA, 22 nt, Human
guacaugcagauuauagcuaau

SEQ ID NO: 755870 - RNA, 22 nt, Human
ccucccguauauguccugggcu

SEQ ID NO: 755871 - RNA, 22 nt, Human
cagagcucagagcagggcacuc

SEQ ID NO: 755872 - RNA, 22 nt, Human
uuguucuagccuccuguuuuga

SEQ ID NO: 755873 - RNA, 22 nt, Human
uuucuaaguaucuugcaguuuu

SEQ ID NO: 755874 - RNA, 22 nt, Human
gggcucugggauucagagcaag

SEQ ID NO: 755875 - RNA, 22 nt, Human
uagagcuagcuucaaaaugcga

SEQ ID NO: 755876 - RNA, 22 nt, Human
uucucugggacaggaacaguuu

SEQ ID NO: 755877 - RNA, 22 nt, Human
agggcuaggaauggaacuggag

SEQ ID NO: 755878 - RNA, 21 nt, Human
uguuuucuaaagggcggauca

SEQ ID NO: 755879 - RNA, 20 nt, Human
ugcuggcacggguggacucc

SEQ ID NO: 755880 - RNA, 22 nt, Human
ucucagagcaucauuuucuuag

SEQ ID NO: 755881 - RNA, 22 nt, Human
aucuuuuaugagcguucugaca

SEQ ID NO: 755882 - RNA, 22 nt, Human
aacagacauauuuuuaauaugc

SEQ ID NO: 755883 - RNA, 22 nt, Human
guggcuuggaccagucacagug

SEQ ID NO: 755884 - RNA, 22 nt, Human
uggugugaggcgggaguguagu

SEQ ID NO: 755885 - RNA, 22 nt, Human
aaggccaacuaggaugagcuag

SEQ ID NO: 755886 - RNA, 22 nt, Human
gcugucucauacaaggcccugc

SEQ ID NO: 755887 - RNA, 22 nt, Human
auuuugcuuuauguaaauaugu

SEQ ID NO: 755888 - RNA, 22 nt, Human
gggccuggugcuucugacuccu

SEQ ID NO: 755889 - RNA, 22 nt, Human
acugcacuucacccugggugac

SEQ ID NO: 755890 - RNA, 22 nt, Human
uucccugagucucccugagucu

SEQ ID NO: 755891 - RNA, 22 nt, Human
gagcaggaugggagcuggggcc

SEQ ID NO: 755892 - RNA, 17 nt, Human
ggcuuccagguggcucu

SEQ ID NO: 755893 - RNA, 22 nt, Human
gcugcugggaaugaacaguguu

SEQ ID NO: 755894 - RNA, 22 nt, Human
agcuuucuucuaguuguacagu

SEQ ID NO: 755895 - RNA, 22 nt, Human
aguggggcggacaggaccagga

SEQ ID NO: 755896 - RNA, 22 nt, Human
ugcccugugccagacuuccugg

SEQ ID NO: 755897 - RNA, 22 nt, Human
uucaaugcauauagauauagaa

SEQ ID NO: 755898 - RNA, 22 nt, Human
agaaaucuuuccugaaguguuu

SEQ ID NO: 755899 - RNA, 22 nt, Human
uguaauggaagugggauugcau

SEQ ID NO: 755900 - RNA, 22 nt, Human
gucacuguuuccuauuauauuu

SEQ ID NO: 755901 - RNA, 22 nt, Human
gggagcugggcugguuuugcug

SEQ ID NO: 755902 - RNA, 22 nt, Human
cuggguucuuggcacagcagga

SEQ ID NO: 755903 - RNA, 22 nt, Human
guuagggagucagguggcucuu

SEQ ID NO: 755904 - RNA, 22 nt, Human
aucauguacuugacaaauaugu

SEQ ID NO: 755905 - RNA, 22 nt, Human
cacagaggucugggcccagcag

SEQ ID NO: 755906 - RNA, 22 nt, Human
gcacagggagacagccguggcc

SEQ ID NO: 755907 - RNA, 22 nt, Human
uuauguucagcaucugcuuuau

SEQ ID NO: 755908 - RNA, 22 nt, Human
ugcagagagcccugccuuccuc

SEQ ID NO: 755909 - RNA, 22 nt, Human
caggugacccucucaccugcuu

SEQ ID NO: 755910 - RNA, 22 nt, Human
agagccagauggagccgugugu

SEQ ID NO: 755911 - RNA, 22 nt, Human
gggcuucaaaauuggcacucuu

SEQ ID NO: 755912 - RNA, 22 nt, Human
agggcuccaggggcugggugac

SEQ ID NO: 755913 - RNA, 23 nt, Human
ucguugaauagcaauagcacaac

SEQ ID NO: 755914 - RNA, 22 nt, Human
aagugucuucugauggggugug

SEQ ID NO: 755915 - RNA, 22 nt, Human
uugagcaagaguaggaacugaa

SEQ ID NO: 755916 - RNA, 22 nt, Human
agacauuuugcaauggguagcu

SEQ ID NO: 755917 - RNA, 21 nt, Human
gccaccucaaucuucuagcgc

SEQ ID NO: 755918 - RNA, 22 nt, Human
gucacaaaggugagggacauga

SEQ ID NO: 755919 - RNA, 22 nt, Human
aaggagucugggccauucagag

SEQ ID NO: 755920 - RNA, 22 nt, Human
guguuuggucagacguccgggg

SEQ ID NO: 755921 - RNA, 22 nt, Human
aaggcucucugauggcagcagu

SEQ ID NO: 755922 - RNA, 22 nt, Human
auggaaagccaguguuccauca

SEQ ID NO: 755923 - RNA, 22 nt, Human
ucaguguugaauuuuuugcaaa

SEQ ID NO: 755924 - RNA, 23 nt, Human
gcccucaguagaaaauguuagaa

SEQ ID NO: 755925 - RNA, 22 nt, Human
cuggguuuuauuacagugagcu

SEQ ID NO: 755926 - RNA, 22 nt, Human
uguagcacagagcuuugacacu

SEQ ID NO: 755927 - RNA, 22 nt, Human
gagcuggcuccgccaugcugcu

SEQ ID NO: 755928 - RNA, 22 nt, Human
gguggggccagggcuccaaccu

SEQ ID NO: 755929 - RNA, 22 nt, Human
ccuucugugugcccacguuuau

SEQ ID NO: 755930 - RNA, 22 nt, Human
gcagagcauguccucaggacag

SEQ ID NO: 755931 - RNA, 22 nt, Human
ugggacagggaaucugaucccc

SEQ ID NO: 755932 - RNA, 22 nt, Human
cuuauugaaagccccugugccu

SEQ ID NO: 755933 - RNA, 22 nt, Human
ugcuugggaauguggagucaga

SEQ ID NO: 755934 - RNA, 20 nt, Human
ugagaggacauuuuucaugu

SEQ ID NO: 755935 - RNA, 22 nt, Human
uucugaaaccacugaccaacua

SEQ ID NO: 755936 - RNA, 22 nt, Human
uuucaguucaucugugaagauu

SEQ ID NO: 755937 - RNA, 19 nt, Human
guuuuucccagacgaggca

SEQ ID NO: 755938 - RNA, 22 nt, Human
uggacaggaucugagacugaga

SEQ ID NO: 755939 - RNA, 22 nt, Human
cugcagggcuguggucuggagu

SEQ ID NO: 755940 - RNA, 20 nt, Human
ccacagaggacagggcugug

SEQ ID NO: 755941 - RNA, 22 nt, Human
uuuaaugugagucccuuucaag

SEQ ID NO: 755942 - RNA, 22 nt, Human
cuccagugcgcaggacagcccc

SEQ ID NO: 755943 - RNA, 22 nt, Human
uuuuggaaugaggaacauccag

SEQ ID NO: 755944 - RNA, 22 nt, Human
aucuuuaaagacaugugaacuu

SEQ ID NO: 755945 - RNA, 22 nt, Human
cucauccaccgcagccccucag

SEQ ID NO: 755946 - RNA, 22 nt, Human
gcagcugccccgacugugaguc

SEQ ID NO: 755947 - RNA, 22 nt, Human
aaagcagccugcucauccugga

SEQ ID NO: 755948 - RNA, 22 nt, Human
uggcaggcggagguugcaguga

SEQ ID NO: 755949 - RNA, 22 nt, Human
uccuagagaugcaauuugauuu

SEQ ID NO: 755950 - RNA, 22 nt, Human
acuuugcagagccagaagagaa

SEQ ID NO: 755951 - RNA, 19 nt, Human
ccaaaagcaauuccaagua

SEQ ID NO: 755952 - RNA, 22 nt, Human
gggccacaggccuugcccgcag

SEQ ID NO: 755953 - RNA, 22 nt, Human
aaaugcauguauguaauaugcu

SEQ ID NO: 755954 - RNA, 22 nt, Human
gcugcagcccugcggaucacuu

SEQ ID NO: 755955 - RNA, 22 nt, Human
uccaggcuggagugcaguggcg

SEQ ID NO: 755956 - RNA, 22 nt, Human
accaucaguacuggaugcugac

SEQ ID NO: 755957 - RNA, 22 nt, Human
gaugccugcauuucaggagagu

SEQ ID NO: 755958 - RNA, 22 nt, Human
agcugccuggagucauuuccug

SEQ ID NO: 755959 - RNA, 22 nt, Human
acugccaccuggugguccugga

SEQ ID NO: 755960 - RNA, 22 nt, Human
uacugcauaacuggcauguggg

SEQ ID NO: 755961 - RNA, 21 nt, Human
aagcuuccaaacugcuggacu

SEQ ID NO: 755962 - RNA, 22 nt, Human
gccacguugccacccgggugac

SEQ ID NO: 755963 - RNA, 22 nt, Human
ccacuggcuuuuccuaggucuc

SEQ ID NO: 755964 - RNA, 22 nt, Human
cacugggcuuuguaguuagcau

SEQ ID NO: 755965 - RNA, 22 nt, Human
cuucagaaauaacaacaauuac

SEQ ID NO: 755966 - RNA, 22 nt, Human
ugcuuaauacguauuugcugga

SEQ ID NO: 755967 - RNA, 22 nt, Human
uacuaggcaauuauguaaauaa

SEQ ID NO: 755968 - RNA, 18 nt, Human
acagaacucaggggcacc

SEQ ID NO: 755969 - RNA, 23 nt, Human
aggaacugaggccuagggaggua

SEQ ID NO: 755970 - RNA, 22 nt, Human
auucucuggucauugaguauaa

SEQ ID NO: 755971 - RNA, 23 nt, Human
ucuauacauacugcagccucugg

SEQ ID NO: 755972 - RNA, 22 nt, Human
uccaggucuuccuauuccaggu

SEQ ID NO: 755973 - RNA, 22 nt, Human
acagccagucaucucagcaggg

SEQ ID NO: 755974 - RNA, 22 nt, Human
guuggcacuucauaauaugaaa

SEQ ID NO: 755975 - RNA, 22 nt, Human
gcacuggggucauagccuccag

SEQ ID NO: 755976 - RNA, 21 nt, Human
cagacaugagucucagcuuug

SEQ ID NO: 755977 - RNA, 22 nt, Human
ggaguuaaggccuaagaaauag

SEQ ID NO: 755978 - RNA, 22 nt, Human
ggcugugacccccacaggggug

SEQ ID NO: 755979 - RNA, 22 nt, Human
guauuuuacugcucaaagcucu

SEQ ID NO: 755980 - RNA, 22 nt, Human
cugugugcauaguugugcucaa

SEQ ID NO: 755981 - RNA, 20 nt, Human
ggaaaaguacuccuccuuaa

SEQ ID NO: 755982 - RNA, 22 nt, Human
auuguggcuagacagucacaau

SEQ ID NO: 755983 - RNA, 22 nt, Human
ucaguuuucucauuuaugagau

SEQ ID NO: 755984 - RNA, 22 nt, Human
aacaaacucaaauggaagagug

SEQ ID NO: 755985 - RNA, 22 nt, Human
ccaggugcugaccggucagauu

SEQ ID NO: 755986 - RNA, 16 nt, Human
ugggaccuguggccaa

SEQ ID NO: 755987 - RNA, 22 nt, Human
uagaaacagagagauaugcccc

SEQ ID NO: 755988 - RNA, 22 nt, Human
auguauugucucuuuuccuuaa

SEQ ID NO: 755989 - RNA, 22 nt, Human
uggggagaguuacaaggaaucu

SEQ ID NO: 755990 - RNA, 22 nt, Human
aaaugcacagaaaggaugugga

SEQ ID NO: 755991 - RNA, 22 nt, Human
uucagcuugcugacugcggcag

SEQ ID NO: 755992 - RNA, 22 nt, Human
uccucagcuuugguuuacucau

SEQ ID NO: 755993 - RNA, 22 nt, Human
ucaaaucaccaaacucacuggc

SEQ ID NO: 755994 - RNA, 22 nt, Human
auugucuucugucuuauaguuc

SEQ ID NO: 755995 - RNA, 22 nt, Human
ggaggccaggguggguggaucg

SEQ ID NO: 755996 - RNA, 22 nt, Human
cacaauuacuuuugcaccaaca

SEQ ID NO: 755997 - RNA, 22 nt, Human
ucugaacaugaugucaucugga

SEQ ID NO: 755998 - RNA, 22 nt, Human
agaggcugggcaggacccacag

SEQ ID NO: 755999 - RNA, 22 nt, Human
cuuuaugagccuugugaaggag

SEQ ID NO: 756000 - RNA, 22 nt, Human
ccauuucauugccuguaaagug

SEQ ID NO: 756001 - RNA, 22 nt, Human
uacaaaugaaccaacuuugaug

SEQ ID NO: 756002 - RNA, 22 nt, Human
uaugcuuugguagagaguugug

SEQ ID NO: 756003 - RNA, 22 nt, Human
uauuagaaaggcuauugcauag

SEQ ID NO: 756004 - RNA, 22 nt, Human
cccagggacagaugggcagcua

SEQ ID NO: 756005 - RNA, 21 nt, Human
uccucccugagcuguggggga

SEQ ID NO: 756006 - RNA, 22 nt, Human
auggaauauagucuuauaucuc

SEQ ID NO: 756007 - RNA, 22 nt, Human
agcacagagguggaaguguaua

SEQ ID NO: 756008 - RNA, 22 nt, Human
ucugguggugggccacaagcau

SEQ ID NO: 756009 - RNA, 22 nt, Human
cagcccugcuggcaaugaugag

SEQ ID NO: 756010 - RNA, 22 nt, Human
ccagccuugacugccccagcac

SEQ ID NO: 756011 - RNA, 22 nt, Human
guacuucccugggaggcaagca

SEQ ID NO: 756012 - RNA, 22 nt, Human
uggcaagcagagucuggugggg

SEQ ID NO: 756013 - RNA, 22 nt, Human
acuuccuguuaugugugccucu

SEQ ID NO: 756014 - RNA, 22 nt, Human
uggcucagugcauucacaguaa

SEQ ID NO: 756015 - RNA, 22 nt, Human
uagcaaagaggagaccuaggca

SEQ ID NO: 756016 - RNA, 22 nt, Human
cuacagaguucacaggauuuua

SEQ ID NO: 756017 - RNA, 22 nt, Human
cauguauauuuuauguggagag

SEQ ID NO: 756018 - RNA, 17 nt, Human
gguguauggggagggaa

SEQ ID NO: 756019 - RNA, 22 nt, Human
ucaucugucugagagacuucug

SEQ ID NO: 756020 - RNA, 23 nt, Human
gggcagguuuuuauaggcuucag

SEQ ID NO: 756021 - RNA, 21 nt, Human
ugcagacagggacagaaugga

SEQ ID NO: 756022 - RNA, 22 nt, Human
aguacaaauuauagcgcuugga

SEQ ID NO: 756023 - RNA, 22 nt, Human
aaacuugaggcaaugaaggugu

SEQ ID NO: 756024 - RNA, 22 nt, Human
ucugccuggccuggagggcaca

SEQ ID NO: 756025 - RNA, 22 nt, Human
ucugcuguaaagaauuucugcc

SEQ ID NO: 756026 - RNA, 22 nt, Human
ggggcugagucagugggaagag

SEQ ID NO: 756027 - RNA, 22 nt, Human
ugguauuucagcuuuuguaucu

SEQ ID NO: 756028 - RNA, 22 nt, Human
uguauuuuuaggaaugcgcuau

SEQ ID NO: 756029 - RNA, 22 nt, Human
ugagcuggcaggggcucaggga

SEQ ID NO: 756030 - RNA, 22 nt, Human
cacacuuuguugaaguuuucau

SEQ ID NO: 756031 - RNA, 22 nt, Human
auauacuuuucacuaauggcua

SEQ ID NO: 756032 - RNA, 22 nt, Human
uguuuacauaguagcugcccug

SEQ ID NO: 756033 - RNA, 22 nt, Human
caucacccggaacugugucugc

SEQ ID NO: 756034 - RNA, 22 nt, Human
aaacucuguugagauaauauuu

SEQ ID NO: 756035 - RNA, 22 nt, Human
ucaaaguuuuugagaauuacau

SEQ ID NO: 756036 - RNA, 22 nt, Human
aguggcagagcaggugcuggaa

SEQ ID NO: 756037 - RNA, 22 nt, Human
aguguuucugugccccaguguu

SEQ ID NO: 756038 - RNA, 18 nt, Human
auugcacaccagccuggg

SEQ ID NO: 756039 - RNA, 22 nt, Human
aucuuuagauuagaaacucuaa

SEQ ID NO: 756040 - RNA, 22 nt, Human
cacugguguacaggagguaaaa

SEQ ID NO: 756041 - RNA, 22 nt, Human
aauguggccacuuuuuucuggg

SEQ ID NO: 756042 - RNA, 23 nt, Human
uggaaacauucugaauguccauc

SEQ ID NO: 756043 - RNA, 22 nt, Human
ccaggagcagccggcccaccug

SEQ ID NO: 756044 - RNA, 22 nt, Human
aaguugcuaaaggaguucuuug

SEQ ID NO: 756045 - RNA, 19 nt, Human
ggcuuuaacucuuguagcu

SEQ ID NO: 756046 - RNA, 23 nt, Human
ugaagcauggauaacucacaccu

SEQ ID NO: 756047 - RNA, 19 nt, Human
uccaguuuggcaggaagac

SEQ ID NO: 756048 - RNA, 22 nt, Human
gauaaaauucuuauuuuacccg

SEQ ID NO: 756049 - RNA, 22 nt, Human
gcuccugugcaggucucgguug

SEQ ID NO: 756050 - RNA, 22 nt, Human
guucaaagcuccugguacagua

SEQ ID NO: 756051 - RNA, 22 nt, Human
ggcugccccaugggcugggcug

SEQ ID NO: 756052 - RNA, 22 nt, Human
uuucuaguaaaagcuaauuacc

SEQ ID NO: 756053 - RNA, 22 nt, Human
ucugggcucacgagucuggaca

SEQ ID NO: 756054 - RNA, 22 nt, Human
agaguuccacguacagcuuuug

SEQ ID NO: 756055 - RNA, 22 nt, Human
ucagcaaaggcaauucauuauu

SEQ ID NO: 756056 - RNA, 22 nt, Human
acguggcggccgccgugagcgg

SEQ ID NO: 756057 - RNA, 22 nt, Human
uacauguggagauaacugaagc

SEQ ID NO: 756058 - RNA, 22 nt, Human
ugaguuaagcagguagcaagcu

SEQ ID NO: 756059 - RNA, 22 nt, Human
accacaggacccaugagucagu

SEQ ID NO: 756060 - RNA, 20 nt, Human
ugcaaacacagaguguauga

SEQ ID NO: 756061 - RNA, 22 nt, Human
gcccauggacacccaagugcca

SEQ ID NO: 756062 - RNA, 22 nt, Human
agucugucuacuuaaagucugu

SEQ ID NO: 756063 - RNA, 22 nt, Human
ugcuuuaacgcugagggucuca

SEQ ID NO: 756064 - RNA, 23 nt, Human
ugaauuuuggcauauucugaaau

SEQ ID NO: 756065 - RNA, 22 nt, Human
gugcugggauuacaggugugag

SEQ ID NO: 756066 - RNA, 22 nt, Human
ucagaggagcaaaagaggggau

SEQ ID NO: 756067 - RNA, 22 nt, Human
aacaggaaaacagcacaauagc

SEQ ID NO: 756068 - RNA, 22 nt, Human
aacaguguucuaggguguggcu

SEQ ID NO: 756069 - RNA, 22 nt, Human
uauugaugcuuggauugggcca

SEQ ID NO: 756070 - RNA, 22 nt, Human
acaucugaggagaccagccucu

SEQ ID NO: 756071 - RNA, 22 nt, Human
ucuguuucuccaacauugugag

SEQ ID NO: 756072 - RNA, 22 nt, Human
uuuguuuagaaagagauuggug

SEQ ID NO: 756073 - RNA, 22 nt, Human
uaauaguugugacuuuguaaag

SEQ ID NO: 756074 - RNA, 22 nt, Human
gauggcuuugaggaauuugaau

SEQ ID NO: 756075 - RNA, 22 nt, Human
guccccucaaaauucauauguu

SEQ ID NO: 756076 - RNA, 20 nt, Human
ucucauuauauccaagaggc

SEQ ID NO: 756077 - RNA, 22 nt, Human
aagauguucuauuuucacuuuu

SEQ ID NO: 756078 - RNA, 23 nt, Human
accagcaaaaaugacagcccagg

SEQ ID NO: 756079 - RNA, 22 nt, Human
aauuagggagccaucauaaggu

SEQ ID NO: 756080 - RNA, 22 nt, Human
uacagaaugauguguuuaaaua

SEQ ID NO: 756081 - RNA, 19 nt, Human
uuuuaaguccucucuauuc

SEQ ID NO: 756082 - RNA, 22 nt, Human
uuuguaacuuuagaauugaucc

SEQ ID NO: 756083 - RNA, 22 nt, Human
gcaguagugucaguacagcaaa

SEQ ID NO: 756084 - RNA, 22 nt, Human
ucuggggauggucuacuuucug

SEQ ID NO: 756085 - RNA, 22 nt, Human
ucucagaguuuuuuuccaggac

SEQ ID NO: 756086 - RNA, 22 nt, Human
uggcaggaggaugaggcggcua

SEQ ID NO: 756087 - RNA, 22 nt, Human
ugggcucauguuuauacauauc

SEQ ID NO: 756088 - RNA, 22 nt, Human
aaaugguauuuacucuguauua

SEQ ID NO: 756089 - RNA, 22 nt, Human
gaggcccagcauucagggcagg

SEQ ID NO: 756090 - RNA, 22 nt, Human
aguacacagaguuauuuugugu

SEQ ID NO: 756091 - RNA, 22 nt, Human
aaacaucuaucagcauuuuuua

SEQ ID NO: 756092 - RNA, 22 nt, Human
aggaacugucauguauugcuca

SEQ ID NO: 756093 - RNA, 22 nt, Human
aaauguguguauguacauauau

SEQ ID NO: 756094 - RNA, 22 nt, Human
ugugaauggcaguuggauagca

SEQ ID NO: 756095 - RNA, 22 nt, Human
gugaauaacuuucuauguuaau

SEQ ID NO: 756096 - RNA, 21 nt, Human
acagggcuucagggaggguua

SEQ ID NO: 756097 - RNA, 22 nt, Human
acuuagaagaugcaguaaagca

SEQ ID NO: 756098 - RNA, 22 nt, Human
uugaguuccaggaugguuguua

SEQ ID NO: 756099 - RNA, 22 nt, Human
gaauucuagucacacacauuca

SEQ ID NO: 756100 - RNA, 20 nt, Human
uuuggagagaaagaaguagu

SEQ ID NO: 756101 - RNA, 22 nt, Human
ggaggugacgaaaagaaauugu

SEQ ID NO: 756102 - RNA, 22 nt, Human
aacaauguucuuuuagcuugaa

SEQ ID NO: 756103 - RNA, 22 nt, Human
aucagacaauuguugaguacug

SEQ ID NO: 756104 - RNA, 22 nt, Human
aauaaaugaacaaagcagguug

SEQ ID NO: 756105 - RNA, 22 nt, Human
uacagcacugugcauagugguu

SEQ ID NO: 756106 - RNA, 23 nt, Human
uuuugacaggaggaagguguuga

SEQ ID NO: 756107 - RNA, 22 nt, Human
cuuaagagucuuucuguguuua

SEQ ID NO: 756108 - RNA, 22 nt, Human
cuccagucauagccucuugagu

SEQ ID NO: 756109 - RNA, 22 nt, Human
ugacaccacaacuagccauuga

SEQ ID NO: 756110 - RNA, 22 nt, Human
aaauccuaauaaugcacuagug

SEQ ID NO: 756111 - RNA, 22 nt, Human
uuccugguccuauuauauacac

SEQ ID NO: 756112 - RNA, 22 nt, Human
aaguuacuaugacucuucuuuu

SEQ ID NO: 756113 - RNA, 17 nt, Human
aauacuuccaacuagug

SEQ ID NO: 756114 - RNA, 22 nt, Human
agcacagaaaguauugacugaa

SEQ ID NO: 756115 - RNA, 22 nt, Human
cugucuguggagcuucugaugu

SEQ ID NO: 756116 - RNA, 22 nt, Human
uugaggucaaguaaccacugga

SEQ ID NO: 756117 - RNA, 22 nt, Human
uggauauccuuguuaacuuucu

SEQ ID NO: 756118 - RNA, 22 nt, Human
aaggagugauauaugggugcua

SEQ ID NO: 756119 - RNA, 22 nt, Human
aggaacuggugggaggugauug

SEQ ID NO: 756120 - RNA, 22 nt, Human
gguggggagucaggcauucuug

SEQ ID NO: 756121 - RNA, 22 nt, Human
uucugcuuuuauugccagaguu

SEQ ID NO: 756122 - RNA, 22 nt, Human
cagccacucggccauaaaggcu

SEQ ID NO: 756123 - RNA, 22 nt, Human
gcuccccauugaucugcaggcu

SEQ ID NO: 756124 - RNA, 22 nt, Human
ugagaaggguuggagaaauaau

SEQ ID NO: 756125 - RNA, 22 nt, Human
agcacaggacguagagcuugga

SEQ ID NO: 756126 - RNA, 22 nt, Human
ucucuaaaguagaaaagacccc

SEQ ID NO: 756127 - RNA, 22 nt, Human
auuuuguuuccuuuggaguaga

SEQ ID NO: 756128 - RNA, 22 nt, Human
guacaugugcacaaugugcagg

SEQ ID NO: 756129 - RNA, 22 nt, Human
ucugaggcauacccaggccccc

SEQ ID NO: 756130 - RNA, 22 nt, Human
agcugcuuguacaugaccacau

SEQ ID NO: 756131 - RNA, 22 nt, Human
aacugcaacuucguaaagugag

SEQ ID NO: 756132 - RNA, 19 nt, Human
aaugcauggaaguuggaga

SEQ ID NO: 756133 - RNA, 22 nt, Human
aagugucugcaaaaugacagag

SEQ ID NO: 756134 - RNA, 23 nt, Human
agcugaggcugugggugucagag

SEQ ID NO: 756135 - RNA, 22 nt, Human
ggccuucacgugaccuggcgug

SEQ ID NO: 756136 - RNA, 17 nt, Human
cucagagcaggacagaa

SEQ ID NO: 756137 - RNA, 22 nt, Human
uaacaaagguugccaaacuaag

SEQ ID NO: 756138 - RNA, 22 nt, Human
ucucagugauggcccauuugga

SEQ ID NO: 756139 - RNA, 22 nt, Human
gggcuggagaugcuuauggaga

SEQ ID NO: 756140 - RNA, 22 nt, Human
uucaagucagagcaagccaagu

SEQ ID NO: 756141 - RNA, 22 nt, Human
agagcuguucagcagccagguu

SEQ ID NO: 756142 - RNA, 22 nt, Human
aggaauguaauaguguggcuca

SEQ ID NO: 756143 - RNA, 22 nt, Human
gaaggcugaguggguacggagg

SEQ ID NO: 756144 - RNA, 21 nt, Human
gcugugcacauaguagaagug

SEQ ID NO: 756145 - RNA, 22 nt, Human
aaguaugugauacauguuaauu

SEQ ID NO: 756146 - RNA, 22 nt, Human
agccugcaggaugggcagcacc

SEQ ID NO: 756147 - RNA, 22 nt, Human
uaugaagcuuugaaaagcuuac

SEQ ID NO: 756148 - RNA, 22 nt, Human
aagcaagaguuggagugauguu

SEQ ID NO: 756149 - RNA, 22 nt, Human
gacagagauugaaucaggaaau

SEQ ID NO: 756150 - RNA, 22 nt, Human
uguauuuauucaggauguaacu

SEQ ID NO: 756151 - RNA, 22 nt, Human
gaggagaaauuuggggaccuga

SEQ ID NO: 756152 - RNA, 22 nt, Human
ugucugaacugcacugaaagac

SEQ ID NO: 756153 - RNA, 20 nt, Human
aauuuacucacagaaugaau

SEQ ID NO: 756154 - RNA, 22 nt, Human
uauacugaucacugaggucauc

SEQ ID NO: 756155 - RNA, 22 nt, Human
gcuccaggccccagcguuccgc

SEQ ID NO: 756156 - RNA, 22 nt, Human
caguguuuguauagaauaugca

SEQ ID NO: 756157 - RNA, 18 nt, Human
acccucuggcuucugagc

SEQ ID NO: 756158 - RNA, 22 nt, Human
cagaaaaggguguuuguucagg

SEQ ID NO: 756159 - RNA, 22 nt, Human
cauccugaaagaaacauuuccu

SEQ ID NO: 756160 - RNA, 22 nt, Human
aucaauuuugaggauacaagaa

SEQ ID NO: 756161 - RNA, 20 nt, Human
aagcuuccaggaucuggugu

SEQ ID NO: 756162 - RNA, 22 nt, Human
uuuccucaacugucaaaugggg

SEQ ID NO: 756163 - RNA, 22 nt, Human
uggaggaugagugugggcucug

SEQ ID NO: 756164 - RNA, 22 nt, Human
ugcagguggcagcggggcacca

SEQ ID NO: 756165 - RNA, 22 nt, Human
gugcccugguccccagcauaua

SEQ ID NO: 756166 - RNA, 22 nt, Human
uccugggacccugggugcagag

SEQ ID NO: 756167 - RNA, 18 nt, Human
ggaaguaggaagaggaag

SEQ ID NO: 756168 - RNA, 22 nt, Human
cuugagaagagauuuauauuug

SEQ ID NO: 756169 - RNA, 22 nt, Human
uuccucagagggcgcuggggaa

SEQ ID NO: 756170 - RNA, 22 nt, Human
aagugcuuucauauagucuuaa

SEQ ID NO: 756171 - RNA, 22 nt, Human
cuugggugcuggaggcugccgc

SEQ ID NO: 756172 - RNA, 20 nt, Human
agagccuugaggaagaugau

SEQ ID NO: 756173 - RNA, 22 nt, Human
ugaaggccagcagagugaaggc

SEQ ID NO: 756174 - RNA, 22 nt, Human
agauggcuccaguguccagagg

SEQ ID NO: 756175 - RNA, 22 nt, Human
guccucuguagggcugggccac

SEQ ID NO: 756176 - RNA, 22 nt, Human
uguguuuaaagaggaagugaga

SEQ ID NO: 756177 - RNA, 22 nt, Human
ugggaaggcguggaaguagaag

SEQ ID NO: 756178 - RNA, 22 nt, Human
gcaugauagcuaacuccccuca

SEQ ID NO: 756179 - RNA, 22 nt, Human
aggcccugaagucggccccuca

SEQ ID NO: 756180 - RNA, 23 nt, Human
cugcuuucccacuccaugcucuu

SEQ ID NO: 756181 - RNA, 22 nt, Human
uggcagagucucuccuuuccag

SEQ ID NO: 756182 - RNA, 22 nt, Human
ggagccccaauugagcaguacg

SEQ ID NO: 756183 - RNA, 22 nt, Human
ugagcuggcacuuuuccuggga

SEQ ID NO: 756184 - RNA, 22 nt, Human
ucaggaacacaggggcccaugc

SEQ ID NO: 756185 - RNA, 22 nt, Human
caggcagaggaggccuucuccu

SEQ ID NO: 756186 - RNA, 19 nt, Human
uuugaaaggauuguuauuu

SEQ ID NO: 756187 - RNA, 22 nt, Human
agcacagaguugcagagagcgu

SEQ ID NO: 756188 - RNA, 22 nt, Human
uccagucaacuuaaucucuuua

SEQ ID NO: 756189 - RNA, 22 nt, Human
aguaaaaucuuaagcacagugg

SEQ ID NO: 756190 - RNA, 22 nt, Human
agaggauccuaagaagauauga

SEQ ID NO: 756191 - RNA, 22 nt, Human
ugucaguuuggcucuaaaguuu

SEQ ID NO: 756192 - RNA, 22 nt, Human
aguggcugccaagagcaaugcu

SEQ ID NO: 756193 - RNA, 22 nt, Human
uaucuugagagacaacacagca

SEQ ID NO: 756194 - RNA, 23 nt, Human
aggcugcagaagaauagggucau

SEQ ID NO: 756195 - RNA, 23 nt, Human
aucuuacauauuuagcaccugaa

SEQ ID NO: 756196 - RNA, 22 nt, Human
auugcauuguauuguaaauguu

SEQ ID NO: 756197 - RNA, 22 nt, Human
guccucugaaguugugcaaugc

SEQ ID NO: 756198 - RNA, 22 nt, Human
gauuuccaugauugggccagaa

SEQ ID NO: 756199 - RNA, 19 nt, Human
ugaggccaaggucacagau

SEQ ID NO: 756200 - RNA, 22 nt, Human
ugagggcugcuuccagagcuag

SEQ ID NO: 756201 - RNA, 22 nt, Human
uagauugauugcaaagacaggc

SEQ ID NO: 756202 - RNA, 22 nt, Human
ggcagcugggucacaccgaucu

SEQ ID NO: 756203 - RNA, 21 nt, Human
agugucauucccaagcuguga

SEQ ID NO: 756204 - RNA, 22 nt, Human
uaagguuuaacgcccugucucg

SEQ ID NO: 756205 - RNA, 22 nt, Human
ugaguggaguagugaaugcauu

SEQ ID NO: 756206 - RNA, 22 nt, Human
gccaaggcugaggcccugggcu

SEQ ID NO: 756207 - RNA, 22 nt, Human
cucaugucuucacccauucuaa

SEQ ID NO: 756208 - RNA, 22 nt, Human
ccacacuggcaugggauggagg

SEQ ID NO: 756209 - RNA, 22 nt, Human
agggagacaaaagcagcugcca

SEQ ID NO: 756210 - RNA, 22 nt, Human
uaagaacaguagaacaguaggu

SEQ ID NO: 756211 - RNA, 19 nt, Human
cuggaaugagaacaugccc

SEQ ID NO: 756212 - RNA, 22 nt, Human
augguuucacaaacaaaagguu

SEQ ID NO: 756213 - RNA, 22 nt, Human
ucauaaaacacaccagguaguu

SEQ ID NO: 756214 - RNA, 22 nt, Human
aauggcuuagcagaguuagaag

SEQ ID NO: 756215 - RNA, 22 nt, Human
caggguggaacaggcaauacuu

SEQ ID NO: 756216 - RNA, 19 nt, Human
aggcuggagacaccaggcc

SEQ ID NO: 756217 - RNA, 22 nt, Human
uccacaucaagggcagagaggu

SEQ ID NO: 756218 - RNA, 22 nt, Human
ucuguggcacgauugcacugca

SEQ ID NO: 756219 - RNA, 22 nt, Human
agacuguacuuucugcagcucu

SEQ ID NO: 756220 - RNA, 17 nt, Human
agaaugcaaagcaggcu

SEQ ID NO: 756221 - RNA, 22 nt, Human
ucugaaaugcaggcaauuugcu

SEQ ID NO: 756222 - RNA, 22 nt, Human
ccuggcuccaaagcugugacuc

SEQ ID NO: 756223 - RNA, 22 nt, Human
ugugcuaaguauuuucuuauuu

SEQ ID NO: 756224 - RNA, 22 nt, Human
uuacugauggaacagagauaga

SEQ ID NO: 756225 - RNA, 22 nt, Human
aguggcaguggggcagggcccu

SEQ ID NO: 756226 - RNA, 22 nt, Human
gguggcugguuuuauaagaggu

SEQ ID NO: 756227 - RNA, 22 nt, Human
gcacugccugugagcccugguu

SEQ ID NO: 756228 - RNA, 22 nt, Human
gucccaggcaggccacuggcag

SEQ ID NO: 756229 - RNA, 22 nt, Human
gccuggugcuaugagggccagc

SEQ ID NO: 756230 - RNA, 18 nt, Human
ccucacagacuuccaugu

SEQ ID NO: 756231 - RNA, 22 nt, Human
uguugcacggccuucacagagc

SEQ ID NO: 756232 - RNA, 17 nt, Human
ggccagaggcggggcug

SEQ ID NO: 756233 - RNA, 22 nt, Human
auuccacagccgauaccaugac

SEQ ID NO: 756234 - RNA, 22 nt, Human
cugcccuggucccauggcugau

SEQ ID NO: 756235 - RNA, 22 nt, Human
auggcuccagcuuggcuucacc

SEQ ID NO: 756236 - RNA, 22 nt, Human
uccuccaguggcccaguccuuc

SEQ ID NO: 756237 - RNA, 22 nt, Human
ucuuccuauggggcugcaggaa

SEQ ID NO: 756238 - RNA, 22 nt, Human
cuuuccccaguauaucauugcc

SEQ ID NO: 756239 - RNA, 19 nt, Human
ggacagucucagccucaug

SEQ ID NO: 756240 - RNA, 18 nt, Human
ggguccuguucuuggaag

SEQ ID NO: 756241 - RNA, 22 nt, Human
uccagcagaaaagagguaggga

SEQ ID NO: 756242 - RNA, 22 nt, Human
gcagaaggauccgcaggugcaa

SEQ ID NO: 756243 - RNA, 21 nt, Human
guuuucaugauagagucugua

SEQ ID NO: 756244 - RNA, 22 nt, Human
acauugaccugauuuugaagac

SEQ ID NO: 756245 - RNA, 23 nt, Human
ccacugaagaauccagggaguuu

SEQ ID NO: 756246 - RNA, 22 nt, Human
ucagaugccuguggggucuagg

SEQ ID NO: 756247 - RNA, 22 nt, Human
cacagguguaugaauaugucca

SEQ ID NO: 756248 - RNA, 22 nt, Human
ugccuggcaagaggggcuggcu

SEQ ID NO: 756249 - RNA, 22 nt, Human
caaaguuuggcucucaugacau

SEQ ID NO: 756250 - RNA, 22 nt, Human
uccucagggaagaugagccuca

SEQ ID NO: 756251 - RNA, 19 nt, Human
cuauacagccucugaggaa

SEQ ID NO: 756252 - RNA, 19 nt, Human
cagaacagcugggaagaga

SEQ ID NO: 756253 - RNA, 22 nt, Human
uccugggucucuuccuuaguuc

SEQ ID NO: 756254 - RNA, 22 nt, Human
ucucuggggauggaccugggag

SEQ ID NO: 756255 - RNA, 22 nt, Human
ggagcuguuggcagcuaucuug

SEQ ID NO: 756256 - RNA, 18 nt, Human
gaggcacauaguuggggc

SEQ ID NO: 756257 - RNA, 18 nt, Human
caugagcugccccuagac

SEQ ID NO: 756258 - RNA, 20 nt, Human
uucucuuuggguccagagaa

SEQ ID NO: 756259 - RNA, 22 nt, Human
ucccagcauaacaaacugcccg

SEQ ID NO: 756260 - RNA, 22 nt, Human
cccuguccuuggcugugaggcu

SEQ ID NO: 756261 - RNA, 22 nt, Human
ucaccccuugugaaugcugcuc

SEQ ID NO: 756262 - RNA, 22 nt, Human
caaaggacccauaauuaaaacc

SEQ ID NO: 756263 - RNA, 22 nt, Human
caggcucagcucuggccagugc

SEQ ID NO: 756264 - RNA, 22 nt, Human
aggcugaggcgggaggaucacu

SEQ ID NO: 756265 - RNA, 22 nt, Human
guucacaaaguacuguaugcau

SEQ ID NO: 756266 - RNA, 22 nt, Human
ugcagaagaaugagcuuggagu

SEQ ID NO: 756267 - RNA, 22 nt, Human
augcaaaugcuagagaauguug

SEQ ID NO: 756268 - RNA, 22 nt, Human
uggcucagcaagacauugaccu

SEQ ID NO: 756269 - RNA, 20 nt, Human
uccuaauaaccugaagaaau

SEQ ID NO: 756270 - RNA, 22 nt, Human
ugcauuguugaugaguugaaua

SEQ ID NO: 756271 - RNA, 22 nt, Human
ggacauuuaguuucauugggca

SEQ ID NO: 756272 - RNA, 20 nt, Human
ugcuuuuauaccuauaauga

SEQ ID NO: 756273 - RNA, 22 nt, Human
uuacaaacaagaucuuauucuu

SEQ ID NO: 756274 - RNA, 22 nt, Human
ugggccagauccauggcaauaa

SEQ ID NO: 756275 - RNA, 22 nt, Human
agagccaguuguuaagcacuua

SEQ ID NO: 756276 - RNA, 22 nt, Human
cucccaggggaacuaucaagua

SEQ ID NO: 756277 - RNA, 22 nt, Human
acccagaguaacagauggauuc

SEQ ID NO: 756278 - RNA, 22 nt, Human
gcucagugguauucggaaacug

SEQ ID NO: 756279 - RNA, 19 nt, Human
ccagcagcuuugauucucu

SEQ ID NO: 756280 - RNA, 22 nt, Human
gggcuccagggcccgagucguc

SEQ ID NO: 756281 - RNA, 22 nt, Human
auagucuuuacugcugaauuga

SEQ ID NO: 756282 - RNA, 22 nt, Human
ugcauuggucauuuagaaaaua

SEQ ID NO: 756283 - RNA, 22 nt, Human
uauguuuccugagcuuacacca

SEQ ID NO: 756284 - RNA, 22 nt, Human
cagcuuucuuccuucugucugu

SEQ ID NO: 756285 - RNA, 22 nt, Human
aaggcacacaguuagauagagc

SEQ ID NO: 756286 - RNA, 22 nt, Human
aguuuacaucuucaaucucauu

SEQ ID NO: 756287 - RNA, 22 nt, Human
uguuaucacuuguaaaagcaau

SEQ ID NO: 756288 - RNA, 22 nt, Human
augucuguccccuagcccugau

SEQ ID NO: 756289 - RNA, 22 nt, Human
gcagcuuucugcaaugucaucc

SEQ ID NO: 756290 - RNA, 22 nt, Human
gaaagggucuuugauuucccuc

SEQ ID NO: 756291 - RNA, 22 nt, Human
gaggcucagagugguuaaauaa

SEQ ID NO: 756292 - RNA, 22 nt, Human
ggacaaaggucuggggaaccug

SEQ ID NO: 756293 - RNA, 22 nt, Human
ugcaaauacaaaaugguacagc

SEQ ID NO: 756294 - RNA, 22 nt, Human
cccaggggagguccucagggaa

SEQ ID NO: 756295 - RNA, 18 nt, Human
cagaggagagacauucag

SEQ ID NO: 756296 - RNA, 20 nt, Human
ccucucugcccugcaaggcc

SEQ ID NO: 756297 - RNA, 22 nt, Human
acugccugcuccuggcuccaca

SEQ ID NO: 756298 - RNA, 22 nt, Human
uuuucuccuaagacccuucacc

SEQ ID NO: 756299 - RNA, 22 nt, Human
gcaugcagagaauaccugugau

SEQ ID NO: 756300 - RNA, 22 nt, Human
acauagcauaaagaaugacucu

SEQ ID NO: 756301 - RNA, 22 nt, Human
ugcacacaguucucaggaaaga

SEQ ID NO: 756302 - RNA, 22 nt, Human
uguguagugauuuucuuccaac

SEQ ID NO: 756303 - RNA, 22 nt, Human
caagggcugcuaucagcuacug

SEQ ID NO: 756304 - RNA, 22 nt, Human
cuuacauugugugcaugagggg

SEQ ID NO: 756305 - RNA, 22 nt, Human
uuacacucauauugcacuuacc

SEQ ID NO: 756306 - RNA, 22 nt, Human
ugugggugguaaaauacaauga

SEQ ID NO: 756307 - RNA, 22 nt, Human
guuuuauuggaacacagccaug

SEQ ID NO: 756308 - RNA, 22 nt, Human
uguuuacuuaugugggucacau

SEQ ID NO: 756309 - RNA, 22 nt, Human
cuguauuuuuuaagugaucugg

SEQ ID NO: 756310 - RNA, 22 nt, Human
gggagcuggggcauuuauaccc

SEQ ID NO: 756311 - RNA, 22 nt, Human
gauggcaggcaggugaguagag

SEQ ID NO: 756312 - RNA, 22 nt, Human
uuacacaugcucacuuauuugu

SEQ ID NO: 756313 - RNA, 22 nt, Human
gccaagcuguuuuucagagacg

SEQ ID NO: 756314 - RNA, 19 nt, Human
ccagaugagcagcugagau

SEQ ID NO: 756315 - RNA, 22 nt, Human
cucuccuuuacugcagagagcg

SEQ ID NO: 756316 - RNA, 22 nt, Human
uucacauggcaauagagaggga

SEQ ID NO: 756317 - RNA, 22 nt, Human
cuggcaccuccagcucauggcc

SEQ ID NO: 756318 - RNA, 22 nt, Human
ugccuugggauauauggacacu

SEQ ID NO: 756319 - RNA, 22 nt, Human
gagugguaggcaguguuaggaa

SEQ ID NO: 756320 - RNA, 22 nt, Human
ccagcccuugcugaaggguggc

SEQ ID NO: 756321 - RNA, 22 nt, Human
aucauucuaguccuuauggucu

SEQ ID NO: 756322 - RNA, 22 nt, Human
accagagcccaucugcuccuag

SEQ ID NO: 756323 - RNA, 22 nt, Human
uccagcugacaguucaaaauga

SEQ ID NO: 756324 - RNA, 22 nt, Human
uaaagugcuuaugauaaccaag

SEQ ID NO: 756325 - RNA, 22 nt, Human
ugcuuugcagugucuaacagaa

SEQ ID NO: 756326 - RNA, 22 nt, Human
ggggcagaaguagugccccuga

SEQ ID NO: 756327 - RNA, 22 nt, Human
uaauuauucuagucacauagca

SEQ ID NO: 756328 - RNA, 22 nt, Human
ugcaugcuccacagcccauuca

SEQ ID NO: 756329 - RNA, 22 nt, Human
cugagagccuccuguuggcuag

SEQ ID NO: 756330 - RNA, 22 nt, Human
auuuuucaacuuuggaaauggc

SEQ ID NO: 756331 - RNA, 22 nt, Human
agaagccauaguaucucagggu

SEQ ID NO: 756332 - RNA, 22 nt, Human
uggcccugacuuggaggccuga

SEQ ID NO: 756333 - RNA, 21 nt, Human
aggggaaguagaguuuugauu

SEQ ID NO: 756334 - RNA, 22 nt, Human
ugccauuuguuacuaucaggac

SEQ ID NO: 756335 - RNA, 22 nt, Human
aggcugcagaacagucaggugc

SEQ ID NO: 756336 - RNA, 22 nt, Human
ucugcaaacuggcucuuacugc

SEQ ID NO: 756337 - RNA, 22 nt, Human
uccaggguguguuuacuggggu

SEQ ID NO: 756338 - RNA, 22 nt, Human
aagguggauguaagcggcaaug

SEQ ID NO: 756339 - RNA, 20 nt, Human
gaaucuuacuacauucucuc

SEQ ID NO: 756340 - RNA, 22 nt, Human
uagugucugauccguaguuaca

SEQ ID NO: 756341 - RNA, 20 nt, Human
guucucacugaucugcaggg

SEQ ID NO: 756342 - RNA, 22 nt, Human
cagauacauuaaaaugaugauu

SEQ ID NO: 756343 - RNA, 22 nt, Human
cccuguacagucucuguggcac

SEQ ID NO: 756344 - RNA, 22 nt, Human
uccuggccgcuggccccugaga

SEQ ID NO: 756345 - RNA, 22 nt, Human
aggguugcauuuuuagaggcuc

SEQ ID NO: 756346 - RNA, 22 nt, Human
acucuguaauucuauaugcagu

SEQ ID NO: 756347 - RNA, 22 nt, Human
acauacuuuuuaaaagauugcu

SEQ ID NO: 756348 - RNA, 22 nt, Human
guccacugcugugugcuucacc

SEQ ID NO: 756349 - RNA, 22 nt, Human
gugccuuccccgguggucuguu

SEQ ID NO: 756350 - RNA, 22 nt, Human
caggggcugaaauguugggguu

SEQ ID NO: 756351 - RNA, 22 nt, Human
agacaagagcugaggacauauu

SEQ ID NO: 756352 - RNA, 22 nt, Human
agaagucaaguggucuaugaaa

SEQ ID NO: 756353 - RNA, 17 nt, Human
cagugaucauuacauua

SEQ ID NO: 756354 - RNA, 22 nt, Human
auauucuugugauuauaaagua

SEQ ID NO: 756355 - RNA, 22 nt, Human
aucagcaagcaugguuaggugu

SEQ ID NO: 756356 - RNA, 22 nt, Human
ugcuggcuuagauaucacugcc

SEQ ID NO: 756357 - RNA, 22 nt, Human
cacauucaauuacacagauagg

SEQ ID NO: 756358 - RNA, 22 nt, Human
uucuucaaccaucuacauaaac

SEQ ID NO: 756359 - RNA, 22 nt, Human
aaugauugcaaacauugagaac

SEQ ID NO: 756360 - RNA, 22 nt, Human
cacugcuuuuuuggcuauguac

SEQ ID NO: 756361 - RNA, 22 nt, Human
augcaguaaauguucuaguuug

SEQ ID NO: 756362 - RNA, 22 nt, Human
cuauccauuaaagccuuggaaa

SEQ ID NO: 756363 - RNA, 22 nt, Human
guucuaauaggagaaaagacag

SEQ ID NO: 756364 - RNA, 22 nt, Human
agaugcaaccucugcuuaacaa

SEQ ID NO: 756365 - RNA, 22 nt, Human
uucauucugcaguucucagcuc

SEQ ID NO: 756366 - RNA, 22 nt, Human
gcugugggugcuggcuccaccc

SEQ ID NO: 756367 - RNA, 22 nt, Human
agcugaauguucucagaccaga

SEQ ID NO: 756368 - RNA, 22 nt, Human
agaggcggagcuugcagugagc

SEQ ID NO: 756369 - RNA, 22 nt, Human
agcaggagagcagugcgugguc

SEQ ID NO: 756370 - RNA, 22 nt, Human
uucuccuugguuuaugggacau

SEQ ID NO: 756371 - RNA, 22 nt, Human
uaauaucuacuucauagaguuu

SEQ ID NO: 756372 - RNA, 22 nt, Human
ugcaggcugcucaagacuuagu

SEQ ID NO: 756373 - RNA, 20 nt, Human
auucugcuuugaaaauaagg

SEQ ID NO: 756374 - RNA, 22 nt, Human
gagcugugccaaucugucuggg

SEQ ID NO: 756375 - RNA, 22 nt, Human
aggagacccagaauguugcugu

SEQ ID NO: 756376 - RNA, 22 nt, Human
ucagcauuguggcagagaaugg

SEQ ID NO: 756377 - RNA, 20 nt, Human
agggcccaggaagagaguua

SEQ ID NO: 756378 - RNA, 22 nt, Human
gaagguccagcguggccaaguc

SEQ ID NO: 756379 - RNA, 22 nt, Human
gauccugucuguggagucagca

SEQ ID NO: 756380 - RNA, 22 nt, Human
aaauguacacuuugcaucuuga

SEQ ID NO: 756381 - RNA, 22 nt, Human
agaggccagcaaccacaguaaa

SEQ ID NO: 756382 - RNA, 22 nt, Human
uccuuaauaaguacuucauugu

SEQ ID NO: 756383 - RNA, 22 nt, Human
agaaagggagagccagcacacg

SEQ ID NO: 756384 - RNA, 22 nt, Human
gcuggaggcaguucagacacca

SEQ ID NO: 756385 - RNA, 22 nt, Human
aguuauguccucagcaaaucaa

SEQ ID NO: 756386 - RNA, 23 nt, Human
ucccaggaaucugcauuuuuaac

SEQ ID NO: 756387 - RNA, 22 nt, Human
gagggccacguucagggcucuc

SEQ ID NO: 756388 - RNA, 20 nt, Human
gugcagaggcagccuguggg

SEQ ID NO: 756389 - RNA, 22 nt, Human
gcacaugacaguaaguagagca

SEQ ID NO: 756390 - RNA, 22 nt, Human
gagucagaauuguauuuuaaac

SEQ ID NO: 756391 - RNA, 22 nt, Human
agcuugguguugccugcuugag

SEQ ID NO: 756392 - RNA, 17 nt, Human
ggaacaaauacuaugca

SEQ ID NO: 756393 - RNA, 22 nt, Human
uuccuggugagauuucguucug

SEQ ID NO: 756394 - RNA, 22 nt, Human
gcugaggauuacuugaagucag

SEQ ID NO: 756395 - RNA, 22 nt, Human
guaaucuguaguaaagcaccau

SEQ ID NO: 756396 - RNA, 21 nt, Human
cacuguauagcaggagaaaac

SEQ ID NO: 756397 - RNA, 22 nt, Human
cauugaaaccuaacauaggcug

SEQ ID NO: 756398 - RNA, 22 nt, Human
cuggccugcagaucccaggguc

SEQ ID NO: 756399 - RNA, 22 nt, Human
uuacaacaaaggcacgugcaug

SEQ ID NO: 756400 - RNA, 22 nt, Human
acagcucugcauggcaguuauu

SEQ ID NO: 756401 - RNA, 22 nt, Human
ugaauccagagcuauuucgucc

SEQ ID NO: 756402 - RNA, 22 nt, Human
ugggugaguggagggcauucua

SEQ ID NO: 756403 - RNA, 22 nt, Human
cacagaggaaaggcaguuggua

SEQ ID NO: 756404 - RNA, 22 nt, Human
ucaaucaaagcacugggcuuug

SEQ ID NO: 756405 - RNA, 22 nt, Human
ggacagagagugaauaugacau

SEQ ID NO: 756406 - RNA, 22 nt, Human
agcagcuuacauguggccuauc

SEQ ID NO: 756407 - RNA, 22 nt, Human
cuggcucccgucugguggccau

SEQ ID NO: 756408 - RNA, 22 nt, Human
ccagggugugagaaggaaguag

SEQ ID NO: 756409 - RNA, 22 nt, Human
acucagugggcuugaugucgaa

SEQ ID NO: 756410 - RNA, 22 nt, Human
acugcuuuagaccuagagcucu

SEQ ID NO: 756411 - RNA, 22 nt, Human
auaaaucucuuaagacucaaca

SEQ ID NO: 756412 - RNA, 22 nt, Human
gguaggggcagggccaagcugu

SEQ ID NO: 756413 - RNA, 22 nt, Human
uucaguguggcccaugaagagg

SEQ ID NO: 756414 - RNA, 22 nt, Human
agguggcuucuggccaggugug

SEQ ID NO: 756415 - RNA, 22 nt, Human
acucuucauucaaguaugcaaa

SEQ ID NO: 756416 - RNA, 22 nt, Human
cugggcaguuuauucaguucug

SEQ ID NO: 756417 - RNA, 22 nt, Human
ucuaguucuagaucccugagga

SEQ ID NO: 756418 - RNA, 22 nt, Human
ugcuucuguauuuugggcuuga

SEQ ID NO: 756419 - RNA, 22 nt, Human
uuguaacaaucugucauaaaug

SEQ ID NO: 756420 - RNA, 22 nt, Human
aaauaucauucuggugcacaga

SEQ ID NO: 756421 - RNA, 22 nt, Human
acauuaaagaguaagguuaguu

SEQ ID NO: 756422 - RNA, 22 nt, Human
ugcaccccauuuuacauuuaca

SEQ ID NO: 756423 - RNA, 22 nt, Human
acacaugugucugcaugcagug

SEQ ID NO: 756424 - RNA, 22 nt, Human
uucuaacuuucaagguccuuuc

SEQ ID NO: 756425 - RNA, 22 nt, Human
agaaguguuuauuucagcaaca

SEQ ID NO: 756426 - RNA, 22 nt, Human
ucugauuagcaguuuagggaaa

SEQ ID NO: 756427 - RNA, 22 nt, Human
uacauuuauaaggcuucucugu

SEQ ID NO: 756428 - RNA, 22 nt, Human
aaggcaaugacugauuuagaau

SEQ ID NO: 756429 - RNA, 22 nt, Human
caggggcucuaaugcaugauca

SEQ ID NO: 756430 - RNA, 22 nt, Human
cuggacacaaacaucuccucug

SEQ ID NO: 756431 - RNA, 22 nt, Human
aguggggagguccaggccaccc

SEQ ID NO: 756432 - RNA, 22 nt, Human
gcugccugaagugucuacacug

SEQ ID NO: 756433 - RNA, 22 nt, Human
aggagugggggcgagaaguuaa

SEQ ID NO: 756434 - RNA, 22 nt, Human
ugcacacacucugcauauacuu

SEQ ID NO: 756435 - RNA, 22 nt, Human
uugcauuuuuagaugcuucugu

SEQ ID NO: 756436 - RNA, 22 nt, Human
ugagcagaugucuaacuuuuac

SEQ ID NO: 756437 - RNA, 22 nt, Human
uuucagagucagcuccucucua

SEQ ID NO: 756438 - RNA, 22 nt, Human
cagagaaagaagcccauucauu

SEQ ID NO: 756439 - RNA, 22 nt, Human
uuugacagaaaguuauuauuuu

SEQ ID NO: 756440 - RNA, 21 nt, Human
uugaccaagggugcgugcucc

SEQ ID NO: 756441 - RNA, 22 nt, Human
uagauuucaggagacaaaaugg

SEQ ID NO: 756442 - RNA, 22 nt, Human
agggcuuuugagcgcacgucug

SEQ ID NO: 756443 - RNA, 23 nt, Human
uggcacagaggaccaugcuuugc

SEQ ID NO: 756444 - RNA, 22 nt, Human
ggaaacugcuuacacuagaggg

SEQ ID NO: 756445 - RNA, 22 nt, Human
aguucuguggcugugcccugua

SEQ ID NO: 756446 - RNA, 22 nt, Human
ucuggcaggguguguauuuaca

SEQ ID NO: 756447 - RNA, 22 nt, Human
aggaagagcccgggugacauaa

SEQ ID NO: 756448 - RNA, 22 nt, Human
ugcauuccacauaaagcgauaa

SEQ ID NO: 756449 - RNA, 19 nt, Human
uggcagcauugguaccuug

SEQ ID NO: 756450 - RNA, 22 nt, Human
agcagcaggauuuucguuggga

SEQ ID NO: 756451 - RNA, 22 nt, Human
ugaaagcugaggacaggagggu

SEQ ID NO: 756452 - RNA, 22 nt, Human
auucucagcuuucaaauagaca

SEQ ID NO: 756453 - RNA, 22 nt, Human
cucaggcugucuaauggauuag

SEQ ID NO: 756454 - RNA, 22 nt, Human
agguuaguaugacacgguuaua

SEQ ID NO: 756455 - RNA, 22 nt, Human
aggcacaggaggugguaagaag

SEQ ID NO: 756456 - RNA, 22 nt, Human
uggccacacugcccccacuggg

SEQ ID NO: 756457 - RNA, 22 nt, Human
gucuuuauauuuacuaaagaau

SEQ ID NO: 756458 - RNA, 22 nt, Human
aaaauacuguggaguguugaaa

SEQ ID NO: 756459 - RNA, 22 nt, Human
cugaggccguuggugggccuua

SEQ ID NO: 756460 - RNA, 22 nt, Human
uccagugcuggaccagagcacc

SEQ ID NO: 756461 - RNA, 22 nt, Human
cgcugccuucaucccacgccua

SEQ ID NO: 756462 - RNA, 16 nt, Human
aggagcuggguaggag

SEQ ID NO: 756463 - RNA, 22 nt, Human
cuguccuaugaguacucacuag

SEQ ID NO: 756464 - RNA, 22 nt, Human
caugcaggugaccagguguggg

SEQ ID NO: 756465 - RNA, 22 nt, Human
gugcacacaagcaaugcacuua

SEQ ID NO: 756466 - RNA, 22 nt, Human
cagggggcuguggcuguccagu

SEQ ID NO: 756467 - RNA, 22 nt, Human
acucucugugauggaggccagc

SEQ ID NO: 756468 - RNA, 22 nt, Human
uguggcaggaugcggaagaugc

SEQ ID NO: 756469 - RNA, 22 nt, Human
uucuugcaggucacucacugag

SEQ ID NO: 756470 - RNA, 22 nt, Human
cacaaaguggguggaaaacuaa

SEQ ID NO: 756471 - RNA, 22 nt, Human
acuacuuugggccauuuguuua

SEQ ID NO: 756472 - RNA, 22 nt, Human
acgaguauguuuguauuuucuu

SEQ ID NO: 756473 - RNA, 22 nt, Human
ugcacacauguauguauaugug

SEQ ID NO: 756474 - RNA, 22 nt, Human
uuucugcaacgagucuuugacu

SEQ ID NO: 756475 - RNA, 22 nt, Human
cucugcagaggcccaaggcuga

SEQ ID NO: 756476 - RNA, 22 nt, Human
agcaucuggugagggccuaguu

SEQ ID NO: 756477 - RNA, 19 nt, Human
ugccagagauacucccaga

SEQ ID NO: 756478 - RNA, 22 nt, Human
gcugagagugggugcagugcuu

SEQ ID NO: 756479 - RNA, 20 nt, Human
agcaugcagccagagccaac

SEQ ID NO: 756480 - RNA, 22 nt, Human
cacagguuugacaaggauaaaa

SEQ ID NO: 756481 - RNA, 22 nt, Human
agcaguuaugugucucuugacu

SEQ ID NO: 756482 - RNA, 19 nt, Human
acucaagucuaaugaaauc

SEQ ID NO: 756483 - RNA, 22 nt, Human
agcagcauguaugagggugaac

SEQ ID NO: 756484 - RNA, 22 nt, Human
aauaaauguuuguuggauguuu

SEQ ID NO: 756485 - RNA, 22 nt, Human
uuagagucaaaauggcauguua

SEQ ID NO: 756486 - RNA, 22 nt, Human
gcauggaucuaagaggucaagg

SEQ ID NO: 756487 - RNA, 22 nt, Human
uugaaaguaauaacuuuguuca

SEQ ID NO: 756488 - RNA, 21 nt, Human
ucagcaaaauaagcaaaugga

SEQ ID NO: 756489 - RNA, 22 nt, Human
cagaggcucagauggcccuggc

SEQ ID NO: 756490 - RNA, 22 nt, Human
ugggacugcucuugcugggguc

SEQ ID NO: 756491 - RNA, 22 nt, Human
gggcugugccucaggugggguc

SEQ ID NO: 756492 - RNA, 22 nt, Human
uugaagcauuucuuugagcuuc

SEQ ID NO: 756493 - RNA, 22 nt, Human
uaacugaagcuggaagcgcugg

SEQ ID NO: 756494 - RNA, 22 nt, Human
uaauuuacucagauguucaauc

SEQ ID NO: 756495 - RNA, 19 nt, Human
ucuuccagcaucugggggc

SEQ ID NO: 756496 - RNA, 22 nt, Human
ggggugagcugggccugugccu

SEQ ID NO: 756497 - RNA, 22 nt, Human
uccaguggagugugggggugaa

SEQ ID NO: 756498 - RNA, 22 nt, Human
ucagcaggcacggacaggcugc

SEQ ID NO: 756499 - RNA, 16 nt, Human
uguaugaacgucucca

SEQ ID NO: 756500 - RNA, 22 nt, Human
uuagauaacaguagaauaucaa

SEQ ID NO: 756501 - RNA, 22 nt, Human
ugguccuggucaucugggcugg

SEQ ID NO: 756502 - RNA, 21 nt, Human
uuacuaaacaaaacaugcagg

SEQ ID NO: 756503 - RNA, 22 nt, Human
ugggccuguugccugaguccau

SEQ ID NO: 756504 - RNA, 22 nt, Human
cucugggugggcagcagaugga

SEQ ID NO: 756505 - RNA, 22 nt, Human
uuucuaaggugagguagaaaau

SEQ ID NO: 756506 - RNA, 22 nt, Human
gaacugaguuuucugccuggac

SEQ ID NO: 756507 - RNA, 20 nt, Human
guggcagugguggcagcagu

SEQ ID NO: 756508 - RNA, 22 nt, Human
acagaugaauuuauggauggaa

SEQ ID NO: 756509 - RNA, 22 nt, Human
uacacaucucugucaguaguga

SEQ ID NO: 756510 - RNA, 22 nt, Human
aaagccaucuguauuaagugaa

SEQ ID NO: 756511 - RNA, 21 nt, Human
cucaggauggcggccuggugg

SEQ ID NO: 756512 - RNA, 22 nt, Human
uucacagcuccuuuuacucaac

SEQ ID NO: 756513 - RNA, 22 nt, Human
acuugggagggugugggcagcu

SEQ ID NO: 756514 - RNA, 22 nt, Human
uuccuggugguggugacagcac

SEQ ID NO: 756515 - RNA, 22 nt, Human
aaagucaucuguccuaggcucu

SEQ ID NO: 756516 - RNA, 22 nt, Human
aagcuggauguaggaucccccu

SEQ ID NO: 756517 - RNA, 21 nt, Human
ugagagccuccaaccggcuac

SEQ ID NO: 756518 - RNA, 22 nt, Human
augcugacagacuauuaacuau

SEQ ID NO: 756519 - RNA, 22 nt, Human
auguuucagggugauagaaggu

SEQ ID NO: 756520 - RNA, 22 nt, Human
cacugaaccguaaaugauuuag

SEQ ID NO: 756521 - RNA, 22 nt, Human
uguuccaucaguuuuugguuga

SEQ ID NO: 756522 - RNA, 22 nt, Human
uaagaugucuaagaggagaugc

SEQ ID NO: 756523 - RNA, 22 nt, Human
gggccacacagggcagcucccu

SEQ ID NO: 756524 - RNA, 22 nt, Human
cgucccaguuccagccgcgcug

SEQ ID NO: 756525 - RNA, 22 nt, Human
acuguggggugcgaggcaguga

SEQ ID NO: 756526 - RNA, 22 nt, Human
ugggccuccugcccuggccuag

SEQ ID NO: 756527 - RNA, 21 nt, Human
cugccuugaaugguacuggga

SEQ ID NO: 756528 - RNA, 22 nt, Human
uggcuucucgccugucaucccg

SEQ ID NO: 756529 - RNA, 22 nt, Human
aagugcuuggagcauaccuguu

SEQ ID NO: 756530 - RNA, 22 nt, Human
uaaggaagucacaagaaucgcu

SEQ ID NO: 756531 - RNA, 22 nt, Human
aucauacacucacauaaacaga

SEQ ID NO: 756532 - RNA, 22 nt, Human
acaugaagcaagaaagaugcua

SEQ ID NO: 756533 - RNA, 22 nt, Human
uacugaaauagcacucugaugc

SEQ ID NO: 756534 - RNA, 22 nt, Human
augcacaacaguggcugccuug

SEQ ID NO: 756535 - RNA, 22 nt, Human
uuucugcuugagagaauugcug

SEQ ID NO: 756536 - RNA, 22 nt, Human
ccugguggcuucuggguggacg

SEQ ID NO: 756537 - RNA, 22 nt, Human
ugaaggcuugacugaggcagga

SEQ ID NO: 756538 - RNA, 17 nt, Human
gucauucucagaaaaug

SEQ ID NO: 756539 - RNA, 22 nt, Human
cugucagaggcucucuguugcc

SEQ ID NO: 756540 - RNA, 22 nt, Human
ucccagccacaguuuccaccug

SEQ ID NO: 756541 - RNA, 22 nt, Human
ugccucaguuucuccauaugaa

SEQ ID NO: 756542 - RNA, 23 nt, Human
ucuuuccucagcacacaccaaga

SEQ ID NO: 756543 - RNA, 22 nt, Human
aagcaauaagccagauuuggau

SEQ ID NO: 756544 - RNA, 22 nt, Human
cucagaaaaccucuuucuugau

SEQ ID NO: 756545 - RNA, 22 nt, Human
acugugggucccagcugugucu

SEQ ID NO: 756546 - RNA, 22 nt, Human
cagcccugugcggagggcccug

SEQ ID NO: 756547 - RNA, 22 nt, Human
uuucacagagaaauauaacagg

SEQ ID NO: 756548 - RNA, 22 nt, Human
augcauaagugcagcagauuug

SEQ ID NO: 756549 - RNA, 22 nt, Human
aucacauucuuucaaagcaguc

SEQ ID NO: 756550 - RNA, 22 nt, Human
acccuggagcaauaaucccugg

SEQ ID NO: 756551 - RNA, 22 nt, Human
ucccagugcugcuaaagaggua

SEQ ID NO: 756552 - RNA, 22 nt, Human
ucaguuaagaggccacggcagu

SEQ ID NO: 756553 - RNA, 22 nt, Human
cuauugaauagcccaaaucauu

SEQ ID NO: 756554 - RNA, 22 nt, Human
gccuaaggauaugcuuugcuug

SEQ ID NO: 756555 - RNA, 22 nt, Human
aagggcuguaagccaaguaaag

SEQ ID NO: 756556 - RNA, 21 nt, Human
gcauuccuaggagguaagcau

SEQ ID NO: 756557 - RNA, 22 nt, Human
acacauuuucaacacugucaag

SEQ ID NO: 756558 - RNA, 22 nt, Human
aguggucuccccaguagaauaa

SEQ ID NO: 756559 - RNA, 22 nt, Human
auaacuuagaguaggcaaaagu

SEQ ID NO: 756560 - RNA, 22 nt, Human
uuagcaauaugaaugcauuugc

SEQ ID NO: 756561 - RNA, 22 nt, Human
uauugcuuucaguugcuuugag

SEQ ID NO: 756562 - RNA, 22 nt, Human
ucugugccaucagucuccagag

SEQ ID NO: 756563 - RNA, 21 nt, Human
aacuacaguuguuccuucauu

SEQ ID NO: 756564 - RNA, 19 nt, Human
cugugagucuuguggccuc

SEQ ID NO: 756565 - RNA, 22 nt, Human
acagagcuguacaugugccaug

SEQ ID NO: 756566 - RNA, 22 nt, Human
cugcugccaagggugccacagg

SEQ ID NO: 756567 - RNA, 22 nt, Human
uuauucacucauuuaacauuau

SEQ ID NO: 756568 - RNA, 22 nt, Human
cugccucugguuuuggucccug

SEQ ID NO: 756569 - RNA, 22 nt, Human
uaacuuguguuacauuacucuu

SEQ ID NO: 756570 - RNA, 22 nt, Human
aaaucacuaaguuauagugugg

SEQ ID NO: 756571 - RNA, 22 nt, Human
aaggcuccacccucauggaugc

SEQ ID NO: 756572 - RNA, 22 nt, Human
gaagcaaguggccugauucaga

SEQ ID NO: 756573 - RNA, 22 nt, Human
aggguggcugugaagugcuugg

SEQ ID NO: 756574 - RNA, 22 nt, Human
aggaaacuaaggcucagugaag

SEQ ID NO: 756575 - RNA, 22 nt, Human
uguggggacccaugccaugggc

SEQ ID NO: 756576 - RNA, 22 nt, Human
gccuccaccgaacgcucucuug

SEQ ID NO: 756577 - RNA, 22 nt, Human
acaggaacgaauguacauuguu

SEQ ID NO: 756578 - RNA, 22 nt, Human
uaccugaaccaagcccagcucu

SEQ ID NO: 756579 - RNA, 22 nt, Human
cuuccuuccuuccccgaaaugc

SEQ ID NO: 756580 - RNA, 22 nt, Human
gaagguuuuguuugcaaaucau

SEQ ID NO: 756581 - RNA, 22 nt, Human
acagcagguuauuguuauggca

SEQ ID NO: 756582 - RNA, 22 nt, Human
cacuucaaggaauaucuagaaa

SEQ ID NO: 756583 - RNA, 22 nt, Human
cccagaggugacaucccauucu

SEQ ID NO: 756584 - RNA, 22 nt, Human
ugugaauagugccgcaauaaac

SEQ ID NO: 756585 - RNA, 22 nt, Human
gaaugcagauggcugguguaug

SEQ ID NO: 756586 - RNA, 21 nt, Human
aguuuuauauuauaagcuaaa

SEQ ID NO: 756587 - RNA, 20 nt, Human
cauuugaaucuccauucugc

SEQ ID NO: 756588 - RNA, 21 nt, Human
auccuugaucagaagagugcu

SEQ ID NO: 756589 - RNA, 22 nt, Human
ugcauuaagaauuucugaggau

SEQ ID NO: 756590 - RNA, 22 nt, Human
acucucugagcuaccaggugag

SEQ ID NO: 756591 - RNA, 22 nt, Human
aaucauuguugucguuccuaga

SEQ ID NO: 756592 - RNA, 22 nt, Human
uugucauugggguuauuuguua

SEQ ID NO: 756593 - RNA, 22 nt, Human
cagacacugcagcagucuccca

SEQ ID NO: 756594 - RNA, 22 nt, Human
cagagucagagcuccauggagu

SEQ ID NO: 756595 - RNA, 19 nt, Human
augcuuuauguuauuucuu

SEQ ID NO: 756596 - RNA, 22 nt, Human
acacuguuccugaaauuguuau

SEQ ID NO: 756597 - RNA, 22 nt, Human
gggcacauguaaagcuggagaa

SEQ ID NO: 756598 - RNA, 22 nt, Human
ugcaaacaggcauuucacaaac

SEQ ID NO: 756599 - RNA, 22 nt, Human
cucagaggguugaaggugcucu

SEQ ID NO: 756600 - RNA, 22 nt, Human
caaggcugcuucagacuaguga

SEQ ID NO: 756601 - RNA, 22 nt, Human
aggcauggcuuuaggcaggcgu

SEQ ID NO: 756602 - RNA, 22 nt, Human
aggcaguuguugcugagcagcu

SEQ ID NO: 756603 - RNA, 22 nt, Human
auguguaaaaagugcuuaauau

SEQ ID NO: 756604 - RNA, 22 nt, Human
gcuggcagagagcuggugagga

SEQ ID NO: 756605 - RNA, 22 nt, Human
gcuuggcuuugucuuguucacu

SEQ ID NO: 756606 - RNA, 21 nt, Human
ccagaagcugcuugcaggcua

SEQ ID NO: 756607 - RNA, 22 nt, Human
gcgagggcacgcgguugaaggc

SEQ ID NO: 756608 - RNA, 22 nt, Human
cugcucggcgcgcauggcugcc

SEQ ID NO: 756609 - RNA, 22 nt, Human
gcauucuuguuuuuccuacccu

SEQ ID NO: 756610 - RNA, 22 nt, Human
gugcugagcugcagaugcgcuc

SEQ ID NO: 756611 - RNA, 22 nt, Human
gggcccugccuaaggaacacac

SEQ ID NO: 756612 - RNA, 20 nt, Human
uccugaauuuccuuucugcu

SEQ ID NO: 756613 - RNA, 22 nt, Human
uggcucagagagggagugugga

SEQ ID NO: 756614 - RNA, 22 nt, Human
cagggcggggucugccggcccu

SEQ ID NO: 756615 - RNA, 22 nt, Human
aagcagccucauuugugguaag

SEQ ID NO: 756616 - RNA, 22 nt, Human
ucaagaagauaaugucuagggu

SEQ ID NO: 756617 - RNA, 23 nt, Human
agguggccuuugccucuuucucu

SEQ ID NO: 756618 - RNA, 22 nt, Human
uagagguguugacgccaaggua

SEQ ID NO: 756619 - RNA, 22 nt, Human
gaguggcauaugugccugugaa

SEQ ID NO: 756620 - RNA, 22 nt, Human
cauacaagcguucaauagaugu

SEQ ID NO: 756621 - RNA, 22 nt, Human
acagagccacuuuggugccuac

SEQ ID NO: 756622 - RNA, 22 nt, Human
ucccuguggcuaagacaugaca

SEQ ID NO: 756623 - RNA, 22 nt, Human
aaguauuucguucugaaaaagu

SEQ ID NO: 756624 - RNA, 22 nt, Human
gaggagacggggugccuggagc

SEQ ID NO: 756625 - RNA, 22 nt, Human
auccuuuaaguuaauaaaauuc

SEQ ID NO: 756626 - RNA, 22 nt, Human
agaaggaaggaagcauucuguu

SEQ ID NO: 756627 - RNA, 22 nt, Human
guauacaacuauuguuggguaa

SEQ ID NO: 756628 - RNA, 22 nt, Human
uucuggaagcugcagguggccg

SEQ ID NO: 756629 - RNA, 22 nt, Human
augggcaggcacuggcucucag

SEQ ID NO: 756630 - RNA, 22 nt, Human
caggagccccaggcugacaaua

SEQ ID NO: 756631 - RNA, 22 nt, Human
agcagagccaggucucucugua

SEQ ID NO: 756632 - RNA, 20 nt, Human
gcagcagugcaaguccucuu

SEQ ID NO: 756633 - RNA, 21 nt, Human
cugcaucucauagaacauguc

SEQ ID NO: 756634 - RNA, 22 nt, Human
auagaugguauuuagacuagcg

SEQ ID NO: 756635 - RNA, 22 nt, Human
cuuuccuggcuggcaguugugg

SEQ ID NO: 756636 - RNA, 22 nt, Human
ccuggcucugagguaugccugg

SEQ ID NO: 756637 - RNA, 22 nt, Human
cacuaauuccaucuccuuuucc

SEQ ID NO: 756638 - RNA, 22 nt, Human
aguagggagaccggaggccgcc

SEQ ID NO: 756639 - RNA, 22 nt, Human
cugggcacacucugcuccagcu

SEQ ID NO: 756640 - RNA, 22 nt, Human
ugaguguauaucaggagagagc

SEQ ID NO: 756641 - RNA, 20 nt, Human
ucaggaugugcugagugaag

SEQ ID NO: 756642 - RNA, 22 nt, Human
agcuggaagauccugguuuugu

SEQ ID NO: 756643 - RNA, 22 nt, Human
agagacuggcuucuaaaauggc

SEQ ID NO: 756644 - RNA, 22 nt, Human
acugggaacaaggugcucagcg

SEQ ID NO: 756645 - RNA, 22 nt, Human
ucccuggagauaacuucuggga

SEQ ID NO: 756646 - RNA, 22 nt, Human
ggaaaugguggaggaaggcuua

SEQ ID NO: 756647 - RNA, 22 nt, Human
agcugcugggaccccagaucca

SEQ ID NO: 756648 - RNA, 22 nt, Human
cuauuagaaagcaucuucuaua

SEQ ID NO: 756649 - RNA, 22 nt, Human
uucuccagccuauuggccuauc

SEQ ID NO: 756650 - RNA, 22 nt, Human
ucaguguguucaauuggauagg

SEQ ID NO: 756651 - RNA, 22 nt, Human
ucagugcacagagauuuuuguu

SEQ ID NO: 756652 - RNA, 22 nt, Human
gccuugccgcucagcagugggg

SEQ ID NO: 756653 - RNA, 22 nt, Human
cuugcuugccaugggcuugggc

SEQ ID NO: 756654 - RNA, 22 nt, Human
ugccagggccauagggagucua

SEQ ID NO: 756655 - RNA, 18 nt, Human
ccugccagucuggagcag

SEQ ID NO: 756656 - RNA, 22 nt, Human
aaaacacacuggaccaauuuaa

SEQ ID NO: 756657 - RNA, 22 nt, Human
uggcuucccauagcuugcuagu

SEQ ID NO: 756658 - RNA, 22 nt, Human
uuaaauagcucuuguagaagaa

SEQ ID NO: 756659 - RNA, 22 nt, Human
ccuuuuauauggcucaucacag

SEQ ID NO: 756660 - RNA, 22 nt, Human
ccugaguguaauaaugaaggca

SEQ ID NO: 756661 - RNA, 22 nt, Human
ugaggaagggugugacggcacc

SEQ ID NO: 756662 - RNA, 22 nt, Human
agcacuuuaagcaacagaucaa

SEQ ID NO: 756663 - RNA, 22 nt, Human
cuucuggaggacacuggcccca

SEQ ID NO: 756664 - RNA, 22 nt, Human
gagaagaaauagaaucacauuu

SEQ ID NO: 756665 - RNA, 22 nt, Human
ccagcaggguugguuucuucug

SEQ ID NO: 756666 - RNA, 22 nt, Human
guggccaggagagggugggaca

SEQ ID NO: 756667 - RNA, 22 nt, Human
cugaucccauuggcaguccagu

SEQ ID NO: 756668 - RNA, 22 nt, Human
ccucagccccugaauggagaga

SEQ ID NO: 756669 - RNA, 22 nt, Human
aaaguacaaauguucuagccau

SEQ ID NO: 756670 - RNA, 22 nt, Human
aaaguuuuauaugcugcagcga

SEQ ID NO: 756671 - RNA, 22 nt, Human
gcagaggggaagcugaggaauu

SEQ ID NO: 756672 - RNA, 22 nt, Human
ugggaugaguuguuaggacuga

SEQ ID NO: 756673 - RNA, 19 nt, Human
cugcucccuccuucuggca

SEQ ID NO: 756674 - RNA, 22 nt, Human
gagcuuccagagacaucagagu

SEQ ID NO: 756675 - RNA, 22 nt, Human
auucucugugucugcuuuccca

SEQ ID NO: 756676 - RNA, 22 nt, Human
ugaaugagugaguucagaccuc

SEQ ID NO: 756677 - RNA, 22 nt, Human
cuggcaggcagacuucugcaag

SEQ ID NO: 756678 - RNA, 22 nt, Human
uuacuuuggguccugcuuauaa

SEQ ID NO: 756679 - RNA, 22 nt, Human
ucaagacaucacugugcauuuu

SEQ ID NO: 756680 - RNA, 21 nt, Human
agcagacagcccaagaaaauc

SEQ ID NO: 756681 - RNA, 22 nt, Human
cucuuauagacacucuucuaua

SEQ ID NO: 756682 - RNA, 22 nt, Human
uaagcauuguuucugaggaugg

SEQ ID NO: 756683 - RNA, 22 nt, Human
auguccuucuccucuuaccugc

SEQ ID NO: 756684 - RNA, 22 nt, Human
cucuccagggcaugaguuccac

SEQ ID NO: 756685 - RNA, 23 nt, Human
agcugaggcagaggggcauucuc

SEQ ID NO: 756686 - RNA, 22 nt, Human
uucaggauccccuugaugggcu

SEQ ID NO: 756687 - RNA, 23 nt, Human
augguuuauguuguugugaagca

SEQ ID NO: 756688 - RNA, 22 nt, Human
ucuggggagugccuaaguggaa

SEQ ID NO: 756689 - RNA, 22 nt, Human
ucugggagguggcagggugcau

SEQ ID NO: 756690 - RNA, 22 nt, Human
ucauaauacaaagaguucugca

SEQ ID NO: 756691 - RNA, 22 nt, Human
cucugggcugccuuuuagcucu

SEQ ID NO: 756692 - RNA, 22 nt, Human
aacaguuuaucaaguuuuuaca

SEQ ID NO: 756693 - RNA, 22 nt, Human
ugccugugggugaugauuugau

SEQ ID NO: 756694 - RNA, 22 nt, Human
ucccagcacuguaauucuuugg

SEQ ID NO: 756695 - RNA, 22 nt, Human
ucuccugggaggacaaggaagg

SEQ ID NO: 756696 - RNA, 22 nt, Human
uauuucuaagcuguaagucuga

SEQ ID NO: 756697 - RNA, 22 nt, Human
aauuucuucagcucuaaaaugg

SEQ ID NO: 756698 - RNA, 22 nt, Human
cugcaggcauuuauucaugcaa

SEQ ID NO: 756699 - RNA, 22 nt, Human
gcagcgacaggcacuggucagg

SEQ ID NO: 756700 - RNA, 22 nt, Human
agucagggguuggacggggcca

SEQ ID NO: 756701 - RNA, 22 nt, Human
ccugucugcagauaucucaggu

SEQ ID NO: 756702 - RNA, 22 nt, Human
uuuaguaccaucauuugccucu

SEQ ID NO: 756703 - RNA, 22 nt, Human
aggaggcccuagagcucuagag

SEQ ID NO: 756704 - RNA, 18 nt, Human
cccagcuggugggucagu

SEQ ID NO: 756705 - RNA, 22 nt, Human
guuauucuacagucauugaagu

SEQ ID NO: 756706 - RNA, 22 nt, Human
gagggcugccacguugggcgag

SEQ ID NO: 756707 - RNA, 22 nt, Human
ucagugaaccuucuguggcagg

SEQ ID NO: 756708 - RNA, 22 nt, Human
uuuugugauggcauuacauuua

SEQ ID NO: 756709 - RNA, 22 nt, Human
aagguacaccaaaguucaaguu

SEQ ID NO: 756710 - RNA, 22 nt, Human
aauucuaaauguaauuuagaau

SEQ ID NO: 756711 - RNA, 22 nt, Human
aaucuuucguuucuccugucug

SEQ ID NO: 756712 - RNA, 22 nt, Human
ggcuacagacugcauaagggca

SEQ ID NO: 756713 - RNA, 22 nt, Human
acugggcaccaucaugagaugg

SEQ ID NO: 756714 - RNA, 22 nt, Human
cugccuccaggcucaccuugac

SEQ ID NO: 756715 - RNA, 22 nt, Human
cugugccuucugccuggaacau

SEQ ID NO: 756716 - RNA, 22 nt, Human
aguugaaagccuuauuucucug

SEQ ID NO: 756717 - RNA, 22 nt, Human
aaauaggagcuuaagcacuucu

SEQ ID NO: 756718 - RNA, 22 nt, Human
agucacagaaacccaggugugg

SEQ ID NO: 756719 - RNA, 22 nt, Human
gucugugggccaaauacagccc

SEQ ID NO: 756720 - RNA, 22 nt, Human
ucagggacuaggugcugccuga

SEQ ID NO: 756721 - RNA, 22 nt, Human
aaacagcugcaguacacggccu

SEQ ID NO: 756722 - RNA, 22 nt, Human
aaauacagaguuauggaccuca

SEQ ID NO: 756723 - RNA, 21 nt, Human
auaagcaugcugauuacauuu

SEQ ID NO: 756724 - RNA, 22 nt, Human
gucugcuuugucuuucaugaua

SEQ ID NO: 756725 - RNA, 22 nt, Human
ugguccugucucaaggagccuu

SEQ ID NO: 756726 - RNA, 22 nt, Human
gaaucacacucguaagugaguu

SEQ ID NO: 756727 - RNA, 22 nt, Human
ugguccugccccgugcacagag

SEQ ID NO: 756728 - RNA, 22 nt, Human
gucccaggaguugcugggccuu

SEQ ID NO: 756729 - RNA, 22 nt, Human
cugauaauguccugcaguaaau

SEQ ID NO: 756730 - RNA, 22 nt, Human
ugcccaggcuucacccucagag

SEQ ID NO: 756731 - RNA, 22 nt, Human
aacuacaggggguggcaggcgg

SEQ ID NO: 756732 - RNA, 22 nt, Human
agcccugagccagccuggucag

SEQ ID NO: 756733 - RNA, 22 nt, Human
ugaaacauuauagaauauuuau

SEQ ID NO: 756734 - RNA, 17 nt, Human
uguauuuaucaugucag

SEQ ID NO: 756735 - RNA, 22 nt, Human
aacgugcauuaggaccucucca

SEQ ID NO: 756736 - RNA, 18 nt, Human
gcugucugaggucugagg

SEQ ID NO: 756737 - RNA, 22 nt, Human
ucagcucuuccccccagccagg

SEQ ID NO: 756738 - RNA, 22 nt, Human
ugagguaaauagaaaaaccaug

SEQ ID NO: 756739 - RNA, 22 nt, Human
agggcugcuccuccuucaggcc

SEQ ID NO: 756740 - RNA, 22 nt, Human
ccaguguuacggcuugaacuau

SEQ ID NO: 756741 - RNA, 22 nt, Human
uacagaauguuaugaagcauag

SEQ ID NO: 756742 - RNA, 22 nt, Human
gaugucuuugcuguuauccacu

SEQ ID NO: 756743 - RNA, 22 nt, Human
ggagggccccuccagugggcag

SEQ ID NO: 756744 - RNA, 22 nt, Human
aaaugauugucaaaguucuguu

SEQ ID NO: 756745 - RNA, 22 nt, Human
aggauucagaauguaugcagug

SEQ ID NO: 756746 - RNA, 22 nt, Human
aggcgcagaaggccaggggccu

SEQ ID NO: 756747 - RNA, 22 nt, Human
acaugacuuuucucuuccagag

SEQ ID NO: 756748 - RNA, 22 nt, Human
ucucuguagcagcuuccuuccu

SEQ ID NO: 756749 - RNA, 22 nt, Human
agccagaggaacuugaugacug

SEQ ID NO: 756750 - RNA, 22 nt, Human
agagcagucaggcuaggacacu

SEQ ID NO: 756751 - RNA, 22 nt, Human
cagggacagccuugggguggcg

SEQ ID NO: 756752 - RNA, 22 nt, Human
uucucaaagggugguuugcaaa

SEQ ID NO: 756753 - RNA, 22 nt, Human
uguuacagugacuaauguuuua

SEQ ID NO: 756754 - RNA, 22 nt, Human
uccuccugccuuugcuucuugu

SEQ ID NO: 756755 - RNA, 22 nt, Human
uuagggcuuuucugaauaggcc

SEQ ID NO: 756756 - RNA, 22 nt, Human
uggaauagaggugcugauauua

SEQ ID NO: 756757 - RNA, 22 nt, Human
gcucugaggcugugaggugcug

SEQ ID NO: 756758 - RNA, 22 nt, Human
auguggcugguaguugacaacu

SEQ ID NO: 756759 - RNA, 16 nt, Human
ugguggggaggacagc

SEQ ID NO: 756760 - RNA, 22 nt, Human
aacuuuaucggaacagguacuc

SEQ ID NO: 756761 - RNA, 19 nt, Human
cccaguccuuguccugggc

SEQ ID NO: 756762 - RNA, 22 nt, Human
aauguuuugcauuaguuuucua

SEQ ID NO: 756763 - RNA, 22 nt, Human
cccugaguuaguacaguugagu

SEQ ID NO: 756764 - RNA, 22 nt, Human
uccccagcucugugcuuccacu

SEQ ID NO: 756765 - RNA, 22 nt, Human
uucuuucuguccauaaugagac

SEQ ID NO: 756766 - RNA, 22 nt, Human
ucagcaaaauguggcuagugcu

SEQ ID NO: 756767 - RNA, 22 nt, Human
uccagguagauuuauuccagcc

SEQ ID NO: 756768 - RNA, 22 nt, Human
ugcaauaacuacuuuaauguug

SEQ ID NO: 756769 - RNA, 22 nt, Human
uguccaguccuuggggugcugu

SEQ ID NO: 756770 - RNA, 22 nt, Human
agacagcauuucuagcaccagg

SEQ ID NO: 756771 - RNA, 22 nt, Human
agcugguaaguggcagagauuc

SEQ ID NO: 756772 - RNA, 22 nt, Human
uugucugucccagcuugugcau

SEQ ID NO: 756773 - RNA, 18 nt, Human
acacacacaccuguguau

SEQ ID NO: 756774 - RNA, 21 nt, Human
ccacauucucauucugacugc

SEQ ID NO: 756775 - RNA, 22 nt, Human
uucagcaccacuuccagagaag

SEQ ID NO: 756776 - RNA, 22 nt, Human
ugcaggcucacccuggagcuga

SEQ ID NO: 756777 - RNA, 22 nt, Human
gcagcuggagaaauaccacccu

SEQ ID NO: 756778 - RNA, 18 nt, Human
gggcaucauucacaaagu

SEQ ID NO: 756779 - RNA, 19 nt, Human
uccuggggaggggcauggc

SEQ ID NO: 756780 - RNA, 22 nt, Human
gagaccaggaaguacagcagcc

SEQ ID NO: 756781 - RNA, 22 nt, Human
uggcagcagccauggaaggccc

SEQ ID NO: 756782 - RNA, 22 nt, Human
gcucugagaggugcagcaguaa

SEQ ID NO: 756783 - RNA, 22 nt, Human
gggagcugaccugcagguuccc

SEQ ID NO: 756784 - RNA, 22 nt, Human
caggcucccuucucggaauucu

SEQ ID NO: 756785 - RNA, 22 nt, Human
auguggcaaugguuagcacugu

SEQ ID NO: 756786 - RNA, 22 nt, Human
ugucucuuggagggucuaguga

SEQ ID NO: 756787 - RNA, 22 nt, Human
aagcuuuagagaugaguuccuu

SEQ ID NO: 756788 - RNA, 22 nt, Human
aggcuagggccauggcugguga

SEQ ID NO: 756789 - RNA, 22 nt, Human
cugggugucaggagacaugaug

SEQ ID NO: 756790 - RNA, 18 nt, Human
cauuaugugguuauagaa

SEQ ID NO: 756791 - RNA, 22 nt, Human
ggcacugaucugauuucccucc

SEQ ID NO: 756792 - RNA, 22 nt, Human
gcuucagaccugaaaggaaaaa

SEQ ID NO: 756793 - RNA, 22 nt, Human
caaaugaaguccaaagggcuua

SEQ ID NO: 756794 - RNA, 22 nt, Human
gagggugcugugccaagaugac

SEQ ID NO: 756795 - RNA, 19 nt, Human
ccaggaccuuuccaggguc

SEQ ID NO: 756796 - RNA, 22 nt, Human
uagcugagaggccaauugaacu

SEQ ID NO: 756797 - RNA, 22 nt, Human
cagggcuucgugucucagugcu

SEQ ID NO: 756798 - RNA, 22 nt, Human
aggcuucuggggcaccgagcga

SEQ ID NO: 756799 - RNA, 22 nt, Human
acaguguuuuaugagaauuguu

SEQ ID NO: 756800 - RNA, 22 nt, Human
augaaugaagaacaucugugcc

SEQ ID NO: 756801 - RNA, 22 nt, Human
uaacaugcuaauuugcagauag

SEQ ID NO: 756802 - RNA, 22 nt, Human
agcugccuggagccagaguuga

SEQ ID NO: 756803 - RNA, 20 nt, Human
agugcauggagggagagggc

SEQ ID NO: 756804 - RNA, 22 nt, Human
gcugucagugaggugagacaug

SEQ ID NO: 756805 - RNA, 22 nt, Human
gggggggucuucagaccucaga

SEQ ID NO: 756806 - RNA, 22 nt, Human
cagggccauuggaacaaagagg

SEQ ID NO: 756807 - RNA, 22 nt, Human
aguguacaucagaacauaucaa

SEQ ID NO: 756808 - RNA, 22 nt, Human
uuggaacaaucacauccuugcu

SEQ ID NO: 756809 - RNA, 22 nt, Human
acucuggguccugccauucacu

SEQ ID NO: 756810 - RNA, 22 nt, Human
ugcaagagcccagggccaggaa

SEQ ID NO: 756811 - RNA, 22 nt, Human
uugguuccuucugaaaguauug

SEQ ID NO: 756812 - RNA, 22 nt, Human
ugugaaaggagccauagacagu

SEQ ID NO: 756813 - RNA, 22 nt, Human
uuguacaaauaggaaccucuga

SEQ ID NO: 756814 - RNA, 22 nt, Human
caccuuuugugucugcguuugu

SEQ ID NO: 756815 - RNA, 22 nt, Human
aagccaaaggcuccagugaccu

SEQ ID NO: 756816 - RNA, 23 nt, Human
uuucacauuuacuguuagauggc

SEQ ID NO: 756817 - RNA, 22 nt, Human
ggcauuagcguugaauuuuauu

SEQ ID NO: 756818 - RNA, 22 nt, Human
aaccuagacagggccucuguua

SEQ ID NO: 756819 - RNA, 22 nt, Human
uggcuacagauuugcugacaau

SEQ ID NO: 756820 - RNA, 22 nt, Human
cuguggcuuuggggcggaggac

SEQ ID NO: 756821 - RNA, 22 nt, Human
uguccuguaggaggcagaacaa

SEQ ID NO: 756822 - RNA, 23 nt, Human
uggagguuuuacugaguugagga

SEQ ID NO: 756823 - RNA, 22 nt, Human
ucauuucaugucucaggcacug

SEQ ID NO: 756824 - RNA, 22 nt, Human
uuuaaagugcugcuccuauccu

SEQ ID NO: 756825 - RNA, 22 nt, Human
uucaaggagauuggagucuacu

SEQ ID NO: 756826 - RNA, 22 nt, Human
gcaauaaaauguaaugauuggg

SEQ ID NO: 756827 - RNA, 22 nt, Human
gcuuuaaugaagucacgcaaag

SEQ ID NO: 756828 - RNA, 20 nt, Human
augauucugggcuacacugg

SEQ ID NO: 756829 - RNA, 22 nt, Human
uggcugccuagucccucagccu

SEQ ID NO: 756830 - RNA, 22 nt, Human
ugauaaacagcugaugaagacc

SEQ ID NO: 756831 - RNA, 22 nt, Human
uuugucuuuccccuccucauug

SEQ ID NO: 756832 - RNA, 22 nt, Human
auauauaagcugaugagccaca

SEQ ID NO: 756833 - RNA, 22 nt, Human
aggcauaggacaucuaugucau

SEQ ID NO: 756834 - RNA, 17 nt, Human
ugcucaaauacuuuuga

SEQ ID NO: 756835 - RNA, 22 nt, Human
uuaaaaaccaucuuccuuuccu

SEQ ID NO: 756836 - RNA, 22 nt, Human
agcugccacagagccuggccag

SEQ ID NO: 756837 - RNA, 22 nt, Human
auucagaaauagaaaauuugau

SEQ ID NO: 756838 - RNA, 18 nt, Human
agcaacaggaucccaggg

SEQ ID NO: 756839 - RNA, 22 nt, Human
auggcucagcccauggaagaaa

SEQ ID NO: 756840 - RNA, 22 nt, Human
auguggcuauuuuaauguuaau

SEQ ID NO: 756841 - RNA, 22 nt, Human
ucuacuauguuucuuaaauaga

SEQ ID NO: 756842 - RNA, 22 nt, Human
acacauauauuugcauauacac

SEQ ID NO: 756843 - RNA, 22 nt, Human
acagacauauuuggcccauagc

SEQ ID NO: 756844 - RNA, 22 nt, Human
uccaacuuucuccuccggcuug

SEQ ID NO: 756845 - RNA, 19 nt, Human
ugcuucuggaaugcaaggc

SEQ ID NO: 756846 - RNA, 22 nt, Human
guucacagguucucuuucuaag

SEQ ID NO: 756847 - RNA, 22 nt, Human
agcugcuuuuagggccgggcuc

SEQ ID NO: 756848 - RNA, 22 nt, Human
ucaggcugguggucagauggcu

SEQ ID NO: 756849 - RNA, 22 nt, Human
gggacagacccaugggccaggu

SEQ ID NO: 756850 - RNA, 22 nt, Human
cauuucaaaagaauugccagaa

SEQ ID NO: 756851 - RNA, 22 nt, Human
gaggaggucgcugcugagcccc

SEQ ID NO: 756852 - RNA, 22 nt, Human
gaucugguacaggccugcagcc

SEQ ID NO: 756853 - RNA, 22 nt, Human
uuuguacacaggauguuauaau

SEQ ID NO: 756854 - RNA, 22 nt, Human
agcuguugcagggaucagcacc

SEQ ID NO: 756855 - RNA, 17 nt, Human
caaggccagcaucuuca

SEQ ID NO: 756856 - RNA, 22 nt, Human
augcacuugcguguuugcaaau

SEQ ID NO: 756857 - RNA, 22 nt, Human
cuuccccaaguagagaggggag

SEQ ID NO: 756858 - RNA, 22 nt, Human
cugccaggggccucacaggcca

SEQ ID NO: 756859 - RNA, 22 nt, Human
uguguuaaggcacugauaucug

SEQ ID NO: 756860 - RNA, 22 nt, Human
gcuugccuaucugguggucguu

SEQ ID NO: 756861 - RNA, 23 nt, Human
auacugaaacuguuguuuaucug

SEQ ID NO: 756862 - RNA, 22 nt, Human
gccaaggccucugcaggaugag

SEQ ID NO: 756863 - RNA, 22 nt, Human
ucacucagguucaugucuuugu

SEQ ID NO: 756864 - RNA, 22 nt, Human
uugcccuuguggaguuuacaug

SEQ ID NO: 756865 - RNA, 22 nt, Human
cuuucuuauaccugucagggcc

SEQ ID NO: 756866 - RNA, 22 nt, Human
caugcucacaaaagauggcaaa

SEQ ID NO: 756867 - RNA, 22 nt, Human
gcccacagaggcaccaccaggc

SEQ ID NO: 756868 - RNA, 22 nt, Human
ucucccaggcuggagugcagug

SEQ ID NO: 756869 - RNA, 21 nt, Human
auaugaguuucagauguugcu

SEQ ID NO: 756870 - RNA, 23 nt, Human
ugcagcugccucuggcgggccgg

SEQ ID NO: 756871 - RNA, 22 nt, Human
ugugcagaaacugggaaggaag

SEQ ID NO: 756872 - RNA, 22 nt, Human
uuccaauauuuacaaugcauua

SEQ ID NO: 756873 - RNA, 22 nt, Human
uuccucaguuagugccugaggc

SEQ ID NO: 756874 - RNA, 22 nt, Human
acuguuaauucaaucaacaggu

SEQ ID NO: 756875 - RNA, 22 nt, Human
cuguggaaauaaacaaugcuaa

SEQ ID NO: 756876 - RNA, 22 nt, Human
ugucuuauuaagaccagugacu

SEQ ID NO: 756877 - RNA, 22 nt, Human
gaaaccugggauauauaaguuu

SEQ ID NO: 756878 - RNA, 21 nt, Human
uuucccucauuguguuggcac

SEQ ID NO: 756879 - RNA, 22 nt, Human
caugcaucgaugaaugcguggg

SEQ ID NO: 756880 - RNA, 23 nt, Human
ucucaggacacacaugucuauca

SEQ ID NO: 756881 - RNA, 22 nt, Human
ugucacauuauaugugaggaua

SEQ ID NO: 756882 - RNA, 22 nt, Human
cagcuuccgaccgggggcugca

SEQ ID NO: 756883 - RNA, 20 nt, Human
ggucagccccaccuggcagc

SEQ ID NO: 756884 - RNA, 22 nt, Human
uauuuggauacaaucauuugcu

SEQ ID NO: 756885 - RNA, 22 nt, Human
gggcuaaaugcagaaaugcaga

SEQ ID NO: 756886 - RNA, 22 nt, Human
ucuucucccagggucgcccaag

SEQ ID NO: 756887 - RNA, 22 nt, Human
ucagggacuuacaaaccagaag

SEQ ID NO: 756888 - RNA, 22 nt, Human
ucacaguaguuguucucuguuu

SEQ ID NO: 756889 - RNA, 22 nt, Human
acagcagcuugcgugucugguc

SEQ ID NO: 756890 - RNA, 22 nt, Human
cuuacagugaucaacacaaaga

SEQ ID NO: 756891 - RNA, 22 nt, Human
aaucagaaagaggucauguugc

SEQ ID NO: 756892 - RNA, 22 nt, Human
ugaaagguuaaaaguaguauug

SEQ ID NO: 756893 - RNA, 22 nt, Human
ggaggccacgguuuagcaccga

SEQ ID NO: 756894 - RNA, 22 nt, Human
ucacagaagagcauuaagauga

SEQ ID NO: 756895 - RNA, 22 nt, Human
cugagaaaggaccucaaacagg

SEQ ID NO: 756896 - RNA, 22 nt, Human
agguggccggugccagccgggc

SEQ ID NO: 756897 - RNA, 22 nt, Human
aguagacagacagaacacagcc

SEQ ID NO: 756898 - RNA, 18 nt, Human
agcaguguggcaagcaga

SEQ ID NO: 756899 - RNA, 22 nt, Human
uugacauaagacuuagaguauu

SEQ ID NO: 756900 - RNA, 22 nt, Human
uggaccgcagggaugcccggca

SEQ ID NO: 756901 - RNA, 22 nt, Human
uggcuuucucccccagcuucuc

SEQ ID NO: 756902 - RNA, 22 nt, Human
acagggccauuaucuguucuag

SEQ ID NO: 756903 - RNA, 22 nt, Human
uacagaccaguaguucucagcg

SEQ ID NO: 756904 - RNA, 17 nt, Human
ucuacuccugaaggaag

SEQ ID NO: 756905 - RNA, 22 nt, Human
agcuccagaggcagugaugaag

SEQ ID NO: 756906 - RNA, 22 nt, Human
uaucacacuguuuuaauuacuu

SEQ ID NO: 756907 - RNA, 22 nt, Human
caaugugguggcagaugucagu

SEQ ID NO: 756908 - RNA, 22 nt, Human
gcuucucuggccugcagggcau

SEQ ID NO: 756909 - RNA, 22 nt, Human
ucacaaauuucagcucccugaa

SEQ ID NO: 756910 - RNA, 22 nt, Human
uggauggaucucaagggaauua

SEQ ID NO: 756911 - RNA, 22 nt, Human
ggauggcagacagugaguggcu

SEQ ID NO: 756912 - RNA, 22 nt, Human
agaguuuacagaaauaagcugu

SEQ ID NO: 756913 - RNA, 22 nt, Human
acagccaguccucccacagggu

SEQ ID NO: 756914 - RNA, 22 nt, Human
agaaccuuucuuuagaaauuca

SEQ ID NO: 756915 - RNA, 22 nt, Human
caccacugcuuccugccaucug

SEQ ID NO: 756916 - RNA, 22 nt, Human
caagguuuuggaagauuuucgu

SEQ ID NO: 756917 - RNA, 22 nt, Human
aggcuggcccuacuggcugccu

SEQ ID NO: 756918 - RNA, 22 nt, Human
uccgauaagcaauucuugugcu

SEQ ID NO: 756919 - RNA, 22 nt, Human
ucuacacuguagaauuauaagg

SEQ ID NO: 756920 - RNA, 20 nt, Human
uggccucugagaugccacgg

SEQ ID NO: 756921 - RNA, 22 nt, Human
cccugcagagggaugggggcag

SEQ ID NO: 756922 - RNA, 22 nt, Human
guuaaauucgaugauggauaaa

SEQ ID NO: 756923 - RNA, 22 nt, Human
aauauuaauagaagggguucua

SEQ ID NO: 756924 - RNA, 22 nt, Human
guaaaauagaauaacguggcua

SEQ ID NO: 756925 - RNA, 23 nt, Human
ugcuggaagguccaauuugcuca

SEQ ID NO: 756926 - RNA, 22 nt, Human
aggaugagagauacauggagca

SEQ ID NO: 756927 - RNA, 22 nt, Human
ccagugcuuccaggaauacggu

SEQ ID NO: 756928 - RNA, 22 nt, Human
auuuuguuauaggagcugaaau

SEQ ID NO: 756929 - RNA, 22 nt, Human
gagggccagccugccaagggcc

SEQ ID NO: 756930 - RNA, 22 nt, Human
aauagcaaacagacaugcacaa

SEQ ID NO: 756931 - RNA, 22 nt, Human
aaugaugacaggauaaagaaca

SEQ ID NO: 756932 - RNA, 22 nt, Human
auuccaaagacagaagcagcug

SEQ ID NO: 756933 - RNA, 22 nt, Human
gcaauacaguagguuuauuggu

SEQ ID NO: 756934 - RNA, 22 nt, Human
acccaggagacagguugcagug

SEQ ID NO: 756935 - RNA, 22 nt, Human
cuuggagacaggacaggcagaa

SEQ ID NO: 756936 - RNA, 22 nt, Human
cugcagaggucuugcugauggu

SEQ ID NO: 756937 - RNA, 22 nt, Human
acuagaaccagaggaggcaggu

SEQ ID NO: 756938 - RNA, 22 nt, Human
cuuccaagaugaacagcaagcg

SEQ ID NO: 756939 - RNA, 22 nt, Human
ccugacaguccuuuucuagugu

SEQ ID NO: 756940 - RNA, 22 nt, Human
aaaaauacuucacuucugggug

SEQ ID NO: 756941 - RNA, 22 nt, Human
acauaaauagauuauugggagg

SEQ ID NO: 756942 - RNA, 23 nt, Human
ggaguuggauuguacuugcugcu

SEQ ID NO: 756943 - RNA, 22 nt, Human
cugggcaauaugcugggccugg

SEQ ID NO: 756944 - RNA, 23 nt, Human
agaagcagcuucuggaguaucgg

SEQ ID NO: 756945 - RNA, 22 nt, Human
ucacaucuccauguguuguuca

SEQ ID NO: 756946 - RNA, 22 nt, Human
uguaaacaugcugaggcuggag

SEQ ID NO: 756947 - RNA, 22 nt, Human
uuugaugaaccuauauaauuug

SEQ ID NO: 756948 - RNA, 22 nt, Human
cugcaguaucugcuuuggguag

SEQ ID NO: 756949 - RNA, 22 nt, Human
gucugguauucaauuauuauuu

SEQ ID NO: 756950 - RNA, 23 nt, Human
ugauggaaaugaucugggucugu

SEQ ID NO: 756951 - RNA, 22 nt, Human
cccagggguaaggcgcagcgug

SEQ ID NO: 756952 - RNA, 22 nt, Human
caggccuggcugcagcucgccu

SEQ ID NO: 756953 - RNA, 22 nt, Human
augucccuugucugugaugucu

SEQ ID NO: 756954 - RNA, 22 nt, Human
uuccugagucgccgagucuaug

SEQ ID NO: 756955 - RNA, 22 nt, Human
ucugugcugccauccuguggcc

SEQ ID NO: 756956 - RNA, 22 nt, Human
augucagagcuuccacaauagu

SEQ ID NO: 756957 - RNA, 22 nt, Human
ugugccuuucaucaugcuuuug

SEQ ID NO: 756958 - RNA, 22 nt, Human
acugccugcauccuuaggguag

SEQ ID NO: 756959 - RNA, 22 nt, Human
uggggcucaccuaggcuggaag

SEQ ID NO: 756960 - RNA, 22 nt, Human
gcucagaagauauuugaugcug

SEQ ID NO: 756961 - RNA, 22 nt, Human
cacaaaauaucaagcacuuuua

SEQ ID NO: 756962 - RNA, 22 nt, Human
ggcuccuggggaggugagcuug

SEQ ID NO: 756963 - RNA, 18 nt, Human
uggcuccugccuccugca

SEQ ID NO: 756964 - RNA, 21 nt, Human
acucaucuuuuuggagaccag

SEQ ID NO: 756965 - RNA, 21 nt, Human
gagugggcugagauggggcug

SEQ ID NO: 756966 - RNA, 22 nt, Human
ucaggcagagggagaagccaag

SEQ ID NO: 756967 - RNA, 22 nt, Human
aacuccucacugccucuggcac

SEQ ID NO: 756968 - RNA, 22 nt, Human
cuguuuucuagggcugagguga

SEQ ID NO: 756969 - RNA, 22 nt, Human
ggaaguguuugugcagauggcc

SEQ ID NO: 756970 - RNA, 22 nt, Human
aggcagccauuaccaagggcau

SEQ ID NO: 756971 - RNA, 22 nt, Human
cacaguuuuaucuuauacugau

SEQ ID NO: 756972 - RNA, 22 nt, Human
cagagagagucaaaucuuugcu

SEQ ID NO: 756973 - RNA, 18 nt, Human
cuguugagauguggcuga

SEQ ID NO: 756974 - RNA, 22 nt, Human
agccaaaacaugugaguuuuga

SEQ ID NO: 756975 - RNA, 22 nt, Human
aaacuacacuuugggaccagca

SEQ ID NO: 756976 - RNA, 22 nt, Human
uaguggagaggauguggagaaa

SEQ ID NO: 756977 - RNA, 18 nt, Human
cucaggcagagaagcuuu

SEQ ID NO: 756978 - RNA, 23 nt, Human
auaaggcauaaagguacauugga

SEQ ID NO: 756979 - RNA, 22 nt, Human
cagaucaugaaugacugacaga

SEQ ID NO: 756980 - RNA, 22 nt, Human
ccugaguggccaggcagcugug

SEQ ID NO: 756981 - RNA, 22 nt, Human
ucugcuugcguucugcucccuc

SEQ ID NO: 756982 - RNA, 19 nt, Human
cacuuugcugaacucuucu

SEQ ID NO: 756983 - RNA, 22 nt, Human
caggacagacagaaugccuaac

SEQ ID NO: 756984 - RNA, 22 nt, Human
cagcagcucacucagguggcuc

SEQ ID NO: 756985 - RNA, 22 nt, Human
uucccagaccuguaggaucaga

SEQ ID NO: 756986 - RNA, 20 nt, Human
accagaggaaagagcaguga

SEQ ID NO: 756987 - RNA, 22 nt, Human
uguucacaagcagauguugcuu

SEQ ID NO: 756988 - RNA, 22 nt, Human
ugcccuggcgcugucucuaugg

SEQ ID NO: 756989 - RNA, 22 nt, Human
accagcaccugauaggcaguaa

SEQ ID NO: 756990 - RNA, 22 nt, Human
ugcagagcagcaacugcgugcg

SEQ ID NO: 756991 - RNA, 22 nt, Human
cauaggucacuguacagguuaa

SEQ ID NO: 756992 - RNA, 22 nt, Human
gggugggaugccgcugucucca

SEQ ID NO: 756993 - RNA, 22 nt, Human
agccuggagaagauguguauug

SEQ ID NO: 756994 - RNA, 22 nt, Human
ccugucuggccuuccacggggg

SEQ ID NO: 756995 - RNA, 22 nt, Human
ccugggaacaguggguuggcuc

SEQ ID NO: 756996 - RNA, 22 nt, Human
acaugccagccucagcagcagu

SEQ ID NO: 756997 - RNA, 19 nt, Human
ucaguggagaaaggggaag

SEQ ID NO: 756998 - RNA, 22 nt, Human
acuucauauuguuuccacuaga

SEQ ID NO: 756999 - RNA, 22 nt, Human
ucugaaauauugguaauacuuu

SEQ ID NO: 757000 - RNA, 23 nt, Human
uuacaacaguguccauauuugua

SEQ ID NO: 757001 - RNA, 20 nt, Human
acugagguuagauaacaggu

SEQ ID NO: 757002 - RNA, 22 nt, Human
ucuuucaaaguaacaaccacga

SEQ ID NO: 757003 - RNA, 22 nt, Human
ugagcacauuucacaugacagg

SEQ ID NO: 757004 - RNA, 22 nt, Human
uuuuacuucauuccugacuuca

SEQ ID NO: 757005 - RNA, 22 nt, Human
aguuuccugggagauucuuaca

SEQ ID NO: 757006 - RNA, 22 nt, Human
ucuggcucugaauucacuucug

SEQ ID NO: 757007 - RNA, 22 nt, Human
gacccuggugggcacuggcacc

SEQ ID NO: 757008 - RNA, 22 nt, Human
aaagguuuuguucaucgauuuu

SEQ ID NO: 757009 - RNA, 22 nt, Human
uugaaaggaauacagaggccua

SEQ ID NO: 757010 - RNA, 23 nt, Human
aggaacugcuucauuuuugaaag

SEQ ID NO: 757011 - RNA, 22 nt, Human
acauucuuaacaguuaaaaacu

SEQ ID NO: 757012 - RNA, 22 nt, Human
agggcaauggacuacaaaaggu

SEQ ID NO: 757013 - RNA, 22 nt, Human
aagaaauggcuucaucugagua

SEQ ID NO: 757014 - RNA, 22 nt, Human
uuuguucaauccagacaauagc

SEQ ID NO: 757015 - RNA, 22 nt, Human
aucuuuguuuugaugcagaucu

SEQ ID NO: 757016 - RNA, 22 nt, Human
uuauuauuuuguguacagcaaa

SEQ ID NO: 757017 - RNA, 22 nt, Human
gcagccuguuguaccagccugu

SEQ ID NO: 757018 - RNA, 22 nt, Human
uggcuucaaagguagcauacaa

SEQ ID NO: 757019 - RNA, 22 nt, Human
uuuccuuucucaagagccggca

SEQ ID NO: 757020 - RNA, 22 nt, Human
guucaaccaugauuaggaacug

SEQ ID NO: 757021 - RNA, 21 nt, Human
uaagcauaucagauagacucu

SEQ ID NO: 757022 - RNA, 22 nt, Human
agugaccaaucaugguuagauu

SEQ ID NO: 757023 - RNA, 22 nt, Human
gaaacaaucaucaugugauuug

SEQ ID NO: 757024 - RNA, 22 nt, Human
gacaauguguugaaagggaaaa

SEQ ID NO: 757025 - RNA, 21 nt, Human
ugcagcugacacugguaugcc

SEQ ID NO: 757026 - RNA, 22 nt, Human
aaaguguggcacaagucacauc

SEQ ID NO: 757027 - RNA, 22 nt, Human
aaaaugauauccugacuuuuau

SEQ ID NO: 757028 - RNA, 22 nt, Human
auggguaaagcaggaagagagu

SEQ ID NO: 757029 - RNA, 21 nt, Human
uucaaaguuugccuaaagauu

SEQ ID NO: 757030 - RNA, 22 nt, Human
aauuaccaggauuuuucaguau

SEQ ID NO: 757031 - RNA, 22 nt, Human
guggcaggucccauuggagcag

SEQ ID NO: 757032 - RNA, 22 nt, Human
uccuggguagccuguccaagau

SEQ ID NO: 757033 - RNA, 22 nt, Human
gcucucuggcuaguccaucggg

SEQ ID NO: 757034 - RNA, 22 nt, Human
agcuggugaaccugaggcacag

SEQ ID NO: 757035 - RNA, 22 nt, Human
aaggaggcagaacucacaugga

SEQ ID NO: 757036 - RNA, 22 nt, Human
agaugcuuuccugauauuuaug

SEQ ID NO: 757037 - RNA, 22 nt, Human
uccccaggaaauucugauucuu

SEQ ID NO: 757038 - RNA, 22 nt, Human
ucauuuacgcgccuccuuccuu

SEQ ID NO: 757039 - RNA, 21 nt, Human
uggaucugugaucuggggcac

SEQ ID NO: 757040 - RNA, 22 nt, Human
uucauuuguaacucuguuaggg

SEQ ID NO: 757041 - RNA, 22 nt, Human
gcagcauggaguuguggaauga

SEQ ID NO: 757042 - RNA, 22 nt, Human
agcccagagccccggccauguu

SEQ ID NO: 757043 - RNA, 22 nt, Human
ugagcacagcuuucacuagaaa

SEQ ID NO: 757044 - RNA, 22 nt, Human
ggcaccaggcugggcauaggcc

SEQ ID NO: 757045 - RNA, 22 nt, Human
gcuucagaaaugaacacugucu

SEQ ID NO: 757046 - RNA, 22 nt, Human
aacaguauaugaaauguuagga

SEQ ID NO: 757047 - RNA, 22 nt, Human
aaacucagacacaguaucuguu

SEQ ID NO: 757048 - RNA, 22 nt, Human
aaggcagaggaaggucuaguuu

SEQ ID NO: 757049 - RNA, 22 nt, Human
cagacagaaggcuccuugaggu

SEQ ID NO: 757050 - RNA, 22 nt, Human
uuuaggauauuaauguucagag

SEQ ID NO: 757051 - RNA, 22 nt, Human
auuguucacugugaaucuugau

SEQ ID NO: 757052 - RNA, 22 nt, Human
ugacuauuacggccacgaauuu

SEQ ID NO: 757053 - RNA, 22 nt, Human
gagcuuccuuuuucugcaugac

SEQ ID NO: 757054 - RNA, 22 nt, Human
ucauccuguauccucagaccau

SEQ ID NO: 757055 - RNA, 19 nt, Human
agcccagcuuauuugucag

SEQ ID NO: 757056 - RNA, 22 nt, Human
cucagcaggcacugugccuuac

SEQ ID NO: 757057 - RNA, 22 nt, Human
auuaauuuuaccuuuguaaaca

SEQ ID NO: 757058 - RNA, 22 nt, Human
acuggcugaucaccugccucag

SEQ ID NO: 757059 - RNA, 22 nt, Human
gccacagcuuagaucacagccu

SEQ ID NO: 757060 - RNA, 22 nt, Human
cagcagcugguuauaccugugg

SEQ ID NO: 757061 - RNA, 22 nt, Human
augugcaggauccaggcuccua

SEQ ID NO: 757062 - RNA, 22 nt, Human
ugcagagguguugcugagauaa

SEQ ID NO: 757063 - RNA, 22 nt, Human
cauuucugugacacuuccaucu

SEQ ID NO: 757064 - RNA, 18 nt, Human
gagcugagaagaggaugc

SEQ ID NO: 757065 - RNA, 22 nt, Human
aggucaaguuuagauagaguua

SEQ ID NO: 757066 - RNA, 22 nt, Human
cuggccaggcggccccugcaug

SEQ ID NO: 757067 - RNA, 22 nt, Human
ugugcauguucucauuucuaac

SEQ ID NO: 757068 - RNA, 21 nt, Human
agagcuggccugccaggcccu

SEQ ID NO: 757069 - RNA, 22 nt, Human
agaggccggccgagcccauggg

SEQ ID NO: 757070 - RNA, 22 nt, Human
ucuauacaaguuucacuuugac

SEQ ID NO: 757071 - RNA, 22 nt, Human
aaagcuuuuguuuucguaacug

SEQ ID NO: 757072 - RNA, 23 nt, Human
gaauggcuaagcacauagacuug

SEQ ID NO: 757073 - RNA, 22 nt, Human
gcauuuuaaugagguuuaugag

SEQ ID NO: 757074 - RNA, 22 nt, Human
ggcaggguccacaccugggaaa

SEQ ID NO: 757075 - RNA, 22 nt, Human
auguguguguauauacacacau

SEQ ID NO: 757076 - RNA, 22 nt, Human
ccacaaauuagguuuugcuugu

SEQ ID NO: 757077 - RNA, 21 nt, Human
ugggcagauggcaguguggcu

SEQ ID NO: 757078 - RNA, 22 nt, Human
gcagaggccaggccaccagcaa

SEQ ID NO: 757079 - RNA, 22 nt, Human
cuggcaccaggcaugcugggag

SEQ ID NO: 757080 - RNA, 22 nt, Human
cugggaccaucugugucuacuu

SEQ ID NO: 757081 - RNA, 22 nt, Human
uuagagauugguugacagauuu

SEQ ID NO: 757082 - RNA, 20 nt, Human
aggaugcagggagucugcag

SEQ ID NO: 757083 - RNA, 22 nt, Human
aaacaauguacauuuauaaugc

SEQ ID NO: 757084 - RNA, 22 nt, Human
caccuggacccugggaggaggg

SEQ ID NO: 757085 - RNA, 22 nt, Human
ugcugggccugccccugucagc

SEQ ID NO: 757086 - RNA, 22 nt, Human
gggaacuauuuuaagcacuuga

SEQ ID NO: 757087 - RNA, 22 nt, Human
uucccagaaugaauggauggag

SEQ ID NO: 757088 - RNA, 22 nt, Human
gaugcacaaagcagagggaauc

SEQ ID NO: 757089 - RNA, 22 nt, Human
agcuguggcagcagccguggca

SEQ ID NO: 757090 - RNA, 22 nt, Human
agcuuucuauauaugaguugcu

SEQ ID NO: 757091 - RNA, 22 nt, Human
gcugcuuccuuuccugcugacc

SEQ ID NO: 757092 - RNA, 22 nt, Human
uccucugcuccaggcuggacuu

SEQ ID NO: 757093 - RNA, 22 nt, Human
aacgugcaccaggaggucauga

SEQ ID NO: 757094 - RNA, 22 nt, Human
uugagaagaauguguugaguuu

SEQ ID NO: 757095 - RNA, 22 nt, Human
cuuaggcaagcagagcccaucc

SEQ ID NO: 757096 - RNA, 22 nt, Human
gugccuggacccucuuuccgga

SEQ ID NO: 757097 - RNA, 22 nt, Human
auguauaguggugaugauuaca

SEQ ID NO: 757098 - RNA, 22 nt, Human
gagcaacagggcgaggagaacu

SEQ ID NO: 757099 - RNA, 22 nt, Human
gcgggcagggcacugguccccu

SEQ ID NO: 757100 - RNA, 23 nt, Human
aggugcagcccuggaccugcccc

SEQ ID NO: 757101 - RNA, 22 nt, Human
acagcaagccagcuugucacug

SEQ ID NO: 757102 - RNA, 22 nt, Human
ggccucugcaacuggcuguggc

SEQ ID NO: 757103 - RNA, 23 nt, Human
aaaguugauuugcaguuuaagag

SEQ ID NO: 757104 - RNA, 22 nt, Human
ccagagucauuuugagucauaa

SEQ ID NO: 757105 - RNA, 22 nt, Human
uggcucugagacacaggcucuc

SEQ ID NO: 757106 - RNA, 22 nt, Human
gcucccagcaauugaggcagcc

SEQ ID NO: 757107 - RNA, 22 nt, Human
uuuguaacaaguugaucuggua

SEQ ID NO: 757108 - RNA, 21 nt, Human
uuuuuucuugcgugaggccug

SEQ ID NO: 757109 - RNA, 22 nt, Human
auaaacugugcuggaugaugag

SEQ ID NO: 757110 - RNA, 22 nt, Human
gcaguaucuaugugauggguug

SEQ ID NO: 757111 - RNA, 22 nt, Human
gaaauucaaaaugucaguauag

SEQ ID NO: 757112 - RNA, 22 nt, Human
uggcucauucuuuagaauauac

SEQ ID NO: 757113 - RNA, 22 nt, Human
agccaaucuacaacaaaggaua

SEQ ID NO: 757114 - RNA, 22 nt, Human
agcuccagcccuaguacagcug

SEQ ID NO: 757115 - RNA, 22 nt, Human
aggaggccauucucucaguagc

SEQ ID NO: 757116 - RNA, 22 nt, Human
uagaaacauauaggauggcagg

SEQ ID NO: 757117 - RNA, 22 nt, Human
accuuaaaacugacacauggag

SEQ ID NO: 757118 - RNA, 22 nt, Human
uaaggaauagugcuaugaaaaa

SEQ ID NO: 757119 - RNA, 20 nt, Human
aggcugccuaaggcucugca

SEQ ID NO: 757120 - RNA, 22 nt, Human
gcuggccugcgagggcaggcug

SEQ ID NO: 757121 - RNA, 22 nt, Human
cugucuguguggacacggcugc

SEQ ID NO: 757122 - RNA, 22 nt, Human
augcagaauugcuaaguaucug

SEQ ID NO: 757123 - RNA, 22 nt, Human
ggcgggaggcugaggaguuggu

SEQ ID NO: 757124 - RNA, 22 nt, Human
agagacaggaauggcauuaaga

SEQ ID NO: 757125 - RNA, 22 nt, Human
gcccacaccauuuauucuuugu

SEQ ID NO: 757126 - RNA, 22 nt, Human
gcugaauagaagucuucaaagg

SEQ ID NO: 757127 - RNA, 22 nt, Human
agacagcauuucccggaaccgc

SEQ ID NO: 757128 - RNA, 22 nt, Human
agugggcugguggcagggagaa

SEQ ID NO: 757129 - RNA, 23 nt, Human
gcauucugaugguucucugugau

SEQ ID NO: 757130 - RNA, 22 nt, Human
ccagcuggagcucgcagauagg

SEQ ID NO: 757131 - RNA, 22 nt, Human
uccagugguaguaaagaggucu

SEQ ID NO: 757132 - RNA, 22 nt, Human
ccuuuucugaaccacuuaaaua

SEQ ID NO: 757133 - RNA, 22 nt, Human
uucaaugauuuuuagggaucau

SEQ ID NO: 757134 - RNA, 22 nt, Human
ccagcugcaggggagcagugga

SEQ ID NO: 757135 - RNA, 22 nt, Human
uaaagcagccagggucuaagcc

SEQ ID NO: 757136 - RNA, 22 nt, Human
uugugauaaaacauuagacauu

SEQ ID NO: 757137 - RNA, 22 nt, Human
ggcuggcuccaccuagguagcu

SEQ ID NO: 757138 - RNA, 22 nt, Human
aaagaucagucugaagcaacau

SEQ ID NO: 757139 - RNA, 22 nt, Human
uugguuuaggaacuggcuugga

SEQ ID NO: 757140 - RNA, 22 nt, Human
agauacauugaguuuccuccug

SEQ ID NO: 757141 - RNA, 22 nt, Human
ucaggcuguggcuucaguucuu

SEQ ID NO: 757142 - RNA, 22 nt, Human
cacauucagguggcauguuaga

SEQ ID NO: 757143 - RNA, 22 nt, Human
ccagcagcauccugcagcacuu

SEQ ID NO: 757144 - RNA, 22 nt, Human
ucuuuuagcucugcaaggaaag

SEQ ID NO: 757145 - RNA, 22 nt, Human
uggccagcccucuucccacacu

SEQ ID NO: 757146 - RNA, 22 nt, Human
ggcauggcuggguucuggugag

SEQ ID NO: 757147 - RNA, 22 nt, Human
gacaguauuuaacuaguucauu

SEQ ID NO: 757148 - RNA, 22 nt, Human
ucuccaagaaaagaucucagcu

SEQ ID NO: 757149 - RNA, 22 nt, Human
ugucuacuccugugcuagcucc

SEQ ID NO: 757150 - RNA, 22 nt, Human
cucccugaaauucagaugccuc

SEQ ID NO: 757151 - RNA, 22 nt, Human
aagacacacacauaugcugagu

SEQ ID NO: 757152 - RNA, 22 nt, Human
uaaaugaagaaauggagauugu

SEQ ID NO: 757153 - RNA, 22 nt, Human
aggagaaggaagugcaucacua

SEQ ID NO: 757154 - RNA, 22 nt, Human
augcaaagcacacacagaaucc

SEQ ID NO: 757155 - RNA, 22 nt, Human
ucuuuuaaccuaacuagcuugg

SEQ ID NO: 757156 - RNA, 22 nt, Human
uauauacaagguagguuuaggu

SEQ ID NO: 757157 - RNA, 21 nt, Human
acugucauuugcuuagggagg

SEQ ID NO: 757158 - RNA, 19 nt, Human
caauauauagugaguggau

SEQ ID NO: 757159 - RNA, 22 nt, Human
gcaggaugccagggcagcagcg

SEQ ID NO: 757160 - RNA, 22 nt, Human
auucuccacuguaagguuauua

SEQ ID NO: 757161 - RNA, 22 nt, Human
guggcaucaagauuuagauuca

SEQ ID NO: 757162 - RNA, 22 nt, Human
uuagcuuuggauugcauuuagu

SEQ ID NO: 757163 - RNA, 22 nt, Human
agucugucucugcuaaucacua

SEQ ID NO: 757164 - RNA, 21 nt, Human
ucuuggccuaaguucacugaa

SEQ ID NO: 757165 - RNA, 22 nt, Human
caaauguguaaggaaguguuag

SEQ ID NO: 757166 - RNA, 22 nt, Human
uggggggcacuucagcacaaug

SEQ ID NO: 757167 - RNA, 22 nt, Human
gaaugcacucacccaucacuca

SEQ ID NO: 757168 - RNA, 20 nt, Human
aauuuuacuguccuauagag

SEQ ID NO: 757169 - RNA, 22 nt, Human
aacuuggcuaccagcguuaaau

SEQ ID NO: 757170 - RNA, 20 nt, Human
ucagagaagggacugagauu

SEQ ID NO: 757171 - RNA, 22 nt, Human
caguucaaaguuaagcagcagu

SEQ ID NO: 757172 - RNA, 22 nt, Human
gcaggagugugucuaauacuca

SEQ ID NO: 757173 - RNA, 22 nt, Human
gauauucauaggcagguauuua

SEQ ID NO: 757174 - RNA, 22 nt, Human
gagcugcagcggcugacgcaac

SEQ ID NO: 757175 - RNA, 22 nt, Human
cugugggccuagucuggccuag

SEQ ID NO: 757176 - RNA, 22 nt, Human
gcaagcugcucuuauguggagg

SEQ ID NO: 757177 - RNA, 22 nt, Human
aaguccagguccucauuccauc

SEQ ID NO: 757178 - RNA, 20 nt, Human
uagauuucauacuucucuuu

SEQ ID NO: 757179 - RNA, 22 nt, Human
auguggcucauuguuugcuuac

SEQ ID NO: 757180 - RNA, 22 nt, Human
acagcucuguguauugucaucu

SEQ ID NO: 757181 - RNA, 22 nt, Human
ugucacauaauuuaucuguagg

SEQ ID NO: 757182 - RNA, 22 nt, Human
cagcugagagacaaugagucau

SEQ ID NO: 757183 - RNA, 22 nt, Human
gcagaggcucuuuaaugcuuag

SEQ ID NO: 757184 - RNA, 22 nt, Human
auugaacuauaauuaugauuug

SEQ ID NO: 757185 - RNA, 22 nt, Human
ugcugccuugaccuccugggcu

SEQ ID NO: 757186 - RNA, 22 nt, Human
gagcaggacgugggaaugggaa

SEQ ID NO: 757187 - RNA, 22 nt, Human
aaaguuguaauggaagaaaugc

SEQ ID NO: 757188 - RNA, 22 nt, Human
ucucaaauggacaauauugugg

SEQ ID NO: 757189 - RNA, 22 nt, Human
ccagcugucacucagaaaggcc

SEQ ID NO: 757190 - RNA, 22 nt, Human
ggucuggacccuccuggagugg

SEQ ID NO: 757191 - RNA, 22 nt, Human
uucaacugggcggaucugagaa

SEQ ID NO: 757192 - RNA, 22 nt, Human
ggcaggugaccuggccucccag

SEQ ID NO: 757193 - RNA, 22 nt, Human
uucuuggcaaugguauucaucc

SEQ ID NO: 757194 - RNA, 22 nt, Human
cauccauagauugagagauggu

SEQ ID NO: 757195 - RNA, 19 nt, Human
gcaggucauuaggcuaggu

SEQ ID NO: 757196 - RNA, 19 nt, Human
uuaugaauagcuucaucca

SEQ ID NO: 757197 - RNA, 22 nt, Human
uaucagaacacauguuuugcag

SEQ ID NO: 757198 - RNA, 22 nt, Human
agcagcugaccagugaguccug

SEQ ID NO: 757199 - RNA, 22 nt, Human
ugucuucuaccuugacagcauu

SEQ ID NO: 757200 - RNA, 21 nt, Human
gcuggcuggcugaccggccuu

SEQ ID NO: 757201 - RNA, 22 nt, Human
aagcaacuaaggcaaggaaaug

SEQ ID NO: 757202 - RNA, 22 nt, Human
cagugcccucaucuaugaaauc

SEQ ID NO: 757203 - RNA, 22 nt, Human
auuuccuuugcaaagacugugc

SEQ ID NO: 757204 - RNA, 22 nt, Human
guuaugaaauaaauauagauca

SEQ ID NO: 757205 - RNA, 22 nt, Human
agcuuuauggugccucacuuga

SEQ ID NO: 757206 - RNA, 22 nt, Human
ugcugccaucucaacugcccuu

SEQ ID NO: 757207 - RNA, 22 nt, Human
uuguguguacugguuaugggca

SEQ ID NO: 757208 - RNA, 23 nt, Human
uugcaaaaugcaauugaguuaga

SEQ ID NO: 757209 - RNA, 22 nt, Human
aagacagcauugcugagggcuu

SEQ ID NO: 757210 - RNA, 19 nt, Human
aaaguucugacuguagagc

SEQ ID NO: 757211 - RNA, 22 nt, Human
uggcccaguauguauaaucuua

SEQ ID NO: 757212 - RNA, 22 nt, Human
uuacaaacugucauauaguauu

SEQ ID NO: 757213 - RNA, 22 nt, Human
gucuuguccauuccaugcugcu

SEQ ID NO: 757214 - RNA, 22 nt, Human
caaugcuuuuagcuucagcuug

SEQ ID NO: 757215 - RNA, 22 nt, Human
ugauuucccuguagccucugaa

SEQ ID NO: 757216 - RNA, 22 nt, Human
ugucacauauauaauguucaau

SEQ ID NO: 757217 - RNA, 22 nt, Human
gagcuagagggagaagggcacu

SEQ ID NO: 757218 - RNA, 22 nt, Human
cagcagugugcaggugugcugg

SEQ ID NO: 757219 - RNA, 22 nt, Human
aacugagauuacaagagacauu

SEQ ID NO: 757220 - RNA, 22 nt, Human
ccagcuggaaacaaauagagug

SEQ ID NO: 757221 - RNA, 22 nt, Human
uuuagaaggacuacagugugau

SEQ ID NO: 757222 - RNA, 22 nt, Human
cucaaaaugguuaauuuuaaua

SEQ ID NO: 757223 - RNA, 17 nt, Human
ucugccgacugccagcu

SEQ ID NO: 757224 - RNA, 22 nt, Human
agcuggcuuugagcugggaggu

SEQ ID NO: 757225 - RNA, 22 nt, Human
guguuacauauaccugagcuua

SEQ ID NO: 757226 - RNA, 22 nt, Human
gagguucgauacagcguauuua

SEQ ID NO: 757227 - RNA, 22 nt, Human
cagacaguggacuugauaaagg

SEQ ID NO: 757228 - RNA, 22 nt, Human
auccccuucacacccucugcau

SEQ ID NO: 757229 - RNA, 22 nt, Human
gugcaauauugccauguucuug

SEQ ID NO: 757230 - RNA, 22 nt, Human
aucucugggcuuugaguuuguu

SEQ ID NO: 757231 - RNA, 16 nt, Human
ucugccagggacaggc

SEQ ID NO: 757232 - RNA, 22 nt, Human
uccagggcugacuugggagagg

SEQ ID NO: 757233 - RNA, 18 nt, Human
agcagagcccaugcauuc

SEQ ID NO: 757234 - RNA, 17 nt, Human
ggaaaaggaugauacag

SEQ ID NO: 757235 - RNA, 22 nt, Human
aaugaacacuuagccuuucuau

SEQ ID NO: 757236 - RNA, 20 nt, Human
gcagugcuggugccucugcu

SEQ ID NO: 757237 - RNA, 22 nt, Human
cuuugaaaaaugguuuccuaga

SEQ ID NO: 757238 - RNA, 22 nt, Human
acaaaagugagugugucucaga

SEQ ID NO: 757239 - RNA, 22 nt, Human
uucuuucucuacuagcagagcu

SEQ ID NO: 757240 - RNA, 22 nt, Human
ugcuuaauauugugauguaaua

SEQ ID NO: 757241 - RNA, 22 nt, Human
cauacuuacuguguaccaggug

SEQ ID NO: 757242 - RNA, 22 nt, Human
augaggagucaaggagucggag

SEQ ID NO: 757243 - RNA, 22 nt, Human
aucuggcuuggguguggguagc

SEQ ID NO: 757244 - RNA, 22 nt, Human
caguuuagaagaaucaugaaca

SEQ ID NO: 757245 - RNA, 22 nt, Human
agcagauguuucagagcaggcu

SEQ ID NO: 757246 - RNA, 20 nt, Human
ggcagagggccugggagaag

SEQ ID NO: 757247 - RNA, 22 nt, Human
gaggaaggcuaaggggcuuaga

SEQ ID NO: 757248 - RNA, 19 nt, Human
gagcugccuuuugaagacc

SEQ ID NO: 757249 - RNA, 22 nt, Human
uuuuaguuuggauuucuaaagc

SEQ ID NO: 757250 - RNA, 22 nt, Human
acagaaagaccuuguaacacuu

SEQ ID NO: 757251 - RNA, 22 nt, Human
uuuuauuaguggcuagaugggg

SEQ ID NO: 757252 - RNA, 22 nt, Human
ggcuuugcccuggacugaggca

SEQ ID NO: 757253 - RNA, 22 nt, Human
ugaagccaccgaaccagaagag

SEQ ID NO: 757254 - RNA, 22 nt, Human
cugcuuggguccuggcaugggu

SEQ ID NO: 757255 - RNA, 22 nt, Human
gcccugcuccuccgucccacga

SEQ ID NO: 757256 - RNA, 22 nt, Human
gcuuuguguagaaggaggaugg

SEQ ID NO: 757257 - RNA, 22 nt, Human
ugguggcaucagugaaguacac

SEQ ID NO: 757258 - RNA, 22 nt, Human
acauugaagcugugaaaucaaa

SEQ ID NO: 757259 - RNA, 22 nt, Human
cagcagccauguaccacacuca

SEQ ID NO: 757260 - RNA, 22 nt, Human
agcacagaaugagguggaagug

SEQ ID NO: 757261 - RNA, 23 nt, Human
acauacauggagauaaagugaug

SEQ ID NO: 757262 - RNA, 22 nt, Human
ucccacagaguggcucaccuag

SEQ ID NO: 757263 - RNA, 22 nt, Human
cugugccacugccccaggccuc

SEQ ID NO: 757264 - RNA, 21 nt, Human
uuguuucccagagcucgcucc

SEQ ID NO: 757265 - RNA, 22 nt, Human
aagugcauuagauagaaugaug

SEQ ID NO: 757266 - RNA, 22 nt, Human
aacauucugucaauugaugacc

SEQ ID NO: 757267 - RNA, 22 nt, Human
augcuguguggccaccuccaug

SEQ ID NO: 757268 - RNA, 22 nt, Human
aaaugcaauuguauguacucca

SEQ ID NO: 757269 - RNA, 22 nt, Human
ugacagggucagagcugagcug

SEQ ID NO: 757270 - RNA, 22 nt, Human
uugccagggucaggaugagauc

SEQ ID NO: 757271 - RNA, 22 nt, Human
ccuggcacauaguaaguacuag

SEQ ID NO: 757272 - RNA, 22 nt, Human
uaugcucuccucccagucccag

SEQ ID NO: 757273 - RNA, 21 nt, Human
aagaaagauaauuaaggaccc

SEQ ID NO: 757274 - RNA, 22 nt, Human
ugguacacauguccaaggucag

SEQ ID NO: 757275 - RNA, 17 nt, Human
acacagccagguucucc

SEQ ID NO: 757276 - RNA, 22 nt, Human
cgugcaugauauaugaguuguu

SEQ ID NO: 757277 - RNA, 22 nt, Human
cuggugucuacuacaugguuga

SEQ ID NO: 757278 - RNA, 22 nt, Human
agcagcaggaggcuguccacca

SEQ ID NO: 757279 - RNA, 22 nt, Human
ccaccuccuaggccuggagaag

SEQ ID NO: 757280 - RNA, 22 nt, Human
cugaagcuuuacuucaaauaca

SEQ ID NO: 757281 - RNA, 22 nt, Human
cucuccagcagauguagucugu

SEQ ID NO: 757282 - RNA, 22 nt, Human
cuccaggacugaggacagagcu

SEQ ID NO: 757283 - RNA, 22 nt, Human
uaaguuaucggaguguguuuca

SEQ ID NO: 757284 - RNA, 22 nt, Human
aaagggcagaguucacuagaaa

SEQ ID NO: 757285 - RNA, 22 nt, Human
ggccagcuuauuagcucagagg

SEQ ID NO: 757286 - RNA, 22 nt, Human
gcugugagggcuucugaggcau

SEQ ID NO: 757287 - RNA, 22 nt, Human
gugcauuaacaacccagaacuc

SEQ ID NO: 757288 - RNA, 22 nt, Human
cuauacagugacuagaaguaau

SEQ ID NO: 757289 - RNA, 22 nt, Human
uggugccaagcaugaggacucu

SEQ ID NO: 757290 - RNA, 22 nt, Human
ccugagagcagcuuccugcuua

SEQ ID NO: 757291 - RNA, 22 nt, Human
uuaauccauggcaguuauuaaa

SEQ ID NO: 757292 - RNA, 20 nt, Human
uccagcuccguguucuuccu

SEQ ID NO: 757293 - RNA, 22 nt, Human
uuguuuuaaccuaguguuuaug

SEQ ID NO: 757294 - RNA, 22 nt, Human
ccagagaaaagaggccaaggau

SEQ ID NO: 757295 - RNA, 22 nt, Human
ucagccuggugauuccucuguc

SEQ ID NO: 757296 - RNA, 22 nt, Human
gcaaggcugaccucucuagacu

SEQ ID NO: 757297 - RNA, 22 nt, Human
agggcuccaggggaccaucagu

SEQ ID NO: 757298 - RNA, 22 nt, Human
uguuaacaucuuggacucguga

SEQ ID NO: 757299 - RNA, 22 nt, Human
cagugcagccaaggacaggcac

SEQ ID NO: 757300 - RNA, 22 nt, Human
aagggcaggcagagaucauaua

SEQ ID NO: 757301 - RNA, 22 nt, Human
uuggccuuguuaaggaggcccu

SEQ ID NO: 757302 - RNA, 22 nt, Human
cuggggcucacuccagcccugg

SEQ ID NO: 757303 - RNA, 22 nt, Human
agcaccaggcaguauaucaaag

SEQ ID NO: 757304 - RNA, 18 nt, Human
ugagaggcagguagagga

SEQ ID NO: 757305 - RNA, 20 nt, Human
ucugagaagcaaacaauguu

SEQ ID NO: 757306 - RNA, 22 nt, Human
ugugcgcgugcagcggaguguu

SEQ ID NO: 757307 - RNA, 22 nt, Human
acauuucauuugcaguauggau

SEQ ID NO: 757308 - RNA, 22 nt, Human
uguguggauucaucucaaagag

SEQ ID NO: 757309 - RNA, 22 nt, Human
ugguaccauuucccaggagugu

SEQ ID NO: 757310 - RNA, 22 nt, Human
agaagcugacagaugcagcagg

SEQ ID NO: 757311 - RNA, 22 nt, Human
gcucugugcuagaacuaagaau

SEQ ID NO: 757312 - RNA, 22 nt, Human
auugacaagugagcugggcugc

SEQ ID NO: 757313 - RNA, 22 nt, Human
ucaaagagcucuaucuucaaaa

SEQ ID NO: 757314 - RNA, 22 nt, Human
uccgccaggacugagggcccau

SEQ ID NO: 757315 - RNA, 22 nt, Human
uaaaucacuguacuuuauuccu

SEQ ID NO: 757316 - RNA, 22 nt, Human
ccacucugauuuuggcuccacu

SEQ ID NO: 757317 - RNA, 22 nt, Human
agaaacauauucagugaguaau

SEQ ID NO: 757318 - RNA, 22 nt, Human
aggaauuugagugcuguaggaa

SEQ ID NO: 757319 - RNA, 22 nt, Human
ggaggugaggccguagggugug

SEQ ID NO: 757320 - RNA, 22 nt, Human
ucagcuucucaaaauggcuuag

SEQ ID NO: 757321 - RNA, 22 nt, Human
acagagaugucagauuggcagc

SEQ ID NO: 757322 - RNA, 22 nt, Human
augaaaauguacauguguauaa

SEQ ID NO: 757323 - RNA, 22 nt, Human
uaaaaugacuuccuccaacauc

SEQ ID NO: 757324 - RNA, 18 nt, Human
guuucaugcaugugaaac

SEQ ID NO: 757325 - RNA, 22 nt, Human
agcacugcuuuagagccucugc

SEQ ID NO: 757326 - RNA, 22 nt, Human
aaacagugcaggaaguuaagca

SEQ ID NO: 757327 - RNA, 22 nt, Human
cuggagguuggguccaggccag

SEQ ID NO: 757328 - RNA, 22 nt, Human
ugcugaggcccaggagcacuuu

SEQ ID NO: 757329 - RNA, 22 nt, Human
uuacagagaggugauugugaag

SEQ ID NO: 757330 - RNA, 22 nt, Human
ucuguggcuuucuuauguugua

SEQ ID NO: 757331 - RNA, 22 nt, Human
caggcuggagugaguguagugg

SEQ ID NO: 757332 - RNA, 22 nt, Human
uggcugagugauauuugcaaag

SEQ ID NO: 757333 - RNA, 23 nt, Human
uguaggcuguaguuuguaggucc

SEQ ID NO: 757334 - RNA, 22 nt, Human
aagagggguggucugugaggau

SEQ ID NO: 757335 - RNA, 22 nt, Human
uuuucaguuccaucucugcucu

SEQ ID NO: 757336 - RNA, 22 nt, Human
agaggucagagcaggaaaggca

SEQ ID NO: 757337 - RNA, 22 nt, Human
gccaggcucagcagucaaccug

SEQ ID NO: 757338 - RNA, 22 nt, Human
uacauugacucucugucccuaa

SEQ ID NO: 757339 - RNA, 22 nt, Human
guuucucagcaugucaguacaa

SEQ ID NO: 757340 - RNA, 22 nt, Human
ggcaggugguaaggauuucaua

SEQ ID NO: 757341 - RNA, 22 nt, Human
ucuguuccuguccuaagggcca

SEQ ID NO: 757342 - RNA, 22 nt, Human
uuuggccaugcucaaggguaua

SEQ ID NO: 757343 - RNA, 22 nt, Human
ccuuuaaagacugcauaacuuc

SEQ ID NO: 757344 - RNA, 22 nt, Human
aaaauucugucauuaaauugug

SEQ ID NO: 757345 - RNA, 22 nt, Human
uaaacagagaagacuuugagca

SEQ ID NO: 757346 - RNA, 22 nt, Human
ggugcagcugcagccugggagc

SEQ ID NO: 757347 - RNA, 22 nt, Human
auuaucuauguagaaugauuuu

SEQ ID NO: 757348 - RNA, 22 nt, Human
gcuuccagcaaacacuggcugc

SEQ ID NO: 757349 - RNA, 17 nt, Human
uauguguguguuuauac

SEQ ID NO: 757350 - RNA, 22 nt, Human
uggaaugaauauguuuuaagga

SEQ ID NO: 757351 - RNA, 21 nt, Human
ucucugguuggaguugugcca

SEQ ID NO: 757352 - RNA, 22 nt, Human
ugaggcucagagaacagugacu

SEQ ID NO: 757353 - RNA, 22 nt, Human
cucagggacguuagaggacagg

SEQ ID NO: 757354 - RNA, 22 nt, Human
uauuugaagauucuucugaugu

SEQ ID NO: 757355 - RNA, 22 nt, Human
acaugcacacgauucagucugg

SEQ ID NO: 757356 - RNA, 22 nt, Human
cauagaauguaauaaagaguag

SEQ ID NO: 757357 - RNA, 22 nt, Human
cugaucuuaaguaacauuauuu

SEQ ID NO: 757358 - RNA, 22 nt, Human
gugcuuuauauguggguaucca

SEQ ID NO: 757359 - RNA, 22 nt, Human
ugcccugcaugcagggagcugu

SEQ ID NO: 757360 - RNA, 22 nt, Human
uucuaccagcuacucacugaua

SEQ ID NO: 757361 - RNA, 22 nt, Human
auauuugagggcaauagggugg

SEQ ID NO: 757362 - RNA, 22 nt, Human
uggucaggauucucagcccuuc

SEQ ID NO: 757363 - RNA, 22 nt, Human
uguacacaugcccacuugaagc

SEQ ID NO: 757364 - RNA, 22 nt, Human
auauuuucuggaacuaugccug

SEQ ID NO: 757365 - RNA, 22 nt, Human
uuucugugguggguaguucaga

SEQ ID NO: 757366 - RNA, 22 nt, Human
acaguucccgucuugcacagcu

SEQ ID NO: 757367 - RNA, 22 nt, Human
aaugcauuguugauuuggagug

SEQ ID NO: 757368 - RNA, 22 nt, Human
uggccaggcagguagaacggcc

SEQ ID NO: 757369 - RNA, 22 nt, Human
cuguccauuuucgugccuccuu

SEQ ID NO: 757370 - RNA, 22 nt, Human
ugaaucuggaucuaugaucaau

SEQ ID NO: 757371 - RNA, 17 nt, Human
agccaggcauaugaagu

SEQ ID NO: 757372 - RNA, 22 nt, Human
gccagcauccugguggugguug

SEQ ID NO: 757373 - RNA, 22 nt, Human
acugaggcuuaaagagauuagg

SEQ ID NO: 757374 - RNA, 22 nt, Human
ccagagccucgcccggagccuc

SEQ ID NO: 757375 - RNA, 22 nt, Human
cuggggagugaagguaauuaca

SEQ ID NO: 757376 - RNA, 22 nt, Human
gcaggacacagaugcaaggcca

SEQ ID NO: 757377 - RNA, 22 nt, Human
auuagaagauagugauuucugc

SEQ ID NO: 757378 - RNA, 22 nt, Human
gcauucaggaaccggaagggua

SEQ ID NO: 757379 - RNA, 22 nt, Human
guagccauuggcaaugaagccu

SEQ ID NO: 757380 - RNA, 22 nt, Human
caguggccuugaugccucauuc

SEQ ID NO: 757381 - RNA, 22 nt, Human
caucacagaaauaaacauaccu

SEQ ID NO: 757382 - RNA, 22 nt, Human
gcuggccaggugcuuugguucu

SEQ ID NO: 757383 - RNA, 22 nt, Human
cauggccaaggaugcucaacca

SEQ ID NO: 757384 - RNA, 20 nt, Human
guaggcauaugaccaauuac

SEQ ID NO: 757385 - RNA, 22 nt, Human
cagaacagucgccugcauggau

SEQ ID NO: 757386 - RNA, 18 nt, Human
auugagcaugacagaccu

SEQ ID NO: 757387 - RNA, 22 nt, Human
aagacauuccaaaguggcuaau

SEQ ID NO: 757388 - RNA, 22 nt, Human
aagcacauuuggaaaacaugga

SEQ ID NO: 757389 - RNA, 22 nt, Human
uauuccaaaauaguuaagcacu

SEQ ID NO: 757390 - RNA, 19 nt, Human
agcagagcccugaagaucc

SEQ ID NO: 757391 - RNA, 22 nt, Human
agacuucuaaauagcagcuucu

SEQ ID NO: 757392 - RNA, 22 nt, Human
ugugaaaucugaacucaaagau

SEQ ID NO: 757393 - RNA, 23 nt, Human
acagggcauugcuggccucgagg

SEQ ID NO: 757394 - RNA, 22 nt, Human
uuccaguucacuccauuucugg

SEQ ID NO: 757395 - RNA, 22 nt, Human
cagccacugacaggaauggucc

SEQ ID NO: 757396 - RNA, 22 nt, Human
cugcagagaugaagaagguggc

SEQ ID NO: 757397 - RNA, 22 nt, Human
agccugcugggaagggaggcuu

SEQ ID NO: 757398 - RNA, 22 nt, Human
auuucucaguguacauuauguu

SEQ ID NO: 757399 - RNA, 22 nt, Human
caauaauauccugugcuguuug

SEQ ID NO: 757400 - RNA, 23 nt, Human
guuaacaugguccauggaagagc

SEQ ID NO: 757401 - RNA, 22 nt, Human
cacagcagacagggaggcggcu

SEQ ID NO: 757402 - RNA, 22 nt, Human
ccaggagaagcaucugagugua

SEQ ID NO: 757403 - RNA, 22 nt, Human
aaaagauuguuagggagaaugu

SEQ ID NO: 757404 - RNA, 22 nt, Human
uuucacauaugguuguugauug

SEQ ID NO: 757405 - RNA, 22 nt, Human
ucugcuucugugaaggcagucu

SEQ ID NO: 757406 - RNA, 22 nt, Human
ugagccagcaggccuccagugg

SEQ ID NO: 757407 - RNA, 22 nt, Human
agcuggagauucuggggacagu

SEQ ID NO: 757408 - RNA, 22 nt, Human
uacuagaaaaacacaugcucug

SEQ ID NO: 757409 - RNA, 22 nt, Human
aauuauauuguggugugaaugu

SEQ ID NO: 757410 - RNA, 22 nt, Human
uuacaacauaugauaggagucu

SEQ ID NO: 757411 - RNA, 23 nt, Human
auccuauauaaccuuggaggcug

SEQ ID NO: 757412 - RNA, 22 nt, Human
gcagagugaagggagaggugug

SEQ ID NO: 757413 - RNA, 22 nt, Human
ucaaaggcgguccaggaauaaa

SEQ ID NO: 757414 - RNA, 20 nt, Human
uugauucaagggcugaugga

SEQ ID NO: 757415 - RNA, 22 nt, Human
acagaauuuuuacacaggguaa

SEQ ID NO: 757416 - RNA, 22 nt, Human
ggcaggaagaggagggugaacu

SEQ ID NO: 757417 - RNA, 21 nt, Human
acacugacaaccauccacgag

SEQ ID NO: 757418 - RNA, 22 nt, Human
uuucaucucucuaaaagacagu

SEQ ID NO: 757419 - RNA, 21 nt, Human
gggcaggucucugaugucaac

SEQ ID NO: 757420 - RNA, 22 nt, Human
uuccccucucagaucuggccua

SEQ ID NO: 757421 - RNA, 22 nt, Human
uagcaagaucgugucucuaaaa

SEQ ID NO: 757422 - RNA, 22 nt, Human
uuucuuuaucauagcaucuuug

SEQ ID NO: 757423 - RNA, 22 nt, Human
cuccagugagugagcaggcgac

SEQ ID NO: 757424 - RNA, 22 nt, Human
ggguggugagauguagcugaug

SEQ ID NO: 757425 - RNA, 22 nt, Human
ggccuccucacccugcucaggc

SEQ ID NO: 757426 - RNA, 22 nt, Human
ugaagcaacuggacaaguuggc

SEQ ID NO: 757427 - RNA, 22 nt, Human
acugcugagcacacaagagugu

SEQ ID NO: 757428 - RNA, 22 nt, Human
uagcagcuuaaguaauuagaau

SEQ ID NO: 757429 - RNA, 22 nt, Human
ugcaauauguugcauuguaugg

SEQ ID NO: 757430 - RNA, 22 nt, Human
aggucaaggcugcagugagcug

SEQ ID NO: 757431 - RNA, 22 nt, Human
gucugggcaucagacugcgggc

SEQ ID NO: 757432 - RNA, 22 nt, Human
aucaaaguucguaacugauaac

SEQ ID NO: 757433 - RNA, 19 nt, Human
agcaaauauaauaguguuc

SEQ ID NO: 757434 - RNA, 22 nt, Human
gcuggagggguaauaggauggg

SEQ ID NO: 757435 - RNA, 22 nt, Human
uguccugggccggcgacugguc

SEQ ID NO: 757436 - RNA, 22 nt, Human
uuccauccauaucuuguugagg

SEQ ID NO: 757437 - RNA, 22 nt, Human
auuuccuauccuggucuuaaaa

SEQ ID NO: 757438 - RNA, 22 nt, Human
ucuuuugagggccagaggaaga

SEQ ID NO: 757439 - RNA, 22 nt, Human
ucucacagggcuaggcccugcc

SEQ ID NO: 757440 - RNA, 22 nt, Human
agccauugaguuuuaugugcua

SEQ ID NO: 757441 - RNA, 22 nt, Human
cagagcuguccaaacccugaca

SEQ ID NO: 757442 - RNA, 22 nt, Human
cagagugaaauaggggaucaag

SEQ ID NO: 757443 - RNA, 22 nt, Human
aggggagaaaaaugccuucugu

SEQ ID NO: 757444 - RNA, 22 nt, Human
cacacauugaauucauucuugu

SEQ ID NO: 757445 - RNA, 22 nt, Human
auagaucacaaugguucacuuu

SEQ ID NO: 757446 - RNA, 22 nt, Human
acagagggggccuuggagugca

SEQ ID NO: 757447 - RNA, 22 nt, Human
uuuguucaaaaauuauaagaua

SEQ ID NO: 757448 - RNA, 22 nt, Human
gggcugacucugcacugagcca

SEQ ID NO: 757449 - RNA, 22 nt, Human
cagggcugaagaaauucaaaag

SEQ ID NO: 757450 - RNA, 22 nt, Human
agagcccucugcaaugccucag

SEQ ID NO: 757451 - RNA, 22 nt, Human
gucuccagaauucuugggaggg

SEQ ID NO: 757452 - RNA, 22 nt, Human
agaauagagaaaaagguuauuu

SEQ ID NO: 757453 - RNA, 19 nt, Human
uugaggggccaggggagau

SEQ ID NO: 757454 - RNA, 22 nt, Human
uuuguaaaaggaggaagcaugg

SEQ ID NO: 757455 - RNA, 22 nt, Human
uuuuuauacuuugcucaagauu

SEQ ID NO: 757456 - RNA, 22 nt, Human
cacaguggcagguguggguugu

SEQ ID NO: 757457 - RNA, 22 nt, Human
ugaggcagugcugggaagccug

SEQ ID NO: 757458 - RNA, 22 nt, Human
gucuguaauuauuaaagaaagg

SEQ ID NO: 757459 - RNA, 22 nt, Human
acagccugauuuauggagcagu

SEQ ID NO: 757460 - RNA, 22 nt, Human
uccaucugcauuugguuucugu

SEQ ID NO: 757461 - RNA, 22 nt, Human
ccaggccugcaucugcugcgca

SEQ ID NO: 757462 - RNA, 22 nt, Human
gcuggcagcuggaaguugggcu

SEQ ID NO: 757463 - RNA, 22 nt, Human
cugcuuuaacucugggaagcca

SEQ ID NO: 757464 - RNA, 21 nt, Human
acaguauauuagauauuugaa

SEQ ID NO: 757465 - RNA, 22 nt, Human
cuuuucaugagucuguuauggg

SEQ ID NO: 757466 - RNA, 22 nt, Human
cagcccagagccaguucccgcu

SEQ ID NO: 757467 - RNA, 22 nt, Human
cagucacauagguauacacaua

SEQ ID NO: 757468 - RNA, 22 nt, Human
ggcccagccuugggguuucuuu

SEQ ID NO: 757469 - RNA, 22 nt, Human
aauauguugagucuaucuuuau

SEQ ID NO: 757470 - RNA, 20 nt, Human
ggcucuggaaucuggugggc

SEQ ID NO: 757471 - RNA, 22 nt, Human
uaaagacaugguguaggugaac

SEQ ID NO: 757472 - RNA, 22 nt, Human
aucauagaacaccuaccuaccu

SEQ ID NO: 757473 - RNA, 22 nt, Human
cugacaguaacuaauguggaga

SEQ ID NO: 757474 - RNA, 22 nt, Human
ugucaccuugcagggcuggggc

SEQ ID NO: 757475 - RNA, 19 nt, Human
accaggaacuucccuaggc

SEQ ID NO: 757476 - RNA, 22 nt, Human
augaaugauuaaagaguacagu

SEQ ID NO: 757477 - RNA, 22 nt, Human
auaaaguuuaaaagucaauagu

SEQ ID NO: 757478 - RNA, 23 nt, Human
uuaaacacuaguucgaguagcau

SEQ ID NO: 757479 - RNA, 22 nt, Human
ggcaggacugaucagugggaug

SEQ ID NO: 757480 - RNA, 22 nt, Human
auacaagaucacuccagaaaau

SEQ ID NO: 757481 - RNA, 22 nt, Human
aauaauauuccucugugugcgu

SEQ ID NO: 757482 - RNA, 22 nt, Human
cuugacuuugccuuuuaaaugu

SEQ ID NO: 757483 - RNA, 22 nt, Human
ugcauauuugauugagauaccu

SEQ ID NO: 757484 - RNA, 21 nt, Human
aggcccagcuuuccucuugcu

SEQ ID NO: 757485 - RNA, 22 nt, Human
uuugcugacuggaugcaguugg

SEQ ID NO: 757486 - RNA, 22 nt, Human
gcaucauucuggcucuuuccau

SEQ ID NO: 757487 - RNA, 22 nt, Human
aagcucagagucucggagggaa

SEQ ID NO: 757488 - RNA, 22 nt, Human
caacucaggcaccucauauaag

SEQ ID NO: 757489 - RNA, 18 nt, Human
ccucagggagauccagug

SEQ ID NO: 757490 - RNA, 22 nt, Human
ugccuuuuccagcuuccaggag

SEQ ID NO: 757491 - RNA, 22 nt, Human
uccccuccucuccugauauggg

SEQ ID NO: 757492 - RNA, 22 nt, Human
ccaaauuaaaucauacagacag

SEQ ID NO: 757493 - RNA, 22 nt, Human
aacuggagccccucugccacug

SEQ ID NO: 757494 - RNA, 22 nt, Human
uccuccugucuaccaguuccug

SEQ ID NO: 757495 - RNA, 22 nt, Human
caguguuuccgucaguauguga

SEQ ID NO: 757496 - RNA, 21 nt, Human
uuauucugagaugagauucuu

SEQ ID NO: 757497 - RNA, 22 nt, Human
uuagagauacauuuguagcuug

SEQ ID NO: 757498 - RNA, 22 nt, Human
acaaauugccuagucuagcauc

SEQ ID NO: 757499 - RNA, 22 nt, Human
caagaaaugggauuugacugcc

SEQ ID NO: 757500 - RNA, 22 nt, Human
caucagaccugccagacuaggu

SEQ ID NO: 757501 - RNA, 22 nt, Human
augugaaaauccaauggcagca

SEQ ID NO: 757502 - RNA, 22 nt, Human
gaaucuuauuuuuaaaucuucc

SEQ ID NO: 757503 - RNA, 22 nt, Human
uaugaguacaaggacucugucu

SEQ ID NO: 757504 - RNA, 22 nt, Human
uuuguucugcaucacagaaaaa

SEQ ID NO: 757505 - RNA, 22 nt, Human
cuuugcaaacgauuaccacaug

SEQ ID NO: 757506 - RNA, 22 nt, Human
uuucacagguacaaacacuccu

SEQ ID NO: 757507 - RNA, 19 nt, Human
acaauguuguuggacacuc

SEQ ID NO: 757508 - RNA, 22 nt, Human
uucagguuuuuaaguucugccu

SEQ ID NO: 757509 - RNA, 19 nt, Human
ugugacugguugucucgcu

SEQ ID NO: 757510 - RNA, 22 nt, Human
ugcagggcaguggagguugagu

SEQ ID NO: 757511 - RNA, 20 nt, Human
agcucuuaagaagaagauga

SEQ ID NO: 757512 - RNA, 22 nt, Human
ugccagaagauucucuaucaga

SEQ ID NO: 757513 - RNA, 22 nt, Human
uuuagcaaaacauuaugucugu

SEQ ID NO: 757514 - RNA, 22 nt, Human
caggaaauaggcguuuguccuc

SEQ ID NO: 757515 - RNA, 18 nt, Human
ucuuccagcuucuggagg

SEQ ID NO: 757516 - RNA, 22 nt, Human
aguuuaauccuccagcccaacu

SEQ ID NO: 757517 - RNA, 22 nt, Human
cauuucaagcauugacuucuau

SEQ ID NO: 757518 - RNA, 22 nt, Human
guggcuucacauggcauuuggc

SEQ ID NO: 757519 - RNA, 22 nt, Human
acagaaauuagcagugaguuua

SEQ ID NO: 757520 - RNA, 22 nt, Human
ugggcagggagcuggaaccaca

SEQ ID NO: 757521 - RNA, 22 nt, Human
uuuauacauggagaauuuuugc

SEQ ID NO: 757522 - RNA, 22 nt, Human
cacugaagccugggaguaagac

SEQ ID NO: 757523 - RNA, 22 nt, Human
caccagacagguguaugcauau

SEQ ID NO: 757524 - RNA, 22 nt, Human
uaucaguggucacaagauacau

SEQ ID NO: 757525 - RNA, 22 nt, Human
uggaauggaaacaaacugagga

SEQ ID NO: 757526 - RNA, 22 nt, Human
uucucuccagacugcagugggu

SEQ ID NO: 757527 - RNA, 23 nt, Human
aggcagagccaaggucaaaaccc

SEQ ID NO: 757528 - RNA, 22 nt, Human
gagucuggaaugaugaagaccu

SEQ ID NO: 757529 - RNA, 22 nt, Human
uguguguuaacuuauuuaaugu

SEQ ID NO: 757530 - RNA, 22 nt, Human
aacaugaaaagcccagagaggu

SEQ ID NO: 757531 - RNA, 21 nt, Human
aauggcugggcaaggucucuc

SEQ ID NO: 757532 - RNA, 22 nt, Human
gagagcaggaggcagcgggacg

SEQ ID NO: 757533 - RNA, 22 nt, Human
aggcuucccuuccucugggggu

SEQ ID NO: 757534 - RNA, 22 nt, Human
gaggagagccugcacuuugacc

SEQ ID NO: 757535 - RNA, 22 nt, Human
aaaacugagguuuccugaagaa

SEQ ID NO: 757536 - RNA, 22 nt, Human
uugauuuuaaaauagugacacu

SEQ ID NO: 757537 - RNA, 22 nt, Human
agccuggaagaaccugaagucu

SEQ ID NO: 757538 - RNA, 19 nt, Human
uggagacugagagugagca

SEQ ID NO: 757539 - RNA, 22 nt, Human
cguguguguaccugcgcauuua

SEQ ID NO: 757540 - RNA, 22 nt, Human
gggguagggugauugugaagua

SEQ ID NO: 757541 - RNA, 22 nt, Human
uuguuggugaauaggguggaau

SEQ ID NO: 757542 - RNA, 22 nt, Human
guauucagggcuagucagagga

SEQ ID NO: 757543 - RNA, 22 nt, Human
ucugcugccaccuuguggugag

SEQ ID NO: 757544 - RNA, 22 nt, Human
uggagacagagauagccaauug

SEQ ID NO: 757545 - RNA, 22 nt, Human
uaaacagccuccccuuucacuc

SEQ ID NO: 757546 - RNA, 22 nt, Human
agcagggcugugcuccuuccga

SEQ ID NO: 757547 - RNA, 23 nt, Human
auacaaaccuugcaggacauguu

SEQ ID NO: 757548 - RNA, 22 nt, Human
aaagcaauugugguuuuugcca

SEQ ID NO: 757549 - RNA, 22 nt, Human
caggcagcguccugcuuccugu

SEQ ID NO: 757550 - RNA, 22 nt, Human
ccuggcucaaggcgaggacucc

SEQ ID NO: 757551 - RNA, 22 nt, Human
uaguggaggccuguugugugca

SEQ ID NO: 757552 - RNA, 22 nt, Human
aacuacagaaucauagaaaaua

SEQ ID NO: 757553 - RNA, 22 nt, Human
ugcuugauggcucuucuuucua

SEQ ID NO: 757554 - RNA, 22 nt, Human
ugcaggcuccaugaggacaggc

SEQ ID NO: 757555 - RNA, 22 nt, Human
uuguuucuccagucuaggaaaa

SEQ ID NO: 757556 - RNA, 22 nt, Human
uaugcuuucauucauaugugag

SEQ ID NO: 757557 - RNA, 22 nt, Human
uuccaggaacagaugaagguug

SEQ ID NO: 757558 - RNA, 22 nt, Human
cacaggcaggagguucuccagu

SEQ ID NO: 757559 - RNA, 22 nt, Human
cuucucuucccagggacacagg

SEQ ID NO: 757560 - RNA, 22 nt, Human
cuucucuuggguguggugucuu

SEQ ID NO: 757561 - RNA, 22 nt, Human
uccuagaaugcaccucugcugu

SEQ ID NO: 757562 - RNA, 22 nt, Human
cagcaagucauccaggaugaug

SEQ ID NO: 757563 - RNA, 22 nt, Human
aagagcauuuggugagauuuga

SEQ ID NO: 757564 - RNA, 22 nt, Human
gggcgcugggugucgagacuca

SEQ ID NO: 757565 - RNA, 22 nt, Human
ccaggucuucacuuuacugaag

SEQ ID NO: 757566 - RNA, 22 nt, Human
uuuccuuuaugacaucaccacu

SEQ ID NO: 757567 - RNA, 22 nt, Human
ccugggaaggggaagagaauuc

SEQ ID NO: 757568 - RNA, 19 nt, Human
cuggucugucaugcucccc

SEQ ID NO: 757569 - RNA, 22 nt, Human
ugucagugucuaugaagaauuu

SEQ ID NO: 757570 - RNA, 22 nt, Human
gaauauauuucucuuaccuuua

SEQ ID NO: 757571 - RNA, 22 nt, Human
cacuugggacaaagcuucugcu

SEQ ID NO: 757572 - RNA, 22 nt, Human
aggggcuucccuuccuggguag

SEQ ID NO: 757573 - RNA, 22 nt, Human
ccaggcaguggaagcuaaaauu

SEQ ID NO: 757574 - RNA, 23 nt, Human
cuguggagcccuuuguugggaga

SEQ ID NO: 757575 - RNA, 22 nt, Human
ugagagcugaagauauguuaac

SEQ ID NO: 757576 - RNA, 22 nt, Human
acaguguauauuguuuaucugg

SEQ ID NO: 757577 - RNA, 19 nt, Human
cccagcuguucuuccacca

SEQ ID NO: 757578 - RNA, 19 nt, Human
cccaggagcaguauugaug

SEQ ID NO: 757579 - RNA, 22 nt, Human
cagguggggcagcugugggagc

SEQ ID NO: 757580 - RNA, 22 nt, Human
gaugagcauuguuucauguguu

SEQ ID NO: 757581 - RNA, 22 nt, Human
agcagggcuguguagguaauga

SEQ ID NO: 757582 - RNA, 22 nt, Human
cuuuuggccucaaaggaaagaa

SEQ ID NO: 757583 - RNA, 22 nt, Human
cuuuccuccacucccuaggcuu

SEQ ID NO: 757584 - RNA, 22 nt, Human
uacagggcugagugagacaugg

SEQ ID NO: 757585 - RNA, 22 nt, Human
ccaggguugguauucaccugga

SEQ ID NO: 757586 - RNA, 22 nt, Human
ggaggccaggugggagucaucu

SEQ ID NO: 757587 - RNA, 22 nt, Human
uugacacagaucaauauucaac

SEQ ID NO: 757588 - RNA, 20 nt, Human
cagcaggaaaagugccucag

SEQ ID NO: 757589 - RNA, 22 nt, Human
uuucuguaauuaaaagggcagg

SEQ ID NO: 757590 - RNA, 22 nt, Human
uagaucauggguacugcauaug

SEQ ID NO: 757591 - RNA, 22 nt, Human
uucagagugguaugaagugaug

SEQ ID NO: 757592 - RNA, 22 nt, Human
cacagcugggaaaauuuguaca

SEQ ID NO: 757593 - RNA, 22 nt, Human
ugguuccaaucgcacuggcuca

SEQ ID NO: 757594 - RNA, 22 nt, Human
uacaaagucaccagcuucuugc

SEQ ID NO: 757595 - RNA, 22 nt, Human
cccugcugaaucccauggaguc

SEQ ID NO: 757596 - RNA, 22 nt, Human
cucaggccauucuuccagcugc

SEQ ID NO: 757597 - RNA, 22 nt, Human
uaucuagaaacagaguuuuacu

SEQ ID NO: 757598 - RNA, 22 nt, Human
cagaauucgaaugagcagaauc

SEQ ID NO: 757599 - RNA, 22 nt, Human
ucaggaaguugaggcguagaga

SEQ ID NO: 757600 - RNA, 22 nt, Human
ugaggcaguugagcuuccugag

SEQ ID NO: 757601 - RNA, 22 nt, Human
uugucuuaaauggauggacaau

SEQ ID NO: 757602 - RNA, 22 nt, Human
uaacaugagagcuaagacauua

SEQ ID NO: 757603 - RNA, 22 nt, Human
ucuuuucuguaacucagugucu

SEQ ID NO: 757604 - RNA, 22 nt, Human
ggcaaagccuuacucuaacuga

SEQ ID NO: 757605 - RNA, 23 nt, Human
agguggagcugugcagccggggc

SEQ ID NO: 757606 - RNA, 22 nt, Human
ucuuugaauucaaacuguucaa

SEQ ID NO: 757607 - RNA, 22 nt, Human
ggcuucccagcagagggcgcac

SEQ ID NO: 757608 - RNA, 22 nt, Human
cagcccuggcuagggcgagggc

SEQ ID NO: 757609 - RNA, 22 nt, Human
aagugagugguaaggagcaugg

SEQ ID NO: 757610 - RNA, 22 nt, Human
uccaggccccacugaagccccu

SEQ ID NO: 757611 - RNA, 22 nt, Human
ucagguccagcuccugugccuc

SEQ ID NO: 757612 - RNA, 22 nt, Human
aaggaaucacuucuuuaaauga

SEQ ID NO: 757613 - RNA, 22 nt, Human
gaaaucugaacucuguauccuu

SEQ ID NO: 757614 - RNA, 22 nt, Human
ucuucaaaaauacagguuuuca

SEQ ID NO: 757615 - RNA, 22 nt, Human
auggcaguugcccagccaaucc

SEQ ID NO: 757616 - RNA, 22 nt, Human
ccuggagacgaggcuggaccau

SEQ ID NO: 757617 - RNA, 22 nt, Human
aaucaacaggaugugcauugua

SEQ ID NO: 757618 - RNA, 22 nt, Human
uuguacauucuauggguuugga

SEQ ID NO: 757619 - RNA, 22 nt, Human
cggcaggguugguuuucucuga

SEQ ID NO: 757620 - RNA, 22 nt, Human
acacugguaggaagagauggcu

SEQ ID NO: 757621 - RNA, 20 nt, Human
aggaaaaauggaaacuggag

SEQ ID NO: 757622 - RNA, 22 nt, Human
cacucugagaaacacuaaacca

SEQ ID NO: 757623 - RNA, 17 nt, Human
gcuuuggaaggguagac

SEQ ID NO: 757624 - RNA, 22 nt, Human
ugcaguguuccuguagccugcc

SEQ ID NO: 757625 - RNA, 22 nt, Human
ccagcuuuccaggguugacugg

SEQ ID NO: 757626 - RNA, 22 nt, Human
uuaacuggggaagcauuucaug

SEQ ID NO: 757627 - RNA, 22 nt, Human
uguaacagcucuccaugugggg

SEQ ID NO: 757628 - RNA, 22 nt, Human
ucagaaacagaaacuaagaacc

SEQ ID NO: 757629 - RNA, 22 nt, Human
ucacuggauccuagcugagccu

SEQ ID NO: 757630 - RNA, 22 nt, Human
caggccaggcugcauuugcccc

SEQ ID NO: 757631 - RNA, 20 nt, Human
aagcaauauagugcaaaugu

SEQ ID NO: 757632 - RNA, 22 nt, Human
cugcugucuuuauuucacugcu

SEQ ID NO: 757633 - RNA, 22 nt, Human
cuguggaguggggaguacuggu

SEQ ID NO: 757634 - RNA, 22 nt, Human
uccauuuuucaugacuccucaa

SEQ ID NO: 757635 - RNA, 20 nt, Human
cugagcugagcuccaugggu

SEQ ID NO: 757636 - RNA, 19 nt, Human
acauagcuggcuacacugu

SEQ ID NO: 757637 - RNA, 22 nt, Human
cugcugugcuuguggccacccg

SEQ ID NO: 757638 - RNA, 22 nt, Human
acaguguguucugggaccucca

SEQ ID NO: 757639 - RNA, 22 nt, Human
aauauauuugaaucaggaacaa

SEQ ID NO: 757640 - RNA, 22 nt, Human
agacucuggaggggcugguccu

SEQ ID NO: 757641 - RNA, 22 nt, Human
gagcugaguaucccacugaagu

SEQ ID NO: 757642 - RNA, 22 nt, Human
ccugcugucucugggcaggcag

SEQ ID NO: 757643 - RNA, 22 nt, Human
ggaggccagaaucuguguugga

SEQ ID NO: 757644 - RNA, 19 nt, Human
gcgaggaagucacuguggu

SEQ ID NO: 757645 - RNA, 22 nt, Human
ccauggccgccgcugcucagga

SEQ ID NO: 757646 - RNA, 22 nt, Human
uucucucuguggucccauuuug

SEQ ID NO: 757647 - RNA, 19 nt, Human
gagggcucauuugaacaau

SEQ ID NO: 757648 - RNA, 22 nt, Human
aaccucaaacucuugggcuuaa

SEQ ID NO: 757649 - RNA, 20 nt, Human
agggccugcucugugguguc

SEQ ID NO: 757650 - RNA, 22 nt, Human
uaagauaaggaacauucuguga

SEQ ID NO: 757651 - RNA, 22 nt, Human
ugggaggugauuaaauuauggg

SEQ ID NO: 757652 - RNA, 22 nt, Human
agacauauauugcaauucacug

SEQ ID NO: 757653 - RNA, 22 nt, Human
auguuucagauacagaucaaau

SEQ ID NO: 757654 - RNA, 22 nt, Human
ccugucuguccucucaugagcc

SEQ ID NO: 757655 - RNA, 20 nt, Human
acugcaaaguacucuuucag

SEQ ID NO: 757656 - RNA, 22 nt, Human
uuguagaaaauuagaugcaugg

SEQ ID NO: 757657 - RNA, 22 nt, Human
acagaugauuuuuaugaaaaca

SEQ ID NO: 757658 - RNA, 22 nt, Human
cuuucacaguccugacugagcg

SEQ ID NO: 757659 - RNA, 22 nt, Human
ggagcucaggcccagcaaggcc

SEQ ID NO: 757660 - RNA, 22 nt, Human
uucacagugugaucuaugggca

SEQ ID NO: 757661 - RNA, 22 nt, Human
caguucuggaggauagaagucu

SEQ ID NO: 757662 - RNA, 22 nt, Human
ucccugggaacaaaggaugaga

SEQ ID NO: 757663 - RNA, 22 nt, Human
ccaggccagcaggcacaccugc

SEQ ID NO: 757664 - RNA, 22 nt, Human
auacaaagcuaaauaugguuuc

SEQ ID NO: 757665 - RNA, 22 nt, Human
gagguggcagaggccuggaccu

SEQ ID NO: 757666 - RNA, 22 nt, Human
cuuugaagaucacauguugcuc

SEQ ID NO: 757667 - RNA, 22 nt, Human
aguucuggcggcugucggcacu

SEQ ID NO: 757668 - RNA, 22 nt, Human
ggcacugauaauguccucucuc

SEQ ID NO: 757669 - RNA, 22 nt, Human
aaucuggacacaguucucaugc

SEQ ID NO: 757670 - RNA, 22 nt, Human
uggcacacagagaagacacuug

SEQ ID NO: 757671 - RNA, 22 nt, Human
aauauuugaacagucacugagu

SEQ ID NO: 757672 - RNA, 22 nt, Human
gacagugacagcuuggaaagca

SEQ ID NO: 757673 - RNA, 22 nt, Human
agccuucacugggaccuuggau

SEQ ID NO: 757674 - RNA, 22 nt, Human
cuccuucagucugcguggcugu

SEQ ID NO: 757675 - RNA, 22 nt, Human
uaccucagauugcugccuuggg

SEQ ID NO: 757676 - RNA, 22 nt, Human
auaucauuauguuaugagcaca

SEQ ID NO: 757677 - RNA, 22 nt, Human
auauggaagagccugggaauuu

SEQ ID NO: 757678 - RNA, 22 nt, Human
cuggccuuggugcuugcagaca

SEQ ID NO: 757679 - RNA, 22 nt, Human
uccagcagugcucuagagcgug

SEQ ID NO: 757680 - RNA, 22 nt, Human
ucugaguuuucugagaagcuua

SEQ ID NO: 757681 - RNA, 19 nt, Human
gcuguauuaaagauacaug

SEQ ID NO: 757682 - RNA, 22 nt, Human
gauauuuucgcagggagaauuc

SEQ ID NO: 757683 - RNA, 22 nt, Human
acacauguuuccaaaagcaccc

SEQ ID NO: 757684 - RNA, 22 nt, Human
gagccagccgcaagagcuguga

SEQ ID NO: 757685 - RNA, 22 nt, Human
gcauccaaauguuucauuucuu

SEQ ID NO: 757686 - RNA, 22 nt, Human
auacaaguuaaugagaaugaca

SEQ ID NO: 757687 - RNA, 22 nt, Human
gacuuugguuugagcaagucag

SEQ ID NO: 757688 - RNA, 22 nt, Human
guaguuuucugaaaauuacuuu

SEQ ID NO: 757689 - RNA, 22 nt, Human
uugaggucccaaacccacugag

SEQ ID NO: 757690 - RNA, 22 nt, Human
uuucagguaagaaaacuaagaa

SEQ ID NO: 757691 - RNA, 22 nt, Human
acauuucuaguuguucaucucc

SEQ ID NO: 757692 - RNA, 22 nt, Human
ucuuucccgccagagcaugagu

SEQ ID NO: 757693 - RNA, 22 nt, Human
ucuaugcuugagacagaugggg

SEQ ID NO: 757694 - RNA, 22 nt, Human
auaugcuggaguacaggaaaua

SEQ ID NO: 757695 - RNA, 22 nt, Human
gucccucacccagaugcuccca

SEQ ID NO: 757696 - RNA, 22 nt, Human
ccucuacuuaccacucagccag

SEQ ID NO: 757697 - RNA, 22 nt, Human
ugaaauguuuggguccagaagu

SEQ ID NO: 757698 - RNA, 22 nt, Human
cugagcuuaacccuguuagcaa

SEQ ID NO: 757699 - RNA, 23 nt, Human
ggccacuuugugucaguaugugc

SEQ ID NO: 757700 - RNA, 22 nt, Human
ugcaggguagaugcaggcugug

SEQ ID NO: 757701 - RNA, 22 nt, Human
agagccacugggagacagagca

SEQ ID NO: 757702 - RNA, 23 nt, Human
agggaacaagcaagcugcuaguc

SEQ ID NO: 757703 - RNA, 22 nt, Human
agaugaagacucaggagcaggu

SEQ ID NO: 757704 - RNA, 22 nt, Human
cuuuccuagaaauauauacuua

SEQ ID NO: 757705 - RNA, 22 nt, Human
acaguguucugcuuuuuaaucc

SEQ ID NO: 757706 - RNA, 22 nt, Human
acauuucaguaaguguuaauuu

SEQ ID NO: 757707 - RNA, 22 nt, Human
uggcugugggaugagagccuca

SEQ ID NO: 757708 - RNA, 22 nt, Human
aaguuacaguuacagaauggag

SEQ ID NO: 757709 - RNA, 22 nt, Human
uaguauuugcagauuuguguca

SEQ ID NO: 757710 - RNA, 22 nt, Human
gugacaaaaacacugauuauuu

SEQ ID NO: 757711 - RNA, 22 nt, Human
accagggcacaggagucugaag

SEQ ID NO: 757712 - RNA, 20 nt, Human
ugccgggcagccugaggagu

SEQ ID NO: 757713 - RNA, 23 nt, Human
gcugagguccugcugaguggugg

SEQ ID NO: 757714 - RNA, 22 nt, Human
caaaagcaguucuaucugaguu

SEQ ID NO: 757715 - RNA, 22 nt, Human
uuuaguguagccuaagcagaau

SEQ ID NO: 757716 - RNA, 22 nt, Human
gaaggccugugguagugagacg

SEQ ID NO: 757717 - RNA, 22 nt, Human
aguggcggggauuagcaguguu

SEQ ID NO: 757718 - RNA, 22 nt, Human
uugcaggguacauucuuagaau

SEQ ID NO: 757719 - RNA, 22 nt, Human
cuguagcuccagccugucuaca

SEQ ID NO: 757720 - RNA, 22 nt, Human
uugggcccauggggcuaagcua

SEQ ID NO: 757721 - RNA, 22 nt, Human
caggggacaguaugguggauga

SEQ ID NO: 757722 - RNA, 22 nt, Human
uaguacagaauuaauaauugug

SEQ ID NO: 757723 - RNA, 22 nt, Human
ugaaggcacguggguggauacu

SEQ ID NO: 757724 - RNA, 22 nt, Human
cuccgugcuauuuuaguaucgc

SEQ ID NO: 757725 - RNA, 22 nt, Human
aaagacuaaccaguugucaaaa

SEQ ID NO: 757726 - RNA, 21 nt, Human
uuaaagcuaugguagugggcu

SEQ ID NO: 757727 - RNA, 22 nt, Human
gcagaagcugggagaagggauu

SEQ ID NO: 757728 - RNA, 22 nt, Human
cagaugaacucuauccuguggc

SEQ ID NO: 757729 - RNA, 22 nt, Human
uuauacagggaguuucccugca

SEQ ID NO: 757730 - RNA, 22 nt, Human
cagauaacacaaagaaaugggc

SEQ ID NO: 757731 - RNA, 22 nt, Human
uuugcaaauaccaugaaacuug

SEQ ID NO: 757732 - RNA, 21 nt, Human
ccccugggagcccugucagua

SEQ ID NO: 757733 - RNA, 21 nt, Human
gcagggaccgcgacuucuggg

SEQ ID NO: 757734 - RNA, 20 nt, Human
gcuuccuucccagcccccac

SEQ ID NO: 757735 - RNA, 18 nt, Human
gagaaaguuugggcagaa

SEQ ID NO: 757736 - RNA, 22 nt, Human
uaacacuggcuuuugcugaggc

SEQ ID NO: 757737 - RNA, 18 nt, Human
ccuagccuccaagcucau

SEQ ID NO: 757738 - RNA, 22 nt, Human
uuccuggaaauuaugcucaccu

SEQ ID NO: 757739 - RNA, 22 nt, Human
guucucucucuugccugggugg

SEQ ID NO: 757740 - RNA, 22 nt, Human
ccuguugucauggaauaaguua

SEQ ID NO: 757741 - RNA, 22 nt, Human
gcuggcaccugcaccaagcagg

SEQ ID NO: 757742 - RNA, 22 nt, Human
gugaagcauaugcuucucugcc

SEQ ID NO: 757743 - RNA, 22 nt, Human
gagagggagccagccaggaacc

SEQ ID NO: 757744 - RNA, 22 nt, Human
gagcuguguucaugaggagaaa

SEQ ID NO: 757745 - RNA, 22 nt, Human
acaaugucugcuauuuggcucu

SEQ ID NO: 757746 - RNA, 22 nt, Human
ccaggugugcucugcaguggau

SEQ ID NO: 757747 - RNA, 22 nt, Human
uaacuugaccuguauaaaacac

SEQ ID NO: 757748 - RNA, 22 nt, Human
acugagcagaacaaugggagcc

SEQ ID NO: 757749 - RNA, 22 nt, Human
uugugucccccuuugagagcca

SEQ ID NO: 757750 - RNA, 22 nt, Human
gaagcagcuaggaucuucauuu

SEQ ID NO: 757751 - RNA, 20 nt, Human
ugaauagagagcacauaugc

SEQ ID NO: 757752 - RNA, 22 nt, Human
gcaguguuucccagagauggaa

SEQ ID NO: 757753 - RNA, 22 nt, Human
auguggcuuuucuaacccuucc

SEQ ID NO: 757754 - RNA, 22 nt, Human
ucugccaguuuauagacaagcc

SEQ ID NO: 757755 - RNA, 22 nt, Human
agcacccucagccuuauccaga

SEQ ID NO: 757756 - RNA, 18 nt, Human
cuugagcuaagggacccc

SEQ ID NO: 757757 - RNA, 22 nt, Human
ugcugaggucaccuugcugcua

SEQ ID NO: 757758 - RNA, 22 nt, Human
ugcauuauacuuuuagaaauuu

SEQ ID NO: 757759 - RNA, 22 nt, Human
ucucuucacaugcuugcuccaa

SEQ ID NO: 757760 - RNA, 22 nt, Human
ccagaaguggcuuucucaggga

SEQ ID NO: 757761 - RNA, 22 nt, Human
uuccuguaguugugcaauguac

SEQ ID NO: 757762 - RNA, 22 nt, Human
auucagaauuuuggggagcuaa

SEQ ID NO: 757763 - RNA, 22 nt, Human
aggcugugagcaagaacaccua

SEQ ID NO: 757764 - RNA, 22 nt, Human
gugcuuggaccaggucaucuuc

SEQ ID NO: 757765 - RNA, 22 nt, Human
aucacuguuaucuagaagcaca

SEQ ID NO: 757766 - RNA, 22 nt, Human
gcccugcuguuuagagagcuac

SEQ ID NO: 757767 - RNA, 22 nt, Human
cucaugugcaaaaguccaaauu

SEQ ID NO: 757768 - RNA, 22 nt, Human
cagagcagauuucuaaguauug

SEQ ID NO: 757769 - RNA, 21 nt, Human
ggaaaacuuuccuugucugaa

SEQ ID NO: 757770 - RNA, 22 nt, Human
cauggcuucaugaggguuuugc

SEQ ID NO: 757771 - RNA, 22 nt, Human
acaacuucucacagauaaauuu

SEQ ID NO: 757772 - RNA, 22 nt, Human
cagcagugcuucagugugagau

SEQ ID NO: 757773 - RNA, 18 nt, Human
ggaagauuggcuaugugc

SEQ ID NO: 757774 - RNA, 22 nt, Human
gccaggcgggucucaaacuccu

SEQ ID NO: 757775 - RNA, 22 nt, Human
uguccucuaauuggccucuugc

SEQ ID NO: 757776 - RNA, 22 nt, Human
agcagggaggcggugugcuggc

SEQ ID NO: 757777 - RNA, 22 nt, Human
aaagagaugugccaaauagccu

SEQ ID NO: 757778 - RNA, 22 nt, Human
aggcauauacucucagaaaaaa

SEQ ID NO: 757779 - RNA, 22 nt, Human
gaagaggacuguggcauccuag

SEQ ID NO: 757780 - RNA, 22 nt, Human
ucccagagacaucauuucuccg

SEQ ID NO: 757781 - RNA, 22 nt, Human
uggcaaaggaaaugauuuaaga

SEQ ID NO: 757782 - RNA, 22 nt, Human
ccugagcuugauccuucugucu

SEQ ID NO: 757783 - RNA, 22 nt, Human
uacuuugaccaccaucugauua

SEQ ID NO: 757784 - RNA, 22 nt, Human
aaggauuuguccaaagucacac

SEQ ID NO: 757785 - RNA, 22 nt, Human
ccaguccucagauggucugugc

SEQ ID NO: 757786 - RNA, 22 nt, Human
uguauacauucucuuggguuug

SEQ ID NO: 757787 - RNA, 22 nt, Human
uccagcccagcuccucucagaa

SEQ ID NO: 757788 - RNA, 22 nt, Human
ccugaagauccauuauagacac

SEQ ID NO: 757789 - RNA, 22 nt, Human
gcagagcagagccugcauuggc

SEQ ID NO: 757790 - RNA, 22 nt, Human
aaacaucaauugcaucucccaa

SEQ ID NO: 757791 - RNA, 22 nt, Human
caccaggcugaaccagagggga

SEQ ID NO: 757792 - RNA, 22 nt, Human
agcuauuucaaaguuugagaca

SEQ ID NO: 757793 - RNA, 22 nt, Human
ggccccuggcaccaggcugauu

SEQ ID NO: 757794 - RNA, 22 nt, Human
gggaaagagugcuuguccagag

SEQ ID NO: 757795 - RNA, 22 nt, Human
cccagugugccccuccugcagc

SEQ ID NO: 757796 - RNA, 22 nt, Human
aaguuauaucaucucauugacg

SEQ ID NO: 757797 - RNA, 22 nt, Human
caugggcaguuggcagggcuca

SEQ ID NO: 757798 - RNA, 22 nt, Human
uuucuccaauguaucagcacac

SEQ ID NO: 757799 - RNA, 22 nt, Human
ucucugugaguggaaggcaccc

SEQ ID NO: 757800 - RNA, 22 nt, Human
gcuggcugccaauuucagagcu

SEQ ID NO: 757801 - RNA, 22 nt, Human
agagcugaauuuggguggugga

SEQ ID NO: 757802 - RNA, 22 nt, Human
cuggcccugccuaauguacuug

SEQ ID NO: 757803 - RNA, 22 nt, Human
gcuuugcuaugacucaccagca

SEQ ID NO: 757804 - RNA, 22 nt, Human
aaaugcacacaccaggaaacua

SEQ ID NO: 757805 - RNA, 22 nt, Human
ugaucaguguugguucuaucua

SEQ ID NO: 757806 - RNA, 22 nt, Human
aguccaaggccauacaguugug

SEQ ID NO: 757807 - RNA, 22 nt, Human
cuccucucaaaaguagguugac

SEQ ID NO: 757808 - RNA, 18 nt, Human
uaguggaacugcucuggg

SEQ ID NO: 757809 - RNA, 19 nt, Human
gcccugaguaagcuaggag

SEQ ID NO: 757810 - RNA, 22 nt, Human
ucacccagacagcuugcacuga

SEQ ID NO: 757811 - RNA, 22 nt, Human
cugcuuuauagggcuuccaugu

SEQ ID NO: 757812 - RNA, 22 nt, Human
aagucuuuuugaaucuauaacu

SEQ ID NO: 757813 - RNA, 22 nt, Human
ucuguugguucuguuucucuga

SEQ ID NO: 757814 - RNA, 21 nt, Human
gcagaggcacggcaccaaggg

SEQ ID NO: 757815 - RNA, 22 nt, Human
cacugcacaggugagauguggg

SEQ ID NO: 757816 - RNA, 22 nt, Human
gggaacagagugccagacugac

SEQ ID NO: 757817 - RNA, 22 nt, Human
cugagcagcaccuucaagaaac

SEQ ID NO: 757818 - RNA, 22 nt, Human
auuuuccaaaauaauuguuacu

SEQ ID NO: 757819 - RNA, 22 nt, Human
acucuugaacugauuaagaaug

SEQ ID NO: 757820 - RNA, 22 nt, Human
cagagauaccauugcuaaaauu

SEQ ID NO: 757821 - RNA, 22 nt, Human
gcccaugcucucaggcgggccu

SEQ ID NO: 757822 - RNA, 22 nt, Human
uuucuacagaagauacacugcu

SEQ ID NO: 757823 - RNA, 22 nt, Human
ccacugccucuccagggccauc

SEQ ID NO: 757824 - RNA, 22 nt, Human
gcacuucaccacuguccugguu

SEQ ID NO: 757825 - RNA, 22 nt, Human
cggggcagagggucuucuccag

SEQ ID NO: 757826 - RNA, 22 nt, Human
agguggcagaggacuccuccug

SEQ ID NO: 757827 - RNA, 22 nt, Human
cacaugagguggagaugaauga

SEQ ID NO: 757828 - RNA, 22 nt, Human
cuguggggaagauagaaccgac

SEQ ID NO: 757829 - RNA, 22 nt, Human
agcagaagaaagccacaugacu

SEQ ID NO: 757830 - RNA, 22 nt, Human
gaggcacaccagggagucuugu

SEQ ID NO: 757831 - RNA, 22 nt, Human
cuucaagagaaugcagggaugu

SEQ ID NO: 757832 - RNA, 22 nt, Human
gccugaugagcuuccagcugag

SEQ ID NO: 757833 - RNA, 22 nt, Human
gcucugagagugggugauucug

SEQ ID NO: 757834 - RNA, 22 nt, Human
uauggauggaaagggccaagcu

SEQ ID NO: 757835 - RNA, 22 nt, Human
cagaggccaguggacaagggcc

SEQ ID NO: 757836 - RNA, 22 nt, Human
uggagggcauagcuguucuuuc

SEQ ID NO: 757837 - RNA, 22 nt, Human
aaggccuggauuuagguuguga

SEQ ID NO: 757838 - RNA, 22 nt, Human
gagggaugcagaaacagaggcc

SEQ ID NO: 757839 - RNA, 22 nt, Human
uucuaucauacuugaauacauu

SEQ ID NO: 757840 - RNA, 22 nt, Human
auguuucccagagcaaaucugg

SEQ ID NO: 757841 - RNA, 22 nt, Human
ugcuacacucaaucagugcuau

SEQ ID NO: 757842 - RNA, 22 nt, Human
cacccuagcugucauuucaguu

SEQ ID NO: 757843 - RNA, 18 nt, Human
aacuucaacuacaaugga

SEQ ID NO: 757844 - RNA, 22 nt, Human
ucucugugucuuagugaaggga

SEQ ID NO: 757845 - RNA, 22 nt, Human
auauggcauuuuaauguaugag

SEQ ID NO: 757846 - RNA, 22 nt, Human
gaauuuuaauaaagguuuauca

SEQ ID NO: 757847 - RNA, 22 nt, Human
aguggcagagaccccagccagc

SEQ ID NO: 757848 - RNA, 22 nt, Human
ucuaaggacauuggcuuuggag

SEQ ID NO: 757849 - RNA, 22 nt, Human
cccuuuggaagaggcucacuga

SEQ ID NO: 757850 - RNA, 20 nt, Human
cccagaagcuuaacagagca

SEQ ID NO: 757851 - RNA, 22 nt, Human
uuaguuaggauuuggugguaua

SEQ ID NO: 757852 - RNA, 22 nt, Human
aaguuuuugguagagaaaagua

SEQ ID NO: 757853 - RNA, 22 nt, Human
acuggauugggaaaguacuuca

SEQ ID NO: 757854 - RNA, 22 nt, Human
uaaaguuuguagcaauugauau

SEQ ID NO: 757855 - RNA, 22 nt, Human
ugaagcaauagagacaagacca

SEQ ID NO: 757856 - RNA, 22 nt, Human
aagcaauaaauaauuuuuagua

SEQ ID NO: 757857 - RNA, 22 nt, Human
uucuguauguacauauguguau

SEQ ID NO: 757858 - RNA, 22 nt, Human
acuguugucaggcugcuuugga

SEQ ID NO: 757859 - RNA, 22 nt, Human
cagucuaagacucacgccaaga

SEQ ID NO: 757860 - RNA, 22 nt, Human
cccaggagacagaaacagaggu

SEQ ID NO: 757861 - RNA, 22 nt, Human
uuggcugcugaaauauguucug

SEQ ID NO: 757862 - RNA, 22 nt, Human
gaggcuccccaugaggccccag

SEQ ID NO: 757863 - RNA, 22 nt, Human
uuucaaggccuucugguucagu

SEQ ID NO: 757864 - RNA, 22 nt, Human
uugaaguugcacauuauaauuu

SEQ ID NO: 757865 - RNA, 22 nt, Human
augugugcauauucugccaccu

SEQ ID NO: 757866 - RNA, 22 nt, Human
acauuuguaugcguuuuuacug

SEQ ID NO: 757867 - RNA, 20 nt, Human
uccagcucaguuuuuuuguc

SEQ ID NO: 757868 - RNA, 23 nt, Human
uccugcugaaagcuccagcuggc

SEQ ID NO: 757869 - RNA, 22 nt, Human
uuugacagacauuuacuacauu

SEQ ID NO: 757870 - RNA, 22 nt, Human
ccugagggcucagcccccagcc

SEQ ID NO: 757871 - RNA, 22 nt, Human
ucaggcugagaaaaucuggacc

SEQ ID NO: 757872 - RNA, 22 nt, Human
cugagcucaagugaucugccca

SEQ ID NO: 757873 - RNA, 22 nt, Human
ugggcagcaaagacugugugcu

SEQ ID NO: 757874 - RNA, 22 nt, Human
uccuuagggauuuuuccaguca

SEQ ID NO: 757875 - RNA, 22 nt, Human
uagcacaugccgggagugaucu

SEQ ID NO: 757876 - RNA, 22 nt, Human
uauaacaguuuaggugguguca

SEQ ID NO: 757877 - RNA, 22 nt, Human
ggcuuuauuuugcaugaaugcu

SEQ ID NO: 757878 - RNA, 22 nt, Human
uaguuugagaauugaaauagaa

SEQ ID NO: 757879 - RNA, 22 nt, Human
aauagaggagcuuuggacuccc

SEQ ID NO: 757880 - RNA, 22 nt, Human
aggcagcuuuaacugguaguag

SEQ ID NO: 757881 - RNA, 22 nt, Human
ugacuucucuggccuggugcag

SEQ ID NO: 757882 - RNA, 22 nt, Human
ugugcucugaagagugcauguc

SEQ ID NO: 757883 - RNA, 22 nt, Human
ugcaauacucaucauuggagau

SEQ ID NO: 757884 - RNA, 22 nt, Human
aguguauuaugcagcggagguc

SEQ ID NO: 757885 - RNA, 22 nt, Human
uuuuagauugggaaauguaaag

SEQ ID NO: 757886 - RNA, 22 nt, Human
gacauuggguguacaauuggca

SEQ ID NO: 757887 - RNA, 21 nt, Human
ucccacuggcccagggcucca

SEQ ID NO: 757888 - RNA, 23 nt, Human
auguuauuauuagcagucuugcc

SEQ ID NO: 757889 - RNA, 22 nt, Human
aguacaaaugcagccagaguag

SEQ ID NO: 757890 - RNA, 22 nt, Human
uagugaauaguccaaucccgca

SEQ ID NO: 757891 - RNA, 22 nt, Human
auuugugaauuaagcaugucaa

SEQ ID NO: 757892 - RNA, 22 nt, Human
cugacucugacaggacuugugg

SEQ ID NO: 757893 - RNA, 22 nt, Human
cugacccuuaaugagcaaguaa

SEQ ID NO: 757894 - RNA, 22 nt, Human
uuguuuuaagccagucugccua

SEQ ID NO: 757895 - RNA, 22 nt, Human
auucagacugucuaaaugguuu

SEQ ID NO: 757896 - RNA, 22 nt, Human
acaguggagaaggcaugaggcu

SEQ ID NO: 757897 - RNA, 22 nt, Human
gcugccuccugaaagcgcucug

SEQ ID NO: 757898 - RNA, 22 nt, Human
ccacuuccugcagguaaggagc

SEQ ID NO: 757899 - RNA, 21 nt, Human
auacauucuauuaagcauuua

SEQ ID NO: 757900 - RNA, 22 nt, Human
uucuuacauuagucugugcuuu

SEQ ID NO: 757901 - RNA, 22 nt, Human
cuuuacuucucaaaauaaagca

SEQ ID NO: 757902 - RNA, 22 nt, Human
ugcauguguuugccacagugag

SEQ ID NO: 757903 - RNA, 21 nt, Human
cagaggcugagagggcaaucu

SEQ ID NO: 757904 - RNA, 22 nt, Human
auuguauaauuguauugccaaa

SEQ ID NO: 757905 - RNA, 22 nt, Human
ucuguagguuaaaaguagacaa

SEQ ID NO: 757906 - RNA, 22 nt, Human
agcacguucuucauuacuucac

SEQ ID NO: 757907 - RNA, 22 nt, Human
augucaccuucgguggcacggu

SEQ ID NO: 757908 - RNA, 22 nt, Human
uugagcaaaucagaaguuuaga

SEQ ID NO: 757909 - RNA, 19 nt, Human
gucuuggcucucaaccauc

SEQ ID NO: 757910 - RNA, 22 nt, Human
ugcugagaggaaggugcacugg

SEQ ID NO: 757911 - RNA, 21 nt, Human
guauugcagaguuaugugcuc

SEQ ID NO: 757912 - RNA, 22 nt, Human
acauucuauagcaagcugaucu

SEQ ID NO: 757913 - RNA, 22 nt, Human
caagagcucaccggagagcauu

SEQ ID NO: 757914 - RNA, 22 nt, Human
cucagaguccccaguggguuug

SEQ ID NO: 757915 - RNA, 22 nt, Human
acacuaguggaaauugauuugu

SEQ ID NO: 757916 - RNA, 22 nt, Human
cuugccuucuguuccuauagaa

SEQ ID NO: 757917 - RNA, 22 nt, Human
cacauucacuucucuguccacc

SEQ ID NO: 757918 - RNA, 22 nt, Human
ugaggccauggaacuagcuugg

SEQ ID NO: 757919 - RNA, 22 nt, Human
aauuccaacagacaaaguuaga

SEQ ID NO: 757920 - RNA, 22 nt, Human
auacagcuuucuuucacaugag

SEQ ID NO: 757921 - RNA, 22 nt, Human
cacagugcaugaugggcagaag

SEQ ID NO: 757922 - RNA, 22 nt, Human
gccccacagccugcggucucag

SEQ ID NO: 757923 - RNA, 22 nt, Human
cacaguuugguauagaagugau

SEQ ID NO: 757924 - RNA, 22 nt, Human
ggcuuuauauuguuugagcaga

SEQ ID NO: 757925 - RNA, 22 nt, Human
gcagauggugggggaggaguac

SEQ ID NO: 757926 - RNA, 22 nt, Human
gauuuuacugucuguguaucuc

SEQ ID NO: 757927 - RNA, 22 nt, Human
gagcugugcuuauaccaauuca

SEQ ID NO: 757928 - RNA, 22 nt, Human
ugugugucuggaagcucaggga

SEQ ID NO: 757929 - RNA, 22 nt, Human
uccugggacucugccucaggcu

SEQ ID NO: 757930 - RNA, 22 nt, Human
acagcccagaaagccuaagggg

SEQ ID NO: 757931 - RNA, 22 nt, Human
cugaauuaagcauuacauacau

SEQ ID NO: 757932 - RNA, 22 nt, Human
acacagagcaaaucaugacaga

SEQ ID NO: 757933 - RNA, 22 nt, Human
gaaaauaggcugcaucuccuuc

SEQ ID NO: 757934 - RNA, 22 nt, Human
agaaaucaugacuaagagcagu

SEQ ID NO: 757935 - RNA, 22 nt, Human
ucagacuucuacuuugcagagc

SEQ ID NO: 757936 - RNA, 22 nt, Human
gcucugcugauccgcagccauc

SEQ ID NO: 757937 - RNA, 21 nt, Human
caauggcgagaucuuggcuca

SEQ ID NO: 757938 - RNA, 22 nt, Human
guuuuccauggaggucugaccu

SEQ ID NO: 757939 - RNA, 21 nt, Human
ugcaguauguauuuguaucca

SEQ ID NO: 757940 - RNA, 22 nt, Human
aagacagugacagucacaauug

SEQ ID NO: 757941 - RNA, 22 nt, Human
ggguggcagcuguugccaaggu

SEQ ID NO: 757942 - RNA, 18 nt, Human
uggacacauggccugggu

SEQ ID NO: 757943 - RNA, 23 nt, Human
ucuuuacauacugaugaguucuc

SEQ ID NO: 757944 - RNA, 22 nt, Human
acacaugcauaagccuucccuu

SEQ ID NO: 757945 - RNA, 22 nt, Human
cacacaugguuccgcaggaugc

SEQ ID NO: 757946 - RNA, 22 nt, Human
gggagacacgcugcaggcauaa

SEQ ID NO: 757947 - RNA, 22 nt, Human
uacugaaagaauacauaauuuc

SEQ ID NO: 757948 - RNA, 22 nt, Human
aauguucagcgagggaugcuag

SEQ ID NO: 757949 - RNA, 22 nt, Human
gugcaaccaucaccacugacuc

SEQ ID NO: 757950 - RNA, 22 nt, Human
uuggaauagggaggcuggcaua

SEQ ID NO: 757951 - RNA, 22 nt, Human
agggaagcaauauuagauauca

SEQ ID NO: 757952 - RNA, 22 nt, Human
agcucccagaaggcccugcgcc

SEQ ID NO: 757953 - RNA, 22 nt, Human
gaauagauuauacuugaagcau

SEQ ID NO: 757954 - RNA, 22 nt, Human
aaagagccgcugaugucagccc

SEQ ID NO: 757955 - RNA, 22 nt, Human
gcccugggcucccugcuccaca

SEQ ID NO: 757956 - RNA, 22 nt, Human
cuggcucugggcuaagcuccca

SEQ ID NO: 757957 - RNA, 22 nt, Human
ucuucuuccuccacagggccca

SEQ ID NO: 757958 - RNA, 22 nt, Human
uucuuuuaauuucugucugcag

SEQ ID NO: 757959 - RNA, 22 nt, Human
ggagucugauuuuuuaugggug

SEQ ID NO: 757960 - RNA, 22 nt, Human
ucaggcucugagcugaugcuaa

SEQ ID NO: 757961 - RNA, 22 nt, Human
gugugauaacagggcaugacgg

SEQ ID NO: 757962 - RNA, 22 nt, Human
aaguaaaagcaggugugcuggg

SEQ ID NO: 757963 - RNA, 22 nt, Human
ucugccuguugagccuaaggcc

SEQ ID NO: 757964 - RNA, 22 nt, Human
aacacagguucauucugugagg

SEQ ID NO: 757965 - RNA, 22 nt, Human
cuguaugauuccauuucuauaa

SEQ ID NO: 757966 - RNA, 22 nt, Human
cugaggcacagugaacuucucc

SEQ ID NO: 757967 - RNA, 22 nt, Human
ugggggugguucuugccuccag

SEQ ID NO: 757968 - RNA, 22 nt, Human
gggaaggcauaccugagggaga

SEQ ID NO: 757969 - RNA, 18 nt, Human
ugaauagggguuugcaga

SEQ ID NO: 757970 - RNA, 22 nt, Human
ugcaacaggcugugacauggaa

SEQ ID NO: 757971 - RNA, 22 nt, Human
ggagaagggacagacucagcuu

SEQ ID NO: 757972 - RNA, 22 nt, Human
caggaacaauaucuguccuggu

SEQ ID NO: 757973 - RNA, 22 nt, Human
agggcagcucucaccucuggcc

SEQ ID NO: 757974 - RNA, 22 nt, Human
uaaguauguuagaaaaucaagu

SEQ ID NO: 757975 - RNA, 22 nt, Human
acacauguauguuuuguauuug

SEQ ID NO: 757976 - RNA, 22 nt, Human
caguggguccugcgucugccag

SEQ ID NO: 757977 - RNA, 22 nt, Human
aaggaaauacaacauguauuca

SEQ ID NO: 757978 - RNA, 22 nt, Human
gccuucaguagugucagcugua

SEQ ID NO: 757979 - RNA, 22 nt, Human
acagaugcgcuugguugccaga

SEQ ID NO: 757980 - RNA, 22 nt, Human
ggcagucuuucccuugagcucu

SEQ ID NO: 757981 - RNA, 22 nt, Human
gcucaggaaggcucaaccagga

SEQ ID NO: 757982 - RNA, 19 nt, Human
ggccuuggggucccaaagu

SEQ ID NO: 757983 - RNA, 22 nt, Human
agccuggcggucgucggucagg

SEQ ID NO: 757984 - RNA, 22 nt, Human
cugugagauuuuuaaauaacuu

SEQ ID NO: 757985 - RNA, 22 nt, Human
ccacccagcagaggaggcaaga

SEQ ID NO: 757986 - RNA, 22 nt, Human
gcuguucugcgucccaggcugg

SEQ ID NO: 757987 - RNA, 22 nt, Human
uugcagcugcaguaaauguuca

SEQ ID NO: 757988 - RNA, 22 nt, Human
uauguguauaucuguaugugca

SEQ ID NO: 757989 - RNA, 22 nt, Human
cucagacacagccccacgaagu

SEQ ID NO: 757990 - RNA, 22 nt, Human
gaauugcucugccuggccagcc

SEQ ID NO: 757991 - RNA, 22 nt, Human
uagcaucugcguuggguuggac

SEQ ID NO: 757992 - RNA, 22 nt, Human
agucucugcugguugugccuau

SEQ ID NO: 757993 - RNA, 22 nt, Human
uccagcccugcacugauuagau

SEQ ID NO: 757994 - RNA, 22 nt, Human
gucauuuuaugggaacagauuu

SEQ ID NO: 757995 - RNA, 16 nt, Human
ccaggaacacacagcu

SEQ ID NO: 757996 - RNA, 22 nt, Human
auggaaauggagugugcuugcu

SEQ ID NO: 757997 - RNA, 22 nt, Human
uuugcaaaaugaggugaagagu

SEQ ID NO: 757998 - RNA, 23 nt, Human
accuuggacuucccagcuuccag

SEQ ID NO: 757999 - RNA, 22 nt, Human
auacaugugggucuaaacauau

SEQ ID NO: 758000 - RNA, 19 nt, Human
agggagaauuccaagagga

SEQ ID NO: 758001 - RNA, 22 nt, Human
auaauggcaugacaguuauaua

SEQ ID NO: 758002 - RNA, 22 nt, Human
uuucugcauuuacaaaaugagg

SEQ ID NO: 758003 - RNA, 22 nt, Human
uccagcuugacaaaugauuuua

SEQ ID NO: 758004 - RNA, 22 nt, Human
ccuggcucugguucccucagcu

SEQ ID NO: 758005 - RNA, 22 nt, Human
uuucuggaaacuguaaagagga

SEQ ID NO: 758006 - RNA, 22 nt, Human
acuucuugggacccuggcaccg

SEQ ID NO: 758007 - RNA, 22 nt, Human
gagccagggcugugagcugagc

SEQ ID NO: 758008 - RNA, 18 nt, Human
gcugagcaaauuccuccc

SEQ ID NO: 758009 - RNA, 22 nt, Human
uucagagaaacugagguuuaga

SEQ ID NO: 758010 - RNA, 22 nt, Human
uuggaaaugcauuuguuauuau

SEQ ID NO: 758011 - RNA, 22 nt, Human
uggcacagccacugaaucggga

SEQ ID NO: 758012 - RNA, 22 nt, Human
cugcaggcugagcgccugccgg

SEQ ID NO: 758013 - RNA, 22 nt, Human
caggcugggcugguguuagagu

SEQ ID NO: 758014 - RNA, 22 nt, Human
ugcauuaaaaugauggagaaau

SEQ ID NO: 758015 - RNA, 22 nt, Human
gggagagcgggaggugccacag

SEQ ID NO: 758016 - RNA, 22 nt, Human
ggcuccugggagauagagguca

SEQ ID NO: 758017 - RNA, 20 nt, Human
ugaagauuuuguguuuagaa

SEQ ID NO: 758018 - RNA, 18 nt, Human
ggucaggggcggagagaa

SEQ ID NO: 758019 - RNA, 17 nt, Human
uggcaugaggguguggg

SEQ ID NO: 758020 - RNA, 22 nt, Human
agagccuggagguucugcugaa

SEQ ID NO: 758021 - RNA, 22 nt, Human
ugggugccaaccucugguggcc

SEQ ID NO: 758022 - RNA, 19 nt, Human
guggccagggcaggggcug

SEQ ID NO: 758023 - RNA, 22 nt, Human
cgucauccuuuggaugaaucac

SEQ ID NO: 758024 - RNA, 17 nt, Human
cucuccuuccucugagg

SEQ ID NO: 758025 - RNA, 22 nt, Human
ucuucagacccuuagcugugau

SEQ ID NO: 758026 - RNA, 22 nt, Human
ucauguuuuaguaaagugaagg

SEQ ID NO: 758027 - RNA, 18 nt, Human
aaaugcuaggcuacauga

SEQ ID NO: 758028 - RNA, 22 nt, Human
acaauagacaaagugaauggcu

SEQ ID NO: 758029 - RNA, 22 nt, Human
ucuggaauucucaaguccugga

SEQ ID NO: 758030 - RNA, 22 nt, Human
uucucaggccccugccuggacu

SEQ ID NO: 758031 - RNA, 22 nt, Human
cugucuccagggcaggugcagg

SEQ ID NO: 758032 - RNA, 22 nt, Human
aggaacaauugauaaacucaca

SEQ ID NO: 758033 - RNA, 20 nt, Human
uucuaacuacucucccuuug

SEQ ID NO: 758034 - RNA, 22 nt, Human
aggcucaguucacgucaacuuu

SEQ ID NO: 758035 - RNA, 22 nt, Human
gaauuuuaaguguucgccucuu

SEQ ID NO: 758036 - RNA, 22 nt, Human
gagcuuuagcugagaccugcuu

SEQ ID NO: 758037 - RNA, 22 nt, Human
acaguaauuaaaauggaucugc

SEQ ID NO: 758038 - RNA, 22 nt, Human
ugcuggagaccugcuugcacca

SEQ ID NO: 758039 - RNA, 23 nt, Human
acagccaggaugggagcagaagc

SEQ ID NO: 758040 - RNA, 22 nt, Human
cauguugaauggccuugauuuu

SEQ ID NO: 758041 - RNA, 22 nt, Human
uauacaguuugaguucuugcau

SEQ ID NO: 758042 - RNA, 22 nt, Human
gaggccuggagccgccuaggcg

SEQ ID NO: 758043 - RNA, 22 nt, Human
gcaauacaguaagaguacugua

SEQ ID NO: 758044 - RNA, 22 nt, Human
ucugcguccaucugccugcuug

SEQ ID NO: 758045 - RNA, 22 nt, Human
caaggcauuaccauggcuagag

SEQ ID NO: 758046 - RNA, 22 nt, Human
aaggcacuuuuccugagaugau

SEQ ID NO: 758047 - RNA, 20 nt, Human
cuagucucacaucccuggca

SEQ ID NO: 758048 - RNA, 22 nt, Human
uggcucuuuucacguccccucu

SEQ ID NO: 758049 - RNA, 22 nt, Human
uaggcucacauagcacuaagug

SEQ ID NO: 758050 - RNA, 21 nt, Human
uggcacugcuuagcagguucc

SEQ ID NO: 758051 - RNA, 22 nt, Human
gcagaggaggacccaggaauua

SEQ ID NO: 758052 - RNA, 22 nt, Human
gugaaaaaugauuuguuaacug

SEQ ID NO: 758053 - RNA, 20 nt, Human
caggugagcagaucugggug

SEQ ID NO: 758054 - RNA, 22 nt, Human
ugggccguggagcacucugaga

SEQ ID NO: 758055 - RNA, 22 nt, Human
gguucacuccgaucucugccuc

SEQ ID NO: 758056 - RNA, 22 nt, Human
gagaggaauaucauuauauuag

SEQ ID NO: 758057 - RNA, 22 nt, Human
gguggcaguuacaggggcaaau

SEQ ID NO: 758058 - RNA, 22 nt, Human
ucccucugggcuggagcagggu

SEQ ID NO: 758059 - RNA, 22 nt, Human
aaagaucugacuuagacacaga

SEQ ID NO: 758060 - RNA, 22 nt, Human
uguauacaggauuacucauagc

SEQ ID NO: 758061 - RNA, 22 nt, Human
uauaggcucuuguuaaccuuuu

SEQ ID NO: 758062 - RNA, 22 nt, Human
auuugcuugugcuaugaaaguu

SEQ ID NO: 758063 - RNA, 22 nt, Human
uugcugugucugauggcugaga

SEQ ID NO: 758064 - RNA, 22 nt, Human
auauauagagcuagauguuaaa

SEQ ID NO: 758065 - RNA, 22 nt, Human
ucacccagacuugugaaugugu

SEQ ID NO: 758066 - RNA, 21 nt, Human
uuuuaugcauaggaaauauau

SEQ ID NO: 758067 - RNA, 19 nt, Human
agucucaguguacagaggc

SEQ ID NO: 758068 - RNA, 22 nt, Human
ugcugggcccagggagccucug

SEQ ID NO: 758069 - RNA, 22 nt, Human
caagacauugauuuuguacaga

SEQ ID NO: 758070 - RNA, 22 nt, Human
ugucaucugauauuacuuauag

SEQ ID NO: 758071 - RNA, 22 nt, Human
uaggggcucagaacauguccuu

SEQ ID NO: 758072 - RNA, 22 nt, Human
acacugaauguuuaagaacuug

SEQ ID NO: 758073 - RNA, 22 nt, Human
agggaaggcuuuugacauuucc

SEQ ID NO: 758074 - RNA, 22 nt, Human
agggcacccucucugcaguacc

SEQ ID NO: 758075 - RNA, 22 nt, Human
uuucucugggcacucuccaaac

SEQ ID NO: 758076 - RNA, 22 nt, Human
cgcuggccauagccuccugugu

SEQ ID NO: 758077 - RNA, 22 nt, Human
uuugcuucacaaguaugguucu

SEQ ID NO: 758078 - RNA, 22 nt, Human
ugaggccagugacauauauuaa

SEQ ID NO: 758079 - RNA, 22 nt, Human
auggacaggcugagcuuccuca

SEQ ID NO: 758080 - RNA, 20 nt, Human
ucugaacaaaauguaauguc

SEQ ID NO: 758081 - RNA, 22 nt, Human
gaccauuugcuaguaaauugca

SEQ ID NO: 758082 - RNA, 22 nt, Human
uuguguuucuggccaagaugga

SEQ ID NO: 758083 - RNA, 22 nt, Human
gugugccuuaagcucuauagac

SEQ ID NO: 758084 - RNA, 22 nt, Human
guaguucugcagugucaccuga

SEQ ID NO: 758085 - RNA, 17 nt, Human
aauugcuuguacuccca

SEQ ID NO: 758086 - RNA, 22 nt, Human
cugcaggaggauccugagagug

SEQ ID NO: 758087 - RNA, 22 nt, Human
cuggagccacuuuuuauccuuu

SEQ ID NO: 758088 - RNA, 22 nt, Human
gguggccuagggcccagccugu

SEQ ID NO: 758089 - RNA, 20 nt, Human
uuccuguauacaaagaguuc

SEQ ID NO: 758090 - RNA, 22 nt, Human
gcaggcugugguauguugggca

SEQ ID NO: 758091 - RNA, 22 nt, Human
acagaggccucguagguacaac

SEQ ID NO: 758092 - RNA, 20 nt, Human
agggccuggaguacagcagg

SEQ ID NO: 758093 - RNA, 22 nt, Human
agaccuggaugugagggaagua

SEQ ID NO: 758094 - RNA, 22 nt, Human
uggcagcagacaucugaggucu

SEQ ID NO: 758095 - RNA, 22 nt, Human
aauaauacugcauguaaggugc

SEQ ID NO: 758096 - RNA, 20 nt, Human
gcccuggacguggccucggc

SEQ ID NO: 758097 - RNA, 22 nt, Human
cuggcaguauuaagagaaguga

SEQ ID NO: 758098 - RNA, 22 nt, Human
ucuucauuccguagauauuuau

SEQ ID NO: 758099 - RNA, 22 nt, Human
agcuggagcuucaagcagguaa

SEQ ID NO: 758100 - RNA, 22 nt, Human
ucuuagcagugcugagaagaau

SEQ ID NO: 758101 - RNA, 22 nt, Human
acaagcagagauuaaauguuuu

SEQ ID NO: 758102 - RNA, 22 nt, Human
gaugcuuuccaagaaauccuca

SEQ ID NO: 758103 - RNA, 22 nt, Human
gaggccuugggaugugccacgg

SEQ ID NO: 758104 - RNA, 22 nt, Human
ccugguggaaggugagugaggc

SEQ ID NO: 758105 - RNA, 22 nt, Human
guucacagauccuugaagccag

SEQ ID NO: 758106 - RNA, 22 nt, Human
cccuguugggaagagagauggc

SEQ ID NO: 758107 - RNA, 20 nt, Human
ucacuguaauugccuacauu

SEQ ID NO: 758108 - RNA, 23 nt, Human
ucugugcucgggggagcucucug

SEQ ID NO: 758109 - RNA, 22 nt, Human
caauuagcugguacugacagga

SEQ ID NO: 758110 - RNA, 22 nt, Human
aaucccuacuagagcauaccgu

SEQ ID NO: 758111 - RNA, 22 nt, Human
cacagcaggcagaacgugggca

SEQ ID NO: 758112 - RNA, 22 nt, Human
cacaaaugacugaaacgacugu

SEQ ID NO: 758113 - RNA, 22 nt, Human
acuuacaagcuagggaagcuug

SEQ ID NO: 758114 - RNA, 22 nt, Human
agcuucaaagcuaggaagaucu

SEQ ID NO: 758115 - RNA, 22 nt, Human
cccuccaggcacugcccucuuc

SEQ ID NO: 758116 - RNA, 22 nt, Human
ucucaggaagugauauugagac

SEQ ID NO: 758117 - RNA, 22 nt, Human
uccagccccgaggccggcgacg

SEQ ID NO: 758118 - RNA, 22 nt, Human
ucugucagccccucagcuguca

SEQ ID NO: 758119 - RNA, 22 nt, Human
ucauaaaguuguuuuaauggga

SEQ ID NO: 758120 - RNA, 22 nt, Human
gaauuuccucuaaaccccugag

SEQ ID NO: 758121 - RNA, 22 nt, Human
ccuuccuggagcccaugcagau

SEQ ID NO: 758122 - RNA, 23 nt, Human
auuuuuagccucucugagcugag

SEQ ID NO: 758123 - RNA, 20 nt, Human
ucaagacagacauggaguuu

SEQ ID NO: 758124 - RNA, 22 nt, Human
ugcccaagauccuacauccuga

SEQ ID NO: 758125 - RNA, 22 nt, Human
caugacaguccugaagagaacg

SEQ ID NO: 758126 - RNA, 22 nt, Human
gcagugacagggcugcugccuu

SEQ ID NO: 758127 - RNA, 22 nt, Human
ccaggucucgggucugcucgug

SEQ ID NO: 758128 - RNA, 22 nt, Human
uaaucuguaauuuuugcaauag

SEQ ID NO: 758129 - RNA, 19 nt, Human
agucuguggauuugugggu

SEQ ID NO: 758130 - RNA, 22 nt, Human
cugcaggucucugugugcauuc

SEQ ID NO: 758131 - RNA, 22 nt, Human
ugucuuauggcauguccacugg

SEQ ID NO: 758132 - RNA, 22 nt, Human
agagccaggccaggccggggca

SEQ ID NO: 758133 - RNA, 18 nt, Human
ugaacuuuuccugcugcu

SEQ ID NO: 758134 - RNA, 22 nt, Human
guuuagaacacggaaauacuga

SEQ ID NO: 758135 - RNA, 22 nt, Human
gacuuuaaagguucugcugcuu

SEQ ID NO: 758136 - RNA, 22 nt, Human
uuugggaagugggagcaaggug

SEQ ID NO: 758137 - RNA, 22 nt, Human
auuauuuuaugugcggccugau

SEQ ID NO: 758138 - RNA, 22 nt, Human
uaaagagcacgcuuuucucucu

SEQ ID NO: 758139 - RNA, 22 nt, Human
auggccauagccuuauagcagg

SEQ ID NO: 758140 - RNA, 22 nt, Human
aaagaagcauaggcuagacuuc

SEQ ID NO: 758141 - RNA, 22 nt, Human
agucucuccacauuguuauaaa

SEQ ID NO: 758142 - RNA, 21 nt, Human
ccagggaagaaaugagggcag

SEQ ID NO: 758143 - RNA, 22 nt, Human
cagggcaguuugugccuaugag

SEQ ID NO: 758144 - RNA, 22 nt, Human
gaugugugcugcauaguauauu

SEQ ID NO: 758145 - RNA, 20 nt, Human
aggcacaguuccuaguuggg

SEQ ID NO: 758146 - RNA, 22 nt, Human
cacagggaacaacuagaacaaa

SEQ ID NO: 758147 - RNA, 22 nt, Human
ucucacagugagccugaggucg

SEQ ID NO: 758148 - RNA, 22 nt, Human
cuuucucuucgaaaaccugccc

SEQ ID NO: 758149 - RNA, 22 nt, Human
uagauucucccaucaugagaug

SEQ ID NO: 758150 - RNA, 22 nt, Human
uagcaucagccacaccuuguac

SEQ ID NO: 758151 - RNA, 22 nt, Human
caggcccauuuguagccacuuu

SEQ ID NO: 758152 - RNA, 22 nt, Human
agcaccuugcucuuggccuucc

SEQ ID NO: 758153 - RNA, 22 nt, Human
uaggcugagguugaugccaggg

SEQ ID NO: 758154 - RNA, 21 nt, Human
cacaccaggcaugucuugagc

SEQ ID NO: 758155 - RNA, 20 nt, Human
ucuuuagauuuaucuuaugu

SEQ ID NO: 758156 - RNA, 20 nt, Human
gcucuuuguaagggaauuug

SEQ ID NO: 758157 - RNA, 22 nt, Human
ucacuguaaaguaauacuguca

SEQ ID NO: 758158 - RNA, 22 nt, Human
uccagauagaguccuguuagua

SEQ ID NO: 758159 - RNA, 22 nt, Human
aagaggaagucuccauggagag

SEQ ID NO: 758160 - RNA, 22 nt, Human
gcuggcaggagccuuucccuuu

SEQ ID NO: 758161 - RNA, 21 nt, Human
ucuuugcaucaguuguuuucu

SEQ ID NO: 758162 - RNA, 22 nt, Human
ucaguuaacaacuauuuauuga

SEQ ID NO: 758163 - RNA, 22 nt, Human
auugauaaauugcaauggggcu

SEQ ID NO: 758164 - RNA, 17 nt, Human
acagggcagaaacagcu

SEQ ID NO: 758165 - RNA, 22 nt, Human
ugcuggcaguggcagugauggu

SEQ ID NO: 758166 - RNA, 22 nt, Human
uuccuaacaagggguauucauc

SEQ ID NO: 758167 - RNA, 22 nt, Human
ucaagcaaacucugagaaauaa

SEQ ID NO: 758168 - RNA, 22 nt, Human
cuuguauuaggaagaaugcuuu

SEQ ID NO: 758169 - RNA, 22 nt, Human
uucuggaaguggaauuuuugua

SEQ ID NO: 758170 - RNA, 22 nt, Human
ugcugcagcuaaggugaggugc

SEQ ID NO: 758171 - RNA, 22 nt, Human
cagagaugggucgcagagaugg

SEQ ID NO: 758172 - RNA, 22 nt, Human
ucccuucaauaauucaacauua

SEQ ID NO: 758173 - RNA, 22 nt, Human
caacugcugacaccaucacucc

SEQ ID NO: 758174 - RNA, 22 nt, Human
uggcauguauuuguggugaauu

SEQ ID NO: 758175 - RNA, 22 nt, Human
ccagcuguuucugaugcuaggc

SEQ ID NO: 758176 - RNA, 22 nt, Human
aacacaggccagccugugcagu

SEQ ID NO: 758177 - RNA, 22 nt, Human
uguuauucuaguggaucacguc

SEQ ID NO: 758178 - RNA, 22 nt, Human
ugauucuuuggagagcuauaua

SEQ ID NO: 758179 - RNA, 22 nt, Human
agagcuggugcauauucagaaa

SEQ ID NO: 758180 - RNA, 20 nt, Human
aaagagaagccucaccuugu

SEQ ID NO: 758181 - RNA, 22 nt, Human
ugguccaguuuagcauugagug

SEQ ID NO: 758182 - RNA, 22 nt, Human
gcugcagggggugggcgucucc

SEQ ID NO: 758183 - RNA, 22 nt, Human
uccucuuucucaacauuaguua

SEQ ID NO: 758184 - RNA, 22 nt, Human
uuuucuuggaguggcuguccuu

SEQ ID NO: 758185 - RNA, 22 nt, Human
gccugccuguuggcugaggugc

SEQ ID NO: 758186 - RNA, 22 nt, Human
uaccugagcccagugcagcaua

SEQ ID NO: 758187 - RNA, 19 nt, Human
ucaggaguuaguugugcuc

SEQ ID NO: 758188 - RNA, 22 nt, Human
uaucuucaauuuauucaaggag

SEQ ID NO: 758189 - RNA, 22 nt, Human
cugugguggcacagcgggcugg

SEQ ID NO: 758190 - RNA, 22 nt, Human
cugagguguuuaguaggggcgg

SEQ ID NO: 758191 - RNA, 22 nt, Human
agaaaauaauuucuuggcuggu

SEQ ID NO: 758192 - RNA, 15 nt, Human
ucccucagcuaaaga

SEQ ID NO: 758193 - RNA, 22 nt, Human
gagcucuguguggcuugggugg

SEQ ID NO: 758194 - RNA, 21 nt, Human
acauacauaccuuaccaccuu

SEQ ID NO: 758195 - RNA, 22 nt, Human
ugagggcaaaguggugcugagg

SEQ ID NO: 758196 - RNA, 22 nt, Human
accacuggcucaggagcuggga

SEQ ID NO: 758197 - RNA, 22 nt, Human
ggugggcgacugagagggguuu

SEQ ID NO: 758198 - RNA, 23 nt, Human
ggcaugcaauggacagagcugga

SEQ ID NO: 758199 - RNA, 22 nt, Human
aagauucuagaggaacuucuua

SEQ ID NO: 758200 - RNA, 22 nt, Human
acaaaugugucuaauugugccu

SEQ ID NO: 758201 - RNA, 20 nt, Human
aauuauauaacuccaacauu

SEQ ID NO: 758202 - RNA, 22 nt, Human
cagcuucuccggccuggugcgg

SEQ ID NO: 758203 - RNA, 22 nt, Human
uuuauucuugagagugagaaga

SEQ ID NO: 758204 - RNA, 22 nt, Human
ucaggagcugcacugggcccac

SEQ ID NO: 758205 - RNA, 22 nt, Human
gcggggggcaggcaguacguug

SEQ ID NO: 758206 - RNA, 22 nt, Human
gaguaggaauguucugccaucu

SEQ ID NO: 758207 - RNA, 22 nt, Human
uuauuauugauucgcucucaaa

SEQ ID NO: 758208 - RNA, 22 nt, Human
aacacugaagccguuaaaccuu

SEQ ID NO: 758209 - RNA, 22 nt, Human
ucaaacauaucugauuuuccau

SEQ ID NO: 758210 - RNA, 22 nt, Human
uuccacuggcuuucagugaucu

SEQ ID NO: 758211 - RNA, 23 nt, Human
agguuaugauuauagagcgagga

SEQ ID NO: 758212 - RNA, 22 nt, Human
gcucuccaggggcucccaggau

SEQ ID NO: 758213 - RNA, 22 nt, Human
caggauauuaccuaauauuuga

SEQ ID NO: 758214 - RNA, 22 nt, Human
ucaguuuucaauuucaucagag

SEQ ID NO: 758215 - RNA, 22 nt, Human
ggcccaaaccaaguaccucaaa

SEQ ID NO: 758216 - RNA, 22 nt, Human
ggggaagagcauugcacggugu

SEQ ID NO: 758217 - RNA, 22 nt, Human
ggcccagaauacuuuguaaaau

SEQ ID NO: 758218 - RNA, 22 nt, Human
accaggcaacugugaaugggcu

SEQ ID NO: 758219 - RNA, 22 nt, Human
uuucuagagugggcaugucuua

SEQ ID NO: 758220 - RNA, 22 nt, Human
gcaguguugguuugcucugcag

SEQ ID NO: 758221 - RNA, 22 nt, Human
acuccagguguguuggacucua

SEQ ID NO: 758222 - RNA, 22 nt, Human
cucucagggcagguggccuuuc

SEQ ID NO: 758223 - RNA, 22 nt, Human
cuaacauuuggaaggcuuauga

SEQ ID NO: 758224 - RNA, 22 nt, Human
uaguggcugcuucauuggugag

SEQ ID NO: 758225 - RNA, 18 nt, Human
ucauggcuugcagauggu

SEQ ID NO: 758226 - RNA, 22 nt, Human
ggccugugucugugccuguccu

SEQ ID NO: 758227 - RNA, 22 nt, Human
ucauucagagagaauguuccag

SEQ ID NO: 758228 - RNA, 22 nt, Human
aggcagugagcagggugucaug

SEQ ID NO: 758229 - RNA, 22 nt, Human
aaauuucaguuggaaugagcuc

SEQ ID NO: 758230 - RNA, 22 nt, Human
caacagcuuuagaaacacuuuc

SEQ ID NO: 758231 - RNA, 23 nt, Human
gccucugcagccuaguuaguguc

SEQ ID NO: 758232 - RNA, 22 nt, Human
acugaaggguaaugugggagcc

SEQ ID NO: 758233 - RNA, 22 nt, Human
ugcauguauuuaaaguugcaau

SEQ ID NO: 758234 - RNA, 22 nt, Human
agguuuucagcuguauccugag

SEQ ID NO: 758235 - RNA, 22 nt, Human
auguuuaaucggcugccuuucc

SEQ ID NO: 758236 - RNA, 18 nt, Human
acagacaaaauggaaaug

SEQ ID NO: 758237 - RNA, 22 nt, Human
uuggugaguauggacacagaga

SEQ ID NO: 758238 - RNA, 22 nt, Human
agaggcacuaagggaagagcag

SEQ ID NO: 758239 - RNA, 22 nt, Human
uuggcagcauuccagccaagca

SEQ ID NO: 758240 - RNA, 19 nt, Human
gcucugagaggggcauggg

SEQ ID NO: 758241 - RNA, 22 nt, Human
cuccugaggggacaggacucau

SEQ ID NO: 758242 - RNA, 22 nt, Human
uccacacacauuucuaugugca

SEQ ID NO: 758243 - RNA, 22 nt, Human
cugucuucuaccuucaaccucc

SEQ ID NO: 758244 - RNA, 22 nt, Human
uucugggguuaugggugauucu

SEQ ID NO: 758245 - RNA, 22 nt, Human
aggcuguguggauaauauuggg

SEQ ID NO: 758246 - RNA, 18 nt, Human
cagcucuucuccaguaac

SEQ ID NO: 758247 - RNA, 22 nt, Human
ugcaaacauccgacugaaagcc

SEQ ID NO: 758248 - RNA, 22 nt, Human
cugggcagugguggcccuuccc

SEQ ID NO: 758249 - RNA, 22 nt, Human
cagccugacuauggcugcaggu

SEQ ID NO: 758250 - RNA, 22 nt, Human
cugccugcugacauucuuuaua

SEQ ID NO: 758251 - RNA, 22 nt, Human
gaggaggcugaacaaugcccug

SEQ ID NO: 758252 - RNA, 22 nt, Human
cauaacauuauuuucugaagau

SEQ ID NO: 758253 - RNA, 22 nt, Human
uucuggaagcugggcagcaccc

SEQ ID NO: 758254 - RNA, 22 nt, Human
gcccugaaauauuuccacggcc

SEQ ID NO: 758255 - RNA, 17 nt, Human
uggucauuuuaauuuua

SEQ ID NO: 758256 - RNA, 22 nt, Human
cacacagguaagccucuuucaa

SEQ ID NO: 758257 - RNA, 22 nt, Human
cuuauucaaugcuggaaauguu

SEQ ID NO: 758258 - RNA, 22 nt, Human
gaauaacagcaaguuugcaggc

SEQ ID NO: 758259 - RNA, 17 nt, Human
ccaaggcuauuuguagu

SEQ ID NO: 758260 - RNA, 22 nt, Human
ggagaaagcuguaguggaaugu

SEQ ID NO: 758261 - RNA, 22 nt, Human
ccagcauuugcuucuggugggg

SEQ ID NO: 758262 - RNA, 22 nt, Human
gacauacaagcugguaccuccu

SEQ ID NO: 758263 - RNA, 22 nt, Human
ugauagaaaaugcugucaagcu

SEQ ID NO: 758264 - RNA, 22 nt, Human
ugugaauagucagcauuuuguu

SEQ ID NO: 758265 - RNA, 22 nt, Human
ugcacauugaaugagcaaacug

SEQ ID NO: 758266 - RNA, 22 nt, Human
ugaggcacuccaggaugcuguu

SEQ ID NO: 758267 - RNA, 22 nt, Human
cucaggaggugguagaggcccu

SEQ ID NO: 758268 - RNA, 22 nt, Human
gaaugauauauuagcagauuuu

SEQ ID NO: 758269 - RNA, 22 nt, Human
cagcagacuuacuagaauguaa

SEQ ID NO: 758270 - RNA, 22 nt, Human
cacagccugcugcacucaagaa

SEQ ID NO: 758271 - RNA, 22 nt, Human
guccugugccgaggugggaagc

SEQ ID NO: 758272 - RNA, 22 nt, Human
ucugucacugagcucaggauuc

SEQ ID NO: 758273 - RNA, 22 nt, Human
uauccauauuaagaugccucug

SEQ ID NO: 758274 - RNA, 22 nt, Human
agagccagagaccuggguucac

SEQ ID NO: 758275 - RNA, 22 nt, Human
uggcacaggcgguaagggugug

SEQ ID NO: 758276 - RNA, 22 nt, Human
caaguccuuagaugguucuuug

SEQ ID NO: 758277 - RNA, 23 nt, Human
uucuggaagauuuacuugagaca

SEQ ID NO: 758278 - RNA, 22 nt, Human
ugggggcuccaggcuccaggga

SEQ ID NO: 758279 - RNA, 22 nt, Human
ucuugggcauguguuugauuuc

SEQ ID NO: 758280 - RNA, 22 nt, Human
cauugcacugcagcccgggcaa

SEQ ID NO: 758281 - RNA, 22 nt, Human
cccucucagucagagccagaua

SEQ ID NO: 758282 - RNA, 22 nt, Human
caagguuuacuuuaugauccag

SEQ ID NO: 758283 - RNA, 22 nt, Human
ugaagacacauacaagggaaug

SEQ ID NO: 758284 - RNA, 22 nt, Human
gccacaugucaugugcucagua

SEQ ID NO: 758285 - RNA, 22 nt, Human
cuucugugaaugaaguguggga

SEQ ID NO: 758286 - RNA, 22 nt, Human
cagcuccuagaucggcgaagug

SEQ ID NO: 758287 - RNA, 22 nt, Human
ccaggaaguaugacccaacaga

SEQ ID NO: 758288 - RNA, 22 nt, Human
uugcucuguccagccagcaggu

SEQ ID NO: 758289 - RNA, 22 nt, Human
cagcuucagcgugacaccagug

SEQ ID NO: 758290 - RNA, 22 nt, Human
caggcucuuccauccugcugag

SEQ ID NO: 758291 - RNA, 22 nt, Human
aaguuuaguauuagggaaaagu

SEQ ID NO: 758292 - RNA, 22 nt, Human
ugccugccugcauagucccacg

SEQ ID NO: 758293 - RNA, 22 nt, Human
cuggugaucuugggcaagucac

SEQ ID NO: 758294 - RNA, 22 nt, Human
aggccugucccagcugaggacg

SEQ ID NO: 758295 - RNA, 22 nt, Human
uuaagagaagaguaucuagaac

SEQ ID NO: 758296 - RNA, 22 nt, Human
agccaagcacucaacuccugga

SEQ ID NO: 758297 - RNA, 23 nt, Human
ucaguuuuggcuguucaguguug

SEQ ID NO: 758298 - RNA, 22 nt, Human
uggcagcuccggguaggggcug

SEQ ID NO: 758299 - RNA, 22 nt, Human
auuucaggauagccuaguuuug

SEQ ID NO: 758300 - RNA, 22 nt, Human
auucucucuucugcugcccgug

SEQ ID NO: 758301 - RNA, 22 nt, Human
uccugagcccuguaggacccug

SEQ ID NO: 758302 - RNA, 22 nt, Human
uugaaagacuucuccugugaaa

SEQ ID NO: 758303 - RNA, 22 nt, Human
ggucugaguggugcugacucag

SEQ ID NO: 758304 - RNA, 22 nt, Human
uaacagcacuggcaggcacugu

SEQ ID NO: 758305 - RNA, 22 nt, Human
uuagaaagaauagccuggcugc

SEQ ID NO: 758306 - RNA, 22 nt, Human
ggagccuguggcugcuugaagc

SEQ ID NO: 758307 - RNA, 22 nt, Human
uuuacaguccccaggugaggau

SEQ ID NO: 758308 - RNA, 22 nt, Human
uuuacuacuugugauaacugaa

SEQ ID NO: 758309 - RNA, 22 nt, Human
gcagaugggagccccaggggag

SEQ ID NO: 758310 - RNA, 22 nt, Human
ugaaaugauguacaagaaggca

SEQ ID NO: 758311 - RNA, 22 nt, Human
auggacaguacugaguggacua

SEQ ID NO: 758312 - RNA, 22 nt, Human
agcagcaggcugggaugagucu

SEQ ID NO: 758313 - RNA, 22 nt, Human
acacuucaaagggugacuugau

SEQ ID NO: 758314 - RNA, 20 nt, Human
ugguccaggaccuggugucc

SEQ ID NO: 758315 - RNA, 22 nt, Human
gaguccuuuguuccuugccaca

SEQ ID NO: 758316 - RNA, 22 nt, Human
uucuaagagaguacaagcaauu

SEQ ID NO: 758317 - RNA, 22 nt, Human
gugaggcagcaggagccucugu

SEQ ID NO: 758318 - RNA, 22 nt, Human
ucugcuguuuacugugugauau

SEQ ID NO: 758319 - RNA, 22 nt, Human
augaggcacguguuacuggccu

SEQ ID NO: 758320 - RNA, 18 nt, Human
gguggcucagucaugggg

SEQ ID NO: 758321 - RNA, 22 nt, Human
cugagaggggaccaggguguuu

SEQ ID NO: 758322 - RNA, 22 nt, Human
ucugccuggcggacucccggaa

SEQ ID NO: 758323 - RNA, 22 nt, Human
gggccagccuacugcuagaccc

SEQ ID NO: 758324 - RNA, 22 nt, Human
accagcuggucaguugaagauu

SEQ ID NO: 758325 - RNA, 22 nt, Human
aggauggcuugcaggaggcugu

SEQ ID NO: 758326 - RNA, 22 nt, Human
auuuguacaaauuuauguuagu

SEQ ID NO: 758327 - RNA, 23 nt, Human
auaacugagccgaggcuuaagaa

SEQ ID NO: 758328 - RNA, 22 nt, Human
acuaaauagccucugguaguug

SEQ ID NO: 758329 - RNA, 22 nt, Human
guuauguaugagggaaugauua

SEQ ID NO: 758330 - RNA, 22 nt, Human
caacugaacugauaucaacuau

SEQ ID NO: 758331 - RNA, 17 nt, Human
acucaggaucugggagu

SEQ ID NO: 758332 - RNA, 20 nt, Human
ugucauuguuucuaggaccu

SEQ ID NO: 758333 - RNA, 22 nt, Human
caugcaaagcguuuugaccagc

SEQ ID NO: 758334 - RNA, 22 nt, Human
aagcagaguuagcuugucaccu

SEQ ID NO: 758335 - RNA, 22 nt, Human
aauagcagaagacuaguagaca

SEQ ID NO: 758336 - RNA, 22 nt, Human
aacguuuuaucgugugcucuuc

SEQ ID NO: 758337 - RNA, 22 nt, Human
gcaggaguuagagguuuaaucu

SEQ ID NO: 758338 - RNA, 22 nt, Human
cagggcaguaacgggaacaucu

SEQ ID NO: 758339 - RNA, 22 nt, Human
augcacaugaggcaagcaaaau

SEQ ID NO: 758340 - RNA, 18 nt, Human
guggccagccuggucuug

SEQ ID NO: 758341 - RNA, 22 nt, Human
uauaaagugugaacugugagua

SEQ ID NO: 758342 - RNA, 22 nt, Human
cccagcagaaucugaugagggc

SEQ ID NO: 758343 - RNA, 22 nt, Human
gaggagaggccaucguuguuau

SEQ ID NO: 758344 - RNA, 22 nt, Human
ccuuccagaggcgugacacccu

SEQ ID NO: 758345 - RNA, 22 nt, Human
ugcagggaggccccgcagcccu

SEQ ID NO: 758346 - RNA, 22 nt, Human
ucaguguuggagauaauugcac

SEQ ID NO: 758347 - RNA, 22 nt, Human
uucuggaagccaugggaacagg

SEQ ID NO: 758348 - RNA, 22 nt, Human
gcugccugcucggcuccuggga

SEQ ID NO: 758349 - RNA, 22 nt, Human
ugcugcaggccuuggcugggaa

SEQ ID NO: 758350 - RNA, 21 nt, Human
cucagacagggaggcucuggg

SEQ ID NO: 758351 - RNA, 22 nt, Human
aaaaguaauugaugcaaucgua

SEQ ID NO: 758352 - RNA, 22 nt, Human
uacaguaagaugaaauagcaau

SEQ ID NO: 758353 - RNA, 22 nt, Human
uggcucucagcucccagcagcc

SEQ ID NO: 758354 - RNA, 22 nt, Human
ugaauacaggaaaauauacuga

SEQ ID NO: 758355 - RNA, 21 nt, Human
gcucaugguggagaaaagcag

SEQ ID NO: 758356 - RNA, 22 nt, Human
agugccaggagcaaggagcucc

SEQ ID NO: 758357 - RNA, 22 nt, Human
ucacugcucgauaacaugauua

SEQ ID NO: 758358 - RNA, 22 nt, Human
gcacaauggaccgugugcucug

SEQ ID NO: 758359 - RNA, 22 nt, Human
ccagagcugaugggcccagggu

SEQ ID NO: 758360 - RNA, 22 nt, Human
cagacaggaauucuggcguggu

SEQ ID NO: 758361 - RNA, 22 nt, Human
aaauagcugaaaguuccuagau

SEQ ID NO: 758362 - RNA, 22 nt, Human
cauguaaaacacucagaacagu

SEQ ID NO: 758363 - RNA, 22 nt, Human
uuuuuggguccaggcuguaucu

SEQ ID NO: 758364 - RNA, 22 nt, Human
ugcagcuguuacggacccuguc

SEQ ID NO: 758365 - RNA, 18 nt, Human
gcaggugccacugcuguu

SEQ ID NO: 758366 - RNA, 23 nt, Human
aaugauuucaugaugauagcagc

SEQ ID NO: 758367 - RNA, 18 nt, Human
aagccaggucaagauaag

SEQ ID NO: 758368 - RNA, 19 nt, Human
agcagccaucgaccaugga

SEQ ID NO: 758369 - RNA, 19 nt, Human
uccugggcguugacuuugg

SEQ ID NO: 758370 - RNA, 22 nt, Human
gaaugauaaauggaagcagcau

SEQ ID NO: 758371 - RNA, 22 nt, Human
cacugaaaauuagcuuuccuga

SEQ ID NO: 758372 - RNA, 22 nt, Human
cugaggaaggaguuaggcaguu

SEQ ID NO: 758373 - RNA, 22 nt, Human
auugguggugaggacaugccag

SEQ ID NO: 758374 - RNA, 22 nt, Human
gagcugaggccagagucuucug

SEQ ID NO: 758375 - RNA, 22 nt, Human
ggguggaagccagagaggucau

SEQ ID NO: 758376 - RNA, 23 nt, Human
uuuauucucagauacauaggucu

SEQ ID NO: 758377 - RNA, 21 nt, Human
ugucugccugcuucuucacuc

SEQ ID NO: 758378 - RNA, 22 nt, Human
gugggcaggcccuaggcgauuu

SEQ ID NO: 758379 - RNA, 22 nt, Human
cucuaauacugaccaagucacc

SEQ ID NO: 758380 - RNA, 22 nt, Human
guucaaauugauuuugguaaag

SEQ ID NO: 758381 - RNA, 22 nt, Human
gagggcgcuucagagagaugaa

SEQ ID NO: 758382 - RNA, 22 nt, Human
gcagccugaugaucuggguugu

SEQ ID NO: 758383 - RNA, 22 nt, Human
gcugcagcuguaggacacaauu

SEQ ID NO: 758384 - RNA, 22 nt, Human
gagggaagaaagaauugaugcg

SEQ ID NO: 758385 - RNA, 22 nt, Human
aagaguuugggcaagucauaaa

SEQ ID NO: 758386 - RNA, 22 nt, Human
cuggggaggcagggcugccccu

SEQ ID NO: 758387 - RNA, 17 nt, Human
agaguuuuaagaaauuu

SEQ ID NO: 758388 - RNA, 22 nt, Human
uguggcagacaagauucuaugu

SEQ ID NO: 758389 - RNA, 22 nt, Human
uuuagcagcugguguuaccaua

SEQ ID NO: 758390 - RNA, 20 nt, Human
cacaggccccaagaccugua

SEQ ID NO: 758391 - RNA, 22 nt, Human
uucuccugcgcaggcccaggga

SEQ ID NO: 758392 - RNA, 22 nt, Human
ggcucucuggaggagcucaccc

SEQ ID NO: 758393 - RNA, 18 nt, Human
agguggccugggagcuuu

SEQ ID NO: 758394 - RNA, 22 nt, Human
uuucugauauucauuuagaaga

SEQ ID NO: 758395 - RNA, 21 nt, Human
uagcuuuaauauucccacauu

SEQ ID NO: 758396 - RNA, 21 nt, Human
agcaccaguuuuaugccaggc

SEQ ID NO: 758397 - RNA, 22 nt, Human
uugggcccugcucugaguugcu

SEQ ID NO: 758398 - RNA, 22 nt, Human
caguauuugguaauuggcuacc

SEQ ID NO: 758399 - RNA, 22 nt, Human
auacuacacuaugcauggaugu

SEQ ID NO: 758400 - RNA, 22 nt, Human
ccccaccagcacccucucuauc

SEQ ID NO: 758401 - RNA, 22 nt, Human
cugccuggugcggugcccaccc

SEQ ID NO: 758402 - RNA, 21 nt, Human
acaugucuggucauuuuuagc

SEQ ID NO: 758403 - RNA, 22 nt, Human
cugugauuguuaguuccuauac

SEQ ID NO: 758404 - RNA, 22 nt, Human
caauauagagagaaaauuaugu

SEQ ID NO: 758405 - RNA, 20 nt, Human
uaaagcagccguggagggua

SEQ ID NO: 758406 - RNA, 22 nt, Human
cucagguagagucugcaugggg

SEQ ID NO: 758407 - RNA, 22 nt, Human
uuagaacugaagaagauuaagg

SEQ ID NO: 758408 - RNA, 22 nt, Human
agcaggcugcuggcguugaagu

SEQ ID NO: 758409 - RNA, 22 nt, Human
aaauuguauauuccauuuguau

SEQ ID NO: 758410 - RNA, 22 nt, Human
ucagcagugcagggugaggcag

SEQ ID NO: 758411 - RNA, 22 nt, Human
uuagaaccaccuggagagcuuu

SEQ ID NO: 758412 - RNA, 22 nt, Human
auucaguuacucuagacacuuc

SEQ ID NO: 758413 - RNA, 22 nt, Human
aucuggaacaaagcuuaggaau

SEQ ID NO: 758414 - RNA, 22 nt, Human
cucccuuccaaugacuaugcuu

SEQ ID NO: 758415 - RNA, 22 nt, Human
uuauuuauuguguaccuacugu

SEQ ID NO: 758416 - RNA, 17 nt, Human
aguuaaggcucuuugcu

SEQ ID NO: 758417 - RNA, 22 nt, Human
agggaaauuaaugugagcaaug

SEQ ID NO: 758418 - RNA, 22 nt, Human
uauuuucaucuuguccuuggau

SEQ ID NO: 758419 - RNA, 22 nt, Human
agcaggcuccaggcuggccauc

SEQ ID NO: 758420 - RNA, 22 nt, Human
uaaaugauuuauguaugugaaa

SEQ ID NO: 758421 - RNA, 22 nt, Human
gaaacccaaacuaagacaguag

SEQ ID NO: 758422 - RNA, 22 nt, Human
gagcugucucuauaugaaugcu

SEQ ID NO: 758423 - RNA, 20 nt, Human
ugagggaguauugauuuccc

SEQ ID NO: 758424 - RNA, 22 nt, Human
uuggauuacaugaaaugcagaa

SEQ ID NO: 758425 - RNA, 22 nt, Human
cccucuggcucuucucaggccg

SEQ ID NO: 758426 - RNA, 22 nt, Human
ugaggcuuggaggcuccagugg

SEQ ID NO: 758427 - RNA, 22 nt, Human
uggcaggcugaguuggccuggu

SEQ ID NO: 758428 - RNA, 22 nt, Human
accgugucugacacuuugggcg

SEQ ID NO: 758429 - RNA, 22 nt, Human
uucuccuuuguaauucucaucc

SEQ ID NO: 758430 - RNA, 22 nt, Human
ugguccuuuaagucuuucucug

SEQ ID NO: 758431 - RNA, 22 nt, Human
uucaauuuugcagaggaaugca

SEQ ID NO: 758432 - RNA, 22 nt, Human
gucaucuuaucauuguugcugu

SEQ ID NO: 758433 - RNA, 22 nt, Human
cuccaccccgugccggugcugg

SEQ ID NO: 758434 - RNA, 22 nt, Human
aauagguagccagauauauaaa

SEQ ID NO: 758435 - RNA, 22 nt, Human
uaauugcuccaaggagaacuaa

SEQ ID NO: 758436 - RNA, 22 nt, Human
gcugagcuagcuaucucagucu

SEQ ID NO: 758437 - RNA, 22 nt, Human
uugccagggcuuugguggcauc

SEQ ID NO: 758438 - RNA, 22 nt, Human
cugggcacuugcucacagcucu

SEQ ID NO: 758439 - RNA, 22 nt, Human
acauuguagacuuuucauaugu

SEQ ID NO: 758440 - RNA, 22 nt, Human
uugagaagaaauaguuugcaau

SEQ ID NO: 758441 - RNA, 22 nt, Human
ucuccuggaagaauaccacacu

SEQ ID NO: 758442 - RNA, 22 nt, Human
uuuguacacaggucauucaggg

SEQ ID NO: 758443 - RNA, 22 nt, Human
uguguauuaauguuuguauaug

SEQ ID NO: 758444 - RNA, 22 nt, Human
cuaugcaucugaacaauagaga

SEQ ID NO: 758445 - RNA, 22 nt, Human
acaggcuguugggguccagggu

SEQ ID NO: 758446 - RNA, 22 nt, Human
ugcauauucuccuuuauuuugu

SEQ ID NO: 758447 - RNA, 22 nt, Human
gugcagggcuggcaccggaggc

SEQ ID NO: 758448 - RNA, 22 nt, Human
caaauuacccucaacaucuaga

SEQ ID NO: 758449 - RNA, 22 nt, Human
gguggcucucuuaagggcagcg

SEQ ID NO: 758450 - RNA, 22 nt, Human
uuagccauuuuauacaagugua

SEQ ID NO: 758451 - RNA, 22 nt, Human
ucaaagauagauguugagaaau

SEQ ID NO: 758452 - RNA, 22 nt, Human
ugggugugaagucuguuggccu

SEQ ID NO: 758453 - RNA, 22 nt, Human
uguguuggcugccggcacagga

SEQ ID NO: 758454 - RNA, 22 nt, Human
auuugucaguggaagugauuca

SEQ ID NO: 758455 - RNA, 22 nt, Human
uccuggucuacacugcauuggg

SEQ ID NO: 758456 - RNA, 22 nt, Human
augggaaguguuagaagauuuu

SEQ ID NO: 758457 - RNA, 22 nt, Human
agccagagggaaucuuugggga

SEQ ID NO: 758458 - RNA, 18 nt, Human
aauugcauuuguuuccuu

SEQ ID NO: 758459 - RNA, 22 nt, Human
agugucuggaggcauucuuggu

SEQ ID NO: 758460 - RNA, 18 nt, Human
acacuuccugguggugug

SEQ ID NO: 758461 - RNA, 22 nt, Human
acucuuggccacucuugguguc

SEQ ID NO: 758462 - RNA, 22 nt, Human
uuucuaaucugauucuccuacc

SEQ ID NO: 758463 - RNA, 19 nt, Human
agacacuggauggaaaaug

SEQ ID NO: 758464 - RNA, 22 nt, Human
acuggcagcagcagcccuuggg

SEQ ID NO: 758465 - RNA, 22 nt, Human
cucucuuucugaaugaggacua

SEQ ID NO: 758466 - RNA, 22 nt, Human
ccugaggcucgcgcgccccugg

SEQ ID NO: 758467 - RNA, 22 nt, Human
gagcucugguucaugaucuauu

SEQ ID NO: 758468 - RNA, 22 nt, Human
uuuaaacaucuuguugccuuaa

SEQ ID NO: 758469 - RNA, 22 nt, Human
cccagugugguucuuuggagaa

SEQ ID NO: 758470 - RNA, 22 nt, Human
caaaagcaaagucccugaaugu

SEQ ID NO: 758471 - RNA, 22 nt, Human
ucucucacuggugccucuguug

SEQ ID NO: 758472 - RNA, 22 nt, Human
ccagcucugccaagcgucagcu

SEQ ID NO: 758473 - RNA, 22 nt, Human
gucuucuggaagagagccagcu

SEQ ID NO: 758474 - RNA, 22 nt, Human
aagcagcauuguaaccaaugcc

SEQ ID NO: 758475 - RNA, 23 nt, Human
uugaggcaaacauguaaguagga

SEQ ID NO: 758476 - RNA, 22 nt, Human
aggcaggcacuccggaaguguc

SEQ ID NO: 758477 - RNA, 22 nt, Human
gaaggcaagaucucaguggagg

SEQ ID NO: 758478 - RNA, 20 nt, Human
acagauauuugauuuucagu

SEQ ID NO: 758479 - RNA, 22 nt, Human
ugagucacacauuucuucauac

SEQ ID NO: 758480 - RNA, 22 nt, Human
aucucugcuagccuucuucagg

SEQ ID NO: 758481 - RNA, 22 nt, Human
uacauauacugagugauuugcu

SEQ ID NO: 758482 - RNA, 22 nt, Human
cuguuucaagugaagucagaca

SEQ ID NO: 758483 - RNA, 22 nt, Human
ucuaggagcuuaaaggaggcca

SEQ ID NO: 758484 - RNA, 22 nt, Human
ggguggagcuuggacaccagua

SEQ ID NO: 758485 - RNA, 22 nt, Human
aaauguacaacauccauauaua

SEQ ID NO: 758486 - RNA, 22 nt, Human
gggcaggagagggccaccugga

SEQ ID NO: 758487 - RNA, 22 nt, Human
auguguauauuuggugucaaua

SEQ ID NO: 758488 - RNA, 22 nt, Human
agggaucagcagaggguguggu

SEQ ID NO: 758489 - RNA, 22 nt, Human
gguuccagaguauuucauuuca

SEQ ID NO: 758490 - RNA, 22 nt, Human
uccagccaugcaugacaaucac

SEQ ID NO: 758491 - RNA, 22 nt, Human
uagcaucuccuuaggguaagga

SEQ ID NO: 758492 - RNA, 22 nt, Human
uccuggauuuagaagagccucc

SEQ ID NO: 758493 - RNA, 22 nt, Human
aaaaacugguaacuauucccca

SEQ ID NO: 758494 - RNA, 23 nt, Human
ggaaagagaggaguugugcauag

SEQ ID NO: 758495 - RNA, 23 nt, Human
aggcuucauccauauuuauugcc

SEQ ID NO: 758496 - RNA, 22 nt, Human
cuccagcucuuaacugcggaag

SEQ ID NO: 758497 - RNA, 22 nt, Human
cagcugcaguucaaugcuugcu

SEQ ID NO: 758498 - RNA, 22 nt, Human
gcugggcaacggaagagagaaa

SEQ ID NO: 758499 - RNA, 22 nt, Human
caggugggcuugggagaacacu

SEQ ID NO: 758500 - RNA, 22 nt, Human
caucaucucucccccaggccug

SEQ ID NO: 758501 - RNA, 22 nt, Human
ggugcauguagccaucaagaua

SEQ ID NO: 758502 - RNA, 22 nt, Human
gguggcaggcuggcauuggcaa

SEQ ID NO: 758503 - RNA, 22 nt, Human
ggcugccuucauagaccauggg

SEQ ID NO: 758504 - RNA, 22 nt, Human
uagcuaauggugaagauucaga

SEQ ID NO: 758505 - RNA, 19 nt, Human
cuccucagucccagagguc

SEQ ID NO: 758506 - RNA, 22 nt, Human
aauuccaggguuagcucauuug

SEQ ID NO: 758507 - RNA, 22 nt, Human
auuaacaugaguuggagauagg

SEQ ID NO: 758508 - RNA, 22 nt, Human
agucugaguuaguggaaaugua

SEQ ID NO: 758509 - RNA, 22 nt, Human
aagccaggaauggagucuucgc

SEQ ID NO: 758510 - RNA, 22 nt, Human
ccuggccuuaagggcagggagc

SEQ ID NO: 758511 - RNA, 22 nt, Human
caaagaguuuuuucauauaaug

SEQ ID NO: 758512 - RNA, 22 nt, Human
aaucuguuugaugcuugugaua

SEQ ID NO: 758513 - RNA, 22 nt, Human
aaucuucagugucuaaaaagca

SEQ ID NO: 758514 - RNA, 22 nt, Human
ccagccucacuggcaucaccua

SEQ ID NO: 758515 - RNA, 21 nt, Human
cuuggcugcagugacaggcau

SEQ ID NO: 758516 - RNA, 16 nt, Human
gcagaggaaaggggag

SEQ ID NO: 758517 - RNA, 22 nt, Human
ucucugggagcaauuguuugcu

SEQ ID NO: 758518 - RNA, 18 nt, Human
gugucuuauuacaguggg

SEQ ID NO: 758519 - RNA, 22 nt, Human
uacaaacucuuuauauuucaua

SEQ ID NO: 758520 - RNA, 22 nt, Human
aaugcuuaauucaauacugugu

SEQ ID NO: 758521 - RNA, 22 nt, Human
gugauaaaauucaaauagcucu

SEQ ID NO: 758522 - RNA, 22 nt, Human
uuuuaagcaaaagaauggugug

SEQ ID NO: 758523 - RNA, 21 nt, Human
agcaccuuacagcuauaaugg

SEQ ID NO: 758524 - RNA, 22 nt, Human
gaggcagcucuucugaaugggg

SEQ ID NO: 758525 - RNA, 22 nt, Human
acugaaaguccagcaugguaca

SEQ ID NO: 758526 - RNA, 22 nt, Human
ucacugcucagucuguacuaca

SEQ ID NO: 758527 - RNA, 22 nt, Human
aggaagacaaucugugugcugu

SEQ ID NO: 758528 - RNA, 22 nt, Human
acaguggagcucagaugaaaau

SEQ ID NO: 758529 - RNA, 22 nt, Human
gaggaacagagacgggaucgcu

SEQ ID NO: 758530 - RNA, 22 nt, Human
uugaauaguguuuucaguauac

SEQ ID NO: 758531 - RNA, 22 nt, Human
ucuccccaaccauggcacucac

SEQ ID NO: 758532 - RNA, 22 nt, Human
gguaugaauucacuacuuccaa

SEQ ID NO: 758533 - RNA, 22 nt, Human
acuggggccuccuccaugcucu

SEQ ID NO: 758534 - RNA, 22 nt, Human
caguucuggaggcuccacaucu

SEQ ID NO: 758535 - RNA, 22 nt, Human
acacugacugggcaguauaguc

SEQ ID NO: 758536 - RNA, 22 nt, Human
acauuucucagggaguuuugcu

SEQ ID NO: 758537 - RNA, 22 nt, Human
cauuuguucugauuucaaaagg

SEQ ID NO: 758538 - RNA, 22 nt, Human
uuauguauggauggcugaaagu

SEQ ID NO: 758539 - RNA, 21 nt, Human
ucaagacagcauauuuaagaa

SEQ ID NO: 758540 - RNA, 22 nt, Human
cuugcagcauccgguccucucu

SEQ ID NO: 758541 - RNA, 22 nt, Human
uccuuuaaagaacugugcuuuu

SEQ ID NO: 758542 - RNA, 22 nt, Human
agcuggcauacuuugcuaggaa

SEQ ID NO: 758543 - RNA, 22 nt, Human
auguguuaaugagcaaugaccu

SEQ ID NO: 758544 - RNA, 22 nt, Human
agaauucuguucuucgggugug

SEQ ID NO: 758545 - RNA, 21 nt, Human
agcagcagggaagccucaucc

SEQ ID NO: 758546 - RNA, 22 nt, Human
auuaagugacuaaaguaaugcu

SEQ ID NO: 758547 - RNA, 22 nt, Human
aggcuccaugcaaaggcuguuu

SEQ ID NO: 758548 - RNA, 22 nt, Human
cagcuuggcgaauguagguaug

SEQ ID NO: 758549 - RNA, 22 nt, Human
uucaagaucgaguuuaaaguga

SEQ ID NO: 758550 - RNA, 22 nt, Human
ggggcagagaauaaaaaccuaa

SEQ ID NO: 758551 - RNA, 22 nt, Human
uuugggaagaggaaucucugga

SEQ ID NO: 758552 - RNA, 22 nt, Human
ugcuuucaaugaauuguauacu

SEQ ID NO: 758553 - RNA, 22 nt, Human
guuuggcucugggugccugugc

SEQ ID NO: 758554 - RNA, 22 nt, Human
aaggaaagacaggacggaauuc

SEQ ID NO: 758555 - RNA, 22 nt, Human
ucauuuuuugcauaccuguguc

SEQ ID NO: 758556 - RNA, 22 nt, Human
uacaggaagucucaguacagua

SEQ ID NO: 758557 - RNA, 22 nt, Human
uuacaguagauuuugaaugugg

SEQ ID NO: 758558 - RNA, 22 nt, Human
uggguacuccuauuaguucagu

SEQ ID NO: 758559 - RNA, 22 nt, Human
uguguccuuuggaggaucagcg

SEQ ID NO: 758560 - RNA, 22 nt, Human
auuugcaagcaugcacaaaagc

SEQ ID NO: 758561 - RNA, 22 nt, Human
augaggcauagcagggaucgga

SEQ ID NO: 758562 - RNA, 22 nt, Human
gcagcugcuguggcaucaagcu

SEQ ID NO: 758563 - RNA, 22 nt, Human
guggccuugggcacugaccuug

SEQ ID NO: 758564 - RNA, 18 nt, Human
ucacagugcucuugccua

SEQ ID NO: 758565 - RNA, 22 nt, Human
cagacagagucuucccaucagu

SEQ ID NO: 758566 - RNA, 22 nt, Human
aggaaggacugcagcauuuggu

SEQ ID NO: 758567 - RNA, 22 nt, Human
uaggcuccugaggacuccaugc

SEQ ID NO: 758568 - RNA, 22 nt, Human
cauccaaacucucauuaucugu

SEQ ID NO: 758569 - RNA, 22 nt, Human
gcuggagcgugauccuugaucu

SEQ ID NO: 758570 - RNA, 22 nt, Human
agccaccucuaucuugggcucc

SEQ ID NO: 758571 - RNA, 22 nt, Human
gcacaaggagcaguguaugaaa

SEQ ID NO: 758572 - RNA, 22 nt, Human
aacaguguuuugcucuuugccc

SEQ ID NO: 758573 - RNA, 22 nt, Human
gcucagguguuaccuccucuag

SEQ ID NO: 758574 - RNA, 22 nt, Human
gcaggcucguuggaaguccccu

SEQ ID NO: 758575 - RNA, 22 nt, Human
cagcccugcugccuuagugccu

SEQ ID NO: 758576 - RNA, 22 nt, Human
cacuauaucucuuucaucuuuu

SEQ ID NO: 758577 - RNA, 22 nt, Human
acuuguuucaacuguacucucc

SEQ ID NO: 758578 - RNA, 21 nt, Human
uuguagcuuguuagaccaugu

SEQ ID NO: 758579 - RNA, 22 nt, Human
cagguggcuaacggccucauag

SEQ ID NO: 758580 - RNA, 22 nt, Human
ggcaucuucaaaauugccaaau

SEQ ID NO: 758581 - RNA, 22 nt, Human
cucuccagggaagcaguguacu

SEQ ID NO: 758582 - RNA, 22 nt, Human
agggagaggagggucuuguuga

SEQ ID NO: 758583 - RNA, 23 nt, Human
agugcucccaggaccuggggcag

SEQ ID NO: 758584 - RNA, 20 nt, Human
uuuauagugaucaauuuaua

SEQ ID NO: 758585 - RNA, 22 nt, Human
gguggcagcgucuaucugacau

SEQ ID NO: 758586 - RNA, 22 nt, Human
uggccugggccggcagauauac

SEQ ID NO: 758587 - RNA, 22 nt, Human
ccugagggaaggaugcuaccca

SEQ ID NO: 758588 - RNA, 22 nt, Human
ucucucuacuggggcacuagga

SEQ ID NO: 758589 - RNA, 22 nt, Human
ucuuccaggcccugccacagcu

SEQ ID NO: 758590 - RNA, 22 nt, Human
cugcuuuggacaacuauucuug

SEQ ID NO: 758591 - RNA, 22 nt, Human
cagugacagcaagcagugcugg

SEQ ID NO: 758592 - RNA, 22 nt, Human
gcugcugucuggucugagggcu

SEQ ID NO: 758593 - RNA, 22 nt, Human
cugagaaauucuuucuuucacu

SEQ ID NO: 758594 - RNA, 23 nt, Human
uuggagagggugaguagugucag

SEQ ID NO: 758595 - RNA, 22 nt, Human
uucuugaaucacuuuagagaua

SEQ ID NO: 758596 - RNA, 22 nt, Human
gcaaagcaaucaggaguagcau

SEQ ID NO: 758597 - RNA, 22 nt, Human
ucuuccagaugcagaugcuucu

SEQ ID NO: 758598 - RNA, 22 nt, Human
uugaauguaggucuuggugagc

SEQ ID NO: 758599 - RNA, 19 nt, Human
uauauauuuugggguugug

SEQ ID NO: 758600 - RNA, 22 nt, Human
augcaagucuuaauaguuuagg

SEQ ID NO: 758601 - RNA, 22 nt, Human
uguggcugcaaaggaaggcugc

SEQ ID NO: 758602 - RNA, 22 nt, Human
ucuugcaggcaugaaaggacuc

SEQ ID NO: 758603 - RNA, 22 nt, Human
agggaagggcagggucuaugca

SEQ ID NO: 758604 - RNA, 22 nt, Human
uagccgggugugguggaacucc

SEQ ID NO: 758605 - RNA, 22 nt, Human
ucauugaggaaagguaguggcu

SEQ ID NO: 758606 - RNA, 22 nt, Human
uaacuuugagaacuuucuggug

SEQ ID NO: 758607 - RNA, 22 nt, Human
augaagcagaauuucccacucu

SEQ ID NO: 758608 - RNA, 22 nt, Human
gagaaagauguaggcugggagg

SEQ ID NO: 758609 - RNA, 22 nt, Human
ccagagaaagcucacaggcagu

SEQ ID NO: 758610 - RNA, 22 nt, Human
gcugcaacuguugcucucugca

SEQ ID NO: 758611 - RNA, 22 nt, Human
ccagggcuuugccaaaguccag

SEQ ID NO: 758612 - RNA, 22 nt, Human
uauucagaaaacugagcgauga

SEQ ID NO: 758613 - RNA, 22 nt, Human
ucucuguucauggcacuauguc

SEQ ID NO: 758614 - RNA, 22 nt, Human
ucucuguaagcugccuucucgu

SEQ ID NO: 758615 - RNA, 22 nt, Human
agaggucagcugcaugccacau

SEQ ID NO: 758616 - RNA, 22 nt, Human
ccuggaaacacaugaugaugaa

SEQ ID NO: 758617 - RNA, 18 nt, Human
cuccccuguuuucccugc

SEQ ID NO: 758618 - RNA, 21 nt, Human
ccuggacugggagcagcacug

SEQ ID NO: 758619 - RNA, 22 nt, Human
auuuucugaguccagaauuuac

SEQ ID NO: 758620 - RNA, 22 nt, Human
auaacugagagcaaucuuucuu

SEQ ID NO: 758621 - RNA, 22 nt, Human
agcuggcuggccccuuccugcc

SEQ ID NO: 758622 - RNA, 22 nt, Human
ugagcaggacucacugcagccu

SEQ ID NO: 758623 - RNA, 22 nt, Human
gugcuguugccuggcugcacgg

SEQ ID NO: 758624 - RNA, 22 nt, Human
uccuuuaucugcucagaaagua

SEQ ID NO: 758625 - RNA, 22 nt, Human
cugccagcucgccacaaugaca

SEQ ID NO: 758626 - RNA, 22 nt, Human
gcccuuggaaagccaaggcagc

SEQ ID NO: 758627 - RNA, 22 nt, Human
ugaaacaaguuuaagggaucua

SEQ ID NO: 758628 - RNA, 21 nt, Human
ucuguggcggacucuaggccc

SEQ ID NO: 758629 - RNA, 22 nt, Human
uggcuucugcuuucaguggagg

SEQ ID NO: 758630 - RNA, 22 nt, Human
uuggguaggagaaagaacagau

SEQ ID NO: 758631 - RNA, 22 nt, Human
uguuuuucaaauauugcucugu

SEQ ID NO: 758632 - RNA, 22 nt, Human
gaaaggucaguuccacuuccau

SEQ ID NO: 758633 - RNA, 22 nt, Human
ccuagggagccugagagcagug

SEQ ID NO: 758634 - RNA, 22 nt, Human
cauuucaaguaacagauugcuu

SEQ ID NO: 758635 - RNA, 22 nt, Human
ccaugagcuuccuauauagggu

SEQ ID NO: 758636 - RNA, 22 nt, Human
auguauaaugcuaauuagcuag

SEQ ID NO: 758637 - RNA, 22 nt, Human
auccacagugcagcaagggccc

SEQ ID NO: 758638 - RNA, 22 nt, Human
uuuucucaagauccaaugcacu

SEQ ID NO: 758639 - RNA, 22 nt, Human
ucaacccuuccuccauauuucc

SEQ ID NO: 758640 - RNA, 20 nt, Human
ccuuuauuauuuguaugaug

SEQ ID NO: 758641 - RNA, 22 nt, Human
agccuucuaggaugucaucugc

SEQ ID NO: 758642 - RNA, 22 nt, Human
auggcuuuguguucagagcuga

SEQ ID NO: 758643 - RNA, 22 nt, Human
uaagauguuuugguuugauaag

SEQ ID NO: 758644 - RNA, 22 nt, Human
agcgugugugcgggucuucuuu

SEQ ID NO: 758645 - RNA, 22 nt, Human
gaucacaugaauggaauagaag

SEQ ID NO: 758646 - RNA, 22 nt, Human
aucagaaauugcccagcuguuu

SEQ ID NO: 758647 - RNA, 22 nt, Human
ccucugugauuucugagccaau

SEQ ID NO: 758648 - RNA, 22 nt, Human
acaggcagcccucucccugguu

SEQ ID NO: 758649 - RNA, 21 nt, Human
augaagucuaugcuucugugu

SEQ ID NO: 758650 - RNA, 23 nt, Human
gcccacccucagcguccucacgg

SEQ ID NO: 758651 - RNA, 22 nt, Human
ggcaaaaaccacaauuacuuuu

SEQ ID NO: 758652 - RNA, 22 nt, Human
agcagggcagguaaggaucaga

SEQ ID NO: 758653 - RNA, 14 nt, Human
acacuguguuuaga

SEQ ID NO: 758654 - RNA, 22 nt, Human
cuucuuggacuacucacuagag

SEQ ID NO: 758655 - RNA, 22 nt, Human
gcugcuuugucuguaaaaugga

SEQ ID NO: 758656 - RNA, 22 nt, Human
auuaagggccaauccuccagcc

SEQ ID NO: 758657 - RNA, 22 nt, Human
gggaucugaguaggcagaagcu

SEQ ID NO: 758658 - RNA, 22 nt, Human
acccaggguuccugggucccag

SEQ ID NO: 758659 - RNA, 22 nt, Human
uaacagaaauagaaaugagagu

SEQ ID NO: 758660 - RNA, 22 nt, Human
gcccacagcucguuccucuccu

SEQ ID NO: 758661 - RNA, 22 nt, Human
acugauacgguuuuagagucca

SEQ ID NO: 758662 - RNA, 22 nt, Human
cuccaaggugguuauuugagau

SEQ ID NO: 758663 - RNA, 22 nt, Human
ccugauucaguggugcccagag

SEQ ID NO: 758664 - RNA, 19 nt, Human
caggaacauggagggaggg

SEQ ID NO: 758665 - RNA, 22 nt, Human
agaaagggucacugaaagagga

SEQ ID NO: 758666 - RNA, 22 nt, Human
uucuucagggaagcuuguuaau

SEQ ID NO: 758667 - RNA, 22 nt, Human
agcuauauagaugguguguuug

SEQ ID NO: 758668 - RNA, 22 nt, Human
cuggaaguuuccuuccugguca

SEQ ID NO: 758669 - RNA, 20 nt, Human
uccaguauguuauuuggugu

SEQ ID NO: 758670 - RNA, 22 nt, Human
acagcuuuaguguggguggugc

SEQ ID NO: 758671 - RNA, 20 nt, Human
ucuaauuaaaauugucuagu

SEQ ID NO: 758672 - RNA, 22 nt, Human
cagcugaggaauacuagaugua

SEQ ID NO: 758673 - RNA, 22 nt, Human
aauaauugucaacuaugcuaca

SEQ ID NO: 758674 - RNA, 22 nt, Human
ugugguagucucagggcaguau

SEQ ID NO: 758675 - RNA, 20 nt, Human
gagggugggacuuccuaggc

SEQ ID NO: 758676 - RNA, 22 nt, Human
uauuugcaaagaacuacacuag

SEQ ID NO: 758677 - RNA, 22 nt, Human
uacagugugaauaagcaggcau

SEQ ID NO: 758678 - RNA, 22 nt, Human
gugggggaugcugaguuggaaa

SEQ ID NO: 758679 - RNA, 22 nt, Human
gaacuguuucuggugaaagagu

SEQ ID NO: 758680 - RNA, 22 nt, Human
augagagcucuaugaucuguuu

SEQ ID NO: 758681 - RNA, 20 nt, Human
ugugugaacacggacucugu

SEQ ID NO: 758682 - RNA, 22 nt, Human
gaacagagaagcuuuacuaaag

SEQ ID NO: 758683 - RNA, 22 nt, Human
cagacuggcugaaggccgagug

SEQ ID NO: 758684 - RNA, 22 nt, Human
uuugcaaauauguguuucuauu

SEQ ID NO: 758685 - RNA, 22 nt, Human
ugcugucuuccaggauggugaa

SEQ ID NO: 758686 - RNA, 22 nt, Human
caguucugagcuuucccagaag

SEQ ID NO: 758687 - RNA, 22 nt, Human
aggcagagagcaguggccgucu

SEQ ID NO: 758688 - RNA, 22 nt, Human
gucagugcuugaagggcagaga

SEQ ID NO: 758689 - RNA, 16 nt, Human
uccaagaagugccccu

SEQ ID NO: 758690 - RNA, 22 nt, Human
cagaggucccuauuucuuuguu

SEQ ID NO: 758691 - RNA, 19 nt, Human
aagcauggugccucaccuc

SEQ ID NO: 758692 - RNA, 22 nt, Human
acaagaguaauuucaacagagu

SEQ ID NO: 758693 - RNA, 22 nt, Human
ucugcccucauugcugccugga

SEQ ID NO: 758694 - RNA, 22 nt, Human
uaucauugcugaugugcugaga

SEQ ID NO: 758695 - RNA, 22 nt, Human
ucacccagguccaggcucuggc

SEQ ID NO: 758696 - RNA, 22 nt, Human
cugaagagguuguugaggaaua

SEQ ID NO: 758697 - RNA, 22 nt, Human
aaacaacaauccaaugggagcu

SEQ ID NO: 758698 - RNA, 22 nt, Human
ggccugcucaaacagauuccug

SEQ ID NO: 758699 - RNA, 22 nt, Human
uuuacugagugaccuagaauaa

SEQ ID NO: 758700 - RNA, 22 nt, Human
acaggaguggcucuaccagacc

SEQ ID NO: 758701 - RNA, 22 nt, Human
acugggaagagagaauucuguc

SEQ ID NO: 758702 - RNA, 22 nt, Human
aggcugggaagguaaaguugua

SEQ ID NO: 758703 - RNA, 22 nt, Human
uaacaagucauuuuaaauuaug

SEQ ID NO: 758704 - RNA, 22 nt, Human
gaagauuggggccucugcaccc

SEQ ID NO: 758705 - RNA, 22 nt, Human
cugggccagaagacauuuagga

SEQ ID NO: 758706 - RNA, 22 nt, Human
uuucucaaaagacagaagugaa

SEQ ID NO: 758707 - RNA, 22 nt, Human
acaguaugaaugcagaauguag

SEQ ID NO: 758708 - RNA, 22 nt, Human
gguggcucagugucaggcccug

SEQ ID NO: 758709 - RNA, 22 nt, Human
guuacagugagaagauagccua

SEQ ID NO: 758710 - RNA, 22 nt, Human
aagugguuugauucaguuuaug

SEQ ID NO: 758711 - RNA, 22 nt, Human
gugaaccucugaaaggcaguga

SEQ ID NO: 758712 - RNA, 22 nt, Human
ucucaagcuuguugguauguuu

SEQ ID NO: 758713 - RNA, 22 nt, Human
uucaccagagguuagaauauuu

SEQ ID NO: 758714 - RNA, 22 nt, Human
cagcaauaaugucuacaaaucu

SEQ ID NO: 758715 - RNA, 22 nt, Human
aguuuaugucuuuacuucagcu

SEQ ID NO: 758716 - RNA, 22 nt, Human
aggcuuccucgugccuuagaua

SEQ ID NO: 758717 - RNA, 22 nt, Human
aaggccaucuacuuacggaauu

SEQ ID NO: 758718 - RNA, 22 nt, Human
ccagcaggaaagugacguuuga

SEQ ID NO: 758719 - RNA, 18 nt, Human
ucugggcuucccgaggcu

SEQ ID NO: 758720 - RNA, 19 nt, Human
gcugggugggguccacagc

SEQ ID NO: 758721 - RNA, 22 nt, Human
ugagggagucaugauuaaggaa

SEQ ID NO: 758722 - RNA, 22 nt, Human
acuucaaaaugaguuuccuggu

SEQ ID NO: 758723 - RNA, 22 nt, Human
auuagucuacugucuaauaaau

SEQ ID NO: 758724 - RNA, 22 nt, Human
ccagagucccuguucucggccu

SEQ ID NO: 758725 - RNA, 22 nt, Human
ugguuuacucuguaaaccagga

SEQ ID NO: 758726 - RNA, 22 nt, Human
ccacccugagccgcaagagcag

SEQ ID NO: 758727 - RNA, 22 nt, Human
aacagcuugagacuggauaugc

SEQ ID NO: 758728 - RNA, 22 nt, Human
ucuuugcaacucccauuuccau

SEQ ID NO: 758729 - RNA, 19 nt, Human
ucagucuaggaaugagcua

SEQ ID NO: 758730 - RNA, 21 nt, Human
gaucucuggaaggagaaagcu

SEQ ID NO: 758731 - RNA, 22 nt, Human
uacuauguucuuccuaaauagu

SEQ ID NO: 758732 - RNA, 19 nt, Human
aggugcuggugaggguguu

SEQ ID NO: 758733 - RNA, 22 nt, Human
uuguguuugaugcugacacgca

SEQ ID NO: 758734 - RNA, 22 nt, Human
uaggccaaaugacuugauguuu

SEQ ID NO: 758735 - RNA, 22 nt, Human
aagggcuccacuugaaucacac

SEQ ID NO: 758736 - RNA, 22 nt, Human
caguccucucacucaggccuuu

SEQ ID NO: 758737 - RNA, 22 nt, Human
acaguguuuaagagauggcauu

SEQ ID NO: 758738 - RNA, 22 nt, Human
cuuauguauauuuggaacguac

SEQ ID NO: 758739 - RNA, 22 nt, Human
uacaagauguacuaaaaauuau

SEQ ID NO: 758740 - RNA, 22 nt, Human
aacauguaaccagcauucaucu

SEQ ID NO: 758741 - RNA, 22 nt, Human
ggcuucauuucuguccuugauu

SEQ ID NO: 758742 - RNA, 22 nt, Human
auguuaccaucuuuuaucuaca

SEQ ID NO: 758743 - RNA, 22 nt, Human
ucugggucuaugaucucacuuc

SEQ ID NO: 758744 - RNA, 22 nt, Human
gcaauaaauaacauggaagaca

SEQ ID NO: 758745 - RNA, 22 nt, Human
gggcggcgucggcgaggccauc

SEQ ID NO: 758746 - RNA, 22 nt, Human
ugcaggcauaaccgauguugau

SEQ ID NO: 758747 - RNA, 22 nt, Human
auuuuaugacacgauucuucca

SEQ ID NO: 758748 - RNA, 20 nt, Human
aagagaagaagucuuugaaa

SEQ ID NO: 758749 - RNA, 22 nt, Human
cuguccauggugcuggacgguc

SEQ ID NO: 758750 - RNA, 22 nt, Human
augaggcauuccacucaaacuc

SEQ ID NO: 758751 - RNA, 22 nt, Human
aagauguuuagauuuauacaau

SEQ ID NO: 758752 - RNA, 22 nt, Human
augaaucaagugagaacagcau

SEQ ID NO: 758753 - RNA, 22 nt, Human
aucauucuauuguugagcugcc

SEQ ID NO: 758754 - RNA, 22 nt, Human
ugucugcccauucaugggcaca

SEQ ID NO: 758755 - RNA, 22 nt, Human
augaauccaaaguuuacuauua

SEQ ID NO: 758756 - RNA, 21 nt, Human
uguguuugagacuauguuucc

SEQ ID NO: 758757 - RNA, 22 nt, Human
uucagcaaugggauggugcagg

SEQ ID NO: 758758 - RNA, 22 nt, Human
accucugcucaagaccccuccg

SEQ ID NO: 758759 - RNA, 22 nt, Human
agagcugcaccuaugcagaccu

SEQ ID NO: 758760 - RNA, 22 nt, Human
cccucccucugcuggguguaga

SEQ ID NO: 758761 - RNA, 22 nt, Human
aacagaaugcaggggaugcugc

SEQ ID NO: 758762 - RNA, 22 nt, Human
ugagcagaggaggcugccaacu

SEQ ID NO: 758763 - RNA, 22 nt, Human
ucacaguugauugaaacacagc

SEQ ID NO: 758764 - RNA, 22 nt, Human
aaaccuuaaaccaagcucuuga

SEQ ID NO: 758765 - RNA, 22 nt, Human
aguuauaaucugcuacugauau

SEQ ID NO: 758766 - RNA, 22 nt, Human
gacacaggauuccuggcucugc

SEQ ID NO: 758767 - RNA, 22 nt, Human
ggaggccaaggugggcggauca

SEQ ID NO: 758768 - RNA, 22 nt, Human
cugugaggcggaaaggacucuc

SEQ ID NO: 758769 - RNA, 16 nt, Human
aguggcagauaauacc

SEQ ID NO: 758770 - RNA, 22 nt, Human
aggccagcagacgugggacuga

SEQ ID NO: 758771 - RNA, 22 nt, Human
augcauauaauggccagaacaa

SEQ ID NO: 758772 - RNA, 22 nt, Human
agcagcuggggccugugacgau

SEQ ID NO: 758773 - RNA, 22 nt, Human
gccaguggucagugggagggug

SEQ ID NO: 758774 - RNA, 22 nt, Human
agacaggcuuugcuguauauca

SEQ ID NO: 758775 - RNA, 22 nt, Human
agucagugaaugguguaugcua

SEQ ID NO: 758776 - RNA, 22 nt, Human
uguagcauguaaauugguuauu

SEQ ID NO: 758777 - RNA, 22 nt, Human
aaacugcacaagggugcauagc

SEQ ID NO: 758778 - RNA, 22 nt, Human
uuggaggggccacugcagagcu

SEQ ID NO: 758779 - RNA, 22 nt, Human
agggucagguuaagggagucau

SEQ ID NO: 758780 - RNA, 22 nt, Human
gaaaaggaaauuuauagagauc

SEQ ID NO: 758781 - RNA, 22 nt, Human
cagcucugacacaguacaaaau

SEQ ID NO: 758782 - RNA, 22 nt, Human
gagguucacuuccuggauccuu

SEQ ID NO: 758783 - RNA, 22 nt, Human
uccugccuguuuaccuguacuu

SEQ ID NO: 758784 - RNA, 22 nt, Human
ucuggcuguguaauauguguag

SEQ ID NO: 758785 - RNA, 19 nt, Human
cacagcuggcgcugaccgc

SEQ ID NO: 758786 - RNA, 21 nt, Human
uaaagaagaugaaugugauca

SEQ ID NO: 758787 - RNA, 22 nt, Human
acugggcuccagaugugauacg

SEQ ID NO: 758788 - RNA, 22 nt, Human
cacaguuucuauaggucagaau

SEQ ID NO: 758789 - RNA, 22 nt, Human
aagcuuuaugacuuggagacag

SEQ ID NO: 758790 - RNA, 22 nt, Human
aucccacaccccuacaacauau

SEQ ID NO: 758791 - RNA, 22 nt, Human
aucugaagggaaguggaaggca

SEQ ID NO: 758792 - RNA, 22 nt, Human
auugaacuguagucuucugucu

SEQ ID NO: 758793 - RNA, 22 nt, Human
auguuuuccugggagagcacuc

SEQ ID NO: 758794 - RNA, 22 nt, Human
ccagcuggugggucuuucucug

SEQ ID NO: 758795 - RNA, 22 nt, Human
aguccugggucuggagaaugga

SEQ ID NO: 758796 - RNA, 22 nt, Human
cuauauuuggugagggaugucu

SEQ ID NO: 758797 - RNA, 22 nt, Human
ggaggcugagaaguccaagauc

SEQ ID NO: 758798 - RNA, 22 nt, Human
aggggcaggugcugcacuuaga

SEQ ID NO: 758799 - RNA, 22 nt, Human
uuugaaaauuuaagugcuacac

SEQ ID NO: 758800 - RNA, 22 nt, Human
gcaguguguagaguuuaggaaa

SEQ ID NO: 758801 - RNA, 22 nt, Human
ccuccaggaggaaauggaacac

SEQ ID NO: 758802 - RNA, 22 nt, Human
ggcucuuguucguaccauggcu

SEQ ID NO: 758803 - RNA, 22 nt, Human
uaggauuuuuuggauucuggau

SEQ ID NO: 758804 - RNA, 22 nt, Human
cccaccccuggacaggugagug

SEQ ID NO: 758805 - RNA, 22 nt, Human
guggcugcuguccucucugguu

SEQ ID NO: 758806 - RNA, 22 nt, Human
uacuuugucauucuaaccuucc

SEQ ID NO: 758807 - RNA, 20 nt, Human
ucuguagucuaugaggcuua

SEQ ID NO: 758808 - RNA, 22 nt, Human
caggaagccacaggacagguag

SEQ ID NO: 758809 - RNA, 22 nt, Human
uagagguagcaacaggacuaga

SEQ ID NO: 758810 - RNA, 23 nt, Human
uaggaggagaccgcaguguuacc

SEQ ID NO: 758811 - RNA, 21 nt, Human
cuaagcaaggagcagggguag

SEQ ID NO: 758812 - RNA, 22 nt, Human
guuuagaagccaagauuugggu

SEQ ID NO: 758813 - RNA, 22 nt, Human
ugggcuggugagggaucauuua

SEQ ID NO: 758814 - RNA, 19 nt, Human
ggaguuuccaauggguaaa

SEQ ID NO: 758815 - RNA, 22 nt, Human
augccuguaaucccagugcuuu

SEQ ID NO: 758816 - RNA, 22 nt, Human
cagggacugagauccagacugu

SEQ ID NO: 758817 - RNA, 22 nt, Human
ucaggggcuugaggugcauguc

SEQ ID NO: 758818 - RNA, 20 nt, Human
aggggugaucgggugacacu

SEQ ID NO: 758819 - RNA, 22 nt, Human
uuucacagucaauuuggaguca

SEQ ID NO: 758820 - RNA, 22 nt, Human
gagcaaugcccuucaccagccc

SEQ ID NO: 758821 - RNA, 22 nt, Human
aggaguguggccagggcucugg

SEQ ID NO: 758822 - RNA, 22 nt, Human
accuaaaucuaccucauguuuu

SEQ ID NO: 758823 - RNA, 22 nt, Human
ggcacugggaaugcagugauga

SEQ ID NO: 758824 - RNA, 21 nt, Human
ggccacaagcggaggagccgc

SEQ ID NO: 758825 - RNA, 22 nt, Human
ugcaugcaugauguuugguagc

SEQ ID NO: 758826 - RNA, 18 nt, Human
gaaagugcggggcagggg

SEQ ID NO: 758827 - RNA, 22 nt, Human
gggcagugucuggcccccaggc

SEQ ID NO: 758828 - RNA, 22 nt, Human
ccugccugccugcuggccggga

SEQ ID NO: 758829 - RNA, 22 nt, Human
agaccugugaucacauggaaug

SEQ ID NO: 758830 - RNA, 22 nt, Human
aaucaguuguucacucugaaaa

SEQ ID NO: 758831 - RNA, 22 nt, Human
augggaugcauggcuguggcca

SEQ ID NO: 758832 - RNA, 22 nt, Human
ucagagagguuggugauaagaa

SEQ ID NO: 758833 - RNA, 22 nt, Human
uuccagugaaacaugaggugug

SEQ ID NO: 758834 - RNA, 22 nt, Human
caggcuccaagcccucugaugu

SEQ ID NO: 758835 - RNA, 22 nt, Human
aggcucugggcucuagauuuug

SEQ ID NO: 758836 - RNA, 22 nt, Human
ugccaggcacgugagaguggcc

SEQ ID NO: 758837 - RNA, 22 nt, Human
ugugugaacauguuuucauuuc

SEQ ID NO: 758838 - RNA, 23 nt, Human
uggccagcagaagcaaggggagc

SEQ ID NO: 758839 - RNA, 22 nt, Human
caccagguuccgggcagagcug

SEQ ID NO: 758840 - RNA, 22 nt, Human
cagcuauuguucuguauaauga

SEQ ID NO: 758841 - RNA, 22 nt, Human
ggcagugaaucugagagccugg

SEQ ID NO: 758842 - RNA, 22 nt, Human
ccucaggcuucgucuuccaccc

SEQ ID NO: 758843 - RNA, 22 nt, Human
cccugccuacaggguuuucuuu

SEQ ID NO: 758844 - RNA, 22 nt, Human
augucacugugaggcagcuguc

SEQ ID NO: 758845 - RNA, 22 nt, Human
uucaagaguccaggagagucug

SEQ ID NO: 758846 - RNA, 22 nt, Human
ccucagcauccuccugcucagu

SEQ ID NO: 758847 - RNA, 22 nt, Human
ggcagccagcaaugagaaguuu

SEQ ID NO: 758848 - RNA, 22 nt, Human
cuuuauguuggggugucuuagu

SEQ ID NO: 758849 - RNA, 22 nt, Human
ggccugugagcccuugcaugua

SEQ ID NO: 758850 - RNA, 22 nt, Human
auucacagaauaguuuuaccag

SEQ ID NO: 758851 - RNA, 22 nt, Human
uccacauuagaauguuuucuca

SEQ ID NO: 758852 - RNA, 22 nt, Human
uccagucccuugccuccacagc

SEQ ID NO: 758853 - RNA, 22 nt, Human
cugcacagggauauggggagcu

SEQ ID NO: 758854 - RNA, 22 nt, Human
ucauuuugccugccauuugagu

SEQ ID NO: 758855 - RNA, 22 nt, Human
gagaagaacuugggcaaaguca

SEQ ID NO: 758856 - RNA, 22 nt, Human
gaccaaggccaggccagggcgu

SEQ ID NO: 758857 - RNA, 22 nt, Human
ggcuucucgugccgaagcaaga

SEQ ID NO: 758858 - RNA, 22 nt, Human
aucaucuugaaagucuauguuu

SEQ ID NO: 758859 - RNA, 22 nt, Human
cugcugugcagacagacucucu

SEQ ID NO: 758860 - RNA, 22 nt, Human
auucuucagcaggggacacuau

SEQ ID NO: 758861 - RNA, 22 nt, Human
uccgaggcgcaccggcgcuccu

SEQ ID NO: 758862 - RNA, 22 nt, Human
ugauuucauaguauauacauga

SEQ ID NO: 758863 - RNA, 22 nt, Human
cagcuguuucaguagcguuacu

SEQ ID NO: 758864 - RNA, 22 nt, Human
ggcacacucaccacguggaggg

SEQ ID NO: 758865 - RNA, 22 nt, Human
acugaacagaccauuuuguccu

SEQ ID NO: 758866 - RNA, 22 nt, Human
uucccuaaugucuaacgcuauu

SEQ ID NO: 758867 - RNA, 22 nt, Human
auauauuuugaauagccucugu

SEQ ID NO: 758868 - RNA, 22 nt, Human
guaaccugggauguagcacaga

SEQ ID NO: 758869 - RNA, 22 nt, Human
ugugaacuuuggaugguucuga

SEQ ID NO: 758870 - RNA, 22 nt, Human
acaauguaggcugaaaaagcuu

SEQ ID NO: 758871 - RNA, 22 nt, Human
aaccauuugcaguuacugagac

SEQ ID NO: 758872 - RNA, 23 nt, Human
agguuacaguuguuaaguugcaa

SEQ ID NO: 758873 - RNA, 22 nt, Human
aggcacuuuacaaugugugaca

SEQ ID NO: 758874 - RNA, 22 nt, Human
ugcuuuaucaaagcuauaguga

SEQ ID NO: 758875 - RNA, 22 nt, Human
uucaugaauaccccuucuguaa

SEQ ID NO: 758876 - RNA, 22 nt, Human
uggucagcguuugucagagcag

SEQ ID NO: 758877 - RNA, 22 nt, Human
ccaggagagcagaagcccaggc

SEQ ID NO: 758878 - RNA, 18 nt, Human
gcccagaggucugggccc

SEQ ID NO: 758879 - RNA, 22 nt, Human
agucucugcacaguaagaagca

SEQ ID NO: 758880 - RNA, 22 nt, Human
auuuuuucuguaaacuggccuu

SEQ ID NO: 758881 - RNA, 22 nt, Human
ugcucuuacauuaauucagcau

SEQ ID NO: 758882 - RNA, 22 nt, Human
aggaagcuuggggcagggcuac

SEQ ID NO: 758883 - RNA, 22 nt, Human
agucaacacauuaaaccuaggg

SEQ ID NO: 758884 - RNA, 22 nt, Human
gcuuccuguaggcagguccaag

SEQ ID NO: 758885 - RNA, 22 nt, Human
gaugauggacaaagcauuggug

SEQ ID NO: 758886 - RNA, 22 nt, Human
agugaguggauguaggaauugg

SEQ ID NO: 758887 - RNA, 22 nt, Human
aggguaggaacugaguggaagg

SEQ ID NO: 758888 - RNA, 22 nt, Human
gugggcaaggucccugccagcu

SEQ ID NO: 758889 - RNA, 22 nt, Human
auacuuccugcuucccugaucu

SEQ ID NO: 758890 - RNA, 22 nt, Human
cagcaaggacugggcaugugaa

SEQ ID NO: 758891 - RNA, 22 nt, Human
gcuuccagggugggggauguuu

SEQ ID NO: 758892 - RNA, 22 nt, Human
gggcucuuuucugagcuucacu

SEQ ID NO: 758893 - RNA, 22 nt, Human
cucuugccagagaugagacucu

SEQ ID NO: 758894 - RNA, 22 nt, Human
cccagcagcuugcacagugcug

SEQ ID NO: 758895 - RNA, 22 nt, Human
gcaccccugcgugccuucccuu

SEQ ID NO: 758896 - RNA, 22 nt, Human
gaggccuggaccagccacagag

SEQ ID NO: 758897 - RNA, 22 nt, Human
aucuuucuaugguacuuucucc

SEQ ID NO: 758898 - RNA, 22 nt, Human
ucuguacauuuggggaccccag

SEQ ID NO: 758899 - RNA, 18 nt, Human
cugcuccagucuggccag

SEQ ID NO: 758900 - RNA, 20 nt, Human
auguagaugaaagcaaaggc

SEQ ID NO: 758901 - RNA, 20 nt, Human
guggccucucacauucugag

SEQ ID NO: 758902 - RNA, 22 nt, Human
agccucucacugucacccuccc

SEQ ID NO: 758903 - RNA, 22 nt, Human
aggcugggaaaccugaaguugu

SEQ ID NO: 758904 - RNA, 22 nt, Human
ccaguggcuacagggggguuga

SEQ ID NO: 758905 - RNA, 22 nt, Human
ugggcucucgucccugcagaag

SEQ ID NO: 758906 - RNA, 22 nt, Human
cucagagaagucuuugcuaaac

SEQ ID NO: 758907 - RNA, 22 nt, Human
ugaugacuauauaugacuagug

SEQ ID NO: 758908 - RNA, 22 nt, Human
ucaggaaauggacaucuuugcu

SEQ ID NO: 758909 - RNA, 22 nt, Human
acugugggcagcuucugggaac

SEQ ID NO: 758910 - RNA, 22 nt, Human
gcagcauuaccaagacauggca

SEQ ID NO: 758911 - RNA, 22 nt, Human
gcacagggcccugugcguaggu

SEQ ID NO: 758912 - RNA, 19 nt, Human
gcuggccacgccccaguug

SEQ ID NO: 758913 - RNA, 22 nt, Human
cucuuuggagaagcacguauua

SEQ ID NO: 758914 - RNA, 22 nt, Human
agcuaguucacugaagccuaug

SEQ ID NO: 758915 - RNA, 22 nt, Human
uccaagaagcucagcaaacauc

SEQ ID NO: 758916 - RNA, 22 nt, Human
aauagucucucccacaccaucc

SEQ ID NO: 758917 - RNA, 22 nt, Human
agccuguggaucccugcacugg

SEQ ID NO: 758918 - RNA, 22 nt, Human
ugcaggcuauccuuugcugcaa

SEQ ID NO: 758919 - RNA, 21 nt, Human
ggaguuuuucuggaagggacu

SEQ ID NO: 758920 - RNA, 22 nt, Human
gaggcucagggaaacagcgcag

SEQ ID NO: 758921 - RNA, 22 nt, Human
ugcauggaguaauugaugcuug

SEQ ID NO: 758922 - RNA, 22 nt, Human
cccugcuagaaccuccaacaug

SEQ ID NO: 758923 - RNA, 22 nt, Human
aggcacugacaauucuggacug

SEQ ID NO: 758924 - RNA, 22 nt, Human
gaguuuaguuuggcuuaaacug

SEQ ID NO: 758925 - RNA, 22 nt, Human
ccugucuguccuuugcauucuu

SEQ ID NO: 758926 - RNA, 21 nt, Human
uggcuucugccaauguuaaga

SEQ ID NO: 758927 - RNA, 17 nt, Human
cacaugucuacauggau

SEQ ID NO: 758928 - RNA, 22 nt, Human
cccaggacuaaugagcucuacg

SEQ ID NO: 758929 - RNA, 22 nt, Human
auucuaagcacgcugaagucuu

SEQ ID NO: 758930 - RNA, 20 nt, Human
aggagccauugacugcagca

SEQ ID NO: 758931 - RNA, 22 nt, Human
ucuguacuuuuauuuuggcacu

SEQ ID NO: 758932 - RNA, 22 nt, Human
cugguggaggugccaggauuug

SEQ ID NO: 758933 - RNA, 19 nt, Human
agcuucuuuggaaacauuu

SEQ ID NO: 758934 - RNA, 22 nt, Human
aagauaacaggaggaguuugua

SEQ ID NO: 758935 - RNA, 22 nt, Human
acagccagugacugcagacccu

SEQ ID NO: 758936 - RNA, 22 nt, Human
cugugccuuaguauucucauuu

SEQ ID NO: 758937 - RNA, 22 nt, Human
ugggaagaggagcacuggaaug

SEQ ID NO: 758938 - RNA, 22 nt, Human
agcagccucccagggagcagcc

SEQ ID NO: 758939 - RNA, 22 nt, Human
acaguccuuguuucggucagau

SEQ ID NO: 758940 - RNA, 22 nt, Human
aggacaugugccuccagggcag

SEQ ID NO: 758941 - RNA, 22 nt, Human
ggcuccuucaaagcaccuggcu

SEQ ID NO: 758942 - RNA, 22 nt, Human
caggagcucucaucgucagggc

SEQ ID NO: 758943 - RNA, 22 nt, Human
gcacuucacaugccuuuuccug

SEQ ID NO: 758944 - RNA, 22 nt, Human
guggcucaucuuugggaaguaa

SEQ ID NO: 758945 - RNA, 22 nt, Human
acugucacugacagaaucaaca

SEQ ID NO: 758946 - RNA, 22 nt, Human
auugucauuccagucauuguua

SEQ ID NO: 758947 - RNA, 22 nt, Human
ucuuucagccacuuaccugucu

SEQ ID NO: 758948 - RNA, 22 nt, Human
auagaauuuguacuuguagaac

SEQ ID NO: 758949 - RNA, 22 nt, Human
ugugugcacuuaaugcaaucau

SEQ ID NO: 758950 - RNA, 22 nt, Human
ccuggccagggucugggcugcu

SEQ ID NO: 758951 - RNA, 22 nt, Human
uccucuucaaaauagcucugaa

SEQ ID NO: 758952 - RNA, 22 nt, Human
aaagaaucacauccuucagcaa

SEQ ID NO: 758953 - RNA, 23 nt, Human
ccagucucacguauacaggauuu

SEQ ID NO: 758954 - RNA, 22 nt, Human
aggcccugcggaaaugaucauu

SEQ ID NO: 758955 - RNA, 22 nt, Human
cagauagcguuugagagcauaa

SEQ ID NO: 758956 - RNA, 20 nt, Human
auauaccaucccacaacagg

SEQ ID NO: 758957 - RNA, 22 nt, Human
acagcagagugugagauagcca

SEQ ID NO: 758958 - RNA, 22 nt, Human
uccccagaggugaggcagcuuu

SEQ ID NO: 758959 - RNA, 18 nt, Human
ucacacuuccuuuggguc

SEQ ID NO: 758960 - RNA, 22 nt, Human
cuggguagggcaaggaacuggc

SEQ ID NO: 758961 - RNA, 22 nt, Human
gccagagcuugguuuuuauuua

SEQ ID NO: 758962 - RNA, 22 nt, Human
acaguuagggacuauaaucauu

SEQ ID NO: 758963 - RNA, 22 nt, Human
uacagccuguuaccuauauuug

SEQ ID NO: 758964 - RNA, 22 nt, Human
gcagggcugcagagggcacugu

SEQ ID NO: 758965 - RNA, 22 nt, Human
agggccugagaccguggcuuga

SEQ ID NO: 758966 - RNA, 22 nt, Human
ccuccuggaggcucuaagggag

SEQ ID NO: 758967 - RNA, 22 nt, Human
gccaccccauagguguuaggug

SEQ ID NO: 758968 - RNA, 22 nt, Human
aaguccauagguuucaugaggg

SEQ ID NO: 758969 - RNA, 22 nt, Human
uacauauagacaguuacucuag

SEQ ID NO: 758970 - RNA, 22 nt, Human
aggcagcuggcaaauucuagag

SEQ ID NO: 758971 - RNA, 22 nt, Human
acccccacggaaggccguacgc

SEQ ID NO: 758972 - RNA, 22 nt, Human
agggcagauggaacuuccccga

SEQ ID NO: 758973 - RNA, 20 nt, Human
auauaggcauaguaaaauga

SEQ ID NO: 758974 - RNA, 22 nt, Human
cagggccuccccggcagucuuu

SEQ ID NO: 758975 - RNA, 22 nt, Human
gaguuuaguggaauuuccuucu

SEQ ID NO: 758976 - RNA, 22 nt, Human
ggccccagggauuaggccaacc

SEQ ID NO: 758977 - RNA, 21 nt, Human
uugcacagaaaaccauagaga

SEQ ID NO: 758978 - RNA, 22 nt, Human
cugucauuuucuuccaauauaa

SEQ ID NO: 758979 - RNA, 22 nt, Human
uccagcugcugacccaguagcc

SEQ ID NO: 758980 - RNA, 22 nt, Human
gagcuggaagucuguggucaga

SEQ ID NO: 758981 - RNA, 22 nt, Human
cagugauuaaaacaugacagcc

SEQ ID NO: 758982 - RNA, 22 nt, Human
cauggccaggccaagagaguac

SEQ ID NO: 758983 - RNA, 22 nt, Human
ugcaggagauaauggugcuuag

SEQ ID NO: 758984 - RNA, 22 nt, Human
uucuacauuuaaaaggaaaauc

SEQ ID NO: 758985 - RNA, 22 nt, Human
cucucagggacccagccagccu

SEQ ID NO: 758986 - RNA, 22 nt, Human
uucucuggcgguguguuuuccu

SEQ ID NO: 758987 - RNA, 23 nt, Human
auguccccuucuugaugccuggc

SEQ ID NO: 758988 - RNA, 22 nt, Human
ggugaggguaaauauaggcaaa

SEQ ID NO: 758989 - RNA, 22 nt, Human
gauguaaaaacuccuuucgaaa

SEQ ID NO: 758990 - RNA, 20 nt, Human
ggccggggagcucuccaggg

SEQ ID NO: 758991 - RNA, 22 nt, Human
ggccaccucugcccuacugagu

SEQ ID NO: 758992 - RNA, 22 nt, Human
uuacuugguguucugcccagga

SEQ ID NO: 758993 - RNA, 22 nt, Human
cuguugcaugacugugcaugcu

SEQ ID NO: 758994 - RNA, 22 nt, Human
uaaauuaugucacaugacucug

SEQ ID NO: 758995 - RNA, 22 nt, Human
guggcucaguuaacuuccaugu

SEQ ID NO: 758996 - RNA, 22 nt, Human
uagaugcuguagaaauacuuau

SEQ ID NO: 758997 - RNA, 23 nt, Human
gguggcaggaguggaugcugagc

SEQ ID NO: 758998 - RNA, 20 nt, Human
uaugcaguauguguguauaa

SEQ ID NO: 758999 - RNA, 22 nt, Human
uugcaccaaaugaguuaaaauu

SEQ ID NO: 759000 - RNA, 22 nt, Human
aaguuuggaaugauagagaccu

SEQ ID NO: 759001 - RNA, 22 nt, Human
uugucugaagucacacagaugc

SEQ ID NO: 759002 - RNA, 22 nt, Human
agugcauuccuggggaagaagc

SEQ ID NO: 759003 - RNA, 22 nt, Human
gcccaagcuggacugcaguggc

SEQ ID NO: 759004 - RNA, 22 nt, Human
auucucagggaguauuuucuau

SEQ ID NO: 759005 - RNA, 19 nt, Human
aaggaauggcuuuaaguag

SEQ ID NO: 759006 - RNA, 22 nt, Human
ucagaggacaagcucccuggug

SEQ ID NO: 759007 - RNA, 22 nt, Human
agaguuuggagguguuccugga

SEQ ID NO: 759008 - RNA, 22 nt, Human
uagcaacaauggaaguaacuuc

SEQ ID NO: 759009 - RNA, 22 nt, Human
gucuguaucagaggagugaaug

SEQ ID NO: 759010 - RNA, 22 nt, Human
uuaggaaauuccaccuguauuc

SEQ ID NO: 759011 - RNA, 22 nt, Human
uggcauguacccaggaauggac

SEQ ID NO: 759012 - RNA, 22 nt, Human
guacacucccccugugaaguug

SEQ ID NO: 759013 - RNA, 22 nt, Human
cagucacagugacaggaugugg

SEQ ID NO: 759014 - RNA, 22 nt, Human
uggugaauaguagcuucagacu

SEQ ID NO: 759015 - RNA, 22 nt, Human
cauuguucaacacugacuugca

SEQ ID NO: 759016 - RNA, 22 nt, Human
gaagucagucaucuccugucuc

SEQ ID NO: 759017 - RNA, 22 nt, Human
caggaaaccgcaucccaguggg

SEQ ID NO: 759018 - RNA, 22 nt, Human
gcuaauacuuuggaaagaaugu

SEQ ID NO: 759019 - RNA, 22 nt, Human
uaaguuuaaauguacaugaagc

SEQ ID NO: 759020 - RNA, 22 nt, Human
cccuuagcuccaagggguuugg

SEQ ID NO: 759021 - RNA, 23 nt, Human
ggguccagccaauuccaaggaaa

SEQ ID NO: 759022 - RNA, 22 nt, Human
cugagagaagagcgcaguuugu

SEQ ID NO: 759023 - RNA, 22 nt, Human
cuggccauguugccucugagac

SEQ ID NO: 759024 - RNA, 22 nt, Human
cuggagcaggcuugucccagcu

SEQ ID NO: 759025 - RNA, 22 nt, Human
ggugggaaggggccagugugcg

SEQ ID NO: 759026 - RNA, 22 nt, Human
uggucugaaggacuucugaggg

SEQ ID NO: 759027 - RNA, 22 nt, Human
aauugugcuaugauuaugaaag

SEQ ID NO: 759028 - RNA, 22 nt, Human
uauugacaauaggcaacugagg

SEQ ID NO: 759029 - RNA, 22 nt, Human
acucugggauuguuucugguau

SEQ ID NO: 759030 - RNA, 22 nt, Human
ucagugcauucauggguggcug

SEQ ID NO: 759031 - RNA, 22 nt, Human
accagcaguuaugaggccagga

SEQ ID NO: 759032 - RNA, 22 nt, Human
cauggcuuuguucuguuagaug

SEQ ID NO: 759033 - RNA, 21 nt, Human
aagugguuuagguuaccgggg

SEQ ID NO: 759034 - RNA, 22 nt, Human
ugcuucagagacauccuacuca

SEQ ID NO: 759035 - RNA, 22 nt, Human
aaaaucuugacuguuuuuagaa

SEQ ID NO: 759036 - RNA, 23 nt, Human
aucauuacuuugauaccuuuucu

SEQ ID NO: 759037 - RNA, 20 nt, Human
caggcacacucauuccugcu

SEQ ID NO: 759038 - RNA, 22 nt, Human
ccuucagccaguuuucuuuguu

SEQ ID NO: 759039 - RNA, 22 nt, Human
aaaaaugcugugguagcugugu

SEQ ID NO: 759040 - RNA, 22 nt, Human
cuggaaggguacauaggaaacu

SEQ ID NO: 759041 - RNA, 22 nt, Human
auucugacuuucaucugccuuu

SEQ ID NO: 759042 - RNA, 22 nt, Human
gccccaccuugagagcagaaac

SEQ ID NO: 759043 - RNA, 22 nt, Human
guggcuguucuugccccaugcu

SEQ ID NO: 759044 - RNA, 22 nt, Human
acuuuuuaguuuccucaaacau

SEQ ID NO: 759045 - RNA, 22 nt, Human
uuucauugcagagucugugugc

SEQ ID NO: 759046 - RNA, 22 nt, Human
gaagauuugaaacacauagaca

SEQ ID NO: 759047 - RNA, 22 nt, Human
ugaaaacacuuuaguuuagguc

SEQ ID NO: 759048 - RNA, 22 nt, Human
aacacuuagauuuuuaagguuu

SEQ ID NO: 759049 - RNA, 19 nt, Human
gaaggcugaaaugaagcac

SEQ ID NO: 759050 - RNA, 22 nt, Human
accagagggcaaaccccagugu

SEQ ID NO: 759051 - RNA, 22 nt, Human
gcuucucuuucuccccuggcgg

SEQ ID NO: 759052 - RNA, 22 nt, Human
aaggacaggagaaaacgggauc

SEQ ID NO: 759053 - RNA, 21 nt, Human
acaauagaauagaguguggug

SEQ ID NO: 759054 - RNA, 22 nt, Human
ggcuguguuccaagugucagga

SEQ ID NO: 759055 - RNA, 22 nt, Human
gccacugaacauuagagcuagu

SEQ ID NO: 759056 - RNA, 22 nt, Human
ucacaucuguugauacagcauc

SEQ ID NO: 759057 - RNA, 22 nt, Human
acuacaguacuauaucuauagg

SEQ ID NO: 759058 - RNA, 23 nt, Human
agagcuuagggaauucacaugag

SEQ ID NO: 759059 - RNA, 22 nt, Human
uucacuuauagggauguuauug

SEQ ID NO: 759060 - RNA, 22 nt, Human
aaaccacuuauaucgugauuug

SEQ ID NO: 759061 - RNA, 22 nt, Human
ccaggaagcugucugauaugaa

SEQ ID NO: 759062 - RNA, 22 nt, Human
ucuauacaugugcacacacauc

SEQ ID NO: 759063 - RNA, 22 nt, Human
gggaggucagggugccugcugg

SEQ ID NO: 759064 - RNA, 22 nt, Human
uugaaaacuuucuagaccaaga

SEQ ID NO: 759065 - RNA, 22 nt, Human
cuuagcaugugguguccuugua

SEQ ID NO: 759066 - RNA, 22 nt, Human
ugcagagggagugacgguucac

SEQ ID NO: 759067 - RNA, 22 nt, Human
gcucaggcaccauaugaugugu

SEQ ID NO: 759068 - RNA, 23 nt, Human
agugcaugcuugacuuagcaagc

SEQ ID NO: 759069 - RNA, 22 nt, Human
ggcuuaaguccugaauuuaugc

SEQ ID NO: 759070 - RNA, 22 nt, Human
acauugaauuucacuuuuguac

SEQ ID NO: 759071 - RNA, 21 nt, Human
cacagaauauacauuuuaguu

SEQ ID NO: 759072 - RNA, 22 nt, Human
uauggguaaauaauaauuuuag

SEQ ID NO: 759073 - RNA, 22 nt, Human
ggucucugcucagaugccacuu

SEQ ID NO: 759074 - RNA, 22 nt, Human
acagaugcucugaugucugggu

SEQ ID NO: 759075 - RNA, 22 nt, Human
cuaaggaugcauauguuuuguu

SEQ ID NO: 759076 - RNA, 22 nt, Human
ugggccacagcucacacaucca

SEQ ID NO: 759077 - RNA, 22 nt, Human
uguccccugcccagggauggga

SEQ ID NO: 759078 - RNA, 22 nt, Human
ugggcagcagcaaagccagacu

SEQ ID NO: 759079 - RNA, 22 nt, Human
agaaauagaggaaagguuugac

SEQ ID NO: 759080 - RNA, 22 nt, Human
gaugggcugucugagcgcugug

SEQ ID NO: 759081 - RNA, 20 nt, Human
ccuguguggccagcugaggc

SEQ ID NO: 759082 - RNA, 22 nt, Human
augaggaggccaguaagagccu

SEQ ID NO: 759083 - RNA, 22 nt, Human
ggagaaggcacacccaccucug

SEQ ID NO: 759084 - RNA, 22 nt, Human
cagcagcugcgugcccaggccg

SEQ ID NO: 759085 - RNA, 22 nt, Human
ucuugguuaggggaaauaggca

SEQ ID NO: 759086 - RNA, 22 nt, Human
ccacguccagcuaauuuucgua

SEQ ID NO: 759087 - RNA, 22 nt, Human
uggaauuaauaggggauauaca

SEQ ID NO: 759088 - RNA, 22 nt, Human
ugugagaaaaugauugcacagu

SEQ ID NO: 759089 - RNA, 22 nt, Human
gguuuauuaaugugaacuguau

SEQ ID NO: 759090 - RNA, 22 nt, Human
acuuuggcacagaacuuccauu

SEQ ID NO: 759091 - RNA, 22 nt, Human
gcaucaagacgaugugaaaucg

SEQ ID NO: 759092 - RNA, 22 nt, Human
agaaauguggaucguuuuaaaa

SEQ ID NO: 759093 - RNA, 22 nt, Human
aggcuucauauuuaggcauaug

SEQ ID NO: 759094 - RNA, 20 nt, Human
ugagcaccaagaaucaagaa

SEQ ID NO: 759095 - RNA, 22 nt, Human
uacuuacauuagcaaacaaggu

SEQ ID NO: 759096 - RNA, 22 nt, Human
uggagguguccaacucgugggu

SEQ ID NO: 759097 - RNA, 19 nt, Human
cgcagguggaaggagccgc

SEQ ID NO: 759098 - RNA, 22 nt, Human
ucacuguaugucuuuuuuugau

SEQ ID NO: 759099 - RNA, 22 nt, Human
ggagcucuuccagcuuguugcu

SEQ ID NO: 759100 - RNA, 22 nt, Human
ggucuccugaggcugccacacc

SEQ ID NO: 759101 - RNA, 22 nt, Human
aauaguccucuccuuggaauuu

SEQ ID NO: 759102 - RNA, 20 nt, Human
agggcagcuugaggagccgg

SEQ ID NO: 759103 - RNA, 22 nt, Human
ucuuuacaucacaauuguaugg

SEQ ID NO: 759104 - RNA, 22 nt, Human
gagcucuggcagggcaggucug

SEQ ID NO: 759105 - RNA, 22 nt, Human
gaggcccucuugccacaaugaa

SEQ ID NO: 759106 - RNA, 22 nt, Human
caggaacaccugcagcuagugg

SEQ ID NO: 759107 - RNA, 22 nt, Human
auguuuauuguuuuaagcugcu

SEQ ID NO: 759108 - RNA, 22 nt, Human
uucagaggguuuuagggucaga

SEQ ID NO: 759109 - RNA, 18 nt, Human
uaggaaccacuugcagag

SEQ ID NO: 759110 - RNA, 17 nt, Human
ugguuccaaccauacgc

SEQ ID NO: 759111 - RNA, 22 nt, Human
uucucaguaguuagcauuugug

SEQ ID NO: 759112 - RNA, 22 nt, Human
aaucaggcacagcgacugcagc

SEQ ID NO: 759113 - RNA, 22 nt, Human
ugugacugagcugcagaguguc

SEQ ID NO: 759114 - RNA, 22 nt, Human
gugcgugugccuaucaauaaag

SEQ ID NO: 759115 - RNA, 22 nt, Human
cucuggguucacugaggcucug

SEQ ID NO: 759116 - RNA, 22 nt, Human
uagagcaguggguaccauggca

SEQ ID NO: 759117 - RNA, 22 nt, Human
agcucagaaaugccaguaggua

SEQ ID NO: 759118 - RNA, 22 nt, Human
cuccugggaaaugaaggggcag

SEQ ID NO: 759119 - RNA, 22 nt, Human
ucucagugggaagggcacaguu

SEQ ID NO: 759120 - RNA, 22 nt, Human
ggaaguagaaguaaugaaauca

SEQ ID NO: 759121 - RNA, 22 nt, Human
gaggggcugggcagucccugga

SEQ ID NO: 759122 - RNA, 22 nt, Human
agguuuauuaaguaaauagagc

SEQ ID NO: 759123 - RNA, 22 nt, Human
ugcagggcuauaacuccauucu

SEQ ID NO: 759124 - RNA, 22 nt, Human
uucugcauacacugaauguagu

SEQ ID NO: 759125 - RNA, 22 nt, Human
cuuugauucagacuuugucggc

SEQ ID NO: 759126 - RNA, 22 nt, Human
gagcagcuuaugucaagccaga

SEQ ID NO: 759127 - RNA, 22 nt, Human
uacuguaaugagauuagcuucc

SEQ ID NO: 759128 - RNA, 22 nt, Human
acugugcacaauucuaaguccu

SEQ ID NO: 759129 - RNA, 22 nt, Human
ccacagaguccgcauuugaggc

SEQ ID NO: 759130 - RNA, 22 nt, Human
uccagcauuagaugugaaauug

SEQ ID NO: 759131 - RNA, 22 nt, Human
caaacuauuuacaauggaauca

SEQ ID NO: 759132 - RNA, 22 nt, Human
aagaacauugauauugucuaug

SEQ ID NO: 759133 - RNA, 22 nt, Human
uaacauguguauugguuuccua

SEQ ID NO: 759134 - RNA, 22 nt, Human
cucuuaauuaagcugagaucug

SEQ ID NO: 759135 - RNA, 22 nt, Human
caccugggcuaaacuaugcagg

SEQ ID NO: 759136 - RNA, 22 nt, Human
acccaggcuagagugcaguggu

SEQ ID NO: 759137 - RNA, 22 nt, Human
aauugcuuugaagaagggagcg

SEQ ID NO: 759138 - RNA, 19 nt, Human
aggcuucauccugggcagc

SEQ ID NO: 759139 - RNA, 19 nt, Human
cacuucacauggugaaagc

SEQ ID NO: 759140 - RNA, 22 nt, Human
agcugcuccuuggcugugguuc

SEQ ID NO: 759141 - RNA, 22 nt, Human
ugcagggcuaagucagagccug

SEQ ID NO: 759142 - RNA, 22 nt, Human
uuacaaagcgcuuuaccucuga

SEQ ID NO: 759143 - RNA, 22 nt, Human
augcuguuaagauaauggguuc

SEQ ID NO: 759144 - RNA, 21 nt, Human
ugaaaucugaugggacaaaug

SEQ ID NO: 759145 - RNA, 22 nt, Human
uccagguaugacauggcuguuu

SEQ ID NO: 759146 - RNA, 22 nt, Human
aggcugagauagguggaucauu

SEQ ID NO: 759147 - RNA, 22 nt, Human
guuucacagucugcagaauuuu

SEQ ID NO: 759148 - RNA, 22 nt, Human
aggagcugcacugggaguuuuu

SEQ ID NO: 759149 - RNA, 22 nt, Human
aaguguuuauuuauaacgaucu

SEQ ID NO: 759150 - RNA, 22 nt, Human
aaaugcagaucccugaaucuca

SEQ ID NO: 759151 - RNA, 22 nt, Human
cccacuuugguugcacucugcc

SEQ ID NO: 759152 - RNA, 22 nt, Human
cucagaggucaagagcagagcu

SEQ ID NO: 759153 - RNA, 22 nt, Human
aaucaacauuguuuuaagucaa

SEQ ID NO: 759154 - RNA, 22 nt, Human
ucuggacuaacagcagccucag

SEQ ID NO: 759155 - RNA, 22 nt, Human
uugaggccugcuggaagguguu

SEQ ID NO: 759156 - RNA, 22 nt, Human
uuuacaagucagggacuguucu

SEQ ID NO: 759157 - RNA, 22 nt, Human
ucugggagcagcucagcagauu

SEQ ID NO: 759158 - RNA, 22 nt, Human
guuuggggaguuccuuuaggcc

SEQ ID NO: 759159 - RNA, 22 nt, Human
acugggcucaagugauuguccu

SEQ ID NO: 759160 - RNA, 22 nt, Human
uguauuuucuucuggaagcuua

SEQ ID NO: 759161 - RNA, 22 nt, Human
agcuggguacagccugugccua

SEQ ID NO: 759162 - RNA, 22 nt, Human
uugaaagugccaaguccuagug

SEQ ID NO: 759163 - RNA, 22 nt, Human
uucuguggcaguuugggaggug

SEQ ID NO: 759164 - RNA, 22 nt, Human
auuuccaggagaaaggauuuua

SEQ ID NO: 759165 - RNA, 22 nt, Human
agcaguuaucgaagaaucaggu

SEQ ID NO: 759166 - RNA, 22 nt, Human
auauuuucacugaaccaaagua

SEQ ID NO: 759167 - RNA, 22 nt, Human
gaagagaugacaaaggagcaug

SEQ ID NO: 759168 - RNA, 20 nt, Human
uugaaaaugcauugugcagu

SEQ ID NO: 759169 - RNA, 22 nt, Human
uuccaagagccuuucuucuaga

SEQ ID NO: 759170 - RNA, 22 nt, Human
gcagagcucuguucuuaucucc

SEQ ID NO: 759171 - RNA, 21 nt, Human
aucuuaaaaggucuuaacuuu

SEQ ID NO: 759172 - RNA, 22 nt, Human
guuuucauuacugcugugauuu

SEQ ID NO: 759173 - RNA, 22 nt, Human
auuucagauucgagaggaagug

SEQ ID NO: 759174 - RNA, 22 nt, Human
cagcaucuucaugugcaucucc

SEQ ID NO: 759175 - RNA, 22 nt, Human
ggcuguauauacuguauacagu

SEQ ID NO: 759176 - RNA, 22 nt, Human
ugggaaugggccuagaaggcug

SEQ ID NO: 759177 - RNA, 22 nt, Human
ucuuggccccaacccucuauuu

SEQ ID NO: 759178 - RNA, 22 nt, Human
ugguaauuuacgcauuucugua

SEQ ID NO: 759179 - RNA, 22 nt, Human
acaugacaaaaugcacaggauu

SEQ ID NO: 759180 - RNA, 22 nt, Human
gaaaggugccccauaggcagga

SEQ ID NO: 759181 - RNA, 22 nt, Human
guggcccuggaguugugacacu

SEQ ID NO: 759182 - RNA, 22 nt, Human
gugugcauauguguggcucucc

SEQ ID NO: 759183 - RNA, 22 nt, Human
gaacagaagaggcuggugccac

SEQ ID NO: 759184 - RNA, 22 nt, Human
cggcugagacggccauagacac

SEQ ID NO: 759185 - RNA, 22 nt, Human
cucuccuccaggaacucacagu

SEQ ID NO: 759186 - RNA, 22 nt, Human
accucuaaaaaauuagaagccu

SEQ ID NO: 759187 - RNA, 20 nt, Human
uuauuugcucuuuaucugca

SEQ ID NO: 759188 - RNA, 22 nt, Human
aaaucagucccucuuggaauuu

SEQ ID NO: 759189 - RNA, 22 nt, Human
uguccugggaacucacagucca

SEQ ID NO: 759190 - RNA, 17 nt, Human
ggacacagcucauggcu

SEQ ID NO: 759191 - RNA, 22 nt, Human
ugcacaaauuuguguaugcuca

SEQ ID NO: 759192 - RNA, 22 nt, Human
ucuagucauauuuuuucaguau

SEQ ID NO: 759193 - RNA, 22 nt, Human
acuucugaagcagagauuuggg

SEQ ID NO: 759194 - RNA, 22 nt, Human
uccugcucugauggguucuccu

SEQ ID NO: 759195 - RNA, 22 nt, Human
aaaugcuuagagguguucaaau

SEQ ID NO: 759196 - RNA, 22 nt, Human
ugcaggugauucugaugcaguu

SEQ ID NO: 759197 - RNA, 19 nt, Human
gaaugggaaugggaaagcu

SEQ ID NO: 759198 - RNA, 22 nt, Human
uugcuuuagaaucugcuucugg

SEQ ID NO: 759199 - RNA, 22 nt, Human
gcugccuuagagggagugguuc

SEQ ID NO: 759200 - RNA, 22 nt, Human
auucagugccaaggagaacuug

SEQ ID NO: 759201 - RNA, 21 nt, Human
gggcuggauauuggaaagagg

SEQ ID NO: 759202 - RNA, 20 nt, Human
uccuccagaagggcagggug

SEQ ID NO: 759203 - RNA, 23 nt, Human
guuaccuuacuucugugaucuuc

SEQ ID NO: 759204 - RNA, 22 nt, Human
gaggaguggguuagugcuuauu

SEQ ID NO: 759205 - RNA, 22 nt, Human
cagcaguguacaaggugucaga

SEQ ID NO: 759206 - RNA, 22 nt, Human
uucagaaaaagaccauugcaau

SEQ ID NO: 759207 - RNA, 22 nt, Human
agauacaucuugaacuucuaga

SEQ ID NO: 759208 - RNA, 22 nt, Human
acauguaaaaauuaagguaaga

SEQ ID NO: 759209 - RNA, 22 nt, Human
ggauuagcuuuuguucuugacu

SEQ ID NO: 759210 - RNA, 22 nt, Human
ggaagaggaggagccaggcuuu

SEQ ID NO: 759211 - RNA, 21 nt, Human
uucaagucucuaggacuucuc

SEQ ID NO: 759212 - RNA, 22 nt, Human
augcuugguuccuacuucuggc

SEQ ID NO: 759213 - RNA, 21 nt, Human
uuugaaagugggugauucuuu

SEQ ID NO: 759214 - RNA, 22 nt, Human
gcuggagagugaggggagcaag

SEQ ID NO: 759215 - RNA, 22 nt, Human
agaggaauggagacuaaacgcu

SEQ ID NO: 759216 - RNA, 22 nt, Human
agauacaguguuacauuuuuau

SEQ ID NO: 759217 - RNA, 20 nt, Human
gugaccagaagacagugggu

SEQ ID NO: 759218 - RNA, 22 nt, Human
uauaaauuauuaggcugcuaaa

SEQ ID NO: 759219 - RNA, 19 nt, Human
acuaaaaaugauguuugag

SEQ ID NO: 759220 - RNA, 22 nt, Human
acuguccauucacucauauuca

SEQ ID NO: 759221 - RNA, 22 nt, Human
ggcuucaccaggugcaugcaug

SEQ ID NO: 759222 - RNA, 22 nt, Human
cuuuuucuucuaggugugccug

SEQ ID NO: 759223 - RNA, 17 nt, Human
aauguggaaguacaugc

SEQ ID NO: 759224 - RNA, 22 nt, Human
aaucuuaaagaauauucuacca

SEQ ID NO: 759225 - RNA, 22 nt, Human
cucaggauguacuacagaaggc

SEQ ID NO: 759226 - RNA, 19 nt, Human
auggaaaaugccagacuga

SEQ ID NO: 759227 - RNA, 22 nt, Human
cuggaagggucuacuuagcaga

SEQ ID NO: 759228 - RNA, 22 nt, Human
cucugugggaagcuggguguga

SEQ ID NO: 759229 - RNA, 22 nt, Human
agggggugucucugauuggguu

SEQ ID NO: 759230 - RNA, 22 nt, Human
aauggcaaaguguuuucauacc

SEQ ID NO: 759231 - RNA, 22 nt, Human
ucacucaagcaucuacagggau

SEQ ID NO: 759232 - RNA, 22 nt, Human
aauguguauaugaacauacagg

SEQ ID NO: 759233 - RNA, 22 nt, Human
uugcaacacaaaguuugauucc

SEQ ID NO: 759234 - RNA, 22 nt, Human
ucagaggaagcaucaaguucuc

SEQ ID NO: 759235 - RNA, 22 nt, Human
uuuuccugccuuugcucaggga

SEQ ID NO: 759236 - RNA, 22 nt, Human
uuccagaacaauguggacguau

SEQ ID NO: 759237 - RNA, 19 nt, Human
aucuugggaaaugguaacu

SEQ ID NO: 759238 - RNA, 22 nt, Human
ucugucacuuuuauuuacugaa

SEQ ID NO: 759239 - RNA, 22 nt, Human
ggccagcugcucagugucucug

SEQ ID NO: 759240 - RNA, 22 nt, Human
gcaggucucaaucugagcaggc

SEQ ID NO: 759241 - RNA, 20 nt, Human
ggcugugcccuuccguggcc

SEQ ID NO: 759242 - RNA, 22 nt, Human
caggagcccugguggguggaca

SEQ ID NO: 759243 - RNA, 22 nt, Human
augugaggaagaaagagguaag

SEQ ID NO: 759244 - RNA, 22 nt, Human
agguagagcuccaguagaaaau

SEQ ID NO: 759245 - RNA, 22 nt, Human
uccugaaggccugaguuccacc

SEQ ID NO: 759246 - RNA, 23 nt, Human
aguggcuggacagacuuuccugg

SEQ ID NO: 759247 - RNA, 22 nt, Human
ugcaguaggcacguggcuguga

SEQ ID NO: 759248 - RNA, 22 nt, Human
uuagcuuuuaagugugcuacau

SEQ ID NO: 759249 - RNA, 22 nt, Human
ucuacugcacuggugucucauc

SEQ ID NO: 759250 - RNA, 22 nt, Human
ggaagaagcagggcauuugaau

SEQ ID NO: 759251 - RNA, 22 nt, Human
uaaugugugucaucaguagagu

SEQ ID NO: 759252 - RNA, 22 nt, Human
cugaaggggguuucacugagcu

SEQ ID NO: 759253 - RNA, 22 nt, Human
uugauucugcugaucucggacg

SEQ ID NO: 759254 - RNA, 22 nt, Human
ugugucuguccucgguugaugc

SEQ ID NO: 759255 - RNA, 22 nt, Human
cuaggcuguaaagagcuaggag

SEQ ID NO: 759256 - RNA, 22 nt, Human
auguggcuuggcagggaauaug

SEQ ID NO: 759257 - RNA, 22 nt, Human
aaggcuccgugacuggggcuga

SEQ ID NO: 759258 - RNA, 20 nt, Human
ucccuccugcagauagagaa

SEQ ID NO: 759259 - RNA, 22 nt, Human
ccaggggccugugaaggugccc

SEQ ID NO: 759260 - RNA, 22 nt, Human
acucugggaucuugaaaagagu

SEQ ID NO: 759261 - RNA, 22 nt, Human
ucaguugcauauuuuguguucu

SEQ ID NO: 759262 - RNA, 22 nt, Human
ugucauugaggaaaacuaggug

SEQ ID NO: 759263 - RNA, 22 nt, Human
caaaguauaguguaggauggca

SEQ ID NO: 759264 - RNA, 22 nt, Human
cuggggugagcagaaacagggg

SEQ ID NO: 759265 - RNA, 22 nt, Human
auacacugaguccuuuucucau

SEQ ID NO: 759266 - RNA, 22 nt, Human
guccucugcccaggucaagguu

SEQ ID NO: 759267 - RNA, 22 nt, Human
auuccacagugccuuccgugaa

SEQ ID NO: 759268 - RNA, 22 nt, Human
ucccugggcuucuccagacuug

SEQ ID NO: 759269 - RNA, 22 nt, Human
gcagcugguuaaugggagaauu

SEQ ID NO: 759270 - RNA, 22 nt, Human
ugucacaauaucccaaucugcc

SEQ ID NO: 759271 - RNA, 22 nt, Human
ucuuaauucugugucuucacua

SEQ ID NO: 759272 - RNA, 22 nt, Human
cagcucuggguaggaggaaucu

SEQ ID NO: 759273 - RNA, 22 nt, Human
agugggggcagagccucucucg

SEQ ID NO: 759274 - RNA, 22 nt, Human
aagauauuuuagaacauucacu

SEQ ID NO: 759275 - RNA, 22 nt, Human
guguccugcaggccaggaaugg

SEQ ID NO: 759276 - RNA, 22 nt, Human
caggguugggcuccaaggaugg

SEQ ID NO: 759277 - RNA, 22 nt, Human
ugaggcaggagaauggcgggaa

SEQ ID NO: 759278 - RNA, 20 nt, Human
agaaggcuccuuuugccaag

SEQ ID NO: 759279 - RNA, 22 nt, Human
cgcaggcucgguucacagagca

SEQ ID NO: 759280 - RNA, 22 nt, Human
auuugucacugagagaguuaga

SEQ ID NO: 759281 - RNA, 22 nt, Human
uuucccaacagucucucucaaa

SEQ ID NO: 759282 - RNA, 22 nt, Human
auacagcagugaauaagauaaa

SEQ ID NO: 759283 - RNA, 22 nt, Human
ccugcccuaugaccagcuucac

SEQ ID NO: 759284 - RNA, 22 nt, Human
agcuggugcucaggggcaugga

SEQ ID NO: 759285 - RNA, 22 nt, Human
caggagcuggaucuccuugcgg

SEQ ID NO: 759286 - RNA, 22 nt, Human
gacauaaaauggaauucuguug

SEQ ID NO: 759287 - RNA, 22 nt, Human
agaacauuugucgaucaauuug

SEQ ID NO: 759288 - RNA, 22 nt, Human
acauuuguaggacagaggaaga

SEQ ID NO: 759289 - RNA, 22 nt, Human
ucuucagacuccaaauguuuua

SEQ ID NO: 759290 - RNA, 22 nt, Human
uaauuuauauggaauuguugcu

SEQ ID NO: 759291 - RNA, 22 nt, Human
uagaguccuucauucugugcag

SEQ ID NO: 759292 - RNA, 22 nt, Human
guacgugcaugcacgugugccu

SEQ ID NO: 759293 - RNA, 22 nt, Human
aagaaagugcuuuguaaauuau

SEQ ID NO: 759294 - RNA, 22 nt, Human
ggugcccaccugucuuccugga

SEQ ID NO: 759295 - RNA, 22 nt, Human
cccagccucugggcucacccaa

SEQ ID NO: 759296 - RNA, 22 nt, Human
gugggagcuuuggcaucaggcu

SEQ ID NO: 759297 - RNA, 22 nt, Human
gggagcucgugcgcccaggugc

SEQ ID NO: 759298 - RNA, 22 nt, Human
gaguuuagccaauuuggucccc

SEQ ID NO: 759299 - RNA, 22 nt, Human
ucagugugaggggcuggguccu

SEQ ID NO: 759300 - RNA, 22 nt, Human
gacaucugaauuuagcaguuuu

SEQ ID NO: 759301 - RNA, 18 nt, Human
agcuuagcauacuuuucc

SEQ ID NO: 759302 - RNA, 22 nt, Human
auuucucugccucagcuucugc

SEQ ID NO: 759303 - RNA, 22 nt, Human
gagguucacaggcuaucacagu

SEQ ID NO: 759304 - RNA, 22 nt, Human
cuuaggaauauccacagcaggu

SEQ ID NO: 759305 - RNA, 22 nt, Human
gaggcccaggguacaggccgcu

SEQ ID NO: 759306 - RNA, 22 nt, Human
aauuuauauguaauuaggcaca

SEQ ID NO: 759307 - RNA, 22 nt, Human
gaagcucucaaacucuccccuu

SEQ ID NO: 759308 - RNA, 22 nt, Human
ggagacucucauugucaagcuu

SEQ ID NO: 759309 - RNA, 22 nt, Human
acaugcauucucuaaaagcaaa

SEQ ID NO: 759310 - RNA, 22 nt, Human
guuuuauaugucucugcugaca

SEQ ID NO: 759311 - RNA, 18 nt, Human
cugggacucaaugcuacu

SEQ ID NO: 759312 - RNA, 22 nt, Human
cccuaaggacaccugcugucca

SEQ ID NO: 759313 - RNA, 22 nt, Human
cuguaaauggaacuauguagua

SEQ ID NO: 759314 - RNA, 22 nt, Human
acagcuucgaggaucucauccc

SEQ ID NO: 759315 - RNA, 22 nt, Human
cagccugccgucagccagguag

SEQ ID NO: 759316 - RNA, 22 nt, Human
agaggacaaaaugagaagugcu

SEQ ID NO: 759317 - RNA, 22 nt, Human
cacaaugcguacauauaucaaa

SEQ ID NO: 759318 - RNA, 22 nt, Human
ggcagagcucuggacugagaac

SEQ ID NO: 759319 - RNA, 22 nt, Human
uaucacaucaauguuuuaaaau

SEQ ID NO: 759320 - RNA, 22 nt, Human
cuguggugggcccugggcuuca

SEQ ID NO: 759321 - RNA, 21 nt, Human
ucccaagcugcuggcucagcu

SEQ ID NO: 759322 - RNA, 22 nt, Human
ggacaaagccugguggcaggug

SEQ ID NO: 759323 - RNA, 22 nt, Human
acagggcaccugagguaggaag

SEQ ID NO: 759324 - RNA, 22 nt, Human
cucucccccacagcagccuucu

SEQ ID NO: 759325 - RNA, 22 nt, Human
ccaggagcuauguacacacuau

SEQ ID NO: 759326 - RNA, 22 nt, Human
uuaauugucugugaguaccuga

SEQ ID NO: 759327 - RNA, 22 nt, Human
ucucuccuccacaccgggugcu

SEQ ID NO: 759328 - RNA, 22 nt, Human
gugaacuuccagaugauaaaca

SEQ ID NO: 759329 - RNA, 22 nt, Human
agcagagcgccugcucagaggg

SEQ ID NO: 759330 - RNA, 22 nt, Human
gcagcagcucugaaugggcccc

SEQ ID NO: 759331 - RNA, 22 nt, Human
uuugcaaagugcuugcagagua

SEQ ID NO: 759332 - RNA, 22 nt, Human
gaaggaaaggucucaugccuuu

SEQ ID NO: 759333 - RNA, 22 nt, Human
cuugccuuugucuucaaaggcu

SEQ ID NO: 759334 - RNA, 22 nt, Human
agccuccuggaguuucugggau

SEQ ID NO: 759335 - RNA, 18 nt, Human
cuccugggcugcagaugc

SEQ ID NO: 759336 - RNA, 22 nt, Human
uucaggaugacaccauguccag

SEQ ID NO: 759337 - RNA, 22 nt, Human
acugaggucagggguaugugau

SEQ ID NO: 759338 - RNA, 22 nt, Human
cauaggaaaagcauucuucuug

SEQ ID NO: 759339 - RNA, 16 nt, Human
aacaaugccaauccag

SEQ ID NO: 759340 - RNA, 22 nt, Human
ggucagaagugcaaaaucaguu

SEQ ID NO: 759341 - RNA, 22 nt, Human
aaugcuuucaaaaaugugcagu

SEQ ID NO: 759342 - RNA, 19 nt, Human
agagacugccaccagcugu

SEQ ID NO: 759343 - RNA, 22 nt, Human
augcagaaagcggcaaacaggu

SEQ ID NO: 759344 - RNA, 21 nt, Human
gaugaagcaaucuuucuguug

SEQ ID NO: 759345 - RNA, 22 nt, Human
uccuccaggucuaggguggcuu

SEQ ID NO: 759346 - RNA, 22 nt, Human
ucuggcucauaggaaggccauu

SEQ ID NO: 759347 - RNA, 17 nt, Human
ccacagccuggcacuug

SEQ ID NO: 759348 - RNA, 22 nt, Human
ugacgucaacugcaaaggccuu

SEQ ID NO: 759349 - RNA, 22 nt, Human
gcaggcggaucacuggaaguca

SEQ ID NO: 759350 - RNA, 22 nt, Human
cuuuaguuuaagaacaugauga

SEQ ID NO: 759351 - RNA, 22 nt, Human
auguguauccaucugucuauuu

SEQ ID NO: 759352 - RNA, 22 nt, Human
caggguagggcaagggaaccug

SEQ ID NO: 759353 - RNA, 21 nt, Human
caggaaagaaaacguacauau

SEQ ID NO: 759354 - RNA, 22 nt, Human
cuggcugcaaaaucuauucacu

SEQ ID NO: 759355 - RNA, 22 nt, Human
caguuucuguggucucuuuuca

SEQ ID NO: 759356 - RNA, 22 nt, Human
uucaacaaugcacuugaguaua

SEQ ID NO: 759357 - RNA, 22 nt, Human
accuuucaaaguggcuaucacu

SEQ ID NO: 759358 - RNA, 21 nt, Human
ggcacagccugaaaugccuca

SEQ ID NO: 759359 - RNA, 20 nt, Human
cucucucuccauucccaggg

SEQ ID NO: 759360 - RNA, 22 nt, Human
gagcugagggucuaggaggguu

SEQ ID NO: 759361 - RNA, 22 nt, Human
agaagccagucgcucucccgca

SEQ ID NO: 759362 - RNA, 22 nt, Human
ccuuccaggagucucugcaggu

SEQ ID NO: 759363 - RNA, 22 nt, Human
ggaggggaugguuugacccugg

SEQ ID NO: 759364 - RNA, 22 nt, Human
uacugucuaauaagauugaugg

SEQ ID NO: 759365 - RNA, 22 nt, Human
acaaagagggaccagugacuug

SEQ ID NO: 759366 - RNA, 22 nt, Human
agauaacuuuuggguauucaug

SEQ ID NO: 759367 - RNA, 20 nt, Human
acccugaggcuccccagccu

SEQ ID NO: 759368 - RNA, 22 nt, Human
ccaggacucaguggggaaaggg

SEQ ID NO: 759369 - RNA, 22 nt, Human
guguucaucccaaugcugauag

SEQ ID NO: 759370 - RNA, 22 nt, Human
uguuuacuaugauguaaccuau

SEQ ID NO: 759371 - RNA, 22 nt, Human
agggaugcuuugcugacagauu

SEQ ID NO: 759372 - RNA, 22 nt, Human
gcuggcucccauugguccuucc

SEQ ID NO: 759373 - RNA, 21 nt, Human
agagaagggacucuuccaguc

SEQ ID NO: 759374 - RNA, 22 nt, Human
ccuuuugagacuuccacugugu

SEQ ID NO: 759375 - RNA, 22 nt, Human
ugggaauggaugcuaagugcua

SEQ ID NO: 759376 - RNA, 22 nt, Human
aggauuugcacugguguuugag

SEQ ID NO: 759377 - RNA, 22 nt, Human
ugggcucagccaugaccuccac

SEQ ID NO: 759378 - RNA, 22 nt, Human
ucaggaugguccuuuaugagaa

SEQ ID NO: 759379 - RNA, 23 nt, Human
gggaagcuccauggaggugcugg

SEQ ID NO: 759380 - RNA, 22 nt, Human
ccuuuggguucaaucucggucu

SEQ ID NO: 759381 - RNA, 22 nt, Human
agagaugguagaacagucauaa

SEQ ID NO: 759382 - RNA, 22 nt, Human
gguacagaauaaaaauccuaca

SEQ ID NO: 759383 - RNA, 22 nt, Human
ugcagcucugggguaaggggug

SEQ ID NO: 759384 - RNA, 21 nt, Human
aaggcagaagcauggaaugag

SEQ ID NO: 759385 - RNA, 19 nt, Human
uacaggcaguuucuacaau

SEQ ID NO: 759386 - RNA, 22 nt, Human
caugcauguuuacuacagugac

SEQ ID NO: 759387 - RNA, 22 nt, Human
cugguggguagagggcaucagg

SEQ ID NO: 759388 - RNA, 22 nt, Human
ccuguacuagggucucauugcc

SEQ ID NO: 759389 - RNA, 18 nt, Human
ucuugccugcacccucuc

SEQ ID NO: 759390 - RNA, 22 nt, Human
ucagggcucaccagccucugcc

SEQ ID NO: 759391 - RNA, 22 nt, Human
accuuuccaaguaucagguggu

SEQ ID NO: 759392 - RNA, 22 nt, Human
uguguaaauggacugugaauua

SEQ ID NO: 759393 - RNA, 22 nt, Human
gggagcugccaccaccccuggg

SEQ ID NO: 759394 - RNA, 23 nt, Human
gagauggcugguuguccucugaa

SEQ ID NO: 759395 - RNA, 22 nt, Human
uguccuggagugcuugggggaa

SEQ ID NO: 759396 - RNA, 22 nt, Human
cuacaggucaagcaguagcucu

SEQ ID NO: 759397 - RNA, 22 nt, Human
guucuucagucacaucacagaa

SEQ ID NO: 759398 - RNA, 22 nt, Human
cuuuaugaaggaacaaugcucc

SEQ ID NO: 759399 - RNA, 18 nt, Human
gcuucucauuucuaagca

SEQ ID NO: 759400 - RNA, 22 nt, Human
uucagggcaugagggacacauc

SEQ ID NO: 759401 - RNA, 22 nt, Human
cuuucagucuuuacaagguugc

SEQ ID NO: 759402 - RNA, 20 nt, Human
gucuccacuggggguuaacc

SEQ ID NO: 759403 - RNA, 22 nt, Human
guggcagugccguuugguucag

SEQ ID NO: 759404 - RNA, 22 nt, Human
agugggcugagcuugcugggug

SEQ ID NO: 759405 - RNA, 22 nt, Human
uuuggcauuuaauaggugauca

SEQ ID NO: 759406 - RNA, 22 nt, Human
gucuuucuaugaugaacuguug

SEQ ID NO: 759407 - RNA, 22 nt, Human
auuccaaacagugcugcagacu

SEQ ID NO: 759408 - RNA, 22 nt, Human
agaaaugcaguuucaagacaaa

SEQ ID NO: 759409 - RNA, 21 nt, Human
aguuuccucaacugcagaagg

SEQ ID NO: 759410 - RNA, 22 nt, Human
aaagaguuuggagacaagauca

SEQ ID NO: 759411 - RNA, 22 nt, Human
gaggcuggugguuaguuccauu

SEQ ID NO: 759412 - RNA, 22 nt, Human
aacacucuacgugcagcuccua

SEQ ID NO: 759413 - RNA, 22 nt, Human
uagcauuccaucuuggacuugu

SEQ ID NO: 759414 - RNA, 22 nt, Human
auuuuagcaaaugcaagaugga

SEQ ID NO: 759415 - RNA, 22 nt, Human
ggcacagcacaguggacccagg

SEQ ID NO: 759416 - RNA, 23 nt, Human
aguguuuauguucagugacccuc

SEQ ID NO: 759417 - RNA, 22 nt, Human
aaaguaugauuggggauuauuu

SEQ ID NO: 759418 - RNA, 22 nt, Human
guucaaggaagggaggaaagcc

SEQ ID NO: 759419 - RNA, 22 nt, Human
uugaggccaaaaaguccuauga

SEQ ID NO: 759420 - RNA, 22 nt, Human
uugacaagcgaaguaccauaau

SEQ ID NO: 759421 - RNA, 22 nt, Human
gcacaggcacagagggccacug

SEQ ID NO: 759422 - RNA, 22 nt, Human
acuguauuccuacuagaaucua

SEQ ID NO: 759423 - RNA, 22 nt, Human
ggcuuuaaacacugaaauugca

SEQ ID NO: 759424 - RNA, 22 nt, Human
ucuccucugugccacagcuugg

SEQ ID NO: 759425 - RNA, 22 nt, Human
uuucacauuagauaugucauuu

SEQ ID NO: 759426 - RNA, 22 nt, Human
ugcucccaaacgaccuacugug

SEQ ID NO: 759427 - RNA, 22 nt, Human
uuuuauucuaaguaugauggga

SEQ ID NO: 759428 - RNA, 22 nt, Human
gcacugggcuccaggaaggagg

SEQ ID NO: 759429 - RNA, 22 nt, Human
aagcacagauugcugcauccau

SEQ ID NO: 759430 - RNA, 22 nt, Human
uuugaaguucccccauaucaga

SEQ ID NO: 759431 - RNA, 22 nt, Human
gcagcuuuuuggaugucaguua

SEQ ID NO: 759432 - RNA, 22 nt, Human
aauuucaguaugaaguuucaca

SEQ ID NO: 759433 - RNA, 22 nt, Human
cuggagcugcuguccuugggug

SEQ ID NO: 759434 - RNA, 22 nt, Human
aaaaaucuaugacugcuucucc

SEQ ID NO: 759435 - RNA, 22 nt, Human
ugggcugaguguggaacuaguu

SEQ ID NO: 759436 - RNA, 22 nt, Human
uguuuucucuugaaaagcaguc

SEQ ID NO: 759437 - RNA, 22 nt, Human
gaggugccuggcgaugucucug

SEQ ID NO: 759438 - RNA, 22 nt, Human
gcccuggagcuagacuaggaca

SEQ ID NO: 759439 - RNA, 22 nt, Human
augaggcaaggcuggccguguu

SEQ ID NO: 759440 - RNA, 22 nt, Human
uaaugucuaugggccagauaau

SEQ ID NO: 759441 - RNA, 22 nt, Human
gugcaaaagucauugugguuuu

SEQ ID NO: 759442 - RNA, 22 nt, Human
cagcaauaguguguuuguuuca

SEQ ID NO: 759443 - RNA, 22 nt, Human
uccagggcuggguuggcucagc

SEQ ID NO: 759444 - RNA, 22 nt, Human
aaaauaugaaguugucaguaug

SEQ ID NO: 759445 - RNA, 22 nt, Human
agacucugauucccucauguca

SEQ ID NO: 759446 - RNA, 22 nt, Human
uuuccuucuuagcgguguucuu

SEQ ID NO: 759447 - RNA, 22 nt, Human
agcagguggccacgaggaggag

SEQ ID NO: 759448 - RNA, 22 nt, Human
gguuggugagugcaggguguua

SEQ ID NO: 759449 - RNA, 22 nt, Human
agugucugaaccaccggggcau

SEQ ID NO: 759450 - RNA, 22 nt, Human
cugagauggaguuuugcucuug

SEQ ID NO: 759451 - RNA, 21 nt, Human
uccauaagagaccaucuccua

SEQ ID NO: 759452 - RNA, 23 nt, Human
gggaagugaggagccccucagcc

SEQ ID NO: 759453 - RNA, 22 nt, Human
augcaagagcaauaugguaugc

SEQ ID NO: 759454 - RNA, 21 nt, Human
ucugucucuccacugcccugc

SEQ ID NO: 759455 - RNA, 22 nt, Human
aagcuuuggaagggcaggguug

SEQ ID NO: 759456 - RNA, 22 nt, Human
aauugaaagaagugggauugcc

SEQ ID NO: 759457 - RNA, 22 nt, Human
aaagugcaccugcuucuucuug

SEQ ID NO: 759458 - RNA, 22 nt, Human
gaauuucaagcagugcaauguu

SEQ ID NO: 759459 - RNA, 22 nt, Human
aaaggcuccuucucccaugacc

SEQ ID NO: 759460 - RNA, 22 nt, Human
uagcagaggguagugccggggc

SEQ ID NO: 759461 - RNA, 22 nt, Human
gggaucaguuaaggagaguuuu

SEQ ID NO: 759462 - RNA, 22 nt, Human
acaucugaccauuacaagacau

SEQ ID NO: 759463 - RNA, 22 nt, Human
ugcccuguuaucuuggaagagu

SEQ ID NO: 759464 - RNA, 22 nt, Human
agucaauucuuuucaacucaag

SEQ ID NO: 759465 - RNA, 22 nt, Human
uggccacauccuuuccuuguca

SEQ ID NO: 759466 - RNA, 22 nt, Human
ccagcagcugcaaagccugggu

SEQ ID NO: 759467 - RNA, 20 nt, Human
ugcuuguaauaccugcuuca

SEQ ID NO: 759468 - RNA, 22 nt, Human
uagcagggguagauagagugug

SEQ ID NO: 759469 - RNA, 22 nt, Human
agcagcaggugaccucgaugcc

SEQ ID NO: 759470 - RNA, 22 nt, Human
aaucuucauaaaaaucuaguag

SEQ ID NO: 759471 - RNA, 22 nt, Human
cugcuuccaugcaauggcaguc

SEQ ID NO: 759472 - RNA, 20 nt, Human
aggaaaaggguggugguaga

SEQ ID NO: 759473 - RNA, 22 nt, Human
cggggaggcuucggauuaaagc

SEQ ID NO: 759474 - RNA, 22 nt, Human
uccacugguauccacagugggg

SEQ ID NO: 759475 - RNA, 17 nt, Human
cuggagccuccaacucc

SEQ ID NO: 759476 - RNA, 22 nt, Human
agaaguaugugagaaauuaucc

SEQ ID NO: 759477 - RNA, 22 nt, Human
gacaccagaagacauaagcaga

SEQ ID NO: 759478 - RNA, 22 nt, Human
gacaagacaccucucuccaucc

SEQ ID NO: 759479 - RNA, 22 nt, Human
uuaauaaacaggugcagcugaa

SEQ ID NO: 759480 - RNA, 22 nt, Human
aaaugggccuggaaagaggaug

SEQ ID NO: 759481 - RNA, 22 nt, Human
gugugaaaguaauugcgguuuu

SEQ ID NO: 759482 - RNA, 22 nt, Human
uuauuaguguugauauuaggau

SEQ ID NO: 759483 - RNA, 22 nt, Human
uuguauuucgaugcacguguag

SEQ ID NO: 759484 - RNA, 22 nt, Human
cuaaaggcucagcauucuuuuc

SEQ ID NO: 759485 - RNA, 22 nt, Human
uucugggagagaaagggccuug

SEQ ID NO: 759486 - RNA, 22 nt, Human
ccucuggcuguaccacuggcac

SEQ ID NO: 759487 - RNA, 22 nt, Human
gcacugggugugaggcagcguc

SEQ ID NO: 759488 - RNA, 22 nt, Human
ccagggcacguugggacaguac

SEQ ID NO: 759489 - RNA, 22 nt, Human
aaggcgcugggcuaaggcacca

SEQ ID NO: 759490 - RNA, 22 nt, Human
agcaccugcuaugugucaggga

SEQ ID NO: 759491 - RNA, 22 nt, Human
uguaugcuuguguauaauauaa

SEQ ID NO: 759492 - RNA, 22 nt, Human
gcugcuggagcuuugcagaagg

SEQ ID NO: 759493 - RNA, 22 nt, Human
agcuguuuguacuuagauagua

SEQ ID NO: 759494 - RNA, 22 nt, Human
auaugaauuuggcuggaaaggu

SEQ ID NO: 759495 - RNA, 22 nt, Human
gcccucagcaggaaagaucaac

SEQ ID NO: 759496 - RNA, 22 nt, Human
caggcugggacugaccccugcu

SEQ ID NO: 759497 - RNA, 22 nt, Human
uguggggcagcuagccggccug

SEQ ID NO: 759498 - RNA, 22 nt, Human
uucagcaacauuuguugagugc

SEQ ID NO: 759499 - RNA, 22 nt, Human
cugggcuggagugcaauggcgc

SEQ ID NO: 759500 - RNA, 22 nt, Human
ugggagaagcagcagccaagug

SEQ ID NO: 759501 - RNA, 22 nt, Human
ugaggugggcuuguggauuugc

SEQ ID NO: 759502 - RNA, 22 nt, Human
uaucuucucaguauaugggaug

SEQ ID NO: 759503 - RNA, 22 nt, Human
aggacuggcggucgguggggau

SEQ ID NO: 759504 - RNA, 22 nt, Human
auauacacuccacugauacagg

SEQ ID NO: 759505 - RNA, 22 nt, Human
acaguggagaagcaaaugcagu

SEQ ID NO: 759506 - RNA, 22 nt, Human
cugcagccuccuccagcuacgu

SEQ ID NO: 759507 - RNA, 19 nt, Human
ccaggcuuuaugcaaauac

SEQ ID NO: 759508 - RNA, 22 nt, Human
uugaagcaugguacuuguucaa

SEQ ID NO: 759509 - RNA, 22 nt, Human
uggaagcggugcuggcccaugg

SEQ ID NO: 759510 - RNA, 22 nt, Human
agauggagaccuuggaugaacu

SEQ ID NO: 759511 - RNA, 22 nt, Human
aaacagcaauuacuuuugcacc

SEQ ID NO: 759512 - RNA, 22 nt, Human
cuccuggcaguuccccuuguca

SEQ ID NO: 759513 - RNA, 22 nt, Human
uggcuuccuaggagcccgugcu

SEQ ID NO: 759514 - RNA, 22 nt, Human
guaaaugugaaugucauuuagc

SEQ ID NO: 759515 - RNA, 22 nt, Human
auucuacaaaagaacuggaucu

SEQ ID NO: 759516 - RNA, 22 nt, Human
aacaugcauguuauuuaucagu

SEQ ID NO: 759517 - RNA, 22 nt, Human
gaaggagggagcggcgcggauu

SEQ ID NO: 759518 - RNA, 22 nt, Human
uauaaagcugacucaugaaacu

SEQ ID NO: 759519 - RNA, 22 nt, Human
caauaacuuugauauuuugcgg

SEQ ID NO: 759520 - RNA, 22 nt, Human
ugcacacagaugguacaugcau

SEQ ID NO: 759521 - RNA, 20 nt, Human
ucucaggcccccuccuugcu

SEQ ID NO: 759522 - RNA, 23 nt, Human
ugggcaucuccucugugccaggc

SEQ ID NO: 759523 - RNA, 22 nt, Human
ggucaucugccuccaaagcacu

SEQ ID NO: 759524 - RNA, 22 nt, Human
uucuuuccccauggaguucgga

SEQ ID NO: 759525 - RNA, 22 nt, Human
acucacagcagacuaugaggga

SEQ ID NO: 759526 - RNA, 22 nt, Human
agggccagcacuccuggcagga

SEQ ID NO: 759527 - RNA, 22 nt, Human
uuauaucuuuuuacaucucucc

SEQ ID NO: 759528 - RNA, 22 nt, Human
agucacugaauaccuuaauguu

SEQ ID NO: 759529 - RNA, 22 nt, Human
ggcugaaaggugggaggauggc

SEQ ID NO: 759530 - RNA, 22 nt, Human
gucugcccuuccucuccacgau

SEQ ID NO: 759531 - RNA, 22 nt, Human
gcagggcagaccuccagccuau

SEQ ID NO: 759532 - RNA, 22 nt, Human
caaagugcugggauuagugcug

SEQ ID NO: 759533 - RNA, 17 nt, Human
cucacggaggaugaauc

SEQ ID NO: 759534 - RNA, 22 nt, Human
auauuacauaaacaugagugaa

SEQ ID NO: 759535 - RNA, 22 nt, Human
cguccauauucaugagcugagu

SEQ ID NO: 759536 - RNA, 22 nt, Human
ugacacaaaggaaagcauaauc

SEQ ID NO: 759537 - RNA, 22 nt, Human
ccugagaaaccuggugcaauua

SEQ ID NO: 759538 - RNA, 22 nt, Human
ccagacaugugcccuugaggaa

SEQ ID NO: 759539 - RNA, 20 nt, Human
cuccagccccugcccugguc

SEQ ID NO: 759540 - RNA, 22 nt, Human
ccaauccucauguucaacaacc

SEQ ID NO: 759541 - RNA, 22 nt, Human
gccucaaauguggagcacuauu

SEQ ID NO: 759542 - RNA, 22 nt, Human
aaagacugcaaaaacgcacaga

SEQ ID NO: 759543 - RNA, 22 nt, Human
ugucccagggaaggcccagcac

SEQ ID NO: 759544 - RNA, 22 nt, Human
uuugaaaauuagacacaggcua

SEQ ID NO: 759545 - RNA, 22 nt, Human
uuuugggugaauuugccaguua

SEQ ID NO: 759546 - RNA, 22 nt, Human
ggcuguguccuguaugauuauu

SEQ ID NO: 759547 - RNA, 22 nt, Human
ucacugaacucucauagagaaa

SEQ ID NO: 759548 - RNA, 22 nt, Human
uugccaggcuuguuucuaggcu

SEQ ID NO: 759549 - RNA, 22 nt, Human
aggcucugccaauuccuuccuc

SEQ ID NO: 759550 - RNA, 22 nt, Human
acuggcaguuugagaaugcauu

SEQ ID NO: 759551 - RNA, 22 nt, Human
gccacagcuccagucaggugac

SEQ ID NO: 759552 - RNA, 22 nt, Human
gcuuuagauagauuuagucuuu

SEQ ID NO: 759553 - RNA, 22 nt, Human
uauuuucaccuucucuggauau

SEQ ID NO: 759554 - RNA, 22 nt, Human
uggucugaacuaagacaguagu

SEQ ID NO: 759555 - RNA, 22 nt, Human
uuucacauuuuauacuuaagcc

SEQ ID NO: 759556 - RNA, 22 nt, Human
ugcuaugugacugcuucagauu

SEQ ID NO: 759557 - RNA, 22 nt, Human
ugugaauaaugccgcaauaaac

SEQ ID NO: 759558 - RNA, 17 nt, Human
gcccuggagccaggcua

SEQ ID NO: 759559 - RNA, 22 nt, Human
ucucugucugagccuggcagac

SEQ ID NO: 759560 - RNA, 22 nt, Human
uguguucaccaaaguguagaaa

SEQ ID NO: 759561 - RNA, 22 nt, Human
uuucacacuagucagaauacca

SEQ ID NO: 759562 - RNA, 23 nt, Human
ggaugggcaagccuagugccuac

SEQ ID NO: 759563 - RNA, 22 nt, Human
agcugaggacgugaagggcggc

SEQ ID NO: 759564 - RNA, 22 nt, Human
gacuuuccagguccugggcuau

SEQ ID NO: 759565 - RNA, 22 nt, Human
cccaggcagggacgugcucugg

SEQ ID NO: 759566 - RNA, 22 nt, Human
guuaauuugcagcuuucgagcu

SEQ ID NO: 759567 - RNA, 22 nt, Human
aacauguugcuuuaauaauauu

SEQ ID NO: 759568 - RNA, 22 nt, Human
caggaccaggcguucugggcug

SEQ ID NO: 759569 - RNA, 22 nt, Human
ccaagaugaucuuuacaguguu

SEQ ID NO: 759570 - RNA, 22 nt, Human
auuuccuauacaguuguccaua

SEQ ID NO: 759571 - RNA, 20 nt, Human
cagccuccacucacucagcu

SEQ ID NO: 759572 - RNA, 18 nt, Human
uguagagccagguuugcc

SEQ ID NO: 759573 - RNA, 22 nt, Human
augucuucuaagcucuaagcug

SEQ ID NO: 759574 - RNA, 22 nt, Human
uugcaaauuccaauccaauauu

SEQ ID NO: 759575 - RNA, 22 nt, Human
agaaugcuccagagcugaaaga

SEQ ID NO: 759576 - RNA, 22 nt, Human
cugggcuggauaauucuuugcu

SEQ ID NO: 759577 - RNA, 22 nt, Human
aaugagaaaacacagaggaggu

SEQ ID NO: 759578 - RNA, 22 nt, Human
augucagaagcuggaugacagc

SEQ ID NO: 759579 - RNA, 22 nt, Human
ucugaggcugucucugggcucc

SEQ ID NO: 759580 - RNA, 22 nt, Human
ugccuucaccaggccuucagcc

SEQ ID NO: 759581 - RNA, 22 nt, Human
gcagcguggggacaggagcuca

SEQ ID NO: 759582 - RNA, 22 nt, Human
aaaagagaauccuguacagaga

SEQ ID NO: 759583 - RNA, 22 nt, Human
agggccaggaucacagccaaga

SEQ ID NO: 759584 - RNA, 21 nt, Human
cccagagccuagggagggcac

SEQ ID NO: 759585 - RNA, 22 nt, Human
ccucagaccccugcugagcuuc

SEQ ID NO: 759586 - RNA, 22 nt, Human
ucuuacaagucacccgcuuucu

SEQ ID NO: 759587 - RNA, 22 nt, Human
gaaggcugcgaggggagugccg

SEQ ID NO: 759588 - RNA, 22 nt, Human
cuggcuguggucacagguaacu

SEQ ID NO: 759589 - RNA, 22 nt, Human
gaguuuagguucaugaacgagu

SEQ ID NO: 759590 - RNA, 22 nt, Human
caggcucacuguaaggucagcu

SEQ ID NO: 759591 - RNA, 22 nt, Human
uucucuaauggugaugauuaga

SEQ ID NO: 759592 - RNA, 22 nt, Human
acacuuggagcaacacuuaugg

SEQ ID NO: 759593 - RNA, 22 nt, Human
auauuacuuccugguauaaaau

SEQ ID NO: 759594 - RNA, 21 nt, Human
agacacagggguugcuggggu

SEQ ID NO: 759595 - RNA, 22 nt, Human
uagccucucuccuccacaaccu

SEQ ID NO: 759596 - RNA, 22 nt, Human
gugcauugcgaugcagacgacc

SEQ ID NO: 759597 - RNA, 22 nt, Human
aaaccucuccacuacaugacag

SEQ ID NO: 759598 - RNA, 22 nt, Human
cucuuuaacucccauucugucc

SEQ ID NO: 759599 - RNA, 18 nt, Human
guucaaggucaagagaga

SEQ ID NO: 759600 - RNA, 22 nt, Human
gagaaguuguguggauuuaaag

SEQ ID NO: 759601 - RNA, 22 nt, Human
ugugcgugauggaccgggccug

SEQ ID NO: 759602 - RNA, 22 nt, Human
cacugcaaccuccgccucuugg

SEQ ID NO: 759603 - RNA, 22 nt, Human
ucccgggcaggucgagcgagcc

SEQ ID NO: 759604 - RNA, 22 nt, Human
auuuguaauuucuuaucugugu

SEQ ID NO: 759605 - RNA, 22 nt, Human
ucuaaaguaugcuaauauguga

SEQ ID NO: 759606 - RNA, 22 nt, Human
aggacagcaguuggugagguuc

SEQ ID NO: 759607 - RNA, 22 nt, Human
acaguggaugugauguccaggu

SEQ ID NO: 759608 - RNA, 22 nt, Human
gcacccaguuugucucaggguu

SEQ ID NO: 759609 - RNA, 22 nt, Human
uuaaagaauagugccccuauug

SEQ ID NO: 759610 - RNA, 22 nt, Human
gagcagcuagauaaagcccuuc

SEQ ID NO: 759611 - RNA, 22 nt, Human
aauuuauaauaaauagggcuuu

SEQ ID NO: 759612 - RNA, 22 nt, Human
caccagcucuccaccagguuuc

SEQ ID NO: 759613 - RNA, 22 nt, Human
aacacugugcccacccuagucc

SEQ ID NO: 759614 - RNA, 22 nt, Human
cccaggguagcugagcuggcag

SEQ ID NO: 759615 - RNA, 17 nt, Human
ccucacagggaccagac

SEQ ID NO: 759616 - RNA, 22 nt, Human
gcagagugggagcccagggcug

SEQ ID NO: 759617 - RNA, 22 nt, Human
uguaggaauguuuuuaaguugg

SEQ ID NO: 759618 - RNA, 22 nt, Human
acucauugggaaagugcucucu

SEQ ID NO: 759619 - RNA, 22 nt, Human
uguuuaagccuguggugucauc

SEQ ID NO: 759620 - RNA, 22 nt, Human
ccuuuggcugcauagggaaggg

SEQ ID NO: 759621 - RNA, 22 nt, Human
uagaacagcauuuggcuauuaa

SEQ ID NO: 759622 - RNA, 22 nt, Human
cugcuggugcagaguggggcug

SEQ ID NO: 759623 - RNA, 19 nt, Human
cucuggagcagacacugga

SEQ ID NO: 759624 - RNA, 22 nt, Human
gcugaggcucaagucauggguc

SEQ ID NO: 759625 - RNA, 22 nt, Human
ggcugggcagcagcuguuaagc

SEQ ID NO: 759626 - RNA, 22 nt, Human
gggaagugagcuggaaucaagg

SEQ ID NO: 759627 - RNA, 22 nt, Human
uaucagaagacuuacaguaucg

SEQ ID NO: 759628 - RNA, 22 nt, Human
uagaggccugaaagaaugauca

SEQ ID NO: 759629 - RNA, 22 nt, Human
auagaucauguuaaaagcucca

SEQ ID NO: 759630 - RNA, 22 nt, Human
uggcuucacugcucaagugauu

SEQ ID NO: 759631 - RNA, 22 nt, Human
ugcugagguuucugacuaugga

SEQ ID NO: 759632 - RNA, 22 nt, Human
cagcucucuaaggucuugcuuu

SEQ ID NO: 759633 - RNA, 22 nt, Human
aaggcagauaagaauucagcaa

SEQ ID NO: 759634 - RNA, 22 nt, Human
aggcgcagacauacagggucug

SEQ ID NO: 759635 - RNA, 22 nt, Human
uagaugauuuucagucaaagca

SEQ ID NO: 759636 - RNA, 22 nt, Human
gugcuaggauuacaggcauggg

SEQ ID NO: 759637 - RNA, 22 nt, Human
aggaggcucucagguccucccc

SEQ ID NO: 759638 - RNA, 22 nt, Human
ccuggaugauccaugucaugga

SEQ ID NO: 759639 - RNA, 17 nt, Human
guccuggugugugagga

SEQ ID NO: 759640 - RNA, 22 nt, Human
gaguggggcguggauccagcgu

SEQ ID NO: 759641 - RNA, 22 nt, Human
uuauucacuucuuggucccuca

SEQ ID NO: 759642 - RNA, 22 nt, Human
ucugauuccagaaggggcauac

SEQ ID NO: 759643 - RNA, 22 nt, Human
aacuuuucauuccaaaggugcu

SEQ ID NO: 759644 - RNA, 22 nt, Human
uuguucauaaagacaguucaga

SEQ ID NO: 759645 - RNA, 22 nt, Human
aucuguccugugacagugggag

SEQ ID NO: 759646 - RNA, 22 nt, Human
uuuccuaggagauugaucacau

SEQ ID NO: 759647 - RNA, 22 nt, Human
aaagagaaaaagaucccggcuc

SEQ ID NO: 759648 - RNA, 23 nt, Human
aggccagcgcagacaccgagcac

SEQ ID NO: 759649 - RNA, 22 nt, Human
ggcugcuggauuguguaucugu

SEQ ID NO: 759650 - RNA, 22 nt, Human
acaugagauuagcucacccacu

SEQ ID NO: 759651 - RNA, 22 nt, Human
auacagaugcuugcucgugacu

SEQ ID NO: 759652 - RNA, 22 nt, Human
uggagcaggacugcugcccuca

SEQ ID NO: 759653 - RNA, 22 nt, Human
uaaugcucacccugcaucaggc

SEQ ID NO: 759654 - RNA, 22 nt, Human
ccucaguguguggauguuagag

SEQ ID NO: 759655 - RNA, 22 nt, Human
uagacuagaggaucagcaaggg

SEQ ID NO: 759656 - RNA, 22 nt, Human
gaugguuuaugauagaugggaa

SEQ ID NO: 759657 - RNA, 22 nt, Human
uguaugaaugggaaaaggaaac

SEQ ID NO: 759658 - RNA, 22 nt, Human
ccuuggauuuugugcccacgcc

SEQ ID NO: 759659 - RNA, 20 nt, Human
uacacuaaguaugaagugcu

SEQ ID NO: 759660 - RNA, 19 nt, Human
ccccaggguaggcuagggg

SEQ ID NO: 759661 - RNA, 22 nt, Human
uauaaaauggcaucagcuccaa

SEQ ID NO: 759662 - RNA, 22 nt, Human
ucuauguccuuucucccauucc

SEQ ID NO: 759663 - RNA, 22 nt, Human
gcaaagcauucuguggagucua

SEQ ID NO: 759664 - RNA, 22 nt, Human
gccccagaaggggaaagccugg

SEQ ID NO: 759665 - RNA, 22 nt, Human
aucugcuguguguaauggaaug

SEQ ID NO: 759666 - RNA, 22 nt, Human
gacuucaaaucaugcuaaaccu

SEQ ID NO: 759667 - RNA, 22 nt, Human
gugaggucaaagccuuggguau

SEQ ID NO: 759668 - RNA, 22 nt, Human
uaccaggcagcugcacagaggc

SEQ ID NO: 759669 - RNA, 22 nt, Human
uccaagcuuuccaugcccucac

SEQ ID NO: 759670 - RNA, 22 nt, Human
gacccaggcucgugggacggcu

SEQ ID NO: 759671 - RNA, 22 nt, Human
uacaacauguaaagugguuuaa

SEQ ID NO: 759672 - RNA, 20 nt, Human
uuucaguuaucuugaccuuc

SEQ ID NO: 759673 - RNA, 22 nt, Human
caggauaacagaaaauagcuga

SEQ ID NO: 759674 - RNA, 22 nt, Human
aauauauagaaguacccguugu

SEQ ID NO: 759675 - RNA, 22 nt, Human
uggcaggaagcaucuauagguc

SEQ ID NO: 759676 - RNA, 22 nt, Human
uguccuuguuccuaauguaaaa

SEQ ID NO: 759677 - RNA, 22 nt, Human
ugaucugguccuacugugggca

SEQ ID NO: 759678 - RNA, 23 nt, Human
aggcagugggggccacuuugcuu

SEQ ID NO: 759679 - RNA, 22 nt, Human
uccccuuggcuuggucaagagg

SEQ ID NO: 759680 - RNA, 22 nt, Human
agggacuuguguccuauguaug

SEQ ID NO: 759681 - RNA, 22 nt, Human
uucugcagcccaacaguaguuu

SEQ ID NO: 759682 - RNA, 22 nt, Human
cugcccaccccgaggcaggaag

SEQ ID NO: 759683 - RNA, 18 nt, Human
ccuucugacgcuugagaa

SEQ ID NO: 759684 - RNA, 22 nt, Human
agagucugaaugcucagaguug

SEQ ID NO: 759685 - RNA, 22 nt, Human
ucccugcccucagugcacccgg

SEQ ID NO: 759686 - RNA, 22 nt, Human
agagcacaggcucaccauuguu

SEQ ID NO: 759687 - RNA, 22 nt, Human
uuucuauuguaagucuccuaua

SEQ ID NO: 759688 - RNA, 22 nt, Human
cauuuauugaguggccacagug

SEQ ID NO: 759689 - RNA, 22 nt, Human
uggguagaggaauugggcuacc

SEQ ID NO: 759690 - RNA, 22 nt, Human
aaccuggaccuuuuggguauug

SEQ ID NO: 759691 - RNA, 22 nt, Human
ccaaggccaucagguagguccu

SEQ ID NO: 759692 - RNA, 22 nt, Human
ggucccaggaagugcggcggcg

SEQ ID NO: 759693 - RNA, 22 nt, Human
ucuauuagauuauucucaagga

SEQ ID NO: 759694 - RNA, 22 nt, Human
augcuuuauugcuucugggcac

SEQ ID NO: 759695 - RNA, 22 nt, Human
caaaugugacuuuugggcuucu

SEQ ID NO: 759696 - RNA, 22 nt, Human
agccagaaaggggcauuaucug

SEQ ID NO: 759697 - RNA, 22 nt, Human
uuccuguccgcaauggccuggg

SEQ ID NO: 759698 - RNA, 22 nt, Human
auuuaagaggcugcuagaguau

SEQ ID NO: 759699 - RNA, 22 nt, Human
auauuuuccgaacuugagguag

SEQ ID NO: 759700 - RNA, 22 nt, Human
gagagcaauggggacgggcagg

SEQ ID NO: 759701 - RNA, 21 nt, Human
aagcagcuuaauaaaguaugu

SEQ ID NO: 759702 - RNA, 22 nt, Human
uccuggagaagaggggcuugga

SEQ ID NO: 759703 - RNA, 22 nt, Human
ucacugcuucuuggagaauguc

SEQ ID NO: 759704 - RNA, 22 nt, Human
ugcauuuacgguacaacagcag

SEQ ID NO: 759705 - RNA, 22 nt, Human
ugcaugcagcauaugaggccuc

SEQ ID NO: 759706 - RNA, 22 nt, Human
ggagugaaguggcgcgaucucg

SEQ ID NO: 759707 - RNA, 19 nt, Human
gaggaggaaaacuagugua

SEQ ID NO: 759708 - RNA, 22 nt, Human
ugggcacuauggcucugugcac

SEQ ID NO: 759709 - RNA, 22 nt, Human
aggcugaugcuggcugaggcug

SEQ ID NO: 759710 - RNA, 22 nt, Human
aguuucuagccucacuguuuag

SEQ ID NO: 759711 - RNA, 22 nt, Human
aaagaucagaggauagcugagu

SEQ ID NO: 759712 - RNA, 19 nt, Human
uguggcugagcacuccuua

SEQ ID NO: 759713 - RNA, 22 nt, Human
cagauuucuuuagcaagcuaag

SEQ ID NO: 759714 - RNA, 22 nt, Human
cagugcuauaauccagugucgu

SEQ ID NO: 759715 - RNA, 22 nt, Human
aaguaacacauguuacuucugc

SEQ ID NO: 759716 - RNA, 19 nt, Human
ugagacagaagaugagccu

SEQ ID NO: 759717 - RNA, 22 nt, Human
ugaaacauuaggaaaucauuau

SEQ ID NO: 759718 - RNA, 22 nt, Human
agaagauuauuagagacuuugu

SEQ ID NO: 759719 - RNA, 22 nt, Human
acagugggacagugacggggga

SEQ ID NO: 759720 - RNA, 22 nt, Human
uuugauacuuugugcaauuucu

SEQ ID NO: 759721 - RNA, 22 nt, Human
cagcuugugcaaagguccuggg

SEQ ID NO: 759722 - RNA, 22 nt, Human
ccaggcagagggaauagcaagu

SEQ ID NO: 759723 - RNA, 22 nt, Human
gagauauguuagaaagcuauug

SEQ ID NO: 759724 - RNA, 22 nt, Human
ucauugcaccccagucccagcu

SEQ ID NO: 759725 - RNA, 22 nt, Human
gaggucugggcuugggccuggu

SEQ ID NO: 759726 - RNA, 22 nt, Human
cucccagguuccgacgccucuu

SEQ ID NO: 759727 - RNA, 22 nt, Human
cucugugggggagaggcagcug

SEQ ID NO: 759728 - RNA, 22 nt, Human
gcuguuucugaguagcuaggcu

SEQ ID NO: 759729 - RNA, 22 nt, Human
gugcaaaaguaauugcuguuuu

SEQ ID NO: 759730 - RNA, 22 nt, Human
agacacagcaauaacuacuguu

SEQ ID NO: 759731 - RNA, 22 nt, Human
ugcaugaaauauuuucuguagg

SEQ ID NO: 759732 - RNA, 22 nt, Human
uugggcugaucuguggaagaag

SEQ ID NO: 759733 - RNA, 22 nt, Human
uccuuggcaugccgucuucucc

SEQ ID NO: 759734 - RNA, 22 nt, Human
cuauauuucuuggcuuuaaaca

SEQ ID NO: 759735 - RNA, 19 nt, Human
gccucacaggucucaggcc

SEQ ID NO: 759736 - RNA, 22 nt, Human
uuauucuguagaaccuaguaca

SEQ ID NO: 759737 - RNA, 22 nt, Human
ugaaggagcucaggagauaguc

SEQ ID NO: 759738 - RNA, 20 nt, Human
aguguaugaaucuggauggg

SEQ ID NO: 759739 - RNA, 22 nt, Human
caucauuuguucacuugauucc

SEQ ID NO: 759740 - RNA, 22 nt, Human
gagcacagcugucuugcaagcu

SEQ ID NO: 759741 - RNA, 22 nt, Human
ccuuaaaagaacuaucucuucu

SEQ ID NO: 759742 - RNA, 22 nt, Human
ugcagaggcccagcgguucuuc

SEQ ID NO: 759743 - RNA, 22 nt, Human
cuacagacccaccuuggaagaa

SEQ ID NO: 759744 - RNA, 22 nt, Human
uauuugcugaaucugauucaga

SEQ ID NO: 759745 - RNA, 22 nt, Human
uucuuuaucaguuacucauagg

SEQ ID NO: 759746 - RNA, 22 nt, Human
uuaaagcugagcccucagaagc

SEQ ID NO: 759747 - RNA, 20 nt, Human
ucugcaaacaaguuuuagac

SEQ ID NO: 759748 - RNA, 20 nt, Human
uucuggaggcuacaagucug

SEQ ID NO: 759749 - RNA, 22 nt, Human
aauguguacuuuuucaugcuca

SEQ ID NO: 759750 - RNA, 22 nt, Human
cgcucuggagaauaguagcuuu

SEQ ID NO: 759751 - RNA, 22 nt, Human
auggauaaucaugaacuuugag

SEQ ID NO: 759752 - RNA, 22 nt, Human
uaucacccuacauaagaaauaa

SEQ ID NO: 759753 - RNA, 22 nt, Human
auaaucuggucuuuguaugagu

SEQ ID NO: 759754 - RNA, 22 nt, Human
cugggcuuugaagccaggcugc

SEQ ID NO: 759755 - RNA, 22 nt, Human
ucuggcccuauggcauguaccu

SEQ ID NO: 759756 - RNA, 22 nt, Human
aguaaacagaaagcaagaugau

SEQ ID NO: 759757 - RNA, 22 nt, Human
uuccugaaugcuguugugcugu

SEQ ID NO: 759758 - RNA, 22 nt, Human
gcuuaauucuggcucaguuucc

SEQ ID NO: 759759 - RNA, 22 nt, Human
cacaguauuuguuuuucugagu

SEQ ID NO: 759760 - RNA, 22 nt, Human
uaucuaaaggauuuaauuuagu

SEQ ID NO: 759761 - RNA, 22 nt, Human
uggcugaguaaguugugauaug

SEQ ID NO: 759762 - RNA, 22 nt, Human
cacagggcaccaguuggccauc

SEQ ID NO: 759763 - RNA, 22 nt, Human
ggaagacugcauggcauaguga

SEQ ID NO: 759764 - RNA, 20 nt, Human
agugucuggauuuuguaacc

SEQ ID NO: 759765 - RNA, 21 nt, Human
ugacaggcacccuggcuguga

SEQ ID NO: 759766 - RNA, 21 nt, Human
cugugacucccugggcaaucc

SEQ ID NO: 759767 - RNA, 22 nt, Human
cagugugacuucugagcugcca

SEQ ID NO: 759768 - RNA, 22 nt, Human
ggaggggagguccagcugaucu

SEQ ID NO: 759769 - RNA, 22 nt, Human
uagaaucuggaaggggcuauuc

SEQ ID NO: 759770 - RNA, 20 nt, Human
uuauuucaguugcuagauug

SEQ ID NO: 759771 - RNA, 22 nt, Human
cacagcuuagaaaagaagccau

SEQ ID NO: 759772 - RNA, 22 nt, Human
agcuuuauauuuaaugaauucu

SEQ ID NO: 759773 - RNA, 22 nt, Human
agaggaggcucugggaucgucc

SEQ ID NO: 759774 - RNA, 22 nt, Human
uuaaacaccaagugcaaaccac

SEQ ID NO: 759775 - RNA, 22 nt, Human
guagcuuccagaaagugucuuu

SEQ ID NO: 759776 - RNA, 21 nt, Human
agaggcccucggacugggcgu

SEQ ID NO: 759777 - RNA, 22 nt, Human
ggaucugggguagagcaguggg

SEQ ID NO: 759778 - RNA, 22 nt, Human
cccaggaggcagagguugcagu

SEQ ID NO: 759779 - RNA, 22 nt, Human
ggcugggcauccauccaugaga

SEQ ID NO: 759780 - RNA, 22 nt, Human
ugggacuugccucgagggcugc

SEQ ID NO: 759781 - RNA, 22 nt, Human
uuauucugagaguugaaguaau

SEQ ID NO: 759782 - RNA, 22 nt, Human
uggccuggggaccugugagacc

SEQ ID NO: 759783 - RNA, 22 nt, Human
gcacagagugggugagaugugg

SEQ ID NO: 759784 - RNA, 22 nt, Human
ugggagaagcauggggugcaga

SEQ ID NO: 759785 - RNA, 22 nt, Human
aucacagauugugaauaacuau

SEQ ID NO: 759786 - RNA, 22 nt, Human
uuccaagucacccuuaggguca

SEQ ID NO: 759787 - RNA, 22 nt, Human
auguccaggaucuauccccaga

SEQ ID NO: 759788 - RNA, 22 nt, Human
uguggcagauuuuauaaauugc

SEQ ID NO: 759789 - RNA, 22 nt, Human
aggcagaucaguacaggguuaa

SEQ ID NO: 759790 - RNA, 22 nt, Human
gaaggcccagcuugaaugcugc

SEQ ID NO: 759791 - RNA, 22 nt, Human
cauuacaaccccaaauuacaaa

SEQ ID NO: 759792 - RNA, 22 nt, Human
cauuuaaugcacggauguagcc

SEQ ID NO: 759793 - RNA, 22 nt, Human
gugcaugugcguugacugucca

SEQ ID NO: 759794 - RNA, 22 nt, Human
cucacuguccaacaggcuuuac

SEQ ID NO: 759795 - RNA, 22 nt, Human
uggacagggcagagaccgaguc

SEQ ID NO: 759796 - RNA, 22 nt, Human
aaaccugucugauuauggagac

SEQ ID NO: 759797 - RNA, 22 nt, Human
agaggcucuggugcagcaugca

SEQ ID NO: 759798 - RNA, 22 nt, Human
agaugcuucaguguuuaauuua

SEQ ID NO: 759799 - RNA, 22 nt, Human
aaucacuuguaaggaauucaau

SEQ ID NO: 759800 - RNA, 22 nt, Human
gugugcgccgacacagccaggu

SEQ ID NO: 759801 - RNA, 17 nt, Human
gcuaggagagggaggag

SEQ ID NO: 759802 - RNA, 22 nt, Human
agucagaguucuuggggagaca

SEQ ID NO: 759803 - RNA, 22 nt, Human
uuuggcacauucugucacauuc

SEQ ID NO: 759804 - RNA, 22 nt, Human
gcagcaggucugucaaugucau

SEQ ID NO: 759805 - RNA, 22 nt, Human
caggcacaaugagcgccaucuu

SEQ ID NO: 759806 - RNA, 22 nt, Human
uccaggagauucauuaggucau

SEQ ID NO: 759807 - RNA, 22 nt, Human
uggugucuuggaaguaggugcu

SEQ ID NO: 759808 - RNA, 18 nt, Human
aagcugcccucaggcagg

SEQ ID NO: 759809 - RNA, 22 nt, Human
uuugagaagauaggggaauacu

SEQ ID NO: 759810 - RNA, 22 nt, Human
uaaaugaaaggguuuaauuuau

SEQ ID NO: 759811 - RNA, 22 nt, Human
gcauaucaugacuucuaucuua

SEQ ID NO: 759812 - RNA, 22 nt, Human
aggguauguuuuaggcugaguu

SEQ ID NO: 759813 - RNA, 22 nt, Human
cuagcaggucaaaccagcugau

SEQ ID NO: 759814 - RNA, 22 nt, Human
aggggaugauccucccgcagcg

SEQ ID NO: 759815 - RNA, 22 nt, Human
ggcagcugugaagugccucaca

SEQ ID NO: 759816 - RNA, 22 nt, Human
acacaguaugacauuggcagag

SEQ ID NO: 759817 - RNA, 22 nt, Human
gucacccugcuggcuguucagc

SEQ ID NO: 759818 - RNA, 22 nt, Human
uacacacaugcauuugccuuau

SEQ ID NO: 759819 - RNA, 16 nt, Human
cagcccaggggcgggc

SEQ ID NO: 759820 - RNA, 22 nt, Human
acuuguucauugaguacauaug

SEQ ID NO: 759821 - RNA, 22 nt, Human
aguggcagacagagacaguacc

SEQ ID NO: 759822 - RNA, 22 nt, Human
gaaucucaaauuaagaauuuua

SEQ ID NO: 759823 - RNA, 22 nt, Human
cagugcaauguuaaauaggaaa

SEQ ID NO: 759824 - RNA, 22 nt, Human
cagagcagugaggaguugugua

SEQ ID NO: 759825 - RNA, 22 nt, Human
ccauuuggaggucauuaggaca

SEQ ID NO: 759826 - RNA, 22 nt, Human
gccuggagcccaguguggggcu

SEQ ID NO: 759827 - RNA, 22 nt, Human
agggcagagggugccucaccug

SEQ ID NO: 759828 - RNA, 22 nt, Human
caaaguaucaacucccacacug

SEQ ID NO: 759829 - RNA, 22 nt, Human
cucauuuacucaucugcaaaac

SEQ ID NO: 759830 - RNA, 22 nt, Human
acugagugggagguuuguguga

SEQ ID NO: 759831 - RNA, 22 nt, Human
uucugcaguguuaacaauguca

SEQ ID NO: 759832 - RNA, 22 nt, Human
ccuucugagcuucaauuucagu

SEQ ID NO: 759833 - RNA, 17 nt, Human
caggcuccuuccagauu

SEQ ID NO: 759834 - RNA, 22 nt, Human
ccagccccuauccucgcuccac

SEQ ID NO: 759835 - RNA, 23 nt, Human
uggcuuuauucacauaucugacc

SEQ ID NO: 759836 - RNA, 19 nt, Human
agaaauagccuuccuuguc

SEQ ID NO: 759837 - RNA, 22 nt, Human
uuagcacuuugauucaugcaga

SEQ ID NO: 759838 - RNA, 22 nt, Human
agguaggguuaauggagauaua

SEQ ID NO: 759839 - RNA, 22 nt, Human
ugacaauacagagagagcaaaa

SEQ ID NO: 759840 - RNA, 22 nt, Human
aauccacuuugugccccucucu

SEQ ID NO: 759841 - RNA, 22 nt, Human
ccuuuucuaggaugcuuuauag

SEQ ID NO: 759842 - RNA, 22 nt, Human
gugaggucuuugggaggugauu

SEQ ID NO: 759843 - RNA, 22 nt, Human
ucuaagaauacucauaucuucu

SEQ ID NO: 759844 - RNA, 22 nt, Human
ccuuggcugugcugcccuuugc

SEQ ID NO: 759845 - RNA, 22 nt, Human
cugccugugccaccgccucauu

SEQ ID NO: 759846 - RNA, 22 nt, Human
uuucucugaguuguuacaaaac

SEQ ID NO: 759847 - RNA, 22 nt, Human
uucauugaaggagggacuugcu

SEQ ID NO: 759848 - RNA, 22 nt, Human
aggccaaguagcuagcauugaa

SEQ ID NO: 759849 - RNA, 22 nt, Human
aggacacaugcacacccugcgu

SEQ ID NO: 759850 - RNA, 20 nt, Human
uucuuuguuccuuacauuug

SEQ ID NO: 759851 - RNA, 22 nt, Human
cacacagcucaggggcacugcc

SEQ ID NO: 759852 - RNA, 22 nt, Human
uggaugagaaacucuggugacu

SEQ ID NO: 759853 - RNA, 22 nt, Human
agcuugccucccccucuuagga

SEQ ID NO: 759854 - RNA, 22 nt, Human
ccuggaaagcugcccugugaca

SEQ ID NO: 759855 - RNA, 22 nt, Human
ucugaggaagcagcaggaagug

SEQ ID NO: 759856 - RNA, 22 nt, Human
gauauaaauuaaucaagugcaa

SEQ ID NO: 759857 - RNA, 22 nt, Human
auagacaacacuuauuauuccu

SEQ ID NO: 759858 - RNA, 22 nt, Human
uuucuacauguuuucuauugaa

SEQ ID NO: 759859 - RNA, 22 nt, Human
uuuccagagcugagaaggcuug

SEQ ID NO: 759860 - RNA, 22 nt, Human
gcaagauguuaacauagggaga

SEQ ID NO: 759861 - RNA, 21 nt, Human
auggcucaggccaucaaugga

SEQ ID NO: 759862 - RNA, 22 nt, Human
uacuucugccuuagagaacacu

SEQ ID NO: 759863 - RNA, 22 nt, Human
gugcugcugccagcaggauccu

SEQ ID NO: 759864 - RNA, 22 nt, Human
augcccugcugccaucuggccg

SEQ ID NO: 759865 - RNA, 22 nt, Human
uacagcccaagaaguuuauacg

SEQ ID NO: 759866 - RNA, 22 nt, Human
gacagacuaaauggcuguagga

SEQ ID NO: 759867 - RNA, 22 nt, Human
gggaaggcagugucugguugaa

SEQ ID NO: 759868 - RNA, 22 nt, Human
guaugaaguaagauauuguuca

SEQ ID NO: 759869 - RNA, 22 nt, Human
gaagaagccucuguggaucuga

SEQ ID NO: 759870 - RNA, 22 nt, Human
aaagcagagaucauggcuugua

SEQ ID NO: 759871 - RNA, 22 nt, Human
gcgggccaccuuggagagcgcu

SEQ ID NO: 759872 - RNA, 22 nt, Human
aaaugucuuuaucucauguaac

SEQ ID NO: 759873 - RNA, 22 nt, Human
uuuggucucugugcauccuccu

SEQ ID NO: 759874 - RNA, 23 nt, Human
gcucauccacggagaggggcucc

SEQ ID NO: 759875 - RNA, 22 nt, Human
ucucaggaguagugggauccau

SEQ ID NO: 759876 - RNA, 22 nt, Human
gagggccucugugggugcucac

SEQ ID NO: 759877 - RNA, 23 nt, Human
agggaaaguaguaauggccuuug

SEQ ID NO: 759878 - RNA, 22 nt, Human
gacacaggaaaagcuccagccc

SEQ ID NO: 759879 - RNA, 21 nt, Human
agggcagauuagcuguaagag

SEQ ID NO: 759880 - RNA, 22 nt, Human
ggccucucauucucccuggucc

SEQ ID NO: 759881 - RNA, 22 nt, Human
cugcccugcuugaugacagcga

SEQ ID NO: 759882 - RNA, 22 nt, Human
uugcaagacacuuggaagcaca

SEQ ID NO: 759883 - RNA, 23 nt, Human
aggauggguggcaauagaaagac

SEQ ID NO: 759884 - RNA, 20 nt, Human
ucccuggaggugguggcauc

SEQ ID NO: 759885 - RNA, 22 nt, Human
agaauaagccugacgaaaccua

SEQ ID NO: 759886 - RNA, 22 nt, Human
aacagcagggggaccugcuggu

SEQ ID NO: 759887 - RNA, 22 nt, Human
accagcugaguucucggauggu

SEQ ID NO: 759888 - RNA, 19 nt, Human
agaaaucucgagauuuguu

SEQ ID NO: 759889 - RNA, 22 nt, Human
gauucuggcaaaauccuggcuu

SEQ ID NO: 759890 - RNA, 22 nt, Human
ggguuaaagcaggaagcaucuu

SEQ ID NO: 759891 - RNA, 22 nt, Human
cugcugugagugguucuugccu

SEQ ID NO: 759892 - RNA, 22 nt, Human
cugcuuugaggggcucuguaua

SEQ ID NO: 759893 - RNA, 22 nt, Human
auuuccauuuucagccauuacu

SEQ ID NO: 759894 - RNA, 22 nt, Human
auuuagaaccccuuccaaccug

SEQ ID NO: 759895 - RNA, 22 nt, Human
cagcagcucacugaauaaugac

SEQ ID NO: 759896 - RNA, 22 nt, Human
gaacacuugcuguuaauaagug

SEQ ID NO: 759897 - RNA, 22 nt, Human
ucgagucauguucucccauuaa

SEQ ID NO: 759898 - RNA, 22 nt, Human
acaguccuguugucaaagcaau

SEQ ID NO: 759899 - RNA, 22 nt, Human
cccagcucuaggagugguggca

SEQ ID NO: 759900 - RNA, 22 nt, Human
ucacaauaugggugugggaacu

SEQ ID NO: 759901 - RNA, 22 nt, Human
ccugaauaggcucugcucaaaa

SEQ ID NO: 759902 - RNA, 22 nt, Human
uuuggaauguaguuuaaucauc

SEQ ID NO: 759903 - RNA, 22 nt, Human
acuuccaggguagaggggaaga

SEQ ID NO: 759904 - RNA, 22 nt, Human
ggaagagggaaccacgacugua

SEQ ID NO: 759905 - RNA, 22 nt, Human
auuuaugauagcugcauuaaag

SEQ ID NO: 759906 - RNA, 22 nt, Human
ucaauacauacaauguauagug

SEQ ID NO: 759907 - RNA, 22 nt, Human
auucuuuccagacacugauugc

SEQ ID NO: 759908 - RNA, 22 nt, Human
cugagaauguuuucugauugau

SEQ ID NO: 759909 - RNA, 22 nt, Human
auguuuccauuuucuuguauca

SEQ ID NO: 759910 - RNA, 22 nt, Human
uguauuccaaaaugcugaggau

SEQ ID NO: 759911 - RNA, 22 nt, Human
gcccaagaucuggagcugcagg

SEQ ID NO: 759912 - RNA, 22 nt, Human
acccagauaaaugacagggcuu

SEQ ID NO: 759913 - RNA, 22 nt, Human
ucugcugcugaccaacacugug

SEQ ID NO: 759914 - RNA, 22 nt, Human
uccagggagauggcagaggcug

SEQ ID NO: 759915 - RNA, 22 nt, Human
gcuucuaaccugcuuccuguag

SEQ ID NO: 759916 - RNA, 22 nt, Human
aacaaugcuugccaagugugau

SEQ ID NO: 759917 - RNA, 22 nt, Human
cucauauugcugguggucuaag

SEQ ID NO: 759918 - RNA, 22 nt, Human
cugagguccucagagggaaagg

SEQ ID NO: 759919 - RNA, 21 nt, Human
acagccuugugauggagacag

SEQ ID NO: 759920 - RNA, 22 nt, Human
uaaggcaccauaauauauuuaa

SEQ ID NO: 759921 - RNA, 22 nt, Human
auuuccuaacagaggcaacagu

SEQ ID NO: 759922 - RNA, 23 nt, Human
aaggucacagaacuuagcaagcc

SEQ ID NO: 759923 - RNA, 22 nt, Human
augugucuggcauggaaagugu

SEQ ID NO: 759924 - RNA, 22 nt, Human
guggggcuuccuggggcaaguu

SEQ ID NO: 759925 - RNA, 22 nt, Human
cagggccaguucucgcagcagu

SEQ ID NO: 759926 - RNA, 22 nt, Human
ucugacagggccaaacaugaca

SEQ ID NO: 759927 - RNA, 22 nt, Human
uccugaggcccuguuagggucu

SEQ ID NO: 759928 - RNA, 18 nt, Human
uggcuucuugagcuaaca

SEQ ID NO: 759929 - RNA, 22 nt, Human
ggcucuguaaagugacaccugc

SEQ ID NO: 759930 - RNA, 22 nt, Human
aaguuuaucccucucacaguua

SEQ ID NO: 759931 - RNA, 22 nt, Human
aguggcagaucucuggucugga

SEQ ID NO: 759932 - RNA, 22 nt, Human
uccuguuucaacccuuacacug

SEQ ID NO: 759933 - RNA, 19 nt, Human
ggaccagcuuucaggaggc

SEQ ID NO: 759934 - RNA, 22 nt, Human
uacacauccauguuuugacuuu

SEQ ID NO: 759935 - RNA, 22 nt, Human
aagccaguggcuucucccugcu

SEQ ID NO: 759936 - RNA, 22 nt, Human
aaaaaugcuuggacuuaauaaa

SEQ ID NO: 759937 - RNA, 22 nt, Human
cuguuuaucuaggaguugcagg

SEQ ID NO: 759938 - RNA, 22 nt, Human
ucagggaaccucuccuguuucu

SEQ ID NO: 759939 - RNA, 22 nt, Human
gaagcauauagguacugaacua

SEQ ID NO: 759940 - RNA, 22 nt, Human
aggcucugacccaugggaccca

SEQ ID NO: 759941 - RNA, 22 nt, Human
agcuaggaaauugaggcugaga

SEQ ID NO: 759942 - RNA, 22 nt, Human
uggagcagcaucacuuugagcu

SEQ ID NO: 759943 - RNA, 22 nt, Human
acagagaugggaacauucaggu

SEQ ID NO: 759944 - RNA, 22 nt, Human
agguggcagaugggggugcucg

SEQ ID NO: 759945 - RNA, 22 nt, Human
uuccuucuuuuacaccauaaau

SEQ ID NO: 759946 - RNA, 22 nt, Human
caguuuaguguugcauuuggag

SEQ ID NO: 759947 - RNA, 22 nt, Human
cccagcccacgguccugggugg

SEQ ID NO: 759948 - RNA, 22 nt, Human
ccccgcccugcgcggggauaac

SEQ ID NO: 759949 - RNA, 22 nt, Human
uggccaggccucuuggugccca

SEQ ID NO: 759950 - RNA, 22 nt, Human
aucucaaaugauuacaccaagc

SEQ ID NO: 759951 - RNA, 22 nt, Human
uagcaucaugaucagaacuguu

SEQ ID NO: 759952 - RNA, 22 nt, Human
aacagcgucuuuccagcuguuc

SEQ ID NO: 759953 - RNA, 22 nt, Human
cugcagugaaaucaggaagcaa

SEQ ID NO: 759954 - RNA, 22 nt, Human
ggggccuuuucugaauguggaa

SEQ ID NO: 759955 - RNA, 22 nt, Human
uauauacuuucuuccuggguag

SEQ ID NO: 759956 - RNA, 22 nt, Human
uguuuauucauggcuaaugaaa

SEQ ID NO: 759957 - RNA, 19 nt, Human
gaggggaggaauugacaag

SEQ ID NO: 759958 - RNA, 22 nt, Human
ccugaccuccaaguggcucugg

SEQ ID NO: 759959 - RNA, 22 nt, Human
cgaggaagaaguuugagucaag

SEQ ID NO: 759960 - RNA, 22 nt, Human
ugggacaguuguccuccacucu

SEQ ID NO: 759961 - RNA, 22 nt, Human
aggccugccuggagccuggcug

SEQ ID NO: 759962 - RNA, 20 nt, Human
cuguuaaaagguaugaauuc

SEQ ID NO: 759963 - RNA, 22 nt, Human
cugugcuggagaugggccagag

SEQ ID NO: 759964 - RNA, 22 nt, Human
cugggcugcaguuccugguccu

SEQ ID NO: 759965 - RNA, 22 nt, Human
cuacauuucauccagggagagc

SEQ ID NO: 759966 - RNA, 23 nt, Human
agggcuccuuguugauuagcauu

SEQ ID NO: 759967 - RNA, 22 nt, Human
gugagcuguuggaguggcagag

SEQ ID NO: 759968 - RNA, 22 nt, Human
gccagcuggaaaucugcuugaa

SEQ ID NO: 759969 - RNA, 22 nt, Human
ccauggaucuggaucuaucuuu

SEQ ID NO: 759970 - RNA, 22 nt, Human
uugcuggcuugaagauagagga

SEQ ID NO: 759971 - RNA, 22 nt, Human
uccugagaggugugaggugcag

SEQ ID NO: 759972 - RNA, 22 nt, Human
cuuguuaaaaugccgauucuga

SEQ ID NO: 759973 - RNA, 22 nt, Human
ggcuuaagaaaugucuaguuuu

SEQ ID NO: 759974 - RNA, 22 nt, Human
auucuuucauauaaaggcucag

SEQ ID NO: 759975 - RNA, 22 nt, Human
uacagcuaggcaaaaaugacau

SEQ ID NO: 759976 - RNA, 22 nt, Human
auacauuagugaacaaaagaga

SEQ ID NO: 759977 - RNA, 22 nt, Human
cagcuucuauuuaucuuugugu

SEQ ID NO: 759978 - RNA, 22 nt, Human
ggcagucauuuaaucccugcau

SEQ ID NO: 759979 - RNA, 22 nt, Human
ugaagccauuacuguguuaggg

SEQ ID NO: 759980 - RNA, 22 nt, Human
caggcugucugaauggaggccc

SEQ ID NO: 759981 - RNA, 23 nt, Human
uccugaggaauggcaucucacau

SEQ ID NO: 759982 - RNA, 22 nt, Human
cagcuggaggagcagcuuccag

SEQ ID NO: 759983 - RNA, 22 nt, Human
cagccacucucagacaguccca

SEQ ID NO: 759984 - RNA, 22 nt, Human
ucugcagauuuaucagcagcug

SEQ ID NO: 759985 - RNA, 22 nt, Human
ccuuggguuccaagucacugaa

SEQ ID NO: 759986 - RNA, 22 nt, Human
acggcuucuugacuguggguug

SEQ ID NO: 759987 - RNA, 22 nt, Human
uccagccuaauguucuucccac

SEQ ID NO: 759988 - RNA, 22 nt, Human
agagggggugucagcacugcag

SEQ ID NO: 759989 - RNA, 17 nt, Human
aggcauggucuggggug

SEQ ID NO: 759990 - RNA, 22 nt, Human
aaauguucccaauaugaagcug

SEQ ID NO: 759991 - RNA, 22 nt, Human
agcugccaaguuggaguagcaa

SEQ ID NO: 759992 - RNA, 22 nt, Human
acaaugcuguugagacauucuu

SEQ ID NO: 759993 - RNA, 22 nt, Human
agaagcuggaggaagacuaagc

SEQ ID NO: 759994 - RNA, 22 nt, Human
caguccagcccccugcuaaaag

SEQ ID NO: 759995 - RNA, 22 nt, Human
ucagcugagcuccagcucauag

SEQ ID NO: 759996 - RNA, 22 nt, Human
acaggguugaagagcauaaagu

SEQ ID NO: 759997 - RNA, 22 nt, Human
aaguuucuguaugcucuucugu

SEQ ID NO: 759998 - RNA, 22 nt, Human
uacuaaauaguuuaauuccuca

SEQ ID NO: 759999 - RNA, 22 nt, Human
aggaaacaggcagccuuugaac

SEQ ID NO: 760000 - RNA, 22 nt, Human
ggcgaggccgggacaggcugga

SEQ ID NO: 760001 - RNA, 21 nt, Human
ccuuuuugcuuauggacagac

SEQ ID NO: 760002 - RNA, 23 nt, Human
gaggccuggcccugccacaucuc

SEQ ID NO: 760003 - RNA, 22 nt, Human
gcugcuguguuggccacugcuu

SEQ ID NO: 760004 - RNA, 22 nt, Human
auacauacauguaugcacauac

SEQ ID NO: 760005 - RNA, 22 nt, Human
auuuccaauuucauccaugucc

SEQ ID NO: 760006 - RNA, 22 nt, Human
ucagggcaagauugguuaauaa

SEQ ID NO: 760007 - RNA, 22 nt, Human
ggccaccuuccaguugccugca

SEQ ID NO: 760008 - RNA, 22 nt, Human
agguggaaauggcuuuccuagg

SEQ ID NO: 760009 - RNA, 22 nt, Human
acaauagacccaugacacauac

SEQ ID NO: 760010 - RNA, 22 nt, Human
ccuuggcuggaauuacucuggg

SEQ ID NO: 760011 - RNA, 22 nt, Human
gcaaauuaaccaaucaugcucg

SEQ ID NO: 760012 - RNA, 22 nt, Human
acaguauaacuccaugccaccc

SEQ ID NO: 760013 - RNA, 22 nt, Human
gagacacacauucuggagagaa

SEQ ID NO: 760014 - RNA, 22 nt, Human
auuguauuuaggagaaaagggu

SEQ ID NO: 760015 - RNA, 22 nt, Human
aaaugcacaaaguaaguguaau

SEQ ID NO: 760016 - RNA, 18 nt, Human
uggaggaaucacaauggc

SEQ ID NO: 760017 - RNA, 22 nt, Human
gguagcugcagcaggcuggcaa

SEQ ID NO: 760018 - RNA, 22 nt, Human
aggugaaguugaggaggcagaa

SEQ ID NO: 760019 - RNA, 22 nt, Human
ccagcugcccaagaggcauccu

SEQ ID NO: 760020 - RNA, 22 nt, Human
gugaagaccagggaacgcuggc

SEQ ID NO: 760021 - RNA, 22 nt, Human
accuuggaaaugcccauugccu

SEQ ID NO: 760022 - RNA, 19 nt, Human
gagaaagcaggcacagcac

SEQ ID NO: 760023 - RNA, 22 nt, Human
uggagcaugagagucuuuagcu

SEQ ID NO: 760024 - RNA, 22 nt, Human
uugcuuccuugagcuggucuga

SEQ ID NO: 760025 - RNA, 22 nt, Human
gacagcagccacagggagaggg

SEQ ID NO: 760026 - RNA, 22 nt, Human
uuuagcagaucuauguauguga

SEQ ID NO: 760027 - RNA, 22 nt, Human
ccuggcucugcgugcagcuccg

SEQ ID NO: 760028 - RNA, 22 nt, Human
ccugcagcuuugccuccugaac

SEQ ID NO: 760029 - RNA, 22 nt, Human
ggcaggcucagcagccaaggag

SEQ ID NO: 760030 - RNA, 22 nt, Human
aggagagcuggugucuggaauc

SEQ ID NO: 760031 - RNA, 22 nt, Human
auagaucaaugagcaauuuaau

SEQ ID NO: 760032 - RNA, 23 nt, Human
aagcuuccuugacuggccccuag

SEQ ID NO: 760033 - RNA, 22 nt, Human
uuguauuagcuguaaauuuucu

SEQ ID NO: 760034 - RNA, 22 nt, Human
ugggauauaguaaaacaugaau

SEQ ID NO: 760035 - RNA, 21 nt, Human
augugaaaccuuccacgcuga

SEQ ID NO: 760036 - RNA, 22 nt, Human
uuauuauagauuaugcaagauu

SEQ ID NO: 760037 - RNA, 22 nt, Human
ucagugugaguaccaugcucag

SEQ ID NO: 760038 - RNA, 22 nt, Human
agaguaauuucugcugaaaagg

SEQ ID NO: 760039 - RNA, 22 nt, Human
gagaggagucccuaucacaguu

SEQ ID NO: 760040 - RNA, 22 nt, Human
gugcagccauuugcaugcuucc

SEQ ID NO: 760041 - RNA, 22 nt, Human
ucuucagcagggccucucugag

SEQ ID NO: 760042 - RNA, 22 nt, Human
uggcuuucccccagcccaguug

SEQ ID NO: 760043 - RNA, 22 nt, Human
auguaugcaugcuacaguuuuc

SEQ ID NO: 760044 - RNA, 22 nt, Human
cagcuggcuccaccucugggcu

SEQ ID NO: 760045 - RNA, 20 nt, Human
gaguccaggggccuguagca

SEQ ID NO: 760046 - RNA, 22 nt, Human
gagugugugacuucacuuuagc

SEQ ID NO: 760047 - RNA, 22 nt, Human
gaucauuaacaaccuuacccuu

SEQ ID NO: 760048 - RNA, 22 nt, Human
gacagcagggaaaguccagacc

SEQ ID NO: 760049 - RNA, 22 nt, Human
cuggcucuuggcuagggagagu

SEQ ID NO: 760050 - RNA, 22 nt, Human
gccugggacugcagauccccag

SEQ ID NO: 760051 - RNA, 22 nt, Human
ucaggagcagcuguaggaaggg

SEQ ID NO: 760052 - RNA, 22 nt, Human
aguaugaaucuuucagaccgua

SEQ ID NO: 760053 - RNA, 22 nt, Human
ugcuguccuguuuuggaguaau

SEQ ID NO: 760054 - RNA, 22 nt, Human
cacccaggcuggaaugcaaugg

SEQ ID NO: 760055 - RNA, 22 nt, Human
gagaaggcuucuuuuccucuga

SEQ ID NO: 760056 - RNA, 22 nt, Human
uuuggugauagugcagagaaau

SEQ ID NO: 760057 - RNA, 22 nt, Human
uuggcucauuaaagaugauaau

SEQ ID NO: 760058 - RNA, 22 nt, Human
uuuugaagaagaugggaauuua

SEQ ID NO: 760059 - RNA, 22 nt, Human
ggcucugcugguaagaugccuc

SEQ ID NO: 760060 - RNA, 22 nt, Human
uguuuuaagggucaacugucac

SEQ ID NO: 760061 - RNA, 22 nt, Human
aguccuggguucugguguuuug

SEQ ID NO: 760062 - RNA, 22 nt, Human
aauucacaauuauguugggaga

SEQ ID NO: 760063 - RNA, 21 nt, Human
aauugaagauguggagccauu

SEQ ID NO: 760064 - RNA, 23 nt, Human
aggcugccagaaauuggguaagg

SEQ ID NO: 760065 - RNA, 22 nt, Human
ugcaauuuuaauacauuagagg

SEQ ID NO: 760066 - RNA, 22 nt, Human
acuaggaacgggguuugcacuc

SEQ ID NO: 760067 - RNA, 22 nt, Human
uaacagaauagcagaaacagaa

SEQ ID NO: 760068 - RNA, 22 nt, Human
cacugggcguguccugggugag

SEQ ID NO: 760069 - RNA, 22 nt, Human
agcuucuccaucugcccagaga

SEQ ID NO: 760070 - RNA, 22 nt, Human
uaauguuuccagucuaugaugg

SEQ ID NO: 760071 - RNA, 22 nt, Human
acacagguuaaaauaauuggga

SEQ ID NO: 760072 - RNA, 22 nt, Human
aucaggaacguucauggacugu

SEQ ID NO: 760073 - RNA, 22 nt, Human
cuucaauugccaccagcuagca

SEQ ID NO: 760074 - RNA, 22 nt, Human
cagagccucucagaggucagac

SEQ ID NO: 760075 - RNA, 22 nt, Human
agugcugaagacuggcuaggga

SEQ ID NO: 760076 - RNA, 22 nt, Human
agcuggccagaugucccaaaga

SEQ ID NO: 760077 - RNA, 22 nt, Human
uccaaagcaucugagugugcau

SEQ ID NO: 760078 - RNA, 22 nt, Human
ccugggccuugaccucgugggc

SEQ ID NO: 760079 - RNA, 22 nt, Human
ggcccagcacagugcuuggggg

SEQ ID NO: 760080 - RNA, 17 nt, Human
ugcucuguggucuuuua

SEQ ID NO: 760081 - RNA, 22 nt, Human
ccuggccagcgccggcugcucg

SEQ ID NO: 760082 - RNA, 22 nt, Human
uucuguguggguagcuccuguu

SEQ ID NO: 760083 - RNA, 22 nt, Human
ucagaggcagcugauguucugu

SEQ ID NO: 760084 - RNA, 22 nt, Human
ugugccuggagucccugaggag

SEQ ID NO: 760085 - RNA, 22 nt, Human
aaggagucucagcugggccuga

SEQ ID NO: 760086 - RNA, 22 nt, Human
gcagcccaauggacugagacag

SEQ ID NO: 760087 - RNA, 17 nt, Human
uccuggcucugccacug

SEQ ID NO: 760088 - RNA, 22 nt, Human
gaaccccaacuuauaagacaga

SEQ ID NO: 760089 - RNA, 20 nt, Human
cagaggcaaggagacuugga

SEQ ID NO: 760090 - RNA, 22 nt, Human
aagaauguucuuguagucauga

SEQ ID NO: 760091 - RNA, 22 nt, Human
gaguuggcuguucgaagguagc

SEQ ID NO: 760092 - RNA, 22 nt, Human
uuguggaagcccuaugagagac

SEQ ID NO: 760093 - RNA, 22 nt, Human
cuguucugaacugccugcaugc

SEQ ID NO: 760094 - RNA, 22 nt, Human
acuucuuuucaaaucaugcaaa

SEQ ID NO: 760095 - RNA, 22 nt, Human
gugcucugaucugucugacauc

SEQ ID NO: 760096 - RNA, 22 nt, Human
aaaugguaguagcauuccauau

SEQ ID NO: 760097 - RNA, 22 nt, Human
uggcucauauugagugauuucu

SEQ ID NO: 760098 - RNA, 22 nt, Human
gaauccgugugauguggacuag

SEQ ID NO: 760099 - RNA, 23 nt, Human
auugaccuguuuagucucucccu

SEQ ID NO: 760100 - RNA, 22 nt, Human
agugcuccugaagcuugaggca

SEQ ID NO: 760101 - RNA, 22 nt, Human
ucuccaaggcccuacucuauuu

SEQ ID NO: 760102 - RNA, 22 nt, Human
cgccugggaguccacaccugcu

SEQ ID NO: 760103 - RNA, 22 nt, Human
aaaguguuuacauugcuauaag

SEQ ID NO: 760104 - RNA, 22 nt, Human
agucugugaaaagauaggaagu

SEQ ID NO: 760105 - RNA, 21 nt, Human
gaccacagggaaggucuugca

SEQ ID NO: 760106 - RNA, 22 nt, Human
uuaaaaccuagagaucagacag

SEQ ID NO: 760107 - RNA, 22 nt, Human
acaggcaauauauaaauuauga

SEQ ID NO: 760108 - RNA, 22 nt, Human
ucugcagcgugcaggcuggugc

SEQ ID NO: 760109 - RNA, 22 nt, Human
aggcacugacagauucuguguc

SEQ ID NO: 760110 - RNA, 22 nt, Human
aaagcaauugugguuuuuguca

SEQ ID NO: 760111 - RNA, 22 nt, Human
ccuuucuguguugcccuauuug

SEQ ID NO: 760112 - RNA, 22 nt, Human
uaggaaaugcugucuuauugua

SEQ ID NO: 760113 - RNA, 22 nt, Human
aggcccuguuaugagccacugu

SEQ ID NO: 760114 - RNA, 22 nt, Human
agcagagcugcaguggccugcu

SEQ ID NO: 760115 - RNA, 22 nt, Human
ugguguguuagagcucagggca

SEQ ID NO: 760116 - RNA, 22 nt, Human
uuggcaccucccuaggaagaag

SEQ ID NO: 760117 - RNA, 23 nt, Human
uuucaguugagaaugcacggacc

SEQ ID NO: 760118 - RNA, 22 nt, Human
uggcucuggccaccgggagggc

SEQ ID NO: 760119 - RNA, 22 nt, Human
cugaggcauguuacaggacaua

SEQ ID NO: 760120 - RNA, 22 nt, Human
gauuuuauauggcauacugugg

SEQ ID NO: 760121 - RNA, 22 nt, Human
cucuguccuugcacaguuccua

SEQ ID NO: 760122 - RNA, 22 nt, Human
uucaucauugccagucuuuaaa

SEQ ID NO: 760123 - RNA, 22 nt, Human
ugcuggcauuucaggacucacc

SEQ ID NO: 760124 - RNA, 22 nt, Human
ucaaaugcacguagagaaaaua

SEQ ID NO: 760125 - RNA, 22 nt, Human
ugugagagagugcauuugcaua

SEQ ID NO: 760126 - RNA, 22 nt, Human
cugcagcagaauaaucugcuca

SEQ ID NO: 760127 - RNA, 22 nt, Human
cugaagcuuaguuuacgcucca

SEQ ID NO: 760128 - RNA, 22 nt, Human
uggcugggcccccaccugccuc

SEQ ID NO: 760129 - RNA, 22 nt, Human
ugauuuaggaaacagcuacagg

SEQ ID NO: 760130 - RNA, 22 nt, Human
uagcacugagucuagcuuugga

SEQ ID NO: 760131 - RNA, 22 nt, Human
cacagcagggcauggcuguugu

SEQ ID NO: 760132 - RNA, 22 nt, Human
cagccucugacaccacagucgu

SEQ ID NO: 760133 - RNA, 22 nt, Human
ugauucugucuccuucacuccg

SEQ ID NO: 760134 - RNA, 22 nt, Human
ccagccuggguguuagaagaca

SEQ ID NO: 760135 - RNA, 22 nt, Human
ucagcaguguaguuuaucauuc

SEQ ID NO: 760136 - RNA, 22 nt, Human
ccagagaccagaacauggggau

SEQ ID NO: 760137 - RNA, 22 nt, Human
agugcaugcgcuugggaggggu

SEQ ID NO: 760138 - RNA, 22 nt, Human
ggcgggagauggggccguucag

SEQ ID NO: 760139 - RNA, 23 nt, Human
cuucaugagagcccugaggaaaa

SEQ ID NO: 760140 - RNA, 22 nt, Human
agaauuguaagcaauuugauua

SEQ ID NO: 760141 - RNA, 22 nt, Human
gaagccacagagauuguggggg

SEQ ID NO: 760142 - RNA, 22 nt, Human
aacauugcaaauaagcuugcag

SEQ ID NO: 760143 - RNA, 22 nt, Human
cuccccagcucgcgggugacgg

SEQ ID NO: 760144 - RNA, 22 nt, Human
uggcucagaaggcugccuucac

SEQ ID NO: 760145 - RNA, 22 nt, Human
gcagagugagauaugaacccag

SEQ ID NO: 760146 - RNA, 22 nt, Human
auuaucuugauaaaauggcagu

SEQ ID NO: 760147 - RNA, 22 nt, Human
uagagcagauagugaaacagaa

SEQ ID NO: 760148 - RNA, 22 nt, Human
uaauugucccugcaguuaggau

SEQ ID NO: 760149 - RNA, 22 nt, Human
agagcccuggagggcagucccg

SEQ ID NO: 760150 - RNA, 23 nt, Human
ggcagauuugguuuguuuuaaua

SEQ ID NO: 760151 - RNA, 22 nt, Human
gagcagagucuauuuccacacu

SEQ ID NO: 760152 - RNA, 22 nt, Human
augagggaggcaaggagaugcu

SEQ ID NO: 760153 - RNA, 22 nt, Human
gcccugccugccgguguggguc

SEQ ID NO: 760154 - RNA, 22 nt, Human
gucaugugaauaaguguggggu

SEQ ID NO: 760155 - RNA, 21 nt, Human
agagcacagguggacaaugcu

SEQ ID NO: 760156 - RNA, 22 nt, Human
cacagcugaccacccugcuccc

SEQ ID NO: 760157 - RNA, 22 nt, Human
aaagagaaacuuagaagccuga

SEQ ID NO: 760158 - RNA, 22 nt, Human
cggggugggaauagaccugucu

SEQ ID NO: 760159 - RNA, 22 nt, Human
ggcaggcuccaagcauccuaug

SEQ ID NO: 760160 - RNA, 22 nt, Human
aauaacagagaaggguggcuuc

SEQ ID NO: 760161 - RNA, 22 nt, Human
ggcagucagugugguucauaaa

SEQ ID NO: 760162 - RNA, 22 nt, Human
uugugauacugagcuuggcauu

SEQ ID NO: 760163 - RNA, 22 nt, Human
ucucaaaucaaacuuugagcuu

SEQ ID NO: 760164 - RNA, 22 nt, Human
auagcuuuuugucauagagucu

SEQ ID NO: 760165 - RNA, 22 nt, Human
cuguuuccugucuucucacuau

SEQ ID NO: 760166 - RNA, 22 nt, Human
cuacaaauauaaaacacagaua

SEQ ID NO: 760167 - RNA, 22 nt, Human
caugugaauuccaaagcuaggu

SEQ ID NO: 760168 - RNA, 22 nt, Human
acagauggagcuacuagguaaa

SEQ ID NO: 760169 - RNA, 22 nt, Human
cagggagggaggaaaauuugcu

SEQ ID NO: 760170 - RNA, 23 nt, Human
uuguaaaacagugugacgguucc

SEQ ID NO: 760171 - RNA, 22 nt, Human
uuuggggcucagcaggcuguuu

SEQ ID NO: 760172 - RNA, 19 nt, Human
gucagcaccauggacaggg

SEQ ID NO: 760173 - RNA, 22 nt, Human
uuacaggggacauuggggacau

SEQ ID NO: 760174 - RNA, 22 nt, Human
cuccaggccauggcugcggagg

SEQ ID NO: 760175 - RNA, 21 nt, Human
agcaggugcuguuggaggaaa

SEQ ID NO: 760176 - RNA, 20 nt, Human
aaguuuaggggaaagugaca

SEQ ID NO: 760177 - RNA, 22 nt, Human
augaugguaaauucaguauccg

SEQ ID NO: 760178 - RNA, 20 nt, Human
uagggagauaugcucuuuuc

SEQ ID NO: 760179 - RNA, 22 nt, Human
uccacccccagacagcugguga

SEQ ID NO: 760180 - RNA, 22 nt, Human
ugcaauaauguaugucacuccc

SEQ ID NO: 760181 - RNA, 22 nt, Human
augcagcugacauuuucauguu

SEQ ID NO: 760182 - RNA, 22 nt, Human
cuuauuuguacuaauaaaucug

SEQ ID NO: 760183 - RNA, 19 nt, Human
ccuagagggaaggcaggac

SEQ ID NO: 760184 - RNA, 22 nt, Human
uguguaaagcuuguuccagaaa

SEQ ID NO: 760185 - RNA, 22 nt, Human
cagguccagucacuggucugca

SEQ ID NO: 760186 - RNA, 22 nt, Human
ucucucagaacugcagcugcag

SEQ ID NO: 760187 - RNA, 22 nt, Human
uucucuguggauugggugagag

SEQ ID NO: 760188 - RNA, 22 nt, Human
gcagguguggaguggggugagc

SEQ ID NO: 760189 - RNA, 22 nt, Human
guucuuuugguagagugugcau

SEQ ID NO: 760190 - RNA, 22 nt, Human
cuggggagugaaauucuuaaau

SEQ ID NO: 760191 - RNA, 22 nt, Human
ucugcugugggucuauauuuua

SEQ ID NO: 760192 - RNA, 22 nt, Human
aguacacucaagaaaccgguaa

SEQ ID NO: 760193 - RNA, 22 nt, Human
uugcauuugaucuuggguucuc

SEQ ID NO: 760194 - RNA, 22 nt, Human
ugucucuuuggguuccucuugg

SEQ ID NO: 760195 - RNA, 22 nt, Human
ccaugagccaggcugaggaagc

SEQ ID NO: 760196 - RNA, 22 nt, Human
aauuuguggccacauuguggaa

SEQ ID NO: 760197 - RNA, 22 nt, Human
uggcaaaguaucugucccagcu

SEQ ID NO: 760198 - RNA, 22 nt, Human
aacaauaauugcgguucucuau

SEQ ID NO: 760199 - RNA, 22 nt, Human
uccaccaggcuccauguucagu

SEQ ID NO: 760200 - RNA, 22 nt, Human
cagagacaggaaucagcugcag

SEQ ID NO: 760201 - RNA, 22 nt, Human
ucaggcugugggcacuggccau

SEQ ID NO: 760202 - RNA, 22 nt, Human
cauuuacuuaaaucuuuacaag

SEQ ID NO: 760203 - RNA, 22 nt, Human
ucugucccugagagcucaggag

SEQ ID NO: 760204 - RNA, 22 nt, Human
aaucuuuuucacaagaaagcac

SEQ ID NO: 760205 - RNA, 22 nt, Human
uagcagcuguggaggggcugug

SEQ ID NO: 760206 - RNA, 19 nt, Human
ggcauccagaacuaccagu

SEQ ID NO: 760207 - RNA, 22 nt, Human
aggaccugcuaaugugccaagu

SEQ ID NO: 760208 - RNA, 22 nt, Human
aaugacagagauagaagggaug

SEQ ID NO: 760209 - RNA, 22 nt, Human
uuuguguuuaauacaaggaccu

SEQ ID NO: 760210 - RNA, 22 nt, Human
ucaggagaacuuccuucuaccc

SEQ ID NO: 760211 - RNA, 23 nt, Human
agcacuuguaucuuacuaaaaug

SEQ ID NO: 760212 - RNA, 22 nt, Human
gcagcuggcucagagagguggg

SEQ ID NO: 760213 - RNA, 22 nt, Human
ucagaacacuuucucuacugac

SEQ ID NO: 760214 - RNA, 22 nt, Human
cccagcucugcagaccugcccu

SEQ ID NO: 760215 - RNA, 22 nt, Human
acaaagugcacaagaugagaac

SEQ ID NO: 760216 - RNA, 22 nt, Human
gaauggcugaaugucuuaaauu

SEQ ID NO: 760217 - RNA, 22 nt, Human
gccuucaggaaaucaguccuug

SEQ ID NO: 760218 - RNA, 22 nt, Human
uuucucucuuaaggaguuuaaa

SEQ ID NO: 760219 - RNA, 22 nt, Human
uauuucuguaacucagggucug

SEQ ID NO: 760220 - RNA, 22 nt, Human
caugucuguguacacaugcaca

SEQ ID NO: 760221 - RNA, 22 nt, Human
uccucuuccuucuguccaaaug

SEQ ID NO: 760222 - RNA, 22 nt, Human
agcagcucgggcuacagagggg

SEQ ID NO: 760223 - RNA, 22 nt, Human
ugaaguacccguuuuuauugca

SEQ ID NO: 760224 - RNA, 22 nt, Human
gaaguagcauguugcugccaga

SEQ ID NO: 760225 - RNA, 22 nt, Human
guggccaggagaccuugggcau

SEQ ID NO: 760226 - RNA, 22 nt, Human
ucuugauuuugugaauaaguug

SEQ ID NO: 760227 - RNA, 22 nt, Human
gcugagcaggguggggaaaggc

SEQ ID NO: 760228 - RNA, 22 nt, Human
uuagcuuuugagaaugauuucu

SEQ ID NO: 760229 - RNA, 22 nt, Human
ggaggcuccacugcucuuccug

SEQ ID NO: 760230 - RNA, 22 nt, Human
cuguacagcaaguucaccuugg

SEQ ID NO: 760231 - RNA, 22 nt, Human
ggaggccaaggagggcggauca

SEQ ID NO: 760232 - RNA, 22 nt, Human
ucaggcugaggucaucugcauc

SEQ ID NO: 760233 - RNA, 22 nt, Human
gagggugacaguucuggucucu

SEQ ID NO: 760234 - RNA, 22 nt, Human
cuguggaaaauuuguauguaau

SEQ ID NO: 760235 - RNA, 22 nt, Human
auaaaaguucaagagaguacag

SEQ ID NO: 760236 - RNA, 22 nt, Human
aaguacacaucguuggccccga

SEQ ID NO: 760237 - RNA, 22 nt, Human
ccaggguaccccaagggcaggu

SEQ ID NO: 760238 - RNA, 22 nt, Human
uucuauugggcagcauugcuuc

SEQ ID NO: 760239 - RNA, 22 nt, Human
aggccugcugucuugaggccaa

SEQ ID NO: 760240 - RNA, 20 nt, Human
aucaggaagagagacugacc

SEQ ID NO: 760241 - RNA, 19 nt, Human
cuguggcugaccucuggcc

SEQ ID NO: 760242 - RNA, 22 nt, Human
aacaugaugacauuguaagcuu

SEQ ID NO: 760243 - RNA, 22 nt, Human
gcucagccgaacuucagagcag

SEQ ID NO: 760244 - RNA, 21 nt, Human
ggcagagaagcuggaaguugg

SEQ ID NO: 760245 - RNA, 23 nt, Human
gcugggcuuacucuuucagugag

SEQ ID NO: 760246 - RNA, 22 nt, Human
cuaucucuuguuuuccugaagc

SEQ ID NO: 760247 - RNA, 22 nt, Human
aguccugaugcucuggcaggag

SEQ ID NO: 760248 - RNA, 22 nt, Human
uuccugagacccucacagugau

SEQ ID NO: 760249 - RNA, 22 nt, Human
ccauugaauccucagcugcuag

SEQ ID NO: 760250 - RNA, 22 nt, Human
ugaauacacuaaaaaucacuuu

SEQ ID NO: 760251 - RNA, 22 nt, Human
cauggcugaaauucuucgcuug

SEQ ID NO: 760252 - RNA, 22 nt, Human
augcuuccuaaccauggccgug

SEQ ID NO: 760253 - RNA, 22 nt, Human
ccagggcucuaugaggguggag

SEQ ID NO: 760254 - RNA, 22 nt, Human
auaaggcaagcugucaguuugu

SEQ ID NO: 760255 - RNA, 22 nt, Human
agaaagcuccccaugagaugau

SEQ ID NO: 760256 - RNA, 22 nt, Human
aggcuggugcuuccuagggcag

SEQ ID NO: 760257 - RNA, 22 nt, Human
ugcaacaggagaguucagggca

SEQ ID NO: 760258 - RNA, 22 nt, Human
cagggcugaacugagcuuguga

SEQ ID NO: 760259 - RNA, 22 nt, Human
ccuguacaagcucuuggugaca

SEQ ID NO: 760260 - RNA, 22 nt, Human
ccaggaagacacaugcucaucc

SEQ ID NO: 760261 - RNA, 22 nt, Human
uccuccacgauggcacaccugg

SEQ ID NO: 760262 - RNA, 22 nt, Human
gaguaacauaccaaaauucaca

SEQ ID NO: 760263 - RNA, 22 nt, Human
gcaggaacuggagcuggauguu

SEQ ID NO: 760264 - RNA, 22 nt, Human
ucacaugcuugaggaaagaaaa

SEQ ID NO: 760265 - RNA, 22 nt, Human
cauggcuugucuugucuucuga

SEQ ID NO: 760266 - RNA, 23 nt, Human
ggcuugagcuggaacagcuuggu

SEQ ID NO: 760267 - RNA, 23 nt, Human
ugucuggggcgccagaagagaga

SEQ ID NO: 760268 - RNA, 22 nt, Human
uuggagagugauauucagaugc

SEQ ID NO: 760269 - RNA, 22 nt, Human
ugcugagggagggguuuuccag

SEQ ID NO: 760270 - RNA, 22 nt, Human
uauaguuaguuucauaaucaug

SEQ ID NO: 760271 - RNA, 22 nt, Human
gaagacacuaaacuggggcuuc

SEQ ID NO: 760272 - RNA, 22 nt, Human
ccuaaggaccagggcuuccagc

SEQ ID NO: 760273 - RNA, 22 nt, Human
gggucuggagggcagcccuucu

SEQ ID NO: 760274 - RNA, 22 nt, Human
gauuuuaauuauaggagguccu

SEQ ID NO: 760275 - RNA, 22 nt, Human
cacuggaggucaguggagcacu

SEQ ID NO: 760276 - RNA, 22 nt, Human
gcugcccucccagggcaagcuu

SEQ ID NO: 760277 - RNA, 22 nt, Human
uuucuuucucguaaacuuaguu

SEQ ID NO: 760278 - RNA, 22 nt, Human
aagcacaauuuaggacugaaau

SEQ ID NO: 760279 - RNA, 19 nt, Human
ggucagagagauccaggcu

SEQ ID NO: 760280 - RNA, 22 nt, Human
gcuggcucccagaggccccagc

SEQ ID NO: 760281 - RNA, 20 nt, Human
uaggcagagcugugcagccu

SEQ ID NO: 760282 - RNA, 22 nt, Human
ucuuuuuauauugacaaaaggu

SEQ ID NO: 760283 - RNA, 23 nt, Human
agcugggcaaggauccgggcucc

SEQ ID NO: 760284 - RNA, 22 nt, Human
ucagcucuuaacccucuggccu

SEQ ID NO: 760285 - RNA, 22 nt, Human
uuggccuucugguguucauuuu

SEQ ID NO: 760286 - RNA, 22 nt, Human
uucagggcagcuagaaccagga

SEQ ID NO: 760287 - RNA, 22 nt, Human
augaaagaugauuuaaaguacu

SEQ ID NO: 760288 - RNA, 22 nt, Human
agagaccuuucuccugccuuuc

SEQ ID NO: 760289 - RNA, 22 nt, Human
cucagagcccaggguacacccg

SEQ ID NO: 760290 - RNA, 22 nt, Human
ucugggaaccaaagggugcuua

SEQ ID NO: 760291 - RNA, 22 nt, Human
auuccacagaggacuccgauug

SEQ ID NO: 760292 - RNA, 22 nt, Human
ccagggaagauuagaagccacu

SEQ ID NO: 760293 - RNA, 22 nt, Human
ucuuuguuuguacuguuagaau

SEQ ID NO: 760294 - RNA, 22 nt, Human
agaugcuuaaguuuucagugua

SEQ ID NO: 760295 - RNA, 18 nt, Human
cagcugaggaccaaacug

SEQ ID NO: 760296 - RNA, 22 nt, Human
ugucugaaucucgguuuccuca

SEQ ID NO: 760297 - RNA, 22 nt, Human
guucuucagcccucagguccua

SEQ ID NO: 760298 - RNA, 22 nt, Human
uagagcuuggacugcauuuucg

SEQ ID NO: 760299 - RNA, 22 nt, Human
aaaugacagaguaagcuguuua

SEQ ID NO: 760300 - RNA, 22 nt, Human
agcagaaagcuuauuuugacug

SEQ ID NO: 760301 - RNA, 17 nt, Human
agugaaauuuacauugc

SEQ ID NO: 760302 - RNA, 22 nt, Human
cuccucuggguccugguggcca

SEQ ID NO: 760303 - RNA, 22 nt, Human
gcagggccagggcucaggcugu

SEQ ID NO: 760304 - RNA, 22 nt, Human
uuuagugccugggccaguucca

SEQ ID NO: 760305 - RNA, 22 nt, Human
ccaaaauaacagcccaauucac

SEQ ID NO: 760306 - RNA, 22 nt, Human
ugccaggcuccggaacgacagu

SEQ ID NO: 760307 - RNA, 22 nt, Human
cugccuggcuaaacucaagucg

SEQ ID NO: 760308 - RNA, 22 nt, Human
caugccuguaaucccagcucuu

SEQ ID NO: 760309 - RNA, 22 nt, Human
aacaguaugugagauuuacaca

SEQ ID NO: 760310 - RNA, 22 nt, Human
ggggcugacgggcauguggcuu

SEQ ID NO: 760311 - RNA, 22 nt, Human
aacaucaguauucucaucugua

SEQ ID NO: 760312 - RNA, 22 nt, Human
aagggugaagggugguggccua

SEQ ID NO: 760313 - RNA, 22 nt, Human
agugucaacugucuacagggag

SEQ ID NO: 760314 - RNA, 22 nt, Human
uuugcagugauucuugcaguga

SEQ ID NO: 760315 - RNA, 22 nt, Human
uuccuuuagugucauauacuuu

SEQ ID NO: 760316 - RNA, 22 nt, Human
ugaggcucacgaacagaagacu

SEQ ID NO: 760317 - RNA, 19 nt, Human
ugacugccucaggggugga

SEQ ID NO: 760318 - RNA, 22 nt, Human
acgcccggucuccauaguuuuu

SEQ ID NO: 760319 - RNA, 22 nt, Human
cauuuaauccauagaggaaugu

SEQ ID NO: 760320 - RNA, 22 nt, Human
cacugcugauuucauaggcagg

SEQ ID NO: 760321 - RNA, 22 nt, Human
uuucacaagacagcuacuguug

SEQ ID NO: 760322 - RNA, 22 nt, Human
aggggcuggaguucgagguuac

SEQ ID NO: 760323 - RNA, 22 nt, Human
agugcagaguacauuuguggca

SEQ ID NO: 760324 - RNA, 22 nt, Human
caaaccaguaggaagucuauua

SEQ ID NO: 760325 - RNA, 22 nt, Human
aggcuucuaggguuggcagcgg

SEQ ID NO: 760326 - RNA, 22 nt, Human
ccaggagggugguuacucaauc

SEQ ID NO: 760327 - RNA, 22 nt, Human
cuuauuuugcugaugacccagg

SEQ ID NO: 760328 - RNA, 22 nt, Human
gcaccagcugcaggguggcuga

SEQ ID NO: 760329 - RNA, 22 nt, Human
uguuuacuccagcugauggaac

SEQ ID NO: 760330 - RNA, 22 nt, Human
ccacaguaaagaaacaacuucg

SEQ ID NO: 760331 - RNA, 22 nt, Human
uuccaggaagcaguuagcagcc

SEQ ID NO: 760332 - RNA, 22 nt, Human
cuggccagagguuccucugccc

SEQ ID NO: 760333 - RNA, 22 nt, Human
cccacucccugcacgccugccg

SEQ ID NO: 760334 - RNA, 22 nt, Human
ccagcaagccaggucuguggcu

SEQ ID NO: 760335 - RNA, 22 nt, Human
aaggcagagauuagcagaauga

SEQ ID NO: 760336 - RNA, 22 nt, Human
gugggggacccaggugcugucc

SEQ ID NO: 760337 - RNA, 22 nt, Human
ucuguucuuggugcagcuggga

SEQ ID NO: 760338 - RNA, 22 nt, Human
uuucucuccccaaguggaauug

SEQ ID NO: 760339 - RNA, 22 nt, Human
guaggagcucauggggccagga

SEQ ID NO: 760340 - RNA, 22 nt, Human
aauaacuugaagaucucuucca

SEQ ID NO: 760341 - RNA, 22 nt, Human
uccuucagaaccugugauggaa

SEQ ID NO: 760342 - RNA, 22 nt, Human
aagucagagaugccaaagauua

SEQ ID NO: 760343 - RNA, 22 nt, Human
gcagcugcaagcacuucuggca

SEQ ID NO: 760344 - RNA, 22 nt, Human
uucucagguagugcugaugcug

SEQ ID NO: 760345 - RNA, 19 nt, Human
guuucauuaagauaggaaa

SEQ ID NO: 760346 - RNA, 22 nt, Human
aggguccauguuuccaguuaau

SEQ ID NO: 760347 - RNA, 22 nt, Human
ccaggaggggucucugucuccc

SEQ ID NO: 760348 - RNA, 22 nt, Human
ugaccugacaugaauuaaaaac

SEQ ID NO: 760349 - RNA, 22 nt, Human
uuucacagaggaggaagcugag

SEQ ID NO: 760350 - RNA, 21 nt, Human
ucccacagcgccagcuccugu

SEQ ID NO: 760351 - RNA, 21 nt, Human
ugcaauuuagacuugaacauu

SEQ ID NO: 760352 - RNA, 17 nt, Human
aauagcugcucagagag

SEQ ID NO: 760353 - RNA, 22 nt, Human
ccuuuaaguccucuuuuauauu

SEQ ID NO: 760354 - RNA, 22 nt, Human
cagcagaaauggauuuugagau

SEQ ID NO: 760355 - RNA, 22 nt, Human
cauuuauucagcucagucgguu

SEQ ID NO: 760356 - RNA, 22 nt, Human
gccaggggugcccacccaagga

SEQ ID NO: 760357 - RNA, 22 nt, Human
gaagccuugaacugcaaacccc

SEQ ID NO: 760358 - RNA, 22 nt, Human
gcucaccucgcugcaggugggu

SEQ ID NO: 760359 - RNA, 19 nt, Human
cuuugccacugauaggagu

SEQ ID NO: 760360 - RNA, 22 nt, Human
uggaaaacaaagcucucauuau

SEQ ID NO: 760361 - RNA, 22 nt, Human
cuggaaugucugcucaauguuu

SEQ ID NO: 760362 - RNA, 22 nt, Human
acucuggcaagcuuccacuucc

SEQ ID NO: 760363 - RNA, 21 nt, Human
uuagcuuucuagaaucuuugu

SEQ ID NO: 760364 - RNA, 22 nt, Human
aguccuggugacacuccucuuc

SEQ ID NO: 760365 - RNA, 21 nt, Human
auggagccuaagaguggaggu

SEQ ID NO: 760366 - RNA, 22 nt, Human
gaggcagcgggucaggaccgug

SEQ ID NO: 760367 - RNA, 19 nt, Human
cccugaggcaaaagccuuu

SEQ ID NO: 760368 - RNA, 23 nt, Human
ucagaaugcacugaauuuacccu

SEQ ID NO: 760369 - RNA, 22 nt, Human
auggaacaugaauuaauauggu

SEQ ID NO: 760370 - RNA, 22 nt, Human
uuacauguuuauggggguacau

SEQ ID NO: 760371 - RNA, 22 nt, Human
cucagcaguauacucugaagau

SEQ ID NO: 760372 - RNA, 17 nt, Human
cagugcagauaagugag

SEQ ID NO: 760373 - RNA, 22 nt, Human
ugcaggaagacuucccaagcca

SEQ ID NO: 760374 - RNA, 22 nt, Human
gcacuugggcagagacgcacag

SEQ ID NO: 760375 - RNA, 22 nt, Human
uaugcuauuuuaaugaagaugu

SEQ ID NO: 760376 - RNA, 22 nt, Human
cucccuucaggagaggcucaca

SEQ ID NO: 760377 - RNA, 22 nt, Human
uacaugaagaugaauguauggc

SEQ ID NO: 760378 - RNA, 22 nt, Human
agugucuuacaugaauugauuu

SEQ ID NO: 760379 - RNA, 22 nt, Human
gggugcugggaggcugacaucu

SEQ ID NO: 760380 - RNA, 22 nt, Human
aguagcagugacagcugaggua

SEQ ID NO: 760381 - RNA, 22 nt, Human
caaauuuaaguuagaaagcaau

SEQ ID NO: 760382 - RNA, 22 nt, Human
agaaaugugagccccuuaucaa

SEQ ID NO: 760383 - RNA, 22 nt, Human
gaggaagugcguuaugccuuuu

SEQ ID NO: 760384 - RNA, 18 nt, Human
gaaaggagagacaguagg

SEQ ID NO: 760385 - RNA, 22 nt, Human
uuaucugucuaucaagacuagc

SEQ ID NO: 760386 - RNA, 19 nt, Human
ccuggcucugagcccagcc

SEQ ID NO: 760387 - RNA, 22 nt, Human
aaacaugaguuaaaaguaacug

SEQ ID NO: 760388 - RNA, 22 nt, Human
uucuucuuuccuauaauuaauu

SEQ ID NO: 760389 - RNA, 22 nt, Human
uagaaacacagaucugguguca

SEQ ID NO: 760390 - RNA, 22 nt, Human
acucaaauuugucaacugaagc

SEQ ID NO: 760391 - RNA, 22 nt, Human
auacaaugagugagugaauggg

SEQ ID NO: 760392 - RNA, 22 nt, Human
gcaggcauggucgcugccaggu

SEQ ID NO: 760393 - RNA, 22 nt, Human
uccuggaggaauaaguuuucca

SEQ ID NO: 760394 - RNA, 22 nt, Human
cagcugugaauugucuuaucua

SEQ ID NO: 760395 - RNA, 22 nt, Human
gccugggauucucaaaggggug

SEQ ID NO: 760396 - RNA, 22 nt, Human
uguccuggggcgacuuggggcc

SEQ ID NO: 760397 - RNA, 22 nt, Human
ugugauuauauuguaguacauu

SEQ ID NO: 760398 - RNA, 21 nt, Human
uaucacaguagaauaggaucu

SEQ ID NO: 760399 - RNA, 21 nt, Human
uguucaaacguacacauuucu

SEQ ID NO: 760400 - RNA, 22 nt, Human
uuccuuguggaaacuauggacg

SEQ ID NO: 760401 - RNA, 22 nt, Human
uggaagacaguugaugggaguu

SEQ ID NO: 760402 - RNA, 22 nt, Human
aggaucuucauugugcugcaaa

SEQ ID NO: 760403 - RNA, 19 nt, Human
uuagaaacuguugacacug

SEQ ID NO: 760404 - RNA, 22 nt, Human
acucauguuuucucuagcugga

SEQ ID NO: 760405 - RNA, 22 nt, Human
ucucauguuuuaccuguccuca

SEQ ID NO: 760406 - RNA, 17 nt, Human
uagcccauggcugccag

SEQ ID NO: 760407 - RNA, 22 nt, Human
uuuaaucuauucccuaaacacc

SEQ ID NO: 760408 - RNA, 22 nt, Human
ucacauuuuccuugguaucugu

SEQ ID NO: 760409 - RNA, 22 nt, Human
gccuccuaccacacccucaguc

SEQ ID NO: 760410 - RNA, 22 nt, Human
gagcagcuaaaauucucaugca

SEQ ID NO: 760411 - RNA, 22 nt, Human
uggacuggaaugcugauccucu

SEQ ID NO: 760412 - RNA, 22 nt, Human
agcuagaaguccuagauaaagg

SEQ ID NO: 760413 - RNA, 22 nt, Human
gguagcaagcgcuugcccugcg

SEQ ID NO: 760414 - RNA, 22 nt, Human
gauuucuaguucauuaucuauu

SEQ ID NO: 760415 - RNA, 22 nt, Human
cauacaguuuucccuagaugug

SEQ ID NO: 760416 - RNA, 22 nt, Human
uauaaaauucucaguuuggggu

SEQ ID NO: 760417 - RNA, 23 nt, Human
uggccaggguacuacacccaccc

SEQ ID NO: 760418 - RNA, 23 nt, Human
gaggagggucgugcuguguuccu

SEQ ID NO: 760419 - RNA, 18 nt, Human
cagcagagacauucaaaa

SEQ ID NO: 760420 - RNA, 22 nt, Human
gcaggagguugagccaggacug

SEQ ID NO: 760421 - RNA, 22 nt, Human
uuaucaguuguguguauacacg

SEQ ID NO: 760422 - RNA, 20 nt, Human
agcuucuucugucuaauuuu

SEQ ID NO: 760423 - RNA, 22 nt, Human
ugggcugccagcucuccagaug

SEQ ID NO: 760424 - RNA, 22 nt, Human
gaaugauagagcugccuucgga

SEQ ID NO: 760425 - RNA, 22 nt, Human
ucccccucauuaccucauucaa

SEQ ID NO: 760426 - RNA, 22 nt, Human
cuugggcuuagaagguaaguga

SEQ ID NO: 760427 - RNA, 22 nt, Human
uccaggcauguggccaguacuc

SEQ ID NO: 760428 - RNA, 22 nt, Human
aaauacuguccaccauggagca

SEQ ID NO: 760429 - RNA, 19 nt, Human
uggaggccaggacacaggu

SEQ ID NO: 760430 - RNA, 21 nt, Human
uguuuacucccugcaagcacg

SEQ ID NO: 760431 - RNA, 22 nt, Human
gucugaggucauuagcucucuu

SEQ ID NO: 760432 - RNA, 22 nt, Human
gggagcugugggauugguugag

SEQ ID NO: 760433 - RNA, 22 nt, Human
acuuuacacaucuuuucucauu

SEQ ID NO: 760434 - RNA, 22 nt, Human
caucuuuauuuauauagacagg

SEQ ID NO: 760435 - RNA, 22 nt, Human
agggccacgugcaccgcggucu

SEQ ID NO: 760436 - RNA, 22 nt, Human
ugggaaaguguagccugcaggc

SEQ ID NO: 760437 - RNA, 18 nt, Human
uccagagcuacuguggug

SEQ ID NO: 760438 - RNA, 22 nt, Human
acagugaugagggaauuuugug

SEQ ID NO: 760439 - RNA, 22 nt, Human
uggaaugaaggagauggccuuu

SEQ ID NO: 760440 - RNA, 21 nt, Human
uuacaaagcuacagauguugc

SEQ ID NO: 760441 - RNA, 22 nt, Human
ccuggucagguaacugggcuga

SEQ ID NO: 760442 - RNA, 22 nt, Human
ugcacgugugagcauucacaug

SEQ ID NO: 760443 - RNA, 22 nt, Human
acaggcuuacaggcugcaagua

SEQ ID NO: 760444 - RNA, 23 nt, Human
uuucuucagaagccuugcgaggc

SEQ ID NO: 760445 - RNA, 22 nt, Human
gccuggcucugagggagcuccu

SEQ ID NO: 760446 - RNA, 22 nt, Human
uggaggaaaauuacuggggucu

SEQ ID NO: 760447 - RNA, 22 nt, Human
cuuguggagugccugcugcagu

SEQ ID NO: 760448 - RNA, 22 nt, Human
uguacuugaacuugacuguaga

SEQ ID NO: 760449 - RNA, 22 nt, Human
uucucaugaaacucgcuuccuc

SEQ ID NO: 760450 - RNA, 22 nt, Human
uucaaaguugcaugacagcuua

SEQ ID NO: 760451 - RNA, 22 nt, Human
aauuuaaggaggccuucacucu

SEQ ID NO: 760452 - RNA, 22 nt, Human
uugggguguuggauggagcaag

SEQ ID NO: 760453 - RNA, 22 nt, Human
auaaucauucacauaaggugcu

SEQ ID NO: 760454 - RNA, 22 nt, Human
cagcuuuaccaauauuuggaaa

SEQ ID NO: 760455 - RNA, 22 nt, Human
cucuggcuguuugcagcucaag

SEQ ID NO: 760456 - RNA, 22 nt, Human
aagggcugcuguagaagcagag

SEQ ID NO: 760457 - RNA, 20 nt, Human
caaaucacagguaauugcaa

SEQ ID NO: 760458 - RNA, 22 nt, Human
ugucaugaugugcacaccacag

SEQ ID NO: 760459 - RNA, 22 nt, Human
agcaggcuuucaagagucuucu

SEQ ID NO: 760460 - RNA, 22 nt, Human
aaaggucuugucuugacagagu

SEQ ID NO: 760461 - RNA, 22 nt, Human
aucugucuaugauauagucugu

SEQ ID NO: 760462 - RNA, 21 nt, Human
aggagccauguggucugaugg

SEQ ID NO: 760463 - RNA, 22 nt, Human
cagagggaccagaacauacugu

SEQ ID NO: 760464 - RNA, 19 nt, Human
auucauuggccaggguggu

SEQ ID NO: 760465 - RNA, 22 nt, Human
uuauuacacugaaagaauugcg

SEQ ID NO: 760466 - RNA, 22 nt, Human
aacugcaauuacuuuugcacua

SEQ ID NO: 760467 - RNA, 22 nt, Human
aggcagauuuucuuuacucagu

SEQ ID NO: 760468 - RNA, 22 nt, Human
agggaggaaggaacuccuucua

SEQ ID NO: 760469 - RNA, 22 nt, Human
aagauuuccuggauguaauucc

SEQ ID NO: 760470 - RNA, 22 nt, Human
acaguguccuuguggucccugu

SEQ ID NO: 760471 - RNA, 22 nt, Human
ucuucaaagaagccuuggauua

SEQ ID NO: 760472 - RNA, 22 nt, Human
cccacguugaaccgcuuacaga

SEQ ID NO: 760473 - RNA, 22 nt, Human
guaaugaauagaugguggcagg

SEQ ID NO: 760474 - RNA, 22 nt, Human
cagaggcaaaagagguggaggu

SEQ ID NO: 760475 - RNA, 22 nt, Human
gaauacaugauacaugaacugc

SEQ ID NO: 760476 - RNA, 22 nt, Human
gcugcagacugggaggcaggug

SEQ ID NO: 760477 - RNA, 22 nt, Human
cgggcagaucacacagggcuug

SEQ ID NO: 760478 - RNA, 22 nt, Human
aggaaggacuccaugguccguc

SEQ ID NO: 760479 - RNA, 19 nt, Human
auuuuucuuccucugugca

SEQ ID NO: 760480 - RNA, 22 nt, Human
acugagaggugauagugacauu

SEQ ID NO: 760481 - RNA, 22 nt, Human
uaguaaguagcuaauauuuacu

SEQ ID NO: 760482 - RNA, 22 nt, Human
agagacaggguuuugucguguu

SEQ ID NO: 760483 - RNA, 22 nt, Human
caggcacaggggaaugucuuuu

SEQ ID NO: 760484 - RNA, 22 nt, Human
aucaggaagccagucuaaugga

SEQ ID NO: 760485 - RNA, 22 nt, Human
uccugguggcuuucccugccuu

SEQ ID NO: 760486 - RNA, 22 nt, Human
uaauaaaugaaagugcuggcau

SEQ ID NO: 760487 - RNA, 18 nt, Human
ugcuuuaugcuuauauaa

SEQ ID NO: 760488 - RNA, 22 nt, Human
uuccauaaucaccuuauucuuu

SEQ ID NO: 760489 - RNA, 22 nt, Human
uuuaaauggcauuuucccagau

SEQ ID NO: 760490 - RNA, 22 nt, Human
cuggcuggccauguagagauga

SEQ ID NO: 760491 - RNA, 22 nt, Human
cuuauucauauauucucgguag

SEQ ID NO: 760492 - RNA, 22 nt, Human
cucugggaaagauugugcaggc

SEQ ID NO: 760493 - RNA, 22 nt, Human
cugugccagccugucccaggag

SEQ ID NO: 760494 - RNA, 19 nt, Human
uaacuuguagauaugaagu

SEQ ID NO: 760495 - RNA, 22 nt, Human
uaugcagugguaucauuuuaaa

SEQ ID NO: 760496 - RNA, 22 nt, Human
cacagucaccuuaucaggaugu

SEQ ID NO: 760497 - RNA, 22 nt, Human
agaugggccuucgagcaugccc

SEQ ID NO: 760498 - RNA, 20 nt, Human
ucccacugggccucaguuuc

SEQ ID NO: 760499 - RNA, 22 nt, Human
gagaggccaccugacgagcagu

SEQ ID NO: 760500 - RNA, 22 nt, Human
uaaaucagggagucaucugcga

SEQ ID NO: 760501 - RNA, 23 nt, Human
ccugugugcccuuaauucacagc

SEQ ID NO: 760502 - RNA, 22 nt, Human
acagaaacccagaaaaccucuc

SEQ ID NO: 760503 - RNA, 22 nt, Human
uuguuucugaguuuucauguau

SEQ ID NO: 760504 - RNA, 19 nt, Human
acagggaauuuccacagaa

SEQ ID NO: 760505 - RNA, 22 nt, Human
gccuggcccagggcuccgcagg

SEQ ID NO: 760506 - RNA, 22 nt, Human
cucuuauugaugaaggugcuaa

SEQ ID NO: 760507 - RNA, 22 nt, Human
aucuaaaguguuucaugaaaga

SEQ ID NO: 760508 - RNA, 22 nt, Human
ugucuuauuccuucuguucagc

SEQ ID NO: 760509 - RNA, 18 nt, Human
uuacuacagcacuuucuu

SEQ ID NO: 760510 - RNA, 22 nt, Human
auugaaaauaaggccagaaaca

SEQ ID NO: 760511 - RNA, 22 nt, Human
gaggaacccagcugggguugcc

SEQ ID NO: 760512 - RNA, 22 nt, Human
cuggagguaagaggcccugggc

SEQ ID NO: 760513 - RNA, 22 nt, Human
agaagauuuagguugacgcuau

SEQ ID NO: 760514 - RNA, 22 nt, Human
agcacgagaucgaugugccuuu

SEQ ID NO: 760515 - RNA, 22 nt, Human
auuaaggaacaaagccuuuuga

SEQ ID NO: 760516 - RNA, 22 nt, Human
ucaggccuagggagccacacca

SEQ ID NO: 760517 - RNA, 22 nt, Human
auggcuugauagaaagcuaguu

SEQ ID NO: 760518 - RNA, 22 nt, Human
aguggcuaauaacagcuaaaca

SEQ ID NO: 760519 - RNA, 18 nt, Human
uguuuauuuuucucuuac

SEQ ID NO: 760520 - RNA, 22 nt, Human
ggcuguggucugggugcucccc

SEQ ID NO: 760521 - RNA, 22 nt, Human
gcuccuggguguggcugccccu

SEQ ID NO: 760522 - RNA, 22 nt, Human
acugaaggaaagccuuugcaug

SEQ ID NO: 760523 - RNA, 22 nt, Human
augaacacaauacgugcaugca

SEQ ID NO: 760524 - RNA, 21 nt, Human
gggaagacugucaggauuccu

SEQ ID NO: 760525 - RNA, 22 nt, Human
gaagacacaauuggugggucca

SEQ ID NO: 760526 - RNA, 22 nt, Human
uagcuuuaagaugagaugugga

SEQ ID NO: 760527 - RNA, 22 nt, Human
ucggagaguucaugaagacccg

SEQ ID NO: 760528 - RNA, 22 nt, Human
uccuucagaggacggcagccag

SEQ ID NO: 760529 - RNA, 22 nt, Human
ucauggauaaaauauugguuaa

SEQ ID NO: 760530 - RNA, 22 nt, Human
cagcuucucagaaagcugaggu

SEQ ID NO: 760531 - RNA, 22 nt, Human
ugggccuccaauuccagcggga

SEQ ID NO: 760532 - RNA, 22 nt, Human
aagcugucaggagguuaccuuu

SEQ ID NO: 760533 - RNA, 22 nt, Human
aauguguaaaugaggagucuug

SEQ ID NO: 760534 - RNA, 22 nt, Human
acuguaaauuuugguugcaggu

SEQ ID NO: 760535 - RNA, 22 nt, Human
ucccagagccucugccacucug

SEQ ID NO: 760536 - RNA, 22 nt, Human
aaaagcaagaggcuggauuaaa

SEQ ID NO: 760537 - RNA, 22 nt, Human
ugucugggauguaauuccugcc

SEQ ID NO: 760538 - RNA, 22 nt, Human
ugcuggaagaauuccaugcugg

SEQ ID NO: 760539 - RNA, 20 nt, Human
gugcuuccucgcaaguugca

SEQ ID NO: 760540 - RNA, 22 nt, Human
uguguaaaagauuaguuuacua

SEQ ID NO: 760541 - RNA, 22 nt, Human
gaaguguuguaucuuuuuaaua

SEQ ID NO: 760542 - RNA, 18 nt, Human
aggccaaacuuguaagca

SEQ ID NO: 760543 - RNA, 22 nt, Human
uuuuuagaguguuaccaguaua

SEQ ID NO: 760544 - RNA, 22 nt, Human
gcuggccagugucccagggauc

SEQ ID NO: 760545 - RNA, 22 nt, Human
uacugcuucauauagggaugua

SEQ ID NO: 760546 - RNA, 22 nt, Human
cccuggugcccugggucagccu

SEQ ID NO: 760547 - RNA, 22 nt, Human
ugggucaguuugggggccagcc

SEQ ID NO: 760548 - RNA, 22 nt, Human
cagaggcugccagccaugugca

SEQ ID NO: 760549 - RNA, 22 nt, Human
gaauguaaaauugccuacaaga

SEQ ID NO: 760550 - RNA, 22 nt, Human
uguugagacugagggagucagc

SEQ ID NO: 760551 - RNA, 22 nt, Human
uucugcauguguuucaaauacu

SEQ ID NO: 760552 - RNA, 22 nt, Human
acaaagaaggaauuggucuuua

SEQ ID NO: 760553 - RNA, 22 nt, Human
agcagccaagguaaccugugcu

SEQ ID NO: 760554 - RNA, 22 nt, Human
cauggcuuuuuagcauauucaa

SEQ ID NO: 760555 - RNA, 22 nt, Human
agaaucucuacucaaguacuug

SEQ ID NO: 760556 - RNA, 18 nt, Human
ccuucagcucugccagua

SEQ ID NO: 760557 - RNA, 22 nt, Human
uagguacuuaagaucucagcua

SEQ ID NO: 760558 - RNA, 22 nt, Human
gacuuuauuuuaacggagauuc

SEQ ID NO: 760559 - RNA, 22 nt, Human
ggaggucacgacugggaugccu

SEQ ID NO: 760560 - RNA, 22 nt, Human
gcuuagcaaugugacaagaugc

SEQ ID NO: 760561 - RNA, 22 nt, Human
uguaacugccauguagccuguc

SEQ ID NO: 760562 - RNA, 22 nt, Human
acacuugaggaauguggugauu

SEQ ID NO: 760563 - RNA, 22 nt, Human
auacacacaaucagguuuugua

SEQ ID NO: 760564 - RNA, 22 nt, Human
ugugauaacuuuuacauuuucg

SEQ ID NO: 760565 - RNA, 22 nt, Human
gucacacacauuucuuuggugc

SEQ ID NO: 760566 - RNA, 22 nt, Human
gcagagccgugaauggauuuca

SEQ ID NO: 760567 - RNA, 22 nt, Human
acaguaggaauagauguagaua

SEQ ID NO: 760568 - RNA, 22 nt, Human
cuuacagagaagaaaauguagu

SEQ ID NO: 760569 - RNA, 22 nt, Human
gauaacauuuugaagugcuagu

SEQ ID NO: 760570 - RNA, 22 nt, Human
cagguccacagcccaucacugc

SEQ ID NO: 760571 - RNA, 17 nt, Human
ucugaggccucuaggag

SEQ ID NO: 760572 - RNA, 22 nt, Human
cuucccacuaaagcccuuguug

SEQ ID NO: 760573 - RNA, 22 nt, Human
auggggagagccucugucccca

SEQ ID NO: 760574 - RNA, 22 nt, Human
gccugcuguuaacugcaggaau

SEQ ID NO: 760575 - RNA, 22 nt, Human
agcugccuuaaauuacuuugug

SEQ ID NO: 760576 - RNA, 22 nt, Human
uuucacaggauucugauguagu

SEQ ID NO: 760577 - RNA, 22 nt, Human
cagcacaguccuuugcuuacug

SEQ ID NO: 760578 - RNA, 22 nt, Human
guccuagagauccgggagggga

SEQ ID NO: 760579 - RNA, 22 nt, Human
uggaaauauacaaugugucucu

SEQ ID NO: 760580 - RNA, 22 nt, Human
guacucucuugaaggccuuucu

SEQ ID NO: 760581 - RNA, 15 nt, Human
ugaagacauaaggug

SEQ ID NO: 760582 - RNA, 22 nt, Human
aggcuucccaagcagcugcaaa

SEQ ID NO: 760583 - RNA, 22 nt, Human
cagugcagacguggagggggca

SEQ ID NO: 760584 - RNA, 22 nt, Human
uuacagcagcagggacagacua

SEQ ID NO: 760585 - RNA, 22 nt, Human
uauuaugaggcuuagggaugac

SEQ ID NO: 760586 - RNA, 22 nt, Human
gagaaagggauaauuugaagag

SEQ ID NO: 760587 - RNA, 22 nt, Human
uuccaggacucguucuggcuca

SEQ ID NO: 760588 - RNA, 22 nt, Human
agcugcccuucucuugcccuug

SEQ ID NO: 760589 - RNA, 22 nt, Human
ugcgucuggaguggaguuugaa

SEQ ID NO: 760590 - RNA, 22 nt, Human
ugcuucuggguaggccucagga

SEQ ID NO: 760591 - RNA, 22 nt, Human
uagguuucagaggugccgggaa

SEQ ID NO: 760592 - RNA, 22 nt, Human
aggucaaggccaaaagaguggu

SEQ ID NO: 760593 - RNA, 22 nt, Human
gaaaucaaggcuacauucaggu

SEQ ID NO: 760594 - RNA, 22 nt, Human
cugcccgcugcuagagaggccg

SEQ ID NO: 760595 - RNA, 22 nt, Human
acccuggagcuuuucuggcccu

SEQ ID NO: 760596 - RNA, 22 nt, Human
aagggcuuaggauuuugcugug

SEQ ID NO: 760597 - RNA, 22 nt, Human
aguuucaguucugucauuuaua

SEQ ID NO: 760598 - RNA, 22 nt, Human
aggaaucccgcaccagcugcug

SEQ ID NO: 760599 - RNA, 22 nt, Human
uggcaggagacacauggcauag

SEQ ID NO: 760600 - RNA, 22 nt, Human
augcagcaguuuacaaagcaau

SEQ ID NO: 760601 - RNA, 22 nt, Human
auguuauuucugaaagaucauu

SEQ ID NO: 760602 - RNA, 22 nt, Human
uagugauuuagaauucaaaugu

SEQ ID NO: 760603 - RNA, 22 nt, Human
cucauuaaaggaaaucaccugc

SEQ ID NO: 760604 - RNA, 22 nt, Human
uagcagcugcaucauuuuacag

SEQ ID NO: 760605 - RNA, 22 nt, Human
uccagagcuacuugcucaacuu

SEQ ID NO: 760606 - RNA, 22 nt, Human
caugcuaauuaauuccaccugc

SEQ ID NO: 760607 - RNA, 22 nt, Human
acagaguuguguuuguacaacg

SEQ ID NO: 760608 - RNA, 19 nt, Human
uacauuuguguacacuugu

SEQ ID NO: 760609 - RNA, 22 nt, Human
gaggccaaucaauagggcaaua

SEQ ID NO: 760610 - RNA, 22 nt, Human
ccuggcagcauugguagagauu

SEQ ID NO: 760611 - RNA, 22 nt, Human
ucccugggucauucucuggcac

SEQ ID NO: 760612 - RNA, 22 nt, Human
uccugaauuccucuuugcaucc

SEQ ID NO: 760613 - RNA, 22 nt, Human
uuucaaguuaaauggggucuuu

SEQ ID NO: 760614 - RNA, 22 nt, Human
uggcccuguccucauuucaucu

SEQ ID NO: 760615 - RNA, 22 nt, Human
uugaauuggcaaaacugcagcu

SEQ ID NO: 760616 - RNA, 22 nt, Human
ggagcagaugucuucauggccu

SEQ ID NO: 760617 - RNA, 20 nt, Human
cucauguggcaccaggcacu

SEQ ID NO: 760618 - RNA, 22 nt, Human
aaaugaacucaaugaucuccca

SEQ ID NO: 760619 - RNA, 22 nt, Human
gauuucaaccuaacaguaugac

SEQ ID NO: 760620 - RNA, 22 nt, Human
ccugagugccaugagagcaccc

SEQ ID NO: 760621 - RNA, 22 nt, Human
ucacagacaccuuggccacagu

SEQ ID NO: 760622 - RNA, 22 nt, Human
caggcccaucugcucccaggcu

SEQ ID NO: 760623 - RNA, 22 nt, Human
agaggugacauaggagaggcuc

SEQ ID NO: 760624 - RNA, 22 nt, Human
ggaagccagaaagugagaauau

SEQ ID NO: 760625 - RNA, 22 nt, Human
uggcuggaugugagaucaagag

SEQ ID NO: 760626 - RNA, 22 nt, Human
uucuggagggcaugcugcugcc

SEQ ID NO: 760627 - RNA, 22 nt, Human
ugaaagcagauagcucuguugu

SEQ ID NO: 760628 - RNA, 22 nt, Human
gaauguuuaaggaaggcguggc

SEQ ID NO: 760629 - RNA, 22 nt, Human
acaugcaagccccugaacacau

SEQ ID NO: 760630 - RNA, 22 nt, Human
gagcugggaggacugggaacuu

SEQ ID NO: 760631 - RNA, 22 nt, Human
gaggaaaucuuaggccccaacc

SEQ ID NO: 760632 - RNA, 22 nt, Human
gacagaggguuccaaaauugau

SEQ ID NO: 760633 - RNA, 22 nt, Human
cugcuccaccuccgggucaggc

SEQ ID NO: 760634 - RNA, 22 nt, Human
ggugugaaauguucaguguuac

SEQ ID NO: 760635 - RNA, 22 nt, Human
augauugaccaucugcugggcu

SEQ ID NO: 760636 - RNA, 17 nt, Human
agagagaaaagggccau

SEQ ID NO: 760637 - RNA, 22 nt, Human
uuaaaaucuaaagcaguugucu

SEQ ID NO: 760638 - RNA, 22 nt, Human
gugguuuugccauuacaaguaa

SEQ ID NO: 760639 - RNA, 22 nt, Human
uauagugucucuagaucaaaga

SEQ ID NO: 760640 - RNA, 22 nt, Human
ugcuuucacaccaugccuauaa

SEQ ID NO: 760641 - RNA, 22 nt, Human
acaaugaacacacaaggaauuc

SEQ ID NO: 760642 - RNA, 22 nt, Human
ugucaugggucuaaacauugau

SEQ ID NO: 760643 - RNA, 22 nt, Human
agcugggguugcacacauuuug

SEQ ID NO: 760644 - RNA, 22 nt, Human
ugccugcaagaguuggggcuac

SEQ ID NO: 760645 - RNA, 22 nt, Human
gaggcccagcagcgcaggucuu

SEQ ID NO: 760646 - RNA, 22 nt, Human
gcuggagaguaguaagcaguua

SEQ ID NO: 760647 - RNA, 18 nt, Human
gcacagagcccaggcucu

SEQ ID NO: 760648 - RNA, 22 nt, Human
gacagcuugccugguacugcaa

SEQ ID NO: 760649 - RNA, 22 nt, Human
aggacacacccagcucacgggg

SEQ ID NO: 760650 - RNA, 22 nt, Human
guauaucaccccaagcagcuga

SEQ ID NO: 760651 - RNA, 22 nt, Human
ugcuccauucucuagccagugc

SEQ ID NO: 760652 - RNA, 22 nt, Human
aggggcugcuggguccgccccu

SEQ ID NO: 760653 - RNA, 22 nt, Human
ugucagggauuuaaagacacaa

SEQ ID NO: 760654 - RNA, 22 nt, Human
gccuggggcaugcagcugauac

SEQ ID NO: 760655 - RNA, 22 nt, Human
ucagaagucuggacugcuucuc

SEQ ID NO: 760656 - RNA, 22 nt, Human
cagaagcaaaugccuugcugag

SEQ ID NO: 760657 - RNA, 22 nt, Human
uugcuucauuuccucaggcuuu

SEQ ID NO: 760658 - RNA, 22 nt, Human
acaagucaguggaauuaauauu

SEQ ID NO: 760659 - RNA, 23 nt, Human
uuuuccuuuggacaggcuguauu

SEQ ID NO: 760660 - RNA, 22 nt, Human
aagaaacucacuuugggaggca

SEQ ID NO: 760661 - RNA, 22 nt, Human
ucaguuuugaaaacauugaaug

SEQ ID NO: 760662 - RNA, 18 nt, Human
uaucacugcugaacaaga

SEQ ID NO: 760663 - RNA, 22 nt, Human
acaggcugcccgcuccccaccu

SEQ ID NO: 760664 - RNA, 22 nt, Human
cccaggcagucuggcucuaaag

SEQ ID NO: 760665 - RNA, 22 nt, Human
uguggcucggccagcugcugaa

SEQ ID NO: 760666 - RNA, 22 nt, Human
auaaaggcuggcugcugugagc

SEQ ID NO: 760667 - RNA, 22 nt, Human
uccagugaucuagggagcugga

SEQ ID NO: 760668 - RNA, 22 nt, Human
aagaucaugguuuaucugggag

SEQ ID NO: 760669 - RNA, 22 nt, Human
ugggcacaggggaauggaugaa

SEQ ID NO: 760670 - RNA, 22 nt, Human
uuuagcuugaaucuuguuuaaa

SEQ ID NO: 760671 - RNA, 22 nt, Human
gcuugacuaggcucuggcgaca

SEQ ID NO: 760672 - RNA, 22 nt, Human
uacaaugcauucguugucucgg

SEQ ID NO: 760673 - RNA, 19 nt, Human
agcuccugauugugccucg

SEQ ID NO: 760674 - RNA, 22 nt, Human
ccucgaccuccccaggcucagg

SEQ ID NO: 760675 - RNA, 22 nt, Human
uucauauucaaauacucugcuu

SEQ ID NO: 760676 - RNA, 22 nt, Human
agagggcaugcuugguggccug

SEQ ID NO: 760677 - RNA, 22 nt, Human
uuuugccugagauccgagucug

SEQ ID NO: 760678 - RNA, 22 nt, Human
cagggacaauggcagagccuga

SEQ ID NO: 760679 - RNA, 22 nt, Human
gccagcucccaagugagccccu

SEQ ID NO: 760680 - RNA, 22 nt, Human
accugagggcccaaacuuggua

SEQ ID NO: 760681 - RNA, 22 nt, Human
uaauuuuaauaguauguggcau

SEQ ID NO: 760682 - RNA, 22 nt, Human
agaauucuuggugguuagaaua

SEQ ID NO: 760683 - RNA, 22 nt, Human
aaagcagcaacagcuguuagaa

SEQ ID NO: 760684 - RNA, 22 nt, Human
ugcuuuauagacaaggaaguag

SEQ ID NO: 760685 - RNA, 22 nt, Human
agagugauggguugugcugacc

SEQ ID NO: 760686 - RNA, 22 nt, Human
uggacagguuugggugccuguu

SEQ ID NO: 760687 - RNA, 22 nt, Human
cagaggcuuggcauuaucaugc

SEQ ID NO: 760688 - RNA, 22 nt, Human
aggagacauacuauaggaauau

SEQ ID NO: 760689 - RNA, 22 nt, Human
auuaauugggaacuuguugaaa

SEQ ID NO: 760690 - RNA, 22 nt, Human
gcaggaugaacuaacaccugca

SEQ ID NO: 760691 - RNA, 22 nt, Human
uuucugcaaacuuccacgucuc

SEQ ID NO: 760692 - RNA, 22 nt, Human
aaguacagaaauagcaggugca

SEQ ID NO: 760693 - RNA, 22 nt, Human
gagaaaggcauuccuaugcaaa

SEQ ID NO: 760694 - RNA, 22 nt, Human
aaagagcuugcuugcuuuauau

SEQ ID NO: 760695 - RNA, 22 nt, Human
acucuuuagagguacaucucuu

SEQ ID NO: 760696 - RNA, 22 nt, Human
uugaguguacuuuagucaucug

SEQ ID NO: 760697 - RNA, 22 nt, Human
uuauucagucugucuagggagu

SEQ ID NO: 760698 - RNA, 22 nt, Human
caugcagaggugccacgaggcu

SEQ ID NO: 760699 - RNA, 22 nt, Human
uccuuuuugguccaaggugacc

SEQ ID NO: 760700 - RNA, 22 nt, Human
gccuguuggguaacagaguuca

SEQ ID NO: 760701 - RNA, 22 nt, Human
agcaaggaaacuauggagagau

SEQ ID NO: 760702 - RNA, 22 nt, Human
uucuuauagaagcaaccauugu

SEQ ID NO: 760703 - RNA, 22 nt, Human
uggguccucgucuuccaaggca

SEQ ID NO: 760704 - RNA, 22 nt, Human
gguguggggagguucugcuucu

SEQ ID NO: 760705 - RNA, 22 nt, Human
ugaaaugacagucuuaagcucu

SEQ ID NO: 760706 - RNA, 22 nt, Human
ccuagccccagauaucucacac

SEQ ID NO: 760707 - RNA, 22 nt, Human
uguccuuuucuuuagugcagcu

SEQ ID NO: 760708 - RNA, 22 nt, Human
ugugugccagauacaagcacug

SEQ ID NO: 760709 - RNA, 20 nt, Human
uaaugcuuaacacauccccu

SEQ ID NO: 760710 - RNA, 22 nt, Human
uuguuaaagaugcagauuccau

SEQ ID NO: 760711 - RNA, 22 nt, Human
gcuguccauccacuucccagcg

SEQ ID NO: 760712 - RNA, 22 nt, Human
ggugagacuuuagaagagccag

SEQ ID NO: 760713 - RNA, 22 nt, Human
uuuccuaagauagauacuucag

SEQ ID NO: 760714 - RNA, 22 nt, Human
uucaaauccuagcccuguggcc

SEQ ID NO: 760715 - RNA, 22 nt, Human
cuguugcuaaguagugcaggua

SEQ ID NO: 760716 - RNA, 22 nt, Human
ucaguguguuacuuucuccuau

SEQ ID NO: 760717 - RNA, 19 nt, Human
cugcuccaggagcugggga

SEQ ID NO: 760718 - RNA, 22 nt, Human
cucacuguuuaauagcuggauc

SEQ ID NO: 760719 - RNA, 22 nt, Human
ccagaggaucaguacuggcugg

SEQ ID NO: 760720 - RNA, 22 nt, Human
gaaaugaaacaggcuuuuaagg

SEQ ID NO: 760721 - RNA, 19 nt, Human
cucuuaaauugucucuugc

SEQ ID NO: 760722 - RNA, 22 nt, Human
caguggagaggcaugcuuggca

SEQ ID NO: 760723 - RNA, 22 nt, Human
agcgcaggaacacgucugccuu

SEQ ID NO: 760724 - RNA, 22 nt, Human
aaugaccugggugucauuucau

SEQ ID NO: 760725 - RNA, 22 nt, Human
gggagaguagcuggaagguucu

SEQ ID NO: 760726 - RNA, 22 nt, Human
cccucaggagaugucagcugga

SEQ ID NO: 760727 - RNA, 22 nt, Human
uaggcagaaaggaaggcaaguu

SEQ ID NO: 760728 - RNA, 22 nt, Human
gcagcauugugagguccugccc

SEQ ID NO: 760729 - RNA, 22 nt, Human
ugaguuauugagaaauaacugc

SEQ ID NO: 760730 - RNA, 22 nt, Human
cagaggccagggggcucacaaa

SEQ ID NO: 760731 - RNA, 21 nt, Human
uaagacaguaugaauacuuuc

SEQ ID NO: 760732 - RNA, 22 nt, Human
uuucaaacauaucuucauuacu

SEQ ID NO: 760733 - RNA, 22 nt, Human
cucagcacacucccaucuaauu

SEQ ID NO: 760734 - RNA, 22 nt, Human
acaggcaaagggucaguagcag

SEQ ID NO: 760735 - RNA, 22 nt, Human
ucuggcucaggucagacaggga

SEQ ID NO: 760736 - RNA, 22 nt, Human
cugccuguuagucuagcaguua

SEQ ID NO: 760737 - RNA, 22 nt, Human
cccacacacuggcugcugccaa

SEQ ID NO: 760738 - RNA, 22 nt, Human
agcagagugugaaggcagggcu

SEQ ID NO: 760739 - RNA, 22 nt, Human
ccaugcauauaauagugccugg

SEQ ID NO: 760740 - RNA, 22 nt, Human
cugggaguguucuaggucacau

SEQ ID NO: 760741 - RNA, 22 nt, Human
gcaaggagccuggaggugagug

SEQ ID NO: 760742 - RNA, 22 nt, Human
auggauggccugagcacagcug

SEQ ID NO: 760743 - RNA, 22 nt, Human
auuacauauguuggcaacauuu

SEQ ID NO: 760744 - RNA, 22 nt, Human
gauuuuaucgucauccuucugg

SEQ ID NO: 760745 - RNA, 22 nt, Human
aguugaaauuagaguccuggcu

SEQ ID NO: 760746 - RNA, 22 nt, Human
cucuuaauguuuuauagauuga

SEQ ID NO: 760747 - RNA, 22 nt, Human
cacaguguuugauuuaggggcc

SEQ ID NO: 760748 - RNA, 22 nt, Human
ugccaggcuuuggucaaaggcu

SEQ ID NO: 760749 - RNA, 22 nt, Human
acacaguaucaaauuucaucuu

SEQ ID NO: 760750 - RNA, 22 nt, Human
gaaauguguuguucauuucuaa

SEQ ID NO: 760751 - RNA, 22 nt, Human
gccuccagcuggggcauuucag

SEQ ID NO: 760752 - RNA, 22 nt, Human
acagcacaggaguugaaugggc

SEQ ID NO: 760753 - RNA, 22 nt, Human
gugagauuugaguggggauaca

SEQ ID NO: 760754 - RNA, 22 nt, Human
uuuuuugucccagagagccugg

SEQ ID NO: 760755 - RNA, 22 nt, Human
ccuguguggccaggcuggaguc

SEQ ID NO: 760756 - RNA, 22 nt, Human
uagaaaugauuuugaugcuuca

SEQ ID NO: 760757 - RNA, 22 nt, Human
cuccccaccuucgcggucccug

SEQ ID NO: 760758 - RNA, 22 nt, Human
uaaguucugaagaggcgaggua

SEQ ID NO: 760759 - RNA, 20 nt, Human
aaaaacaguaaugcugaaga

SEQ ID NO: 760760 - RNA, 22 nt, Human
ugcuuaauaggaguugaacauu

SEQ ID NO: 760761 - RNA, 22 nt, Human
aaaagcuuuguuaauagguuug

SEQ ID NO: 760762 - RNA, 18 nt, Human
gacagcuguccugagccc

SEQ ID NO: 760763 - RNA, 22 nt, Human
cccucccaggaguggccagaga

SEQ ID NO: 760764 - RNA, 22 nt, Human
cagaaaacaaaccuauccugag

SEQ ID NO: 760765 - RNA, 22 nt, Human
cucccucugucuuguccagaaa

SEQ ID NO: 760766 - RNA, 20 nt, Human
cagagaccaggccagguguc

SEQ ID NO: 760767 - RNA, 23 nt, Human
uucauguggaccuagaggccugu

SEQ ID NO: 760768 - RNA, 22 nt, Human
ccaugccauacuggccacccgg

SEQ ID NO: 760769 - RNA, 22 nt, Human
ccagagccucaacacagguccu

SEQ ID NO: 760770 - RNA, 22 nt, Human
ccacuguagagauuugaaugcc

SEQ ID NO: 760771 - RNA, 22 nt, Human
ugggggcuagaacccagggauu

SEQ ID NO: 760772 - RNA, 22 nt, Human
cucuggaguucuucaagcuacu

SEQ ID NO: 760773 - RNA, 22 nt, Human
ggaaagauguaauauuaucuaa

SEQ ID NO: 760774 - RNA, 20 nt, Human
ccugucuggagacaaagaga

SEQ ID NO: 760775 - RNA, 22 nt, Human
cugcuuuaaaacugauacauga

SEQ ID NO: 760776 - RNA, 22 nt, Human
uucaggauaugugauaucugaa

SEQ ID NO: 760777 - RNA, 22 nt, Human
agucacaugaucccugggccug

SEQ ID NO: 760778 - RNA, 17 nt, Human
cuaggcuuggcagcucg

SEQ ID NO: 760779 - RNA, 22 nt, Human
uuucauaauagugcaguuuguu

SEQ ID NO: 760780 - RNA, 22 nt, Human
uaacagcaaccacagugcuggu

SEQ ID NO: 760781 - RNA, 22 nt, Human
aaaagccaagguccucuucaga

SEQ ID NO: 760782 - RNA, 21 nt, Human
gcuucuguaucuagcaggaac

SEQ ID NO: 760783 - RNA, 22 nt, Human
cagcugguuggaagggagcuga

SEQ ID NO: 760784 - RNA, 22 nt, Human
cuggggcuucaaugcuucggug

SEQ ID NO: 760785 - RNA, 22 nt, Human
cauuaaaauaucucaugguguu

SEQ ID NO: 760786 - RNA, 22 nt, Human
ccugccuucccagcuuggcuuu

SEQ ID NO: 760787 - RNA, 22 nt, Human
uuagcauucucugugugcauaa

SEQ ID NO: 760788 - RNA, 22 nt, Human
uguauacaggcauaagagauac

SEQ ID NO: 760789 - RNA, 22 nt, Human
gggaaugugaaacaguaaggga

SEQ ID NO: 760790 - RNA, 22 nt, Human
cugccucagccuucugggugac

SEQ ID NO: 760791 - RNA, 22 nt, Human
uaaaauagcuuaugucuuuuga

SEQ ID NO: 760792 - RNA, 22 nt, Human
aggcaggucacaugcuuggcga

SEQ ID NO: 760793 - RNA, 22 nt, Human
uuccaggaacaaacucaccuua

SEQ ID NO: 760794 - RNA, 22 nt, Human
uagcuguguagacacucagagc

SEQ ID NO: 760795 - RNA, 22 nt, Human
acuugggaaagaaguuucaccg

SEQ ID NO: 760796 - RNA, 22 nt, Human
ucuggagaguccugcucacguc

SEQ ID NO: 760797 - RNA, 21 nt, Human
aagucagucaguucuauacua

SEQ ID NO: 760798 - RNA, 22 nt, Human
cagcaucuucuccaaagcugcc

SEQ ID NO: 760799 - RNA, 21 nt, Human
guucuuaguuauauucucaau

SEQ ID NO: 760800 - RNA, 22 nt, Human
uugauucauggacaggccaggu

SEQ ID NO: 760801 - RNA, 22 nt, Human
cacuuuaacucacauuucagcu

SEQ ID NO: 760802 - RNA, 22 nt, Human
gaaaucuuccuucagugaagaa

SEQ ID NO: 760803 - RNA, 22 nt, Human
ggucuggcacucaugcagcagg

SEQ ID NO: 760804 - RNA, 20 nt, Human
cuacacaggguucgcugggc

SEQ ID NO: 760805 - RNA, 22 nt, Human
uucuucugugaggugugugccu

SEQ ID NO: 760806 - RNA, 21 nt, Human
ugggcccaguucccgcugggc

SEQ ID NO: 760807 - RNA, 22 nt, Human
uguauguggcuacuuuucuugc

SEQ ID NO: 760808 - RNA, 22 nt, Human
cuuugauauaaguauacauagu

SEQ ID NO: 760809 - RNA, 22 nt, Human
uacaugcuccuuaugagaaucu

SEQ ID NO: 760810 - RNA, 22 nt, Human
agcagcuucuuucacuccugga

SEQ ID NO: 760811 - RNA, 22 nt, Human
uacaacugcacaucugaaucac

SEQ ID NO: 760812 - RNA, 22 nt, Human
uuguagcuuaucaaggcuguuu

SEQ ID NO: 760813 - RNA, 21 nt, Human
cagcccagcuucuuccccagu

SEQ ID NO: 760814 - RNA, 22 nt, Human
ggagagaaauugagguagcaag

SEQ ID NO: 760815 - RNA, 22 nt, Human
acucaggaaaugagaggcucuc

SEQ ID NO: 760816 - RNA, 22 nt, Human
cacaccagagguuaccugcaaa

SEQ ID NO: 760817 - RNA, 18 nt, Human
cuucauuuguagaguucc

SEQ ID NO: 760818 - RNA, 22 nt, Human
gcagcuuucuacuuccuacagc

SEQ ID NO: 760819 - RNA, 22 nt, Human
uccucugaauguacuucauaau

SEQ ID NO: 760820 - RNA, 22 nt, Human
ucuguucuuccuacauucacau

SEQ ID NO: 760821 - RNA, 20 nt, Human
agcagauagcgggagaguuu

SEQ ID NO: 760822 - RNA, 22 nt, Human
ucuuucuacaucauuugcuucu

SEQ ID NO: 760823 - RNA, 22 nt, Human
cagcaucuuauuuucuauggaa

SEQ ID NO: 760824 - RNA, 22 nt, Human
gccaggaccucccagagcuuuc

SEQ ID NO: 760825 - RNA, 22 nt, Human
guggggacgggauggcucacug

SEQ ID NO: 760826 - RNA, 22 nt, Human
aagcaccugcaguugacaaaaa

SEQ ID NO: 760827 - RNA, 22 nt, Human
uuccuuggaguuaagacccugg

SEQ ID NO: 760828 - RNA, 22 nt, Human
augcauuggauaagaaccccau

SEQ ID NO: 760829 - RNA, 22 nt, Human
gcugucccgaaccccugguaau

SEQ ID NO: 760830 - RNA, 22 nt, Human
cccagcuguaacgggucugcac

SEQ ID NO: 760831 - RNA, 22 nt, Human
uucugggcaguuggaaauuuca

SEQ ID NO: 760832 - RNA, 22 nt, Human
caugggggcugaggcugcugua

SEQ ID NO: 760833 - RNA, 22 nt, Human
gccucacugcagccccaggaag

SEQ ID NO: 760834 - RNA, 22 nt, Human
ugaaaugacaaagguuuuucuu

SEQ ID NO: 760835 - RNA, 22 nt, Human
auguuauggcucaaacauuugg

SEQ ID NO: 760836 - RNA, 22 nt, Human
cuuccugaggugcugagcacag

SEQ ID NO: 760837 - RNA, 22 nt, Human
gggcugaaagcucucacagucu

SEQ ID NO: 760838 - RNA, 22 nt, Human
uauguacuaacuuucauucuag

SEQ ID NO: 760839 - RNA, 22 nt, Human
uucuuugggauuguagcugucu

SEQ ID NO: 760840 - RNA, 22 nt, Human
aggugugggaaacgggugaccu

SEQ ID NO: 760841 - RNA, 23 nt, Human
gcucuggcagcuugugucagcac

SEQ ID NO: 760842 - RNA, 22 nt, Human
uaggaagcauuuaaagagaugg

SEQ ID NO: 760843 - RNA, 22 nt, Human
caacuuuugacacgugugcuaa

SEQ ID NO: 760844 - RNA, 22 nt, Human
ccugaauacuggugcugaaagu

SEQ ID NO: 760845 - RNA, 22 nt, Human
aagcuggaggcugagaucacca

SEQ ID NO: 760846 - RNA, 22 nt, Human
ggaggagcccacucaaagggga

SEQ ID NO: 760847 - RNA, 22 nt, Human
ucugauuccagugacccuagga

SEQ ID NO: 760848 - RNA, 22 nt, Human
gauaaacuuguggaguuuuggu

SEQ ID NO: 760849 - RNA, 22 nt, Human
uggccaguuugcucaggcaguc

SEQ ID NO: 760850 - RNA, 22 nt, Human
cugggaagcuucgagcaggaaa

SEQ ID NO: 760851 - RNA, 23 nt, Human
ccaggccucucagagggugugcc

SEQ ID NO: 760852 - RNA, 22 nt, Human
caagauuuggcaacuuugucau

SEQ ID NO: 760853 - RNA, 22 nt, Human
gugcucaggaagcuguuccugc

SEQ ID NO: 760854 - RNA, 22 nt, Human
aaagagcuggcauuuauagucu

SEQ ID NO: 760855 - RNA, 22 nt, Human
gcagugcuugaagagguggcca

SEQ ID NO: 760856 - RNA, 22 nt, Human
agccuucaaccuagcuagagca

SEQ ID NO: 760857 - RNA, 22 nt, Human
uuguaacuguggguugauuaga

SEQ ID NO: 760858 - RNA, 22 nt, Human
uuaugcuaguauaguccuuaga

SEQ ID NO: 760859 - RNA, 22 nt, Human
cuccugcccacgugcuacuucu

SEQ ID NO: 760860 - RNA, 22 nt, Human
ucuaagaaaucagaugaugagg

SEQ ID NO: 760861 - RNA, 22 nt, Human
gaggugcuuccuuugggcucug

SEQ ID NO: 760862 - RNA, 22 nt, Human
aggcuuuauuugaucuauaugc

SEQ ID NO: 760863 - RNA, 22 nt, Human
ugccacuggacccagaacucuu

SEQ ID NO: 760864 - RNA, 22 nt, Human
caugcuuuuugacaacaagcug

SEQ ID NO: 760865 - RNA, 22 nt, Human
uaaguacauuugggaccaccug

SEQ ID NO: 760866 - RNA, 22 nt, Human
agccugcuugagaguccuggcu

SEQ ID NO: 760867 - RNA, 22 nt, Human
uucucuucaucucaguaaaugu

SEQ ID NO: 760868 - RNA, 21 nt, Human
acagcuggaaauuacuugccc

SEQ ID NO: 760869 - RNA, 22 nt, Human
acaaugaugcagaugaguaaga

SEQ ID NO: 760870 - RNA, 22 nt, Human
uuugacaguaauaaagcacaag

SEQ ID NO: 760871 - RNA, 22 nt, Human
aaguggagucccuacaaccagc

SEQ ID NO: 760872 - RNA, 22 nt, Human
ucccaggaauccguccucuaga

SEQ ID NO: 760873 - RNA, 22 nt, Human
cagcaucuguuggauggauaag

SEQ ID NO: 760874 - RNA, 22 nt, Human
ccagucccaucucugucgcuua

SEQ ID NO: 760875 - RNA, 22 nt, Human
uggagagaacagugucugaaag

SEQ ID NO: 760876 - RNA, 18 nt, Human
gggcaagcggcugucacc

SEQ ID NO: 760877 - RNA, 22 nt, Human
uaaagcaaggaauagaguaguc

SEQ ID NO: 760878 - RNA, 19 nt, Human
accuucagaguggcacaaa

SEQ ID NO: 760879 - RNA, 22 nt, Human
gcucagggaaagagcuccuguc

SEQ ID NO: 760880 - RNA, 22 nt, Human
ugcuugcugggccaauggcaau

SEQ ID NO: 760881 - RNA, 22 nt, Human
ucccacacuacacgguuguugg

SEQ ID NO: 760882 - RNA, 22 nt, Human
cccucagcuccacccucagcag

SEQ ID NO: 760883 - RNA, 19 nt, Human
gagcugagaguagcacugg

SEQ ID NO: 760884 - RNA, 19 nt, Human
cccagcuugaccaccugcu

SEQ ID NO: 760885 - RNA, 22 nt, Human
uggcucugucgccguuuggaau

SEQ ID NO: 760886 - RNA, 22 nt, Human
uuccuucuggaggcuccagggg

SEQ ID NO: 760887 - RNA, 22 nt, Human
ucagcauguucuuaggucacag

SEQ ID NO: 760888 - RNA, 22 nt, Human
aauugcuaguuuguagcauuug

SEQ ID NO: 760889 - RNA, 22 nt, Human
aaaaccacaguuacuuuugcac

SEQ ID NO: 760890 - RNA, 22 nt, Human
uaaucacuuuucauuaguaccu

SEQ ID NO: 760891 - RNA, 22 nt, Human
uaaaguuuauuugaacaucucu

SEQ ID NO: 760892 - RNA, 22 nt, Human
ugcuugugugagggccugggag

SEQ ID NO: 760893 - RNA, 22 nt, Human
cucuccagggguagaugccuuc

SEQ ID NO: 760894 - RNA, 22 nt, Human
cuuucacucgagcuccugcagc

SEQ ID NO: 760895 - RNA, 22 nt, Human
uucuucaauuauuggaaagaaa

SEQ ID NO: 760896 - RNA, 16 nt, Human
uucucugggguugugc

SEQ ID NO: 760897 - RNA, 22 nt, Human
cauguguauuauucuuguggaa

SEQ ID NO: 760898 - RNA, 22 nt, Human
agucuccuuggccucaaugccu

SEQ ID NO: 760899 - RNA, 22 nt, Human
aaguaaugguuaaauaauucua

SEQ ID NO: 760900 - RNA, 22 nt, Human
uuguggauucuauuucccagaa

SEQ ID NO: 760901 - RNA, 22 nt, Human
gcuuuagagcccagcuuggugg

SEQ ID NO: 760902 - RNA, 22 nt, Human
aaaguuccuuuuauagacauga

SEQ ID NO: 760903 - RNA, 22 nt, Human
aaagcaguauauugguaguugu

SEQ ID NO: 760904 - RNA, 22 nt, Human
cucucugugcucacaagggcag

SEQ ID NO: 760905 - RNA, 21 nt, Human
ugacaacagaacugggcaagc

SEQ ID NO: 760906 - RNA, 22 nt, Human
uacagaggcuggguuuucaggg

SEQ ID NO: 760907 - RNA, 22 nt, Human
uccaguuucauagcuaaggaac

SEQ ID NO: 760908 - RNA, 20 nt, Human
uuugcuaugcauaucugacc

SEQ ID NO: 760909 - RNA, 22 nt, Human
uggcagcagcaaauggcauauc

SEQ ID NO: 760910 - RNA, 22 nt, Human
aauagcuuggacccauugcuuu

SEQ ID NO: 760911 - RNA, 22 nt, Human
acagacauucagcuaagucuau

SEQ ID NO: 760912 - RNA, 22 nt, Human
acaaugaaagcaagaagacggc

SEQ ID NO: 760913 - RNA, 22 nt, Human
aauaucuguuguucuaagccac

SEQ ID NO: 760914 - RNA, 22 nt, Human
gcuguuccugcuuagaggucgg

SEQ ID NO: 760915 - RNA, 19 nt, Human
cuuccuugcuccccaugug

SEQ ID NO: 760916 - RNA, 22 nt, Human
cagaaagccgacuuacaaugga

SEQ ID NO: 760917 - RNA, 22 nt, Human
uguuaggacuccccagaagcug

SEQ ID NO: 760918 - RNA, 22 nt, Human
aguacaaagugcuccugguucu

SEQ ID NO: 760919 - RNA, 22 nt, Human
uugcaaauguuauacugccagu

SEQ ID NO: 760920 - RNA, 22 nt, Human
ugggaaagacucaggacaggag

SEQ ID NO: 760921 - RNA, 22 nt, Human
aagggaugcaggaaagaagguu

SEQ ID NO: 760922 - RNA, 20 nt, Human
gcaaaauaggcucuguuggu

SEQ ID NO: 760923 - RNA, 22 nt, Human
ugaggacaaucccuaacucaga

SEQ ID NO: 760924 - RNA, 22 nt, Human
ucucuuggaacacuugcucuua

SEQ ID NO: 760925 - RNA, 22 nt, Human
aaaggcuuuaaaauguacauau

SEQ ID NO: 760926 - RNA, 21 nt, Human
gcccccuggacuccucaucca

SEQ ID NO: 760927 - RNA, 22 nt, Human
uuccuggagaguuuucccaaag

SEQ ID NO: 760928 - RNA, 22 nt, Human
cugcuuuaucugagacaaguca

SEQ ID NO: 760929 - RNA, 22 nt, Human
ucuccuggccgggcuguccccu

SEQ ID NO: 760930 - RNA, 22 nt, Human
gggggagcuacaggucccuugg

SEQ ID NO: 760931 - RNA, 22 nt, Human
acaacaguccaguauagacugu

SEQ ID NO: 760932 - RNA, 22 nt, Human
ggcagcuggccuccucgcccac

SEQ ID NO: 760933 - RNA, 22 nt, Human
aaagcaggguccaaggagaugu

SEQ ID NO: 760934 - RNA, 22 nt, Human
ucacaggagucaaggaauagua

SEQ ID NO: 760935 - RNA, 22 nt, Human
ugggccuggguuccuccugggc

SEQ ID NO: 760936 - RNA, 22 nt, Human
ccugaggagauuguggcugggg

SEQ ID NO: 760937 - RNA, 22 nt, Human
ugugaacuuaagauuccuuauc

SEQ ID NO: 760938 - RNA, 23 nt, Human
gggagaauaugaggaugauggug

SEQ ID NO: 760939 - RNA, 22 nt, Human
uacacagaaauuguguagggau

SEQ ID NO: 760940 - RNA, 22 nt, Human
auuuacucgugcuucauugaau

SEQ ID NO: 760941 - RNA, 22 nt, Human
ugcaaggcacccacucugcuuu

SEQ ID NO: 760942 - RNA, 22 nt, Human
ugagccugcugucgcuggaccc

SEQ ID NO: 760943 - RNA, 22 nt, Human
aauucaaagccgcuugggaauc

SEQ ID NO: 760944 - RNA, 22 nt, Human
ugagugugcagggaaguggcgg

SEQ ID NO: 760945 - RNA, 22 nt, Human
ucccugugaaucagaagcaggu

SEQ ID NO: 760946 - RNA, 22 nt, Human
cuggucaaaaauuaugcuuacu

SEQ ID NO: 760947 - RNA, 22 nt, Human
ggcagugaaugaaacagaggcu

SEQ ID NO: 760948 - RNA, 22 nt, Human
guuguuuuuguucucuauagcu

SEQ ID NO: 760949 - RNA, 22 nt, Human
gaagccaacauuccaaguagaa

SEQ ID NO: 760950 - RNA, 20 nt, Human
guucacaggcuuccuuucag

SEQ ID NO: 760951 - RNA, 22 nt, Human
ggagccagagucugcaguguaa

SEQ ID NO: 760952 - RNA, 22 nt, Human
aggggcugggacagagccaagc

SEQ ID NO: 760953 - RNA, 22 nt, Human
ugagaauuugcauuucuaacaa

SEQ ID NO: 760954 - RNA, 22 nt, Human
ucaguucuuaguaaugcagucu

SEQ ID NO: 760955 - RNA, 21 nt, Human
aaggggcaaacccaggacacc

SEQ ID NO: 760956 - RNA, 22 nt, Human
cuguuugugauuagcagugggu

SEQ ID NO: 760957 - RNA, 22 nt, Human
gcaggggcugagcaccagcggg

SEQ ID NO: 760958 - RNA, 22 nt, Human
ggcugagccaugggcacugcag

SEQ ID NO: 760959 - RNA, 22 nt, Human
guagcugauccugaggacaggg

SEQ ID NO: 760960 - RNA, 22 nt, Human
cugcucaguaauaguccuaucu

SEQ ID NO: 760961 - RNA, 22 nt, Human
ugcauugcauuugucaugaaga

SEQ ID NO: 760962 - RNA, 22 nt, Human
aggguggccaccaaguauguca

SEQ ID NO: 760963 - RNA, 22 nt, Human
ugcucaggccagccggacagag

SEQ ID NO: 760964 - RNA, 19 nt, Human
ccagagguuugcugggccu

SEQ ID NO: 760965 - RNA, 22 nt, Human
ucuguucaugucuuuuuaagug

SEQ ID NO: 760966 - RNA, 22 nt, Human
cucccaagauaaauaaggcagu

SEQ ID NO: 760967 - RNA, 22 nt, Human
uuacaguagauacaaugaguaa

SEQ ID NO: 760968 - RNA, 22 nt, Human
ugcugagcgcauccggcggccg

SEQ ID NO: 760969 - RNA, 22 nt, Human
agcauauucaugccagacuacu

SEQ ID NO: 760970 - RNA, 22 nt, Human
ugggaccuguuacauugaguua

SEQ ID NO: 760971 - RNA, 22 nt, Human
agcuccugaaaagcgcuugcuu

SEQ ID NO: 760972 - RNA, 22 nt, Human
agaggccaggcugcagagggau

SEQ ID NO: 760973 - RNA, 22 nt, Human
auaucaaacgaaguuauuuuaa

SEQ ID NO: 760974 - RNA, 22 nt, Human
agguggccccaggccucugcca

SEQ ID NO: 760975 - RNA, 22 nt, Human
caugcacauguggcuauguaau

SEQ ID NO: 760976 - RNA, 22 nt, Human
auaaagucaaggcauuuuauga

SEQ ID NO: 760977 - RNA, 22 nt, Human
uuucauagcugaaaauguugaa

SEQ ID NO: 760978 - RNA, 15 nt, Human
auuauuugugcucag

SEQ ID NO: 760979 - RNA, 22 nt, Human
aaauaugagauguucucuuucg

SEQ ID NO: 760980 - RNA, 22 nt, Human
aaauaguuacuucugcugucuu

SEQ ID NO: 760981 - RNA, 22 nt, Human
acuggggugaaauuggaguguc

SEQ ID NO: 760982 - RNA, 19 nt, Human
uccuccuuacuuccucuug

SEQ ID NO: 760983 - RNA, 22 nt, Human
ucagacaggccucuccagccuc

SEQ ID NO: 760984 - RNA, 22 nt, Human
acuuccagauggccccaucuaa

SEQ ID NO: 760985 - RNA, 21 nt, Human
ugaagggguggcagugugcuu

SEQ ID NO: 760986 - RNA, 22 nt, Human
gaccaaggaagaggggagccag

SEQ ID NO: 760987 - RNA, 22 nt, Human
ggcaggccugagaggcagggcu

SEQ ID NO: 760988 - RNA, 22 nt, Human
ucugcgugaauuugcauugugg

SEQ ID NO: 760989 - RNA, 19 nt, Human
ggaguggguaguuaguggu

SEQ ID NO: 760990 - RNA, 22 nt, Human
agaacagggacuggaggcuuca

SEQ ID NO: 760991 - RNA, 22 nt, Human
agcccagcaguaagauuagaga

SEQ ID NO: 760992 - RNA, 22 nt, Human
acugggcugcuugagugccuuc

SEQ ID NO: 760993 - RNA, 22 nt, Human
ucucauucauccaaggauuuau

SEQ ID NO: 760994 - RNA, 22 nt, Human
gcuuccuggagggagagagcug

SEQ ID NO: 760995 - RNA, 22 nt, Human
cuccaggccagggaaguggaca

SEQ ID NO: 760996 - RNA, 18 nt, Human
cucugaaagacacaccag

SEQ ID NO: 760997 - RNA, 20 nt, Human
uuucuggguacucucccucu

SEQ ID NO: 760998 - RNA, 22 nt, Human
cuggagagaccgaaagaggcug

SEQ ID NO: 760999 - RNA, 22 nt, Human
acagacaguaugguggggcuga

SEQ ID NO: 761000 - RNA, 22 nt, Human
gggcagugucgaggucuggucc

SEQ ID NO: 761001 - RNA, 22 nt, Human
uggcugaauaaaauaugguguu

SEQ ID NO: 761002 - RNA, 22 nt, Human
cccaggcugaguuagagguguc

SEQ ID NO: 761003 - RNA, 22 nt, Human
gcugucaggaacaugccuuggu

SEQ ID NO: 761004 - RNA, 22 nt, Human
gggcuuaaggccagugugcuuu

SEQ ID NO: 761005 - RNA, 22 nt, Human
aguccaggcggguauagaggcu

SEQ ID NO: 761006 - RNA, 22 nt, Human
agugaaauuuguuuagauaggu

SEQ ID NO: 761007 - RNA, 22 nt, Human
accaggcuguugggcccagugu

SEQ ID NO: 761008 - RNA, 22 nt, Human
uuagagucaagcugcauguucu

SEQ ID NO: 761009 - RNA, 22 nt, Human
aauugcuuuuauuuagggccag

SEQ ID NO: 761010 - RNA, 22 nt, Human
cagauuucaaggaggcacucca

SEQ ID NO: 761011 - RNA, 22 nt, Human
caccuggcagcuguuggccacg

SEQ ID NO: 761012 - RNA, 22 nt, Human
uguggggacugaguggaggcuu

SEQ ID NO: 761013 - RNA, 22 nt, Human
ugccuggcuaauuuuuguaucc

SEQ ID NO: 761014 - RNA, 22 nt, Human
uuuggaauuggaaagugcugug

SEQ ID NO: 761015 - RNA, 22 nt, Human
augcaugauccugagcaaccca

SEQ ID NO: 761016 - RNA, 22 nt, Human
acaagagauuaucuacagauga

SEQ ID NO: 761017 - RNA, 22 nt, Human
uagugucuucaggagauaugag

SEQ ID NO: 761018 - RNA, 22 nt, Human
gggcucuggggucagacagccu

SEQ ID NO: 761019 - RNA, 22 nt, Human
acagaaaaugccagaagggugg

SEQ ID NO: 761020 - RNA, 21 nt, Human
ggaggucccuucugguuucag

SEQ ID NO: 761021 - RNA, 22 nt, Human
agcagcugucccuuaacaucag

SEQ ID NO: 761022 - RNA, 22 nt, Human
uauagaagagacaugugcauag

SEQ ID NO: 761023 - RNA, 22 nt, Human
agguacaucuauggggauagaa

SEQ ID NO: 761024 - RNA, 20 nt, Human
aaaaauugauaucgcuuccu

SEQ ID NO: 761025 - RNA, 22 nt, Human
ugcuuggcuuucugagcuucug

SEQ ID NO: 761026 - RNA, 22 nt, Human
gccaccagugggggccugggca

SEQ ID NO: 761027 - RNA, 23 nt, Human
ccugcucaggcgugugcccugcu

SEQ ID NO: 761028 - RNA, 22 nt, Human
ccucaaauuggcauuaauuaag

SEQ ID NO: 761029 - RNA, 22 nt, Human
gaaggagggugcggaucugagc

SEQ ID NO: 761030 - RNA, 22 nt, Human
gccagcugcaaaguauguugaa

SEQ ID NO: 761031 - RNA, 20 nt, Human
auacaaucaugaggaaaaag

SEQ ID NO: 761032 - RNA, 22 nt, Human
ugacagcugagccccaggcaag

SEQ ID NO: 761033 - RNA, 22 nt, Human
gcucuugaaaaucaaaagggaa

SEQ ID NO: 761034 - RNA, 22 nt, Human
cagcuguugucaccucacaucc

SEQ ID NO: 761035 - RNA, 22 nt, Human
cagccacuacaauugguuccau

SEQ ID NO: 761036 - RNA, 22 nt, Human
ccagagguccugcucacuggug

SEQ ID NO: 761037 - RNA, 22 nt, Human
ccaguguuauuuuagaguguga

SEQ ID NO: 761038 - RNA, 22 nt, Human
gugggagccauuuccaguaugc

SEQ ID NO: 761039 - RNA, 22 nt, Human
uuuagaaugugacuguauuuga

SEQ ID NO: 761040 - RNA, 22 nt, Human
cugucguguucacuguggccua

SEQ ID NO: 761041 - RNA, 22 nt, Human
aauuccuuuggaucuucuggag

SEQ ID NO: 761042 - RNA, 22 nt, Human
ugcuaggugcuccucccuaauu

SEQ ID NO: 761043 - RNA, 22 nt, Human
aaagccaggaggagggcgcucg

SEQ ID NO: 761044 - RNA, 22 nt, Human
guucacaaauaugcacuuacga

SEQ ID NO: 761045 - RNA, 22 nt, Human
gagccacagcaaccucaaagga

SEQ ID NO: 761046 - RNA, 22 nt, Human
cugaaugauauaagaucuuucu

SEQ ID NO: 761047 - RNA, 22 nt, Human
uaauacaauggaguugggcccc

SEQ ID NO: 761048 - RNA, 22 nt, Human
cccaggcuggauuucgguggca

SEQ ID NO: 761049 - RNA, 22 nt, Human
auucucaguucacuaguuucuu

SEQ ID NO: 761050 - RNA, 22 nt, Human
agcagcauagaugcuauccgag

SEQ ID NO: 761051 - RNA, 22 nt, Human
cuccugggcugucggcgcucug

SEQ ID NO: 761052 - RNA, 23 nt, Human
cuugcaggaagcagauggcacac

SEQ ID NO: 761053 - RNA, 22 nt, Human
agggcaaguugagugugcgugg

SEQ ID NO: 761054 - RNA, 22 nt, Human
uaggaaauauugauuucaguca

SEQ ID NO: 761055 - RNA, 22 nt, Human
ucuguuuagaugcuuuaucugu

SEQ ID NO: 761056 - RNA, 22 nt, Human
gccaacagcugggugcaugucc

SEQ ID NO: 761057 - RNA, 22 nt, Human
augauggaugucacagucugua

SEQ ID NO: 761058 - RNA, 22 nt, Human
ccaggcugccgaggaaagaaag

SEQ ID NO: 761059 - RNA, 22 nt, Human
gugguaauuuaauccuacacug

SEQ ID NO: 761060 - RNA, 22 nt, Human
uacaguggggagcucaggagag

SEQ ID NO: 761061 - RNA, 21 nt, Human
aaggagccuaggaggcucagg

SEQ ID NO: 761062 - RNA, 22 nt, Human
acccagcuguuucccgugucau

SEQ ID NO: 761063 - RNA, 22 nt, Human
caucaaaguugguauauuugca

SEQ ID NO: 761064 - RNA, 22 nt, Human
aucucagaaacauaucuaaucc

SEQ ID NO: 761065 - RNA, 22 nt, Human
cagaaauggaauuuuccaucac

SEQ ID NO: 761066 - RNA, 22 nt, Human
aacaaucuguucgauagaaaau

SEQ ID NO: 761067 - RNA, 22 nt, Human
agagcuggauggucaagauggc

SEQ ID NO: 761068 - RNA, 22 nt, Human
cagggaugcugcuuaggcaguu

SEQ ID NO: 761069 - RNA, 22 nt, Human
aaucuuagguuuggcuucaucu

SEQ ID NO: 761070 - RNA, 22 nt, Human
agugaggucauacuggagaggg

SEQ ID NO: 761071 - RNA, 22 nt, Human
gggcagugguccaggcuacagc

SEQ ID NO: 761072 - RNA, 22 nt, Human
cagcacccuuuccacugccuug

SEQ ID NO: 761073 - RNA, 22 nt, Human
cacccaggcuggagugcagggg

SEQ ID NO: 761074 - RNA, 22 nt, Human
aggugcaccugagggugucauc

SEQ ID NO: 761075 - RNA, 22 nt, Human
cugagggguauccaagggguaa

SEQ ID NO: 761076 - RNA, 22 nt, Human
cuugaaaauaagaaagacuuuc

SEQ ID NO: 761077 - RNA, 22 nt, Human
gacauguuaucucuggcuucaa

SEQ ID NO: 761078 - RNA, 22 nt, Human
auggcuguguuagaugcuaagu

SEQ ID NO: 761079 - RNA, 22 nt, Human
cccuggggcugagggauggccg

SEQ ID NO: 761080 - RNA, 22 nt, Human
gcugcuggcacuggagugagcc

SEQ ID NO: 761081 - RNA, 22 nt, Human
gcagcucuccucugugaggaac

SEQ ID NO: 761082 - RNA, 20 nt, Human
ugucauucuucuuucacagg

SEQ ID NO: 761083 - RNA, 22 nt, Human
guggcaggaucacggcucacug

SEQ ID NO: 761084 - RNA, 22 nt, Human
uuccuugaaaguuugaacugac

SEQ ID NO: 761085 - RNA, 22 nt, Human
uuuuaaucaugcuucuaugucc

SEQ ID NO: 761086 - RNA, 22 nt, Human
uagggguguuucgagagagguu

SEQ ID NO: 761087 - RNA, 22 nt, Human
cuuccccaaccccgacugugug

SEQ ID NO: 761088 - RNA, 22 nt, Human
guccucugacucagccuuggga

SEQ ID NO: 761089 - RNA, 22 nt, Human
ugccaaaauggccaaaagcuag

SEQ ID NO: 761090 - RNA, 22 nt, Human
ccuuuuggccaggucagugcag

SEQ ID NO: 761091 - RNA, 22 nt, Human
cugagaaagugaggguuaaaca

SEQ ID NO: 761092 - RNA, 17 nt, Human
uuuuguucaucuucaaa

SEQ ID NO: 761093 - RNA, 22 nt, Human
auggcagacgaggcagcagggg

SEQ ID NO: 761094 - RNA, 22 nt, Human
agcuucuuaaguuccugcagca

SEQ ID NO: 761095 - RNA, 22 nt, Human
guccagagauggacgagcagau

SEQ ID NO: 761096 - RNA, 22 nt, Human
uuuacagagagagaacuggacu

SEQ ID NO: 761097 - RNA, 22 nt, Human
aacagcuugcugcaccuuaaua

SEQ ID NO: 761098 - RNA, 22 nt, Human
cccagcaggucggugcugccug

SEQ ID NO: 761099 - RNA, 22 nt, Human
ucagggcacauucugcaguggc

SEQ ID NO: 761100 - RNA, 21 nt, Human
ucacuggaauacaauugauuu

SEQ ID NO: 761101 - RNA, 22 nt, Human
agcaguguuggugggagcaucu

SEQ ID NO: 761102 - RNA, 22 nt, Human
uggcuccaccgccgcggagcuc

SEQ ID NO: 761103 - RNA, 22 nt, Human
ucuccagggacauguuucugga

SEQ ID NO: 761104 - RNA, 22 nt, Human
agaugggcgcccuggacugagg

SEQ ID NO: 761105 - RNA, 22 nt, Human
uucccucuuuuccaacaguugu

SEQ ID NO: 761106 - RNA, 22 nt, Human
uagcagaaacuguuacagaagg

SEQ ID NO: 761107 - RNA, 22 nt, Human
aaacugucauuggaugcauuug

SEQ ID NO: 761108 - RNA, 22 nt, Human
acaaaugauuuuccaagccagu

SEQ ID NO: 761109 - RNA, 22 nt, Human
aaguucaucaaagaguaaauau

SEQ ID NO: 761110 - RNA, 22 nt, Human
auagauguacguauguaaauca

SEQ ID NO: 761111 - RNA, 22 nt, Human
aaaucacuuaaauggcuuauuu

SEQ ID NO: 761112 - RNA, 22 nt, Human
ucagucuccuuuccucuagaca

SEQ ID NO: 761113 - RNA, 19 nt, Human
agcauccagucaugggauc

SEQ ID NO: 761114 - RNA, 18 nt, Human
ccugagcccugcuuacuu

SEQ ID NO: 761115 - RNA, 23 nt, Human
acugccagauugaagguuucuua

SEQ ID NO: 761116 - RNA, 22 nt, Human
uacauugagaaccacugcuuag

SEQ ID NO: 761117 - RNA, 22 nt, Human
uuucuucuguuuguaguuacac

SEQ ID NO: 761118 - RNA, 22 nt, Human
cagucugggacugagcuccacc

SEQ ID NO: 761119 - RNA, 19 nt, Human
gacaggaaggcuaccagua

SEQ ID NO: 761120 - RNA, 22 nt, Human
gaccugaaauuugugguagaac

SEQ ID NO: 761121 - RNA, 22 nt, Human
uucuguacuucaggggcucugu

SEQ ID NO: 761122 - RNA, 22 nt, Human
uggguccacggaagacuuaggg

SEQ ID NO: 761123 - RNA, 22 nt, Human
gcauccaggacuauaugaugau

SEQ ID NO: 761124 - RNA, 18 nt, Human
ugggcacaaugaacagca

SEQ ID NO: 761125 - RNA, 22 nt, Human
uccuuuccagccucaccucagc

SEQ ID NO: 761126 - RNA, 22 nt, Human
uuacuuaaacagaaaugcagaa

SEQ ID NO: 761127 - RNA, 22 nt, Human
aacccuggcccuggaauaggca

SEQ ID NO: 761128 - RNA, 22 nt, Human
cagggucugaaacugaucacag

SEQ ID NO: 761129 - RNA, 22 nt, Human
uggagagcacugucucauuuug

SEQ ID NO: 761130 - RNA, 22 nt, Human
ugagggagcacacacugaagug

SEQ ID NO: 761131 - RNA, 22 nt, Human
ucagauuuauguggcuaggcuc

SEQ ID NO: 761132 - RNA, 22 nt, Human
auucaguaggucuagaauaaga

SEQ ID NO: 761133 - RNA, 22 nt, Human
ucccucugcuagugcuugagcu

SEQ ID NO: 761134 - RNA, 23 nt, Human
aguucacugagguugaccacugg

SEQ ID NO: 761135 - RNA, 22 nt, Human
gcucuggguagccacugccugg

SEQ ID NO: 761136 - RNA, 23 nt, Human
aaauauucuuuuuuaguaagugc

SEQ ID NO: 761137 - RNA, 22 nt, Human
cucuggcuggcaccugaucuga

SEQ ID NO: 761138 - RNA, 22 nt, Human
ugucuccauagaagagacugca

SEQ ID NO: 761139 - RNA, 22 nt, Human
uccuggcccggccgggccugcu

SEQ ID NO: 761140 - RNA, 22 nt, Human
agagucugugcuuucaucagga

SEQ ID NO: 761141 - RNA, 22 nt, Human
uacauucaacaugucacuaugu

SEQ ID NO: 761142 - RNA, 22 nt, Human
acauuaaaaaauguugcaugaa

SEQ ID NO: 761143 - RNA, 22 nt, Human
uggaauaugcaauugcauuuca

SEQ ID NO: 761144 - RNA, 22 nt, Human
acagggcuuagaacuuggccuc

SEQ ID NO: 761145 - RNA, 22 nt, Human
cucaggaggaugacugccuugg

SEQ ID NO: 761146 - RNA, 22 nt, Human
aacauaauguggccaaagucac

SEQ ID NO: 761147 - RNA, 22 nt, Human
aguguauguccugaggggagaa

SEQ ID NO: 761148 - RNA, 22 nt, Human
ccucuggucccagcucugcugc

SEQ ID NO: 761149 - RNA, 22 nt, Human
acagggcagagaggcaggcuug

SEQ ID NO: 761150 - RNA, 22 nt, Human
uucuaaugaaaguggaccaugg

SEQ ID NO: 761151 - RNA, 22 nt, Human
agaugguaaucacauuuaucug

SEQ ID NO: 761152 - RNA, 22 nt, Human
gaugccuguggugagcacacau

SEQ ID NO: 761153 - RNA, 22 nt, Human
agccagggggacgcuuucuggc

SEQ ID NO: 761154 - RNA, 22 nt, Human
agagcuccucacuucggguuca

SEQ ID NO: 761155 - RNA, 22 nt, Human
augcacuuaaauaacauaacuu

SEQ ID NO: 761156 - RNA, 23 nt, Human
agacaaacuuccuucacugcacc

SEQ ID NO: 761157 - RNA, 20 nt, Human
uccaguuuuggagacauucu

SEQ ID NO: 761158 - RNA, 22 nt, Human
uggguaggaaucgaguguaugg

SEQ ID NO: 761159 - RNA, 22 nt, Human
uggcuaugacuucguacugucu

SEQ ID NO: 761160 - RNA, 22 nt, Human
ggcacaaguuugaugugaguua

SEQ ID NO: 761161 - RNA, 22 nt, Human
cuggcuaaagagcaagaagaug

SEQ ID NO: 761162 - RNA, 17 nt, Human
ugcuucuguauugcugg

SEQ ID NO: 761163 - RNA, 22 nt, Human
acacugaauauacaaugaauau

SEQ ID NO: 761164 - RNA, 22 nt, Human
uaagaacaucuguccccagauu

SEQ ID NO: 761165 - RNA, 22 nt, Human
uugcccaccuuagucuucagac

SEQ ID NO: 761166 - RNA, 22 nt, Human
ugccagcucccuuuucuccucc

SEQ ID NO: 761167 - RNA, 22 nt, Human
acugucaugcauuauggcaugu

SEQ ID NO: 761168 - RNA, 22 nt, Human
auugggcuuuauguaggggaag

SEQ ID NO: 761169 - RNA, 22 nt, Human
uuuucucuacaaaauaaccagc

SEQ ID NO: 761170 - RNA, 20 nt, Human
uacaauauucccacuuugcu

SEQ ID NO: 761171 - RNA, 22 nt, Human
ggaguggcagcgaggaucagau

SEQ ID NO: 761172 - RNA, 22 nt, Human
gaagcaagugcaaggaagaggc

SEQ ID NO: 761173 - RNA, 22 nt, Human
ggcucugaacauggggaggagu

SEQ ID NO: 761174 - RNA, 22 nt, Human
caucugaaaucugccuacaagc

SEQ ID NO: 761175 - RNA, 22 nt, Human
aaggcugucuuuuccucuuccc

SEQ ID NO: 761176 - RNA, 22 nt, Human
uucuguuuugcacagacuugaa

SEQ ID NO: 761177 - RNA, 22 nt, Human
ugcugccagccaggccauggag

SEQ ID NO: 761178 - RNA, 22 nt, Human
aguuucacauagcucagugcuc

SEQ ID NO: 761179 - RNA, 22 nt, Human
uacuacauacagaauuuagaga

SEQ ID NO: 761180 - RNA, 20 nt, Human
acccuccacuguucacugug

SEQ ID NO: 761181 - RNA, 22 nt, Human
uggcaggcaggcagccuucuga

SEQ ID NO: 761182 - RNA, 22 nt, Human
gccaugcaauggaauaaaauca

SEQ ID NO: 761183 - RNA, 22 nt, Human
caggcaccccaggugagcacug

SEQ ID NO: 761184 - RNA, 19 nt, Human
aaugaguuccaugaaaaga

SEQ ID NO: 761185 - RNA, 23 nt, Human
agaacagugacuaauauagagag

SEQ ID NO: 761186 - RNA, 22 nt, Human
gcagcagcggggccccugcgcg

SEQ ID NO: 761187 - RNA, 22 nt, Human
guaugcaugcauguguauguac

SEQ ID NO: 761188 - RNA, 22 nt, Human
gaggaggaaaggaguugaaaug

SEQ ID NO: 761189 - RNA, 22 nt, Human
caggccucaggggcucaggcug

SEQ ID NO: 761190 - RNA, 22 nt, Human
ccuggguggcagagguugcagu

SEQ ID NO: 761191 - RNA, 22 nt, Human
cuccagauccagcugagcugca

SEQ ID NO: 761192 - RNA, 22 nt, Human
uguaacaaugaauauagugacu

SEQ ID NO: 761193 - RNA, 22 nt, Human
gagcuccaccaccuucaggcag

SEQ ID NO: 761194 - RNA, 22 nt, Human
ugugcuccaucauccauaaucu

SEQ ID NO: 761195 - RNA, 22 nt, Human
ucagggcaccaaaaaagaugcc

SEQ ID NO: 761196 - RNA, 22 nt, Human
uaaagcaaugaaaguuuugcag

SEQ ID NO: 761197 - RNA, 22 nt, Human
uucugggcauguuacauucugu

SEQ ID NO: 761198 - RNA, 23 nt, Human
uccagcucccuucaauggcacug

SEQ ID NO: 761199 - RNA, 20 nt, Human
ucccucaguccuggcuuugu

SEQ ID NO: 761200 - RNA, 22 nt, Human
gaaaggccauuucugaggguuu

SEQ ID NO: 761201 - RNA, 22 nt, Human
ucaguggauugacaugaaaaag

SEQ ID NO: 761202 - RNA, 22 nt, Human
acuuggauauguucacuagacc

SEQ ID NO: 761203 - RNA, 22 nt, Human
guggcccuauuugaggacccca

SEQ ID NO: 761204 - RNA, 22 nt, Human
acugcuagugagaaaauaacca

SEQ ID NO: 761205 - RNA, 22 nt, Human
uccuggagcuggugucuuuccc

SEQ ID NO: 761206 - RNA, 22 nt, Human
aaacuucaaggauuugcaaauc

SEQ ID NO: 761207 - RNA, 22 nt, Human
ugucacaaguaacuggcaaugc

SEQ ID NO: 761208 - RNA, 22 nt, Human
ucuucuuccucauuuauacaua

SEQ ID NO: 761209 - RNA, 22 nt, Human
uguuuuuaaauaaugauagaaa

SEQ ID NO: 761210 - RNA, 22 nt, Human
cgugugcgcacaccuguuucca

SEQ ID NO: 761211 - RNA, 22 nt, Human
agagcccuaaacccugccuugg

SEQ ID NO: 761212 - RNA, 19 nt, Human
gcugggcuuggguuuguag

SEQ ID NO: 761213 - RNA, 22 nt, Human
ccuccauguaaagguccccuca

SEQ ID NO: 761214 - RNA, 22 nt, Human
uugaggcacacacagguugcau

SEQ ID NO: 761215 - RNA, 22 nt, Human
ugcuucugggccugguguuccc

SEQ ID NO: 761216 - RNA, 22 nt, Human
aacuggaaagaucaguaggaag

SEQ ID NO: 761217 - RNA, 22 nt, Human
auuaguguuguaagaagcugcc

SEQ ID NO: 761218 - RNA, 19 nt, Human
accagcccacucccaguuu

SEQ ID NO: 761219 - RNA, 22 nt, Human
ugcaagcacucaaugcaaacag

SEQ ID NO: 761220 - RNA, 22 nt, Human
acuagacugggccagucaaauu

SEQ ID NO: 761221 - RNA, 22 nt, Human
ucuuuuaagccucuggcauagg

SEQ ID NO: 761222 - RNA, 22 nt, Human
guguggcuuucuggguuuaauu

SEQ ID NO: 761223 - RNA, 22 nt, Human
uuucuaauaucacuuccagcug

SEQ ID NO: 761224 - RNA, 22 nt, Human
aaaacuuucagggauacagaaa

SEQ ID NO: 761225 - RNA, 22 nt, Human
uuccuggguucccucucauucu

SEQ ID NO: 761226 - RNA, 22 nt, Human
aacagacaacuccuguggcuca

SEQ ID NO: 761227 - RNA, 22 nt, Human
aauccuggccuagcugggcuca

SEQ ID NO: 761228 - RNA, 22 nt, Human
cagaagguuuacacuggacugu

SEQ ID NO: 761229 - RNA, 22 nt, Human
aagcacagggacucaggaccgg

SEQ ID NO: 761230 - RNA, 22 nt, Human
cagucucucuuguagugcagcu

SEQ ID NO: 761231 - RNA, 22 nt, Human
uuugacaguccccugauguuug

SEQ ID NO: 761232 - RNA, 21 nt, Human
gauaaaaugggccuugguccu

SEQ ID NO: 761233 - RNA, 22 nt, Human
ucauggcucuaaagacauagau

SEQ ID NO: 761234 - RNA, 22 nt, Human
cagucccacaagaucuccacaa

SEQ ID NO: 761235 - RNA, 21 nt, Human
uggaggaauaaagcacagaag

SEQ ID NO: 761236 - RNA, 22 nt, Human
guauacaauacacaaugcucug

SEQ ID NO: 761237 - RNA, 22 nt, Human
uaugagaauaaucugguaaaua

SEQ ID NO: 761238 - RNA, 22 nt, Human
cucaccccuguaauuccagcac

SEQ ID NO: 761239 - RNA, 22 nt, Human
aggaagccugcaggugacugcu

SEQ ID NO: 761240 - RNA, 22 nt, Human
ggagaaugauucuuugcucacu

SEQ ID NO: 761241 - RNA, 22 nt, Human
ccucaaauaaguuuuauuuauc

SEQ ID NO: 761242 - RNA, 22 nt, Human
caggcagagugagguggucuaa

SEQ ID NO: 761243 - RNA, 22 nt, Human
agaauuagaggccauguacuug

SEQ ID NO: 761244 - RNA, 22 nt, Human
uggaggugggagggacuguccu

SEQ ID NO: 761245 - RNA, 22 nt, Human
aauaaguugcuucagcuuggug

SEQ ID NO: 761246 - RNA, 22 nt, Human
agagaagggccuguauguaauc

SEQ ID NO: 761247 - RNA, 22 nt, Human
aagggacauagacuguacaucu

SEQ ID NO: 761248 - RNA, 22 nt, Human
agucuggaccugcugggucucc

SEQ ID NO: 761249 - RNA, 22 nt, Human
ggaacacucagaaaugcucguc

SEQ ID NO: 761250 - RNA, 22 nt, Human
gacaucugaauauuagagagaa

SEQ ID NO: 761251 - RNA, 22 nt, Human
ucagaauauauucauguuguca

SEQ ID NO: 761252 - RNA, 22 nt, Human
gugcagguggauuugggcucaa

SEQ ID NO: 761253 - RNA, 22 nt, Human
acuaggggcucaggcccaggga

SEQ ID NO: 761254 - RNA, 22 nt, Human
agggccaccagagcagggcagu

SEQ ID NO: 761255 - RNA, 22 nt, Human
ucaugucaguuucuucuauaaa

SEQ ID NO: 761256 - RNA, 22 nt, Human
uccugaggacccugucaggggc

SEQ ID NO: 761257 - RNA, 22 nt, Human
aagaagguguggaaagaugcuc

SEQ ID NO: 761258 - RNA, 22 nt, Human
gggcuucagauccagggaccuc

SEQ ID NO: 761259 - RNA, 22 nt, Human
auagcuuacaggugauaucagc

SEQ ID NO: 761260 - RNA, 22 nt, Human
uuucuacucauccuuuggagaa

SEQ ID NO: 761261 - RNA, 21 nt, Human
uuuguucaggggcaaaguuaa

SEQ ID NO: 761262 - RNA, 22 nt, Human
aaggaaagacauauaaaugacu

SEQ ID NO: 761263 - RNA, 22 nt, Human
ucacccaagaccaucggaagug

SEQ ID NO: 761264 - RNA, 22 nt, Human
aggcagccuuuuuggaaacaua

SEQ ID NO: 761265 - RNA, 22 nt, Human
cucagggcuugaguguccagga

SEQ ID NO: 761266 - RNA, 20 nt, Human
uccagcccugcuucucucuu

SEQ ID NO: 761267 - RNA, 22 nt, Human
cuuaacauccugcauuuuucuu

SEQ ID NO: 761268 - RNA, 22 nt, Human
uucuggaaguuggaaauagcag

SEQ ID NO: 761269 - RNA, 22 nt, Human
uauuagauuaacuuuaaugucu

SEQ ID NO: 761270 - RNA, 22 nt, Human
ggguguguuccuaaggaaacca

SEQ ID NO: 761271 - RNA, 22 nt, Human
agcuuccuuggcgcugaggccu

SEQ ID NO: 761272 - RNA, 22 nt, Human
acccugaagcaggcacucagcu

SEQ ID NO: 761273 - RNA, 20 nt, Human
ugcugcugcuucacccccau

SEQ ID NO: 761274 - RNA, 20 nt, Human
uuauuuguuuacuuuggucc

SEQ ID NO: 761275 - RNA, 20 nt, Human
acacaugucaagcuaaaggc

SEQ ID NO: 761276 - RNA, 20 nt, Human
cagaggaguacauauguuca

SEQ ID NO: 761277 - RNA, 22 nt, Human
cauacauuuugcauauuuacca

SEQ ID NO: 761278 - RNA, 22 nt, Human
gaggccagcuaguccaggaagu

SEQ ID NO: 761279 - RNA, 22 nt, Human
uuggcagagaguaugcugaaga

SEQ ID NO: 761280 - RNA, 22 nt, Human
ucaggaggccugaguagcucua

SEQ ID NO: 761281 - RNA, 22 nt, Human
uggcagcugauuagauggugcc

SEQ ID NO: 761282 - RNA, 22 nt, Human
aauaaagcaugaggcauuuauc

SEQ ID NO: 761283 - RNA, 22 nt, Human
uuuccucuccaccaggaggucu

SEQ ID NO: 761284 - RNA, 22 nt, Human
aguggcugauguaggcaguggg

SEQ ID NO: 761285 - RNA, 18 nt, Human
ucaggcuggaaguuugcc

SEQ ID NO: 761286 - RNA, 22 nt, Human
gaaggaagccguuucucuccag

SEQ ID NO: 761287 - RNA, 19 nt, Human
cuccaagugccaaggacag

SEQ ID NO: 761288 - RNA, 22 nt, Human
ucuguacaugaguugagaauca

SEQ ID NO: 761289 - RNA, 22 nt, Human
aagaagcagcugccaggccagu

SEQ ID NO: 761290 - RNA, 22 nt, Human
cuggcccuguggccuaaggacu

SEQ ID NO: 761291 - RNA, 22 nt, Human
gaaguuuagguucuuauguuua

SEQ ID NO: 761292 - RNA, 22 nt, Human
acauacuuauguguauaugugu

SEQ ID NO: 761293 - RNA, 22 nt, Human
uauugaaaugaaugacagugau

SEQ ID NO: 761294 - RNA, 22 nt, Human
gccaucugcgcgguguccagcu

SEQ ID NO: 761295 - RNA, 22 nt, Human
uccuguguugauagagaugguu

SEQ ID NO: 761296 - RNA, 17 nt, Human
gcuggcuucuccuugcu

SEQ ID NO: 761297 - RNA, 22 nt, Human
agaugagaauuuuuagagugcu

SEQ ID NO: 761298 - RNA, 20 nt, Human
caguccugucccugcugccc

SEQ ID NO: 761299 - RNA, 22 nt, Human
ccacaucuguucuuaguucuga

SEQ ID NO: 761300 - RNA, 21 nt, Human
ccagagccugagaggauuaug

SEQ ID NO: 761301 - RNA, 22 nt, Human
ugcuguguuaaauacaagcaug

SEQ ID NO: 761302 - RNA, 23 nt, Human
ugaaugauuguacugagcuuuua

SEQ ID NO: 761303 - RNA, 22 nt, Human
agggccagagucuguguagaua

SEQ ID NO: 761304 - RNA, 21 nt, Human
cacuggaauuuucugugacau

SEQ ID NO: 761305 - RNA, 22 nt, Human
uuugaaugacaugauucaggca

SEQ ID NO: 761306 - RNA, 17 nt, Human
cugaggggagugcugug

SEQ ID NO: 761307 - RNA, 22 nt, Human
aggcuucaguuguaccuucuug

SEQ ID NO: 761308 - RNA, 17 nt, Human
ucugagaacuugaagca

SEQ ID NO: 761309 - RNA, 22 nt, Human
uuacaaagcguugagacaagua

SEQ ID NO: 761310 - RNA, 21 nt, Human
agcugagcccagaagacuggu

SEQ ID NO: 761311 - RNA, 22 nt, Human
uugcccugucuuaagcuggcaa

SEQ ID NO: 761312 - RNA, 22 nt, Human
cagcugcuuucagcaggaggga

SEQ ID NO: 761313 - RNA, 22 nt, Human
acucugaaugugcauguaaauc

SEQ ID NO: 761314 - RNA, 22 nt, Human
agagcccugagucaguucugga

SEQ ID NO: 761315 - RNA, 22 nt, Human
ucaaaggauaacugagggcagu

SEQ ID NO: 761316 - RNA, 23 nt, Human
caugcaaacacuauugcauuugg

SEQ ID NO: 761317 - RNA, 22 nt, Human
agggcucaggggccccaagcug

SEQ ID NO: 761318 - RNA, 22 nt, Human
ucacaaaugucuccuguccugu

SEQ ID NO: 761319 - RNA, 22 nt, Human
agagcugggugaagugccauca

SEQ ID NO: 761320 - RNA, 22 nt, Human
uugugugguagcuucauugaac

SEQ ID NO: 761321 - RNA, 22 nt, Human
ugcaguggaggccgugagacag

SEQ ID NO: 761322 - RNA, 22 nt, Human
cauuuuaaaugauuuaagccaa

SEQ ID NO: 761323 - RNA, 22 nt, Human
cucagucaugacgcucaggacc

SEQ ID NO: 761324 - RNA, 22 nt, Human
gugcccaggggccagcugccgg

SEQ ID NO: 761325 - RNA, 22 nt, Human
ugaaagcaaccuguaacaguga

SEQ ID NO: 761326 - RNA, 22 nt, Human
ugcagaagaauguaggcauaag

SEQ ID NO: 761327 - RNA, 22 nt, Human
cugcuggaaguuugcuguggau

SEQ ID NO: 761328 - RNA, 22 nt, Human
accuuuuauguaaauauauguu

SEQ ID NO: 761329 - RNA, 22 nt, Human
cugugagauguuucugguuaga

SEQ ID NO: 761330 - RNA, 22 nt, Human
ccuggacucaggcugugggcac

SEQ ID NO: 761331 - RNA, 22 nt, Human
gccuggcaaggcccuguugacu

SEQ ID NO: 761332 - RNA, 22 nt, Human
cuguauguuccguuuugucacu

SEQ ID NO: 761333 - RNA, 22 nt, Human
uacccucucccgguccagcuuu

SEQ ID NO: 761334 - RNA, 22 nt, Human
uaaagaacacagggaauagcac

SEQ ID NO: 761335 - RNA, 22 nt, Human
uccccagcauugagggucucuc

SEQ ID NO: 761336 - RNA, 22 nt, Human
uguaaagaaagacgcagaguua

SEQ ID NO: 761337 - RNA, 22 nt, Human
ugagcagauggaggcuucugca

SEQ ID NO: 761338 - RNA, 22 nt, Human
aaaggagacuucagaucuccuu

SEQ ID NO: 761339 - RNA, 22 nt, Human
aggcuucagaaagaguaauugg

SEQ ID NO: 761340 - RNA, 22 nt, Human
auucugucuaagcuggcuacgu

SEQ ID NO: 761341 - RNA, 22 nt, Human
ggcuugaagacuaugacauuuc

SEQ ID NO: 761342 - RNA, 22 nt, Human
agccucucaaagaaacccugua

SEQ ID NO: 761343 - RNA, 22 nt, Human
aaggaagagucuagaacaggca

SEQ ID NO: 761344 - RNA, 22 nt, Human
aucauucaaaugauuuggaggu

SEQ ID NO: 761345 - RNA, 20 nt, Human
uccagcugacauucucuuuc

SEQ ID NO: 761346 - RNA, 22 nt, Human
cuaaacuuuuauaacauugaga

SEQ ID NO: 761347 - RNA, 22 nt, Human
ucccaggcugggggccugaagu

SEQ ID NO: 761348 - RNA, 22 nt, Human
agaaaugcagucucgucaaaag

SEQ ID NO: 761349 - RNA, 21 nt, Human
ggcuccugcuuugugaggggc

SEQ ID NO: 761350 - RNA, 22 nt, Human
cugcuucagcaaagcuauuugc

SEQ ID NO: 761351 - RNA, 22 nt, Human
aucuccccgagcuuaccuccug

SEQ ID NO: 761352 - RNA, 22 nt, Human
aggucugauauuuguuguauga

SEQ ID NO: 761353 - RNA, 22 nt, Human
ucaggacaauagugauuuuuac

SEQ ID NO: 761354 - RNA, 22 nt, Human
ucugggaguuagaauacauggg

SEQ ID NO: 761355 - RNA, 22 nt, Human
uccauuuuagagaugaagaaac

SEQ ID NO: 761356 - RNA, 20 nt, Human
agaguaacuggcacauaggg

SEQ ID NO: 761357 - RNA, 18 nt, Human
ugaauguuuucuggaccc

SEQ ID NO: 761358 - RNA, 22 nt, Human
auggggagagaagggcugagcu

SEQ ID NO: 761359 - RNA, 20 nt, Human
gugcauuucaccuguacugu

SEQ ID NO: 761360 - RNA, 22 nt, Human
ucucuaauucaaccagacacuu

SEQ ID NO: 761361 - RNA, 22 nt, Human
acauuguugugcaauuauaguu

SEQ ID NO: 761362 - RNA, 22 nt, Human
acagagcaguucuggagcuggc

SEQ ID NO: 761363 - RNA, 22 nt, Human
ccccacagcuuguggagagaau

SEQ ID NO: 761364 - RNA, 22 nt, Human
uuucauguuggauacuguuuca

SEQ ID NO: 761365 - RNA, 22 nt, Human
cugagccagcgggcucacuuuu

SEQ ID NO: 761366 - RNA, 17 nt, Human
gccuucucugcccucac

SEQ ID NO: 761367 - RNA, 21 nt, Human
gacaggggaagaagcaaggag

SEQ ID NO: 761368 - RNA, 22 nt, Human
cuuugaaaacacacgaauagac

SEQ ID NO: 761369 - RNA, 22 nt, Human
ucacacaggguucuggucucau

SEQ ID NO: 761370 - RNA, 22 nt, Human
aggacuggcagugugagggguc

SEQ ID NO: 761371 - RNA, 22 nt, Human
ucugucuccugccagugccucu

SEQ ID NO: 761372 - RNA, 22 nt, Human
cagaggaaggcucugggaaugu

SEQ ID NO: 761373 - RNA, 22 nt, Human
gagaggcagaggccugaaaccg

SEQ ID NO: 761374 - RNA, 22 nt, Human
ggccacauguggcugcucguau

SEQ ID NO: 761375 - RNA, 22 nt, Human
gguccaaggcucgguggcgggg

SEQ ID NO: 761376 - RNA, 22 nt, Human
cucuggaggccuaaggaagugg

SEQ ID NO: 761377 - RNA, 22 nt, Human
cuugggccaccuggagggacug

SEQ ID NO: 761378 - RNA, 22 nt, Human
ggaggaagggcccaggcuuuau

SEQ ID NO: 761379 - RNA, 22 nt, Human
agaucugaguggcugcauguaa

SEQ ID NO: 761380 - RNA, 22 nt, Human
cagggcuggcuuccaaguuguu

SEQ ID NO: 761381 - RNA, 22 nt, Human
cugggccugugacucccauccu

SEQ ID NO: 761382 - RNA, 22 nt, Human
uuucagaagucaacuagguaaa

SEQ ID NO: 761383 - RNA, 22 nt, Human
auuuccaaaaccacuuauugcc

SEQ ID NO: 761384 - RNA, 22 nt, Human
gugucagaaacaggaaggggaa

SEQ ID NO: 761385 - RNA, 22 nt, Human
guacuuccguggacuaauuguu

SEQ ID NO: 761386 - RNA, 22 nt, Human
gccuuggcugccaagcugcuga

SEQ ID NO: 761387 - RNA, 22 nt, Human
ggcuggccucaggguccucgcu

SEQ ID NO: 761388 - RNA, 22 nt, Human
cuggcucaggguggucuggguc

SEQ ID NO: 761389 - RNA, 22 nt, Human
ugugcuucagguugucgccacg

SEQ ID NO: 761390 - RNA, 21 nt, Human
ugcccacagcaaaugcagagg

SEQ ID NO: 761391 - RNA, 22 nt, Human
ugcuggaggauuaaacaaguca

SEQ ID NO: 761392 - RNA, 22 nt, Human
cugcagaucuuguguacuuguc

SEQ ID NO: 761393 - RNA, 19 nt, Human
ggcugagcgccuuggcugc

SEQ ID NO: 761394 - RNA, 22 nt, Human
auaagagcuacagccaguucug

SEQ ID NO: 761395 - RNA, 22 nt, Human
ggcuagggaucuagaccaggac

SEQ ID NO: 761396 - RNA, 22 nt, Human
auuccuaaaguaauacacuaga

SEQ ID NO: 761397 - RNA, 22 nt, Human
ucugggccugucucagagcugg

SEQ ID NO: 761398 - RNA, 22 nt, Human
aacuucauuccuuuuuaugacu

SEQ ID NO: 761399 - RNA, 22 nt, Human
ucacaguaucuagaaaugaggg

SEQ ID NO: 761400 - RNA, 17 nt, Human
agcagcugaagcagcca

SEQ ID NO: 761401 - RNA, 18 nt, Human
uacugguccuuuuaugau

SEQ ID NO: 761402 - RNA, 22 nt, Human
agagacagacacaucgggcugc

SEQ ID NO: 761403 - RNA, 22 nt, Human
gaaaggggcauguagggaucac

SEQ ID NO: 761404 - RNA, 22 nt, Human
gcugccagcccucggggucuga

SEQ ID NO: 761405 - RNA, 23 nt, Human
aauuuccccugucucugauuugg

SEQ ID NO: 761406 - RNA, 22 nt, Human
gugccucugagcucugcuacag

SEQ ID NO: 761407 - RNA, 22 nt, Human
cacauuccuuacauucauagag

SEQ ID NO: 761408 - RNA, 22 nt, Human
cagcagcaacaacggaagccuu

SEQ ID NO: 761409 - RNA, 18 nt, Human
ucugucucuguccuugcu

SEQ ID NO: 761410 - RNA, 23 nt, Human
ugauagaugucauggucuugagu

SEQ ID NO: 761411 - RNA, 22 nt, Human
ugaugcauugccgacuuacugg

SEQ ID NO: 761412 - RNA, 22 nt, Human
guuaauacaaccaugaucuucu

SEQ ID NO: 761413 - RNA, 22 nt, Human
aggucagaaaaggagagcauug

SEQ ID NO: 761414 - RNA, 22 nt, Human
ccagguguucuuugucccuguu

SEQ ID NO: 761415 - RNA, 22 nt, Human
ccaaggcacacucugcaagguu

SEQ ID NO: 761416 - RNA, 22 nt, Human
uggcuucugucccugcuacauu

SEQ ID NO: 761417 - RNA, 22 nt, Human
uaaggcacccgugagcugccag

SEQ ID NO: 761418 - RNA, 22 nt, Human
cccagggauuauaaaggugaaa

SEQ ID NO: 761419 - RNA, 22 nt, Human
aauaacuucauguaacauuuaa

SEQ ID NO: 761420 - RNA, 22 nt, Human
aggagugugaagagccuagauc

SEQ ID NO: 761421 - RNA, 19 nt, Human
ucuagcaacccacugcaug

SEQ ID NO: 761422 - RNA, 22 nt, Human
gagcccucucuguaggcaagua

SEQ ID NO: 761423 - RNA, 22 nt, Human
uuuaguuugauguucuacuccu

SEQ ID NO: 761424 - RNA, 20 nt, Human
agggcagagggauuacaggc

SEQ ID NO: 761425 - RNA, 22 nt, Human
cuucagaauuccucagccucag

SEQ ID NO: 761426 - RNA, 22 nt, Human
accuccaggaagcucuugguac

SEQ ID NO: 761427 - RNA, 20 nt, Human
agcuccuuuguguccaggau

SEQ ID NO: 761428 - RNA, 22 nt, Human
cuacauuaaauuggcuuacuua

SEQ ID NO: 761429 - RNA, 22 nt, Human
gugcgcuucuuccugagccagg

SEQ ID NO: 761430 - RNA, 22 nt, Human
agcagcuguggaaaaguaacua

SEQ ID NO: 761431 - RNA, 22 nt, Human
gcacagcaguggcauaaacaau

SEQ ID NO: 761432 - RNA, 22 nt, Human
cacuggugaguccagaagucau

SEQ ID NO: 761433 - RNA, 22 nt, Human
gagugugggcacgggggccuug

SEQ ID NO: 761434 - RNA, 22 nt, Human
uuugggaaacuuaggggucaga

SEQ ID NO: 761435 - RNA, 22 nt, Human
gcagcuuugucacggagugucg

SEQ ID NO: 761436 - RNA, 22 nt, Human
ugagauccccaggaaggacaac

SEQ ID NO: 761437 - RNA, 22 nt, Human
ggagagaauuccauggacaugu

SEQ ID NO: 761438 - RNA, 22 nt, Human
ucuggguucuugaugcuaccuu

SEQ ID NO: 761439 - RNA, 22 nt, Human
uucuuuguuugauaaguaugcu

SEQ ID NO: 761440 - RNA, 22 nt, Human
acugcacagucccagaggaugc

SEQ ID NO: 761441 - RNA, 19 nt, Human
acagagcucucugcuucug

SEQ ID NO: 761442 - RNA, 22 nt, Human
cccaaccagaaauugacagaca

SEQ ID NO: 761443 - RNA, 22 nt, Human
uccugaaggagcaguugcuggg

SEQ ID NO: 761444 - RNA, 22 nt, Human
ucauugccauggcauuugcaga

SEQ ID NO: 761445 - RNA, 22 nt, Human
auaaauagugcugccaugagua

SEQ ID NO: 761446 - RNA, 22 nt, Human
uacuguguggugagcugucucc

SEQ ID NO: 761447 - RNA, 23 nt, Human
acaggaggggacagguggccgug

SEQ ID NO: 761448 - RNA, 22 nt, Human
ccugaggacagugugaccaugg

SEQ ID NO: 761449 - RNA, 22 nt, Human
uuucaccucagucuuuuuauau

SEQ ID NO: 761450 - RNA, 22 nt, Human
ugagggagagggcgaaaaugaa

SEQ ID NO: 761451 - RNA, 22 nt, Human
ugcugaugaguccuucuaucgc

SEQ ID NO: 761452 - RNA, 22 nt, Human
uuaaggaaacauuuuuccauag

SEQ ID NO: 761453 - RNA, 22 nt, Human
cugucuguuuuguauacaggcc

SEQ ID NO: 761454 - RNA, 20 nt, Human
ggaccagguggggcgguggc

SEQ ID NO: 761455 - RNA, 22 nt, Human
ucugcaucauuuuucagagccg

SEQ ID NO: 761456 - RNA, 22 nt, Human
uuuucaggccagaagauagacc

SEQ ID NO: 761457 - RNA, 22 nt, Human
cuucagaaugggacuguguuug

SEQ ID NO: 761458 - RNA, 23 nt, Human
uagagcagggaaaucugucagag

SEQ ID NO: 761459 - RNA, 22 nt, Human
caguccagagcccaccagagga

SEQ ID NO: 761460 - RNA, 22 nt, Human
guugggaagcagauggaugagc

SEQ ID NO: 761461 - RNA, 22 nt, Human
ggguuggcagcaccagaggagg

SEQ ID NO: 761462 - RNA, 22 nt, Human
cacauuucucuaccucacacaa

SEQ ID NO: 761463 - RNA, 22 nt, Human
gacacuguuauggugagguaag

SEQ ID NO: 761464 - RNA, 22 nt, Human
augucagaaucuacauucuacu

SEQ ID NO: 761465 - RNA, 21 nt, Human
agcagcugcaguuucuaucug

SEQ ID NO: 761466 - RNA, 22 nt, Human
aaugucuuuuaaccucuggacu

SEQ ID NO: 761467 - RNA, 22 nt, Human
uaccuagaccaguuacaaugca

SEQ ID NO: 761468 - RNA, 22 nt, Human
gagaugacaugccuguuguagg

SEQ ID NO: 761469 - RNA, 22 nt, Human
uccaggccauugacugcauccu

SEQ ID NO: 761470 - RNA, 22 nt, Human
ucagugaucuaaggguauggcc

SEQ ID NO: 761471 - RNA, 20 nt, Human
ccuuucuggagugcuguuca

SEQ ID NO: 761472 - RNA, 22 nt, Human
agagaagcugacaggggcgugc

SEQ ID NO: 761473 - RNA, 22 nt, Human
ggcuccugggcagcugcucccu

SEQ ID NO: 761474 - RNA, 22 nt, Human
acucuuuuauaaagcaucuuga

SEQ ID NO: 761475 - RNA, 22 nt, Human
agcaggcugaugggcaugcuug

SEQ ID NO: 761476 - RNA, 22 nt, Human
ugcuggaauuuugcucuugcaa

SEQ ID NO: 761477 - RNA, 22 nt, Human
uaugcacauuaucuaauccauu

SEQ ID NO: 761478 - RNA, 20 nt, Human
uuauuuccaguccagguccu

SEQ ID NO: 761479 - RNA, 19 nt, Human
uugagaacaccaaguacug

SEQ ID NO: 761480 - RNA, 22 nt, Human
uccugacuuaacuacucucugg

SEQ ID NO: 761481 - RNA, 22 nt, Human
aaggccagccugagagcuaaca

SEQ ID NO: 761482 - RNA, 22 nt, Human
cauucaguggaguauuauucag

SEQ ID NO: 761483 - RNA, 22 nt, Human
acgugcaucuuuccauaugugg

SEQ ID NO: 761484 - RNA, 19 nt, Human
acaaugaauguguucucuu

SEQ ID NO: 761485 - RNA, 22 nt, Human
agagaugaagggcauuccccag

SEQ ID NO: 761486 - RNA, 18 nt, Human
ucaaacugucauugguga

SEQ ID NO: 761487 - RNA, 22 nt, Human
augcauucuggaaaguagcaau

SEQ ID NO: 761488 - RNA, 22 nt, Human
agaagggccagcuggacaccug

SEQ ID NO: 761489 - RNA, 22 nt, Human
acugaaaugaaaucuaucaucu

SEQ ID NO: 761490 - RNA, 18 nt, Human
uggguggcuagggaguuu

SEQ ID NO: 761491 - RNA, 22 nt, Human
aauaugaauuauuguuacaagu

SEQ ID NO: 761492 - RNA, 22 nt, Human
aacuuucuugugacauuugggg

SEQ ID NO: 761493 - RNA, 22 nt, Human
aagaacaugaaccucuucuaac

SEQ ID NO: 761494 - RNA, 22 nt, Human
auucaguuauuuacuuugcuau

SEQ ID NO: 761495 - RNA, 22 nt, Human
uccuuuuuauaguuagagaaac

SEQ ID NO: 761496 - RNA, 22 nt, Human
auuuagacauguaucugauagc

SEQ ID NO: 761497 - RNA, 22 nt, Human
aaugacuuugaaauauuugagu

SEQ ID NO: 761498 - RNA, 22 nt, Human
agggccuggcuucacuuucuca

SEQ ID NO: 761499 - RNA, 22 nt, Human
ugacucugauugccuuagcuug

SEQ ID NO: 761500 - RNA, 22 nt, Human
ugguccugagcaccagccugac

SEQ ID NO: 761501 - RNA, 22 nt, Human
acccucaacaaauucacucuau

SEQ ID NO: 761502 - RNA, 22 nt, Human
uucuggacuugccuugcugaug

SEQ ID NO: 761503 - RNA, 22 nt, Human
aguuuacacuuuugauucuuau

SEQ ID NO: 761504 - RNA, 22 nt, Human
ccaaggcuuccugaccuacaug

SEQ ID NO: 761505 - RNA, 20 nt, Human
uuugucaacugcauccagca

SEQ ID NO: 761506 - RNA, 20 nt, Human
aaaauugcucugcagucccc

SEQ ID NO: 761507 - RNA, 22 nt, Human
acucaggcuagggaaaaagugg

SEQ ID NO: 761508 - RNA, 22 nt, Human
acuccagguuuucucucaaguu

SEQ ID NO: 761509 - RNA, 22 nt, Human
uucagcaagugucucuacuguc

SEQ ID NO: 761510 - RNA, 22 nt, Human
gaaggcauucuauucuacauau

SEQ ID NO: 761511 - RNA, 22 nt, Human
uaguaaaaguuuaguugaaagu

SEQ ID NO: 761512 - RNA, 22 nt, Human
gcaaacuggcaaaccugucugu

SEQ ID NO: 761513 - RNA, 22 nt, Human
gagacacaagacgcaacucugu

SEQ ID NO: 761514 - RNA, 22 nt, Human
auaauuuacuaagcucuaccuu

SEQ ID NO: 761515 - RNA, 22 nt, Human
cuccagcuuuagcucuccaggg

SEQ ID NO: 761516 - RNA, 19 nt, Human
acacaaugacacauauaua

SEQ ID NO: 761517 - RNA, 22 nt, Human
agucgcagacaugguccccuuu

SEQ ID NO: 761518 - RNA, 22 nt, Human
aggcuccauuuuccugcagcug

SEQ ID NO: 761519 - RNA, 22 nt, Human
auacacauauauacacguuuaa

SEQ ID NO: 761520 - RNA, 22 nt, Human
cucccugacaggccaugggcuu

SEQ ID NO: 761521 - RNA, 22 nt, Human
uaaaguucuuagaacaaggccu

SEQ ID NO: 761522 - RNA, 22 nt, Human
guuuuucuaaguagcgauauuu

SEQ ID NO: 761523 - RNA, 22 nt, Human
guggcacagugggagagcccca

SEQ ID NO: 761524 - RNA, 22 nt, Human
cugcaauaugaugucugagaaa

SEQ ID NO: 761525 - RNA, 22 nt, Human
gaggcagaggaagguggucucu

SEQ ID NO: 761526 - RNA, 22 nt, Human
cccccaggcucugacacaggag

SEQ ID NO: 761527 - RNA, 23 nt, Human
aguucucauucaucacggccuau

SEQ ID NO: 761528 - RNA, 22 nt, Human
cucuccuccaacagcccugccg

SEQ ID NO: 761529 - RNA, 22 nt, Human
ggucugcccacuacucuccauu

SEQ ID NO: 761530 - RNA, 22 nt, Human
accaaaaccugcuacuaaagga

SEQ ID NO: 761531 - RNA, 22 nt, Human
ggugugggaacuacagguuuuu

SEQ ID NO: 761532 - RNA, 22 nt, Human
agaaagcagcauuuaugaucuc

SEQ ID NO: 761533 - RNA, 20 nt, Human
aguagcagugugacauugac

SEQ ID NO: 761534 - RNA, 22 nt, Human
ucauucuccucuggaaaaggca

SEQ ID NO: 761535 - RNA, 22 nt, Human
cagacugggagucaggaagaag

SEQ ID NO: 761536 - RNA, 23 nt, Human
guggagagauuaguaauucaccc

SEQ ID NO: 761537 - RNA, 22 nt, Human
aggcauuuuuguuaaucuuugg

SEQ ID NO: 761538 - RNA, 22 nt, Human
caauguaucaaccagaaaguuc

SEQ ID NO: 761539 - RNA, 22 nt, Human
uacagaacugaaguagugaaaa

SEQ ID NO: 761540 - RNA, 23 nt, Human
ugcacaggacggccuuauaagua

SEQ ID NO: 761541 - RNA, 20 nt, Human
ugacucugcaaccgucucuc

SEQ ID NO: 761542 - RNA, 22 nt, Human
cugaggcagaaaaagcaagggu

SEQ ID NO: 761543 - RNA, 22 nt, Human
agcugguggggaagcugcaggu

SEQ ID NO: 761544 - RNA, 22 nt, Human
aggagcugcaaaaccggccgcu

SEQ ID NO: 761545 - RNA, 22 nt, Human
aagcugugaaaucucuagugca

SEQ ID NO: 761546 - RNA, 22 nt, Human
augauuuucugauaaagaacug

SEQ ID NO: 761547 - RNA, 22 nt, Human
gacugaggagguaagguuugaa

SEQ ID NO: 761548 - RNA, 22 nt, Human
aauaucuuggcccaacuccaga

SEQ ID NO: 761549 - RNA, 22 nt, Human
caagggccuccaccuugcucgu

SEQ ID NO: 761550 - RNA, 22 nt, Human
gaggggcugggguugacuccaa

SEQ ID NO: 761551 - RNA, 22 nt, Human
cuguccugaguucuuggagguc

SEQ ID NO: 761552 - RNA, 22 nt, Human
ccucuuugagauucaguuuucc

SEQ ID NO: 761553 - RNA, 22 nt, Human
ugcauuauuugcaugugccugu

SEQ ID NO: 761554 - RNA, 22 nt, Human
accugggaaaaggaguggccau

SEQ ID NO: 761555 - RNA, 22 nt, Human
gaaaugugugacaaguuucaau

SEQ ID NO: 761556 - RNA, 22 nt, Human
gaaaucaauuucuugguugaua

SEQ ID NO: 761557 - RNA, 22 nt, Human
ucccugagcuucaucaggcuuu

SEQ ID NO: 761558 - RNA, 22 nt, Human
aagaaguuaauaauggugagaa

SEQ ID NO: 761559 - RNA, 22 nt, Human
uucucacacuuuccacugaggu

SEQ ID NO: 761560 - RNA, 22 nt, Human
cugcugacaaaauaaaaugcuc

SEQ ID NO: 761561 - RNA, 22 nt, Human
acacagagcuggaacugcuuca

SEQ ID NO: 761562 - RNA, 22 nt, Human
augcuaaaugcuggggguacau

SEQ ID NO: 761563 - RNA, 22 nt, Human
acacaauggcgugugccacaga

SEQ ID NO: 761564 - RNA, 22 nt, Human
uucaagaucuggguuuucagcu

SEQ ID NO: 761565 - RNA, 22 nt, Human
uguucuaugcucuuuaagguga

SEQ ID NO: 761566 - RNA, 22 nt, Human
ggaccaucucuagccagagcuu

SEQ ID NO: 761567 - RNA, 22 nt, Human
agcagcacccagagccaugucu

SEQ ID NO: 761568 - RNA, 22 nt, Human
uuuagaagacagaugcacagcc

SEQ ID NO: 761569 - RNA, 22 nt, Human
aggagaccuuuugagugugaga

SEQ ID NO: 761570 - RNA, 22 nt, Human
aagcaucuaggugacugacaua

SEQ ID NO: 761571 - RNA, 22 nt, Human
ccagaaaauauggcuaagguga

SEQ ID NO: 761572 - RNA, 22 nt, Human
uuugagaagcaucugguccacu

SEQ ID NO: 761573 - RNA, 22 nt, Human
ucuguccauuuuccauuuuggc

SEQ ID NO: 761574 - RNA, 22 nt, Human
gcuggugguaaggaggaaaaag

SEQ ID NO: 761575 - RNA, 22 nt, Human
gggcuccaaccccagugaacuc

SEQ ID NO: 761576 - RNA, 22 nt, Human
guuuaacaucugugaagcugcu

SEQ ID NO: 761577 - RNA, 22 nt, Human
uuggagagggcuuggaucacac

SEQ ID NO: 761578 - RNA, 22 nt, Human
aagagcaguguuuuacucagcu

SEQ ID NO: 761579 - RNA, 22 nt, Human
gcagguagugaucgagggugac

SEQ ID NO: 761580 - RNA, 22 nt, Human
gggccugaaaccuucagggcuu

SEQ ID NO: 761581 - RNA, 22 nt, Human
gcugggcagcugaggccucuca

SEQ ID NO: 761582 - RNA, 22 nt, Human
cauugucauucuaugcuauuca

SEQ ID NO: 761583 - RNA, 20 nt, Human
cagauaaacgggaaagaagc

SEQ ID NO: 761584 - RNA, 22 nt, Human
ucaaguauaucuagucauuagg

SEQ ID NO: 761585 - RNA, 19 nt, Human
ggcuucagggaguuagcau

SEQ ID NO: 761586 - RNA, 22 nt, Human
agccaguuuaagcaggaggggu

SEQ ID NO: 761587 - RNA, 22 nt, Human
uuccaugccucuauuuagaauu

SEQ ID NO: 761588 - RNA, 22 nt, Human
gaagaacugacaaacuagauca

SEQ ID NO: 761589 - RNA, 23 nt, Human
aaaaucuucugccuaugaagaaa

SEQ ID NO: 761590 - RNA, 22 nt, Human
uaaauguguaaaccuccauuac

SEQ ID NO: 761591 - RNA, 23 nt, Human
aagagcuauacauucaccuggua

SEQ ID NO: 761592 - RNA, 22 nt, Human
uuccaccauucaugcuaauauu

SEQ ID NO: 761593 - RNA, 22 nt, Human
uccugaagaacgaagucaugua

SEQ ID NO: 761594 - RNA, 22 nt, Human
accagagaugucuaauaggggc

SEQ ID NO: 761595 - RNA, 22 nt, Human
cuguggcuaugguguacauacu

SEQ ID NO: 761596 - RNA, 20 nt, Human
ucauuccaaauaguucagca

SEQ ID NO: 761597 - RNA, 22 nt, Human
aagagcugauuaagucaugagg

SEQ ID NO: 761598 - RNA, 22 nt, Human
ugcuggcuuauuuaguaaaugu

SEQ ID NO: 761599 - RNA, 22 nt, Human
cuuccagucuuuucaguggagu

SEQ ID NO: 761600 - RNA, 22 nt, Human
acuauaaccuguuagaauagau

SEQ ID NO: 761601 - RNA, 22 nt, Human
uccaguacaggucucucauuuc

SEQ ID NO: 761602 - RNA, 22 nt, Human
caggggcuagcacuuaauguuu

SEQ ID NO: 761603 - RNA, 22 nt, Human
cugcagcuccccugagaucaag

SEQ ID NO: 761604 - RNA, 22 nt, Human
ugagcagaacacgggauccaug

SEQ ID NO: 761605 - RNA, 22 nt, Human
ccaggccaaauucagucagcag

SEQ ID NO: 761606 - RNA, 18 nt, Human
uuccaugauuccuuucac

SEQ ID NO: 761607 - RNA, 22 nt, Human
uuccuggcaccaccacuucuag

SEQ ID NO: 761608 - RNA, 20 nt, Human
gugcccugugggcuauuuuc

SEQ ID NO: 761609 - RNA, 22 nt, Human
aacccaggucuuuggcuuccag

SEQ ID NO: 761610 - RNA, 22 nt, Human
uccagggagauacuggcugcca

SEQ ID NO: 761611 - RNA, 22 nt, Human
cuguucuucugggaauggcccu

SEQ ID NO: 761612 - RNA, 19 nt, Human
gccaggagggcucuggcug

SEQ ID NO: 761613 - RNA, 22 nt, Human
uuuaccacaauuuuaaacaaug

SEQ ID NO: 761614 - RNA, 22 nt, Human
augaaaagcauaaacgcugaag

SEQ ID NO: 761615 - RNA, 22 nt, Human
ggacagcguggcugguggaggg

SEQ ID NO: 761616 - RNA, 20 nt, Human
gucagaggacccuagagcga

SEQ ID NO: 761617 - RNA, 22 nt, Human
ggaggcucgcuggucgcacagc

SEQ ID NO: 761618 - RNA, 21 nt, Human
cugguguagcacucaggugcu

SEQ ID NO: 761619 - RNA, 20 nt, Human
accccagccccucuaucuga

SEQ ID NO: 761620 - RNA, 22 nt, Human
cugagcagucugacucaagcua

SEQ ID NO: 761621 - RNA, 22 nt, Human
cugaggcaggauggccuggcug

SEQ ID NO: 761622 - RNA, 22 nt, Human
ucaacagaagugauagcuauua

SEQ ID NO: 761623 - RNA, 22 nt, Human
uaugaaaauuuagcugaagcau

SEQ ID NO: 761624 - RNA, 22 nt, Human
cuccucccucuuugccacacau

SEQ ID NO: 761625 - RNA, 22 nt, Human
acaaaggcauagugaauguuuu

SEQ ID NO: 761626 - RNA, 22 nt, Human
aaagugcugggauuacaggccu

SEQ ID NO: 761627 - RNA, 23 nt, Human
aucucucugguggucacagucag

SEQ ID NO: 761628 - RNA, 22 nt, Human
aggccaggaauccuugucccag

SEQ ID NO: 761629 - RNA, 22 nt, Human
augcacagauccuggcacuuag

SEQ ID NO: 761630 - RNA, 22 nt, Human
ccuuuacaguagcccuuuugaa

SEQ ID NO: 761631 - RNA, 22 nt, Human
ugggaacaacaugcacugccac

SEQ ID NO: 761632 - RNA, 22 nt, Human
uggcuccagaucugucuccugu

SEQ ID NO: 761633 - RNA, 22 nt, Human
gucuggcuuuugcccuguguuu

SEQ ID NO: 761634 - RNA, 22 nt, Human
uguguuaauuccacaaacauuc

SEQ ID NO: 761635 - RNA, 22 nt, Human
cagcccugucccugagggaccu

SEQ ID NO: 761636 - RNA, 22 nt, Human
aaggucuguggccaccucuggg

SEQ ID NO: 761637 - RNA, 22 nt, Human
cuagggcuagacagacgcaugu

SEQ ID NO: 761638 - RNA, 19 nt, Human
ucuugcagccccagcaggc

SEQ ID NO: 761639 - RNA, 22 nt, Human
ggcuccuguccuccuggagcuc

SEQ ID NO: 761640 - RNA, 20 nt, Human
cucaggauacugcaaaguug

SEQ ID NO: 761641 - RNA, 22 nt, Human
uugcugugaaaccaugggaagu

SEQ ID NO: 761642 - RNA, 22 nt, Human
agcgggugcugugucagcccuc

SEQ ID NO: 761643 - RNA, 22 nt, Human
gcccuuacaggguggucagcca

SEQ ID NO: 761644 - RNA, 22 nt, Human
gcucagagauguucaguagcuu

SEQ ID NO: 761645 - RNA, 22 nt, Human
cggcccugaccagaccuuaguu

SEQ ID NO: 761646 - RNA, 22 nt, Human
caggauugaaugcuucucccug

SEQ ID NO: 761647 - RNA, 22 nt, Human
ugcauggaacggucuccugguc

SEQ ID NO: 761648 - RNA, 20 nt, Human
uuacagaaaugauguuauuu

SEQ ID NO: 761649 - RNA, 22 nt, Human
auggaagcagacagguaauucc

SEQ ID NO: 761650 - RNA, 22 nt, Human
aaaaucuugugacuuaggaagg

SEQ ID NO: 761651 - RNA, 22 nt, Human
ccugccagucacuaugucaccu

SEQ ID NO: 761652 - RNA, 22 nt, Human
gguuucagcccugcuguuccug

SEQ ID NO: 761653 - RNA, 22 nt, Human
cuagggaaauaaacugaguggu

SEQ ID NO: 761654 - RNA, 22 nt, Human
cauguuaaugaauuuuugcagu

SEQ ID NO: 761655 - RNA, 22 nt, Human
uaaagugugcauggucaaauau

SEQ ID NO: 761656 - RNA, 19 nt, Human
ggacagggggagcuuuuau

SEQ ID NO: 761657 - RNA, 22 nt, Human
acagggcuccuagguggugugc

SEQ ID NO: 761658 - RNA, 22 nt, Human
uacauuugcuuugauuuucagc

SEQ ID NO: 761659 - RNA, 22 nt, Human
uccuugaaaagaaugucuccau

SEQ ID NO: 761660 - RNA, 22 nt, Human
gauauucaaguggaauuauucu

SEQ ID NO: 761661 - RNA, 22 nt, Human
uguuuauagggucugucacuug

SEQ ID NO: 761662 - RNA, 22 nt, Human
cuguauaucaugguuuugcagu

SEQ ID NO: 761663 - RNA, 22 nt, Human
ugggggcugaguaagaugagau

SEQ ID NO: 761664 - RNA, 22 nt, Human
auuaccacuuaaucaacauaug

SEQ ID NO: 761665 - RNA, 21 nt, Human
gugcggaugccgucauuguca

SEQ ID NO: 761666 - RNA, 22 nt, Human
cugggagaucuguugggacugg

SEQ ID NO: 761667 - RNA, 22 nt, Human
aaggggaaguagcaccagaggu

SEQ ID NO: 761668 - RNA, 22 nt, Human
cucugugguaaaauagcaguau

SEQ ID NO: 761669 - RNA, 20 nt, Human
cccaggugucugaagcucug

SEQ ID NO: 761670 - RNA, 22 nt, Human
agaucugguuggaguccugaca

SEQ ID NO: 761671 - RNA, 22 nt, Human
uuugaagagccacagugaaauu

SEQ ID NO: 761672 - RNA, 22 nt, Human
aggggagacuggaaucuaacau

SEQ ID NO: 761673 - RNA, 22 nt, Human
agaaacuguguuacuagaaugu

SEQ ID NO: 761674 - RNA, 22 nt, Human
augggaggaagagaagaugucu

SEQ ID NO: 761675 - RNA, 22 nt, Human
ccucagaagcucaaggacauug

SEQ ID NO: 761676 - RNA, 23 nt, Human
gcugccuccuacaaaagcccagc

SEQ ID NO: 761677 - RNA, 22 nt, Human
aucucuuaugucacauaaacca

SEQ ID NO: 761678 - RNA, 19 nt, Human
uucacaagugaugucucuc

SEQ ID NO: 761679 - RNA, 22 nt, Human
cugcuguguaucauuuuagaug

SEQ ID NO: 761680 - RNA, 22 nt, Human
cagugcccaaaggaacagaaag

SEQ ID NO: 761681 - RNA, 22 nt, Human
ucaggaagccacuccacagaga

SEQ ID NO: 761682 - RNA, 22 nt, Human
ugcaggcccaguguagaggcuc

SEQ ID NO: 761683 - RNA, 22 nt, Human
agggauggaagacuugaagacc

SEQ ID NO: 761684 - RNA, 22 nt, Human
aacagccugagagaacaaugau

SEQ ID NO: 761685 - RNA, 22 nt, Human
aucaagaguauugacaagacca

SEQ ID NO: 761686 - RNA, 22 nt, Human
agggcugaggcgagggagaugc

SEQ ID NO: 761687 - RNA, 22 nt, Human
uguccuggguggaugcuucauu

SEQ ID NO: 761688 - RNA, 22 nt, Human
aucaguuuugggggacauacug

SEQ ID NO: 761689 - RNA, 22 nt, Human
agccaggauuggcugagccuua

SEQ ID NO: 761690 - RNA, 22 nt, Human
ugcuggaaaguuaaauuuugga

SEQ ID NO: 761691 - RNA, 22 nt, Human
acugagcugcaagucagggagg

SEQ ID NO: 761692 - RNA, 22 nt, Human
acagagcccuuccuugcaccau

SEQ ID NO: 761693 - RNA, 22 nt, Human
cagacauggcgccaagugcuag

SEQ ID NO: 761694 - RNA, 22 nt, Human
guuuccaucuccaggacauaau

SEQ ID NO: 761695 - RNA, 22 nt, Human
uuuuagauuauaagucuaauuc

SEQ ID NO: 761696 - RNA, 22 nt, Human
uucccuggcucuucuacaucgu

SEQ ID NO: 761697 - RNA, 18 nt, Human
cuacauucauaggaaagg

SEQ ID NO: 761698 - RNA, 22 nt, Human
aggcauuacaucuaaauauuua

SEQ ID NO: 761699 - RNA, 22 nt, Human
agaggagugggaagcagugcaa

SEQ ID NO: 761700 - RNA, 22 nt, Human
uagugucuauugaccggaaaga

SEQ ID NO: 761701 - RNA, 22 nt, Human
aaacauguaaguucagaucacc

SEQ ID NO: 761702 - RNA, 22 nt, Human
cuccugagcucugaggaagcuu

SEQ ID NO: 761703 - RNA, 22 nt, Human
acugaauaauggucugugaucu

SEQ ID NO: 761704 - RNA, 22 nt, Human
ggcagagcuugcagugagccga

SEQ ID NO: 761705 - RNA, 22 nt, Human
agcagccaauuggaggaugaag

SEQ ID NO: 761706 - RNA, 22 nt, Human
aagccaggcaugcuuggacagu

SEQ ID NO: 761707 - RNA, 22 nt, Human
aacacugucagccuuugaugga

SEQ ID NO: 761708 - RNA, 22 nt, Human
ugcagagaaaccaguggaggac

SEQ ID NO: 761709 - RNA, 22 nt, Human
aucuuugaagaggacuugaagu

SEQ ID NO: 761710 - RNA, 22 nt, Human
gcuggagaaacaggaggaggaa

SEQ ID NO: 761711 - RNA, 22 nt, Human
aacaaaguguacuuccauacug

SEQ ID NO: 761712 - RNA, 22 nt, Human
gcuggcuguaucaccuggccag

SEQ ID NO: 761713 - RNA, 22 nt, Human
gggaagugugguuucuuuacag

SEQ ID NO: 761714 - RNA, 22 nt, Human
uauagcaaggacauaauaugcu

SEQ ID NO: 761715 - RNA, 22 nt, Human
uuucuauuuuaaaggcauaugg

SEQ ID NO: 761716 - RNA, 22 nt, Human
aauauaauuuuauuccuagagu

SEQ ID NO: 761717 - RNA, 22 nt, Human
aaguccaucucugccccacaca

SEQ ID NO: 761718 - RNA, 22 nt, Human
cucacauucacaggacagaagg

SEQ ID NO: 761719 - RNA, 22 nt, Human
guggcuuccaagacuaagucac

SEQ ID NO: 761720 - RNA, 20 nt, Human
cucagcuaaacaacacugac

SEQ ID NO: 761721 - RNA, 22 nt, Human
agaggccucccucccagcuggu

SEQ ID NO: 761722 - RNA, 22 nt, Human
gguacaauggaccauaaaagcu

SEQ ID NO: 761723 - RNA, 22 nt, Human
gagcacagcagggcucugggug

SEQ ID NO: 761724 - RNA, 22 nt, Human
caaagugcugggauuauaggca

SEQ ID NO: 761725 - RNA, 22 nt, Human
caauagaaaacucaauacuuaa

SEQ ID NO: 761726 - RNA, 22 nt, Human
cugcuuggcuuauaaccucagg

SEQ ID NO: 761727 - RNA, 22 nt, Human
guuaaugucacuuuauguggcu

SEQ ID NO: 761728 - RNA, 22 nt, Human
ucuuccugaaacccuguuccag

SEQ ID NO: 761729 - RNA, 22 nt, Human
uggaaggagacugggaagugug

SEQ ID NO: 761730 - RNA, 22 nt, Human
aacacuuuguugccuaugaacg

SEQ ID NO: 761731 - RNA, 18 nt, Human
guccacagauucuucacu

SEQ ID NO: 761732 - RNA, 22 nt, Human
auguacauaaaauguauaauga

SEQ ID NO: 761733 - RNA, 22 nt, Human
aaaguauuuuugacaggcauua

SEQ ID NO: 761734 - RNA, 22 nt, Human
gagcugccugaacaagcagcag

SEQ ID NO: 761735 - RNA, 21 nt, Human
cugugucgcucucgcugggag

SEQ ID NO: 761736 - RNA, 22 nt, Human
gcacugugcuagaagccagggg

SEQ ID NO: 761737 - RNA, 22 nt, Human
auguuacaauccaacaaaauua

SEQ ID NO: 761738 - RNA, 22 nt, Human
gcaugcauuuccauucucacau

SEQ ID NO: 761739 - RNA, 22 nt, Human
ugcuuuauguggcugauacuca

SEQ ID NO: 761740 - RNA, 22 nt, Human
ugcagcccuuccuuccucuggg

SEQ ID NO: 761741 - RNA, 22 nt, Human
agagcuuagaauuucagaugau

SEQ ID NO: 761742 - RNA, 22 nt, Human
uagggcugugucuccaggacca

SEQ ID NO: 761743 - RNA, 22 nt, Human
ccaggcugggcuacaaguugag

SEQ ID NO: 761744 - RNA, 22 nt, Human
uccaggauggugacgguggcca

SEQ ID NO: 761745 - RNA, 22 nt, Human
uagaugcugaaacauggaggcg

SEQ ID NO: 761746 - RNA, 22 nt, Human
auuguucuguagugacauguag

SEQ ID NO: 761747 - RNA, 22 nt, Human
gaggauguaaaauagacaaaau

SEQ ID NO: 761748 - RNA, 22 nt, Human
agcaugaaagcauaggacaguc

SEQ ID NO: 761749 - RNA, 22 nt, Human
aaggagcgcuuagggggcagaa

SEQ ID NO: 761750 - RNA, 22 nt, Human
uguuccugaggcaugugucaau

SEQ ID NO: 761751 - RNA, 22 nt, Human
aaaggccagguuggcugguauu

SEQ ID NO: 761752 - RNA, 22 nt, Human
aggcaccugagguggccagccu

SEQ ID NO: 761753 - RNA, 22 nt, Human
caguggaagcuggcugugaaga

SEQ ID NO: 761754 - RNA, 22 nt, Human
gcagagccugggggucugcgga

SEQ ID NO: 761755 - RNA, 22 nt, Human
gcacugaaugcuuuuacuguaa

SEQ ID NO: 761756 - RNA, 22 nt, Human
ugggugguugcugaggcuccuu

SEQ ID NO: 761757 - RNA, 22 nt, Human
gaguuaaauagcuuaggauuca

SEQ ID NO: 761758 - RNA, 22 nt, Human
ggucacaagguacuguaagaaa

SEQ ID NO: 761759 - RNA, 22 nt, Human
cagaguggcacucugcuggaug

SEQ ID NO: 761760 - RNA, 22 nt, Human
gggucccaggaaggagcagugu

SEQ ID NO: 761761 - RNA, 22 nt, Human
acugagguuauugcaauaaaau

SEQ ID NO: 761762 - RNA, 22 nt, Human
acaguguuauuucugaguaaug

SEQ ID NO: 761763 - RNA, 22 nt, Human
cagcacaggccccucucuccca

SEQ ID NO: 761764 - RNA, 22 nt, Human
uguuuacuuuccuucucacagg

SEQ ID NO: 761765 - RNA, 22 nt, Human
cccagguggcagaagcugcagu

SEQ ID NO: 761766 - RNA, 21 nt, Human
agaucauucuucugagcacuu

SEQ ID NO: 761767 - RNA, 22 nt, Human
agcuuccugucuucugcacaaa

SEQ ID NO: 761768 - RNA, 17 nt, Human
aaggagcugagagaugg

SEQ ID NO: 761769 - RNA, 22 nt, Human
uguuuagaugcaaagucucaca

SEQ ID NO: 761770 - RNA, 22 nt, Human
aucuggcuuuuaccccacggcc

SEQ ID NO: 761771 - RNA, 20 nt, Human
uucagaguuuacucaaacug

SEQ ID NO: 761772 - RNA, 20 nt, Human
gcagagccucacugcaaggg

SEQ ID NO: 761773 - RNA, 22 nt, Human
ugcuaaauucauuauugauuua

SEQ ID NO: 761774 - RNA, 22 nt, Human
cucugcugccaccagaaccacu

SEQ ID NO: 761775 - RNA, 22 nt, Human
ucagcaggugcuuuguuuacuc

SEQ ID NO: 761776 - RNA, 22 nt, Human
guuaaagaguuuggcuuucuuc

SEQ ID NO: 761777 - RNA, 22 nt, Human
aucaucuuaaaucuagaaugug

SEQ ID NO: 761778 - RNA, 22 nt, Human
aagcaucuucuaucaguuagac

SEQ ID NO: 761779 - RNA, 22 nt, Human
aggcaacaaggguagucaguga

SEQ ID NO: 761780 - RNA, 20 nt, Human
uccuugaaagugggguauau

SEQ ID NO: 761781 - RNA, 22 nt, Human
uaaggccaaggggccauagucu

SEQ ID NO: 761782 - RNA, 22 nt, Human
auggcuuuuuagacuuugguac

SEQ ID NO: 761783 - RNA, 22 nt, Human
caaaauuagggagugagcugga

SEQ ID NO: 761784 - RNA, 21 nt, Human
guguggauaugugacaggugg

SEQ ID NO: 761785 - RNA, 22 nt, Human
gagaggccaaaaucccugcccc

SEQ ID NO: 761786 - RNA, 22 nt, Human
ccuccuggaggcucuagggaaa

SEQ ID NO: 761787 - RNA, 22 nt, Human
cuagccaacaccuuauuuucug

SEQ ID NO: 761788 - RNA, 22 nt, Human
ugaguucuuuccguuagguaug

SEQ ID NO: 761789 - RNA, 22 nt, Human
auuguguccucauugaccuuca

SEQ ID NO: 761790 - RNA, 22 nt, Human
ucauguuauugacucauaauau

SEQ ID NO: 761791 - RNA, 22 nt, Human
auuuggaugcacuaaauaaaau

SEQ ID NO: 761792 - RNA, 22 nt, Human
agagagagggaaacugcuaaac

SEQ ID NO: 761793 - RNA, 22 nt, Human
ggggcugggauuugaacccagg

SEQ ID NO: 761794 - RNA, 22 nt, Human
auugcuguaaauuaucuuauua

SEQ ID NO: 761795 - RNA, 22 nt, Human
uauacaagaggugagaugagca

SEQ ID NO: 761796 - RNA, 22 nt, Human
ccugccaugccagcaugcccgu

SEQ ID NO: 761797 - RNA, 22 nt, Human
auggcagccugagcagaggaau

SEQ ID NO: 761798 - RNA, 22 nt, Human
guccagcccgggcuccgccagc

SEQ ID NO: 761799 - RNA, 22 nt, Human
uuucuaucuaggguuagaguga

SEQ ID NO: 761800 - RNA, 22 nt, Human
agugugggugagggaggcccuc

SEQ ID NO: 761801 - RNA, 22 nt, Human
ucccaggaaggauucggcauuu

SEQ ID NO: 761802 - RNA, 22 nt, Human
uaugcaauucucuuaauauucu

SEQ ID NO: 761803 - RNA, 22 nt, Human
uucuuuggggucuccagcauag

SEQ ID NO: 761804 - RNA, 22 nt, Human
ucuguaguagguuguaguucuu

SEQ ID NO: 761805 - RNA, 21 nt, Human
gccagcugggucuugcaggag

SEQ ID NO: 761806 - RNA, 22 nt, Human
ucauugaauucuggggguugag

SEQ ID NO: 761807 - RNA, 22 nt, Human
uuaacauccuguuuaaauuugg

SEQ ID NO: 761808 - RNA, 22 nt, Human
cuucaagauccauagauauugc

SEQ ID NO: 761809 - RNA, 22 nt, Human
ucacaguuuccauaggucagca

SEQ ID NO: 761810 - RNA, 22 nt, Human
agagcccaucaguggcagugga

SEQ ID NO: 761811 - RNA, 22 nt, Human
uucaaagcaagacacaauuccu

SEQ ID NO: 761812 - RNA, 22 nt, Human
uuuacagggaauauuuuggcuu

SEQ ID NO: 761813 - RNA, 22 nt, Human
gcagggcaaauguggaaaggag

SEQ ID NO: 761814 - RNA, 22 nt, Human
ucuacccagagcuaugaccuga

SEQ ID NO: 761815 - RNA, 22 nt, Human
aggggaauggguagacuguuga

SEQ ID NO: 761816 - RNA, 22 nt, Human
uuaugaaagacauuucuguugg

SEQ ID NO: 761817 - RNA, 18 nt, Human
gaaaugugauucuagggc

SEQ ID NO: 761818 - RNA, 22 nt, Human
ugcugucccuaagucucuucaa

SEQ ID NO: 761819 - RNA, 22 nt, Human
uccagcuccucuacccgaugcg

SEQ ID NO: 761820 - RNA, 22 nt, Human
aggcagcaugggccccagcucc

SEQ ID NO: 761821 - RNA, 22 nt, Human
ccugggucaccaggcccaggca

SEQ ID NO: 761822 - RNA, 22 nt, Human
uucaauacaaagaaaggaauuu

SEQ ID NO: 761823 - RNA, 22 nt, Human
aauucccaccuucucucuuuug

SEQ ID NO: 761824 - RNA, 18 nt, Human
aaauguacuguccauggc

SEQ ID NO: 761825 - RNA, 18 nt, Human
cugucagcagcuucacga

SEQ ID NO: 761826 - RNA, 22 nt, Human
ccugaagagugaauguggcagu

SEQ ID NO: 761827 - RNA, 22 nt, Human
ggaggcucuccuggccuugucu

SEQ ID NO: 761828 - RNA, 22 nt, Human
ugugcucugcaaucaguucuuu

SEQ ID NO: 761829 - RNA, 22 nt, Human
acuccccaaaacuaaccaugca

SEQ ID NO: 761830 - RNA, 22 nt, Human
gcucugccucuuugcugcguca

SEQ ID NO: 761831 - RNA, 22 nt, Human
caggaaauugcaacagucugag

SEQ ID NO: 761832 - RNA, 22 nt, Human
uuucaaaccuacuuguauguuu

SEQ ID NO: 761833 - RNA, 22 nt, Human
cucuggaauugaccugggaggg

SEQ ID NO: 761834 - RNA, 19 nt, Human
ugcaggaggacugagcaga

SEQ ID NO: 761835 - RNA, 22 nt, Human
aacagucaaaguuugguuccuu

SEQ ID NO: 761836 - RNA, 22 nt, Human
uguauuugugauaacgaccuga

SEQ ID NO: 761837 - RNA, 22 nt, Human
ccaggagagcucuaaauggcug

SEQ ID NO: 761838 - RNA, 22 nt, Human
gccuggcuaguuagugucaggu

SEQ ID NO: 761839 - RNA, 22 nt, Human
uccaguccagggaauggcugau

SEQ ID NO: 761840 - RNA, 22 nt, Human
caucaggaggagaugaagaaaa

SEQ ID NO: 761841 - RNA, 22 nt, Human
cagcucuguaaauuccuucauc

SEQ ID NO: 761842 - RNA, 18 nt, Human
agacaaacuucuucugcc

SEQ ID NO: 761843 - RNA, 22 nt, Human
ucuucaugucucugcuugaguc

SEQ ID NO: 761844 - RNA, 22 nt, Human
guagggcaacaugggcacuagg

SEQ ID NO: 761845 - RNA, 22 nt, Human
gggcaguuuauucuagaugguu

SEQ ID NO: 761846 - RNA, 22 nt, Human
cagcaguacuucucagagguau

SEQ ID NO: 761847 - RNA, 22 nt, Human
ccagcuccacugucagaugaga

SEQ ID NO: 761848 - RNA, 17 nt, Human
aguuuauuuagccuucu

SEQ ID NO: 761849 - RNA, 22 nt, Human
auuuauaacgugcagccagggu

SEQ ID NO: 761850 - RNA, 22 nt, Human
ucucugauguauaucagagaac

SEQ ID NO: 761851 - RNA, 23 nt, Human
ugggaauugcaggggguucugcc

SEQ ID NO: 761852 - RNA, 21 nt, Human
ugaaacauuugaucaaagcac

SEQ ID NO: 761853 - RNA, 22 nt, Human
auuuuuccaauuaggauaaaga

SEQ ID NO: 761854 - RNA, 22 nt, Human
uucugggaugugaaugguuuaa

SEQ ID NO: 761855 - RNA, 22 nt, Human
cagaggguggaggccaggcucu

SEQ ID NO: 761856 - RNA, 22 nt, Human
cagaggauuauggagauggucu

SEQ ID NO: 761857 - RNA, 22 nt, Human
ucacaucauuaagacuucuccu

SEQ ID NO: 761858 - RNA, 22 nt, Human
cuggaaggcagagguugcagug

SEQ ID NO: 761859 - RNA, 22 nt, Human
agggcuuugcaaugcacagugg

SEQ ID NO: 761860 - RNA, 22 nt, Human
uacaggagcacaaaagaguuga

SEQ ID NO: 761861 - RNA, 22 nt, Human
cucaggcuaagaaggccaagug

SEQ ID NO: 761862 - RNA, 23 nt, Human
cccagcgcugagcccugcaggca

SEQ ID NO: 761863 - RNA, 22 nt, Human
uccagcuggcuucggaagugga

SEQ ID NO: 761864 - RNA, 22 nt, Human
cacguuuuaugacagaagaagc

SEQ ID NO: 761865 - RNA, 22 nt, Human
cagccccucacagagcuguccu

SEQ ID NO: 761866 - RNA, 20 nt, Human
gggcuagguagccauuuggc

SEQ ID NO: 761867 - RNA, 22 nt, Human
gaagccacuauagauauucuaa

SEQ ID NO: 761868 - RNA, 22 nt, Human
gaaaucuuuuccaauuguuuag

SEQ ID NO: 761869 - RNA, 22 nt, Human
ucacaacuugaagcugauuuaa

SEQ ID NO: 761870 - RNA, 22 nt, Human
ggaaggaggaugcucuggccuu

SEQ ID NO: 761871 - RNA, 22 nt, Human
aggcaccucuuaggcugcuacu

SEQ ID NO: 761872 - RNA, 23 nt, Human
aacaggaugugcuucaucuuuug

SEQ ID NO: 761873 - RNA, 22 nt, Human
ugauuauauuaacuauguuccu

SEQ ID NO: 761874 - RNA, 22 nt, Human
acaggcagguaauuuacauauu

SEQ ID NO: 761875 - RNA, 22 nt, Human
ggcagcugagaucaugcuguug

SEQ ID NO: 761876 - RNA, 22 nt, Human
uucacauucagaaaaagcccgu

SEQ ID NO: 761877 - RNA, 22 nt, Human
uggagaggagcaccauggccau

SEQ ID NO: 761878 - RNA, 20 nt, Human
ucucuguaaaucuucuuuua

SEQ ID NO: 761879 - RNA, 22 nt, Human
gcagaaguaccucguucuaguu

SEQ ID NO: 761880 - RNA, 22 nt, Human
gaauucuaggguaaauauccua

SEQ ID NO: 761881 - RNA, 22 nt, Human
ugccuggcaacuguggugggcu

SEQ ID NO: 761882 - RNA, 22 nt, Human
ggcugagaguuuccucuggggc

SEQ ID NO: 761883 - RNA, 22 nt, Human
ugaggauuuaaugggacucauu

SEQ ID NO: 761884 - RNA, 22 nt, Human
gaaaacuaacggaaaaguuagg

SEQ ID NO: 761885 - RNA, 22 nt, Human
ugucuccacaggugucagcuca

SEQ ID NO: 761886 - RNA, 22 nt, Human
uguguggguacagaugauuguu

SEQ ID NO: 761887 - RNA, 22 nt, Human
cauuucaaacaguuacagcugc

SEQ ID NO: 761888 - RNA, 17 nt, Human
gugccuguuguccugga

SEQ ID NO: 761889 - RNA, 22 nt, Human
caauugcuuucuuaccaagaga

SEQ ID NO: 761890 - RNA, 22 nt, Human
uccugagaugagacagugcugc

SEQ ID NO: 761891 - RNA, 22 nt, Human
guuacaguggguuuggggccca

SEQ ID NO: 761892 - RNA, 22 nt, Human
ccugcucugguuuagucagucu

SEQ ID NO: 761893 - RNA, 22 nt, Human
acaggggaccuaggacccucgg

SEQ ID NO: 761894 - RNA, 22 nt, Human
cccugacucggcgcgcucccgu

SEQ ID NO: 761895 - RNA, 22 nt, Human
cacugucuauuaauauaacuua

SEQ ID NO: 761896 - RNA, 22 nt, Human
cugagggcaccgacagagugga

SEQ ID NO: 761897 - RNA, 20 nt, Human
cugccaugauugauagagug

SEQ ID NO: 761898 - RNA, 22 nt, Human
uacuuacacagcuguagaaggu

SEQ ID NO: 761899 - RNA, 22 nt, Human
ugaggcaguauucuccauucca

SEQ ID NO: 761900 - RNA, 22 nt, Human
augcauucagcggaaugcuuag

SEQ ID NO: 761901 - RNA, 22 nt, Human
aggaaacuaacuuaucuuuaua

SEQ ID NO: 761902 - RNA, 22 nt, Human
ucacaagagcuggacugucuuu

SEQ ID NO: 761903 - RNA, 22 nt, Human
uaacacaguucucuguugcaca

SEQ ID NO: 761904 - RNA, 22 nt, Human
uauaggcagaucugagaauauu

SEQ ID NO: 761905 - RNA, 22 nt, Human
ugcaggcuggaggagggacuaa

SEQ ID NO: 761906 - RNA, 22 nt, Human
agucaguuguggagauuuaacu

SEQ ID NO: 761907 - RNA, 22 nt, Human
uggcaggguggcaacuuuuggu

SEQ ID NO: 761908 - RNA, 19 nt, Human
aaauacagcagcuguuucc

SEQ ID NO: 761909 - RNA, 22 nt, Human
aacagcagcaaguaagcagguc

SEQ ID NO: 761910 - RNA, 22 nt, Human
caccugaauggaacuuugaacc

SEQ ID NO: 761911 - RNA, 22 nt, Human
agaugguuaucuuuucuuugua

SEQ ID NO: 761912 - RNA, 22 nt, Human
auaaauaucacuguugucccuc

SEQ ID NO: 761913 - RNA, 22 nt, Human
uaggccaggacagagcuuccag

SEQ ID NO: 761914 - RNA, 22 nt, Human
cuuguuuucuaaaacaucauuu

SEQ ID NO: 761915 - RNA, 18 nt, Human
auauccaauaaugaacac

SEQ ID NO: 761916 - RNA, 22 nt, Human
ugcaguggaaucuggagagcag

SEQ ID NO: 761917 - RNA, 22 nt, Human
ucacaaagugaagugugucaug

SEQ ID NO: 761918 - RNA, 22 nt, Human
uuuagacaggggcaaaauaagg

SEQ ID NO: 761919 - RNA, 19 nt, Human
uccugcagaccagaccugu

SEQ ID NO: 761920 - RNA, 22 nt, Human
cugccuguggguacaaguggaa

SEQ ID NO: 761921 - RNA, 18 nt, Human
ucugcugcugcguccugc

SEQ ID NO: 761922 - RNA, 22 nt, Human
gaggcuguguuucagugaggcc

SEQ ID NO: 761923 - RNA, 22 nt, Human
acugccugugucccuucagugc

SEQ ID NO: 761924 - RNA, 22 nt, Human
gaguuauuucagaaggaaagau

SEQ ID NO: 761925 - RNA, 23 nt, Human
ucacacagcuggucagguacaga

SEQ ID NO: 761926 - RNA, 22 nt, Human
gagcaaaauaaauucugacaaa

SEQ ID NO: 761927 - RNA, 22 nt, Human
agucagugacuuuugcugagag

SEQ ID NO: 761928 - RNA, 22 nt, Human
ugucaccaugccagcuucugcc

SEQ ID NO: 761929 - RNA, 22 nt, Human
uacacuaauguuuuugcaaagc

SEQ ID NO: 761930 - RNA, 22 nt, Human
uguuaaucaaucaacaguauua

SEQ ID NO: 761931 - RNA, 22 nt, Human
cccugcagggaggauucugaag

SEQ ID NO: 761932 - RNA, 22 nt, Human
uuuacaaguacaccuaacagcu

SEQ ID NO: 761933 - RNA, 22 nt, Human
ggaacugaggaacgaacuggga

SEQ ID NO: 761934 - RNA, 22 nt, Human
caggccaccagauacaugcccc

SEQ ID NO: 761935 - RNA, 22 nt, Human
ucucugugcccaguaguucucu

SEQ ID NO: 761936 - RNA, 22 nt, Human
uucugcuauacuuaugaauaca

SEQ ID NO: 761937 - RNA, 22 nt, Human
aagcuucauauaugugugaguc

SEQ ID NO: 761938 - RNA, 22 nt, Human
acuggcagcuguaggaugcaug

SEQ ID NO: 761939 - RNA, 22 nt, Human
acaaaugcagcauaaagugaac

SEQ ID NO: 761940 - RNA, 19 nt, Human
uagaaugcccacuuaaaaa

SEQ ID NO: 761941 - RNA, 17 nt, Human
uggaugugggaucugga

SEQ ID NO: 761942 - RNA, 22 nt, Human
aggagcugggagaaggacuaaa

SEQ ID NO: 761943 - RNA, 22 nt, Human
ccagguaccagucaaaucugua

SEQ ID NO: 761944 - RNA, 19 nt, Human
guuuucugaucuugccccc

SEQ ID NO: 761945 - RNA, 22 nt, Human
cauggaaugguugaaugacgaa

SEQ ID NO: 761946 - RNA, 22 nt, Human
auccugaguuccugccucuaaa

SEQ ID NO: 761947 - RNA, 21 nt, Human
ucagucccuggguguguccca

SEQ ID NO: 761948 - RNA, 22 nt, Human
ugcaugauguuaaacaucaggu

SEQ ID NO: 761949 - RNA, 22 nt, Human
aggcagugccuggaccccagcu

SEQ ID NO: 761950 - RNA, 22 nt, Human
acucaucaacuguuacaaaugu

SEQ ID NO: 761951 - RNA, 22 nt, Human
gacagagguguccuugagucca

SEQ ID NO: 761952 - RNA, 18 nt, Human
uggagccauugccaccau

SEQ ID NO: 761953 - RNA, 22 nt, Human
cugggucuccggcagccucggg

SEQ ID NO: 761954 - RNA, 22 nt, Human
acagaguaggugcucaguaaau

SEQ ID NO: 761955 - RNA, 22 nt, Human
auguugggaaggccgcaggcac

SEQ ID NO: 761956 - RNA, 22 nt, Human
ugaaugauuaaaacccggacua

SEQ ID NO: 761957 - RNA, 22 nt, Human
ugcacaggccuugaagggagag

SEQ ID NO: 761958 - RNA, 22 nt, Human
ucuaccuauuucuucuauuggu

SEQ ID NO: 761959 - RNA, 22 nt, Human
uaaaccuucaugauggucauua

SEQ ID NO: 761960 - RNA, 22 nt, Human
aucaucugccucaucacugcau

SEQ ID NO: 761961 - RNA, 22 nt, Human
aaauggaagaagugcaauacug

SEQ ID NO: 761962 - RNA, 22 nt, Human
cccaguccuaaagcagacgcca

SEQ ID NO: 761963 - RNA, 22 nt, Human
aggcuaagggaugacuggagug

SEQ ID NO: 761964 - RNA, 19 nt, Human
uggcagaggcaguuuguac

SEQ ID NO: 761965 - RNA, 22 nt, Human
acuguguauucuaaugacuaaa

SEQ ID NO: 761966 - RNA, 22 nt, Human
aaguggcccuaggccaagggga

SEQ ID NO: 761967 - RNA, 22 nt, Human
cccagcuucugagggggccuug

SEQ ID NO: 761968 - RNA, 22 nt, Human
ucaguguuuccuagagcauaua

SEQ ID NO: 761969 - RNA, 22 nt, Human
gagcuuugcuggaagccugggg

SEQ ID NO: 761970 - RNA, 21 nt, Human
ccugagugagaccuggcccgu

SEQ ID NO: 761971 - RNA, 22 nt, Human
aucugcaguuuguuuucucuug

SEQ ID NO: 761972 - RNA, 22 nt, Human
gaggggccggcaugugccucuc

SEQ ID NO: 761973 - RNA, 22 nt, Human
guucacauccuugugaggauuu

SEQ ID NO: 761974 - RNA, 22 nt, Human
gugggacagucagaagugagca

SEQ ID NO: 761975 - RNA, 22 nt, Human
cagagcuuccugcugggcuucu

SEQ ID NO: 761976 - RNA, 22 nt, Human
gcuggccuccugcuagauggaa

SEQ ID NO: 761977 - RNA, 22 nt, Human
aaauaguuuagcucucauuuca

SEQ ID NO: 761978 - RNA, 22 nt, Human
uaacaucaaacugcauuuucua

SEQ ID NO: 761979 - RNA, 23 nt, Human
uucaaagcuuaagcucuuuccac

SEQ ID NO: 761980 - RNA, 22 nt, Human
gcuuccaccuacuaaaugccac

SEQ ID NO: 761981 - RNA, 22 nt, Human
uauauuugcuaaaugugugcaa

SEQ ID NO: 761982 - RNA, 22 nt, Human
cugucucugauaagcucgaggg

SEQ ID NO: 761983 - RNA, 22 nt, Human
acugucaugugcuaacugucca

SEQ ID NO: 761984 - RNA, 22 nt, Human
ugcugaggagggcacccggggg

SEQ ID NO: 761985 - RNA, 22 nt, Human
gaguucaguaguuauagucuag

SEQ ID NO: 761986 - RNA, 22 nt, Human
uucaggauucucucccauuuac

SEQ ID NO: 761987 - RNA, 22 nt, Human
uccagggaaggugugaggcugg

SEQ ID NO: 761988 - RNA, 22 nt, Human
gcuucaugccaggagguuuaag

SEQ ID NO: 761989 - RNA, 23 nt, Human
ucuuccugaacuaucaggcacau

SEQ ID NO: 761990 - RNA, 16 nt, Human
uguuagcugugcauua

SEQ ID NO: 761991 - RNA, 22 nt, Human
gcauaugaucacgugugucggu

SEQ ID NO: 761992 - RNA, 22 nt, Human
agaaauguccagggcuaggauc

SEQ ID NO: 761993 - RNA, 22 nt, Human
cugguccuaaagcccuacucca

SEQ ID NO: 761994 - RNA, 22 nt, Human
augugucucuaaaauuuaguaa

SEQ ID NO: 761995 - RNA, 22 nt, Human
uaccuuuugcuuauuaugacac

SEQ ID NO: 761996 - RNA, 22 nt, Human
uggccugguuauauugcuauca

SEQ ID NO: 761997 - RNA, 19 nt, Human
uucucuggacuagaugcug

SEQ ID NO: 761998 - RNA, 22 nt, Human
agggagcugcucugcuuccgug

SEQ ID NO: 761999 - RNA, 22 nt, Human
ugggagugcaccugggacacga

SEQ ID NO: 762000 - RNA, 22 nt, Human
cugcucugaagccaggauucug

SEQ ID NO: 762001 - RNA, 22 nt, Human
ggugcugguucaggguggcugu

SEQ ID NO: 762002 - RNA, 22 nt, Human
gcucaugggcccagagcagccc

SEQ ID NO: 762003 - RNA, 22 nt, Human
gugagcaggauaggggcucccu

SEQ ID NO: 762004 - RNA, 22 nt, Human
ucuggggaugagugaugucgua

SEQ ID NO: 762005 - RNA, 22 nt, Human
auucuucaaagagugucaaagu

SEQ ID NO: 762006 - RNA, 22 nt, Human
augaagacaaacgacguugcaa

SEQ ID NO: 762007 - RNA, 22 nt, Human
auggggugcaugcagauuggga

SEQ ID NO: 762008 - RNA, 22 nt, Human
uugaaaguccuucuugaguuac

SEQ ID NO: 762009 - RNA, 22 nt, Human
ucacaucucuguuuucuaaauc

SEQ ID NO: 762010 - RNA, 22 nt, Human
acauaugaguacuauacagugc

SEQ ID NO: 762011 - RNA, 22 nt, Human
guuugcauggaagacagugagu

SEQ ID NO: 762012 - RNA, 22 nt, Human
uuuguauuacaaagucacagua

SEQ ID NO: 762013 - RNA, 22 nt, Human
agcugcaguaaagcucuccagg

SEQ ID NO: 762014 - RNA, 22 nt, Human
ucagaaguccaauaccauggga

SEQ ID NO: 762015 - RNA, 22 nt, Human
cuuccucucuugcccauaagag

SEQ ID NO: 762016 - RNA, 22 nt, Human
cugaggccucucccacuccagc

SEQ ID NO: 762017 - RNA, 22 nt, Human
ccagcuggcaggagagucaggg

SEQ ID NO: 762018 - RNA, 22 nt, Human
uugcagcaugcauagacacugc

SEQ ID NO: 762019 - RNA, 22 nt, Human
gaguauaugacuuucuuuugca

SEQ ID NO: 762020 - RNA, 22 nt, Human
ccuccagggcagacggggagca

SEQ ID NO: 762021 - RNA, 22 nt, Human
aggaauuuuaauaugcuugucu

SEQ ID NO: 762022 - RNA, 22 nt, Human
ggcuuuauuaacucauccguaa

SEQ ID NO: 762023 - RNA, 22 nt, Human
ugcuucaaaaaguuguuagagg

SEQ ID NO: 762024 - RNA, 21 nt, Human
aagugguuuacauccagcugu

SEQ ID NO: 762025 - RNA, 22 nt, Human
agaucagacuuugugacuagga

SEQ ID NO: 762026 - RNA, 22 nt, Human
cagaaaggacagagugagggug

SEQ ID NO: 762027 - RNA, 22 nt, Human
uuguuaacggaaaacuguuuuc

SEQ ID NO: 762028 - RNA, 22 nt, Human
aauaacagaaacuugagcauca

SEQ ID NO: 762029 - RNA, 22 nt, Human
caguucaggccggcugacucag

SEQ ID NO: 762030 - RNA, 22 nt, Human
cuagagaaacgccgugggagga

SEQ ID NO: 762031 - RNA, 22 nt, Human
gccuucaggugucccugugggc

SEQ ID NO: 762032 - RNA, 22 nt, Human
guggccaugugcuugcagggua

SEQ ID NO: 762033 - RNA, 22 nt, Human
auaaauagugugucauaaaguc

SEQ ID NO: 762034 - RNA, 20 nt, Human
cugaagaguggccugaucug

SEQ ID NO: 762035 - RNA, 22 nt, Human
cagagacauuaagugccaugau

SEQ ID NO: 762036 - RNA, 22 nt, Human
uccugggucccgcacaucuguc

SEQ ID NO: 762037 - RNA, 22 nt, Human
aaugaaacuauauuuagagagg

SEQ ID NO: 762038 - RNA, 22 nt, Human
auccacuuggcugguuguucua

SEQ ID NO: 762039 - RNA, 22 nt, Human
uggagguggggcucaggaaucu

SEQ ID NO: 762040 - RNA, 22 nt, Human
aggggucuugggaguccuggcu

SEQ ID NO: 762041 - RNA, 22 nt, Human
aaaaguauggugguccuuuuua

SEQ ID NO: 762042 - RNA, 22 nt, Human
gcuuaaauuguuuguggauagu

SEQ ID NO: 762043 - RNA, 22 nt, Human
agggaaagguagugaggucaca

SEQ ID NO: 762044 - RNA, 22 nt, Human
gauguguuuguuucuggaggag

SEQ ID NO: 762045 - RNA, 22 nt, Human
cauccauaugaggcacauuggu

SEQ ID NO: 762046 - RNA, 22 nt, Human
agguccaggagauuuggcaauu

SEQ ID NO: 762047 - RNA, 22 nt, Human
aggagagucuugagucacuggu

SEQ ID NO: 762048 - RNA, 22 nt, Human
uuucuugaccacuauguugaua

SEQ ID NO: 762049 - RNA, 22 nt, Human
ggacacagaccuuucuguucua

SEQ ID NO: 762050 - RNA, 22 nt, Human
agcagggcagcugaugcgcacg

SEQ ID NO: 762051 - RNA, 22 nt, Human
ucaggacagaaggcugccaggg

SEQ ID NO: 762052 - RNA, 22 nt, Human
cuugagcacagcggcuucagga

SEQ ID NO: 762053 - RNA, 23 nt, Human
acugggcugaaauuaaagguguc

SEQ ID NO: 762054 - RNA, 22 nt, Human
aauaacuuuuaaaagacccugg

SEQ ID NO: 762055 - RNA, 22 nt, Human
guuuucucugagaugccuuucu

SEQ ID NO: 762056 - RNA, 22 nt, Human
uccuagaacuccaggacagucc

SEQ ID NO: 762057 - RNA, 22 nt, Human
aucuuuaccaccaaagaaugcu

SEQ ID NO: 762058 - RNA, 22 nt, Human
uugcagcagcucuuugaauguu

SEQ ID NO: 762059 - RNA, 20 nt, Human
ucagcccagggugagcaucu

SEQ ID NO: 762060 - RNA, 22 nt, Human
aguguaugaacuuaagagagag

SEQ ID NO: 762061 - RNA, 22 nt, Human
agccagggauggcagugcccag

SEQ ID NO: 762062 - RNA, 22 nt, Human
uacagugucuggauaucaaagg

SEQ ID NO: 762063 - RNA, 22 nt, Human
ccuggcugguugucugauucua

SEQ ID NO: 762064 - RNA, 22 nt, Human
ucaguguuuuaacugucuuuua

SEQ ID NO: 762065 - RNA, 22 nt, Human
cauuucucacuccagcaacuuu

SEQ ID NO: 762066 - RNA, 22 nt, Human
agcuguguaagucauguaggug

SEQ ID NO: 762067 - RNA, 22 nt, Human
acagugacacucaggugggaug

SEQ ID NO: 762068 - RNA, 22 nt, Human
uuauucuguuggcccucucauc

SEQ ID NO: 762069 - RNA, 22 nt, Human
ccacaugcucaccaagucccug

SEQ ID NO: 762070 - RNA, 22 nt, Human
uguaguccaggaauugugucug

SEQ ID NO: 762071 - RNA, 22 nt, Human
auuguucaaagugcuuugcaug

SEQ ID NO: 762072 - RNA, 22 nt, Human
gccaggaggucagccccucaac

SEQ ID NO: 762073 - RNA, 22 nt, Human
cuggcucugaccgcgcuggccu

SEQ ID NO: 762074 - RNA, 22 nt, Human
uacauggugguggcacuugacu

SEQ ID NO: 762075 - RNA, 22 nt, Human
aagaagcaggucacagacaggg

SEQ ID NO: 762076 - RNA, 22 nt, Human
gggagggaagguaccuguguga

SEQ ID NO: 762077 - RNA, 22 nt, Human
guccucugauuucuagguauau

SEQ ID NO: 762078 - RNA, 22 nt, Human
ggcagauggggugacaagagag

SEQ ID NO: 762079 - RNA, 19 nt, Human
aucccaaggagcugggacu

SEQ ID NO: 762080 - RNA, 21 nt, Human
gggaaauuaggauugcucauc

SEQ ID NO: 762081 - RNA, 22 nt, Human
agacugugagggagauacaggg

SEQ ID NO: 762082 - RNA, 22 nt, Human
auguuuccauagaagucacagu

SEQ ID NO: 762083 - RNA, 19 nt, Human
caggaaggggcgaaucugg

SEQ ID NO: 762084 - RNA, 22 nt, Human
auuuugacugcauuacagaaca

SEQ ID NO: 762085 - RNA, 22 nt, Human
ggaagccacccagcuuugauag

SEQ ID NO: 762086 - RNA, 22 nt, Human
ccgcccacacuaaauaugagcg

SEQ ID NO: 762087 - RNA, 22 nt, Human
ucccagagucuucuccuguaau

SEQ ID NO: 762088 - RNA, 22 nt, Human
aucaggaagaucuagcgaaugu

SEQ ID NO: 762089 - RNA, 22 nt, Human
gaggacagcucuaacuaaaguc

SEQ ID NO: 762090 - RNA, 22 nt, Human
uuuauaaacaguaccacggugc

SEQ ID NO: 762091 - RNA, 22 nt, Human
uugaggucuuugagcaaacgca

SEQ ID NO: 762092 - RNA, 22 nt, Human
gacacauagaucuaucucacuc

SEQ ID NO: 762093 - RNA, 22 nt, Human
gcagacgucaccgagucgaugg

SEQ ID NO: 762094 - RNA, 21 nt, Human
ucaggcaggucccacugaaca

SEQ ID NO: 762095 - RNA, 22 nt, Human
uaacacuucagaugauuuuguu

SEQ ID NO: 762096 - RNA, 22 nt, Human
ucacaaagagaauugugggugu

SEQ ID NO: 762097 - RNA, 22 nt, Human
ugcugaaguccaucuguuugac

SEQ ID NO: 762098 - RNA, 20 nt, Human
ucucccugcccaucucagau

SEQ ID NO: 762099 - RNA, 22 nt, Human
uacaaugcugugcauguaaugg

SEQ ID NO: 762100 - RNA, 22 nt, Human
ucugaugcaauguaagucuugg

SEQ ID NO: 762101 - RNA, 22 nt, Human
gggcucagacaucccuccugga

SEQ ID NO: 762102 - RNA, 22 nt, Human
caguauuuuuaagcugcuuugu

SEQ ID NO: 762103 - RNA, 22 nt, Human
auaugcuuccccuucuuuuugg

SEQ ID NO: 762104 - RNA, 22 nt, Human
gugccgugggccuuagugaucu

SEQ ID NO: 762105 - RNA, 22 nt, Human
acaaaugaaucauacauaaugu

SEQ ID NO: 762106 - RNA, 22 nt, Human
augaauguuuggugaucagaua

SEQ ID NO: 762107 - RNA, 22 nt, Human
cuucuggcaaaacaggcagaaa

SEQ ID NO: 762108 - RNA, 22 nt, Human
uaguugcuaaaaagugccuaac

SEQ ID NO: 762109 - RNA, 20 nt, Human
ucuguaaagacuccagaagc

SEQ ID NO: 762110 - RNA, 22 nt, Human
uggcagcaugucccggccucag

SEQ ID NO: 762111 - RNA, 22 nt, Human
uauguauaaucacagaguguca

SEQ ID NO: 762112 - RNA, 22 nt, Human
caaggccaagucucugugaaga

SEQ ID NO: 762113 - RNA, 22 nt, Human
gauauucaaagauuacugauau

SEQ ID NO: 762114 - RNA, 22 nt, Human
ggcucuggugggaagguuagau

SEQ ID NO: 762115 - RNA, 22 nt, Human
uauuucuguaugcauaaaagga

SEQ ID NO: 762116 - RNA, 22 nt, Human
ugguaaaaacugcaauuacuuu

SEQ ID NO: 762117 - RNA, 22 nt, Human
cuggcugccuauagucucccuu

SEQ ID NO: 762118 - RNA, 22 nt, Human
uggcaauguaggcaagaacauu

SEQ ID NO: 762119 - RNA, 22 nt, Human
acauuuaaauaugccuuauauu

SEQ ID NO: 762120 - RNA, 22 nt, Human
gcugaaugaauguauuuuaaaa

SEQ ID NO: 762121 - RNA, 22 nt, Human
uugguggagucauuggcauaug

SEQ ID NO: 762122 - RNA, 22 nt, Human
uccaggaggcucugguugacgu

SEQ ID NO: 762123 - RNA, 22 nt, Human
augagguaguauuagaaggaga

SEQ ID NO: 762124 - RNA, 22 nt, Human
gacauguauuagucaugcacag

SEQ ID NO: 762125 - RNA, 22 nt, Human
gccugccacgcaugcagaguca

SEQ ID NO: 762126 - RNA, 22 nt, Human
uccaggcaaagggacuagcagg

SEQ ID NO: 762127 - RNA, 22 nt, Human
cuccaaaggauaaaagcagagu

SEQ ID NO: 762128 - RNA, 22 nt, Human
cagcagcuuugccaagucagcc

SEQ ID NO: 762129 - RNA, 22 nt, Human
uccucugacucacagccugggg

SEQ ID NO: 762130 - RNA, 22 nt, Human
cagucaacagagagcccgucag

SEQ ID NO: 762131 - RNA, 22 nt, Human
uuggcagagggaccagccuaca

SEQ ID NO: 762132 - RNA, 22 nt, Human
uguggcagaaccagaauucaaa

SEQ ID NO: 762133 - RNA, 22 nt, Human
auuucagagaaugaaccuaauc

SEQ ID NO: 762134 - RNA, 22 nt, Human
aagugagguuucugcuuucaga

SEQ ID NO: 762135 - RNA, 22 nt, Human
cagcuaggaaguccuuggcgaa

SEQ ID NO: 762136 - RNA, 22 nt, Human
uuuuggcucugcagguuugcac

SEQ ID NO: 762137 - RNA, 22 nt, Human
agguggagaagagaugggcagu

SEQ ID NO: 762138 - RNA, 22 nt, Human
uucugaaauuucuguagaucuu

SEQ ID NO: 762139 - RNA, 20 nt, Human
uagcaaugaguguuccauuu

SEQ ID NO: 762140 - RNA, 22 nt, Human
acagcaguggugcacugagcca

SEQ ID NO: 762141 - RNA, 22 nt, Human
aagagguucuaauuuaacuauc

SEQ ID NO: 762142 - RNA, 18 nt, Human
guguccuggcugcggcgc

SEQ ID NO: 762143 - RNA, 22 nt, Human
uucacaacugccauagccagug

SEQ ID NO: 762144 - RNA, 22 nt, Human
cagcuucuggcguggagccuga

SEQ ID NO: 762145 - RNA, 22 nt, Human
cagccaucaguaaagacagcuu

SEQ ID NO: 762146 - RNA, 22 nt, Human
gaagccugguccagagcuccca

SEQ ID NO: 762147 - RNA, 22 nt, Human
gcaggccuuuaucccugccuca

SEQ ID NO: 762148 - RNA, 22 nt, Human
uucuuacauauuuucauauggu

SEQ ID NO: 762149 - RNA, 18 nt, Human
ucuuuguuuccuucuugc

SEQ ID NO: 762150 - RNA, 22 nt, Human
acuuagcaguuuagaauauguc

SEQ ID NO: 762151 - RNA, 22 nt, Human
uacaaugugugcuucuugucac

SEQ ID NO: 762152 - RNA, 22 nt, Human
gggcucaggucagggcaucagc

SEQ ID NO: 762153 - RNA, 22 nt, Human
guuagggaagcgcuguguucuu

SEQ ID NO: 762154 - RNA, 22 nt, Human
auauuaugcuaagggaaauaag

SEQ ID NO: 762155 - RNA, 22 nt, Human
cugcugucuaguaucuuaaaaa

SEQ ID NO: 762156 - RNA, 22 nt, Human
ucuucagcaacuccccaaucug

SEQ ID NO: 762157 - RNA, 22 nt, Human
ugaaaguuacaggaaaacagau

SEQ ID NO: 762158 - RNA, 22 nt, Human
gagauucugguuagguguauuu

SEQ ID NO: 762159 - RNA, 22 nt, Human
gccaucacauccaggcuaccuc

SEQ ID NO: 762160 - RNA, 19 nt, Human
caggacaguuugccaagaa

SEQ ID NO: 762161 - RNA, 19 nt, Human
uccagcuguuuugagucac

SEQ ID NO: 762162 - RNA, 22 nt, Human
auacauucaaaggaaggauaga

SEQ ID NO: 762163 - RNA, 22 nt, Human
agugcuggcccauagcugcugg

SEQ ID NO: 762164 - RNA, 22 nt, Human
aaaccugaaggaugauacaaca

SEQ ID NO: 762165 - RNA, 22 nt, Human
gcaggcuuguugaaguaaaaua

SEQ ID NO: 762166 - RNA, 22 nt, Human
augcaguguuuggaagcuuaag

SEQ ID NO: 762167 - RNA, 22 nt, Human
cuguauauaauguaugcauggg

SEQ ID NO: 762168 - RNA, 22 nt, Human
aagcaaaggaaagcugacuuuu

SEQ ID NO: 762169 - RNA, 22 nt, Human
agguuucuggaaagguuuugcu

SEQ ID NO: 762170 - RNA, 22 nt, Human
auguguaugagugugcuucuuu

SEQ ID NO: 762171 - RNA, 23 nt, Human
aucaagucaucagcaaaauacau

SEQ ID NO: 762172 - RNA, 22 nt, Human
uacaaugauuagcuaacuugcc

SEQ ID NO: 762173 - RNA, 22 nt, Human
acaagcgggccacagugcuggu

SEQ ID NO: 762174 - RNA, 22 nt, Human
agagaggcgaguuaccugugcu

SEQ ID NO: 762175 - RNA, 22 nt, Human
aggugacugguuuaucuggcag

SEQ ID NO: 762176 - RNA, 22 nt, Human
aacagacagaaaaaugugaucu

SEQ ID NO: 762177 - RNA, 22 nt, Human
agguauagaauugaaaggguuu

SEQ ID NO: 762178 - RNA, 22 nt, Human
uuuaacuuagaagagauauccu

SEQ ID NO: 762179 - RNA, 22 nt, Human
gagagcuaggccacuggggcuu

SEQ ID NO: 762180 - RNA, 22 nt, Human
gcaugaugaaggaggaggaguc

SEQ ID NO: 762181 - RNA, 22 nt, Human
uggagcugagaaguggagcucu

SEQ ID NO: 762182 - RNA, 22 nt, Human
ccaggagacccagggaaggagc

SEQ ID NO: 762183 - RNA, 22 nt, Human
cucugagcagcggugccgaagu

SEQ ID NO: 762184 - RNA, 22 nt, Human
aggaggaggugggacacaguga

SEQ ID NO: 762185 - RNA, 22 nt, Human
auugacaaauggauguugacau

SEQ ID NO: 762186 - RNA, 22 nt, Human
aacuccucucuggugguucguc

SEQ ID NO: 762187 - RNA, 22 nt, Human
agcaguguuuugauucugggag

SEQ ID NO: 762188 - RNA, 22 nt, Human
gcagcagaaggccaaggggagc

SEQ ID NO: 762189 - RNA, 22 nt, Human
uugauuuucaauucauugacaa

SEQ ID NO: 762190 - RNA, 21 nt, Human
ccugaaauucucacuagcuua

SEQ ID NO: 762191 - RNA, 19 nt, Human
gcaucagagcagaaggggu

SEQ ID NO: 762192 - RNA, 22 nt, Human
cugccuggagcauucugaaggu

SEQ ID NO: 762193 - RNA, 22 nt, Human
gaacuguaaaauaauuggcaau

SEQ ID NO: 762194 - RNA, 22 nt, Human
uuggcuuuuaugcagcuuaggu

SEQ ID NO: 762195 - RNA, 22 nt, Human
acacauauucauauguacuuac

SEQ ID NO: 762196 - RNA, 22 nt, Human
aagcagaacugggaaguagugg

SEQ ID NO: 762197 - RNA, 22 nt, Human
uggcagaggagaauuaagauua

SEQ ID NO: 762198 - RNA, 22 nt, Human
ccagagccccugagcuucccug

SEQ ID NO: 762199 - RNA, 22 nt, Human
uggcuucuauugcuguggcauu

SEQ ID NO: 762200 - RNA, 22 nt, Human
uucuccaggggaggguucucca

SEQ ID NO: 762201 - RNA, 22 nt, Human
agcuacucugcagugcccaugg

SEQ ID NO: 762202 - RNA, 22 nt, Human
uacagcauugugucuucacuca

SEQ ID NO: 762203 - RNA, 22 nt, Human
agucaaaugaguaaauauauaa

SEQ ID NO: 762204 - RNA, 22 nt, Human
auuucucauguacaaaaacacu

SEQ ID NO: 762205 - RNA, 22 nt, Human
cuggugugauugagcccaggug

SEQ ID NO: 762206 - RNA, 22 nt, Human
aggcggcuucugaggaggcugc

SEQ ID NO: 762207 - RNA, 22 nt, Human
aaacaagagucuugcuccaccu

SEQ ID NO: 762208 - RNA, 22 nt, Human
aggaauuuaagggcucagagag

SEQ ID NO: 762209 - RNA, 22 nt, Human
uugggaaacaguauagcuaaca

SEQ ID NO: 762210 - RNA, 23 nt, Human
uggggcucuggcaggccugaggu

SEQ ID NO: 762211 - RNA, 22 nt, Human
aaaagacaggugucugcggccc

SEQ ID NO: 762212 - RNA, 22 nt, Human
agacuggguuugagacuuagca

SEQ ID NO: 762213 - RNA, 19 nt, Human
aaccaggaacuaaagcaga

SEQ ID NO: 762214 - RNA, 22 nt, Human
uccaagcucucuaugccaugau

SEQ ID NO: 762215 - RNA, 22 nt, Human
aagcuguugcccugcucuuucu

SEQ ID NO: 762216 - RNA, 22 nt, Human
uugaacauaaaucacuggucag

SEQ ID NO: 762217 - RNA, 22 nt, Human
gccuuuggagaauccagucaug

SEQ ID NO: 762218 - RNA, 22 nt, Human
aaccagcuuugauacgcauuau

SEQ ID NO: 762219 - RNA, 22 nt, Human
cgaggccagcucuaagcccuac

SEQ ID NO: 762220 - RNA, 22 nt, Human
cagcagcagcuuaguggucccc

SEQ ID NO: 762221 - RNA, 22 nt, Human
gggguggagaugguggcccuuu

SEQ ID NO: 762222 - RNA, 23 nt, Human
aaagugacuuuuauaccacuaac

SEQ ID NO: 762223 - RNA, 22 nt, Human
uggcuuuauaccuuugccuugg

SEQ ID NO: 762224 - RNA, 22 nt, Human
guggccuggcuggcaccaccuc

SEQ ID NO: 762225 - RNA, 22 nt, Human
aucauuuaaaacaagucucuau

SEQ ID NO: 762226 - RNA, 22 nt, Human
uucuaugugcuggagaauauuu

SEQ ID NO: 762227 - RNA, 22 nt, Human
agccaguguuaagugacugguu

SEQ ID NO: 762228 - RNA, 22 nt, Human
ugaguucuucacauuaccuacg

SEQ ID NO: 762229 - RNA, 22 nt, Human
cagauggcugccaagaugggcu

SEQ ID NO: 762230 - RNA, 22 nt, Human
uaguuuuacuugcgaugauaau

SEQ ID NO: 762231 - RNA, 22 nt, Human
aguuccaaagccuguauucuua

SEQ ID NO: 762232 - RNA, 22 nt, Human
ggcucucugaggaaacccuucc

SEQ ID NO: 762233 - RNA, 22 nt, Human
uuauugagcaccuacuaugugu

SEQ ID NO: 762234 - RNA, 22 nt, Human
agcaggcuacuccuguguucgu

SEQ ID NO: 762235 - RNA, 22 nt, Human
cuaguugaagaggcugucauca

SEQ ID NO: 762236 - RNA, 22 nt, Human
aaaguucuccuggauugugcug

SEQ ID NO: 762237 - RNA, 22 nt, Human
aggccuccugcagggaugagug

SEQ ID NO: 762238 - RNA, 22 nt, Human
cagcaauaagguaagcuucucc

SEQ ID NO: 762239 - RNA, 22 nt, Human
ucugucuucaucagcaugugau

SEQ ID NO: 762240 - RNA, 22 nt, Human
gaaauguugucucugcagcaau

SEQ ID NO: 762241 - RNA, 22 nt, Human
ggaacacaaaugggagagcugg

SEQ ID NO: 762242 - RNA, 22 nt, Human
gcuggcagaagagcugguucaa

SEQ ID NO: 762243 - RNA, 22 nt, Human
ucauauuuggggguguguguuu

SEQ ID NO: 762244 - RNA, 22 nt, Human
cagaggcagugggguugcuccu

SEQ ID NO: 762245 - RNA, 22 nt, Human
uuugaaauuaagauauugucca

SEQ ID NO: 762246 - RNA, 22 nt, Human
gcucugcccaggaccguccuug

SEQ ID NO: 762247 - RNA, 22 nt, Human
cagacagagcucacaagucuuu

SEQ ID NO: 762248 - RNA, 22 nt, Human
ucugcgugaugagggugcagca

SEQ ID NO: 762249 - RNA, 22 nt, Human
uagcucugucacauacacugca

SEQ ID NO: 762250 - RNA, 22 nt, Human
aagccaagugcuggccaugggc

SEQ ID NO: 762251 - RNA, 21 nt, Human
gcugccugccccucgggggcu

SEQ ID NO: 762252 - RNA, 20 nt, Human
uggguccugugggagaagaa

SEQ ID NO: 762253 - RNA, 22 nt, Human
aaaguuugcaauuuauguuaau

SEQ ID NO: 762254 - RNA, 22 nt, Human
ucaaguauuuauuucugcuggc

SEQ ID NO: 762255 - RNA, 22 nt, Human
cacauccuucagcugagcccag

SEQ ID NO: 762256 - RNA, 23 nt, Human
ccucccaggcugcgagucccgag

SEQ ID NO: 762257 - RNA, 23 nt, Human
augcuuccacagagcuugcagcc

SEQ ID NO: 762258 - RNA, 22 nt, Human
uggcucugcaccucaguguacc

SEQ ID NO: 762259 - RNA, 23 nt, Human
uggcucugagagguucagaugcu

SEQ ID NO: 762260 - RNA, 22 nt, Human
uaaguucugaguaaauacuguu

SEQ ID NO: 762261 - RNA, 22 nt, Human
ucagggacagggugcugcugcg

SEQ ID NO: 762262 - RNA, 22 nt, Human
gggcuccagaggcucacccugg

SEQ ID NO: 762263 - RNA, 22 nt, Human
agcaggagcauuuccaugauuc

SEQ ID NO: 762264 - RNA, 22 nt, Human
caggucuuuucuacugguggag

SEQ ID NO: 762265 - RNA, 21 nt, Human
acacagcugccggagacggau

SEQ ID NO: 762266 - RNA, 22 nt, Human
cuguugucuucauugucauauc

SEQ ID NO: 762267 - RNA, 22 nt, Human
uggaggagggcuggugucugua

SEQ ID NO: 762268 - RNA, 22 nt, Human
uucuuacagcccuauuacuaaa

SEQ ID NO: 762269 - RNA, 22 nt, Human
gcuucgggguccaagcgcgugu

SEQ ID NO: 762270 - RNA, 22 nt, Human
ugcaauuuggggaagaaagaga

SEQ ID NO: 762271 - RNA, 19 nt, Human
ccugaccacacaggccuug

SEQ ID NO: 762272 - RNA, 22 nt, Human
cacuguacugugaauaaggagg

SEQ ID NO: 762273 - RNA, 22 nt, Human
ucucaggguuuccugggggcug

SEQ ID NO: 762274 - RNA, 22 nt, Human
guguguuuagcauuagcagggg

SEQ ID NO: 762275 - RNA, 22 nt, Human
ugauucaucagaauaggaguuu

SEQ ID NO: 762276 - RNA, 22 nt, Human
uaccuggggcugggcuuugauu

SEQ ID NO: 762277 - RNA, 22 nt, Human
uggugcagauagugguguagua

SEQ ID NO: 762278 - RNA, 22 nt, Human
aucuuuuuacuaacacugcuua

SEQ ID NO: 762279 - RNA, 23 nt, Human
aacacaaagcugauuccaguggc

SEQ ID NO: 762280 - RNA, 21 nt, Human
ugucagagcuuguaggacauu

SEQ ID NO: 762281 - RNA, 22 nt, Human
auagacauuauaacacagagcu

SEQ ID NO: 762282 - RNA, 22 nt, Human
gaggauggauccgaccccuucc

SEQ ID NO: 762283 - RNA, 22 nt, Human
agacagacguagugugagagua

SEQ ID NO: 762284 - RNA, 22 nt, Human
aggcaagugcauuagaagagca

SEQ ID NO: 762285 - RNA, 22 nt, Human
accuuuuacggugugacuagca

SEQ ID NO: 762286 - RNA, 22 nt, Human
uuagaguagagccauuucuguu

SEQ ID NO: 762287 - RNA, 22 nt, Human
ggcuggcuuucucuccgcaccu

SEQ ID NO: 762288 - RNA, 22 nt, Human
uggggagguucgggaaucuugu

SEQ ID NO: 762289 - RNA, 22 nt, Human
aggaugaggcuggacacuucuu

SEQ ID NO: 762290 - RNA, 22 nt, Human
aggcuguguuucuugcguuuuc

SEQ ID NO: 762291 - RNA, 22 nt, Human
uuauaggcuuaguucugugugu

SEQ ID NO: 762292 - RNA, 22 nt, Human
ccuuugugaauaugcagaaaau

SEQ ID NO: 762293 - RNA, 22 nt, Human
ccugugaggucuugcaugugaa

SEQ ID NO: 762294 - RNA, 22 nt, Human
ucaaagucauggcaggcucaga

SEQ ID NO: 762295 - RNA, 22 nt, Human
auuggccauuugcauguauuau

SEQ ID NO: 762296 - RNA, 22 nt, Human
ugauuuaaaagaaacauugucu

SEQ ID NO: 762297 - RNA, 22 nt, Human
cucuggguucuggccugcaccc

SEQ ID NO: 762298 - RNA, 21 nt, Human
aggaggggucuuucccacuga

SEQ ID NO: 762299 - RNA, 22 nt, Human
ccauuccaugugcuacacauaa

SEQ ID NO: 762300 - RNA, 22 nt, Human
gcugcagccaaauucauuguca

SEQ ID NO: 762301 - RNA, 22 nt, Human
agcacugauuuaaacuggauuu

SEQ ID NO: 762302 - RNA, 22 nt, Human
aguaaacacgugggguuucuuu

SEQ ID NO: 762303 - RNA, 22 nt, Human
ucaggaagaagacggggcagga

SEQ ID NO: 762304 - RNA, 22 nt, Human
aggcagaugguaacugugauau

SEQ ID NO: 762305 - RNA, 22 nt, Human
gugacucuuaaagcaaaucuug

SEQ ID NO: 762306 - RNA, 22 nt, Human
cuggcugacaccuugauagcag

SEQ ID NO: 762307 - RNA, 22 nt, Human
uuuauguuugcauuuucaaaga

SEQ ID NO: 762308 - RNA, 22 nt, Human
ucucuggcagggauaucuggcu

SEQ ID NO: 762309 - RNA, 22 nt, Human
cuuugguucuguccuucccaga

SEQ ID NO: 762310 - RNA, 22 nt, Human
ugcuggaggaguuuacuguggc

SEQ ID NO: 762311 - RNA, 18 nt, Human
ugggagugggaguggaua

SEQ ID NO: 762312 - RNA, 22 nt, Human
ucacugaaaguaauucuaguga

SEQ ID NO: 762313 - RNA, 22 nt, Human
ccagagagagaggucaauggca

SEQ ID NO: 762314 - RNA, 22 nt, Human
uuggaagcccugugauaggcca

SEQ ID NO: 762315 - RNA, 22 nt, Human
agaagaauacuugauguucaug

SEQ ID NO: 762316 - RNA, 22 nt, Human
auucugcauaauuuccuggcag

SEQ ID NO: 762317 - RNA, 22 nt, Human
aaggcugguggauuaugagguc

SEQ ID NO: 762318 - RNA, 22 nt, Human
uagaggugagauuguggugcug

SEQ ID NO: 762319 - RNA, 22 nt, Human
gaagugaagagauuagaaauca

SEQ ID NO: 762320 - RNA, 22 nt, Human
cucagggacaaggggagacccc

SEQ ID NO: 762321 - RNA, 22 nt, Human
ggcucccaggagggccuggagg

SEQ ID NO: 762322 - RNA, 22 nt, Human
aagguccaugacucggcauagu

SEQ ID NO: 762323 - RNA, 22 nt, Human
cuuaggaaaguuucugcuuaug

SEQ ID NO: 762324 - RNA, 22 nt, Human
auguacauagcaucaucuagga

SEQ ID NO: 762325 - RNA, 22 nt, Human
cauagauuuuagguuagaucga

SEQ ID NO: 762326 - RNA, 22 nt, Human
gcugcugagaauugcaggcaag

SEQ ID NO: 762327 - RNA, 19 nt, Human
ccagucccauacaggagau

SEQ ID NO: 762328 - RNA, 22 nt, Human
aauugugcauuuuuaaaucacg

SEQ ID NO: 762329 - RNA, 22 nt, Human
agauugcuaaugaaguucuuga

SEQ ID NO: 762330 - RNA, 22 nt, Human
uaaccuuuuuaucuuaccucca

SEQ ID NO: 762331 - RNA, 21 nt, Human
uguuaugugcuucaagaagug

SEQ ID NO: 762332 - RNA, 20 nt, Human
auacacuugcccagcuugug

SEQ ID NO: 762333 - RNA, 22 nt, Human
acuuuuuuauaaggaagaagau

SEQ ID NO: 762334 - RNA, 22 nt, Human
uggaggagaccauuccacucag

SEQ ID NO: 762335 - RNA, 22 nt, Human
cacacagggagaaagaaagccu

SEQ ID NO: 762336 - RNA, 22 nt, Human
uagagcuggccgggacagcugg

SEQ ID NO: 762337 - RNA, 23 nt, Human
gcugucugucaucucugcgggag

SEQ ID NO: 762338 - RNA, 22 nt, Human
cacagugacagcuauacagaga

SEQ ID NO: 762339 - RNA, 23 nt, Human
ccagucucuuuccaaaaucacau

SEQ ID NO: 762340 - RNA, 22 nt, Human
cauaaaauggcuuguucuuuaa

SEQ ID NO: 762341 - RNA, 20 nt, Human
uccagaggccacauccagug

SEQ ID NO: 762342 - RNA, 22 nt, Human
gacaggcaguuuuccagaucag

SEQ ID NO: 762343 - RNA, 22 nt, Human
gagaagcaaucagcagccaccc

SEQ ID NO: 762344 - RNA, 22 nt, Human
cacucucagcauaaugaaugug

SEQ ID NO: 762345 - RNA, 22 nt, Human
aagauacugaugauguaggcua

SEQ ID NO: 762346 - RNA, 22 nt, Human
cuccagaggaugcaggugaggg

SEQ ID NO: 762347 - RNA, 22 nt, Human
aggcucagggacggggccccuu

SEQ ID NO: 762348 - RNA, 22 nt, Human
cugccccagugccaggcaggug

SEQ ID NO: 762349 - RNA, 22 nt, Human
uagucacaggaaguuucaaugu

SEQ ID NO: 762350 - RNA, 22 nt, Human
aauucaucauuuuauagcuagu

SEQ ID NO: 762351 - RNA, 22 nt, Human
uacagagagagggguuaccagg

SEQ ID NO: 762352 - RNA, 22 nt, Human
cuuuguagcugcuucugauuua

SEQ ID NO: 762353 - RNA, 23 nt, Human
agguggucuuguggaugcugcaa

SEQ ID NO: 762354 - RNA, 19 nt, Human
agcagcagcaccagggauu

SEQ ID NO: 762355 - RNA, 22 nt, Human
ugcagggaaugcuugcagcaug

SEQ ID NO: 762356 - RNA, 22 nt, Human
auaccugaucaaggcaaaaaug

SEQ ID NO: 762357 - RNA, 22 nt, Human
aaacauuugcaacucgguuugg

SEQ ID NO: 762358 - RNA, 22 nt, Human
uuuggcucugugucuucaccca

SEQ ID NO: 762359 - RNA, 22 nt, Human
aacacuuuuuauauauuguauc

SEQ ID NO: 762360 - RNA, 22 nt, Human
ggguaggaugguagaagggacc

SEQ ID NO: 762361 - RNA, 23 nt, Human
ggcuccuggauucaaauccugcc

SEQ ID NO: 762362 - RNA, 22 nt, Human
uuucaaagaccauuaacuauca

SEQ ID NO: 762363 - RNA, 22 nt, Human
guuauauucaaaaugaggcugu

SEQ ID NO: 762364 - RNA, 22 nt, Human
ccuucaaucagcagucuagcuu

SEQ ID NO: 762365 - RNA, 22 nt, Human
agcuguguucugguugauucac

SEQ ID NO: 762366 - RNA, 22 nt, Human
ggugggaaggccacugaagguu

SEQ ID NO: 762367 - RNA, 20 nt, Human
gugcagauguccuuucacac

SEQ ID NO: 762368 - RNA, 22 nt, Human
aagaugauagaucugucaaugu

SEQ ID NO: 762369 - RNA, 22 nt, Human
auaacagugaccucucagcacc

SEQ ID NO: 762370 - RNA, 22 nt, Human
ggccagagguguccucaguucu

SEQ ID NO: 762371 - RNA, 22 nt, Human
augagaugugucuaauggaacc

SEQ ID NO: 762372 - RNA, 22 nt, Human
gacagcuguacacuccugguua

SEQ ID NO: 762373 - RNA, 22 nt, Human
caagaucaaggugucagcaggu

SEQ ID NO: 762374 - RNA, 22 nt, Human
ggcagccaguagggccagccug

SEQ ID NO: 762375 - RNA, 22 nt, Human
gaagacaucauggagaggauag

SEQ ID NO: 762376 - RNA, 22 nt, Human
ucagugugucucugcauuuggg

SEQ ID NO: 762377 - RNA, 22 nt, Human
agaagaauuucucucaugauuu

SEQ ID NO: 762378 - RNA, 22 nt, Human
cugucuggccggcccagcuucc

SEQ ID NO: 762379 - RNA, 22 nt, Human
acuccagggugacucugucuga

SEQ ID NO: 762380 - RNA, 19 nt, Human
agauggcaaaaugcaaaga

SEQ ID NO: 762381 - RNA, 22 nt, Human
gaggcaguggucugaugcaagg

SEQ ID NO: 762382 - RNA, 22 nt, Human
ucacuguuucaucccuagcacu

SEQ ID NO: 762383 - RNA, 22 nt, Human
ccacaugaugaggaagcugaac

SEQ ID NO: 762384 - RNA, 22 nt, Human
caugaacaccaggcaugaacaa

SEQ ID NO: 762385 - RNA, 22 nt, Human
aaagaggcaaucaauguagcaa

SEQ ID NO: 762386 - RNA, 22 nt, Human
ggggaagaccuggcacuacagc

SEQ ID NO: 762387 - RNA, 22 nt, Human
cuccuucacgcaggcugccaug

SEQ ID NO: 762388 - RNA, 22 nt, Human
gggaccagaagaaggaugguga

SEQ ID NO: 762389 - RNA, 22 nt, Human
cagucacuuacaaaaauauaau

SEQ ID NO: 762390 - RNA, 22 nt, Human
cagaguggagauguguguggaa

SEQ ID NO: 762391 - RNA, 22 nt, Human
auauagaaggugcuauuuacau

SEQ ID NO: 762392 - RNA, 22 nt, Human
aggugcugccccgagaaggaug

SEQ ID NO: 762393 - RNA, 19 nt, Human
uggaacacucaaacugggu

SEQ ID NO: 762394 - RNA, 22 nt, Human
aaguccagcagugcuuguugau

SEQ ID NO: 762395 - RNA, 22 nt, Human
uacagccaucauguauguauau

SEQ ID NO: 762396 - RNA, 22 nt, Human
uguuacagaaauauugcuucuu

SEQ ID NO: 762397 - RNA, 22 nt, Human
agggcagaaaccaccuugaugg

SEQ ID NO: 762398 - RNA, 22 nt, Human
agccucucuuaucccuucaaag

SEQ ID NO: 762399 - RNA, 22 nt, Human
uggcuuccagagcugcuccacc

SEQ ID NO: 762400 - RNA, 22 nt, Human
gacacaggaaucaccuuggaug

SEQ ID NO: 762401 - RNA, 22 nt, Human
cuaaacaugcaagagcuucugg

SEQ ID NO: 762402 - RNA, 23 nt, Human
uugcuucugugcaauucaguacu

SEQ ID NO: 762403 - RNA, 22 nt, Human
gaagaagcauucugcuguuuug

SEQ ID NO: 762404 - RNA, 22 nt, Human
caggcuccuuaucuuacaacuu

SEQ ID NO: 762405 - RNA, 22 nt, Human
ugacaacuuuacaaaauucuuc

SEQ ID NO: 762406 - RNA, 22 nt, Human
auuuaugagcugaaccaugaaa

SEQ ID NO: 762407 - RNA, 22 nt, Human
gcuggagguagggagguccugu

SEQ ID NO: 762408 - RNA, 22 nt, Human
aaggucuggaugaugggugugc

SEQ ID NO: 762409 - RNA, 22 nt, Human
gcaguggcagcugaggggguau

SEQ ID NO: 762410 - RNA, 22 nt, Human
uccaggacugguucacacggug

SEQ ID NO: 762411 - RNA, 22 nt, Human
caugugugagugagcagucuuc

SEQ ID NO: 762412 - RNA, 22 nt, Human
gcacugaugcaaaaaucacuca

SEQ ID NO: 762413 - RNA, 22 nt, Human
auuaauuuuucugacagccaca

SEQ ID NO: 762414 - RNA, 22 nt, Human
gagaggcccuguggucccagcu

SEQ ID NO: 762415 - RNA, 19 nt, Human
cuacuuuauaauaugccuc

SEQ ID NO: 762416 - RNA, 22 nt, Human
ggcugggaggccgugcugaccu

SEQ ID NO: 762417 - RNA, 22 nt, Human
acagaggccgccucucucacgg

SEQ ID NO: 762418 - RNA, 19 nt, Human
uggaagaggaagggaaaua

SEQ ID NO: 762419 - RNA, 22 nt, Human
uaguuaggaauagcagcgacuc

SEQ ID NO: 762420 - RNA, 22 nt, Human
guaaauuauuucaagaucaucu

SEQ ID NO: 762421 - RNA, 22 nt, Human
cagagccacugucugccaggca

SEQ ID NO: 762422 - RNA, 22 nt, Human
cagcccuggcagcuuucagggu

SEQ ID NO: 762423 - RNA, 22 nt, Human
cagcaggcguugggagaaagac

SEQ ID NO: 762424 - RNA, 22 nt, Human
cuggcugccuggagugagggag

SEQ ID NO: 762425 - RNA, 22 nt, Human
gccuuggcugaugugcgaauga

SEQ ID NO: 762426 - RNA, 22 nt, Human
gcagagcagaggugcagguugg

SEQ ID NO: 762427 - RNA, 22 nt, Human
ccagcccuugagauggaaggga

SEQ ID NO: 762428 - RNA, 22 nt, Human
gcugcucuccauggccgugagu

SEQ ID NO: 762429 - RNA, 22 nt, Human
ggcuacaguggcucagugcugg

SEQ ID NO: 762430 - RNA, 22 nt, Human
uuugccugauucuaagagcuca

SEQ ID NO: 762431 - RNA, 22 nt, Human
ucucccaguggugcagaaagca

SEQ ID NO: 762432 - RNA, 22 nt, Human
gaaaacuauuggccuagaacaa

SEQ ID NO: 762433 - RNA, 22 nt, Human
ugugauuauuugauuaacaugu

SEQ ID NO: 762434 - RNA, 22 nt, Human
uuccuaacacaguguaagcaag

SEQ ID NO: 762435 - RNA, 22 nt, Human
gcucugggcugcccucuggaca

SEQ ID NO: 762436 - RNA, 22 nt, Human
uucauugaaccacuuuauucuu

SEQ ID NO: 762437 - RNA, 22 nt, Human
agcacaaaagcagccacagaug

SEQ ID NO: 762438 - RNA, 22 nt, Human
uuauucugacuaauguauaacu

SEQ ID NO: 762439 - RNA, 22 nt, Human
cuucuacacaucccucuugcuu

SEQ ID NO: 762440 - RNA, 22 nt, Human
acugugaguuuauuuaucugau

SEQ ID NO: 762441 - RNA, 22 nt, Human
uccagcaguccaugugagacac

SEQ ID NO: 762442 - RNA, 22 nt, Human
uggccaagccacugcugggucu

SEQ ID NO: 762443 - RNA, 22 nt, Human
agagacacaucauauaaguaua

SEQ ID NO: 762444 - RNA, 22 nt, Human
aauaaccuuacuuauuacaugg

SEQ ID NO: 762445 - RNA, 22 nt, Human
uguaaaaagcccagccgcugag

SEQ ID NO: 762446 - RNA, 22 nt, Human
uugcacaguuugaagaugacuc

SEQ ID NO: 762447 - RNA, 22 nt, Human
agaacugucacgagugacaaag

SEQ ID NO: 762448 - RNA, 22 nt, Human
uguuggcagugcuacagucagu

SEQ ID NO: 762449 - RNA, 22 nt, Human
cugcagagaauuguggggcuuc

SEQ ID NO: 762450 - RNA, 22 nt, Human
guuucauaugcaguuaacagca

SEQ ID NO: 762451 - RNA, 22 nt, Human
uaaguggguuuguaaugugccu

SEQ ID NO: 762452 - RNA, 23 nt, Human
acagacaacacugaugagagaaa

SEQ ID NO: 762453 - RNA, 22 nt, Human
ugcacccugccugccugcgggu

SEQ ID NO: 762454 - RNA, 22 nt, Human
cagcauggugccagugagucca

SEQ ID NO: 762455 - RNA, 22 nt, Human
gccgaagacgcugggcgugggc

SEQ ID NO: 762456 - RNA, 22 nt, Human
caagauuuccaacccuggguaa

SEQ ID NO: 762457 - RNA, 22 nt, Human
uuccaugaagggcagccucuca

SEQ ID NO: 762458 - RNA, 22 nt, Human
gaaccugauccaauauuuacuc

SEQ ID NO: 762459 - RNA, 22 nt, Human
uggcuggagcgcccuccucugc

SEQ ID NO: 762460 - RNA, 22 nt, Human
acacaggagauauguaauggcu

SEQ ID NO: 762461 - RNA, 22 nt, Human
ggagguggccugaaaauguggc

SEQ ID NO: 762462 - RNA, 22 nt, Human
gcugccucccccauggcuggaa

SEQ ID NO: 762463 - RNA, 22 nt, Human
agcaauaagggauccucuauaa

SEQ ID NO: 762464 - RNA, 22 nt, Human
cagggccucugugggcucucuc

SEQ ID NO: 762465 - RNA, 22 nt, Human
cuccugggcucaagugauccuc

SEQ ID NO: 762466 - RNA, 22 nt, Human
aacaaacaaacauuuugucauc

SEQ ID NO: 762467 - RNA, 22 nt, Human
aauggcaaaaggauaacaagga

SEQ ID NO: 762468 - RNA, 22 nt, Human
uggcugcaguucacaggagcaa

SEQ ID NO: 762469 - RNA, 22 nt, Human
ugcaucuguucauucguuccca

SEQ ID NO: 762470 - RNA, 22 nt, Human
uaaguccuauuccaggucucuc

SEQ ID NO: 762471 - RNA, 22 nt, Human
agaaucaaggugaagcccacag

SEQ ID NO: 762472 - RNA, 22 nt, Human
ugcauauccacaccuuaucucu

SEQ ID NO: 762473 - RNA, 22 nt, Human
ugcauuaucuuuaauguucuca

SEQ ID NO: 762474 - RNA, 22 nt, Human
acauuucuuagccuaguuccag

SEQ ID NO: 762475 - RNA, 22 nt, Human
gcuuuacauuuuggaaagguga

SEQ ID NO: 762476 - RNA, 22 nt, Human
gaucuuuauacuguaauaauga

SEQ ID NO: 762477 - RNA, 22 nt, Human
aggcuuuccugucacucaugcu

SEQ ID NO: 762478 - RNA, 20 nt, Human
uucaucagcaaagcacagca

SEQ ID NO: 762479 - RNA, 22 nt, Human
ucagcucuaaguuuuaugcaaa

SEQ ID NO: 762480 - RNA, 20 nt, Human
uccagggcaaacucaucacc

SEQ ID NO: 762481 - RNA, 18 nt, Human
uuuguccuguggcagcug

SEQ ID NO: 762482 - RNA, 18 nt, Human
agaauuauucuuguccuc

SEQ ID NO: 762483 - RNA, 20 nt, Human
ugugaaagcaguagaaugac

SEQ ID NO: 762484 - RNA, 22 nt, Human
gcaggggcuacucugagcuucc

SEQ ID NO: 762485 - RNA, 22 nt, Human
aaggguuugucucccucaaggc

SEQ ID NO: 762486 - RNA, 22 nt, Human
aguuuauucucuggucuuagua

SEQ ID NO: 762487 - RNA, 17 nt, Human
uuuauaauuggccucuu

SEQ ID NO: 762488 - RNA, 22 nt, Human
ccucaggguucggaugagaaca

SEQ ID NO: 762489 - RNA, 22 nt, Human
ucaggauaaaauguaauggcaa

SEQ ID NO: 762490 - RNA, 22 nt, Human
gguucacauauugagaguauuc

SEQ ID NO: 762491 - RNA, 22 nt, Human
gacaggcuggcaaugcccugcu

SEQ ID NO: 762492 - RNA, 22 nt, Human
uuaagugagcuugaauaaucuu

SEQ ID NO: 762493 - RNA, 20 nt, Human
guuugaaaugauugguuggu

SEQ ID NO: 762494 - RNA, 22 nt, Human
cagcucccaguggcagcuccuu

SEQ ID NO: 762495 - RNA, 22 nt, Human
gugguguaggucacaguuagga

SEQ ID NO: 762496 - RNA, 22 nt, Human
uuuccucugggcccugccaccc

SEQ ID NO: 762497 - RNA, 22 nt, Human
aagccagguuccauggaggagc

SEQ ID NO: 762498 - RNA, 22 nt, Human
ccaucuccacugucccugucaa

SEQ ID NO: 762499 - RNA, 22 nt, Human
aggaggccugcagcugccauuc

SEQ ID NO: 762500 - RNA, 22 nt, Human
ugucaaaaauaagagagauugu

SEQ ID NO: 762501 - RNA, 22 nt, Human
augugucaauuuucaaaugcuu

SEQ ID NO: 762502 - RNA, 22 nt, Human
gacaguaagucagagacuuggu

SEQ ID NO: 762503 - RNA, 22 nt, Human
uugaggacagugcuuggggccc

SEQ ID NO: 762504 - RNA, 22 nt, Human
uuuauucacuggggucugcccg

SEQ ID NO: 762505 - RNA, 22 nt, Human
uaaaacugaauacauacugagg

SEQ ID NO: 762506 - RNA, 22 nt, Human
ucauggaaggaguggccaagug

SEQ ID NO: 762507 - RNA, 22 nt, Human
auuuucuguaacuauuucuaua

SEQ ID NO: 762508 - RNA, 22 nt, Human
aaguaacuuauuugcaaacagg

SEQ ID NO: 762509 - RNA, 22 nt, Human
gcaugugucuccccaguggagg

SEQ ID NO: 762510 - RNA, 22 nt, Human
ugagaauuuuuugucaugcauu

SEQ ID NO: 762511 - RNA, 22 nt, Human
aggcaguggaaggagaaagcaa

SEQ ID NO: 762512 - RNA, 22 nt, Human
cagucugaacacugggcuacuc

SEQ ID NO: 762513 - RNA, 22 nt, Human
cucaggcucuggccauccaagg

SEQ ID NO: 762514 - RNA, 22 nt, Human
ccauuuguucgcccagcuccaa

SEQ ID NO: 762515 - RNA, 17 nt, Human
ugucuucugaagagagc

SEQ ID NO: 762516 - RNA, 22 nt, Human
uagcagaguaauacuuuggagc

SEQ ID NO: 762517 - RNA, 22 nt, Human
uucuuaaaauucaagcuagguu

SEQ ID NO: 762518 - RNA, 22 nt, Human
cagcacaggaauaugguggaca

SEQ ID NO: 762519 - RNA, 20 nt, Human
cuuugguggggguagcccag

SEQ ID NO: 762520 - RNA, 23 nt, Human
ugugcgugaugcuuuguugaagg

SEQ ID NO: 762521 - RNA, 22 nt, Human
auaucuuuguuuuugccaagau

SEQ ID NO: 762522 - RNA, 22 nt, Human
ugcuuuaccuucccagaaacca

SEQ ID NO: 762523 - RNA, 18 nt, Human
auccugggccagucuuuc

SEQ ID NO: 762524 - RNA, 22 nt, Human
uaaauagagaaucagcuuggag

SEQ ID NO: 762525 - RNA, 22 nt, Human
uaagagcuaggauuuuaaauca

SEQ ID NO: 762526 - RNA, 22 nt, Human
gcuugccuggcauuucuggggc

SEQ ID NO: 762527 - RNA, 21 nt, Human
cagaggccucaugcucugugc

SEQ ID NO: 762528 - RNA, 22 nt, Human
acacagaagaucucuuaaugcu

SEQ ID NO: 762529 - RNA, 22 nt, Human
uuauagugcauaauuaacaugg

SEQ ID NO: 762530 - RNA, 20 nt, Human
ggaacacuguucauucugua

SEQ ID NO: 762531 - RNA, 22 nt, Human
aguguccuccucugggagccag

SEQ ID NO: 762532 - RNA, 22 nt, Human
uauuggaccacagacuuuaagg

SEQ ID NO: 762533 - RNA, 22 nt, Human
gagcccuguaggaaucucucaa

SEQ ID NO: 762534 - RNA, 22 nt, Human
guuagaaagugucugcuugggu

SEQ ID NO: 762535 - RNA, 22 nt, Human
aaauguaccuugauaguuuggu

SEQ ID NO: 762536 - RNA, 22 nt, Human
caucacaggcauuuugaguguc

SEQ ID NO: 762537 - RNA, 22 nt, Human
agagccugugggagaugcagcu

SEQ ID NO: 762538 - RNA, 22 nt, Human
aaugugauuuucccaguagaau

SEQ ID NO: 762539 - RNA, 20 nt, Human
gcagccguggagacuaggag

SEQ ID NO: 762540 - RNA, 22 nt, Human
uuugagaaacugauuauuaugg

SEQ ID NO: 762541 - RNA, 22 nt, Human
ccaggcugcuuagccuuaucuu

SEQ ID NO: 762542 - RNA, 22 nt, Human
accucugccacuuucuaacucu

SEQ ID NO: 762543 - RNA, 22 nt, Human
uuccauauuguacucuuuggag

SEQ ID NO: 762544 - RNA, 22 nt, Human
uuuacacagaggacacugggcu

SEQ ID NO: 762545 - RNA, 22 nt, Human
aggccacagagagugcaugugc

SEQ ID NO: 762546 - RNA, 22 nt, Human
ccuggccucagacagagggugg

SEQ ID NO: 762547 - RNA, 20 nt, Human
ccaguccaccugagacaugu

SEQ ID NO: 762548 - RNA, 22 nt, Human
aguguuucuaaguagaugugaa

SEQ ID NO: 762549 - RNA, 18 nt, Human
gcagugccagccucuccu

SEQ ID NO: 762550 - RNA, 22 nt, Human
uagagcugauaaugaggccaag

SEQ ID NO: 762551 - RNA, 22 nt, Human
uuucucaguucucugcaaggag

SEQ ID NO: 762552 - RNA, 22 nt, Human
caggagcucuuaaggaugugau

SEQ ID NO: 762553 - RNA, 22 nt, Human
uuucuccucuccagagugcagu

SEQ ID NO: 762554 - RNA, 22 nt, Human
gagccuggguccuucccuggga

SEQ ID NO: 762555 - RNA, 22 nt, Human
ucuggaaucagaccuaauccca

SEQ ID NO: 762556 - RNA, 22 nt, Human
gaugaagccugacuucucggug

SEQ ID NO: 762557 - RNA, 22 nt, Human
gcccaggaggcagagguugugg

SEQ ID NO: 762558 - RNA, 18 nt, Human
ugcuccaggcccaugggc

SEQ ID NO: 762559 - RNA, 22 nt, Human
ugucaggaggguccagagaaaa

SEQ ID NO: 762560 - RNA, 22 nt, Human
uaggccaguaaaauguuucagu

SEQ ID NO: 762561 - RNA, 22 nt, Human
guucuucaggcugugcucuaga

SEQ ID NO: 762562 - RNA, 22 nt, Human
ucucuuccaguaagagucuuua

SEQ ID NO: 762563 - RNA, 22 nt, Human
caguggccuuuccugcugcuca

SEQ ID NO: 762564 - RNA, 22 nt, Human
gcaggcaguugcaguuuucuag

SEQ ID NO: 762565 - RNA, 22 nt, Human
cuuaauuacccaaugugguagg

SEQ ID NO: 762566 - RNA, 22 nt, Human
agccccuuggaacacagggcug

SEQ ID NO: 762567 - RNA, 22 nt, Human
uuugauacugagaaaaacaaau

SEQ ID NO: 762568 - RNA, 22 nt, Human
auucucucauuuaucuguccua

SEQ ID NO: 762569 - RNA, 22 nt, Human
caggcacugcacuaccacuuuu

SEQ ID NO: 762570 - RNA, 22 nt, Human
aucaguuauuuuuaagcuauaa

SEQ ID NO: 762571 - RNA, 22 nt, Human
cagcaagagaggcagggcaaau

SEQ ID NO: 762572 - RNA, 22 nt, Human
augggggcggcugaagcccagg

SEQ ID NO: 762573 - RNA, 22 nt, Human
cagcaaaauuugaggauugccu

SEQ ID NO: 762574 - RNA, 22 nt, Human
caggcauuucgcaaaggcugag

SEQ ID NO: 762575 - RNA, 22 nt, Human
cuucuucagaggccagccucug

SEQ ID NO: 762576 - RNA, 20 nt, Human
gcacugaagguuccagggga

SEQ ID NO: 762577 - RNA, 22 nt, Human
ccagcucugcagggccuggggu

SEQ ID NO: 762578 - RNA, 22 nt, Human
uccauuugaaaugaaagugaua

SEQ ID NO: 762579 - RNA, 22 nt, Human
ugucccuaaagaaacagacauu

SEQ ID NO: 762580 - RNA, 22 nt, Human
auauauacuuugacacauucug

SEQ ID NO: 762581 - RNA, 22 nt, Human
guguguccucaguaguggcaug

SEQ ID NO: 762582 - RNA, 22 nt, Human
cagcagugacaagacuaagaag

SEQ ID NO: 762583 - RNA, 22 nt, Human
caucuucaggggcuacaucugu

SEQ ID NO: 762584 - RNA, 22 nt, Human
uacuugcuguuaguauuuuaca

SEQ ID NO: 762585 - RNA, 22 nt, Human
cggucugagauuuuuaauaggc

SEQ ID NO: 762586 - RNA, 22 nt, Human
aagacccacaaggcugaauguu

SEQ ID NO: 762587 - RNA, 22 nt, Human
uauugcugacuuguucaguguu

SEQ ID NO: 762588 - RNA, 22 nt, Human
gagugcguguuuggggaugugg

SEQ ID NO: 762589 - RNA, 22 nt, Human
ucauuacacaguucaguggaaa

SEQ ID NO: 762590 - RNA, 22 nt, Human
uacugccugggggagacagcug

SEQ ID NO: 762591 - RNA, 22 nt, Human
uaaauuauguuccauguccuuu

SEQ ID NO: 762592 - RNA, 22 nt, Human
acuggggagugguuuugggaag

SEQ ID NO: 762593 - RNA, 22 nt, Human
uuauucaccucuauuagacuca

SEQ ID NO: 762594 - RNA, 22 nt, Human
agaucuuguuaaaugcugccuc

SEQ ID NO: 762595 - RNA, 22 nt, Human
ucaguggagagcuuccaggauu

SEQ ID NO: 762596 - RNA, 22 nt, Human
gcucuccaggucucaugcacug

SEQ ID NO: 762597 - RNA, 23 nt, Human
agugucugagugcaggcugugca

SEQ ID NO: 762598 - RNA, 22 nt, Human
cuacaguagagguugucaggga

SEQ ID NO: 762599 - RNA, 22 nt, Human
cggaggcaaacucaccuggcuc

SEQ ID NO: 762600 - RNA, 23 nt, Human
gccugggacugguagugugaccu

SEQ ID NO: 762601 - RNA, 22 nt, Human
augcauguuaagcucuuaaaau

SEQ ID NO: 762602 - RNA, 22 nt, Human
cccaggcugcaugaguccaugg

SEQ ID NO: 762603 - RNA, 21 nt, Human
ucugugccucaacccucaucu

SEQ ID NO: 762604 - RNA, 22 nt, Human
uuccugagcaccagacacugca

SEQ ID NO: 762605 - RNA, 22 nt, Human
gaacaauagugguaacaaagcc

SEQ ID NO: 762606 - RNA, 22 nt, Human
ucaguuaauauggguaaagcau

SEQ ID NO: 762607 - RNA, 22 nt, Human
aucagguagauuuaauauucug

SEQ ID NO: 762608 - RNA, 22 nt, Human
cagcugugcuagaagccacgaa

SEQ ID NO: 762609 - RNA, 22 nt, Human
guccagggaaauagcgacaggg

SEQ ID NO: 762610 - RNA, 22 nt, Human
cacugucuguguguccuugggg

SEQ ID NO: 762611 - RNA, 22 nt, Human
gaccuuccuucuuugcuccggg

SEQ ID NO: 762612 - RNA, 22 nt, Human
ugguccugcuugcugcuuaaga

SEQ ID NO: 762613 - RNA, 22 nt, Human
gucucucugacugguccacacc

SEQ ID NO: 762614 - RNA, 22 nt, Human
accuggaugcuggccuugccuu

SEQ ID NO: 762615 - RNA, 22 nt, Human
agggguuggacauaagacagaa

SEQ ID NO: 762616 - RNA, 22 nt, Human
uuuauguuccucuugagcuuuc

SEQ ID NO: 762617 - RNA, 22 nt, Human
acauauaagggaucagugacag

SEQ ID NO: 762618 - RNA, 22 nt, Human
ugggcucugcaucagugcccau

SEQ ID NO: 762619 - RNA, 22 nt, Human
acacuaauuaagcugcuuuacu

SEQ ID NO: 762620 - RNA, 22 nt, Human
guuuucaauuauaagauggcuu

SEQ ID NO: 762621 - RNA, 16 nt, Human
gaggcuggcagauguc

SEQ ID NO: 762622 - RNA, 22 nt, Human
gcccaggaguugaaugcagcag

SEQ ID NO: 762623 - RNA, 22 nt, Human
ucagaagcaaacaucacucuag

SEQ ID NO: 762624 - RNA, 22 nt, Human
ggcaggcaacggaccacuaguc

SEQ ID NO: 762625 - RNA, 22 nt, Human
gagcagcuguucugacuugucu

SEQ ID NO: 762626 - RNA, 22 nt, Human
ugagacuugugaguccuucuag

SEQ ID NO: 762627 - RNA, 22 nt, Human
ugaggccagacugaaaccaaca

SEQ ID NO: 762628 - RNA, 22 nt, Human
aaggacaaguaguauuugcauc

SEQ ID NO: 762629 - RNA, 22 nt, Human
uccaggagacacccuugugugu

SEQ ID NO: 762630 - RNA, 20 nt, Human
cagugcaacugaagaacuga

SEQ ID NO: 762631 - RNA, 22 nt, Human
cuggaauguagagacagcuuag

SEQ ID NO: 762632 - RNA, 22 nt, Human
acaguuuagaaugccacauagu

SEQ ID NO: 762633 - RNA, 22 nt, Human
ugccacaccaacaucuuucagc

SEQ ID NO: 762634 - RNA, 22 nt, Human
uuccugcuccauuugcugagcu

SEQ ID NO: 762635 - RNA, 22 nt, Human
uuugaguugcuuauuuaauagg

SEQ ID NO: 762636 - RNA, 22 nt, Human
cucuuuccaggguaccccaggu

SEQ ID NO: 762637 - RNA, 22 nt, Human
ggcugagaaucaacaaccugcu

SEQ ID NO: 762638 - RNA, 22 nt, Human
uugaacacuaaguuuccaggcu

SEQ ID NO: 762639 - RNA, 22 nt, Human
uaauccuucuuguguucauuag

SEQ ID NO: 762640 - RNA, 18 nt, Human
aguuccuuaaauuggugu

SEQ ID NO: 762641 - RNA, 22 nt, Human
agguauaugcuauuacuucugc

SEQ ID NO: 762642 - RNA, 22 nt, Human
uuaacucucccuccuuacaucc

SEQ ID NO: 762643 - RNA, 22 nt, Human
ugccuggaugugcuggccucac

SEQ ID NO: 762644 - RNA, 22 nt, Human
cugaauucugccuugaggccuu

SEQ ID NO: 762645 - RNA, 22 nt, Human
ucuguuauaaaucacacugcau

SEQ ID NO: 762646 - RNA, 22 nt, Human
caaaugcuaacuucuuuccaaa

SEQ ID NO: 762647 - RNA, 22 nt, Human
auuuacagccuugaaaacagca

SEQ ID NO: 762648 - RNA, 22 nt, Human
ugcccagcgcccacauucuguc

SEQ ID NO: 762649 - RNA, 22 nt, Human
uucagcaccuggaauagcaccu

SEQ ID NO: 762650 - RNA, 22 nt, Human
guucugcuuaaauuauugaucc

SEQ ID NO: 762651 - RNA, 22 nt, Human
aacagauauaggcagaacuuug

SEQ ID NO: 762652 - RNA, 21 nt, Human
uucauucauggcauaauauag

SEQ ID NO: 762653 - RNA, 22 nt, Human
gagcacaguccuuuuguuaaaa

SEQ ID NO: 762654 - RNA, 22 nt, Human
caagagcugaggcuggagaggu

SEQ ID NO: 762655 - RNA, 22 nt, Human
uauuaggguaaauuugacaugc

SEQ ID NO: 762656 - RNA, 22 nt, Human
gggccugagacugagggugagg

SEQ ID NO: 762657 - RNA, 22 nt, Human
gugauaaaggggaggaagugug

SEQ ID NO: 762658 - RNA, 22 nt, Human
ucucucugccaacucacagcca

SEQ ID NO: 762659 - RNA, 22 nt, Human
uuuagcagugaagugaagugaa

SEQ ID NO: 762660 - RNA, 20 nt, Human
ucugugugccaucaccuaac

SEQ ID NO: 762661 - RNA, 22 nt, Human
gacccugagcaaaagcaguucu

SEQ ID NO: 762662 - RNA, 22 nt, Human
cacagguguguccuggucuugu

SEQ ID NO: 762663 - RNA, 22 nt, Human
uuuagugauucauuuagaaaaa

SEQ ID NO: 762664 - RNA, 22 nt, Human
cuguaacucugccaagaaggcu

SEQ ID NO: 762665 - RNA, 21 nt, Human
uuauaggcugggguuugcuuu

SEQ ID NO: 762666 - RNA, 22 nt, Human
aguuggagugaacaugagauug

SEQ ID NO: 762667 - RNA, 22 nt, Human
aaaggccucuguccuagugccu

SEQ ID NO: 762668 - RNA, 22 nt, Human
guggcaugaaagcaucugugau

SEQ ID NO: 762669 - RNA, 20 nt, Human
ggcauccuucugacccagag

SEQ ID NO: 762670 - RNA, 22 nt, Human
cagugcugcaggcgccugcggu

SEQ ID NO: 762671 - RNA, 22 nt, Human
uguauacaugucugugugcaca

SEQ ID NO: 762672 - RNA, 22 nt, Human
uggagcagaaauuugaagccau

SEQ ID NO: 762673 - RNA, 22 nt, Human
cagcuccagcccaggcagcucc

SEQ ID NO: 762674 - RNA, 20 nt, Human
aggcaguguagagaugagua

SEQ ID NO: 762675 - RNA, 19 nt, Human
ugugccucuauagcaugug

SEQ ID NO: 762676 - RNA, 22 nt, Human
uugggcagucuggcugcagagu

SEQ ID NO: 762677 - RNA, 22 nt, Human
agauuuuauagauaauuuccca

SEQ ID NO: 762678 - RNA, 22 nt, Human
gagagcugggaaagccguggag

SEQ ID NO: 762679 - RNA, 22 nt, Human
cuuguacauugauuucugcauu

SEQ ID NO: 762680 - RNA, 23 nt, Human
gcccugcuccuggcugggaggga

SEQ ID NO: 762681 - RNA, 22 nt, Human
aucugggggagcugcucaugga

SEQ ID NO: 762682 - RNA, 22 nt, Human
ucuugagucuaaucugaacuuu

SEQ ID NO: 762683 - RNA, 18 nt, Human
ucccuggggcugccaccc

SEQ ID NO: 762684 - RNA, 22 nt, Human
gggacgagaucuuggcagugug

SEQ ID NO: 762685 - RNA, 22 nt, Human
uucuucaguuugguaaauguaa

SEQ ID NO: 762686 - RNA, 22 nt, Human
uggaaggcgucucgaaggccua

SEQ ID NO: 762687 - RNA, 22 nt, Human
cagugcuuugggaggcugagga

SEQ ID NO: 762688 - RNA, 22 nt, Human
ucaugugucugccaguguuuau

SEQ ID NO: 762689 - RNA, 22 nt, Human
accugggaguaugcagugguga

SEQ ID NO: 762690 - RNA, 23 nt, Human
ggagccagccuguggggagcggg

SEQ ID NO: 762691 - RNA, 22 nt, Human
uauuucugagaaccaacuuacc

SEQ ID NO: 762692 - RNA, 22 nt, Human
ucaccaccagaagagcuauucu

SEQ ID NO: 762693 - RNA, 22 nt, Human
ugcccccagacagaauccaguu

SEQ ID NO: 762694 - RNA, 17 nt, Human
aaggccauuuccaccca

SEQ ID NO: 762695 - RNA, 22 nt, Human
aucuuucaggccuaguguuuaa

SEQ ID NO: 762696 - RNA, 22 nt, Human
ucuuucuugguauaaagcaggg

SEQ ID NO: 762697 - RNA, 22 nt, Human
ugcucuggcugggaugagugca

SEQ ID NO: 762698 - RNA, 22 nt, Human
ucugcugugauucuacuagugu

SEQ ID NO: 762699 - RNA, 22 nt, Human
ugaggcucuccaagcagaugag

SEQ ID NO: 762700 - RNA, 22 nt, Human
ugcauguggaucauauguccua

SEQ ID NO: 762701 - RNA, 22 nt, Human
uggaggucugcaaggcgcugga

SEQ ID NO: 762702 - RNA, 22 nt, Human
gccuggagacagcagaggcggc

SEQ ID NO: 762703 - RNA, 18 nt, Human
gagcagaggcucaacugg

SEQ ID NO: 762704 - RNA, 22 nt, Human
gcagcuggccccuuuccuuguu

SEQ ID NO: 762705 - RNA, 22 nt, Human
auuauucucuggaggaaagauu

SEQ ID NO: 762706 - RNA, 22 nt, Human
ccaccuccaccuauugccagcc

SEQ ID NO: 762707 - RNA, 22 nt, Human
ugugaggaacaggacuagagca

SEQ ID NO: 762708 - RNA, 22 nt, Human
auaugugugaugcauggacuaa

SEQ ID NO: 762709 - RNA, 22 nt, Human
uauuucagggagaauaaauuug

SEQ ID NO: 762710 - RNA, 22 nt, Human
augcacauguaugucaauauuu

SEQ ID NO: 762711 - RNA, 21 nt, Human
auggagucaggggaaugggcc

SEQ ID NO: 762712 - RNA, 22 nt, Human
agugcccggacaacuggacaga

SEQ ID NO: 762713 - RNA, 20 nt, Human
ugguccucacaugccaucuu

SEQ ID NO: 762714 - RNA, 22 nt, Human
ucaggaaagaagaugcucagug

SEQ ID NO: 762715 - RNA, 22 nt, Human
caaagcagcggauugggauagu

SEQ ID NO: 762716 - RNA, 22 nt, Human
cuggaggaauaauggcaucuug

SEQ ID NO: 762717 - RNA, 22 nt, Human
aucaaagaaugugacugaaaua

SEQ ID NO: 762718 - RNA, 22 nt, Human
ggagggguggucaccuggcagg

SEQ ID NO: 762719 - RNA, 22 nt, Human
gacuggguccucugcuuauggu

SEQ ID NO: 762720 - RNA, 22 nt, Human
aggggagcuugccuggucaccc

SEQ ID NO: 762721 - RNA, 22 nt, Human
aacuguugucauauggucuuaa

SEQ ID NO: 762722 - RNA, 22 nt, Human
gggugcagggucuccagcagcu

SEQ ID NO: 762723 - RNA, 22 nt, Human
agggaccucuucuugcagcuga

SEQ ID NO: 762724 - RNA, 18 nt, Human
gguggccuugacuucucu

SEQ ID NO: 762725 - RNA, 22 nt, Human
cugccauccucaccagagcagc

SEQ ID NO: 762726 - RNA, 22 nt, Human
aaagugcucggauuacagguau

SEQ ID NO: 762727 - RNA, 22 nt, Human
auacauguugagaaaauaucug

SEQ ID NO: 762728 - RNA, 21 nt, Human
aggcagcaggauccagggaca

SEQ ID NO: 762729 - RNA, 22 nt, Human
aacuguaaggcuuagaacagca

SEQ ID NO: 762730 - RNA, 22 nt, Human
gcagggucgcucuaggagauca

SEQ ID NO: 762731 - RNA, 22 nt, Human
guccuguguacuccugauacuu

SEQ ID NO: 762732 - RNA, 22 nt, Human
cuguggcucaauugccuacuga

SEQ ID NO: 762733 - RNA, 22 nt, Human
agaugcagauuuggauucagga

SEQ ID NO: 762734 - RNA, 22 nt, Human
caaaugaagaaccuucucaccu

SEQ ID NO: 762735 - RNA, 21 nt, Human
ggagucagggucuggcugggg

SEQ ID NO: 762736 - RNA, 22 nt, Human
uagcaaagggaaagaagggccu

SEQ ID NO: 762737 - RNA, 22 nt, Human
uacuuuagaaggaaauaaguuc

SEQ ID NO: 762738 - RNA, 22 nt, Human
aucauuacuccuguaaaauugu

SEQ ID NO: 762739 - RNA, 22 nt, Human
ucagggagccuggacuucaagg

SEQ ID NO: 762740 - RNA, 22 nt, Human
uucggaguauugacaugugaag

SEQ ID NO: 762741 - RNA, 22 nt, Human
aggcagccugguuugaauggaa

SEQ ID NO: 762742 - RNA, 22 nt, Human
caggcccauucuaggcuugcua

SEQ ID NO: 762743 - RNA, 22 nt, Human
aaccagcugagaaugcuucugc

SEQ ID NO: 762744 - RNA, 22 nt, Human
agaggagguggugaugcuuuaa

SEQ ID NO: 762745 - RNA, 22 nt, Human
aaaugccucccauucuacugac

SEQ ID NO: 762746 - RNA, 22 nt, Human
uaaagguaugucuuaaucaaac

SEQ ID NO: 762747 - RNA, 22 nt, Human
aauggcaagagccacagaggcg

SEQ ID NO: 762748 - RNA, 22 nt, Human
uuugcugaauagauuguaaacu

SEQ ID NO: 762749 - RNA, 22 nt, Human
cugcagcaggaggcuccugcag

SEQ ID NO: 762750 - RNA, 22 nt, Human
uuucuucuaagauuucaaacua

SEQ ID NO: 762751 - RNA, 22 nt, Human
ucuuacagccacucugugaagc

SEQ ID NO: 762752 - RNA, 22 nt, Human
guucacagcaaaccuaugaacu

SEQ ID NO: 762753 - RNA, 22 nt, Human
cucagagaaaaggagcaagggu

SEQ ID NO: 762754 - RNA, 22 nt, Human
ccuguuuauccaugccaauccu

SEQ ID NO: 762755 - RNA, 22 nt, Human
acagcucauuuguaaaacggag

SEQ ID NO: 762756 - RNA, 22 nt, Human
uuaaaugagauguucagauauu

SEQ ID NO: 762757 - RNA, 22 nt, Human
cucugucccagacccaccucuc

SEQ ID NO: 762758 - RNA, 22 nt, Human
ucacagaaauaagauaguuauu

SEQ ID NO: 762759 - RNA, 22 nt, Human
cuucacacccacuaaaaugaug

SEQ ID NO: 762760 - RNA, 22 nt, Human
cccaggcucagacuggcuuguu

SEQ ID NO: 762761 - RNA, 22 nt, Human
uucaguauguguaaacuacuuu

SEQ ID NO: 762762 - RNA, 22 nt, Human
aaguauauuuagcugagcuugu

SEQ ID NO: 762763 - RNA, 22 nt, Human
aaacaagucacuuuaucuugaa

SEQ ID NO: 762764 - RNA, 22 nt, Human
cucuccauucccuacaguuuuc

SEQ ID NO: 762765 - RNA, 22 nt, Human
gggcagcaugucacuagcaugg

SEQ ID NO: 762766 - RNA, 20 nt, Human
aaacaagguugcucugagga

SEQ ID NO: 762767 - RNA, 22 nt, Human
cgggcuccgggucuuugcaguc

SEQ ID NO: 762768 - RNA, 22 nt, Human
cucagggggaaucaggucacag

SEQ ID NO: 762769 - RNA, 22 nt, Human
ccucucaaaagcacaacauuga

SEQ ID NO: 762770 - RNA, 22 nt, Human
uggugaggccaaagccaugaca

SEQ ID NO: 762771 - RNA, 22 nt, Human
cugggaagaagugggcuacauu

SEQ ID NO: 762772 - RNA, 21 nt, Human
cagccugcugcuccagggcca

SEQ ID NO: 762773 - RNA, 22 nt, Human
ucacagaaugucagaguugggg

SEQ ID NO: 762774 - RNA, 20 nt, Human
ugagcuucagauaucgugca

SEQ ID NO: 762775 - RNA, 22 nt, Human
aaggccagcuuguagggcuggu

SEQ ID NO: 762776 - RNA, 22 nt, Human
ucaggacacccugugcuuccuu

SEQ ID NO: 762777 - RNA, 19 nt, Human
ucucacaguuuccuugccu

SEQ ID NO: 762778 - RNA, 22 nt, Human
ugcccuccuccugagcccaugu

SEQ ID NO: 762779 - RNA, 22 nt, Human
cuguguaugacuccagagggua

SEQ ID NO: 762780 - RNA, 22 nt, Human
acaggcacugucaagucaugaa

SEQ ID NO: 762781 - RNA, 22 nt, Human
aucuggguagugcaagacauga

SEQ ID NO: 762782 - RNA, 22 nt, Human
aaaaguaauugugguuuuugcc

SEQ ID NO: 762783 - RNA, 22 nt, Human
gugggagcccucagggaggugc

SEQ ID NO: 762784 - RNA, 22 nt, Human
gcucaaagaauauucagaauga

SEQ ID NO: 762785 - RNA, 22 nt, Human
agaggcuccuagccacuggcuu

SEQ ID NO: 762786 - RNA, 22 nt, Human
ucacagcuuucagauuguuccc

SEQ ID NO: 762787 - RNA, 20 nt, Human
aucuggcucagauccugcag

SEQ ID NO: 762788 - RNA, 22 nt, Human
uuagggaaauaaaauuaucagu

SEQ ID NO: 762789 - RNA, 22 nt, Human
agcugcuugggaaccaucaauu

SEQ ID NO: 762790 - RNA, 22 nt, Human
acaaagugaauugcaucgaguu

SEQ ID NO: 762791 - RNA, 22 nt, Human
ugggagcagcuuugcgagggag

SEQ ID NO: 762792 - RNA, 22 nt, Human
auguuuuacccuuugcacaaac

SEQ ID NO: 762793 - RNA, 22 nt, Human
cugugugcaggugcuggguacc

SEQ ID NO: 762794 - RNA, 22 nt, Human
uuucccuuugcacucuacaauu

SEQ ID NO: 762795 - RNA, 22 nt, Human
gaagcaauuaaguuugugaucu

SEQ ID NO: 762796 - RNA, 22 nt, Human
acuucagcccagaggaagggau

SEQ ID NO: 762797 - RNA, 22 nt, Human
cuccagcuuuuucccaguuggc

SEQ ID NO: 762798 - RNA, 22 nt, Human
uuucauugucaauaaacuguau

SEQ ID NO: 762799 - RNA, 22 nt, Human
uccuucaagaugccacagcuuu

SEQ ID NO: 762800 - RNA, 22 nt, Human
ggcagcuggggcagugcccugu

SEQ ID NO: 762801 - RNA, 22 nt, Human
uuuggcucugguucuggcucca

SEQ ID NO: 762802 - RNA, 20 nt, Human
aacacugugcgugguaggug

SEQ ID NO: 762803 - RNA, 22 nt, Human
ugcuuuuugcacccuuugccgu

SEQ ID NO: 762804 - RNA, 22 nt, Human
cuuuauuguccuucuuaggugg

SEQ ID NO: 762805 - RNA, 22 nt, Human
uaauccugaucaauuuuagcuu

SEQ ID NO: 762806 - RNA, 22 nt, Human
agcagagcauggugggaagggc

SEQ ID NO: 762807 - RNA, 22 nt, Human
uccaggagauacacugcaccag

SEQ ID NO: 762808 - RNA, 17 nt, Human
ccugggaggaguuauga

SEQ ID NO: 762809 - RNA, 22 nt, Human
gaggccugucgcuaggccucug

SEQ ID NO: 762810 - RNA, 22 nt, Human
gcaggagcaauggccuaucaga

SEQ ID NO: 762811 - RNA, 22 nt, Human
uaaacagccuaaaacuuucuuu

SEQ ID NO: 762812 - RNA, 22 nt, Human
cagagcaccugcucauugccag

SEQ ID NO: 762813 - RNA, 19 nt, Human
ggcugccuccugggagauu

SEQ ID NO: 762814 - RNA, 22 nt, Human
gccagcuuggccaguggccagu

SEQ ID NO: 762815 - RNA, 22 nt, Human
ugcccugugcuggaaucuuccc

SEQ ID NO: 762816 - RNA, 17 nt, Human
gcaguuaaauuaagaug

SEQ ID NO: 762817 - RNA, 22 nt, Human
ccucucuccuuccuuugccaaa

SEQ ID NO: 762818 - RNA, 22 nt, Human
cuucuuuguucuguugucucac

SEQ ID NO: 762819 - RNA, 22 nt, Human
ugaagaaucccagggaauuugg

SEQ ID NO: 762820 - RNA, 22 nt, Human
gguggcucacgccuguaagccc

SEQ ID NO: 762821 - RNA, 22 nt, Human
uggugagcucuuuagacuggga

SEQ ID NO: 762822 - RNA, 22 nt, Human
uggaaagaauuccuaugguuca

SEQ ID NO: 762823 - RNA, 17 nt, Human
aggcugcugggccaggg

SEQ ID NO: 762824 - RNA, 19 nt, Human
gcugagggccacccagccc

SEQ ID NO: 762825 - RNA, 22 nt, Human
ccacccuggacucgaggcccga

SEQ ID NO: 762826 - RNA, 22 nt, Human
ggcugugaaguagcaggggcag

SEQ ID NO: 762827 - RNA, 22 nt, Human
gaaaccuuugccgauggggucc

SEQ ID NO: 762828 - RNA, 22 nt, Human
uggaaugccgggccaggcuccg

SEQ ID NO: 762829 - RNA, 22 nt, Human
cagagcagguaucuuuggugaa

SEQ ID NO: 762830 - RNA, 22 nt, Human
uguaugugcuugagaagguggg

SEQ ID NO: 762831 - RNA, 22 nt, Human
guuguacagcauccagugcaga

SEQ ID NO: 762832 - RNA, 22 nt, Human
aagaaucauuguaaaguucugu

SEQ ID NO: 762833 - RNA, 22 nt, Human
guauuccuucagaagacguuua

SEQ ID NO: 762834 - RNA, 22 nt, Human
gcagcuuucugggacagaaagg

SEQ ID NO: 762835 - RNA, 22 nt, Human
cuggcuuugaaggucuuuccua

SEQ ID NO: 762836 - RNA, 22 nt, Human
gggugcaggggacccuagggac

SEQ ID NO: 762837 - RNA, 22 nt, Human
cagcccagcagacuguuaccac

SEQ ID NO: 762838 - RNA, 22 nt, Human
uagaaauccccagucucauagu

SEQ ID NO: 762839 - RNA, 22 nt, Human
cucugccugccacuguucaggc

SEQ ID NO: 762840 - RNA, 22 nt, Human
ccagguggcuucugcccgaugu

SEQ ID NO: 762841 - RNA, 20 nt, Human
uuugauuucacaaggccagu

SEQ ID NO: 762842 - RNA, 22 nt, Human
agagugcccugcucugagcucu

SEQ ID NO: 762843 - RNA, 22 nt, Human
uuucacauauaggggaagcuac

SEQ ID NO: 762844 - RNA, 22 nt, Human
uccaaaggaagaggcugucagu

SEQ ID NO: 762845 - RNA, 22 nt, Human
agugaggggauucaggcaaggu

SEQ ID NO: 762846 - RNA, 22 nt, Human
gcaccaugacagugaggagaac

SEQ ID NO: 762847 - RNA, 22 nt, Human
cugagcuguuacucuguccucg

SEQ ID NO: 762848 - RNA, 22 nt, Human
cagcagcaacaauagcggucac

SEQ ID NO: 762849 - RNA, 22 nt, Human
aucagucuguguuagaaaagag

SEQ ID NO: 762850 - RNA, 21 nt, Human
ccuggagacaaagacagggug

SEQ ID NO: 762851 - RNA, 22 nt, Human
ucuuuggcauuuaggagcagga

SEQ ID NO: 762852 - RNA, 22 nt, Human
auugcaaagaaauacaugcuua

SEQ ID NO: 762853 - RNA, 22 nt, Human
agccagggcugcgagcagacag

SEQ ID NO: 762854 - RNA, 22 nt, Human
uguuuugguuuucaccgagucc

SEQ ID NO: 762855 - RNA, 22 nt, Human
agcucugugaagccagcaguuc

SEQ ID NO: 762856 - RNA, 22 nt, Human
auaauaacuccuguugaagaac

SEQ ID NO: 762857 - RNA, 22 nt, Human
uuuccuaagggaugcggcucaa

SEQ ID NO: 762858 - RNA, 22 nt, Human
uggaucugguucccugagccuu

SEQ ID NO: 762859 - RNA, 22 nt, Human
gggcugagcuaagcuggguuga

SEQ ID NO: 762860 - RNA, 22 nt, Human
aaaccuguuaauagagcgaugc

SEQ ID NO: 762861 - RNA, 22 nt, Human
acacccagagcgccagugccga

SEQ ID NO: 762862 - RNA, 22 nt, Human
ggguggcacaggugcagagggu

SEQ ID NO: 762863 - RNA, 22 nt, Human
uacaugaagaaaauuaagcagu

SEQ ID NO: 762864 - RNA, 20 nt, Human
aauuagcuuaagucaaucag

SEQ ID NO: 762865 - RNA, 22 nt, Human
ggcauccaaauaccaagaugua

SEQ ID NO: 762866 - RNA, 21 nt, Human
uugcugcccucccuuuccuca

SEQ ID NO: 762867 - RNA, 22 nt, Human
aagcuggcaaacaagcaucauu

SEQ ID NO: 762868 - RNA, 22 nt, Human
acacaggaagagagauaauaau

SEQ ID NO: 762869 - RNA, 22 nt, Human
cagagggagcccuccaggagca

SEQ ID NO: 762870 - RNA, 21 nt, Human
ugaaagaggauguggucauuc

SEQ ID NO: 762871 - RNA, 22 nt, Human
cacugucacguucugaaacugu

SEQ ID NO: 762872 - RNA, 22 nt, Human
uggaggggcaauggagcgcgga

SEQ ID NO: 762873 - RNA, 22 nt, Human
aggcgugguugaggcgagcaua

SEQ ID NO: 762874 - RNA, 22 nt, Human
uuugagcuaugggcuuggauuu

SEQ ID NO: 762875 - RNA, 22 nt, Human
ccccaacccugguuccguggcg

SEQ ID NO: 762876 - RNA, 22 nt, Human
acgacagcacaacagcauccuc

SEQ ID NO: 762877 - RNA, 22 nt, Human
cuggacagaaagggcugcugug

SEQ ID NO: 762878 - RNA, 22 nt, Human
cuuuccuaguuggucccagcac

SEQ ID NO: 762879 - RNA, 22 nt, Human
cauacuuuugcccugacauucu

SEQ ID NO: 762880 - RNA, 22 nt, Human
acaugugugacaacagagguga

SEQ ID NO: 762881 - RNA, 22 nt, Human
ugaaggcugggcucagccagcu

SEQ ID NO: 762882 - RNA, 22 nt, Human
ucccugccucucagacuuccuu

SEQ ID NO: 762883 - RNA, 22 nt, Human
gauauuuugagaaauccuauga

SEQ ID NO: 762884 - RNA, 22 nt, Human
gcagcaugagcuauacaaagua

SEQ ID NO: 762885 - RNA, 22 nt, Human
guguguucagcaagagguaagg

SEQ ID NO: 762886 - RNA, 22 nt, Human
cacaggaauaagucaaacuuca

SEQ ID NO: 762887 - RNA, 22 nt, Human
uuuaaggaugaugugauauaua

SEQ ID NO: 762888 - RNA, 22 nt, Human
uuacagcuuacauuuuaccuug

SEQ ID NO: 762889 - RNA, 22 nt, Human
acagucugccucucagagcagc

SEQ ID NO: 762890 - RNA, 22 nt, Human
gggagggauuaguucugccugg

SEQ ID NO: 762891 - RNA, 22 nt, Human
gcuucagcccaucccaguacau

SEQ ID NO: 762892 - RNA, 22 nt, Human
gaggcucugugaugugccaggc

SEQ ID NO: 762893 - RNA, 22 nt, Human
uaacuucagcgaguucucuuaa

SEQ ID NO: 762894 - RNA, 22 nt, Human
uagugcuucuacccuaggcagg

SEQ ID NO: 762895 - RNA, 16 nt, Human
uccuggggauacugga

SEQ ID NO: 762896 - RNA, 22 nt, Human
gucaaaacaaaguuaagaauuc

SEQ ID NO: 762897 - RNA, 19 nt, Human
gcuccugggccucacucau

SEQ ID NO: 762898 - RNA, 22 nt, Human
ugaagccacuuuccagaaucac

SEQ ID NO: 762899 - RNA, 19 nt, Human
agcugccugugcgcgcccg

SEQ ID NO: 762900 - RNA, 22 nt, Human
ggcccagccggcgagucucgcg

SEQ ID NO: 762901 - RNA, 22 nt, Human
uuaacaugucuugacuucaucu

SEQ ID NO: 762902 - RNA, 22 nt, Human
uguggaaugggagugagaagac

SEQ ID NO: 762903 - RNA, 22 nt, Human
agagauggauguuauuaugggu

SEQ ID NO: 762904 - RNA, 22 nt, Human
aaugucuucaguucuguauugu

SEQ ID NO: 762905 - RNA, 22 nt, Human
uacauguauguguacgugcaug

SEQ ID NO: 762906 - RNA, 22 nt, Human
caaaaguaauugugguuuucac

SEQ ID NO: 762907 - RNA, 22 nt, Human
gggcagcaucaggaggggcuuu

SEQ ID NO: 762908 - RNA, 22 nt, Human
ugcagggccccucugcaugagu

SEQ ID NO: 762909 - RNA, 22 nt, Human
aagaacuuccuaauauauuuuc

SEQ ID NO: 762910 - RNA, 20 nt, Human
gaagcagcuucauguagaca

SEQ ID NO: 762911 - RNA, 22 nt, Human
ggaagauuuuccauuccucuuu

SEQ ID NO: 762912 - RNA, 22 nt, Human
cacaugugcaaauacugaggcu

SEQ ID NO: 762913 - RNA, 22 nt, Human
gagcccugcccacuugucugag

SEQ ID NO: 762914 - RNA, 22 nt, Human
ggacugaggcccacuugaggga

SEQ ID NO: 762915 - RNA, 22 nt, Human
ucuucuccuuugccauguguuu

SEQ ID NO: 762916 - RNA, 22 nt, Human
cugggccagaccuuguggucuu

SEQ ID NO: 762917 - RNA, 22 nt, Human
aaugcuuugccaacagcuauug

SEQ ID NO: 762918 - RNA, 22 nt, Human
ugcaaaaaggcagacuggugau

SEQ ID NO: 762919 - RNA, 22 nt, Human
cagcaguggccaucuguguggu

SEQ ID NO: 762920 - RNA, 17 nt, Human
ggcucugggugucacau

SEQ ID NO: 762921 - RNA, 22 nt, Human
uggcucaguuccaucaucugga

SEQ ID NO: 762922 - RNA, 22 nt, Human
auguuaaaaaccaguacaguug

SEQ ID NO: 762923 - RNA, 22 nt, Human
uaauugucuuagucugugcagg

SEQ ID NO: 762924 - RNA, 22 nt, Human
agacacugaauguuuggugguc

SEQ ID NO: 762925 - RNA, 22 nt, Human
uggccccugaggagcaucagcc

SEQ ID NO: 762926 - RNA, 17 nt, Human
gcuccugcaggucagga

SEQ ID NO: 762927 - RNA, 22 nt, Human
gcugcagugagccaagaucgug

SEQ ID NO: 762928 - RNA, 19 nt, Human
aggucugcagcugcaguuu

SEQ ID NO: 762929 - RNA, 22 nt, Human
ucacucuggaguccgcuaccag

SEQ ID NO: 762930 - RNA, 22 nt, Human
gacagguugaaguaucaaaggu

SEQ ID NO: 762931 - RNA, 22 nt, Human
caggcacuggccagucagcaca

SEQ ID NO: 762932 - RNA, 22 nt, Human
agugaggcuaauaggcaauggu

SEQ ID NO: 762933 - RNA, 22 nt, Human
aauaauuagugggacagagaac

SEQ ID NO: 762934 - RNA, 18 nt, Human
ggcuggaagcuguugcug

SEQ ID NO: 762935 - RNA, 22 nt, Human
agcagggcuuuggcuggcuuuc

SEQ ID NO: 762936 - RNA, 22 nt, Human
aggcugugcgaggucucagagu

SEQ ID NO: 762937 - RNA, 21 nt, Human
gucacacaggccuggagcuga

SEQ ID NO: 762938 - RNA, 22 nt, Human
uuccuuguuuguagcucuggga

SEQ ID NO: 762939 - RNA, 22 nt, Human
uugcauugaugucuauacgcug

SEQ ID NO: 762940 - RNA, 22 nt, Human
ggaggcaucucuguggcugucu

SEQ ID NO: 762941 - RNA, 22 nt, Human
uagcauuaaagguaagacauua

SEQ ID NO: 762942 - RNA, 22 nt, Human
gggcaaagugguggaggcaguu

SEQ ID NO: 762943 - RNA, 22 nt, Human
aauuuuaucucuaagcaggcuu

SEQ ID NO: 762944 - RNA, 22 nt, Human
uagcaagaggugaagguuucau

SEQ ID NO: 762945 - RNA, 20 nt, Human
ggccuuggccucuuugcagc

SEQ ID NO: 762946 - RNA, 22 nt, Human
cucagaagccuucagucuuggc

SEQ ID NO: 762947 - RNA, 22 nt, Human
uugagaaauacuuuuguagccu

SEQ ID NO: 762948 - RNA, 22 nt, Human
ucacuccaucuuugcuacuggu

SEQ ID NO: 762949 - RNA, 18 nt, Human
accuccccauuuucugaa

SEQ ID NO: 762950 - RNA, 22 nt, Human
cuuauucagaccuuggauucuu

SEQ ID NO: 762951 - RNA, 22 nt, Human
cggggcugcgcucuuccugccg

SEQ ID NO: 762952 - RNA, 20 nt, Human
gugugaagcccucaggagga

SEQ ID NO: 762953 - RNA, 22 nt, Human
ccaagaugagcuggcuccaugg

SEQ ID NO: 762954 - RNA, 22 nt, Human
gaauucugguccuguccaaggu

SEQ ID NO: 762955 - RNA, 22 nt, Human
gggcugucaugugucagugacc

SEQ ID NO: 762956 - RNA, 22 nt, Human
uagaaauguugguauuaacauu

SEQ ID NO: 762957 - RNA, 22 nt, Human
uuucacacaacgugaauauacu

SEQ ID NO: 762958 - RNA, 22 nt, Human
uuuguauuccauaucaugccau

SEQ ID NO: 762959 - RNA, 22 nt, Human
ggacccugggcucugggccuau

SEQ ID NO: 762960 - RNA, 22 nt, Human
uggcagagcccagacuccaguc

SEQ ID NO: 762961 - RNA, 20 nt, Human
ugcuccuaccacuucugccc

SEQ ID NO: 762962 - RNA, 19 nt, Human
gcacaggacaucugaugga

SEQ ID NO: 762963 - RNA, 22 nt, Human
gcagcccagguggaguaaucua

SEQ ID NO: 762964 - RNA, 22 nt, Human
gcuucuguggauuggcuggcuu

SEQ ID NO: 762965 - RNA, 22 nt, Human
uugucugacuucuuuaguuacu

SEQ ID NO: 762966 - RNA, 22 nt, Human
aaggaagguacucagugauucu

SEQ ID NO: 762967 - RNA, 21 nt, Human
gagccuucccucugcccuuuc

SEQ ID NO: 762968 - RNA, 19 nt, Human
cucucuggcggugucugcg

SEQ ID NO: 762969 - RNA, 22 nt, Human
cugugcccuguggcuggcaccu

SEQ ID NO: 762970 - RNA, 22 nt, Human
agggagcucaguuggaagcggu

SEQ ID NO: 762971 - RNA, 20 nt, Human
cuuuaguuacacguuuccuc

SEQ ID NO: 762972 - RNA, 17 nt, Human
agaaacugaggcucagu

SEQ ID NO: 762973 - RNA, 20 nt, Human
cagagcagugcccaggcggc

SEQ ID NO: 762974 - RNA, 22 nt, Human
uuuugaaagggugauuuggcuu

SEQ ID NO: 762975 - RNA, 22 nt, Human
ugauauuuuucacuggccucug

SEQ ID NO: 762976 - RNA, 22 nt, Human
ugguccugggcacaguauaugc

SEQ ID NO: 762977 - RNA, 22 nt, Human
agcaggugcguuacuucacucu

SEQ ID NO: 762978 - RNA, 22 nt, Human
ugcuggcuccucgaggcuucgu

SEQ ID NO: 762979 - RNA, 22 nt, Human
ggaaaagaaagggacugauugg

SEQ ID NO: 762980 - RNA, 22 nt, Human
cuuucaugcaguugacaaggug

SEQ ID NO: 762981 - RNA, 22 nt, Human
ugcuuaaauuucagcagcuuaa

SEQ ID NO: 762982 - RNA, 21 nt, Human
acaguacuugagaucuuuuga

SEQ ID NO: 762983 - RNA, 22 nt, Human
gccucgaggcugagaaggcaca

SEQ ID NO: 762984 - RNA, 22 nt, Human
aaagguaucauguccauacagu

SEQ ID NO: 762985 - RNA, 22 nt, Human
cagagccaggccugcccucuuu

SEQ ID NO: 762986 - RNA, 22 nt, Human
cugcagcugcaguucugagaga

SEQ ID NO: 762987 - RNA, 22 nt, Human
gaauacaagccaggcacaaggc

SEQ ID NO: 762988 - RNA, 22 nt, Human
aacugauaauggacacauaaaa

SEQ ID NO: 762989 - RNA, 21 nt, Human
cucugaauccugcuucucagu

SEQ ID NO: 762990 - RNA, 22 nt, Human
uguucuucuagauugccuuuua

SEQ ID NO: 762991 - RNA, 20 nt, Human
aacaaucuagaagcuauucu

SEQ ID NO: 762992 - RNA, 22 nt, Human
agcagacucuucuccuggggcu

SEQ ID NO: 762993 - RNA, 20 nt, Human
agcugguuaucuuaauucuu

SEQ ID NO: 762994 - RNA, 22 nt, Human
gccugcccacggggcuggcaua

SEQ ID NO: 762995 - RNA, 22 nt, Human
ggaaggaagugcagacuuuaaa

SEQ ID NO: 762996 - RNA, 22 nt, Human
ugaagugggggaacgagaguuc

SEQ ID NO: 762997 - RNA, 22 nt, Human
ucaaucaaagccagauguccuu

SEQ ID NO: 762998 - RNA, 22 nt, Human
ccauggcuuacagauggagcau

SEQ ID NO: 762999 - RNA, 22 nt, Human
accugcagguguuuccacacuu

SEQ ID NO: 763000 - RNA, 22 nt, Human
auagugugugguauagguagag

SEQ ID NO: 763001 - RNA, 22 nt, Human
acucagcugaugaagcacaagu

SEQ ID NO: 763002 - RNA, 19 nt, Human
cugcucuccuugacuugga

SEQ ID NO: 763003 - RNA, 22 nt, Human
aucuuucaaucaggaaaaaucu

SEQ ID NO: 763004 - RNA, 22 nt, Human
cagggauggccuggcgggccac

SEQ ID NO: 763005 - RNA, 21 nt, Human
gagugcagcaagguagagucu

SEQ ID NO: 763006 - RNA, 22 nt, Human
ugacaguguuugcacuucaggu

SEQ ID NO: 763007 - RNA, 20 nt, Human
ugcagcugcaggaggguggg

SEQ ID NO: 763008 - RNA, 22 nt, Human
uggcuggcuguccagcugggca

SEQ ID NO: 763009 - RNA, 22 nt, Human
uucuuugguguuacccagcuca

SEQ ID NO: 763010 - RNA, 22 nt, Human
cccaaggaagacgcuugugaua

SEQ ID NO: 763011 - RNA, 22 nt, Human
caucagaagauggcucuggaaa

SEQ ID NO: 763012 - RNA, 20 nt, Human
uagagagaggauauuaaagu

SEQ ID NO: 763013 - RNA, 22 nt, Human
cuucacaggcaagucuguuuuu

SEQ ID NO: 763014 - RNA, 22 nt, Human
gaggcugagaguuuguucuacu

SEQ ID NO: 763015 - RNA, 22 nt, Human
gcuaggaagaagggugcuugaa

SEQ ID NO: 763016 - RNA, 22 nt, Human
acacauguuuacagucuucagu

SEQ ID NO: 763017 - RNA, 22 nt, Human
ugcccaaguguuuggcugaguc

SEQ ID NO: 763018 - RNA, 22 nt, Human
cugccacuagcuuucacaucuu

SEQ ID NO: 763019 - RNA, 22 nt, Human
ucuguugcauaugcugcugggu

SEQ ID NO: 763020 - RNA, 22 nt, Human
cucaagucugaguacuggcucu

SEQ ID NO: 763021 - RNA, 22 nt, Human
auguacaguggaaacuaacaaa

SEQ ID NO: 763022 - RNA, 22 nt, Human
ugcuccaggugugccucucaug

SEQ ID NO: 763023 - RNA, 22 nt, Human
uuauuguuuggguauaauuuga

SEQ ID NO: 763024 - RNA, 22 nt, Human
cucugcuucauccaccacuggc

SEQ ID NO: 763025 - RNA, 22 nt, Human
aggagccugugccuggcacucc

SEQ ID NO: 763026 - RNA, 22 nt, Human
ccugggcucacagccaaggcuc

SEQ ID NO: 763027 - RNA, 21 nt, Human
agaaaaguauuugaaucaaga

SEQ ID NO: 763028 - RNA, 22 nt, Human
agcuauugugugcccagcagga

SEQ ID NO: 763029 - RNA, 22 nt, Human
gggagcugaaguagggguaaau

SEQ ID NO: 763030 - RNA, 19 nt, Human
augacagaguugauaagug

SEQ ID NO: 763031 - RNA, 22 nt, Human
agagcagcugacagccugccau

SEQ ID NO: 763032 - RNA, 22 nt, Human
ucucagaauccuugcccaggug

SEQ ID NO: 763033 - RNA, 22 nt, Human
uaucuauaauguuuuacuuccu

SEQ ID NO: 763034 - RNA, 22 nt, Human
cagagccugccucuggcugugg

SEQ ID NO: 763035 - RNA, 22 nt, Human
uucaguuucaaauccugugaag

SEQ ID NO: 763036 - RNA, 22 nt, Human
gguaacugaggccauauucuga

SEQ ID NO: 763037 - RNA, 22 nt, Human
ccugagccucuugcacgcucag

SEQ ID NO: 763038 - RNA, 22 nt, Human
cauuacaaaguuauaaacaguu

SEQ ID NO: 763039 - RNA, 22 nt, Human
augauucucauuuuauaaacuu

SEQ ID NO: 763040 - RNA, 22 nt, Human
cagcuucccuuggcugagcaga

SEQ ID NO: 763041 - RNA, 22 nt, Human
gagcugagucugcagucgccau

SEQ ID NO: 763042 - RNA, 22 nt, Human
ccugcuguaaugugucuuuauu

SEQ ID NO: 763043 - RNA, 22 nt, Human
guaacagaggguuugcagauau

SEQ ID NO: 763044 - RNA, 21 nt, Human
ccacucaugacuccacucacc

SEQ ID NO: 763045 - RNA, 22 nt, Human
gggggccuuguuaguggaugga

SEQ ID NO: 763046 - RNA, 20 nt, Human
uccaggaaugguagaggacu

SEQ ID NO: 763047 - RNA, 22 nt, Human
acuagcagggauauuauauaag

SEQ ID NO: 763048 - RNA, 22 nt, Human
ggggcugcucccaccccugagg

SEQ ID NO: 763049 - RNA, 22 nt, Human
auaauacaugguugaucuuuuc

SEQ ID NO: 763050 - RNA, 22 nt, Human
gcaguguuggcaggauggggcu

SEQ ID NO: 763051 - RNA, 22 nt, Human
uuggaaggagucuuuggggaug

SEQ ID NO: 763052 - RNA, 22 nt, Human
cugucccucucacaccucacca

SEQ ID NO: 763053 - RNA, 22 nt, Human
gugcuuccuagguaaguaggua

SEQ ID NO: 763054 - RNA, 22 nt, Human
gccucaguguccuccuccaugu

SEQ ID NO: 763055 - RNA, 22 nt, Human
ucaguguuucaguuuggaaaug

SEQ ID NO: 763056 - RNA, 21 nt, Human
cucuguguugaggguguugag

SEQ ID NO: 763057 - RNA, 22 nt, Human
ucagauacuagcucucagccuc

SEQ ID NO: 763058 - RNA, 22 nt, Human
accagaguuuuauuaguucuaa

SEQ ID NO: 763059 - RNA, 22 nt, Human
aaugauccuuguuguuuaacca

SEQ ID NO: 763060 - RNA, 22 nt, Human
uacaaagugagcaaccucuuuu

SEQ ID NO: 763061 - RNA, 23 nt, Human
aaauaggaguaucuggaucauga

SEQ ID NO: 763062 - RNA, 22 nt, Human
ugcagccuuggcaaccagggac

SEQ ID NO: 763063 - RNA, 22 nt, Human
augcuuuauuggagacagucau

SEQ ID NO: 763064 - RNA, 22 nt, Human
uggcuggagucuggugcuagcc

SEQ ID NO: 763065 - RNA, 22 nt, Human
uaggaagaucaaguuuaucuca

SEQ ID NO: 763066 - RNA, 22 nt, Human
acauguuuaaguuuaaugaaaa

SEQ ID NO: 763067 - RNA, 22 nt, Human
gcacccagccagcaucucagag

SEQ ID NO: 763068 - RNA, 22 nt, Human
uggcuugucauguaucugaggc

SEQ ID NO: 763069 - RNA, 22 nt, Human
gggaagagggagcuggaaugau

SEQ ID NO: 763070 - RNA, 22 nt, Human
auuuuucucuuuccacugagau

SEQ ID NO: 763071 - RNA, 22 nt, Human
cacaguguggcaaauuucaacu

SEQ ID NO: 763072 - RNA, 22 nt, Human
gcugagagaucaaggcaggauu

SEQ ID NO: 763073 - RNA, 23 nt, Human
uggaagaaaaugguuuggcugug

SEQ ID NO: 763074 - RNA, 21 nt, Human
ugauccuuucccccauguugc

SEQ ID NO: 763075 - RNA, 22 nt, Human
gugauuucaaauauagagugag

SEQ ID NO: 763076 - RNA, 20 nt, Human
uguguagcaggugcugugcc

SEQ ID NO: 763077 - RNA, 22 nt, Human
cugagggcaugaacauuccaua

SEQ ID NO: 763078 - RNA, 22 nt, Human
cagugcccaagaugugccaugc

SEQ ID NO: 763079 - RNA, 22 nt, Human
agauccacucgaauccaggaau

SEQ ID NO: 763080 - RNA, 22 nt, Human
uuuagacauggcuugcucacuu

SEQ ID NO: 763081 - RNA, 22 nt, Human
cacaugagacaauuaaagacuu

SEQ ID NO: 763082 - RNA, 22 nt, Human
gaaccacaagauucaaaggggu

SEQ ID NO: 763083 - RNA, 20 nt, Human
agggaggugcugggccugag

SEQ ID NO: 763084 - RNA, 22 nt, Human
cucccagauuccugcuguggga

SEQ ID NO: 763085 - RNA, 22 nt, Human
ucuuucuucagcccuguaagau

SEQ ID NO: 763086 - RNA, 22 nt, Human
uccuugaauugugccacuuacc

SEQ ID NO: 763087 - RNA, 21 nt, Human
uccuccuccacuaggcuagcc

SEQ ID NO: 763088 - RNA, 20 nt, Human
ucucuggguucucacucagc

SEQ ID NO: 763089 - RNA, 22 nt, Human
ugcuggaauugaccuagaagga

SEQ ID NO: 763090 - RNA, 22 nt, Human
ccagcuccauugcuuaguguaa

SEQ ID NO: 763091 - RNA, 22 nt, Human
aggccacaguugaggccagcaa

SEQ ID NO: 763092 - RNA, 22 nt, Human
aggccucaguucuugccaggug

SEQ ID NO: 763093 - RNA, 22 nt, Human
cagcuauuggcaagaaguggug

SEQ ID NO: 763094 - RNA, 22 nt, Human
gagggcugauaaaugcgcaugg

SEQ ID NO: 763095 - RNA, 22 nt, Human
ucaggauguccaaaauccagcc

SEQ ID NO: 763096 - RNA, 22 nt, Human
aaguuaugaaauuuggacagcu

SEQ ID NO: 763097 - RNA, 22 nt, Human
auguaugaagcuuuguuuggga

SEQ ID NO: 763098 - RNA, 18 nt, Human
auguguggcuuggggucc

SEQ ID NO: 763099 - RNA, 20 nt, Human
uugcauuggaugugcaggug

SEQ ID NO: 763100 - RNA, 22 nt, Human
aacaguacuggacaaggaguca

SEQ ID NO: 763101 - RNA, 22 nt, Human
auuauuaaaauguguuucucuu

SEQ ID NO: 763102 - RNA, 22 nt, Human
cauugucucuugucauuuagua

SEQ ID NO: 763103 - RNA, 22 nt, Human
acaccuuugugaagugaugaug

SEQ ID NO: 763104 - RNA, 22 nt, Human
ugcuggagaugaaagggcccug

SEQ ID NO: 763105 - RNA, 22 nt, Human
aaauccaucaaaucuucuagaa

SEQ ID NO: 763106 - RNA, 22 nt, Human
uuagaaucagaagagagguauu

SEQ ID NO: 763107 - RNA, 22 nt, Human
auaucuuuguaugguucagcag

SEQ ID NO: 763108 - RNA, 22 nt, Human
gucagcaggguccccuugagug

SEQ ID NO: 763109 - RNA, 22 nt, Human
uaggccacagagaggagauuuc

SEQ ID NO: 763110 - RNA, 22 nt, Human
agagaguugaggaagcaacacu

SEQ ID NO: 763111 - RNA, 22 nt, Human
uacaaguacuguggcuuugaau

SEQ ID NO: 763112 - RNA, 22 nt, Human
uacagauauguaugcacuuuuu

SEQ ID NO: 763113 - RNA, 22 nt, Human
uguguucaucaugauaucaggu

SEQ ID NO: 763114 - RNA, 22 nt, Human
augugagggcucaggcugacug

SEQ ID NO: 763115 - RNA, 22 nt, Human
gcagggcugggacuuacuggua

SEQ ID NO: 763116 - RNA, 21 nt, Human
cacuugaaugguguuuuacaa

SEQ ID NO: 763117 - RNA, 22 nt, Human
cauggccacauuggaccgaagc

SEQ ID NO: 763118 - RNA, 22 nt, Human
uguggguguucucacuuagaua

SEQ ID NO: 763119 - RNA, 22 nt, Human
uggacucagaguugguggcagu

SEQ ID NO: 763120 - RNA, 22 nt, Human
uagugcuugagucucuccguac

SEQ ID NO: 763121 - RNA, 23 nt, Human
ccuucagaagaaguaacaggggc

SEQ ID NO: 763122 - RNA, 22 nt, Human
gacagagugcagggcuagaaga

SEQ ID NO: 763123 - RNA, 22 nt, Human
acaggccacaguggagucucug

SEQ ID NO: 763124 - RNA, 22 nt, Human
uagaggagaacacaaauuauag

SEQ ID NO: 763125 - RNA, 19 nt, Human
cacagaugauugacacaua

SEQ ID NO: 763126 - RNA, 22 nt, Human
aggaaacuucagaguuuugguc

SEQ ID NO: 763127 - RNA, 22 nt, Human
gcaggagccaggccgagcuggu

SEQ ID NO: 763128 - RNA, 22 nt, Human
aaucacauuagugaaacacuga

SEQ ID NO: 763129 - RNA, 22 nt, Human
uggaggcccccaggcaacagca

SEQ ID NO: 763130 - RNA, 23 nt, Human
uuauuuugucagaagggacuuuu

SEQ ID NO: 763131 - RNA, 22 nt, Human
uguccugggucccugcuagaag

SEQ ID NO: 763132 - RNA, 22 nt, Human
aagaauugguuuccucugucau

SEQ ID NO: 763133 - RNA, 22 nt, Human
aagauggagcacgagcagaagc

SEQ ID NO: 763134 - RNA, 22 nt, Human
agcuauagcuggaucuuaagug

SEQ ID NO: 763135 - RNA, 22 nt, Human
uucagugcuaaaaagucucaag

SEQ ID NO: 763136 - RNA, 21 nt, Human
caucacauuacucaaaguccu

SEQ ID NO: 763137 - RNA, 22 nt, Human
cuuuucacaggaggauaagccc

SEQ ID NO: 763138 - RNA, 22 nt, Human
cuggcagaguugggucucaaau

SEQ ID NO: 763139 - RNA, 22 nt, Human
ucaguacaaaggugcucucaag

SEQ ID NO: 763140 - RNA, 21 nt, Human
ucauccauggcuuuugugcuu

SEQ ID NO: 763141 - RNA, 22 nt, Human
acaugcacccaguuacacucuc

SEQ ID NO: 763142 - RNA, 22 nt, Human
ggcacagagaggcccuggaagg

SEQ ID NO: 763143 - RNA, 23 nt, Human
uuacagaaaguaugcuuuuguuu

SEQ ID NO: 763144 - RNA, 22 nt, Human
aaagccuugcccgucacuggga

SEQ ID NO: 763145 - RNA, 21 nt, Human
uaaauaauaaguugcugagau

SEQ ID NO: 763146 - RNA, 22 nt, Human
ccaggccagccuggagcauggc

SEQ ID NO: 763147 - RNA, 22 nt, Human
ggacaaaggguggagccucuga

SEQ ID NO: 763148 - RNA, 22 nt, Human
aucgcuuuacagccugcuuccu

SEQ ID NO: 763149 - RNA, 22 nt, Human
agucuauuuccccuucucuuga

SEQ ID NO: 763150 - RNA, 22 nt, Human
agcaagcagaauucuguccucu

SEQ ID NO: 763151 - RNA, 21 nt, Human
ugcuggccucaagggugacuu

SEQ ID NO: 763152 - RNA, 22 nt, Human
uugcugcuuucauuuauacagu

SEQ ID NO: 763153 - RNA, 22 nt, Human
gaagagcuauguccagggagca

SEQ ID NO: 763154 - RNA, 22 nt, Human
ggugcaugugagaaagacuggg

SEQ ID NO: 763155 - RNA, 22 nt, Human
aaaggauggcucugcauauuug

SEQ ID NO: 763156 - RNA, 22 nt, Human
cuguagccagaagcagaaggcc

SEQ ID NO: 763157 - RNA, 18 nt, Human
uguacaguuaugagcauu

SEQ ID NO: 763158 - RNA, 20 nt, Human
uucuaauuugauggaguagc

SEQ ID NO: 763159 - RNA, 22 nt, Human
ugagaauucuacaauagaucaa

SEQ ID NO: 763160 - RNA, 22 nt, Human
ucacagacacuggguuauugca

SEQ ID NO: 763161 - RNA, 22 nt, Human
ggaggcccagagaggugaagug

SEQ ID NO: 763162 - RNA, 22 nt, Human
agaguggagagaaacaacucug

SEQ ID NO: 763163 - RNA, 22 nt, Human
ugcagaaagcauugacucuucc

SEQ ID NO: 763164 - RNA, 22 nt, Human
guacaaauugauacagguuuuc

SEQ ID NO: 763165 - RNA, 22 nt, Human
caggcugcagcagcaguggccc

SEQ ID NO: 763166 - RNA, 22 nt, Human
ggcucugccgugugcucacaug

SEQ ID NO: 763167 - RNA, 22 nt, Human
uccagccacguauuaucucacu

SEQ ID NO: 763168 - RNA, 22 nt, Human
acagagauguggaugagggauu

SEQ ID NO: 763169 - RNA, 22 nt, Human
cacagcaagagcuaaaugacca

SEQ ID NO: 763170 - RNA, 22 nt, Human
agaggcacuguucuuagcgacu

SEQ ID NO: 763171 - RNA, 22 nt, Human
uccagcauuuuucaauagaauu

SEQ ID NO: 763172 - RNA, 22 nt, Human
cagcagagcuuauguuggguca

SEQ ID NO: 763173 - RNA, 20 nt, Human
guauuacaggcuuagaacca

SEQ ID NO: 763174 - RNA, 22 nt, Human
uaccagccucuguugggggugg

SEQ ID NO: 763175 - RNA, 22 nt, Human
ucaaagacauggggaagcugag

SEQ ID NO: 763176 - RNA, 22 nt, Human
auaugugugugugagaaaagcu

SEQ ID NO: 763177 - RNA, 22 nt, Human
cugucuguacaaauguggggcc

SEQ ID NO: 763178 - RNA, 22 nt, Human
guggcccaggcacccugaugac

SEQ ID NO: 763179 - RNA, 22 nt, Human
uuucucuuucaaucugcaguac

SEQ ID NO: 763180 - RNA, 22 nt, Human
uagacagaauccagcccacgcc

SEQ ID NO: 763181 - RNA, 22 nt, Human
auguguauugagcaccuacugc

SEQ ID NO: 763182 - RNA, 22 nt, Human
uauguacacacacaugcaugua

SEQ ID NO: 763183 - RNA, 22 nt, Human
cuggggagaagcgacucggcug

SEQ ID NO: 763184 - RNA, 23 nt, Human
agguucucuuaucaucucugccc

SEQ ID NO: 763185 - RNA, 22 nt, Human
aaaaguuaccucuguaauauaa

SEQ ID NO: 763186 - RNA, 22 nt, Human
ugucauuuucagcuuaugcuuc

SEQ ID NO: 763187 - RNA, 22 nt, Human
agcugcuaugacaacaccagcc

SEQ ID NO: 763188 - RNA, 22 nt, Human
ggaggcagaauagagugugggu

SEQ ID NO: 763189 - RNA, 22 nt, Human
gagucuggugauggucauuguc

SEQ ID NO: 763190 - RNA, 22 nt, Human
aagagcuucccuguuguagagg

SEQ ID NO: 763191 - RNA, 17 nt, Human
aagagguaacuguacua

SEQ ID NO: 763192 - RNA, 22 nt, Human
gcacugggaaugugagcagcug

SEQ ID NO: 763193 - RNA, 23 nt, Human
uguuuguuucuaugagagauagc

SEQ ID NO: 763194 - RNA, 22 nt, Human
cagcugaguaugcauucaagca

SEQ ID NO: 763195 - RNA, 22 nt, Human
aagcuggacacugacccacugu

SEQ ID NO: 763196 - RNA, 22 nt, Human
cagcccuguugcgcuuccggcg

SEQ ID NO: 763197 - RNA, 22 nt, Human
uuccuaacgccaguauuuucau

SEQ ID NO: 763198 - RNA, 22 nt, Human
guggauggcccugcacacaggu

SEQ ID NO: 763199 - RNA, 22 nt, Human
uuauuuaaaauguagguuggga

SEQ ID NO: 763200 - RNA, 22 nt, Human
uuugagaacuuugguauuuucc

SEQ ID NO: 763201 - RNA, 22 nt, Human
uuuagcauauccuauaaaacua

SEQ ID NO: 763202 - RNA, 22 nt, Human
gaauuuaagaggaugaaucugu

SEQ ID NO: 763203 - RNA, 22 nt, Human
uuguauuuuguuaugcuacugc

SEQ ID NO: 763204 - RNA, 22 nt, Human
gaccauuuuuacagagcauuca

SEQ ID NO: 763205 - RNA, 22 nt, Human
uuguacauucugaaucuguccu

SEQ ID NO: 763206 - RNA, 22 nt, Human
cugugagggccagagucagggc

SEQ ID NO: 763207 - RNA, 22 nt, Human
uucucuggcgcgcugugcuaug

SEQ ID NO: 763208 - RNA, 22 nt, Human
ccuggcaguucaucaaauggca

SEQ ID NO: 763209 - RNA, 22 nt, Human
cuccucccacggucucaggaag

SEQ ID NO: 763210 - RNA, 22 nt, Human
auguguagaacuguaaugccca

SEQ ID NO: 763211 - RNA, 21 nt, Human
uccccacauuucuaaacagac

SEQ ID NO: 763212 - RNA, 22 nt, Human
uucucugcagcuuaggcccagu

SEQ ID NO: 763213 - RNA, 22 nt, Human
cuggaugcuuccucucugcuag

SEQ ID NO: 763214 - RNA, 22 nt, Human
aagguacaguuuuaagaauaag

SEQ ID NO: 763215 - RNA, 22 nt, Human
acccaggacaaaauaaccaggu

SEQ ID NO: 763216 - RNA, 22 nt, Human
acuuaguauuuuucagcuuuga

SEQ ID NO: 763217 - RNA, 22 nt, Human
uacagcuuuauacccaucaaaa

SEQ ID NO: 763218 - RNA, 22 nt, Human
cagcccugcagcuggaucucac

SEQ ID NO: 763219 - RNA, 22 nt, Human
aggucugacuucaagccugugg

SEQ ID NO: 763220 - RNA, 22 nt, Human
aagaguuuaccagugcugcuuc

SEQ ID NO: 763221 - RNA, 22 nt, Human
ucuggaguccagauccauuugg

SEQ ID NO: 763222 - RNA, 18 nt, Human
aggucaggaaagcagagu

SEQ ID NO: 763223 - RNA, 22 nt, Human
ugaguggguuaucaggaaaggu

SEQ ID NO: 763224 - RNA, 20 nt, Human
aggcucaggguguuuaggaa

SEQ ID NO: 763225 - RNA, 22 nt, Human
ucccuguaguucguggucuuug

SEQ ID NO: 763226 - RNA, 22 nt, Human
caggcagcuagauuuauaacaa

SEQ ID NO: 763227 - RNA, 19 nt, Human
ucccucccuguaaucucac

SEQ ID NO: 763228 - RNA, 22 nt, Human
agugucugcggcggggaggcgg

SEQ ID NO: 763229 - RNA, 22 nt, Human
agagcaggggcaauguguugca

SEQ ID NO: 763230 - RNA, 22 nt, Human
gcugguuagaaaacagagcuca

SEQ ID NO: 763231 - RNA, 22 nt, Human
agcugugugccaggggagaugu

SEQ ID NO: 763232 - RNA, 22 nt, Human
cccccaaggccaggcugagacc

SEQ ID NO: 763233 - RNA, 22 nt, Human
uaaucacaucaggguaaauggg

SEQ ID NO: 763234 - RNA, 21 nt, Human
uuagaguugccauuauaugua

SEQ ID NO: 763235 - RNA, 22 nt, Human
cugggcuagaaggaccaggaug

SEQ ID NO: 763236 - RNA, 22 nt, Human
aaugucauuuaaaauaauucug

SEQ ID NO: 763237 - RNA, 22 nt, Human
acccugggugagaggcaaacag

SEQ ID NO: 763238 - RNA, 22 nt, Human
uaguauuuauaaucaugcuuaa

SEQ ID NO: 763239 - RNA, 22 nt, Human
gcuccuggcuucacugacauca

SEQ ID NO: 763240 - RNA, 22 nt, Human
auuuaagggauuuggagaccaa

SEQ ID NO: 763241 - RNA, 22 nt, Human
uguucucuuuuccugcugagcc

SEQ ID NO: 763242 - RNA, 22 nt, Human
ccuagaugggauggcggccggg

SEQ ID NO: 763243 - RNA, 22 nt, Human
ccucaguguuaggauaagagaa

SEQ ID NO: 763244 - RNA, 20 nt, Human
gcccaggaauuugcauuucu

SEQ ID NO: 763245 - RNA, 22 nt, Human
ucucugggacacugggucaguu

SEQ ID NO: 763246 - RNA, 20 nt, Human
accaggagauggaggcaggg

SEQ ID NO: 763247 - RNA, 22 nt, Human
agucacaugaggaaggggaagg

SEQ ID NO: 763248 - RNA, 22 nt, Human
agggcagaaguacagacacuua

SEQ ID NO: 763249 - RNA, 22 nt, Human
uagacauuagguagguucaugg

SEQ ID NO: 763250 - RNA, 22 nt, Human
cagcuuccauaagagauggaga

SEQ ID NO: 763251 - RNA, 17 nt, Human
gacaucaguacuuacag

SEQ ID NO: 763252 - RNA, 22 nt, Human
aaaagcaaguugccuagguuga

SEQ ID NO: 763253 - RNA, 22 nt, Human
agugggugggugucugacaguu

SEQ ID NO: 763254 - RNA, 22 nt, Human
auauacuuggagacuaucauug

SEQ ID NO: 763255 - RNA, 22 nt, Human
uagaaaccaucucacugcucag

SEQ ID NO: 763256 - RNA, 22 nt, Human
ccagggccaguaagauuggcau

SEQ ID NO: 763257 - RNA, 22 nt, Human
uggcucagugaagagauaacuu

SEQ ID NO: 763258 - RNA, 22 nt, Human
augaggcagagggcugugccag

SEQ ID NO: 763259 - RNA, 22 nt, Human
aauaaacuuccacuguguuuuu

SEQ ID NO: 763260 - RNA, 22 nt, Human
gaguuuaaagcauacauauuuu

SEQ ID NO: 763261 - RNA, 22 nt, Human
cugggccacaucagaugaagac

SEQ ID NO: 763262 - RNA, 22 nt, Human
gacagacaugggacuucauacu

SEQ ID NO: 763263 - RNA, 22 nt, Human
ccaggagcgggaaaaggaagaa

SEQ ID NO: 763264 - RNA, 22 nt, Human
uugcagggaccugcagaaagcu

SEQ ID NO: 763265 - RNA, 22 nt, Human
uugauuugauugaugaacuaag

SEQ ID NO: 763266 - RNA, 22 nt, Human
cuggcccuguggaggcaggaac

SEQ ID NO: 763267 - RNA, 22 nt, Human
gcuuugcauuguuuaaucagga

SEQ ID NO: 763268 - RNA, 22 nt, Human
agcagccagugggagugauaca

SEQ ID NO: 763269 - RNA, 22 nt, Human
cccugagcccauaguugacauu

SEQ ID NO: 763270 - RNA, 22 nt, Human
cucagggaugggcagauguuaa

SEQ ID NO: 763271 - RNA, 20 nt, Human
gccagcccugacacaggagc

SEQ ID NO: 763272 - RNA, 22 nt, Human
uauucaugagauaggcaguuuu

SEQ ID NO: 763273 - RNA, 22 nt, Human
aggagcccugcgggaggcagag

SEQ ID NO: 763274 - RNA, 22 nt, Human
ugcuuuaaaccauggaugugag

SEQ ID NO: 763275 - RNA, 22 nt, Human
ugaggccugcuuggaauugaau

SEQ ID NO: 763276 - RNA, 22 nt, Human
agucuuaacuaugcaaguacua

SEQ ID NO: 763277 - RNA, 22 nt, Human
gaguuauucuagguccuuugua

SEQ ID NO: 763278 - RNA, 22 nt, Human
augcaggggccgccuggccagg

SEQ ID NO: 763279 - RNA, 21 nt, Human
uuccucugcaacugaugcuca

SEQ ID NO: 763280 - RNA, 22 nt, Human
acaaugucuuugucuccuucag

SEQ ID NO: 763281 - RNA, 22 nt, Human
cuggguccccucagugacacug

SEQ ID NO: 763282 - RNA, 22 nt, Human
cuccuucagcugaaucccugcu

SEQ ID NO: 763283 - RNA, 22 nt, Human
ugcguguguguauauacacagg

SEQ ID NO: 763284 - RNA, 22 nt, Human
gaguugaagaaauaguuuugau

SEQ ID NO: 763285 - RNA, 22 nt, Human
uaaggcagguaugguaccaggc

SEQ ID NO: 763286 - RNA, 22 nt, Human
acaggacuguggaaggaucucu

SEQ ID NO: 763287 - RNA, 22 nt, Human
aaugcaaagcaagcagagauuu

SEQ ID NO: 763288 - RNA, 22 nt, Human
uguaugcuuuccuucuuucugg

SEQ ID NO: 763289 - RNA, 22 nt, Human
ugaagccagggacugacacuuc

SEQ ID NO: 763290 - RNA, 22 nt, Human
uacaaauggguuaaaauauagu

SEQ ID NO: 763291 - RNA, 22 nt, Human
gcuggagccaagcugcucuugg

SEQ ID NO: 763292 - RNA, 18 nt, Human
gaagggagcuggaaugca

SEQ ID NO: 763293 - RNA, 22 nt, Human
ccagggcauguccaagacuuag

SEQ ID NO: 763294 - RNA, 22 nt, Human
gagaggcauggaacagauucuu

SEQ ID NO: 763295 - RNA, 22 nt, Human
auguuuuaaauauguguguaaa

SEQ ID NO: 763296 - RNA, 22 nt, Human
aagcacaggaucuugaggagcg

SEQ ID NO: 763297 - RNA, 22 nt, Human
auguggcucacauagcuggaaa

SEQ ID NO: 763298 - RNA, 19 nt, Human
ccugggucugcagcauuca

SEQ ID NO: 763299 - RNA, 22 nt, Human
uggaagggagugacagucagag

SEQ ID NO: 763300 - RNA, 22 nt, Human
ucaugaacuuccuagccagacu

SEQ ID NO: 763301 - RNA, 22 nt, Human
cuguuucaugucuuccgcagcu

SEQ ID NO: 763302 - RNA, 22 nt, Human
gcagacacuugaggugggcuuu

SEQ ID NO: 763303 - RNA, 22 nt, Human
auuagcaauugugcaucuagua

SEQ ID NO: 763304 - RNA, 22 nt, Human
uacaguuuacaugagaggaagc

SEQ ID NO: 763305 - RNA, 22 nt, Human
accagcaagauuuugcuuugca

SEQ ID NO: 763306 - RNA, 22 nt, Human
aguggcaggaaaguggaagaga

SEQ ID NO: 763307 - RNA, 22 nt, Human
aacuacauagaaauuaguauuu

SEQ ID NO: 763308 - RNA, 22 nt, Human
auacagaauacuaauuccugag

SEQ ID NO: 763309 - RNA, 22 nt, Human
ucaguguucgcucagggacucc

SEQ ID NO: 763310 - RNA, 22 nt, Human
cguaugaaauuuuugacauuug

SEQ ID NO: 763311 - RNA, 22 nt, Human
ucaaaguccuugcuuuuucugu

SEQ ID NO: 763312 - RNA, 22 nt, Human
gagccccuucugcagucagguu

SEQ ID NO: 763313 - RNA, 22 nt, Human
uacauauccaggcugagaagau

SEQ ID NO: 763314 - RNA, 22 nt, Human
uuagauuuauaugugagaaugg

SEQ ID NO: 763315 - RNA, 22 nt, Human
aggccagggcacugcucuuuag

SEQ ID NO: 763316 - RNA, 22 nt, Human
uuuucagugggcaaugauguga

SEQ ID NO: 763317 - RNA, 17 nt, Human
agcaacuucucccacag

SEQ ID NO: 763318 - RNA, 22 nt, Human
uuuucucuuguuaauguacuga

SEQ ID NO: 763319 - RNA, 22 nt, Human
gacuggcucuaucuccuuggcg

SEQ ID NO: 763320 - RNA, 22 nt, Human
cccaggcuaguaugauaucagu

SEQ ID NO: 763321 - RNA, 17 nt, Human
ccuuucuucccagaggg

SEQ ID NO: 763322 - RNA, 17 nt, Human
gcucagaguacacgugu

SEQ ID NO: 763323 - RNA, 22 nt, Human
aucaauucuuaggaaaauagcu

SEQ ID NO: 763324 - RNA, 22 nt, Human
agccagcucccuccccugcagg

SEQ ID NO: 763325 - RNA, 23 nt, Human
aggaagagagagugccucuuucu

SEQ ID NO: 763326 - RNA, 23 nt, Human
ggacagggcccugcccuauggcc

SEQ ID NO: 763327 - RNA, 22 nt, Human
aaaucacagggucucuaaguau

SEQ ID NO: 763328 - RNA, 22 nt, Human
cuucuucauaggcaguccuguu

SEQ ID NO: 763329 - RNA, 22 nt, Human
aauugaacaaguaauagaagag

SEQ ID NO: 763330 - RNA, 22 nt, Human
caggcacacccacuggugcaga

SEQ ID NO: 763331 - RNA, 17 nt, Human
ucaggauccaggguucu

SEQ ID NO: 763332 - RNA, 22 nt, Human
uguugccuggggaagcucugau

SEQ ID NO: 763333 - RNA, 23 nt, Human
agcagcccaauggcaagcucugg

SEQ ID NO: 763334 - RNA, 17 nt, Human
acagucugccugacagu

SEQ ID NO: 763335 - RNA, 22 nt, Human
aucuguguaugugaccuuaucu

SEQ ID NO: 763336 - RNA, 22 nt, Human
aaggaagcagcaaugcaugauu

SEQ ID NO: 763337 - RNA, 22 nt, Human
uuugugaacacugcgcagaacu

SEQ ID NO: 763338 - RNA, 22 nt, Human
ugccucuguugagccuuggcug

SEQ ID NO: 763339 - RNA, 22 nt, Human
gaagacauguggauucuaguuu

SEQ ID NO: 763340 - RNA, 22 nt, Human
uucacauuugaaaggaaagaua

SEQ ID NO: 763341 - RNA, 22 nt, Human
uagguucagcuuccacugccua

SEQ ID NO: 763342 - RNA, 22 nt, Human
gucaggauguuuauucuccagu

SEQ ID NO: 763343 - RNA, 22 nt, Human
aggagaggucucccuuccccag

SEQ ID NO: 763344 - RNA, 22 nt, Human
gacuggaaagccuguccucaga

SEQ ID NO: 763345 - RNA, 22 nt, Human
caguuaaucuugccauuauauc

SEQ ID NO: 763346 - RNA, 22 nt, Human
cagagucaguauugaauugaaa

SEQ ID NO: 763347 - RNA, 22 nt, Human
ucauaaugaccccagaguccgc

SEQ ID NO: 763348 - RNA, 22 nt, Human
gggaagggcuccuuuuauugca

SEQ ID NO: 763349 - RNA, 22 nt, Human
uuugacaccaggagagaaaaca

SEQ ID NO: 763350 - RNA, 22 nt, Human
acacaugaaauaauauuaugca

SEQ ID NO: 763351 - RNA, 19 nt, Human
aaggcagaaguuggauaug

SEQ ID NO: 763352 - RNA, 22 nt, Human
gccugugaugcccccauaagua

SEQ ID NO: 763353 - RNA, 22 nt, Human
agagucauaguuuaacuuuugu

SEQ ID NO: 763354 - RNA, 22 nt, Human
uugcuuuguuacugcaguuucc

SEQ ID NO: 763355 - RNA, 22 nt, Human
augagugugaaguuagcucagu

SEQ ID NO: 763356 - RNA, 22 nt, Human
uaacaguaaaguaaguuagcuu

SEQ ID NO: 763357 - RNA, 22 nt, Human
uucauugucucuguuugccuuc

SEQ ID NO: 763358 - RNA, 22 nt, Human
ugacuuuaagcuaucugauucu

SEQ ID NO: 763359 - RNA, 21 nt, Human
ggagucuguggaugcuguuuc

SEQ ID NO: 763360 - RNA, 22 nt, Human
acagccaggacuuggcccucuu

SEQ ID NO: 763361 - RNA, 22 nt, Human
ucaugcccagagcaguaaauua

SEQ ID NO: 763362 - RNA, 22 nt, Human
agcaccugucacaagcagaagg

SEQ ID NO: 763363 - RNA, 22 nt, Human
ccugccagcugugggccagccu

SEQ ID NO: 763364 - RNA, 22 nt, Human
ugggagcucugagccugcuaug

SEQ ID NO: 763365 - RNA, 22 nt, Human
caggaaccuaaugaaggcucac

SEQ ID NO: 763366 - RNA, 22 nt, Human
uccaggcugcaaggccacaggg

SEQ ID NO: 763367 - RNA, 22 nt, Human
ugccugagguggucugcaaaug

SEQ ID NO: 763368 - RNA, 20 nt, Human
agguggcucuuccugggcuu

SEQ ID NO: 763369 - RNA, 22 nt, Human
augcugagguguguuuaauuua

SEQ ID NO: 763370 - RNA, 22 nt, Human
uacaauguucgcauucucucug

SEQ ID NO: 763371 - RNA, 22 nt, Human
cugcaggcucgaagacacggau

SEQ ID NO: 763372 - RNA, 22 nt, Human
uucaggauucugugucugacaa

SEQ ID NO: 763373 - RNA, 22 nt, Human
acaauuuuccccauagguuauc

SEQ ID NO: 763374 - RNA, 18 nt, Human
uaggaagcuuaauguuuu

SEQ ID NO: 763375 - RNA, 22 nt, Human
agggccagggaagcuguauuuu

SEQ ID NO: 763376 - RNA, 22 nt, Human
acuguguaugauauguacuggg

SEQ ID NO: 763377 - RNA, 22 nt, Human
gaacuaaaagcuaacaucaggc

SEQ ID NO: 763378 - RNA, 22 nt, Human
gcucacugcaaccucugcuucc

SEQ ID NO: 763379 - RNA, 22 nt, Human
aagaagaugguuaacuuucagu

SEQ ID NO: 763380 - RNA, 22 nt, Human
uacauggauguuauccuuacug

SEQ ID NO: 763381 - RNA, 22 nt, Human
gaaauauucuugucuuguuuuc

SEQ ID NO: 763382 - RNA, 22 nt, Human
gcuccugcagagauguuccaug

SEQ ID NO: 763383 - RNA, 22 nt, Human
gaagggcuuggcugggaggcca

SEQ ID NO: 763384 - RNA, 22 nt, Human
auuagugauaugugacuagacc

SEQ ID NO: 763385 - RNA, 22 nt, Human
cagcagagcugugugggaaggg

SEQ ID NO: 763386 - RNA, 22 nt, Human
ugguggcaacauugcuggagug

SEQ ID NO: 763387 - RNA, 22 nt, Human
cccagagaauuccacauagagg

SEQ ID NO: 763388 - RNA, 22 nt, Human
aguucacagcaaaguggggacc

SEQ ID NO: 763389 - RNA, 22 nt, Human
aauuuuauuaacuggauguagc

SEQ ID NO: 763390 - RNA, 22 nt, Human
uguacagagacuaccauuaaua

SEQ ID NO: 763391 - RNA, 22 nt, Human
uugcauugugauuacagaggug

SEQ ID NO: 763392 - RNA, 22 nt, Human
ggcuuugccuggaauuuccuug

SEQ ID NO: 763393 - RNA, 22 nt, Human
aaggccaugcacauccuaggca

SEQ ID NO: 763394 - RNA, 22 nt, Human
gugcaguugaagcauggggaga

SEQ ID NO: 763395 - RNA, 22 nt, Human
gcaucuaaaucacuuuaaugua

SEQ ID NO: 763396 - RNA, 22 nt, Human
guuuacuuuucauggagcauau

SEQ ID NO: 763397 - RNA, 22 nt, Human
gcaaugaggagugguagggaua

SEQ ID NO: 763398 - RNA, 22 nt, Human
uucuacaucacuuaacaugcua

SEQ ID NO: 763399 - RNA, 22 nt, Human
caagcaugucuucuuaagcaau

SEQ ID NO: 763400 - RNA, 22 nt, Human
uuugugugguggauacugggua

SEQ ID NO: 763401 - RNA, 18 nt, Human
ugagagcauucgaggcaa

SEQ ID NO: 763402 - RNA, 22 nt, Human
agucugcauucacagcaauuau

SEQ ID NO: 763403 - RNA, 22 nt, Human
augugacaguguuugacagaug

SEQ ID NO: 763404 - RNA, 22 nt, Human
cccagaggguggagguugcagu

SEQ ID NO: 763405 - RNA, 22 nt, Human
ccuuggcaaaccagggcagcug

SEQ ID NO: 763406 - RNA, 22 nt, Human
gucuugaaaaguggccaguuug

SEQ ID NO: 763407 - RNA, 18 nt, Human
uggcagguagacucaggu

SEQ ID NO: 763408 - RNA, 22 nt, Human
guaucuuuccacaucuucagua

SEQ ID NO: 763409 - RNA, 22 nt, Human
gguaggcagaucacugucuaug

SEQ ID NO: 763410 - RNA, 22 nt, Human
uagcacagacagaauggucaua

SEQ ID NO: 763411 - RNA, 22 nt, Human
auggcugcaguccgugcccugg

SEQ ID NO: 763412 - RNA, 22 nt, Human
accuggagggaaguucugacuu

SEQ ID NO: 763413 - RNA, 22 nt, Human
ggaaaucaaggggacaaauugu

SEQ ID NO: 763414 - RNA, 22 nt, Human
ccuuuuucaauauagaauugca

SEQ ID NO: 763415 - RNA, 22 nt, Human
aacaucagaaguagaagacuca

SEQ ID NO: 763416 - RNA, 22 nt, Human
aucaacaugaauuucucugaag

SEQ ID NO: 763417 - RNA, 21 nt, Human
aggauauuaggugauuugggu

SEQ ID NO: 763418 - RNA, 22 nt, Human
ucucugagcaugccauauugcu

SEQ ID NO: 763419 - RNA, 19 nt, Human
agugugagacuccaucuca

SEQ ID NO: 763420 - RNA, 18 nt, Human
agcagcugucagaaugcc

SEQ ID NO: 763421 - RNA, 22 nt, Human
cuccagggaggagcacggguuc

SEQ ID NO: 763422 - RNA, 22 nt, Human
caaugcacgcucagauuugacc

SEQ ID NO: 763423 - RNA, 22 nt, Human
cucugcuggugaccacugggcc

SEQ ID NO: 763424 - RNA, 22 nt, Human
ggugagcacugcccugggucuc

SEQ ID NO: 763425 - RNA, 22 nt, Human
augagacuaccuguaauguggc

SEQ ID NO: 763426 - RNA, 20 nt, Human
cccaggaguuugcucuuacu

SEQ ID NO: 763427 - RNA, 22 nt, Human
gcuccagcuccggcuccgaagc

SEQ ID NO: 763428 - RNA, 22 nt, Human
uccagaaaauucagaaauuguu

SEQ ID NO: 763429 - RNA, 22 nt, Human
agaguuaagacguacaugagug

SEQ ID NO: 763430 - RNA, 22 nt, Human
cugcagcugucucuacugggca

SEQ ID NO: 763431 - RNA, 22 nt, Human
ggccaggagaggagggcacuga

SEQ ID NO: 763432 - RNA, 22 nt, Human
guucaugugguuuuuaaaggau

SEQ ID NO: 763433 - RNA, 22 nt, Human
ugccuguguugauuacuuuguc

SEQ ID NO: 763434 - RNA, 22 nt, Human
cuuagggagaaugccucugcag

SEQ ID NO: 763435 - RNA, 22 nt, Human
ugcuggaauuauagaaaaauag

SEQ ID NO: 763436 - RNA, 22 nt, Human
ccaggacaggaguuggcuucgc

SEQ ID NO: 763437 - RNA, 22 nt, Human
uuuuccuucugauacuccauuu

SEQ ID NO: 763438 - RNA, 22 nt, Human
aucauaagacccagccaguauu

SEQ ID NO: 763439 - RNA, 22 nt, Human
cauggggagacaccuagggaaa

SEQ ID NO: 763440 - RNA, 23 nt, Human
aggcugcuuacugguaucagagc

SEQ ID NO: 763441 - RNA, 17 nt, Human
ugucuacucugacuaaa

SEQ ID NO: 763442 - RNA, 22 nt, Human
guggcccuaacaccguuucuca

SEQ ID NO: 763443 - RNA, 22 nt, Human
uaaaguucagugcaugaaugug

SEQ ID NO: 763444 - RNA, 22 nt, Human
gcuccagaguguggcaucuggg

SEQ ID NO: 763445 - RNA, 22 nt, Human
aagcaucuauauuccacuguga

SEQ ID NO: 763446 - RNA, 22 nt, Human
auggagccauuccugaagacuu

SEQ ID NO: 763447 - RNA, 22 nt, Human
uacaaucacccaaaaguggcuc

SEQ ID NO: 763448 - RNA, 22 nt, Human
uuucucauggaacauagcuccu

SEQ ID NO: 763449 - RNA, 22 nt, Human
agccacagcacauuguaagaaa

SEQ ID NO: 763450 - RNA, 22 nt, Human
uccuugggguaacuccagccug

SEQ ID NO: 763451 - RNA, 22 nt, Human
gcagugaaaaagugcacccugu

SEQ ID NO: 763452 - RNA, 22 nt, Human
uagcauuuauggucaugugucc

SEQ ID NO: 763453 - RNA, 22 nt, Human
guccugugagauucaugcucaa

SEQ ID NO: 763454 - RNA, 19 nt, Human
aguagcagaaagugcagug

SEQ ID NO: 763455 - RNA, 22 nt, Human
cugggacagagcagcagugggg

SEQ ID NO: 763456 - RNA, 22 nt, Human
cccucugaaccugguagcagaa

SEQ ID NO: 763457 - RNA, 21 nt, Human
aggaaugcugaggcucacuuu

SEQ ID NO: 763458 - RNA, 22 nt, Human
uggagcuggcagcggaaaaggg

SEQ ID NO: 763459 - RNA, 22 nt, Human
uaguacaguggagagcaaagaa

SEQ ID NO: 763460 - RNA, 22 nt, Human
uuguagacaucuguaucauuuu

SEQ ID NO: 763461 - RNA, 22 nt, Human
gggaaaaauaaugcacagauau

SEQ ID NO: 763462 - RNA, 22 nt, Human
uccuggccaggaugaccuaaca

SEQ ID NO: 763463 - RNA, 22 nt, Human
cugggcugucaauggcccucug

SEQ ID NO: 763464 - RNA, 22 nt, Human
aagucagaaauuauucaggaau

SEQ ID NO: 763465 - RNA, 22 nt, Human
accuggauuuugcuuagacaug

SEQ ID NO: 763466 - RNA, 23 nt, Human
aaucuggcugauguuuuuucucu

SEQ ID NO: 763467 - RNA, 22 nt, Human
auuaaggcugcacuggccuuaa

SEQ ID NO: 763468 - RNA, 22 nt, Human
ggcucuagagacucuagagaaa

SEQ ID NO: 763469 - RNA, 22 nt, Human
aggaaauaggaccagacaaagc

SEQ ID NO: 763470 - RNA, 22 nt, Human
agagucagaaagcagacagggg

SEQ ID NO: 763471 - RNA, 18 nt, Human
aaugugaauauuuacuuc

SEQ ID NO: 763472 - RNA, 22 nt, Human
gcugcuuuagaauugaaacaga

SEQ ID NO: 763473 - RNA, 22 nt, Human
agauuucacaugcugcucuauu

SEQ ID NO: 763474 - RNA, 22 nt, Human
acauuaguuucucagaucauuu

SEQ ID NO: 763475 - RNA, 19 nt, Human
aagagcagggaaagaauug

SEQ ID NO: 763476 - RNA, 22 nt, Human
cccugauguuuucucugccuuu

SEQ ID NO: 763477 - RNA, 17 nt, Human
cuucuagaaggcaaacu

SEQ ID NO: 763478 - RNA, 17 nt, Human
agcagggagucaaggga

SEQ ID NO: 763479 - RNA, 22 nt, Human
gcugagccacaggcagugcacu

SEQ ID NO: 763480 - RNA, 22 nt, Human
aaaccucuuaauggccuguaau

SEQ ID NO: 763481 - RNA, 22 nt, Human
agcuggagaugcccagcaccgg

SEQ ID NO: 763482 - RNA, 22 nt, Human
ucacugaaugcagauacgugac

SEQ ID NO: 763483 - RNA, 22 nt, Human
uggggugggguuacucauucug

SEQ ID NO: 763484 - RNA, 22 nt, Human
gcaggagcaaacugcagugugg

SEQ ID NO: 763485 - RNA, 22 nt, Human
acagacaugggccgcucuugag

SEQ ID NO: 763486 - RNA, 22 nt, Human
uggggacacagagguucguugg

SEQ ID NO: 763487 - RNA, 22 nt, Human
ugcagccugguggucacuggag

SEQ ID NO: 763488 - RNA, 22 nt, Human
aagaugcuugcaaauuucugaa

SEQ ID NO: 763489 - RNA, 22 nt, Human
caagaacaguuugccaaauugg

SEQ ID NO: 763490 - RNA, 22 nt, Human
aucuggcucgcuaggcucuggg

SEQ ID NO: 763491 - RNA, 22 nt, Human
acagcauggauaacaaggcacu

SEQ ID NO: 763492 - RNA, 22 nt, Human
aaaggagacagucuuaccugga

SEQ ID NO: 763493 - RNA, 22 nt, Human
cauuucccccucauguugcagc

SEQ ID NO: 763494 - RNA, 22 nt, Human
gggcccagcccucugcucacug

SEQ ID NO: 763495 - RNA, 22 nt, Human
cugugucugccugggauccauu

SEQ ID NO: 763496 - RNA, 22 nt, Human
gcucccacgcaauucuuuucag

SEQ ID NO: 763497 - RNA, 22 nt, Human
ugguaaagaaggcuagaucuga

SEQ ID NO: 763498 - RNA, 22 nt, Human
cuggagcccugaaugggcagga

SEQ ID NO: 763499 - RNA, 22 nt, Human
ucacuauguucggagaacucug

SEQ ID NO: 763500 - RNA, 22 nt, Human
acugacuguggauggcagcagc

SEQ ID NO: 763501 - RNA, 22 nt, Human
cuaggcuggagugcauuggcgu

SEQ ID NO: 763502 - RNA, 22 nt, Human
gggccccacuggggcugccugc

SEQ ID NO: 763503 - RNA, 22 nt, Human
uauucaagauugaacuggcaga

SEQ ID NO: 763504 - RNA, 22 nt, Human
ugggcugcuguuacaggggcug

SEQ ID NO: 763505 - RNA, 22 nt, Human
auacacauaucagguguauaca

SEQ ID NO: 763506 - RNA, 22 nt, Human
guacacacuauuuaaaguguuu

SEQ ID NO: 763507 - RNA, 22 nt, Human
guuugcauuccaauuuagggga

SEQ ID NO: 763508 - RNA, 22 nt, Human
ggcagaggugaaguucacaagg

SEQ ID NO: 763509 - RNA, 22 nt, Human
uaaauguagucaaaggagccuc

SEQ ID NO: 763510 - RNA, 22 nt, Human
aaauucuggccuaucacaguga

SEQ ID NO: 763511 - RNA, 22 nt, Human
ucccagaauccucacucuauca

SEQ ID NO: 763512 - RNA, 22 nt, Human
acagugcagugugaugaguauu

SEQ ID NO: 763513 - RNA, 22 nt, Human
ggaaauguaaucacagaggguu

SEQ ID NO: 763514 - RNA, 22 nt, Human
gagaauguggagccugugguug

SEQ ID NO: 763515 - RNA, 22 nt, Human
cagaagucacccucagaauaac

SEQ ID NO: 763516 - RNA, 22 nt, Human
gcaagaguggaacaaaggcagc

SEQ ID NO: 763517 - RNA, 22 nt, Human
acccucagacauauuccaucau

SEQ ID NO: 763518 - RNA, 22 nt, Human
guuagguagaaguuuacuuuga

SEQ ID NO: 763519 - RNA, 22 nt, Human
gcauucuuuuuaggagguuccu

SEQ ID NO: 763520 - RNA, 22 nt, Human
aauacauguuuucuacuauucu

SEQ ID NO: 763521 - RNA, 22 nt, Human
cagugacagguuccaugccgca

SEQ ID NO: 763522 - RNA, 22 nt, Human
cuaagguuggcaguggaauugg

SEQ ID NO: 763523 - RNA, 22 nt, Human
gagagcccuuagguuuagaguu

SEQ ID NO: 763524 - RNA, 22 nt, Human
ccuguacacaauuccgaggaua

SEQ ID NO: 763525 - RNA, 20 nt, Human
gccugagcuccgccuccugu

SEQ ID NO: 763526 - RNA, 22 nt, Human
aacaugauuucaugcauuuaga

SEQ ID NO: 763527 - RNA, 19 nt, Human
aguggcugggcagaagcaa

SEQ ID NO: 763528 - RNA, 22 nt, Human
aacuguagaagggacacaaaag

SEQ ID NO: 763529 - RNA, 22 nt, Human
gcuaguuucuugaauacucuaa

SEQ ID NO: 763530 - RNA, 22 nt, Human
ugcuggguagaaguauuagucu

SEQ ID NO: 763531 - RNA, 19 nt, Human
uugaaauuguuugauaugg

SEQ ID NO: 763532 - RNA, 22 nt, Human
uuccuguaugucagugaagagc

SEQ ID NO: 763533 - RNA, 22 nt, Human
aaaucaguucacguucugaggu

SEQ ID NO: 763534 - RNA, 22 nt, Human
cacagagacaugaugucauugc

SEQ ID NO: 763535 - RNA, 23 nt, Human
cauguguaauuucugguugggug

SEQ ID NO: 763536 - RNA, 22 nt, Human
acagauacaaauauacaaauac

SEQ ID NO: 763537 - RNA, 22 nt, Human
gcagggcuauuggaaggagaug

SEQ ID NO: 763538 - RNA, 22 nt, Human
gcagcccauaacauuugaggcc

SEQ ID NO: 763539 - RNA, 22 nt, Human
acugggcaauaaauucagagaa

SEQ ID NO: 763540 - RNA, 20 nt, Human
ggguccugacuuggucuccu

SEQ ID NO: 763541 - RNA, 19 nt, Human
cacagcgaagacaaggugg

SEQ ID NO: 763542 - RNA, 22 nt, Human
uccaaauugacaguagugauua

SEQ ID NO: 763543 - RNA, 22 nt, Human
ugcauggauaaaaguauauuau

SEQ ID NO: 763544 - RNA, 22 nt, Human
uauucucagugcuauaaguaga

SEQ ID NO: 763545 - RNA, 22 nt, Human
agacaguguguguauauauggu

SEQ ID NO: 763546 - RNA, 22 nt, Human
uggaagagggagcuggguggcc

SEQ ID NO: 763547 - RNA, 22 nt, Human
agcuuccuguugagagagggag

SEQ ID NO: 763548 - RNA, 22 nt, Human
guccuguuggugaauggcucuu

SEQ ID NO: 763549 - RNA, 22 nt, Human
cugggaaauugacacugauaaa

SEQ ID NO: 763550 - RNA, 22 nt, Human
auggcagaauccauaguaggug

SEQ ID NO: 763551 - RNA, 22 nt, Human
cagcuccagccaccggggggug

SEQ ID NO: 763552 - RNA, 22 nt, Human
aagcaaagacaguuugagugga

SEQ ID NO: 763553 - RNA, 22 nt, Human
gacaagacuauguagaaaguau

SEQ ID NO: 763554 - RNA, 22 nt, Human
agaagcacuagaggguauggaa

SEQ ID NO: 763555 - RNA, 22 nt, Human
ccugcagguuucccccggacgg

SEQ ID NO: 763556 - RNA, 22 nt, Human
auagcagaaaccaagcuucuuc

SEQ ID NO: 763557 - RNA, 22 nt, Human
aauuaagaaaauguuuuaugau

SEQ ID NO: 763558 - RNA, 22 nt, Human
cacauugcagcuucuuuuggcu

SEQ ID NO: 763559 - RNA, 22 nt, Human
uuguccugucaggcugggggcu

SEQ ID NO: 763560 - RNA, 23 nt, Human
ucacaucugccguaguguauucu

SEQ ID NO: 763561 - RNA, 22 nt, Human
aaagcuauucaacacgaacaug

SEQ ID NO: 763562 - RNA, 22 nt, Human
caucugcucugucugccauguu

SEQ ID NO: 763563 - RNA, 22 nt, Human
ugaggccacaguaucagaacag

SEQ ID NO: 763564 - RNA, 22 nt, Human
ccuggcugagggaccucgggua

SEQ ID NO: 763565 - RNA, 22 nt, Human
uuuaugagcaaugcugagggga

SEQ ID NO: 763566 - RNA, 22 nt, Human
uggcaaagacugcaaggacuuu

SEQ ID NO: 763567 - RNA, 22 nt, Human
ggcgcugucgugagcucgcccg

SEQ ID NO: 763568 - RNA, 22 nt, Human
ugaggcugaaacuggcgauaga

SEQ ID NO: 763569 - RNA, 22 nt, Human
auuuuaguaccucaaguaucca

SEQ ID NO: 763570 - RNA, 22 nt, Human
ucuagaaacaugacauugaucu

SEQ ID NO: 763571 - RNA, 22 nt, Human
gccagaagggguggauccaggc

SEQ ID NO: 763572 - RNA, 22 nt, Human
aggauaaauucuccaaagugug

SEQ ID NO: 763573 - RNA, 22 nt, Human
augccugccauuuagaagucuu

SEQ ID NO: 763574 - RNA, 22 nt, Human
cuccucucaggcuggauggcgc

SEQ ID NO: 763575 - RNA, 22 nt, Human
aaacuagagcaugugaguggga

SEQ ID NO: 763576 - RNA, 22 nt, Human
cacaauuuccauugagcagcag

SEQ ID NO: 763577 - RNA, 22 nt, Human
uuacaagaugggaaagggaagu

SEQ ID NO: 763578 - RNA, 21 nt, Human
auaaauucugagaggcucugc

SEQ ID NO: 763579 - RNA, 22 nt, Human
cuggagucacucauguagcugc

SEQ ID NO: 763580 - RNA, 22 nt, Human
uuccggaagguucucuagaauu

SEQ ID NO: 763581 - RNA, 22 nt, Human
agucugucugucacuucugcag

SEQ ID NO: 763582 - RNA, 18 nt, Human
uucaccagugugaugggu

SEQ ID NO: 763583 - RNA, 22 nt, Human
agccaccuccugcucugcucac

SEQ ID NO: 763584 - RNA, 22 nt, Human
gccagcucaguuucaaaguagg

SEQ ID NO: 763585 - RNA, 22 nt, Human
cugccaggccuggggugcuguc

SEQ ID NO: 763586 - RNA, 22 nt, Human
cagagcugauuggauccagaga

SEQ ID NO: 763587 - RNA, 22 nt, Human
ugaagccaaggaugccuuucuc

SEQ ID NO: 763588 - RNA, 22 nt, Human
gaagaauauauaaugauuuugu

SEQ ID NO: 763589 - RNA, 22 nt, Human
ugcuggaacucagugaaucauu

SEQ ID NO: 763590 - RNA, 22 nt, Human
ccugcucaacgaauauggcgau

SEQ ID NO: 763591 - RNA, 22 nt, Human
ucccugccuccuggcagugcca

SEQ ID NO: 763592 - RNA, 22 nt, Human
gcacaaguuucuucauuguuca

SEQ ID NO: 763593 - RNA, 22 nt, Human
agauauugugcauacugcuguu

SEQ ID NO: 763594 - RNA, 22 nt, Human
augucuguuuauccuucaagau

SEQ ID NO: 763595 - RNA, 22 nt, Human
acugggcugguuaguuuuacua

SEQ ID NO: 763596 - RNA, 22 nt, Human
ccaggaguggcuggugaccuuc

SEQ ID NO: 763597 - RNA, 22 nt, Human
caguggggggacugaggccuga

SEQ ID NO: 763598 - RNA, 22 nt, Human
caguucugguuugcagauauau

SEQ ID NO: 763599 - RNA, 22 nt, Human
ccacaagacucugucagcauaa

SEQ ID NO: 763600 - RNA, 22 nt, Human
aauuuacacuucauuuggaggg

SEQ ID NO: 763601 - RNA, 22 nt, Human
ucugagaaugguggauguggug

SEQ ID NO: 763602 - RNA, 22 nt, Human
uuucagaguuaguagagcaugu

SEQ ID NO: 763603 - RNA, 22 nt, Human
aagugucugcuggcucuacccu

SEQ ID NO: 763604 - RNA, 22 nt, Human
ggucagguuuuuaggagugacc

SEQ ID NO: 763605 - RNA, 22 nt, Human
cuggcuuuguauaguucccuga

SEQ ID NO: 763606 - RNA, 22 nt, Human
aagugcauacacuaguuaauug

SEQ ID NO: 763607 - RNA, 22 nt, Human
cagagccagcaguggggacagg

SEQ ID NO: 763608 - RNA, 22 nt, Human
gagcagcugagcuggaaugaga

SEQ ID NO: 763609 - RNA, 21 nt, Human
agagaagggauuccaggcccu

SEQ ID NO: 763610 - RNA, 22 nt, Human
agguagaagagcaaggaauaac

SEQ ID NO: 763611 - RNA, 22 nt, Human
acuaaagaugucuaaauauauu

SEQ ID NO: 763612 - RNA, 22 nt, Human
uagagcuguaucaaagagccuu

SEQ ID NO: 763613 - RNA, 22 nt, Human
cuguggcucuuuaguugagcac

SEQ ID NO: 763614 - RNA, 21 nt, Human
acagcaagccuuccuuucagg

SEQ ID NO: 763615 - RNA, 22 nt, Human
gaacuuuauaacuguaaauguc

SEQ ID NO: 763616 - RNA, 22 nt, Human
gcucuuugcacagcucugcccu

SEQ ID NO: 763617 - RNA, 22 nt, Human
aggcuuauagcuuauauuuaag

SEQ ID NO: 763618 - RNA, 22 nt, Human
uguggggaccuggcugccaccc

SEQ ID NO: 763619 - RNA, 22 nt, Human
ucaugcaagaauaauaggaagg

SEQ ID NO: 763620 - RNA, 22 nt, Human
uagauucuggagagacagcagu

SEQ ID NO: 763621 - RNA, 22 nt, Human
ugccagaagugcuuuauaagug

SEQ ID NO: 763622 - RNA, 22 nt, Human
uuaguuuucccaucuuuauggu

SEQ ID NO: 763623 - RNA, 22 nt, Human
ucaguuaccugacagugguuau

SEQ ID NO: 763624 - RNA, 22 nt, Human
cagcaucuucuagauccaggcu

SEQ ID NO: 763625 - RNA, 22 nt, Human
uguauacauacauaugugugug

SEQ ID NO: 763626 - RNA, 22 nt, Human
agaguuuggagagggugaggca

SEQ ID NO: 763627 - RNA, 22 nt, Human
ccugaggucaugguccaguguu

SEQ ID NO: 763628 - RNA, 22 nt, Human
augcuaaagggguaggccuccu

SEQ ID NO: 763629 - RNA, 21 nt, Human
cuaacuuugaguccuggcccc

SEQ ID NO: 763630 - RNA, 22 nt, Human
agacacagucugucuggaggag

SEQ ID NO: 763631 - RNA, 22 nt, Human
gcauggccucugugcuuguugc

SEQ ID NO: 763632 - RNA, 22 nt, Human
agcugcuggggagggcagacac

SEQ ID NO: 763633 - RNA, 22 nt, Human
acccagcaaagauaaacuuaug

SEQ ID NO: 763634 - RNA, 22 nt, Human
agauugauagauguuucuaaaa

SEQ ID NO: 763635 - RNA, 22 nt, Human
caguccugggcacagcccuggg

SEQ ID NO: 763636 - RNA, 22 nt, Human
gcugcaggcggccgugguggcg

SEQ ID NO: 763637 - RNA, 22 nt, Human
aggcuaggccuugcccuggaac

SEQ ID NO: 763638 - RNA, 22 nt, Human
uaaccuuugaccuugcuugugc

SEQ ID NO: 763639 - RNA, 22 nt, Human
uuauuuuguagcucugaucuuu

SEQ ID NO: 763640 - RNA, 22 nt, Human
agcagccagagucugaacauua

SEQ ID NO: 763641 - RNA, 22 nt, Human
gcucccaggaagagaagggcca

SEQ ID NO: 763642 - RNA, 17 nt, Human
uguagcuucuccuucuc

SEQ ID NO: 763643 - RNA, 19 nt, Human
auauagcauuauucaauuu

SEQ ID NO: 763644 - RNA, 20 nt, Human
uggcuccugcgguggaacca

SEQ ID NO: 763645 - RNA, 22 nt, Human
gaugguuugguaaaaguauguu

SEQ ID NO: 763646 - RNA, 19 nt, Human
uaucuguuuccugcuuguc

SEQ ID NO: 763647 - RNA, 22 nt, Human
auucugcuuaagggaggcuguc

SEQ ID NO: 763648 - RNA, 22 nt, Human
gagggucuuaccuaagcagggu

SEQ ID NO: 763649 - RNA, 22 nt, Human
ccaggcugcuuuauuacucugu

SEQ ID NO: 763650 - RNA, 22 nt, Human
caggcccagcccuuagccaggu

SEQ ID NO: 763651 - RNA, 22 nt, Human
cucagugugagugagaagugca

SEQ ID NO: 763652 - RNA, 22 nt, Human
agcugccaccucugccuuuggg

SEQ ID NO: 763653 - RNA, 22 nt, Human
gggaaggcaccaugguguucca

SEQ ID NO: 763654 - RNA, 22 nt, Human
uaacucuagucccaggcaugaa

SEQ ID NO: 763655 - RNA, 22 nt, Human
gccuuuaucuuccugauucaga

SEQ ID NO: 763656 - RNA, 22 nt, Human
uuacaaaguuuaagguggcacu

SEQ ID NO: 763657 - RNA, 21 nt, Human
cugcaggugcugccaucaggg

SEQ ID NO: 763658 - RNA, 22 nt, Human
uggaucucggcaaugcgggacu

SEQ ID NO: 763659 - RNA, 22 nt, Human
cugcuuggaggccugggugcua

SEQ ID NO: 763660 - RNA, 22 nt, Human
cuuuacaaauuagcucucggga

SEQ ID NO: 763661 - RNA, 22 nt, Human
aaaggcacacacuccuuguuau

SEQ ID NO: 763662 - RNA, 22 nt, Human
ucaggagcagcaugggugagag

SEQ ID NO: 763663 - RNA, 22 nt, Human
agguggcauuuacaccauggga

SEQ ID NO: 763664 - RNA, 22 nt, Human
uugauguugcucuuaacaguau

SEQ ID NO: 763665 - RNA, 22 nt, Human
aacacauauuuuugcugagcau

SEQ ID NO: 763666 - RNA, 22 nt, Human
agaaaugaaaccaaagccuaga

SEQ ID NO: 763667 - RNA, 22 nt, Human
ucagccuccgaaagugcuggga

SEQ ID NO: 763668 - RNA, 22 nt, Human
uauuucuggcuuugagggugau

SEQ ID NO: 763669 - RNA, 22 nt, Human
gcuuacaaggguaggaagucua

SEQ ID NO: 763670 - RNA, 22 nt, Human
cugccucuguugggcauggucu

SEQ ID NO: 763671 - RNA, 22 nt, Human
uggcuucuagagcccauccuuc

SEQ ID NO: 763672 - RNA, 22 nt, Human
agagacugcgugucagcgcugg

SEQ ID NO: 763673 - RNA, 22 nt, Human
cagggugcugcaccaucccuca

SEQ ID NO: 763674 - RNA, 22 nt, Human
agcaggacaauaugggaucagg

SEQ ID NO: 763675 - RNA, 22 nt, Human
caggaaugaggucguaaguguc

SEQ ID NO: 763676 - RNA, 20 nt, Human
uuaguugaguagcuccugaa

SEQ ID NO: 763677 - RNA, 22 nt, Human
uccauucuuuugcugucuuccu

SEQ ID NO: 763678 - RNA, 22 nt, Human
ugaauaugauugcaaauuuggc

SEQ ID NO: 763679 - RNA, 22 nt, Human
uuugagaaaugggcucugugcu

SEQ ID NO: 763680 - RNA, 22 nt, Human
cugcacugaagaaaggagcucu

SEQ ID NO: 763681 - RNA, 22 nt, Human
auacagagaagggguagaggau

SEQ ID NO: 763682 - RNA, 22 nt, Human
ggcagcaggagccaucugguag

SEQ ID NO: 763683 - RNA, 22 nt, Human
ggccucagagaaggcugugcgg

SEQ ID NO: 763684 - RNA, 23 nt, Human
ggaggucagugccugagggugag

SEQ ID NO: 763685 - RNA, 22 nt, Human
gcaagacaugucuaagguuuaa

SEQ ID NO: 763686 - RNA, 22 nt, Human
gggcuggaccgcucgccucccu

SEQ ID NO: 763687 - RNA, 22 nt, Human
aagucaaaccuugcucacagga

SEQ ID NO: 763688 - RNA, 22 nt, Human
uaguccucagcugaacugcugc

SEQ ID NO: 763689 - RNA, 22 nt, Human
aggcucugcagaccccagcugu

SEQ ID NO: 763690 - RNA, 22 nt, Human
caggcacaagaagcaaauguua

SEQ ID NO: 763691 - RNA, 22 nt, Human
acaagggauuguugaguagucu

SEQ ID NO: 763692 - RNA, 22 nt, Human
caaugcuuuuguucuuuacuca

SEQ ID NO: 763693 - RNA, 22 nt, Human
uagaaagacaaugggaagugcu

SEQ ID NO: 763694 - RNA, 22 nt, Human
gagaaggauguggcucauagcu

SEQ ID NO: 763695 - RNA, 22 nt, Human
cugggcgcguccccugaggcgg

SEQ ID NO: 763696 - RNA, 22 nt, Human
ucucagggcaauucucagcgac

SEQ ID NO: 763697 - RNA, 22 nt, Human
guguuaaugaaaaacaacucau

SEQ ID NO: 763698 - RNA, 22 nt, Human
ucugaacagaaaagaugcacaa

SEQ ID NO: 763699 - RNA, 22 nt, Human
cugaagcaggccuacuucauug

SEQ ID NO: 763700 - RNA, 22 nt, Human
agcagggcuccauuucacugcc

SEQ ID NO: 763701 - RNA, 22 nt, Human
auguaacuguuauauuuuguug

SEQ ID NO: 763702 - RNA, 22 nt, Human
aggacuggugccagacaaggua

SEQ ID NO: 763703 - RNA, 22 nt, Human
gaccacugaaugcacuucuaau

SEQ ID NO: 763704 - RNA, 18 nt, Human
cucuguguuggugugaag

SEQ ID NO: 763705 - RNA, 22 nt, Human
ucaaggcaaaguaaauauucaa

SEQ ID NO: 763706 - RNA, 22 nt, Human
uccuuaacaagauggcauuugu

SEQ ID NO: 763707 - RNA, 22 nt, Human
uuccagaaaacgcuuuauuuag

SEQ ID NO: 763708 - RNA, 23 nt, Human
augcaggguuacagggcugacuu

SEQ ID NO: 763709 - RNA, 22 nt, Human
ccugagaccaaguugcagccau

SEQ ID NO: 763710 - RNA, 22 nt, Human
agcuaaggagcaaguaggaguu

SEQ ID NO: 763711 - RNA, 21 nt, Human
ugcaccuguucacugcaguuc

SEQ ID NO: 763712 - RNA, 22 nt, Human
agcaggcuuacuuucugauuag

SEQ ID NO: 763713 - RNA, 22 nt, Human
ggcucuggggccuccucccuug

SEQ ID NO: 763714 - RNA, 22 nt, Human
uuacaaagagugccagagugug

SEQ ID NO: 763715 - RNA, 22 nt, Human
aaugcacaaaaauuguauguaa

SEQ ID NO: 763716 - RNA, 22 nt, Human
uucuggcuuaguuguuguauau

SEQ ID NO: 763717 - RNA, 22 nt, Human
uccagcucccacucucacugcu

SEQ ID NO: 763718 - RNA, 22 nt, Human
gaagcacauggcugugagcaac

SEQ ID NO: 763719 - RNA, 22 nt, Human
aaagguuuucugacccuuagua

SEQ ID NO: 763720 - RNA, 22 nt, Human
acaggcagugggccagauuugu

SEQ ID NO: 763721 - RNA, 22 nt, Human
cacacaucuuaucccaguuauu

SEQ ID NO: 763722 - RNA, 22 nt, Human
ucauugcacuccagccugggca

SEQ ID NO: 763723 - RNA, 22 nt, Human
agaaugucuaaguguucagccc

SEQ ID NO: 763724 - RNA, 18 nt, Human
caugggugacagguggau

SEQ ID NO: 763725 - RNA, 22 nt, Human
uuacacugacagcugaaaagca

SEQ ID NO: 763726 - RNA, 19 nt, Human
cuguccuuggcugcacugu

SEQ ID NO: 763727 - RNA, 22 nt, Human
gcaaagcacacuggagaugucg

SEQ ID NO: 763728 - RNA, 22 nt, Human
uccuggaggggacagcaugggc

SEQ ID NO: 763729 - RNA, 22 nt, Human
agcagggguaacagaaggaaag

SEQ ID NO: 763730 - RNA, 22 nt, Human
uccacaguuuugccacuagcug

SEQ ID NO: 763731 - RNA, 22 nt, Human
gaggaagccccauugaagccag

SEQ ID NO: 763732 - RNA, 22 nt, Human
guggcuuuguuuccaaaugaaa

SEQ ID NO: 763733 - RNA, 22 nt, Human
ccugaguccccucauucacucu

SEQ ID NO: 763734 - RNA, 22 nt, Human
cagcggccggugaggaagggga

SEQ ID NO: 763735 - RNA, 22 nt, Human
caugaggucagggggagccggu

SEQ ID NO: 763736 - RNA, 22 nt, Human
gaggcugucuguuagccuggga

SEQ ID NO: 763737 - RNA, 22 nt, Human
ugagccccggaguuucaggcug

SEQ ID NO: 763738 - RNA, 22 nt, Human
uuguccuuuaauguuuaguauu

SEQ ID NO: 763739 - RNA, 22 nt, Human
ggcugcagauuguagucuguua

SEQ ID NO: 763740 - RNA, 22 nt, Human
ugcaggaaauuccaggguggcc

SEQ ID NO: 763741 - RNA, 22 nt, Human
uucauacuguuuaaguucuguu

SEQ ID NO: 763742 - RNA, 22 nt, Human
ccagguggugaaagugggcccu

SEQ ID NO: 763743 - RNA, 22 nt, Human
ccuuuagaauacagacuuucua

SEQ ID NO: 763744 - RNA, 22 nt, Human
augaaacacacacgcgcauacu

SEQ ID NO: 763745 - RNA, 22 nt, Human
uuccaugaaauguguuaugcuu

SEQ ID NO: 763746 - RNA, 22 nt, Human
uccucacagaugggugcauagc

SEQ ID NO: 763747 - RNA, 22 nt, Human
agcuguguguuugucaugggcg

SEQ ID NO: 763748 - RNA, 22 nt, Human
cauuuguaauacugacuugcag

SEQ ID NO: 763749 - RNA, 22 nt, Human
aguuuacacuaugaaaagacua

SEQ ID NO: 763750 - RNA, 22 nt, Human
cacagcugccaugcagucagug

SEQ ID NO: 763751 - RNA, 22 nt, Human
ucacauuuguguuuuauuagag

SEQ ID NO: 763752 - RNA, 22 nt, Human
guaacacuagcucugucacuuu

SEQ ID NO: 763753 - RNA, 22 nt, Human
cuucacugcagucauggcucug

SEQ ID NO: 763754 - RNA, 22 nt, Human
ccucuguggccuuggaccagcu

SEQ ID NO: 763755 - RNA, 22 nt, Human
uuacaaucaucuaggauaaaga

SEQ ID NO: 763756 - RNA, 22 nt, Human
aagggcucacccaacucacuuc

SEQ ID NO: 763757 - RNA, 20 nt, Human
uguguaugugcacaugcgaa

SEQ ID NO: 763758 - RNA, 22 nt, Human
gugcaccagucacaugggcaga

SEQ ID NO: 763759 - RNA, 21 nt, Human
uuggccuuugucucagacacu

SEQ ID NO: 763760 - RNA, 19 nt, Human
aucugaaguaggugcagcu

SEQ ID NO: 763761 - RNA, 22 nt, Human
gggaucagcaagccacugcacc

SEQ ID NO: 763762 - RNA, 22 nt, Human
agucaggagauauuuugauaug

SEQ ID NO: 763763 - RNA, 22 nt, Human
uccugggcugcagggaagagca

SEQ ID NO: 763764 - RNA, 22 nt, Human
uugacuucagaauguugauggu

SEQ ID NO: 763765 - RNA, 22 nt, Human
uaaaucacaucgaaaucugggu

SEQ ID NO: 763766 - RNA, 22 nt, Human
ccugccuuccagccuugggcuc

SEQ ID NO: 763767 - RNA, 22 nt, Human
uucuguaucucuguguuucuug

SEQ ID NO: 763768 - RNA, 22 nt, Human
gaagaaguauuuuuguccuguu

SEQ ID NO: 763769 - RNA, 22 nt, Human
ucuuugaauacaggaagcauga

SEQ ID NO: 763770 - RNA, 22 nt, Human
gggcggugccugucuccgaagc

SEQ ID NO: 763771 - RNA, 22 nt, Human
aaaccacuccugauucacuuca

SEQ ID NO: 763772 - RNA, 22 nt, Human
agagccuguaacaucuuucuua

SEQ ID NO: 763773 - RNA, 22 nt, Human
aguggcaguggcugggcagagc

SEQ ID NO: 763774 - RNA, 21 nt, Human
auccauucuccgguuaaugag

SEQ ID NO: 763775 - RNA, 22 nt, Human
ugcugagggcuguuaaggaagc

SEQ ID NO: 763776 - RNA, 22 nt, Human
ccugcuggccacugcuccaccu

SEQ ID NO: 763777 - RNA, 22 nt, Human
gcugcugcugaggaugcaccug

SEQ ID NO: 763778 - RNA, 22 nt, Human
agaagucagccacagugggaga

SEQ ID NO: 763779 - RNA, 22 nt, Human
auguaacauaugugaucgcauu

SEQ ID NO: 763780 - RNA, 21 nt, Human
gccugggaaaucugggaagcc

SEQ ID NO: 763781 - RNA, 22 nt, Human
uauggcuuuaaauugaaggagu

SEQ ID NO: 763782 - RNA, 22 nt, Human
gcagcccaggcucgcucacugc

SEQ ID NO: 763783 - RNA, 22 nt, Human
ggcugagccuggagcaucuggu

SEQ ID NO: 763784 - RNA, 22 nt, Human
gaauugcuugugaagugugucu

SEQ ID NO: 763785 - RNA, 22 nt, Human
gaagauuucaguuaaguaucua

SEQ ID NO: 763786 - RNA, 22 nt, Human
cuguaaaacugcuuaaguaugc

SEQ ID NO: 763787 - RNA, 22 nt, Human
acugucuuguuccaagacuaaa

SEQ ID NO: 763788 - RNA, 22 nt, Human
gaauacacgcacgacacggggg

SEQ ID NO: 763789 - RNA, 22 nt, Human
aaagaacagauguguggugcau

SEQ ID NO: 763790 - RNA, 22 nt, Human
uucuuagaugauuaaugauggg

SEQ ID NO: 763791 - RNA, 22 nt, Human
uagugcuuaauaaauuucagaa

SEQ ID NO: 763792 - RNA, 22 nt, Human
ugucaauaacauuuacuucuau

SEQ ID NO: 763793 - RNA, 22 nt, Human
gcugccugguuucucagcugca

SEQ ID NO: 763794 - RNA, 22 nt, Human
uaggugagggagcauugugaga

SEQ ID NO: 763795 - RNA, 22 nt, Human
cagaugaacuaggcugcacuug

SEQ ID NO: 763796 - RNA, 22 nt, Human
cuuucuaauucucccauagucu

SEQ ID NO: 763797 - RNA, 22 nt, Human
augucugcuauucauagggaaa

SEQ ID NO: 763798 - RNA, 22 nt, Human
ugaauuuaccuugccuauauuu

SEQ ID NO: 763799 - RNA, 22 nt, Human
uucuugaauagggauugauaaa

SEQ ID NO: 763800 - RNA, 22 nt, Human
uuauuagagugcuuugagaaag

SEQ ID NO: 763801 - RNA, 21 nt, Human
uuuaucaucacgagcuugagc

SEQ ID NO: 763802 - RNA, 22 nt, Human
gagugguuagaaguaguguggc

SEQ ID NO: 763803 - RNA, 19 nt, Human
agacaguggcuaggacuua

SEQ ID NO: 763804 - RNA, 22 nt, Human
aaccagcuaaacuuugcucgaa

SEQ ID NO: 763805 - RNA, 22 nt, Human
ucagcucuaccugggagcuguc

SEQ ID NO: 763806 - RNA, 21 nt, Human
agguacaggucuugugagucu

SEQ ID NO: 763807 - RNA, 22 nt, Human
ugucacaucaggugguggcugu

SEQ ID NO: 763808 - RNA, 19 nt, Human
ucauggaagaaaugugaua

SEQ ID NO: 763809 - RNA, 22 nt, Human
acccgcccucagccuuaccgug

SEQ ID NO: 763810 - RNA, 22 nt, Human
ccauggagcgggugagugagug

SEQ ID NO: 763811 - RNA, 22 nt, Human
ccagccacagcuuccagcuccu

SEQ ID NO: 763812 - RNA, 22 nt, Human
uuguaacagcuguuuauauagu

SEQ ID NO: 763813 - RNA, 22 nt, Human
ugaggggccagaccccaccuag

SEQ ID NO: 763814 - RNA, 22 nt, Human
cugcagugaggauucuuaggug

SEQ ID NO: 763815 - RNA, 21 nt, Human
guucugaguuagaguuggcca

SEQ ID NO: 763816 - RNA, 22 nt, Human
ggcagcuccucaaaaaauuaaa

SEQ ID NO: 763817 - RNA, 22 nt, Human
gucacuuugaagcuguuuuuag

SEQ ID NO: 763818 - RNA, 22 nt, Human
auugacuagagucacaguugca

SEQ ID NO: 763819 - RNA, 22 nt, Human
uuguccugugucuguuuggauu

SEQ ID NO: 763820 - RNA, 22 nt, Human
uuugcauuuccagaguagcaga

SEQ ID NO: 763821 - RNA, 22 nt, Human
gcucacuuaauuucaugcuaca

SEQ ID NO: 763822 - RNA, 22 nt, Human
gaagaugugggaacugcugaaa

SEQ ID NO: 763823 - RNA, 22 nt, Human
uguguguguuuauaaaucuaaa

SEQ ID NO: 763824 - RNA, 22 nt, Human
agagacugcuuuauauuguacu

SEQ ID NO: 763825 - RNA, 22 nt, Human
gcgggggcggcgcagaccucag

SEQ ID NO: 763826 - RNA, 22 nt, Human
acaaacugaauggguuuucugu

SEQ ID NO: 763827 - RNA, 22 nt, Human
gcaccugggcaaggauucagag

SEQ ID NO: 763828 - RNA, 20 nt, Human
uucugggaauuggguagcug

SEQ ID NO: 763829 - RNA, 22 nt, Human
uggcugaggcacagcugccgcc

SEQ ID NO: 763830 - RNA, 22 nt, Human
aagaugguggccagaguggaaa

SEQ ID NO: 763831 - RNA, 20 nt, Human
uggcagaguugucccaccca

SEQ ID NO: 763832 - RNA, 22 nt, Human
aaggucacugaucaguugagua

SEQ ID NO: 763833 - RNA, 22 nt, Human
cuguuggacuuuucaaggucug

SEQ ID NO: 763834 - RNA, 22 nt, Human
uggcuccagcccugagcaagcu

SEQ ID NO: 763835 - RNA, 22 nt, Human
cugagcagaggucaagauacuu

SEQ ID NO: 763836 - RNA, 22 nt, Human
ugcuuucacuucucugcagcca

SEQ ID NO: 763837 - RNA, 22 nt, Human
ucagauuuccuguugaagaagu

SEQ ID NO: 763838 - RNA, 22 nt, Human
gaccagagaaaggcacuggaag

SEQ ID NO: 763839 - RNA, 22 nt, Human
agaggggcccgguucuccgucu

SEQ ID NO: 763840 - RNA, 22 nt, Human
uuuauaguagcaugauuuauag

SEQ ID NO: 763841 - RNA, 22 nt, Human
cugcuggggaggcgccucgacg

SEQ ID NO: 763842 - RNA, 22 nt, Human
aaucagagcccucugagcuuca

SEQ ID NO: 763843 - RNA, 22 nt, Human
aucagcugaugaauggaugaau

SEQ ID NO: 763844 - RNA, 22 nt, Human
caucccugucugccacucugaa

SEQ ID NO: 763845 - RNA, 22 nt, Human
ggcuccaaagggcagugugagg

SEQ ID NO: 763846 - RNA, 22 nt, Human
gggaccugcgccacucacuguc

SEQ ID NO: 763847 - RNA, 22 nt, Human
acauuuaacccucagguuucug

SEQ ID NO: 763848 - RNA, 22 nt, Human
uguugaagauaaaguucucauu

SEQ ID NO: 763849 - RNA, 22 nt, Human
ugggagcaaaugacugggagau

SEQ ID NO: 763850 - RNA, 22 nt, Human
ucugugugcccaccugacaccu

SEQ ID NO: 763851 - RNA, 22 nt, Human
uacuguuauauauagcagcagu

SEQ ID NO: 763852 - RNA, 22 nt, Human
agaggagguccuuuucugaugu

SEQ ID NO: 763853 - RNA, 22 nt, Human
aagagcuggaguuugcagcccu

SEQ ID NO: 763854 - RNA, 22 nt, Human
caccaugcuugauuuguaaugu

SEQ ID NO: 763855 - RNA, 22 nt, Human
uccugggacucaacuuagaagg

SEQ ID NO: 763856 - RNA, 22 nt, Human
ucauacauucagcagauauuug

SEQ ID NO: 763857 - RNA, 22 nt, Human
ggaaacuuguuauuguauuuuc

SEQ ID NO: 763858 - RNA, 22 nt, Human
auuuaacaagacagagaacugg

SEQ ID NO: 763859 - RNA, 22 nt, Human
augggcugaggugggauagaag

SEQ ID NO: 763860 - RNA, 22 nt, Human
aaacucucuuuucuucaguagg

SEQ ID NO: 763861 - RNA, 22 nt, Human
aacugcuugaugaagcucccac

SEQ ID NO: 763862 - RNA, 22 nt, Human
uucauuugggaugagucagaag

SEQ ID NO: 763863 - RNA, 22 nt, Human
auuccagugugcuuccuugcua

SEQ ID NO: 763864 - RNA, 22 nt, Human
ccagcucuagccccauguggcu

SEQ ID NO: 763865 - RNA, 22 nt, Human
ggcuuugcaaaaucggcuucug

SEQ ID NO: 763866 - RNA, 23 nt, Human
caucaaguacuuuugacaagugu

SEQ ID NO: 763867 - RNA, 22 nt, Human
aagaacauaaacagaaggacag

SEQ ID NO: 763868 - RNA, 19 nt, Human
uuucucucccucaucccga

SEQ ID NO: 763869 - RNA, 22 nt, Human
uggucucuccaugcccuccacc

SEQ ID NO: 763870 - RNA, 22 nt, Human
gaagagcugugauucaggcuua

SEQ ID NO: 763871 - RNA, 21 nt, Human
cagugagguccccagccuagg

SEQ ID NO: 763872 - RNA, 20 nt, Human
uguuuacucuagaggguaga

SEQ ID NO: 763873 - RNA, 22 nt, Human
gcauugguuaagagcuuugggg

SEQ ID NO: 763874 - RNA, 22 nt, Human
caagaagcccuuccugggugga

SEQ ID NO: 763875 - RNA, 22 nt, Human
cugccccucgaccaagcgcguc

SEQ ID NO: 763876 - RNA, 23 nt, Human
uucauugagcuguucuugaggau

SEQ ID NO: 763877 - RNA, 22 nt, Human
ucacuggauuaguuugaacugu

SEQ ID NO: 763878 - RNA, 22 nt, Human
aacauucuuuagcucuuccugc

SEQ ID NO: 763879 - RNA, 22 nt, Human
gcaggcugauagaggauuccau

SEQ ID NO: 763880 - RNA, 22 nt, Human
guacaauuaagugcacaaauag

SEQ ID NO: 763881 - RNA, 22 nt, Human
uggccugggucacaccaggguc

SEQ ID NO: 763882 - RNA, 22 nt, Human
ggcugcccucgucuacugccca

SEQ ID NO: 763883 - RNA, 23 nt, Human
uuucagaagugguccuaggaagc

SEQ ID NO: 763884 - RNA, 22 nt, Human
augucugauaaauaaugcauaa

SEQ ID NO: 763885 - RNA, 22 nt, Human
aacuaaaguaaccaaggauauc

SEQ ID NO: 763886 - RNA, 22 nt, Human
agaaaauuuaaagagacacaca

SEQ ID NO: 763887 - RNA, 22 nt, Human
uccagcucuaacaugcugggcc

SEQ ID NO: 763888 - RNA, 22 nt, Human
cagcaccuguuagcauuaaaua

SEQ ID NO: 763889 - RNA, 22 nt, Human
gcaguguucagugaagcaggag

SEQ ID NO: 763890 - RNA, 21 nt, Human
gaggaaugguuugcaaagcac

SEQ ID NO: 763891 - RNA, 22 nt, Human
cuucugggcauggcagagccug

SEQ ID NO: 763892 - RNA, 21 nt, Human
cuggagucauuuucugaguag

SEQ ID NO: 763893 - RNA, 22 nt, Human
cugcccaaauccuucuuccucu

SEQ ID NO: 763894 - RNA, 23 nt, Human
ggauggagccacuuugaaaccac

SEQ ID NO: 763895 - RNA, 22 nt, Human
gucugggcucccagggucggcg

SEQ ID NO: 763896 - RNA, 22 nt, Human
uccccacucucuccuggagcuu

SEQ ID NO: 763897 - RNA, 22 nt, Human
uucuccagaguuucucucacug

SEQ ID NO: 763898 - RNA, 22 nt, Human
uauuuuguuuuguauccacugu

SEQ ID NO: 763899 - RNA, 22 nt, Human
aguccauacauugagaauaaca

SEQ ID NO: 763900 - RNA, 22 nt, Human
gcucucugggugugucuagaua

SEQ ID NO: 763901 - RNA, 22 nt, Human
uaugaaauugccauuuuuaugg

SEQ ID NO: 763902 - RNA, 22 nt, Human
ucucugcucaggcaccagcccu

SEQ ID NO: 763903 - RNA, 22 nt, Human
aacugcuguggccuaguacuua

SEQ ID NO: 763904 - RNA, 22 nt, Human
uugugcagaguugccuuuauuu

SEQ ID NO: 763905 - RNA, 22 nt, Human
gagugggggguccgucucagug

SEQ ID NO: 763906 - RNA, 22 nt, Human
uaaccugaggagaacagugcuu

SEQ ID NO: 763907 - RNA, 22 nt, Human
uuauucucaucucccuacuuag

SEQ ID NO: 763908 - RNA, 23 nt, Human
gcuuccagaagacucauugacau

SEQ ID NO: 763909 - RNA, 22 nt, Human
uucucauucugacucaguguag

SEQ ID NO: 763910 - RNA, 22 nt, Human
guggcucacagcaauguuuccu

SEQ ID NO: 763911 - RNA, 22 nt, Human
gaacacugggguaucauugagc

SEQ ID NO: 763912 - RNA, 22 nt, Human
gaccuggauucaaauucagacu

SEQ ID NO: 763913 - RNA, 22 nt, Human
aaucagaccguucuggcugucc

SEQ ID NO: 763914 - RNA, 22 nt, Human
uagcaaaggccuuggacacgcu

SEQ ID NO: 763915 - RNA, 22 nt, Human
cucagcucugucacuuacuagc

SEQ ID NO: 763916 - RNA, 22 nt, Human
gaggguccuggcuaagucugac

SEQ ID NO: 763917 - RNA, 22 nt, Human
gcugggcucauuugugugucug

SEQ ID NO: 763918 - RNA, 22 nt, Human
uugggguaaggaaauauggcuu

SEQ ID NO: 763919 - RNA, 22 nt, Human
uggagccagagcgcagccuggg

SEQ ID NO: 763920 - RNA, 22 nt, Human
ggcucaggggccaggccugucc

SEQ ID NO: 763921 - RNA, 22 nt, Human
cagcuaggaaaccagagggcag

SEQ ID NO: 763922 - RNA, 22 nt, Human
uuccuggccucucucugagcag

SEQ ID NO: 763923 - RNA, 22 nt, Human
gagggacagcuaaagagaaauu

SEQ ID NO: 763924 - RNA, 22 nt, Human
auacauguuugcuggauaaaca

SEQ ID NO: 763925 - RNA, 22 nt, Human
uauuguuucuggcuguggcagc

SEQ ID NO: 763926 - RNA, 22 nt, Human
cagcuauuuugccuaucauggu

SEQ ID NO: 763927 - RNA, 22 nt, Human
gaacuuuaaaacaaaguacagu

SEQ ID NO: 763928 - RNA, 22 nt, Human
ucaaugaaagagcaugcauuuu

SEQ ID NO: 763929 - RNA, 22 nt, Human
ucugaaggucugagaaccagga

SEQ ID NO: 763930 - RNA, 22 nt, Human
uacacuaaaucuucaucuuuua

SEQ ID NO: 763931 - RNA, 22 nt, Human
cccugggacccgcugcagaggc

SEQ ID NO: 763932 - RNA, 22 nt, Human
caggagagcccggguccgggcu

SEQ ID NO: 763933 - RNA, 22 nt, Human
uuaggaaucaaauuccgaaagg

SEQ ID NO: 763934 - RNA, 22 nt, Human
ucuggagcuggagggcaaggca

SEQ ID NO: 763935 - RNA, 22 nt, Human
uucuaaacggcuucacaggaau

SEQ ID NO: 763936 - RNA, 22 nt, Human
uguuucaugauugcugucauuu

SEQ ID NO: 763937 - RNA, 22 nt, Human
ugcacgugggcucucugcucuu

SEQ ID NO: 763938 - RNA, 22 nt, Human
uugcuaaguuauagaguaucuu

SEQ ID NO: 763939 - RNA, 22 nt, Human
cuggcuggcaaguagaacacaa

SEQ ID NO: 763940 - RNA, 22 nt, Human
acaaaugacucaaacaccacuu

SEQ ID NO: 763941 - RNA, 22 nt, Human
aauaucuggagaugcuuuuugu

SEQ ID NO: 763942 - RNA, 22 nt, Human
cagacugugagcuccuugaggg

SEQ ID NO: 763943 - RNA, 22 nt, Human
uuuagacuaauuccuaaagggc

SEQ ID NO: 763944 - RNA, 22 nt, Human
uaucuguucauguuuauauguc

SEQ ID NO: 763945 - RNA, 22 nt, Human
aagagaagaaagugucuacaca

SEQ ID NO: 763946 - RNA, 22 nt, Human
uaauuucacugauaugaaguca

SEQ ID NO: 763947 - RNA, 22 nt, Human
uaugugcacauuagagagaugg

SEQ ID NO: 763948 - RNA, 22 nt, Human
cccaggauggggcugcaguuau

SEQ ID NO: 763949 - RNA, 22 nt, Human
uaagcucacuguaagaacugau

SEQ ID NO: 763950 - RNA, 22 nt, Human
ccagcucccgcaggcugcacag

SEQ ID NO: 763951 - RNA, 22 nt, Human
cagcaugaauguguucguaggg

SEQ ID NO: 763952 - RNA, 23 nt, Human
ccaagacuguuaggaguggggag

SEQ ID NO: 763953 - RNA, 22 nt, Human
ccuggaaguuggagguugcagu

SEQ ID NO: 763954 - RNA, 22 nt, Human
cagagaaaaaauccugcucuca

SEQ ID NO: 763955 - RNA, 22 nt, Human
aaagcaauuuaauggaccauga

SEQ ID NO: 763956 - RNA, 22 nt, Human
gagagaacacaaagggccagcu

SEQ ID NO: 763957 - RNA, 22 nt, Human
ccuggugcuuaccagagcuuuu

SEQ ID NO: 763958 - RNA, 22 nt, Human
acaauguucuacauauacauaa

SEQ ID NO: 763959 - RNA, 17 nt, Human
agcuccugcccauggcu

SEQ ID NO: 763960 - RNA, 22 nt, Human
agaagccagauuguagugggac

SEQ ID NO: 763961 - RNA, 22 nt, Human
uuugaaaccuaguuauaugacu

SEQ ID NO: 763962 - RNA, 22 nt, Human
augagagacaggaacgagcugg

SEQ ID NO: 763963 - RNA, 21 nt, Human
cccuguguuccacagcagaca

SEQ ID NO: 763964 - RNA, 22 nt, Human
cuagcuucaaguccuggcugug

SEQ ID NO: 763965 - RNA, 22 nt, Human
uugagaaaaccaucguaagaau

SEQ ID NO: 763966 - RNA, 22 nt, Human
ggcaggcgugguggccucagaa

SEQ ID NO: 763967 - RNA, 20 nt, Human
cugggccauccuuuuacaau

SEQ ID NO: 763968 - RNA, 22 nt, Human
uugcaucauuuccuggccgugu

SEQ ID NO: 763969 - RNA, 22 nt, Human
uccaggccuaggccaagugauu

SEQ ID NO: 763970 - RNA, 22 nt, Human
uuggcccuagacucuaaguccg

SEQ ID NO: 763971 - RNA, 20 nt, Human
uaugauaauuacaaaauagu

SEQ ID NO: 763972 - RNA, 22 nt, Human
cagcagcugcaaauggaaacag

SEQ ID NO: 763973 - RNA, 22 nt, Human
uccaugugccaaggggcagagg

SEQ ID NO: 763974 - RNA, 22 nt, Human
cuuuagacaucucauuguguaa

SEQ ID NO: 763975 - RNA, 22 nt, Human
gcaggauugggcugaaggagug

SEQ ID NO: 763976 - RNA, 22 nt, Human
caggaagcaagugauuuucuug

SEQ ID NO: 763977 - RNA, 22 nt, Human
gaaacuugauaauugaaacaga

SEQ ID NO: 763978 - RNA, 22 nt, Human
gaaauugucugugcccaagucu

SEQ ID NO: 763979 - RNA, 22 nt, Human
ugacuuugugcaagugaauuau

SEQ ID NO: 763980 - RNA, 22 nt, Human
uuuccucuucuggcaggcaggg

SEQ ID NO: 763981 - RNA, 22 nt, Human
ccauagugaauugucucagacg

SEQ ID NO: 763982 - RNA, 22 nt, Human
acugaggcuuacaaagguaaag

SEQ ID NO: 763983 - RNA, 22 nt, Human
aaauagcauaaaauaggaagcu

SEQ ID NO: 763984 - RNA, 22 nt, Human
aaagcugccaaggagaauacua

SEQ ID NO: 763985 - RNA, 22 nt, Human
ucagaacaauugggaaccauua

SEQ ID NO: 763986 - RNA, 22 nt, Human
agugaaauacugucguuuuuag

SEQ ID NO: 763987 - RNA, 22 nt, Human
acccaggcuggaaugcaguggc

SEQ ID NO: 763988 - RNA, 22 nt, Human
acccaggcuggagugcagugac

SEQ ID NO: 763989 - RNA, 22 nt, Human
cuggagauaagcagucccaggc

SEQ ID NO: 763990 - RNA, 22 nt, Human
acauucugugagucauguuuua

SEQ ID NO: 763991 - RNA, 22 nt, Human
caugucagggaagagagucagu

SEQ ID NO: 763992 - RNA, 22 nt, Human
uguggucuccccagugccagcu

SEQ ID NO: 763993 - RNA, 22 nt, Human
uugccaggagcucaucugaggg

SEQ ID NO: 763994 - RNA, 22 nt, Human
cuguggcugcagccuugguccu

SEQ ID NO: 763995 - RNA, 22 nt, Human
cacauuuagagguuagcauggu

SEQ ID NO: 763996 - RNA, 22 nt, Human
gaagccuggagaccagauguug

SEQ ID NO: 763997 - RNA, 22 nt, Human
guuaguuugaacuugucuaugu

SEQ ID NO: 763998 - RNA, 22 nt, Human
uauuuggagccuauccauagau

SEQ ID NO: 763999 - RNA, 22 nt, Human
acauccaucuuaugagauaggu

SEQ ID NO: 764000 - RNA, 22 nt, Human
ugugaggccucugcaggagcag

SEQ ID NO: 764001 - RNA, 22 nt, Human
ucauggcuggaagcucaguuag

SEQ ID NO: 764002 - RNA, 19 nt, Human
ucuuuagccagagcucugg

SEQ ID NO: 764003 - RNA, 22 nt, Human
cugcugugauugggagaaaccg

SEQ ID NO: 764004 - RNA, 22 nt, Human
uuuccugucuuuugugaaggau

SEQ ID NO: 764005 - RNA, 22 nt, Human
uuauucagauuggcuacaggau

SEQ ID NO: 764006 - RNA, 22 nt, Human
cacugcuuaguugguaaaugug

SEQ ID NO: 764007 - RNA, 22 nt, Human
agcaucuggucaugagugagaa

SEQ ID NO: 764008 - RNA, 22 nt, Human
ggccagagagccgcuguuagga

SEQ ID NO: 764009 - RNA, 22 nt, Human
acacuuuaucucaucucagaca

SEQ ID NO: 764010 - RNA, 21 nt, Human
gagcuguuacucucucuggag

SEQ ID NO: 764011 - RNA, 22 nt, Human
auuauucuugagguguuuauug

SEQ ID NO: 764012 - RNA, 18 nt, Human
ucacucauagacaucuau

SEQ ID NO: 764013 - RNA, 22 nt, Human
agaggcuaggaccauguaucau

SEQ ID NO: 764014 - RNA, 22 nt, Human
ucucugaagagucagacauaac

SEQ ID NO: 764015 - RNA, 22 nt, Human
caggggccggcuguccgugccc

SEQ ID NO: 764016 - RNA, 22 nt, Human
agaaggcaucagaaguguguag

SEQ ID NO: 764017 - RNA, 22 nt, Human
uucaaagauuuucccaaagcuc

SEQ ID NO: 764018 - RNA, 22 nt, Human
uguauuaugauuguuguucaug

SEQ ID NO: 764019 - RNA, 22 nt, Human
uggucaaaccaguuaucuguaa

SEQ ID NO: 764020 - RNA, 22 nt, Human
acuguuuaaaggcuuccuuucu

SEQ ID NO: 764021 - RNA, 22 nt, Human
aaucuauaugcuuuucacauac

SEQ ID NO: 764022 - RNA, 22 nt, Human
aaagggcugucaaauaagcaac

SEQ ID NO: 764023 - RNA, 22 nt, Human
uguuagaauauuguaauauucg

SEQ ID NO: 764024 - RNA, 22 nt, Human
agccugagccccauccagcuga

SEQ ID NO: 764025 - RNA, 22 nt, Human
caucugaauaaagacuugcaga

SEQ ID NO: 764026 - RNA, 22 nt, Human
acaugaaacuguugcauuagaa

SEQ ID NO: 764027 - RNA, 22 nt, Human
gacuacaggccggcaucagaga

SEQ ID NO: 764028 - RNA, 22 nt, Human
ccugggagguggauguugcggu

SEQ ID NO: 764029 - RNA, 22 nt, Human
ucugugcccucggugcugggcc

SEQ ID NO: 764030 - RNA, 22 nt, Human
caagauggguguugugaugguu

SEQ ID NO: 764031 - RNA, 22 nt, Human
uuacuggcugggccugagggcu

SEQ ID NO: 764032 - RNA, 21 nt, Human
uaaaacuguaacuuuguccug

SEQ ID NO: 764033 - RNA, 22 nt, Human
agcagggcugcggccccaccac

SEQ ID NO: 764034 - RNA, 22 nt, Human
uguuaaaaccacaggugaggac

SEQ ID NO: 764035 - RNA, 22 nt, Human
gacaaagucaacaguacucuca

SEQ ID NO: 764036 - RNA, 22 nt, Human
uagugcaggguuuuaagcacug

SEQ ID NO: 764037 - RNA, 21 nt, Human
ugcauaaagaaauacaaauac

SEQ ID NO: 764038 - RNA, 21 nt, Human
uucugggaaaugagcuggggc

SEQ ID NO: 764039 - RNA, 22 nt, Human
ugguagggacacuaugcagaaa

SEQ ID NO: 764040 - RNA, 22 nt, Human
uuaaaagggauguuaucuguaa

SEQ ID NO: 764041 - RNA, 22 nt, Human
aucagaaggggagguaaagaag

SEQ ID NO: 764042 - RNA, 22 nt, Human
uauaucauggagauuaacauuc

SEQ ID NO: 764043 - RNA, 22 nt, Human
auucuaauggcagagacuccug

SEQ ID NO: 764044 - RNA, 22 nt, Human
ucacauuuuaucuauuuuaagu

SEQ ID NO: 764045 - RNA, 22 nt, Human
ggcuuuaacagcagcuuugcug

SEQ ID NO: 764046 - RNA, 22 nt, Human
cuggugcuggcaacagaguagg

SEQ ID NO: 764047 - RNA, 22 nt, Human
auucuaguguuuccauuacaag

SEQ ID NO: 764048 - RNA, 23 nt, Human
ucucuuucaagagcuuaaugugc

SEQ ID NO: 764049 - RNA, 17 nt, Human
acaagcaguggccaugg

SEQ ID NO: 764050 - RNA, 22 nt, Human
cagcugcuguaacagaauacuu

SEQ ID NO: 764051 - RNA, 22 nt, Human
ccacaugugcacugcuguaugg

SEQ ID NO: 764052 - RNA, 22 nt, Human
ggcccaucucuugcucuggguu

SEQ ID NO: 764053 - RNA, 22 nt, Human
ggcagggguccugguguugacu

SEQ ID NO: 764054 - RNA, 22 nt, Human
uuauuccaauuucuccuacaaa

SEQ ID NO: 764055 - RNA, 17 nt, Human
aaucuguuuacagucag

SEQ ID NO: 764056 - RNA, 18 nt, Human
acucaaggguggagagaa

SEQ ID NO: 764057 - RNA, 22 nt, Human
aagaguuuucuauaaucuuggc

SEQ ID NO: 764058 - RNA, 22 nt, Human
cucugucagaguguugucccca

SEQ ID NO: 764059 - RNA, 22 nt, Human
ucaguaacuuacuuauucaccu

SEQ ID NO: 764060 - RNA, 22 nt, Human
ccaggcuggucugaauuucuag

SEQ ID NO: 764061 - RNA, 22 nt, Human
cugccagcagaggccagcgcug

SEQ ID NO: 764062 - RNA, 22 nt, Human
ugugggaugguuuugccagaau

SEQ ID NO: 764063 - RNA, 22 nt, Human
auguuuccagguucuuccuaug

SEQ ID NO: 764064 - RNA, 22 nt, Human
ugcaagggugacagguugcucu

SEQ ID NO: 764065 - RNA, 22 nt, Human
augcacagaaaaauugcuuacu

SEQ ID NO: 764066 - RNA, 22 nt, Human
gggagcugaucagguggauuca

SEQ ID NO: 764067 - RNA, 22 nt, Human
aacuaucacaaacagagugucu

SEQ ID NO: 764068 - RNA, 22 nt, Human
gaagcacagauaauucaaguau

SEQ ID NO: 764069 - RNA, 22 nt, Human
uuucuagcugacaaaaauguuu

SEQ ID NO: 764070 - RNA, 23 nt, Human
ucuugaaaagccuacagcaguuc

SEQ ID NO: 764071 - RNA, 22 nt, Human
auaugaaaagaagucaccauug

SEQ ID NO: 764072 - RNA, 22 nt, Human
ucugugcuagaggaguuggcca

SEQ ID NO: 764073 - RNA, 22 nt, Human
auaugagaguaaaugccgaucu

SEQ ID NO: 764074 - RNA, 22 nt, Human
ugugcaguucaaacccguguug

SEQ ID NO: 764075 - RNA, 22 nt, Human
aauacugaauuaguugagacaa

SEQ ID NO: 764076 - RNA, 21 nt, Human
agcugcccagaguagggaagg

SEQ ID NO: 764077 - RNA, 22 nt, Human
ucuaagccuguguccucugcag

SEQ ID NO: 764078 - RNA, 22 nt, Human
gagaggcugauccugcagagaa

SEQ ID NO: 764079 - RNA, 21 nt, Human
uauacaugugcacacacaugc

SEQ ID NO: 764080 - RNA, 22 nt, Human
aguuucucuuaaucuaguaucu

SEQ ID NO: 764081 - RNA, 22 nt, Human
uggcugaggagagggcggaagu

SEQ ID NO: 764082 - RNA, 22 nt, Human
uggcauggcauuuagagaauua

SEQ ID NO: 764083 - RNA, 22 nt, Human
uaguccagaaacugagcuuaua

SEQ ID NO: 764084 - RNA, 22 nt, Human
ucccuggcugggggcugccuug

SEQ ID NO: 764085 - RNA, 20 nt, Human
aucuccugcuaccacccauu

SEQ ID NO: 764086 - RNA, 22 nt, Human
ugccucugccuccauuguuagu

SEQ ID NO: 764087 - RNA, 22 nt, Human
uggcaggaucuuugagagugaa

SEQ ID NO: 764088 - RNA, 22 nt, Human
cuguaaaacacuguaguaucug

SEQ ID NO: 764089 - RNA, 21 nt, Human
aguguccuugaucuugccuug

SEQ ID NO: 764090 - RNA, 23 nt, Human
uaauuagauguugauuccugaga

SEQ ID NO: 764091 - RNA, 22 nt, Human
ucaggagcagggggaagcucug

SEQ ID NO: 764092 - RNA, 22 nt, Human
ccagcuggggaaguggggcaua

SEQ ID NO: 764093 - RNA, 22 nt, Human
uguguauguguauacacuauau

SEQ ID NO: 764094 - RNA, 22 nt, Human
aucuacaggcugaggugggagg

SEQ ID NO: 764095 - RNA, 22 nt, Human
aauagacuccagggucuauuuu

SEQ ID NO: 764096 - RNA, 22 nt, Human
ggguaggaaauccagagguggc

SEQ ID NO: 764097 - RNA, 22 nt, Human
ucaaaugcaggucuggucuugg

SEQ ID NO: 764098 - RNA, 20 nt, Human
acaugcaguggucauuucag

SEQ ID NO: 764099 - RNA, 22 nt, Human
aaugccuuggagagccuagagg

SEQ ID NO: 764100 - RNA, 22 nt, Human
uauguuucauucuuuucuggua

SEQ ID NO: 764101 - RNA, 22 nt, Human
aggcaaauugugagaaaaugaa

SEQ ID NO: 764102 - RNA, 22 nt, Human
cuguggagaugcagaccaggcc

SEQ ID NO: 764103 - RNA, 22 nt, Human
auggcccucaguccuuccuugg

SEQ ID NO: 764104 - RNA, 22 nt, Human
ugaaauucaaaacacauuuguc

SEQ ID NO: 764105 - RNA, 22 nt, Human
cagugccauauugaaagacauu

SEQ ID NO: 764106 - RNA, 22 nt, Human
gugagggcagcuuggucagugu

SEQ ID NO: 764107 - RNA, 22 nt, Human
uaggaauuaugaugcuaucaag

SEQ ID NO: 764108 - RNA, 22 nt, Human
aggcuggcauacauuuguucuu

SEQ ID NO: 764109 - RNA, 22 nt, Human
cagagcaggcccacugcccucc

SEQ ID NO: 764110 - RNA, 22 nt, Human
uggcaugaagucagcagcuggg

SEQ ID NO: 764111 - RNA, 22 nt, Human
auugcagggaggcagguagaug

SEQ ID NO: 764112 - RNA, 22 nt, Human
cgcugcagaagcguguucagga

SEQ ID NO: 764113 - RNA, 22 nt, Human
gagcuuaggccagggacaggga

SEQ ID NO: 764114 - RNA, 22 nt, Human
agcacaggaccaaggaagcugu

SEQ ID NO: 764115 - RNA, 22 nt, Human
ccugugggaggggccuggcgcg

SEQ ID NO: 764116 - RNA, 22 nt, Human
cuuaacagauacaucugugguu

SEQ ID NO: 764117 - RNA, 22 nt, Human
aggcucagauucacauuugguu

SEQ ID NO: 764118 - RNA, 22 nt, Human
uccagccaacugccuagggagc

SEQ ID NO: 764119 - RNA, 22 nt, Human
agaacacauagagaaguuuuau

SEQ ID NO: 764120 - RNA, 22 nt, Human
uccugagcccuggggucagugu

SEQ ID NO: 764121 - RNA, 18 nt, Human
uugaauucuucuacaugu

SEQ ID NO: 764122 - RNA, 22 nt, Human
ucaggaagcugaauuacaaaaa

SEQ ID NO: 764123 - RNA, 22 nt, Human
agagcugugcuuugcaccacgu

SEQ ID NO: 764124 - RNA, 22 nt, Human
ugggaugaggccucuguuguga

SEQ ID NO: 764125 - RNA, 22 nt, Human
accaggaggcuacacuguccca

SEQ ID NO: 764126 - RNA, 22 nt, Human
gcauccagucuuggcuccugga

SEQ ID NO: 764127 - RNA, 22 nt, Human
agguuucugcaauguguguaca

SEQ ID NO: 764128 - RNA, 22 nt, Human
auguccuuccauuuugaucugu

SEQ ID NO: 764129 - RNA, 22 nt, Human
caggaaauucaagagaggcugc

SEQ ID NO: 764130 - RNA, 22 nt, Human
uugaacucuggacccaugccag

SEQ ID NO: 764131 - RNA, 22 nt, Human
gugccaggugcuaagcugugcu

SEQ ID NO: 764132 - RNA, 21 nt, Human
gaaugucugccuucacaauga

SEQ ID NO: 764133 - RNA, 22 nt, Human
ugcagagcuucauugcauaggc

SEQ ID NO: 764134 - RNA, 22 nt, Human
auuauuugaguuccucucuacc

SEQ ID NO: 764135 - RNA, 22 nt, Human
gucuguccagcaacacaggagu

SEQ ID NO: 764136 - RNA, 22 nt, Human
agggucaguagugaugcgugaa

SEQ ID NO: 764137 - RNA, 22 nt, Human
uccucugcuguucugguucuuu

SEQ ID NO: 764138 - RNA, 22 nt, Human
auuuucuauucugcugguuuag

SEQ ID NO: 764139 - RNA, 22 nt, Human
cuuuacuaucaggaauaaacaa

SEQ ID NO: 764140 - RNA, 22 nt, Human
cuccagugcugucaucccuucc

SEQ ID NO: 764141 - RNA, 22 nt, Human
agaacagcaguuaugguucauu

SEQ ID NO: 764142 - RNA, 22 nt, Human
agaaacaucauuguuugguauu

SEQ ID NO: 764143 - RNA, 22 nt, Human
uuuuagaaucagguugucuggg

SEQ ID NO: 764144 - RNA, 22 nt, Human
agcuggaggaguuucuccuagc

SEQ ID NO: 764145 - RNA, 22 nt, Human
gggcuuggguauugugagaggu

SEQ ID NO: 764146 - RNA, 22 nt, Human
ucuggagaagaaacuugcucug

SEQ ID NO: 764147 - RNA, 22 nt, Human
ucugccagcaccaugauccuuc

SEQ ID NO: 764148 - RNA, 22 nt, Human
ugcagggacaggcucuggggau

SEQ ID NO: 764149 - RNA, 22 nt, Human
gcaaagacccaggugucuaucc

SEQ ID NO: 764150 - RNA, 22 nt, Human
acaaagugcugacauuacaggc

SEQ ID NO: 764151 - RNA, 22 nt, Human
acaggugauucaggcucuggga

SEQ ID NO: 764152 - RNA, 22 nt, Human
ugucuuuagaaagaagcagaca

SEQ ID NO: 764153 - RNA, 22 nt, Human
uauuguaucuuaccacauguau

SEQ ID NO: 764154 - RNA, 22 nt, Human
ucugucugcuucacuugcauuu

SEQ ID NO: 764155 - RNA, 22 nt, Human
uaauugaaaucauuucaauuca

SEQ ID NO: 764156 - RNA, 22 nt, Human
uggugcagguguugaugcagga

SEQ ID NO: 764157 - RNA, 22 nt, Human
guuuaaaguagcuuccuuuugg

SEQ ID NO: 764158 - RNA, 22 nt, Human
ucccucagcuugucuccaugca

SEQ ID NO: 764159 - RNA, 22 nt, Human
auaacagaugugaagugcuaau

SEQ ID NO: 764160 - RNA, 22 nt, Human
uagagcagccuucagagcaguu

SEQ ID NO: 764161 - RNA, 22 nt, Human
cagcugugucuaauuauggcug

SEQ ID NO: 764162 - RNA, 22 nt, Human
aggcaaggugcucuugcucuau

SEQ ID NO: 764163 - RNA, 22 nt, Human
aggcugugggguucugcuuuca

SEQ ID NO: 764164 - RNA, 22 nt, Human
cccagagaugggaggugaucgg

SEQ ID NO: 764165 - RNA, 23 nt, Human
ggccuguguuuugucugaaguac

SEQ ID NO: 764166 - RNA, 22 nt, Human
uggcagugaagcugucuuuagg

SEQ ID NO: 764167 - RNA, 22 nt, Human
ggcucuggcuacuccacccugu

SEQ ID NO: 764168 - RNA, 22 nt, Human
ucagaaagguugagucaugugc

SEQ ID NO: 764169 - RNA, 22 nt, Human
aggcugugaagguuaaagacga

SEQ ID NO: 764170 - RNA, 22 nt, Human
acugauuacacgaguucugacu

SEQ ID NO: 764171 - RNA, 22 nt, Human
gcagggccagguacaagaagca

SEQ ID NO: 764172 - RNA, 22 nt, Human
ugcugggcacacaguaggugcu

SEQ ID NO: 764173 - RNA, 22 nt, Human
gcccuggaugcucauggcauca

SEQ ID NO: 764174 - RNA, 22 nt, Human
ccucugggccuggaagggcagu

SEQ ID NO: 764175 - RNA, 22 nt, Human
auacuuuuaauuccuucugagu

SEQ ID NO: 764176 - RNA, 21 nt, Human
augucaaaugcuuuauuuuau

SEQ ID NO: 764177 - RNA, 22 nt, Human
gauuuauugucccuguccugcu

SEQ ID NO: 764178 - RNA, 22 nt, Human
aaguggcucauguggcuucugc

SEQ ID NO: 764179 - RNA, 22 nt, Human
uucucuuuucaccaguugcuaa

SEQ ID NO: 764180 - RNA, 22 nt, Human
ucugaaauggcagcgggaauga

SEQ ID NO: 764181 - RNA, 22 nt, Human
uuuucaguuugcacugcagugc

SEQ ID NO: 764182 - RNA, 22 nt, Human
ucaggcuuuuucucaaccucuu

SEQ ID NO: 764183 - RNA, 22 nt, Human
caaugaaauugagauccagaga

SEQ ID NO: 764184 - RNA, 22 nt, Human
cugugcccuuucgcugcacugu

SEQ ID NO: 764185 - RNA, 22 nt, Human
cugugacugcagcaccaaguaa

SEQ ID NO: 764186 - RNA, 22 nt, Human
agagccaggacugugucucacu

SEQ ID NO: 764187 - RNA, 22 nt, Human
aagaugaaucaguauguguccu

SEQ ID NO: 764188 - RNA, 22 nt, Human
ugaugaggggcucagaggucag

SEQ ID NO: 764189 - RNA, 22 nt, Human
cacagcagaacuuaauuucaaa

SEQ ID NO: 764190 - RNA, 22 nt, Human
ucaguccucucuggguuucuua

SEQ ID NO: 764191 - RNA, 22 nt, Human
aagugucuagcaccuggaugca

SEQ ID NO: 764192 - RNA, 22 nt, Human
guauuuguaguagcauagaauu

SEQ ID NO: 764193 - RNA, 22 nt, Human
uccuggccagaggacaaagcug

SEQ ID NO: 764194 - RNA, 22 nt, Human
gcuucuccucccgcucccaggc

SEQ ID NO: 764195 - RNA, 22 nt, Human
ccaggcagucaggguugugugu

SEQ ID NO: 764196 - RNA, 22 nt, Human
uauggcuuuuggcuucucucug

SEQ ID NO: 764197 - RNA, 22 nt, Human
gggcugugugcaguacgggucc

SEQ ID NO: 764198 - RNA, 22 nt, Human
gacuugggugucggggcagucu

SEQ ID NO: 764199 - RNA, 22 nt, Human
agacccuggggaaagucacuuc

SEQ ID NO: 764200 - RNA, 22 nt, Human
gcucugugccagggcugggcca

SEQ ID NO: 764201 - RNA, 22 nt, Human
uggcagauaaacaugugauaaa

SEQ ID NO: 764202 - RNA, 22 nt, Human
aggauggauucuguauguggga

SEQ ID NO: 764203 - RNA, 22 nt, Human
aggaauugagauccuagguuuu

SEQ ID NO: 764204 - RNA, 20 nt, Human
aggaagccaaaggcugucuu

SEQ ID NO: 764205 - RNA, 22 nt, Human
ugcaggaaaaccaacacgccuu

SEQ ID NO: 764206 - RNA, 22 nt, Human
cagcuucaacugcacagucaac

SEQ ID NO: 764207 - RNA, 22 nt, Human
cugagaacaucauucagauauu

SEQ ID NO: 764208 - RNA, 22 nt, Human
ucuggcccagccccugagguca

SEQ ID NO: 764209 - RNA, 22 nt, Human
uuccagaguauugguagcuaua

SEQ ID NO: 764210 - RNA, 22 nt, Human
ccuuuagaugaucucuuggaca

SEQ ID NO: 764211 - RNA, 22 nt, Human
caggccccauuccucuugggac

SEQ ID NO: 764212 - RNA, 22 nt, Human
caggcacugugcaagggucucg

SEQ ID NO: 764213 - RNA, 22 nt, Human
uguacagauaaagacuguaaau

SEQ ID NO: 764214 - RNA, 22 nt, Human
ggccuugguaaagggaugcaug

SEQ ID NO: 764215 - RNA, 22 nt, Human
gugugccaacaaaagacagugc

SEQ ID NO: 764216 - RNA, 22 nt, Human
gacacagguagaauaaaguacu

SEQ ID NO: 764217 - RNA, 22 nt, Human
auggcucauuuaucuugcagcc

SEQ ID NO: 764218 - RNA, 22 nt, Human
augagaaugcauucauguuuug

SEQ ID NO: 764219 - RNA, 22 nt, Human
ccagggugaggaggcucccacg

SEQ ID NO: 764220 - RNA, 22 nt, Human
aagacuuucccucaucagaacg

SEQ ID NO: 764221 - RNA, 19 nt, Human
agacaaguuuccagaagcc

SEQ ID NO: 764222 - RNA, 22 nt, Human
acaugcaaaaauauauuuauga

SEQ ID NO: 764223 - RNA, 20 nt, Human
cagcuuggaugagaggcuga

SEQ ID NO: 764224 - RNA, 22 nt, Human
ugcaugcaaagugucugcuuug

SEQ ID NO: 764225 - RNA, 22 nt, Human
ugucuuuuaccuaaugagcugg

SEQ ID NO: 764226 - RNA, 22 nt, Human
gaaugugugacucuauugagca

SEQ ID NO: 764227 - RNA, 22 nt, Human
gguuucaacuuuugugaggaau

SEQ ID NO: 764228 - RNA, 22 nt, Human
uuuuacuuuggauacaguacuu

SEQ ID NO: 764229 - RNA, 22 nt, Human
uagcugccuuugggcuccugcu

SEQ ID NO: 764230 - RNA, 22 nt, Human
ugggcucagccuucauguggcc

SEQ ID NO: 764231 - RNA, 22 nt, Human
ugggugugccauauuccauuuc

SEQ ID NO: 764232 - RNA, 22 nt, Human
uuacagaguggucuggcuaugu

SEQ ID NO: 764233 - RNA, 22 nt, Human
uuuacaccaaaaugacacagag

SEQ ID NO: 764234 - RNA, 19 nt, Human
cagggauggguagggacuc

SEQ ID NO: 764235 - RNA, 22 nt, Human
ucagcuggcaguucagaggcug

SEQ ID NO: 764236 - RNA, 22 nt, Human
agggccacaguggggccugaga

SEQ ID NO: 764237 - RNA, 22 nt, Human
aaauaguucagccacggugacu

SEQ ID NO: 764238 - RNA, 22 nt, Human
uggcagauuuaacauuggaacu

SEQ ID NO: 764239 - RNA, 22 nt, Human
augaaaugauugaaaucuuuac

SEQ ID NO: 764240 - RNA, 22 nt, Human
caagaagcaaggucagggccca

SEQ ID NO: 764241 - RNA, 22 nt, Human
ccugggcuuugagggcaggaug

SEQ ID NO: 764242 - RNA, 22 nt, Human
cccagcuaccucugcuaggaga

SEQ ID NO: 764243 - RNA, 22 nt, Human
gggcucagucggcaagccccuu

SEQ ID NO: 764244 - RNA, 22 nt, Human
gggcggggggagcuggaaugaa

SEQ ID NO: 764245 - RNA, 22 nt, Human
gccaggcaggccacgcuguguu

SEQ ID NO: 764246 - RNA, 22 nt, Human
aaaugugucauauucaaaguca

SEQ ID NO: 764247 - RNA, 22 nt, Human
acagaccugggcacagaaagga

SEQ ID NO: 764248 - RNA, 22 nt, Human
uaaggccaggcuguggucggca

SEQ ID NO: 764249 - RNA, 22 nt, Human
caacacagccauuccccuagaa

SEQ ID NO: 764250 - RNA, 22 nt, Human
cagauguuguuccugccuguag

SEQ ID NO: 764251 - RNA, 20 nt, Human
uggaccauaaacaccaggua

SEQ ID NO: 764252 - RNA, 22 nt, Human
aaaugcuaaaugcagcaaguag

SEQ ID NO: 764253 - RNA, 22 nt, Human
ucuuuacaaucuaagcauaguu

SEQ ID NO: 764254 - RNA, 22 nt, Human
uucacagggccacuggcaggag

SEQ ID NO: 764255 - RNA, 23 nt, Human
cccuggccuuggggcacaggcug

SEQ ID NO: 764256 - RNA, 22 nt, Human
acauagcaagugcucaauaaau

SEQ ID NO: 764257 - RNA, 22 nt, Human
gaaucagauacugauuucaguc

SEQ ID NO: 764258 - RNA, 22 nt, Human
uguuuaugugugugcauauaua

SEQ ID NO: 764259 - RNA, 22 nt, Human
accacuguaucuccagcacauu

SEQ ID NO: 764260 - RNA, 22 nt, Human
aaaaauuuaugguucuucucug

SEQ ID NO: 764261 - RNA, 22 nt, Human
gcugcggucacugcgggggcug

SEQ ID NO: 764262 - RNA, 22 nt, Human
uuuuuugucuugaagaaauggu

SEQ ID NO: 764263 - RNA, 22 nt, Human
uaagcaaaagucgagugugagc

SEQ ID NO: 764264 - RNA, 22 nt, Human
uagcccaggcuggagggcagug

SEQ ID NO: 764265 - RNA, 20 nt, Human
ucaaagcacugccugucauc

SEQ ID NO: 764266 - RNA, 22 nt, Human
cuacagagaacucagcugcccu

SEQ ID NO: 764267 - RNA, 22 nt, Human
guuuccacgucucaguuccaaa

SEQ ID NO: 764268 - RNA, 22 nt, Human
uucaucaugauguuccccucua

SEQ ID NO: 764269 - RNA, 22 nt, Human
gaacaguaacugucugcugugu

SEQ ID NO: 764270 - RNA, 18 nt, Human
gauauauaggaggaaagu

SEQ ID NO: 764271 - RNA, 22 nt, Human
aaacagucgucuuaauaguauu

SEQ ID NO: 764272 - RNA, 22 nt, Human
ugagaguuccuccucuuuccac

SEQ ID NO: 764273 - RNA, 22 nt, Human
caggagcaaggagcagugggau

SEQ ID NO: 764274 - RNA, 22 nt, Human
cacaauuuccuugcuucacuuu

SEQ ID NO: 764275 - RNA, 22 nt, Human
gaagcacagaaugguuaacaug

SEQ ID NO: 764276 - RNA, 22 nt, Human
gcagugcaugucggaacucauu

SEQ ID NO: 764277 - RNA, 22 nt, Human
ccugggcucaggcuugggcagc

SEQ ID NO: 764278 - RNA, 22 nt, Human
cacuccuguuccacuaaaugag

SEQ ID NO: 764279 - RNA, 22 nt, Human
ugcagcuucuccaaauauuaca

SEQ ID NO: 764280 - RNA, 22 nt, Human
agaagccaagaacagacagugc

SEQ ID NO: 764281 - RNA, 22 nt, Human
uccucagugcuagccaacugcc

SEQ ID NO: 764282 - RNA, 22 nt, Human
auucuauuuuuuaagaaguagu

SEQ ID NO: 764283 - RNA, 22 nt, Human
aggaagcugccugggaugggaa

SEQ ID NO: 764284 - RNA, 21 nt, Human
ugagucucucagcuucaggua

SEQ ID NO: 764285 - RNA, 22 nt, Human
aucacugagcuucagugcuggc

SEQ ID NO: 764286 - RNA, 22 nt, Human
cuuacacuuuccgaaagcuugu

SEQ ID NO: 764287 - RNA, 22 nt, Human
gacccugacucuaaugcuuggc

SEQ ID NO: 764288 - RNA, 22 nt, Human
gcaguauacacugauacaugag

SEQ ID NO: 764289 - RNA, 22 nt, Human
gcugcugugugggagacaggcg

SEQ ID NO: 764290 - RNA, 22 nt, Human
gcaugagggggguuaggaaguu

SEQ ID NO: 764291 - RNA, 20 nt, Human
ugagaagcuccugucuccuc

SEQ ID NO: 764292 - RNA, 22 nt, Human
uauuugcaggacauagauaugg

SEQ ID NO: 764293 - RNA, 22 nt, Human
ggagcaugcgcucugugaccga

SEQ ID NO: 764294 - RNA, 22 nt, Human
uuggcugguuucaagaaggcau

SEQ ID NO: 764295 - RNA, 22 nt, Human
ccugggccaggcuugggaaugc

SEQ ID NO: 764296 - RNA, 22 nt, Human
guggaaggaauuaacagacuag

SEQ ID NO: 764297 - RNA, 22 nt, Human
aauuuuguuuaagugaucugcu

SEQ ID NO: 764298 - RNA, 22 nt, Human
cugggagagguggugggaagua

SEQ ID NO: 764299 - RNA, 22 nt, Human
cagcaucuguaggacuccucuu

SEQ ID NO: 764300 - RNA, 20 nt, Human
gccagcugcccuuccacccu

SEQ ID NO: 764301 - RNA, 17 nt, Human
gguggaaguuucuaguu

SEQ ID NO: 764302 - RNA, 22 nt, Human
uagaaguuaugauaauaauagu

SEQ ID NO: 764303 - RNA, 22 nt, Human
uacagcuugacccauaaugucu

SEQ ID NO: 764304 - RNA, 22 nt, Human
gaucauuagcuuuucaaaggag

SEQ ID NO: 764305 - RNA, 22 nt, Human
ugacuggauugucauuacgacg

SEQ ID NO: 764306 - RNA, 22 nt, Human
augguacaauuuucauuugugg

SEQ ID NO: 764307 - RNA, 22 nt, Human
guuaaugccauuaggaaauuua

SEQ ID NO: 764308 - RNA, 22 nt, Human
agauucaugggaaagcuuuagg

SEQ ID NO: 764309 - RNA, 22 nt, Human
gaggcagcugggcuggugguuu

SEQ ID NO: 764310 - RNA, 22 nt, Human
gcacagaacuucucuuaguagg

SEQ ID NO: 764311 - RNA, 22 nt, Human
agggagcugacuggcugccauu

SEQ ID NO: 764312 - RNA, 22 nt, Human
uauggaaaguguuuucuucugu

SEQ ID NO: 764313 - RNA, 22 nt, Human
gauauuuucauucggaugcuca

SEQ ID NO: 764314 - RNA, 22 nt, Human
ugcauacuuguauguguuacau

SEQ ID NO: 764315 - RNA, 22 nt, Human
aacacugguucugacuacacag

SEQ ID NO: 764316 - RNA, 22 nt, Human
guaaacaugcuguguacucagc

SEQ ID NO: 764317 - RNA, 20 nt, Human
cccucugcacauggcugugg

SEQ ID NO: 764318 - RNA, 22 nt, Human
uuuaugcagccucaguaucaga

SEQ ID NO: 764319 - RNA, 22 nt, Human
agcuucacuuuguacuuuguca

SEQ ID NO: 764320 - RNA, 18 nt, Human
cauccuuauagcugagaa

SEQ ID NO: 764321 - RNA, 22 nt, Human
uauucccacccuaaguaguagg

SEQ ID NO: 764322 - RNA, 22 nt, Human
agagggagcccagucauagcug

SEQ ID NO: 764323 - RNA, 22 nt, Human
caguccagaguaccccaagaag

SEQ ID NO: 764324 - RNA, 22 nt, Human
cuggcucccaugagcucucacg

SEQ ID NO: 764325 - RNA, 22 nt, Human
cgcugggggaacuucagccaau

SEQ ID NO: 764326 - RNA, 22 nt, Human
agugcuuuagagaaauggugcu

SEQ ID NO: 764327 - RNA, 22 nt, Human
uauuucaucuggaacaagguaa

SEQ ID NO: 764328 - RNA, 23 nt, Human
cccagaggagcagggcgugagau

SEQ ID NO: 764329 - RNA, 18 nt, Human
ggucugagaucguuuuuc

SEQ ID NO: 764330 - RNA, 22 nt, Human
gggguggagcuaaaugucuacu

SEQ ID NO: 764331 - RNA, 22 nt, Human
aaggaggagcggaggcuuguug

SEQ ID NO: 764332 - RNA, 22 nt, Human
cuggaagguucuuugugugccu

SEQ ID NO: 764333 - RNA, 22 nt, Human
cugauuaacugaacugaauuua

SEQ ID NO: 764334 - RNA, 22 nt, Human
gaggagaagcuauuggaaggac

SEQ ID NO: 764335 - RNA, 22 nt, Human
gagagaaaagggggaauugauu

SEQ ID NO: 764336 - RNA, 22 nt, Human
uccagaaacuuuuccagucuca

SEQ ID NO: 764337 - RNA, 22 nt, Human
agaggccuccgaaaggugggcu

SEQ ID NO: 764338 - RNA, 19 nt, Human
ucugaagaauuagagagca

SEQ ID NO: 764339 - RNA, 22 nt, Human
ugucccugcuguacuuagagca

SEQ ID NO: 764340 - RNA, 22 nt, Human
cuucugccccuguagccugagu

SEQ ID NO: 764341 - RNA, 22 nt, Human
uguaacacucaaucuguuuaac

SEQ ID NO: 764342 - RNA, 22 nt, Human
cuccaggcucguccaagaucga

SEQ ID NO: 764343 - RNA, 22 nt, Human
agcuccugggcaccucuuucac

SEQ ID NO: 764344 - RNA, 22 nt, Human
uagggcugccuauggcuagaua

SEQ ID NO: 764345 - RNA, 22 nt, Human
aaauguguauaugaaacaugau

SEQ ID NO: 764346 - RNA, 22 nt, Human
gcagcccucggguacucacgug

SEQ ID NO: 764347 - RNA, 22 nt, Human
aauaaauguuaagauugucuca

SEQ ID NO: 764348 - RNA, 22 nt, Human
ggagucugagcuuguguccugg

SEQ ID NO: 764349 - RNA, 23 nt, Human
gcucuggagcugggccuggcagg

SEQ ID NO: 764350 - RNA, 22 nt, Human
aaacagagagauguauguggag

SEQ ID NO: 764351 - RNA, 20 nt, Human
gggguuggcuggcacaggga

SEQ ID NO: 764352 - RNA, 22 nt, Human
uccuggaagugcuuggugaggg

SEQ ID NO: 764353 - RNA, 22 nt, Human
guuacagugcuuggcaauaagu

SEQ ID NO: 764354 - RNA, 22 nt, Human
gagauugggucuugcucuguca

SEQ ID NO: 764355 - RNA, 22 nt, Human
guauuugcaaaucuaaaagaga

SEQ ID NO: 764356 - RNA, 22 nt, Human
guucuggaguggugccaggccu

SEQ ID NO: 764357 - RNA, 22 nt, Human
guagacaagcacaggacucaga

SEQ ID NO: 764358 - RNA, 22 nt, Human
cugccccuggcuggugaagcag

SEQ ID NO: 764359 - RNA, 22 nt, Human
cuccugcaagccuccccaagca

SEQ ID NO: 764360 - RNA, 22 nt, Human
uccagagccuucgauaagaaga

SEQ ID NO: 764361 - RNA, 23 nt, Human
uccagcugcagugggauggggaa

SEQ ID NO: 764362 - RNA, 22 nt, Human
acacauagaaaauaaauaguua

SEQ ID NO: 764363 - RNA, 22 nt, Human
acuuccugaauggggcuaauua

SEQ ID NO: 764364 - RNA, 22 nt, Human
agaguuuguaguggugaaugua

SEQ ID NO: 764365 - RNA, 22 nt, Human
ucagcauguacuucuccuccau

SEQ ID NO: 764366 - RNA, 22 nt, Human
aaacugcacuuuauuuugucaa

SEQ ID NO: 764367 - RNA, 22 nt, Human
acugagguugaaauagugaugu

SEQ ID NO: 764368 - RNA, 22 nt, Human
aagaggccacagcugacagcac

SEQ ID NO: 764369 - RNA, 22 nt, Human
acucaggcuguuuuuuccuugu

SEQ ID NO: 764370 - RNA, 22 nt, Human
ugagggcugacaggaggacagc

SEQ ID NO: 764371 - RNA, 22 nt, Human
cugaaauauuuuaaucucagga

SEQ ID NO: 764372 - RNA, 22 nt, Human
gcccagaguuugaagauacagu

SEQ ID NO: 764373 - RNA, 22 nt, Human
auuaaauguuggcauauuuugu

SEQ ID NO: 764374 - RNA, 22 nt, Human
aaggcauggcaggguuuacaca

SEQ ID NO: 764375 - RNA, 22 nt, Human
cucccuggcuuuguccugaggc

SEQ ID NO: 764376 - RNA, 22 nt, Human
gccagccagggaagggagagac

SEQ ID NO: 764377 - RNA, 22 nt, Human
uggagacugacugccuguauuu

SEQ ID NO: 764378 - RNA, 22 nt, Human
uucaacagcuuccaaagugugu

SEQ ID NO: 764379 - RNA, 22 nt, Human
cagggcaguaccgcccucuggc

SEQ ID NO: 764380 - RNA, 22 nt, Human
ccugggaggcuguuuccagccu

SEQ ID NO: 764381 - RNA, 22 nt, Human
caagggcauugcuugggaccuu

SEQ ID NO: 764382 - RNA, 20 nt, Human
aggauggcaagcaagugcau

SEQ ID NO: 764383 - RNA, 22 nt, Human
accugaaaccaacuuguguacu

SEQ ID NO: 764384 - RNA, 22 nt, Human
aucaguuuguauaugaaacacu

SEQ ID NO: 764385 - RNA, 22 nt, Human
aagacagaccacgugacagggc

SEQ ID NO: 764386 - RNA, 22 nt, Human
cugggcucaaauccuaucucca

SEQ ID NO: 764387 - RNA, 22 nt, Human
uucuaaauggggauccuuucug

SEQ ID NO: 764388 - RNA, 22 nt, Human
uaguuucugaggauugaaagau

SEQ ID NO: 764389 - RNA, 22 nt, Human
uggaucaucuuaagaagugauu

SEQ ID NO: 764390 - RNA, 21 nt, Human
ucacagacuggucagugaggc

SEQ ID NO: 764391 - RNA, 22 nt, Human
uggcugcccucaugggccugau

SEQ ID NO: 764392 - RNA, 22 nt, Human
cagcauggguuccgggggccug

SEQ ID NO: 764393 - RNA, 22 nt, Human
cacacaggagagugcuggaggu

SEQ ID NO: 764394 - RNA, 20 nt, Human
caacagaggggucuggagua

SEQ ID NO: 764395 - RNA, 22 nt, Human
cagggcucaccacugggauccu

SEQ ID NO: 764396 - RNA, 22 nt, Human
auguucuucuaucuuuauuaaa

SEQ ID NO: 764397 - RNA, 22 nt, Human
uucaagaggcuuaauucuggau

SEQ ID NO: 764398 - RNA, 22 nt, Human
gagagacugauguggcuaugua

SEQ ID NO: 764399 - RNA, 22 nt, Human
acuauacauugaauguuaaggu

SEQ ID NO: 764400 - RNA, 19 nt, Human
ugggcagguucaguaaugg

SEQ ID NO: 764401 - RNA, 22 nt, Human
aaggaggaauguagccagcucc

SEQ ID NO: 764402 - RNA, 22 nt, Human
cucucuaacgacauucccauuc

SEQ ID NO: 764403 - RNA, 22 nt, Human
cuguagcaaguuauucaauaaa

SEQ ID NO: 764404 - RNA, 22 nt, Human
cugcaggcccccuuccuggagu

SEQ ID NO: 764405 - RNA, 22 nt, Human
gcaguggcaugaugugggcuca

SEQ ID NO: 764406 - RNA, 22 nt, Human
agacaucauguuacagauuaag

SEQ ID NO: 764407 - RNA, 22 nt, Human
uaauugucaucguaguaaacau

SEQ ID NO: 764408 - RNA, 22 nt, Human
uauuagcagacaagcugcugga

SEQ ID NO: 764409 - RNA, 22 nt, Human
aaaccugauagauuuucagaau

SEQ ID NO: 764410 - RNA, 22 nt, Human
uggaggugacggggccucguug

SEQ ID NO: 764411 - RNA, 21 nt, Human
ucacaacuuugaauuucaaua

SEQ ID NO: 764412 - RNA, 22 nt, Human
auaaagcauuuccccugugugg

SEQ ID NO: 764413 - RNA, 22 nt, Human
acucugcucuguauuucacugu

SEQ ID NO: 764414 - RNA, 22 nt, Human
aaacaccagcacuguuuacaaa

SEQ ID NO: 764415 - RNA, 22 nt, Human
cucuggaguccuguaucacucc

SEQ ID NO: 764416 - RNA, 20 nt, Human
guuaggagguuggacaugga

SEQ ID NO: 764417 - RNA, 22 nt, Human
aggcagugugggccaagcuucc

SEQ ID NO: 764418 - RNA, 22 nt, Human
agacaccagaaucuguugagca

SEQ ID NO: 764419 - RNA, 22 nt, Human
gagauucucagaaguacuagga

SEQ ID NO: 764420 - RNA, 22 nt, Human
ucuuuggcuaugauuuacuguu

SEQ ID NO: 764421 - RNA, 22 nt, Human
cuuugcuugacacugugauugu

SEQ ID NO: 764422 - RNA, 23 nt, Human
gaauacagagauaaauagaacac

SEQ ID NO: 764423 - RNA, 22 nt, Human
gccaccucggcuuucucugcuc

SEQ ID NO: 764424 - RNA, 20 nt, Human
cuccaguguucaggggagug

SEQ ID NO: 764425 - RNA, 22 nt, Human
cucuuacauucuuuuacuagca

SEQ ID NO: 764426 - RNA, 22 nt, Human
ugggcuggcccaccacaccucg

SEQ ID NO: 764427 - RNA, 22 nt, Human
ggcagauggaaugagcugucua

SEQ ID NO: 764428 - RNA, 22 nt, Human
uugcaagauguuaccauuguua

SEQ ID NO: 764429 - RNA, 22 nt, Human
uugcauuuauagacugccauuu

SEQ ID NO: 764430 - RNA, 20 nt, Human
ugcagggcugccucccagcu

SEQ ID NO: 764431 - RNA, 22 nt, Human
ccuccaggaacuugagagacac

SEQ ID NO: 764432 - RNA, 22 nt, Human
gcccucugcucagcuccucagc

SEQ ID NO: 764433 - RNA, 22 nt, Human
ccucuccagcggccucagggcc

SEQ ID NO: 764434 - RNA, 22 nt, Human
cccuggaguagcacugggucgc

SEQ ID NO: 764435 - RNA, 22 nt, Human
caggccuggggcuggcuuccag

SEQ ID NO: 764436 - RNA, 22 nt, Human
gagccagcagccggcaccacca

SEQ ID NO: 764437 - RNA, 22 nt, Human
cccugcuaguugucucagugau

SEQ ID NO: 764438 - RNA, 22 nt, Human
uauauaauuuucugccauaucc

SEQ ID NO: 764439 - RNA, 22 nt, Human
ugagaguagagucuucaucugu

SEQ ID NO: 764440 - RNA, 20 nt, Human
agcuggcccccgguggccug

SEQ ID NO: 764441 - RNA, 21 nt, Human
ucagaguguguuacagcaagc

SEQ ID NO: 764442 - RNA, 20 nt, Human
ugugugcacacaugacauuc

SEQ ID NO: 764443 - RNA, 22 nt, Human
agagggagaaaagaaucaguug

SEQ ID NO: 764444 - RNA, 22 nt, Human
caggagauaaaagagaugcuuu

SEQ ID NO: 764445 - RNA, 22 nt, Human
aaguuucaugacuugguuauua

SEQ ID NO: 764446 - RNA, 22 nt, Human
ucugcagcuuuuugguggggug

SEQ ID NO: 764447 - RNA, 22 nt, Human
ugcaccaguuucucagagaauc

SEQ ID NO: 764448 - RNA, 22 nt, Human
cauggauauauuguacaguagc

SEQ ID NO: 764449 - RNA, 22 nt, Human
caagcuacuuagaaagcacagu

SEQ ID NO: 764450 - RNA, 22 nt, Human
cagagcuggccugugauuuuug

SEQ ID NO: 764451 - RNA, 22 nt, Human
aggauggcgauucgagcaccuc

SEQ ID NO: 764452 - RNA, 22 nt, Human
ugauuacaguauuugagaucca

SEQ ID NO: 764453 - RNA, 22 nt, Human
guccugggcccaggggcugccu

SEQ ID NO: 764454 - RNA, 22 nt, Human
ucugaaaugaacucuugaacuu

SEQ ID NO: 764455 - RNA, 22 nt, Human
aggccuggcuuugguuugcuga

SEQ ID NO: 764456 - RNA, 22 nt, Human
gcauccucugagagcucuagau

SEQ ID NO: 764457 - RNA, 22 nt, Human
cugaaaggcaguggguagugug

SEQ ID NO: 764458 - RNA, 22 nt, Human
ccauacacacaccaaauuugua

SEQ ID NO: 764459 - RNA, 20 nt, Human
agaaggcaggagacaaaagg

SEQ ID NO: 764460 - RNA, 22 nt, Human
gucuccagccauucucugauca

SEQ ID NO: 764461 - RNA, 21 nt, Human
gagcauggcuuacaucagcag

SEQ ID NO: 764462 - RNA, 22 nt, Human
ucugggaugagaucagagacac

SEQ ID NO: 764463 - RNA, 22 nt, Human
gaauaucccgcuaugcaaagua

SEQ ID NO: 764464 - RNA, 22 nt, Human
gaauugcuaauccaagugacug

SEQ ID NO: 764465 - RNA, 22 nt, Human
uuacucauugcuggaucuagaa

SEQ ID NO: 764466 - RNA, 22 nt, Human
ggcagguagccuagaggagguu

SEQ ID NO: 764467 - RNA, 22 nt, Human
gaaaguauucucccugaauuuu

SEQ ID NO: 764468 - RNA, 22 nt, Human
aaacacuagcaggaagcacuga

SEQ ID NO: 764469 - RNA, 22 nt, Human
ucugaggguuguagagagggac

SEQ ID NO: 764470 - RNA, 22 nt, Human
uuuauucugugcuacaugaaga

SEQ ID NO: 764471 - RNA, 22 nt, Human
uggaagacaauguacaugcagu

SEQ ID NO: 764472 - RNA, 21 nt, Human
gaguccuggcuaggguggcag

SEQ ID NO: 764473 - RNA, 17 nt, Human
ugagacagggcaggccc

SEQ ID NO: 764474 - RNA, 22 nt, Human
aaacaaguguaaacuagucugu

SEQ ID NO: 764475 - RNA, 21 nt, Human
ugaggcaggggugcuuuuguc

SEQ ID NO: 764476 - RNA, 21 nt, Human
ucagaacaauuccaugccucc

SEQ ID NO: 764477 - RNA, 22 nt, Human
ggccuugggcuggcugcaguau

SEQ ID NO: 764478 - RNA, 22 nt, Human
cacagaggauuuuuagggcagu

SEQ ID NO: 764479 - RNA, 22 nt, Human
agcauaaaggucaacguuuuag

SEQ ID NO: 764480 - RNA, 22 nt, Human
aaagcaaugcccguucauuauc

SEQ ID NO: 764481 - RNA, 22 nt, Human
cucugggucaggacacaaaagu

SEQ ID NO: 764482 - RNA, 20 nt, Human
agcacuagguguggcaggug

SEQ ID NO: 764483 - RNA, 22 nt, Human
auucaagagcuggcuuugaaau

SEQ ID NO: 764484 - RNA, 22 nt, Human
augggccaaguaaacauucuca

SEQ ID NO: 764485 - RNA, 22 nt, Human
cauggcuucaaagccuuuggca

SEQ ID NO: 764486 - RNA, 22 nt, Human
cuggcaggcaaauuggugggag

SEQ ID NO: 764487 - RNA, 21 nt, Human
ucagaguggaagacaguuuga

SEQ ID NO: 764488 - RNA, 22 nt, Human
cuacagaaaaucagccacaggc

SEQ ID NO: 764489 - RNA, 22 nt, Human
acuauacaguauguacgugcac

SEQ ID NO: 764490 - RNA, 22 nt, Human
aucuuuccuguuuucagacagc

SEQ ID NO: 764491 - RNA, 22 nt, Human
ccagagcuugacgugcaacgga

SEQ ID NO: 764492 - RNA, 22 nt, Human
uccucagacuucccuuugugua

SEQ ID NO: 764493 - RNA, 22 nt, Human
gucugaaaauaugauuuugccu

SEQ ID NO: 764494 - RNA, 22 nt, Human
uugagguauugauauuuuauga

SEQ ID NO: 764495 - RNA, 22 nt, Human
guauuauuggguaguaugguaa

SEQ ID NO: 764496 - RNA, 22 nt, Human
aaacgguugcucauaguuacau

SEQ ID NO: 764497 - RNA, 22 nt, Human
cuguggugagcaacugacugaa

SEQ ID NO: 764498 - RNA, 22 nt, Human
cccugcccaccacaugcuggga

SEQ ID NO: 764499 - RNA, 22 nt, Human
acugaggucucagguggggaag

SEQ ID NO: 764500 - RNA, 22 nt, Human
guuuagaugagauuuuagaaca

SEQ ID NO: 764501 - RNA, 22 nt, Human
gcagagugauggaaugugggug

SEQ ID NO: 764502 - RNA, 22 nt, Human
cugcccaccgugugcacgugcg

SEQ ID NO: 764503 - RNA, 22 nt, Human
uugcaccauuucacuuccauua

SEQ ID NO: 764504 - RNA, 22 nt, Human
acucucugggcaugccccacca

SEQ ID NO: 764505 - RNA, 22 nt, Human
uccugggagcaugaagagggau

SEQ ID NO: 764506 - RNA, 22 nt, Human
uguguuuguuagacuaauguua

SEQ ID NO: 764507 - RNA, 22 nt, Human
cucagcuccagcccucagcagc

SEQ ID NO: 764508 - RNA, 22 nt, Human
caccugagugucaguauucuca

SEQ ID NO: 764509 - RNA, 23 nt, Human
uugcuuccacuguaaguggagaa

SEQ ID NO: 764510 - RNA, 18 nt, Human
agcaggugugcagaaugu

SEQ ID NO: 764511 - RNA, 22 nt, Human
cuuaacuugaugucucucugcu

SEQ ID NO: 764512 - RNA, 22 nt, Human
gucuauuugggaucaugauaug

SEQ ID NO: 764513 - RNA, 22 nt, Human
aguugacauccagagacauucu

SEQ ID NO: 764514 - RNA, 22 nt, Human
gaaucugcauuuuaacaagauc

SEQ ID NO: 764515 - RNA, 21 nt, Human
caguagugcgucgcagaggac

SEQ ID NO: 764516 - RNA, 22 nt, Human
aggagagagguuuuaaaugggg

SEQ ID NO: 764517 - RNA, 22 nt, Human
augacaauauagcuuugauuuu

SEQ ID NO: 764518 - RNA, 22 nt, Human
ggggccuccagcacuaggcagc

SEQ ID NO: 764519 - RNA, 22 nt, Human
aggcugagguaggaggaucgcu

SEQ ID NO: 764520 - RNA, 22 nt, Human
aggacagagggaccagagccca

SEQ ID NO: 764521 - RNA, 22 nt, Human
ucucaccauggugcuugcuuau

SEQ ID NO: 764522 - RNA, 22 nt, Human
uaaugaacaauauaucaauagc

SEQ ID NO: 764523 - RNA, 22 nt, Human
aggcuccaggcaauguuucuga

SEQ ID NO: 764524 - RNA, 22 nt, Human
ugcuguccugcugagggaugug

SEQ ID NO: 764525 - RNA, 19 nt, Human
ugcuuaccaucugugcugg

SEQ ID NO: 764526 - RNA, 22 nt, Human
ggaggagacggagugauuagug

SEQ ID NO: 764527 - RNA, 22 nt, Human
aggcaaaucugagacauuuaaa

SEQ ID NO: 764528 - RNA, 22 nt, Human
gggagaagaaugugucaauugu

SEQ ID NO: 764529 - RNA, 22 nt, Human
caccuggaugccacaaagccac

SEQ ID NO: 764530 - RNA, 22 nt, Human
uucugcuguuuguaguaaugua

SEQ ID NO: 764531 - RNA, 22 nt, Human
uggagccaaugaacauuugcug

SEQ ID NO: 764532 - RNA, 22 nt, Human
aaguccauaguuugcauuaggg

SEQ ID NO: 764533 - RNA, 22 nt, Human
auguguuuugguggaucauuca

SEQ ID NO: 764534 - RNA, 22 nt, Human
ggcccucuguggcugccaugga

SEQ ID NO: 764535 - RNA, 22 nt, Human
agguguggcuggggcagaggcc

SEQ ID NO: 764536 - RNA, 22 nt, Human
uguguguucucaauuauugaug

SEQ ID NO: 764537 - RNA, 22 nt, Human
uguuuaagcugaugagguaucg

SEQ ID NO: 764538 - RNA, 17 nt, Human
uagcacagugccuggua

SEQ ID NO: 764539 - RNA, 22 nt, Human
ugccugaugcaggaguaucaga

SEQ ID NO: 764540 - RNA, 23 nt, Human
aaacugcaucucugagccucagc

SEQ ID NO: 764541 - RNA, 22 nt, Human
cuuccuuggcuucuggggugug

SEQ ID NO: 764542 - RNA, 22 nt, Human
ugcagcugcuggcccaggugcu

SEQ ID NO: 764543 - RNA, 22 nt, Human
cucugggcaccaaagagcagcu

SEQ ID NO: 764544 - RNA, 22 nt, Human
acucuucacacaugcugcccuc

SEQ ID NO: 764545 - RNA, 22 nt, Human
gucccagggaagaaggcagcac

SEQ ID NO: 764546 - RNA, 22 nt, Human
ucucuugggaggaaagagagaa

SEQ ID NO: 764547 - RNA, 19 nt, Human
uuguccagaaaggcauugc

SEQ ID NO: 764548 - RNA, 19 nt, Human
gcagagugggguggagggu

SEQ ID NO: 764549 - RNA, 22 nt, Human
auacacagcgaugagaggaggc

SEQ ID NO: 764550 - RNA, 22 nt, Human
cagcugugacagccaguugaug

SEQ ID NO: 764551 - RNA, 22 nt, Human
uuugaugaugaugauaaaguuu

SEQ ID NO: 764552 - RNA, 22 nt, Human
ucaaagccuguggauaguuugg

SEQ ID NO: 764553 - RNA, 22 nt, Human
uuagucucuuugcauugccaua

SEQ ID NO: 764554 - RNA, 22 nt, Human
gcccagaguggccacuuggcuc

SEQ ID NO: 764555 - RNA, 22 nt, Human
uuugacauggaauaacucauuu

SEQ ID NO: 764556 - RNA, 22 nt, Human
gcuggcuugauaguuucugcuu

SEQ ID NO: 764557 - RNA, 22 nt, Human
caaauacugagcacgcaaucaa

SEQ ID NO: 764558 - RNA, 22 nt, Human
gggggcgggagacagcagugac

SEQ ID NO: 764559 - RNA, 22 nt, Human
gauucugcugucccuaagugcc

SEQ ID NO: 764560 - RNA, 22 nt, Human
uuuauauaacagagacugcuau

SEQ ID NO: 764561 - RNA, 16 nt, Human
uagagagggcagggag

SEQ ID NO: 764562 - RNA, 22 nt, Human
augaauaaaacauuuuaaucag

SEQ ID NO: 764563 - RNA, 22 nt, Human
gaucuuuacuacugccuucucu

SEQ ID NO: 764564 - RNA, 20 nt, Human
ucuguuauuauuacauugcc

SEQ ID NO: 764565 - RNA, 22 nt, Human
cugguccuugacgcgugggagg

SEQ ID NO: 764566 - RNA, 22 nt, Human
cugcagggacccaagucuuugg

SEQ ID NO: 764567 - RNA, 22 nt, Human
uccccugagaccccucagcacu

SEQ ID NO: 764568 - RNA, 22 nt, Human
ucaggaaguuuugaaucaacug

SEQ ID NO: 764569 - RNA, 22 nt, Human
gaagaaucugaggacagucauu

SEQ ID NO: 764570 - RNA, 22 nt, Human
aaggcagccgugugacugcaug

SEQ ID NO: 764571 - RNA, 22 nt, Human
aacuuagucuuucaauuugaua

SEQ ID NO: 764572 - RNA, 22 nt, Human
uuuagcuaagacauagauucuu

SEQ ID NO: 764573 - RNA, 22 nt, Human
aagcagcugauuucacagcuca

SEQ ID NO: 764574 - RNA, 22 nt, Human
uuggaauuuuccagguacagug

SEQ ID NO: 764575 - RNA, 22 nt, Human
ucuccaagcagggcugcaaggc

SEQ ID NO: 764576 - RNA, 20 nt, Human
aggcuguugacggcugccuc

SEQ ID NO: 764577 - RNA, 22 nt, Human
uaacaacugaggaagaggcaga

SEQ ID NO: 764578 - RNA, 17 nt, Human
cagcucuuccucccucu

SEQ ID NO: 764579 - RNA, 22 nt, Human
caaggaaggagagaugaugggu

SEQ ID NO: 764580 - RNA, 22 nt, Human
gaauuuaaauuuaaaucuacca

SEQ ID NO: 764581 - RNA, 22 nt, Human
agaggcacagaggcaguccccu

SEQ ID NO: 764582 - RNA, 22 nt, Human
ugcgcgcuggcgucacuuagca

SEQ ID NO: 764583 - RNA, 22 nt, Human
ccauggcuucuuucucugccag

SEQ ID NO: 764584 - RNA, 18 nt, Human
aaguggcacaggagugca

SEQ ID NO: 764585 - RNA, 22 nt, Human
auaaaugugaaaugagcaguua

SEQ ID NO: 764586 - RNA, 22 nt, Human
aaugggaaagagacuagaugcu

SEQ ID NO: 764587 - RNA, 22 nt, Human
aguaucauguuggaauuaauca

SEQ ID NO: 764588 - RNA, 22 nt, Human
ucuuugcuccacacucuagaga

SEQ ID NO: 764589 - RNA, 23 nt, Human
uauugcacacauagaaacauaga

SEQ ID NO: 764590 - RNA, 22 nt, Human
aggggccuccucauuggagugu

SEQ ID NO: 764591 - RNA, 22 nt, Human
cucccuggaggugagcuggcac

SEQ ID NO: 764592 - RNA, 22 nt, Human
auccucugaccgcugcagggag

SEQ ID NO: 764593 - RNA, 22 nt, Human
gcucuuuggauuccuuuacaaa

SEQ ID NO: 764594 - RNA, 22 nt, Human
ucccaguggugggugcacauuu

SEQ ID NO: 764595 - RNA, 22 nt, Human
uuucuguauuuaaaagaucugg

SEQ ID NO: 764596 - RNA, 22 nt, Human
gccagucugcucccacaaguuc

SEQ ID NO: 764597 - RNA, 21 nt, Human
acacacugaguuuuccacugu

SEQ ID NO: 764598 - RNA, 22 nt, Human
ugaggggauacgguacacauug

SEQ ID NO: 764599 - RNA, 18 nt, Human
uggcucugcagccagaug

SEQ ID NO: 764600 - RNA, 22 nt, Human
ucuuuccagaggaauuuuuaga

SEQ ID NO: 764601 - RNA, 22 nt, Human
uuuuacacuucgguugugugca

SEQ ID NO: 764602 - RNA, 22 nt, Human
auccagaguaauacagaaugca

SEQ ID NO: 764603 - RNA, 22 nt, Human
aauagcuuuggucaccaucugg

SEQ ID NO: 764604 - RNA, 22 nt, Human
cuuggcuggaacuccugagaaa

SEQ ID NO: 764605 - RNA, 22 nt, Human
ggagggagucagcugauuagaa

SEQ ID NO: 764606 - RNA, 22 nt, Human
uuucuacauuuguaaccagauu

SEQ ID NO: 764607 - RNA, 22 nt, Human
gccuguggccacugcgucugca

SEQ ID NO: 764608 - RNA, 22 nt, Human
ucuuccuuguaagggcuuuaga

SEQ ID NO: 764609 - RNA, 22 nt, Human
ucuggccaggggucccugaagg

SEQ ID NO: 764610 - RNA, 22 nt, Human
augcccugccaagcaggcuaaa

SEQ ID NO: 764611 - RNA, 22 nt, Human
aguugugaauagaucugauugg

SEQ ID NO: 764612 - RNA, 22 nt, Human
aaauggcuacaagaugugcucu

SEQ ID NO: 764613 - RNA, 22 nt, Human
ggacgcagccgagggagcaggg

SEQ ID NO: 764614 - RNA, 22 nt, Human
uuucauauuauuccuugagucu

SEQ ID NO: 764615 - RNA, 22 nt, Human
cuauugaaaguguacaauucaa

SEQ ID NO: 764616 - RNA, 19 nt, Human
ugcuucuggggcuucucca

SEQ ID NO: 764617 - RNA, 22 nt, Human
acaagaguaucuuugacuuuag

SEQ ID NO: 764618 - RNA, 22 nt, Human
uuagccagugaaauggagaaau

SEQ ID NO: 764619 - RNA, 22 nt, Human
acucaguggcacuuuggaauuu

SEQ ID NO: 764620 - RNA, 22 nt, Human
auuucccagcuuugaucaguuu

SEQ ID NO: 764621 - RNA, 22 nt, Human
cagugagaauucaguagguacu

SEQ ID NO: 764622 - RNA, 22 nt, Human
ugguccuggccuugaccccagg

SEQ ID NO: 764623 - RNA, 22 nt, Human
cagcaucuuucucuucuggagu

SEQ ID NO: 764624 - RNA, 18 nt, Human
ucuucaucuccugagcug

SEQ ID NO: 764625 - RNA, 22 nt, Human
guuucagauuugguuucagaag

SEQ ID NO: 764626 - RNA, 22 nt, Human
ucucacacaacauguuacuuug

SEQ ID NO: 764627 - RNA, 22 nt, Human
gugcauuugacgaauacucacu

SEQ ID NO: 764628 - RNA, 21 nt, Human
uagaaagucaaagcuaucagc

SEQ ID NO: 764629 - RNA, 22 nt, Human
ucuaaaugugguagucauaaga

SEQ ID NO: 764630 - RNA, 22 nt, Human
gauaaauugcacuuuuucuuac

SEQ ID NO: 764631 - RNA, 22 nt, Human
aucagagacaaaaccagcacuu

SEQ ID NO: 764632 - RNA, 22 nt, Human
ucacacagugagaaagugcgga

SEQ ID NO: 764633 - RNA, 22 nt, Human
uacaggaagcacucaagaaaug

SEQ ID NO: 764634 - RNA, 22 nt, Human
gccugagaaggacacagcaggu

SEQ ID NO: 764635 - RNA, 19 nt, Human
ccagcagaagccacuccug

SEQ ID NO: 764636 - RNA, 22 nt, Human
gcauuccuacaggcugcuauga

SEQ ID NO: 764637 - RNA, 22 nt, Human
gggugaggcccauuugaggcca

SEQ ID NO: 764638 - RNA, 22 nt, Human
gccacaggugggcucugggaaa

SEQ ID NO: 764639 - RNA, 18 nt, Human
agggagagaccgcggguc

SEQ ID NO: 764640 - RNA, 22 nt, Human
aagucaucuugagucuaagauu

SEQ ID NO: 764641 - RNA, 22 nt, Human
gaagacauguuuuuaauaugua

SEQ ID NO: 764642 - RNA, 22 nt, Human
cacaauguguuggguuaaguuu

SEQ ID NO: 764643 - RNA, 22 nt, Human
ggggagaauuacauggcgugga

SEQ ID NO: 764644 - RNA, 22 nt, Human
uauggcuuaggagaguuuaacu

SEQ ID NO: 764645 - RNA, 22 nt, Human
cgagcaugaugacggcuguggc

SEQ ID NO: 764646 - RNA, 22 nt, Human
aaaggcaggacugcagcauagg

SEQ ID NO: 764647 - RNA, 22 nt, Human
acaaauaugguacucggagaaa

SEQ ID NO: 764648 - RNA, 20 nt, Human
cucucuccaucucaguggcc

SEQ ID NO: 764649 - RNA, 22 nt, Human
aguggcugccaagauauaauuc

SEQ ID NO: 764650 - RNA, 22 nt, Human
gcugccugccuugccuggagga

SEQ ID NO: 764651 - RNA, 22 nt, Human
gcagucauccagccuuuccacu

SEQ ID NO: 764652 - RNA, 22 nt, Human
uuuauugacccaaagcgagagu

SEQ ID NO: 764653 - RNA, 22 nt, Human
acugcacaaggccuggacacac

SEQ ID NO: 764654 - RNA, 22 nt, Human
agcauuuaugacuaauguaaaa

SEQ ID NO: 764655 - RNA, 22 nt, Human
ccugucugaaucaugauuuccu

SEQ ID NO: 764656 - RNA, 20 nt, Human
agguccuguuccuugucucc

SEQ ID NO: 764657 - RNA, 22 nt, Human
aacagcuuagaaauguugcuaa

SEQ ID NO: 764658 - RNA, 22 nt, Human
acaggcuugcacuaggguggca

SEQ ID NO: 764659 - RNA, 22 nt, Human
aucacaaaggucucagagcaca

SEQ ID NO: 764660 - RNA, 22 nt, Human
uacagaaaucacaucgcuuuga

SEQ ID NO: 764661 - RNA, 22 nt, Human
ccugacuuaagucuccuguugg

SEQ ID NO: 764662 - RNA, 22 nt, Human
ccacaggacacaacugcugacc

SEQ ID NO: 764663 - RNA, 22 nt, Human
gugaggugggcugggcucuaug

SEQ ID NO: 764664 - RNA, 22 nt, Human
uuuuagaaguucacuuggguuu

SEQ ID NO: 764665 - RNA, 22 nt, Human
cuagggcucgcaagggcuggag

SEQ ID NO: 764666 - RNA, 22 nt, Human
cagacagaaggaaggccaacau

SEQ ID NO: 764667 - RNA, 22 nt, Human
ccagccagaugauaagcucuau

SEQ ID NO: 764668 - RNA, 22 nt, Human
acacuuguguugaaagcuguua

SEQ ID NO: 764669 - RNA, 22 nt, Human
ggagguagucugagucauaggc

SEQ ID NO: 764670 - RNA, 22 nt, Human
uuacaugaauacauaaccauuc

SEQ ID NO: 764671 - RNA, 22 nt, Human
agaagagccuggggaccauggc

SEQ ID NO: 764672 - RNA, 22 nt, Human
auggaaaggcuguggaaacuua

SEQ ID NO: 764673 - RNA, 22 nt, Human
aguuucacuaaggucugugugu

SEQ ID NO: 764674 - RNA, 23 nt, Human
uacauuguggauggaguccuggg

SEQ ID NO: 764675 - RNA, 22 nt, Human
gcugggaacacagccaugagag

SEQ ID NO: 764676 - RNA, 22 nt, Human
ugcggguugguggcauaugcag

SEQ ID NO: 764677 - RNA, 22 nt, Human
caggagaagguuuggagugcag

SEQ ID NO: 764678 - RNA, 22 nt, Human
gcagggcuccccaggcccgagg

SEQ ID NO: 764679 - RNA, 19 nt, Human
cuuggagaaggcuaugacc

SEQ ID NO: 764680 - RNA, 22 nt, Human
gcagggcuaauggggcaaguag

SEQ ID NO: 764681 - RNA, 22 nt, Human
agucagcagugaaagcacagcc

SEQ ID NO: 764682 - RNA, 22 nt, Human
gcaguccaaaguggcucucacc

SEQ ID NO: 764683 - RNA, 22 nt, Human
ggucagccccugcucaaggccg

SEQ ID NO: 764684 - RNA, 22 nt, Human
agaaagugccucccuugggagc

SEQ ID NO: 764685 - RNA, 22 nt, Human
ugagcagagcaauaggacucuc

SEQ ID NO: 764686 - RNA, 21 nt, Human
ggagggcagcccagacuggcu

SEQ ID NO: 764687 - RNA, 18 nt, Human
ucaggcucucuggcuaga

SEQ ID NO: 764688 - RNA, 21 nt, Human
gucuuuuaagugaagagaggc

SEQ ID NO: 764689 - RNA, 22 nt, Human
gucggccacgcaggugcgguag

SEQ ID NO: 764690 - RNA, 22 nt, Human
ucacacagauugguagagcuga

SEQ ID NO: 764691 - RNA, 22 nt, Human
cuuccucccccacacacucacu

SEQ ID NO: 764692 - RNA, 22 nt, Human
gaagggcucaucagguggccgc

SEQ ID NO: 764693 - RNA, 22 nt, Human
uguuaacauaguggcgcaucug

SEQ ID NO: 764694 - RNA, 19 nt, Human
auacaugcauuuacaugcu

SEQ ID NO: 764695 - RNA, 21 nt, Human
gagagcuaacagugacagcuc

SEQ ID NO: 764696 - RNA, 20 nt, Human
ccucaggccaguuuuaaagu

SEQ ID NO: 764697 - RNA, 22 nt, Human
auugaaguccuaaucuccagua

SEQ ID NO: 764698 - RNA, 23 nt, Human
acugggccagcuacuuagcacug

SEQ ID NO: 764699 - RNA, 22 nt, Human
aaaagcagaucuccaaagucua

SEQ ID NO: 764700 - RNA, 22 nt, Human
aaagaacuaaugugcaagguuu

SEQ ID NO: 764701 - RNA, 22 nt, Human
gucuuucuuaauucaagugcuu

SEQ ID NO: 764702 - RNA, 22 nt, Human
acagggcucugacaccaaggua

SEQ ID NO: 764703 - RNA, 22 nt, Human
aauuauacaugaaggcauuaua

SEQ ID NO: 764704 - RNA, 22 nt, Human
uuacagaacugcccuaguuggc

SEQ ID NO: 764705 - RNA, 22 nt, Human
aaugcauucuuucauggaccug

SEQ ID NO: 764706 - RNA, 22 nt, Human
guggccuuuuagaauaaacucu

SEQ ID NO: 764707 - RNA, 22 nt, Human
aagugguuuuaagagguuccuu

SEQ ID NO: 764708 - RNA, 22 nt, Human
cagcugggccuccugagcccug

SEQ ID NO: 764709 - RNA, 22 nt, Human
cagggccugagggcugcucugc

SEQ ID NO: 764710 - RNA, 21 nt, Human
ggcagagcuggggccuccagc

SEQ ID NO: 764711 - RNA, 22 nt, Human
ggagcuguuauggcauaagcau

SEQ ID NO: 764712 - RNA, 23 nt, Human
uggacccugcacaccagcucuac

SEQ ID NO: 764713 - RNA, 22 nt, Human
uucagaaaucgaguuucauguc

SEQ ID NO: 764714 - RNA, 22 nt, Human
uuccuguggccuuacaucugug

SEQ ID NO: 764715 - RNA, 22 nt, Human
uguaaaauaauucuccauguuu

SEQ ID NO: 764716 - RNA, 22 nt, Human
guucauccauauuauagcaugu

SEQ ID NO: 764717 - RNA, 22 nt, Human
cagcccugcagagggcgcuccu

SEQ ID NO: 764718 - RNA, 19 nt, Human
acucaggcuuccucugagg

SEQ ID NO: 764719 - RNA, 22 nt, Human
ugguggcuucugaggauggcga

SEQ ID NO: 764720 - RNA, 22 nt, Human
ucacugugaauguuaucaucuu

SEQ ID NO: 764721 - RNA, 22 nt, Human
auagaugucauugucauccauc

SEQ ID NO: 764722 - RNA, 22 nt, Human
gccaccugcgggccguggugga

SEQ ID NO: 764723 - RNA, 19 nt, Human
uucugggaggggcugacug

SEQ ID NO: 764724 - RNA, 22 nt, Human
cucacagcugcuucaggaucca

SEQ ID NO: 764725 - RNA, 22 nt, Human
caugagcauuuuggucuaguuu

SEQ ID NO: 764726 - RNA, 22 nt, Human
cugggcaggauacuucauggga

SEQ ID NO: 764727 - RNA, 22 nt, Human
guucucagggauaacuuccccc

SEQ ID NO: 764728 - RNA, 22 nt, Human
uacacugucagauuucgauugc

SEQ ID NO: 764729 - RNA, 19 nt, Human
uagagcugcuuccuggcag

SEQ ID NO: 764730 - RNA, 23 nt, Human
ugugucugaggauauaugugcau

SEQ ID NO: 764731 - RNA, 22 nt, Human
uguggcauacacaugagguggu

SEQ ID NO: 764732 - RNA, 22 nt, Human
ccagcucuuuuggcugagugag

SEQ ID NO: 764733 - RNA, 22 nt, Human
uuaguuagucccugguaccuuu

SEQ ID NO: 764734 - RNA, 22 nt, Human
aguaaacaguuucuuagaagaa

SEQ ID NO: 764735 - RNA, 22 nt, Human
uucugaaaggcaugucagguag

SEQ ID NO: 764736 - RNA, 22 nt, Human
auccaggccugagucugguccu

SEQ ID NO: 764737 - RNA, 20 nt, Human
ucagccagcuaacaugggga

SEQ ID NO: 764738 - RNA, 19 nt, Human
acuuucuccaggaccuguu

SEQ ID NO: 764739 - RNA, 22 nt, Human
ccccaccuugcaauuguucccu

SEQ ID NO: 764740 - RNA, 22 nt, Human
gcuaggaggcccugcacgcuua

SEQ ID NO: 764741 - RNA, 22 nt, Human
aucugacaaggccacauauucu

SEQ ID NO: 764742 - RNA, 22 nt, Human
cauaauuaaauucugggcaaga

SEQ ID NO: 764743 - RNA, 22 nt, Human
aggaauucaagaccagcugggc

SEQ ID NO: 764744 - RNA, 22 nt, Human
ucaguaucaugcgguagccaug

SEQ ID NO: 764745 - RNA, 22 nt, Human
uacauuagcaaacaucuuggug

SEQ ID NO: 764746 - RNA, 22 nt, Human
ggcugccucuauuuaggaucaa

SEQ ID NO: 764747 - RNA, 22 nt, Human
aaaguguaaaagcauguuaggg

SEQ ID NO: 764748 - RNA, 22 nt, Human
ugucucugggugauucaguccu

SEQ ID NO: 764749 - RNA, 22 nt, Human
cugaggcacugguaaugggcau

SEQ ID NO: 764750 - RNA, 22 nt, Human
cugcugucccagccuccucaca

SEQ ID NO: 764751 - RNA, 22 nt, Human
uggcaugggccagggagagcug

SEQ ID NO: 764752 - RNA, 22 nt, Human
uauauuuaauccuagagccauu

SEQ ID NO: 764753 - RNA, 22 nt, Human
auuguucaauguaauaauuuug

SEQ ID NO: 764754 - RNA, 22 nt, Human
caguccuucuccauuaaggcuc

SEQ ID NO: 764755 - RNA, 22 nt, Human
ccuaagauugcaaacucucucc

SEQ ID NO: 764756 - RNA, 23 nt, Human
acacuucacccauugugauagga

SEQ ID NO: 764757 - RNA, 22 nt, Human
acaaguuuauuugauuagaaca

SEQ ID NO: 764758 - RNA, 22 nt, Human
gucagcgugcucagccuauuau

SEQ ID NO: 764759 - RNA, 22 nt, Human
aagggcaggagaagacggauau

SEQ ID NO: 764760 - RNA, 22 nt, Human
gcaaacagccaggcgcagaagu

SEQ ID NO: 764761 - RNA, 22 nt, Human
uucaguauucaaauaugucuua

SEQ ID NO: 764762 - RNA, 22 nt, Human
aauaggaagucacaucaaggga

SEQ ID NO: 764763 - RNA, 22 nt, Human
aaucagaaaauucaguggaauu

SEQ ID NO: 764764 - RNA, 22 nt, Human
gcuggcugguccagcaggggcu

SEQ ID NO: 764765 - RNA, 22 nt, Human
gggaagugaggagccccucugc

SEQ ID NO: 764766 - RNA, 22 nt, Human
ccaguuuaagacuuaucucaau

SEQ ID NO: 764767 - RNA, 22 nt, Human
agugaaauuccuggucuuuguu

SEQ ID NO: 764768 - RNA, 22 nt, Human
uauggcuuaugcugaacaccug

SEQ ID NO: 764769 - RNA, 22 nt, Human
ccaggcaucacgggcauguggc

SEQ ID NO: 764770 - RNA, 22 nt, Human
aacacuggaagggacaucaagu

SEQ ID NO: 764771 - RNA, 22 nt, Human
auggaaauggagggugcuagaa

SEQ ID NO: 764772 - RNA, 22 nt, Human
cugccucuccccagaguggccc

SEQ ID NO: 764773 - RNA, 21 nt, Human
ugcagaaagcggcuugaagca

SEQ ID NO: 764774 - RNA, 22 nt, Human
caaaagucuguccuuuaacuuc

SEQ ID NO: 764775 - RNA, 22 nt, Human
agaaagguggaugcucuggaau

SEQ ID NO: 764776 - RNA, 22 nt, Human
uucuaauacacgguaugacuuu

SEQ ID NO: 764777 - RNA, 22 nt, Human
ugauggaagguuucucggugau

SEQ ID NO: 764778 - RNA, 19 nt, Human
ucagaauucugucucuuga

SEQ ID NO: 764779 - RNA, 23 nt, Human
ugggguugaauuguagcugugcc

SEQ ID NO: 764780 - RNA, 22 nt, Human
cauuguauugaggauacuuaag

SEQ ID NO: 764781 - RNA, 22 nt, Human
cagcccacugccucugugguag

SEQ ID NO: 764782 - RNA, 22 nt, Human
ucacaagaguaaguucaugccu

SEQ ID NO: 764783 - RNA, 22 nt, Human
gggcugccuuucuucugggagc

SEQ ID NO: 764784 - RNA, 22 nt, Human
uugccucaagauuuuuuauuga

SEQ ID NO: 764785 - RNA, 22 nt, Human
ccugggcagggcuggacucuca

SEQ ID NO: 764786 - RNA, 22 nt, Human
aaagcaagacaggaguuucaga

SEQ ID NO: 764787 - RNA, 22 nt, Human
gaacuguagagaauacauuucu

SEQ ID NO: 764788 - RNA, 22 nt, Human
gaggguggguacaccagcccuc

SEQ ID NO: 764789 - RNA, 22 nt, Human
acugucauuaaugaauguaaua

SEQ ID NO: 764790 - RNA, 22 nt, Human
ugaaaaacugaauaguugagua

SEQ ID NO: 764791 - RNA, 22 nt, Human
aaguuguaugucuuagaaagua

SEQ ID NO: 764792 - RNA, 22 nt, Human
cuggaucuucagagaucaccag

SEQ ID NO: 764793 - RNA, 20 nt, Human
gcuuggaccuucugcucugu

SEQ ID NO: 764794 - RNA, 22 nt, Human
ccucccaccguaucucaguggc

SEQ ID NO: 764795 - RNA, 22 nt, Human
ccucuguggucugucuaaugca

SEQ ID NO: 764796 - RNA, 22 nt, Human
caagcuuuauccgccauguagg

SEQ ID NO: 764797 - RNA, 22 nt, Human
uuggaggacuaguuaagagacc

SEQ ID NO: 764798 - RNA, 22 nt, Human
gagccagcuauguagcaagagg

SEQ ID NO: 764799 - RNA, 22 nt, Human
aggcacuuuaggaucagguuga

SEQ ID NO: 764800 - RNA, 22 nt, Human
uauggcuugaguuucagacuau

SEQ ID NO: 764801 - RNA, 22 nt, Human
cagagcaugaauaaaaguuaca

SEQ ID NO: 764802 - RNA, 22 nt, Human
cccgagccucgguuucuuuucu

SEQ ID NO: 764803 - RNA, 22 nt, Human
agcaggaacgaguucaugggga

SEQ ID NO: 764804 - RNA, 22 nt, Human
gcaggcugccaccuucugaguu

SEQ ID NO: 764805 - RNA, 23 nt, Human
agggccucaggagggcugcaugg

SEQ ID NO: 764806 - RNA, 21 nt, Human
uggcagagugcagucuauaca

SEQ ID NO: 764807 - RNA, 22 nt, Human
uauauuauaagcccuuucagaa

SEQ ID NO: 764808 - RNA, 22 nt, Human
acuaacauguuaaucaaaagaa

SEQ ID NO: 764809 - RNA, 22 nt, Human
cucugcugcaggaaggcgugca

SEQ ID NO: 764810 - RNA, 22 nt, Human
ugucuuuauauauuuggaaaau

SEQ ID NO: 764811 - RNA, 22 nt, Human
uuucaguugauugcuuggguua

SEQ ID NO: 764812 - RNA, 22 nt, Human
cagcucugccucuggggcugag

SEQ ID NO: 764813 - RNA, 22 nt, Human
aaauaucauuuauaacuuuuaa

SEQ ID NO: 764814 - RNA, 22 nt, Human
ccugccuggcccaccuugccac

SEQ ID NO: 764815 - RNA, 22 nt, Human
ggagccagggaagcugcuuccu

SEQ ID NO: 764816 - RNA, 22 nt, Human
agagaauuacagaagaauguca

SEQ ID NO: 764817 - RNA, 22 nt, Human
ugucaugcuuauguuacauacu

SEQ ID NO: 764818 - RNA, 22 nt, Human
aacuuguaggacugcacuguag

SEQ ID NO: 764819 - RNA, 22 nt, Human
uugucugaggguuugagagaau

SEQ ID NO: 764820 - RNA, 22 nt, Human
agggcaugaaaugggcagaagc

SEQ ID NO: 764821 - RNA, 22 nt, Human
cucaggauuuaaaggggcacuc

SEQ ID NO: 764822 - RNA, 22 nt, Human
aauaaaguguauucuuugucau

SEQ ID NO: 764823 - RNA, 23 nt, Human
gccuggagaaaagcugcaguuca

SEQ ID NO: 764824 - RNA, 22 nt, Human
uuuccuucucagggagcuucaa

SEQ ID NO: 764825 - RNA, 22 nt, Human
uuggcucugaaacccaagcucu

SEQ ID NO: 764826 - RNA, 20 nt, Human
agcagcuguguuuucauccu

SEQ ID NO: 764827 - RNA, 20 nt, Human
gcuccccuucucugggccuc

SEQ ID NO: 764828 - RNA, 22 nt, Human
ugaugguugauuauaaaucagu

SEQ ID NO: 764829 - RNA, 22 nt, Human
gaccacagcagugcaagaggag

SEQ ID NO: 764830 - RNA, 22 nt, Human
ugaaggagaauuaauaggcauu

SEQ ID NO: 764831 - RNA, 21 nt, Human
augguagguggagcaggugau

SEQ ID NO: 764832 - RNA, 22 nt, Human
acuuuucuaagcaauggucuug

SEQ ID NO: 764833 - RNA, 22 nt, Human
ucagaggagaccaaggggaaua

SEQ ID NO: 764834 - RNA, 22 nt, Human
gaaagcacugugagaucuuguu

SEQ ID NO: 764835 - RNA, 22 nt, Human
uuucucucuacaguacuuucau

SEQ ID NO: 764836 - RNA, 22 nt, Human
uacaaggcuucagcucagcuau

SEQ ID NO: 764837 - RNA, 20 nt, Human
caguccaaucagaggccacc

SEQ ID NO: 764838 - RNA, 22 nt, Human
uuugacauugccaauuugcuca

SEQ ID NO: 764839 - RNA, 22 nt, Human
uggagcugagcaccuccagggc

SEQ ID NO: 764840 - RNA, 22 nt, Human
agguccagaguugagauacaga

SEQ ID NO: 764841 - RNA, 22 nt, Human
acauucugaaaaacaguguuuu

SEQ ID NO: 764842 - RNA, 22 nt, Human
uuucuacaugucaauccaaacc

SEQ ID NO: 764843 - RNA, 22 nt, Human
ucaguguuugguuucagaauug

SEQ ID NO: 764844 - RNA, 22 nt, Human
gugacagagugagacccugucu

SEQ ID NO: 764845 - RNA, 22 nt, Human
ggagcagccuguguagacgggg

SEQ ID NO: 764846 - RNA, 22 nt, Human
aaaggcccacagucagucuacc

SEQ ID NO: 764847 - RNA, 22 nt, Human
accucuuugaaccucaguguga

SEQ ID NO: 764848 - RNA, 22 nt, Human
ccaugcuggagucccuagcugu

SEQ ID NO: 764849 - RNA, 22 nt, Human
ggagcagcacugauuagcgguu

SEQ ID NO: 764850 - RNA, 22 nt, Human
agagacaccgcgcaucauggcu

SEQ ID NO: 764851 - RNA, 22 nt, Human
acuguccauaauauuggugaac

SEQ ID NO: 764852 - RNA, 23 nt, Human
agcaauaagaagggauacaugug

SEQ ID NO: 764853 - RNA, 22 nt, Human
uuuacagaagagaaggaugcuu

SEQ ID NO: 764854 - RNA, 22 nt, Human
gaggaggaggaaguggaaccca

SEQ ID NO: 764855 - RNA, 22 nt, Human
agcuccagaaagguacacacag

SEQ ID NO: 764856 - RNA, 22 nt, Human
acacauuucucccagucuccau

SEQ ID NO: 764857 - RNA, 22 nt, Human
caccagcagcggugugagggug

SEQ ID NO: 764858 - RNA, 22 nt, Human
caaguaugagaaagcuauuacc

SEQ ID NO: 764859 - RNA, 22 nt, Human
aggacccacgcacaggaacccc

SEQ ID NO: 764860 - RNA, 22 nt, Human
ugggcugcccaagguggccaug

SEQ ID NO: 764861 - RNA, 22 nt, Human
cuuguccagauguuuguuaggu

SEQ ID NO: 764862 - RNA, 22 nt, Human
gaggcucuucaauaggucaaug

SEQ ID NO: 764863 - RNA, 22 nt, Human
uuacagaaaauguguuuuaacu

SEQ ID NO: 764864 - RNA, 22 nt, Human
cuguugcugagguucaaggguc

SEQ ID NO: 764865 - RNA, 21 nt, Human
ccugagaucuggaguggcuuu

SEQ ID NO: 764866 - RNA, 22 nt, Human
ccagagucuaugaguccucauu

SEQ ID NO: 764867 - RNA, 23 nt, Human
ggggccugcaccggucugcgcgg

SEQ ID NO: 764868 - RNA, 22 nt, Human
gagguugggaaguccaagcugg

SEQ ID NO: 764869 - RNA, 22 nt, Human
cugcucuguuaauuaaacuuug

SEQ ID NO: 764870 - RNA, 22 nt, Human
uggccuuguguuuaagcaagaa

SEQ ID NO: 764871 - RNA, 22 nt, Human
uucagagaacuucauggaagag

SEQ ID NO: 764872 - RNA, 22 nt, Human
uuuaaaagggguauuaagucca

SEQ ID NO: 764873 - RNA, 22 nt, Human
uacuguacugucuuuuuugcug

SEQ ID NO: 764874 - RNA, 22 nt, Human
uaauagaaagguauuuuuugca

SEQ ID NO: 764875 - RNA, 22 nt, Human
uucuuugcccuuaaugaaauaa

SEQ ID NO: 764876 - RNA, 22 nt, Human
uacugugaauacaaaauaaauu

SEQ ID NO: 764877 - RNA, 22 nt, Human
cuucuucuuuugugggugguaa

SEQ ID NO: 764878 - RNA, 22 nt, Human
auguccagaggugagucagagc

SEQ ID NO: 764879 - RNA, 22 nt, Human
ucuugcaugauauucuguauuu

SEQ ID NO: 764880 - RNA, 22 nt, Human
agcagugaugaaaugagcaucc

SEQ ID NO: 764881 - RNA, 22 nt, Human
gauauuuauuaagugguuggua

SEQ ID NO: 764882 - RNA, 22 nt, Human
ugaagggggagauauaugugug

SEQ ID NO: 764883 - RNA, 22 nt, Human
ugcaguuuuggccauugaaggc

SEQ ID NO: 764884 - RNA, 16 nt, Human
uggggaagcucgugag

SEQ ID NO: 764885 - RNA, 22 nt, Human
cagcaggauaugguggagagag

SEQ ID NO: 764886 - RNA, 22 nt, Human
ugggcugcuuccucagcugaga

SEQ ID NO: 764887 - RNA, 22 nt, Human
cagggggcucaaaggagagugc

SEQ ID NO: 764888 - RNA, 22 nt, Human
gaguggcagaacuggggguccu

SEQ ID NO: 764889 - RNA, 22 nt, Human
uauguacaccaaggauugaaaa

SEQ ID NO: 764890 - RNA, 22 nt, Human
ggacacaagcuccggggcugca

SEQ ID NO: 764891 - RNA, 22 nt, Human
agagucugccuuuuucuccugc

SEQ ID NO: 764892 - RNA, 22 nt, Human
gcucugagauugagccuuuggu

SEQ ID NO: 764893 - RNA, 22 nt, Human
acagcaugucuaguuaaauacu

SEQ ID NO: 764894 - RNA, 22 nt, Human
acacaagaaguuaaugggcaaa

SEQ ID NO: 764895 - RNA, 22 nt, Human
aggccaaagcacagagcuggaa

SEQ ID NO: 764896 - RNA, 22 nt, Human
aagcagccuggacuugggcugg

SEQ ID NO: 764897 - RNA, 22 nt, Human
gaggggcaagaaguuggccucu

SEQ ID NO: 764898 - RNA, 22 nt, Human
aacaaugugaagugcuguucag

SEQ ID NO: 764899 - RNA, 22 nt, Human
ccagcucugcuugcccagucag

SEQ ID NO: 764900 - RNA, 22 nt, Human
acaaagucugaaaccugaggca

SEQ ID NO: 764901 - RNA, 22 nt, Human
uuucugcagguauugcauaagu

SEQ ID NO: 764902 - RNA, 22 nt, Human
agcccugcaggaugagggaggu

SEQ ID NO: 764903 - RNA, 22 nt, Human
ccugugcauccgguggucauug

SEQ ID NO: 764904 - RNA, 22 nt, Human
cuuuucucugcaccauguguga

SEQ ID NO: 764905 - RNA, 22 nt, Human
caguccuuggcuucauccgagu

SEQ ID NO: 764906 - RNA, 22 nt, Human
ucacagaacaauguuuaguucu

SEQ ID NO: 764907 - RNA, 20 nt, Human
uaacuuucuaugcuuucagc

SEQ ID NO: 764908 - RNA, 22 nt, Human
guuuagaauucuaacuuuaagg

SEQ ID NO: 764909 - RNA, 22 nt, Human
ugaagacucagaagcuaagaua

SEQ ID NO: 764910 - RNA, 22 nt, Human
gucugcccagaagacauccccu

SEQ ID NO: 764911 - RNA, 22 nt, Human
gaggggcgcugucgggucaccu

SEQ ID NO: 764912 - RNA, 22 nt, Human
agcaccaguuucgucgugacaa

SEQ ID NO: 764913 - RNA, 22 nt, Human
gauuccugcuauucacagggcu

SEQ ID NO: 764914 - RNA, 20 nt, Human
aagcaucuggauguagcaau

SEQ ID NO: 764915 - RNA, 22 nt, Human
augagaaauuuauuacaagcua

SEQ ID NO: 764916 - RNA, 22 nt, Human
ugaggagaaaugcucagagcca

SEQ ID NO: 764917 - RNA, 23 nt, Human
gccagccagaauuucuccacugu

SEQ ID NO: 764918 - RNA, 22 nt, Human
ggcuuuauguuuuucauguggu

SEQ ID NO: 764919 - RNA, 22 nt, Human
aaguauucuacaaagaaauuga

SEQ ID NO: 764920 - RNA, 22 nt, Human
ccucuguccuggggaguggagc

SEQ ID NO: 764921 - RNA, 22 nt, Human
gacugugggaagacuguagguu

SEQ ID NO: 764922 - RNA, 22 nt, Human
cuauuuucugucucuauagagu

SEQ ID NO: 764923 - RNA, 22 nt, Human
ggggaaggauugaguugaccca

SEQ ID NO: 764924 - RNA, 22 nt, Human
agguggagacccagagaaggcg

SEQ ID NO: 764925 - RNA, 22 nt, Human
aauucaguugacagcuaaugcc

SEQ ID NO: 764926 - RNA, 22 nt, Human
guggcagugaaggucauagcau

SEQ ID NO: 764927 - RNA, 22 nt, Human
cagagcagacguugagauuaag

SEQ ID NO: 764928 - RNA, 22 nt, Human
cagagggugugaaggggaugaa

SEQ ID NO: 764929 - RNA, 22 nt, Human
aguugucccggucuagccacuu

SEQ ID NO: 764930 - RNA, 18 nt, Human
gugacagcugcuagcuca

SEQ ID NO: 764931 - RNA, 22 nt, Human
ucucugaguucuccuccagccc

SEQ ID NO: 764932 - RNA, 22 nt, Human
ggugaggaaagauggugacagu

SEQ ID NO: 764933 - RNA, 22 nt, Human
uuuuucaugagacuagaaguca

SEQ ID NO: 764934 - RNA, 18 nt, Human
gccagagcauaucuccag

SEQ ID NO: 764935 - RNA, 22 nt, Human
gcacaugguaggcauuugaugu

SEQ ID NO: 764936 - RNA, 22 nt, Human
ugugcucuucuguuacuuguag

SEQ ID NO: 764937 - RNA, 22 nt, Human
ccugggugaaauaguccucaag

SEQ ID NO: 764938 - RNA, 22 nt, Human
ugccucagagaccugacaguac

SEQ ID NO: 764939 - RNA, 22 nt, Human
caaucuuaguggcuuacaaaga

SEQ ID NO: 764940 - RNA, 22 nt, Human
uucuuucacucaagaaggaucu

SEQ ID NO: 764941 - RNA, 22 nt, Human
cagaggcuguguaggcagacug

SEQ ID NO: 764942 - RNA, 22 nt, Human
aacauuguuuucccuauaucca

SEQ ID NO: 764943 - RNA, 22 nt, Human
uagcuacacugaggcugcuuaa

SEQ ID NO: 764944 - RNA, 22 nt, Human
caaaguauauuggauugaaugg

SEQ ID NO: 764945 - RNA, 21 nt, Human
ucacguggucacaugagcuuu

SEQ ID NO: 764946 - RNA, 22 nt, Human
ucguaugcucucuguguccugu

SEQ ID NO: 764947 - RNA, 17 nt, Human
uaaccucucugaaccug

SEQ ID NO: 764948 - RNA, 20 nt, Human
ugcucugucuaaaacuuccc

SEQ ID NO: 764949 - RNA, 22 nt, Human
aggcuuuggggcauucuguguu

SEQ ID NO: 764950 - RNA, 22 nt, Human
gcccugugcuuggauggcagau

SEQ ID NO: 764951 - RNA, 21 nt, Human
uuuguucaggcaaguuacagu

SEQ ID NO: 764952 - RNA, 22 nt, Human
gggagguccuaaaggggaccag

SEQ ID NO: 764953 - RNA, 22 nt, Human
cucagagccaguuagcaggugc

SEQ ID NO: 764954 - RNA, 19 nt, Human
caagauuuguucacacaug

SEQ ID NO: 764955 - RNA, 22 nt, Human
gagccugcgagggaguaaggca

SEQ ID NO: 764956 - RNA, 21 nt, Human
ggcaggauggcaguggacccc

SEQ ID NO: 764957 - RNA, 22 nt, Human
agcugccagggacugggcaugg

SEQ ID NO: 764958 - RNA, 22 nt, Human
aaucucuugguucagaagccuc

SEQ ID NO: 764959 - RNA, 19 nt, Human
cacaauuaugagacacuua

SEQ ID NO: 764960 - RNA, 22 nt, Human
uacuggaaggcuggaagucagg

SEQ ID NO: 764961 - RNA, 22 nt, Human
aaguggcuuugagcuucugcca

SEQ ID NO: 764962 - RNA, 21 nt, Human
agaaauguaucauucuuuucc

SEQ ID NO: 764963 - RNA, 23 nt, Human
agaaaaguucauaccuuuuuaac

SEQ ID NO: 764964 - RNA, 18 nt, Human
ugagccgguagauggggu

SEQ ID NO: 764965 - RNA, 22 nt, Human
cuaaaugauauuuugguuuccu

SEQ ID NO: 764966 - RNA, 22 nt, Human
gacagccaacuggggagggcau

SEQ ID NO: 764967 - RNA, 22 nt, Human
ugugggaagagcaguggcagca

SEQ ID NO: 764968 - RNA, 22 nt, Human
ucuucuuuggaugaaagaauau

SEQ ID NO: 764969 - RNA, 22 nt, Human
ccucccacauugaggacaugcu

SEQ ID NO: 764970 - RNA, 22 nt, Human
ccaggguugcuguauggcacuu

SEQ ID NO: 764971 - RNA, 22 nt, Human
gcucugguaccagcuacuccua

SEQ ID NO: 764972 - RNA, 22 nt, Human
ggagagcuagugccugccagua

SEQ ID NO: 764973 - RNA, 22 nt, Human
ugucccagauacuggacauaga

SEQ ID NO: 764974 - RNA, 22 nt, Human
cuggucccuggaccucccugga

SEQ ID NO: 764975 - RNA, 22 nt, Human
gcagaggcacagccccagauga

SEQ ID NO: 764976 - RNA, 22 nt, Human
auacauagcaggguaguagauc

SEQ ID NO: 764977 - RNA, 22 nt, Human
auuaugcuuaggaaaauaugaa

SEQ ID NO: 764978 - RNA, 22 nt, Human
uguauuugguguauuuaaugag

SEQ ID NO: 764979 - RNA, 22 nt, Human
ugagggaggccuccaucugcca

SEQ ID NO: 764980 - RNA, 22 nt, Human
uucuggaguauuccuggcaccu

SEQ ID NO: 764981 - RNA, 22 nt, Human
aauagcauagaguuaaaaugca

SEQ ID NO: 764982 - RNA, 22 nt, Human
agccccuguacccugagugcuu

SEQ ID NO: 764983 - RNA, 22 nt, Human
ucacaagauauuucaguccuuu

SEQ ID NO: 764984 - RNA, 22 nt, Human
uaccucucggggucuguuugug

SEQ ID NO: 764985 - RNA, 22 nt, Human
uuccuggccaagcagaguggaa

SEQ ID NO: 764986 - RNA, 22 nt, Human
uauuucacuccgagacucuaug

SEQ ID NO: 764987 - RNA, 22 nt, Human
auagucuuagaucagauaaagu

SEQ ID NO: 764988 - RNA, 22 nt, Human
ggaugugaaucugggcugagac

SEQ ID NO: 764989 - RNA, 22 nt, Human
gcccacuccagcuucucccaca

SEQ ID NO: 764990 - RNA, 20 nt, Human
ucauuucuugggguuccaag

SEQ ID NO: 764991 - RNA, 22 nt, Human
cagaaacacuuguagagaaguu

SEQ ID NO: 764992 - RNA, 22 nt, Human
auacaauaguguuuguuuugag

SEQ ID NO: 764993 - RNA, 22 nt, Human
acccagccuacaaagcucaccu

SEQ ID NO: 764994 - RNA, 22 nt, Human
ccugggcuucugucuagauguu

SEQ ID NO: 764995 - RNA, 22 nt, Human
ugaugauguuuaucuugguauu

SEQ ID NO: 764996 - RNA, 22 nt, Human
ggucccaaggaggaugaggcua

SEQ ID NO: 764997 - RNA, 22 nt, Human
ucuauuuuguuuccagcucuac

SEQ ID NO: 764998 - RNA, 22 nt, Human
guggaugaugagugacuacaga

SEQ ID NO: 764999 - RNA, 22 nt, Human
gccuggagcucggcugagggcg

SEQ ID NO: 765000 - RNA, 22 nt, Human
uacagaaauacagucaggccua

SEQ ID NO: 765001 - RNA, 22 nt, Human
gcagcagcugacagugggugcc

SEQ ID NO: 765002 - RNA, 22 nt, Human
cugucuucuccuuuguuucagg

SEQ ID NO: 765003 - RNA, 22 nt, Human
uccaggaugcccgcuuuugcuu

SEQ ID NO: 765004 - RNA, 22 nt, Human
gugccugcugcagcugagcagu

SEQ ID NO: 765005 - RNA, 22 nt, Human
uguacagugccaugcaguuugc

SEQ ID NO: 765006 - RNA, 22 nt, Human
auccaaagauggaaagaacuuu

SEQ ID NO: 765007 - RNA, 22 nt, Human
ucaguguucuggauuuggggca

SEQ ID NO: 765008 - RNA, 22 nt, Human
gguccccguggaggcuggagcg

SEQ ID NO: 765009 - RNA, 22 nt, Human
ccauccugcaggaccuccauau

SEQ ID NO: 765010 - RNA, 22 nt, Human
ucccuccacaccugcugguacc

SEQ ID NO: 765011 - RNA, 22 nt, Human
acacauaugccauuacagcaaa

SEQ ID NO: 765012 - RNA, 22 nt, Human
ggcucuggcggcucuuucaaua

SEQ ID NO: 765013 - RNA, 22 nt, Human
acaaugaacgcuuuuuaacugu

SEQ ID NO: 765014 - RNA, 22 nt, Human
uugcugugucauuuguuuaauc

SEQ ID NO: 765015 - RNA, 23 nt, Human
uuguacagcccagauuccucuuc

SEQ ID NO: 765016 - RNA, 22 nt, Human
ccucagggaaugggaggcuggg

SEQ ID NO: 765017 - RNA, 22 nt, Human
auacaucaccuauauauucaca

SEQ ID NO: 765018 - RNA, 22 nt, Human
cagggcucagggacugcagaaa

SEQ ID NO: 765019 - RNA, 22 nt, Human
gcucaccaagcagagacucugg

SEQ ID NO: 765020 - RNA, 22 nt, Human
aggcucucacccucugaccaga

SEQ ID NO: 765021 - RNA, 22 nt, Human
ucacugaauacuugucucaucc

SEQ ID NO: 765022 - RNA, 22 nt, Human
gcaugggcuuucucagaguucu

SEQ ID NO: 765023 - RNA, 23 nt, Human
ugcuguccaacagacuggccaug

SEQ ID NO: 765024 - RNA, 21 nt, Human
ggcuggacaucccaggagacu

SEQ ID NO: 765025 - RNA, 22 nt, Human
agcuuccacaucugucuucagu

SEQ ID NO: 765026 - RNA, 22 nt, Human
agcuucucagcuucagaacugu

SEQ ID NO: 765027 - RNA, 22 nt, Human
gcuggagagauaggcauggggu

SEQ ID NO: 765028 - RNA, 21 nt, Human
gugguuauuuucauuagcauc

SEQ ID NO: 765029 - RNA, 22 nt, Human
ggacuggguaggagcccagggc

SEQ ID NO: 765030 - RNA, 22 nt, Human
ugcaguuuuccuucaacauugu

SEQ ID NO: 765031 - RNA, 22 nt, Human
agacucugagacaugaaccauc

SEQ ID NO: 765032 - RNA, 22 nt, Human
uuggcuugaugacuggcagugu

SEQ ID NO: 765033 - RNA, 22 nt, Human
ccuccuggcccugggccuggaa

SEQ ID NO: 765034 - RNA, 22 nt, Human
augcuguggggagugaggguag

SEQ ID NO: 765035 - RNA, 22 nt, Human
ccaggcugaauauguuccaggg

SEQ ID NO: 765036 - RNA, 22 nt, Human
ugcccagguuugagugcccaag

SEQ ID NO: 765037 - RNA, 22 nt, Human
ugucugaauuuuggaaucaagu

SEQ ID NO: 765038 - RNA, 22 nt, Human
uagaaacucaggauacucuucc

SEQ ID NO: 765039 - RNA, 19 nt, Human
ccuuuuuuaacuucagcaa

SEQ ID NO: 765040 - RNA, 22 nt, Human
aucccugaaugcuccugacugg

SEQ ID NO: 765041 - RNA, 22 nt, Human
ucccaaggauaagagagucuga

SEQ ID NO: 765042 - RNA, 21 nt, Human
agaaaauggcguuuuagauuu

SEQ ID NO: 765043 - RNA, 22 nt, Human
gaggcuggaggucaaagaugaa

SEQ ID NO: 765044 - RNA, 22 nt, Human
gccauuuggcaaaacugacuuc

SEQ ID NO: 765045 - RNA, 22 nt, Human
aggggcucaagcaguguggucu

SEQ ID NO: 765046 - RNA, 22 nt, Human
agccuggccugggcaggcacau

SEQ ID NO: 765047 - RNA, 22 nt, Human
auucuacugcaaauccugacca

SEQ ID NO: 765048 - RNA, 22 nt, Human
ggguaggcaaagcaaugacguu

SEQ ID NO: 765049 - RNA, 22 nt, Human
uucuggcuuuacuucccaucca

SEQ ID NO: 765050 - RNA, 22 nt, Human
aagaggaggacgguucccagaa

SEQ ID NO: 765051 - RNA, 22 nt, Human
aguaccauuauccaguaaagga

SEQ ID NO: 765052 - RNA, 22 nt, Human
cauagaaucauagcacauuuga

SEQ ID NO: 765053 - RNA, 23 nt, Human
ucaauugaugauguucucuuuug

SEQ ID NO: 765054 - RNA, 22 nt, Human
ugacagaccacugcaacucugu

SEQ ID NO: 765055 - RNA, 22 nt, Human
gcucucugguuccagucaggaa

SEQ ID NO: 765056 - RNA, 22 nt, Human
gggcccuggacguggcggcaga

SEQ ID NO: 765057 - RNA, 22 nt, Human
agaaaguuaucacaaaauugag

SEQ ID NO: 765058 - RNA, 22 nt, Human
uuacacauuaacaggcagcuaa

SEQ ID NO: 765059 - RNA, 22 nt, Human
gugggcagcaccagggaagugu

SEQ ID NO: 765060 - RNA, 22 nt, Human
ccagagaguaggaggcauuauu

SEQ ID NO: 765061 - RNA, 22 nt, Human
cuggauuuugaugagcaguuuu

SEQ ID NO: 765062 - RNA, 22 nt, Human
uccucuucuguggauucccuga

SEQ ID NO: 765063 - RNA, 22 nt, Human
uuuauagucgucucaguaauaa

SEQ ID NO: 765064 - RNA, 22 nt, Human
gaauacacgaauagagcauggu

SEQ ID NO: 765065 - RNA, 19 nt, Human
auucuucagcagugagacc

SEQ ID NO: 765066 - RNA, 22 nt, Human
cugggcucagugucucacuccu

SEQ ID NO: 765067 - RNA, 22 nt, Human
uaaauucugaucaaguuccuuc

SEQ ID NO: 765068 - RNA, 18 nt, Human
augcagcaaucagaaaua

SEQ ID NO: 765069 - RNA, 17 nt, Human
ggaagaaaaggaucauc

SEQ ID NO: 765070 - RNA, 22 nt, Human
uaacauguuaagaaauuagaua

SEQ ID NO: 765071 - RNA, 22 nt, Human
cucagaauuuagggcucugagg

SEQ ID NO: 765072 - RNA, 22 nt, Human
caagagcugugaccucauucac

SEQ ID NO: 765073 - RNA, 22 nt, Human
agcugggugcgguggcucaugc

SEQ ID NO: 765074 - RNA, 22 nt, Human
gcaaacaaggacauacauccug

SEQ ID NO: 765075 - RNA, 22 nt, Human
cauccguuaauaaaaagacagu

SEQ ID NO: 765076 - RNA, 22 nt, Human
acacaguucaggaucaaauagc

SEQ ID NO: 765077 - RNA, 20 nt, Human
ucuuggagaggguggacuua

SEQ ID NO: 765078 - RNA, 23 nt, Human
ugucuccaucucauuacuugggg

SEQ ID NO: 765079 - RNA, 22 nt, Human
gcucacugccugggcaacaaga

SEQ ID NO: 765080 - RNA, 23 nt, Human
aauguauguuaguaucuuagaga

SEQ ID NO: 765081 - RNA, 19 nt, Human
aggugugggggcugcagac

SEQ ID NO: 765082 - RNA, 22 nt, Human
gacuaaauaaaagccaaacuuc

SEQ ID NO: 765083 - RNA, 22 nt, Human
auccucagcaucuagcaugaag

SEQ ID NO: 765084 - RNA, 22 nt, Human
caguggaauauauaggggauuu

SEQ ID NO: 765085 - RNA, 22 nt, Human
auuuuacauaaggaagguuuaa

SEQ ID NO: 765086 - RNA, 20 nt, Human
gaggcugaaguguuuuugcu

SEQ ID NO: 765087 - RNA, 22 nt, Human
ucagaaaucuugucaaggcauc

SEQ ID NO: 765088 - RNA, 22 nt, Human
uguuuccuaagugucucugaag

SEQ ID NO: 765089 - RNA, 21 nt, Human
aguguguguggaaugagaaua

SEQ ID NO: 765090 - RNA, 22 nt, Human
aagggcuggaauaucucuuaga

SEQ ID NO: 765091 - RNA, 22 nt, Human
agcuccugauacaugcaggaau

SEQ ID NO: 765092 - RNA, 22 nt, Human
ucagccagugccuugaucuugc

SEQ ID NO: 765093 - RNA, 22 nt, Human
uagugaaaguauuaaacagcug

SEQ ID NO: 765094 - RNA, 22 nt, Human
uucuucucucauagauuaaggu

SEQ ID NO: 765095 - RNA, 22 nt, Human
ucucuacacaggauucacauga

SEQ ID NO: 765096 - RNA, 22 nt, Human
cuaggccagagagaccucauga

SEQ ID NO: 765097 - RNA, 22 nt, Human
gguggccuccagggcauaggug

SEQ ID NO: 765098 - RNA, 22 nt, Human
aaagauuuaagaauaauuugug

SEQ ID NO: 765099 - RNA, 22 nt, Human
agccuuagauuugggcaagaac

SEQ ID NO: 765100 - RNA, 17 nt, Human
aggaagggcaaguuucu

SEQ ID NO: 765101 - RNA, 22 nt, Human
gcucaaaucccagcgggcuccu

SEQ ID NO: 765102 - RNA, 22 nt, Human
cuuccucuguguccugggcuuc

SEQ ID NO: 765103 - RNA, 22 nt, Human
gcccuucacgaugguaucuuag

SEQ ID NO: 765104 - RNA, 22 nt, Human
uaguacacuaccaucagguuuu

SEQ ID NO: 765105 - RNA, 22 nt, Human
uccaggcccauagacacuucuc

SEQ ID NO: 765106 - RNA, 22 nt, Human
uucugcuguaguugcaucuguu

SEQ ID NO: 765107 - RNA, 22 nt, Human
uaggaacaaguuuccuugcugu

SEQ ID NO: 765108 - RNA, 22 nt, Human
agagaacuucuccuaaaucuca

SEQ ID NO: 765109 - RNA, 22 nt, Human
uauuuagcuggagucagugcuu

SEQ ID NO: 765110 - RNA, 22 nt, Human
ucaaagcagcacauucgcaagc

SEQ ID NO: 765111 - RNA, 22 nt, Human
caugcagggagcagaggagaca

SEQ ID NO: 765112 - RNA, 22 nt, Human
agggcugccccaguccagccgg

SEQ ID NO: 765113 - RNA, 22 nt, Human
uacaacauaacgggcauucagu

SEQ ID NO: 765114 - RNA, 22 nt, Human
cccuggcagcaaucacuggugu

SEQ ID NO: 765115 - RNA, 22 nt, Human
cagguggagcugacugagggca

SEQ ID NO: 765116 - RNA, 22 nt, Human
aagcccaguaccuucagugagg

SEQ ID NO: 765117 - RNA, 22 nt, Human
ugcuuuauaaccauuucugugg

SEQ ID NO: 765118 - RNA, 22 nt, Human
aggugaguugguaggaaguuug

SEQ ID NO: 765119 - RNA, 22 nt, Human
uuaugcaugagauaaaaauugg

SEQ ID NO: 765120 - RNA, 23 nt, Human
agcccaccuuguuaguccugugg

SEQ ID NO: 765121 - RNA, 22 nt, Human
cagaaauaaacuucucacaucg

SEQ ID NO: 765122 - RNA, 19 nt, Human
aaggcuggagaaggccucu

SEQ ID NO: 765123 - RNA, 22 nt, Human
aucaggauuacacggggaugcu

SEQ ID NO: 765124 - RNA, 22 nt, Human
uuaauacaacuguugucacugg

SEQ ID NO: 765125 - RNA, 22 nt, Human
ucucuucuaauuaggguccaug

SEQ ID NO: 765126 - RNA, 22 nt, Human
gaaaacuuggaucucuagaaug

SEQ ID NO: 765127 - RNA, 22 nt, Human
ucagcagugugcccagaggcug

SEQ ID NO: 765128 - RNA, 22 nt, Human
cuggaaggucuguccccacugc

SEQ ID NO: 765129 - RNA, 22 nt, Human
agaccaagacuauaaugagagg

SEQ ID NO: 765130 - RNA, 22 nt, Human
agaagaugucacugcagacagc

SEQ ID NO: 765131 - RNA, 22 nt, Human
gcauccuggcucuaggugucau

SEQ ID NO: 765132 - RNA, 22 nt, Human
ugcccucugcaggccgccaugg

SEQ ID NO: 765133 - RNA, 22 nt, Human
cuuugugaugaggccuaagaca

SEQ ID NO: 765134 - RNA, 22 nt, Human
cugccccaccccaaccugaggu

SEQ ID NO: 765135 - RNA, 22 nt, Human
guguguguucaauaaauuuaag

SEQ ID NO: 765136 - RNA, 22 nt, Human
uauucacagguucuggggauca

SEQ ID NO: 765137 - RNA, 22 nt, Human
gucagugucuuaacagagauua

SEQ ID NO: 765138 - RNA, 22 nt, Human
ugcuggaggagaagguugcuca

SEQ ID NO: 765139 - RNA, 22 nt, Human
augaaguuccaguauaugcagu

SEQ ID NO: 765140 - RNA, 22 nt, Human
acugcaugcuuuacaugacaug

SEQ ID NO: 765141 - RNA, 22 nt, Human
ggaaugaagaaauagauggugu

SEQ ID NO: 765142 - RNA, 22 nt, Human
cugcaguuggauaaagauacuu

SEQ ID NO: 765143 - RNA, 22 nt, Human
ucuuucugaugggaagggucaa

SEQ ID NO: 765144 - RNA, 22 nt, Human
cucuacagcugcugccccuggu

SEQ ID NO: 765145 - RNA, 22 nt, Human
acacauauguggcaacuguaga

SEQ ID NO: 765146 - RNA, 22 nt, Human
agguggccaauaaauguuggag

SEQ ID NO: 765147 - RNA, 22 nt, Human
uguaucugugauguagggguuu

SEQ ID NO: 765148 - RNA, 17 nt, Human
ugcuuaauuuugacugg

SEQ ID NO: 765149 - RNA, 22 nt, Human
ugagcuguguccugggggcagu

SEQ ID NO: 765150 - RNA, 22 nt, Human
aacaggcacuaagcaugugggg

SEQ ID NO: 765151 - RNA, 22 nt, Human
cagagcauaauugacaugaggu

SEQ ID NO: 765152 - RNA, 22 nt, Human
uggacacaauguugccuuaggg

SEQ ID NO: 765153 - RNA, 19 nt, Human
agaaggcuccuguuggaga

SEQ ID NO: 765154 - RNA, 22 nt, Human
auacugaugaugugaagaaaca

SEQ ID NO: 765155 - RNA, 22 nt, Human
auucacaauagcagcuugcaug

SEQ ID NO: 765156 - RNA, 22 nt, Human
cagcuggccccacaguagaggc

SEQ ID NO: 765157 - RNA, 22 nt, Human
uagcagagugauuggccaugag

SEQ ID NO: 765158 - RNA, 22 nt, Human
acagcuguauccccagagcuca

SEQ ID NO: 765159 - RNA, 22 nt, Human
aaaaggcauuuugucaaccaua

SEQ ID NO: 765160 - RNA, 20 nt, Human
ucauauugauguagagcagc

SEQ ID NO: 765161 - RNA, 22 nt, Human
cuggauuaaguaaaauagagga

SEQ ID NO: 765162 - RNA, 22 nt, Human
ucagcaucaguauuguuuagga

SEQ ID NO: 765163 - RNA, 22 nt, Human
gaguauauauagacaugucaca

SEQ ID NO: 765164 - RNA, 22 nt, Human
accuguuuaccugcaccuguuu

SEQ ID NO: 765165 - RNA, 22 nt, Human
ccaggacaagccagagggacag

SEQ ID NO: 765166 - RNA, 22 nt, Human
augcccuucaacgugaggauuu

SEQ ID NO: 765167 - RNA, 20 nt, Human
gagucacagaagaagcugaa

SEQ ID NO: 765168 - RNA, 22 nt, Human
uugcauuuuugagcacgaaguu

SEQ ID NO: 765169 - RNA, 22 nt, Human
uccaagaauacagauuugugaa

SEQ ID NO: 765170 - RNA, 22 nt, Human
uucuggaaaagaaaguuaagau

SEQ ID NO: 765171 - RNA, 22 nt, Human
aggguccuucuguuccugagca

SEQ ID NO: 765172 - RNA, 20 nt, Human
ccagugggaagugauuaggu

SEQ ID NO: 765173 - RNA, 22 nt, Human
guggcucuccauugacauggaa

SEQ ID NO: 765174 - RNA, 22 nt, Human
cugcugccauuagggcacagac

SEQ ID NO: 765175 - RNA, 22 nt, Human
uucagcuauggagucuuaguua

SEQ ID NO: 765176 - RNA, 22 nt, Human
gagcagcugcagugcagacccu

SEQ ID NO: 765177 - RNA, 22 nt, Human
uuuggcacuguucuaggugcaa

SEQ ID NO: 765178 - RNA, 22 nt, Human
ggaggccagccugaggcugagg

SEQ ID NO: 765179 - RNA, 22 nt, Human
gaaucauucauugcucaauuaa

SEQ ID NO: 765180 - RNA, 22 nt, Human
cucagugcuucuagcuugauga

SEQ ID NO: 765181 - RNA, 22 nt, Human
aacagucacauuguucaacuuu

SEQ ID NO: 765182 - RNA, 22 nt, Human
caaggcauucuugcagguaggg

SEQ ID NO: 765183 - RNA, 22 nt, Human
uccaggcuugagaccaggcucu

SEQ ID NO: 765184 - RNA, 22 nt, Human
gauggaagaaaaaugcaugucu

SEQ ID NO: 765185 - RNA, 22 nt, Human
ugacagugaaugacaagguucu

SEQ ID NO: 765186 - RNA, 22 nt, Human
gagcacccuuugcacaucaguc

SEQ ID NO: 765187 - RNA, 22 nt, Human
ugggcuucugauguugagugcu

SEQ ID NO: 765188 - RNA, 22 nt, Human
aggugucugggcuuuggaguca

SEQ ID NO: 765189 - RNA, 22 nt, Human
uuagugucuggcuauauuuaaa

SEQ ID NO: 765190 - RNA, 23 nt, Human
aaagauguucccaaaguucacgu

SEQ ID NO: 765191 - RNA, 22 nt, Human
guguuugcuggagcucuggguc

SEQ ID NO: 765192 - RNA, 22 nt, Human
aaauauagcaauuaugccuacu

SEQ ID NO: 765193 - RNA, 22 nt, Human
uccugccugagcguggaggagg

SEQ ID NO: 765194 - RNA, 20 nt, Human
gccaacgcgcuggggcugcc

SEQ ID NO: 765195 - RNA, 22 nt, Human
gugugucuugaccaggaucgga

SEQ ID NO: 765196 - RNA, 20 nt, Human
ccuggagccuggaaggaguc

SEQ ID NO: 765197 - RNA, 22 nt, Human
auuauucauugguaggcaagcu

SEQ ID NO: 765198 - RNA, 22 nt, Human
cugcugcucuugugcauuagug

SEQ ID NO: 765199 - RNA, 22 nt, Human
acacaugaaucacugguggaag

SEQ ID NO: 765200 - RNA, 22 nt, Human
cagcagaguauggcacucaacu

SEQ ID NO: 765201 - RNA, 22 nt, Human
auuguacaacugaggguggaau

SEQ ID NO: 765202 - RNA, 22 nt, Human
cagagcugagucuucaagguug

SEQ ID NO: 765203 - RNA, 22 nt, Human
ccuccuggugggcgcuucuggc

SEQ ID NO: 765204 - RNA, 22 nt, Human
caguagcaggcaggugcuuuug

SEQ ID NO: 765205 - RNA, 22 nt, Human
gccaugcagcuuauuaaagugg

SEQ ID NO: 765206 - RNA, 22 nt, Human
cagaauuugaaguaauauucca

SEQ ID NO: 765207 - RNA, 19 nt, Human
cccagguguuugaggcugc

SEQ ID NO: 765208 - RNA, 22 nt, Human
cugcagaauggggccaagugga

SEQ ID NO: 765209 - RNA, 22 nt, Human
cucugggcugaauggcugaacc

SEQ ID NO: 765210 - RNA, 22 nt, Human
gggcugagccauuugaaccuug

SEQ ID NO: 765211 - RNA, 22 nt, Human
cacugggcaauucugagccuaa

SEQ ID NO: 765212 - RNA, 22 nt, Human
gccaugcuugguaugcugugag

SEQ ID NO: 765213 - RNA, 22 nt, Human
auuccuugggcugccuuauuau

SEQ ID NO: 765214 - RNA, 22 nt, Human
ucaggccuccagguuaccauuu

SEQ ID NO: 765215 - RNA, 22 nt, Human
aaugauguauuaguacaacaca

SEQ ID NO: 765216 - RNA, 22 nt, Human
uaugaacacacuuuggaaguga

SEQ ID NO: 765217 - RNA, 22 nt, Human
ucagacaaguaaaauaauguaa

SEQ ID NO: 765218 - RNA, 22 nt, Human
uuguuauaaagacuaaauaugu

SEQ ID NO: 765219 - RNA, 22 nt, Human
ccaggcacucagagacugggac

SEQ ID NO: 765220 - RNA, 22 nt, Human
cauguacaaggaugcucagagu

SEQ ID NO: 765221 - RNA, 22 nt, Human
cucaccacagagccuguccagc

SEQ ID NO: 765222 - RNA, 22 nt, Human
uuacacuugaaaacaggauuua

SEQ ID NO: 765223 - RNA, 22 nt, Human
ggucgugaauugaaucaguggc

SEQ ID NO: 765224 - RNA, 22 nt, Human
aaggaggaauucugaguucaug

SEQ ID NO: 765225 - RNA, 22 nt, Human
cauccagcuccugggggccacc

SEQ ID NO: 765226 - RNA, 22 nt, Human
uucucaagaacauauguagggu

SEQ ID NO: 765227 - RNA, 22 nt, Human
augggaggcagcagagcccagc

SEQ ID NO: 765228 - RNA, 19 nt, Human
gaauguuuguauucagcgc

SEQ ID NO: 765229 - RNA, 22 nt, Human
agcuucaggaacaggcagccug

SEQ ID NO: 765230 - RNA, 22 nt, Human
guuccacaaaaggucuaguuua

SEQ ID NO: 765231 - RNA, 20 nt, Human
aacauugaaagucuagaaga

SEQ ID NO: 765232 - RNA, 22 nt, Human
ggcugcuguacugaugucaguu

SEQ ID NO: 765233 - RNA, 22 nt, Human
caaugguggugucagaagagau

SEQ ID NO: 765234 - RNA, 22 nt, Human
cuccagaaauuuggaugcagca

SEQ ID NO: 765235 - RNA, 22 nt, Human
guuauguaucuugauugggugg

SEQ ID NO: 765236 - RNA, 22 nt, Human
ggccacagucucuggaaggaug

SEQ ID NO: 765237 - RNA, 22 nt, Human
cuuuccuucucgugguucucac

SEQ ID NO: 765238 - RNA, 20 nt, Human
ccuggcuuugcagcaugaga

SEQ ID NO: 765239 - RNA, 22 nt, Human
ccuucacacuuucacuuggaua

SEQ ID NO: 765240 - RNA, 22 nt, Human
gauuccacagcuucgaggucuu

SEQ ID NO: 765241 - RNA, 22 nt, Human
gcccaggggcagcgcauagugg

SEQ ID NO: 765242 - RNA, 22 nt, Human
uucucacaguaccuaacaugua

SEQ ID NO: 765243 - RNA, 22 nt, Human
cagcaucucugccugccugcaa

SEQ ID NO: 765244 - RNA, 22 nt, Human
cggccgcguccagggccgccag

SEQ ID NO: 765245 - RNA, 22 nt, Human
aucaaaguaggcauauguuuuu

SEQ ID NO: 765246 - RNA, 22 nt, Human
aguaugaacggaaggccuggga

SEQ ID NO: 765247 - RNA, 22 nt, Human
aauggcaguaguugcaugagag

SEQ ID NO: 765248 - RNA, 22 nt, Human
agguuucuucuuaggaauaugu

SEQ ID NO: 765249 - RNA, 22 nt, Human
auucucuggucauugagcauau

SEQ ID NO: 765250 - RNA, 22 nt, Human
caggcagccugcggucugcaca

SEQ ID NO: 765251 - RNA, 22 nt, Human
acugccugcucauaacauugcu

SEQ ID NO: 765252 - RNA, 22 nt, Human
cagcuauagauggacugaagag

SEQ ID NO: 765253 - RNA, 22 nt, Human
uggguggagcuccacaaccugu

SEQ ID NO: 765254 - RNA, 22 nt, Human
ggcuggccucuacagggaggca

SEQ ID NO: 765255 - RNA, 22 nt, Human
gggccacacagaaccuccuggu

SEQ ID NO: 765256 - RNA, 22 nt, Human
guugcaggaggauggcugcaua

SEQ ID NO: 765257 - RNA, 22 nt, Human
ugcuggagcccaggcggccuuu

SEQ ID NO: 765258 - RNA, 22 nt, Human
accuggagauccauggugucga

SEQ ID NO: 765259 - RNA, 22 nt, Human
gagagguaauuugaagugcaaa

SEQ ID NO: 765260 - RNA, 22 nt, Human
uacaacugugugaaggaaucug

SEQ ID NO: 765261 - RNA, 22 nt, Human
uauuauugacuauucagaaugu

SEQ ID NO: 765262 - RNA, 19 nt, Human
cugagagaugcuucacaca

SEQ ID NO: 765263 - RNA, 22 nt, Human
ccauaaggagccagacauucca

SEQ ID NO: 765264 - RNA, 19 nt, Human
uggucccauacugcuggcc

SEQ ID NO: 765265 - RNA, 23 nt, Human
cauccaggagcugagucugacug

SEQ ID NO: 765266 - RNA, 22 nt, Human
cuggagagggagcccuggcagu

SEQ ID NO: 765267 - RNA, 23 nt, Human
cuugaaugggauggaauucacug

SEQ ID NO: 765268 - RNA, 22 nt, Human
gguggccucgguggugcacagg

SEQ ID NO: 765269 - RNA, 18 nt, Human
uccagagagggagaagug

SEQ ID NO: 765270 - RNA, 22 nt, Human
uuggaaaaugaggcacagagag

SEQ ID NO: 765271 - RNA, 22 nt, Human
ggcaaagagacaugcaucgggg

SEQ ID NO: 765272 - RNA, 22 nt, Human
auugucuuagucagcucggacu

SEQ ID NO: 765273 - RNA, 22 nt, Human
aggaugaauaacugaaauggug

SEQ ID NO: 765274 - RNA, 22 nt, Human
ccagguaggagagagggauccu

SEQ ID NO: 765275 - RNA, 22 nt, Human
cuucucucggugcaucccucac

SEQ ID NO: 765276 - RNA, 22 nt, Human
uagugauugcugauauuccauu

SEQ ID NO: 765277 - RNA, 22 nt, Human
ucucaguguguugagaggucug

SEQ ID NO: 765278 - RNA, 22 nt, Human
acuuccagaggguguggaaaua

SEQ ID NO: 765279 - RNA, 22 nt, Human
cucagcucacucuuuugugcuu

SEQ ID NO: 765280 - RNA, 22 nt, Human
uuuuaccugaaccacacaguau

SEQ ID NO: 765281 - RNA, 22 nt, Human
cccuggagcugcuugcauguug

SEQ ID NO: 765282 - RNA, 22 nt, Human
agaaucaacugaaaauugguga

SEQ ID NO: 765283 - RNA, 22 nt, Human
aucuuuaggcaaguuacuuaac

SEQ ID NO: 765284 - RNA, 22 nt, Human
cagcugcaggcugugcaggaag

SEQ ID NO: 765285 - RNA, 22 nt, Human
ugagaacauacaaacagagaaa

SEQ ID NO: 765286 - RNA, 22 nt, Human
ccucuucauccuggaagcugcu

SEQ ID NO: 765287 - RNA, 22 nt, Human
ccaggacuuuaaguccagcacu

SEQ ID NO: 765288 - RNA, 22 nt, Human
ucacagccuggacaguugccug

SEQ ID NO: 765289 - RNA, 20 nt, Human
uuucaaaggcaccuaugaag

SEQ ID NO: 765290 - RNA, 22 nt, Human
uugcuugacuuuguguaccugu

SEQ ID NO: 765291 - RNA, 22 nt, Human
agagugggacacgggcgcuguc

SEQ ID NO: 765292 - RNA, 22 nt, Human
gguuuaauuaccugcaucucaa

SEQ ID NO: 765293 - RNA, 23 nt, Human
acagaugaaaguguggcucagag

SEQ ID NO: 765294 - RNA, 22 nt, Human
acgugcgugugcgcacacauac

SEQ ID NO: 765295 - RNA, 22 nt, Human
cacauuaagaauaaugagacua

SEQ ID NO: 765296 - RNA, 22 nt, Human
aggcuaggaaucaagccuuucu

SEQ ID NO: 765297 - RNA, 22 nt, Human
acaguguucuugauauuacagu

SEQ ID NO: 765298 - RNA, 18 nt, Human
ucccaucauccucuccag

SEQ ID NO: 765299 - RNA, 19 nt, Human
ucacccaggcugcuggcuc

SEQ ID NO: 765300 - RNA, 22 nt, Human
acacagaagcuuuuucuauucc

SEQ ID NO: 765301 - RNA, 22 nt, Human
uccagacuggggccaugucugc

SEQ ID NO: 765302 - RNA, 22 nt, Human
gaaaccacaguacccaggaaaa

SEQ ID NO: 765303 - RNA, 22 nt, Human
cuggcagcagcuucuggaucga

SEQ ID NO: 765304 - RNA, 22 nt, Human
agcagcagggcucugcccgugc

SEQ ID NO: 765305 - RNA, 22 nt, Human
gcugcagguuugucuagucugg

SEQ ID NO: 765306 - RNA, 22 nt, Human
ccaggccugcauucccucucag

SEQ ID NO: 765307 - RNA, 22 nt, Human
guucccaccccugagcuccgau

SEQ ID NO: 765308 - RNA, 22 nt, Human
uguaacuggacaagauauucau

SEQ ID NO: 765309 - RNA, 23 nt, Human
auguccaguuuacuucaggauga

SEQ ID NO: 765310 - RNA, 22 nt, Human
ucaacaaugggucuguaaugga

SEQ ID NO: 765311 - RNA, 22 nt, Human
ugucagagagcaggcaguagaa

SEQ ID NO: 765312 - RNA, 22 nt, Human
caaggauucucacuagacuaga

SEQ ID NO: 765313 - RNA, 22 nt, Human
agugaauaugcagcaagaaguu

SEQ ID NO: 765314 - RNA, 22 nt, Human
uuauucaggucauggacuguca

SEQ ID NO: 765315 - RNA, 22 nt, Human
guggggguggaaaggcaaguug

SEQ ID NO: 765316 - RNA, 22 nt, Human
aaaugcugaguguuuagagauc

SEQ ID NO: 765317 - RNA, 21 nt, Human
gcacagcaugaguguuggcau

SEQ ID NO: 765318 - RNA, 22 nt, Human
cagcugaagaaagagugguuag

SEQ ID NO: 765319 - RNA, 15 nt, Human
ccaggcugggugagc

SEQ ID NO: 765320 - RNA, 22 nt, Human
auucaauaagucacuguggaau

SEQ ID NO: 765321 - RNA, 22 nt, Human
aaccaagcucaauggucugagu

SEQ ID NO: 765322 - RNA, 22 nt, Human
ccaaugauggugcccacgauga

SEQ ID NO: 765323 - RNA, 22 nt, Human
guguucauugcuagugaggugu

SEQ ID NO: 765324 - RNA, 22 nt, Human
cuggcuccauuacucagcaucu

SEQ ID NO: 765325 - RNA, 22 nt, Human
agcugccugcugcacucggugc

SEQ ID NO: 765326 - RNA, 22 nt, Human
gaaaugcaggcuuggauucagc

SEQ ID NO: 765327 - RNA, 22 nt, Human
gcuuccagaucccaugcucuua

SEQ ID NO: 765328 - RNA, 22 nt, Human
uaguacagagacacuggaggaa

SEQ ID NO: 765329 - RNA, 22 nt, Human
cagauucuucauucauucuaca

SEQ ID NO: 765330 - RNA, 21 nt, Human
cagugccagccacaggacgcc

SEQ ID NO: 765331 - RNA, 22 nt, Human
gcaggaagaggcucgaagcccc

SEQ ID NO: 765332 - RNA, 22 nt, Human
cacuguggauacagaaauuagu

SEQ ID NO: 765333 - RNA, 22 nt, Human
gauucacucauauuuuacguuu

SEQ ID NO: 765334 - RNA, 22 nt, Human
ccagcccuucccaacuggccag

SEQ ID NO: 765335 - RNA, 22 nt, Human
ucugccaggagccaugagcaag

SEQ ID NO: 765336 - RNA, 22 nt, Human
ucugugcugagcucugagaugu

SEQ ID NO: 765337 - RNA, 22 nt, Human
aacuuagugagccacucuugca

SEQ ID NO: 765338 - RNA, 22 nt, Human
uuacaguauuguuaaacucuuu

SEQ ID NO: 765339 - RNA, 22 nt, Human
ucaguguguacacugagcauuu

SEQ ID NO: 765340 - RNA, 22 nt, Human
uauauuccaguucaucucuuga

SEQ ID NO: 765341 - RNA, 22 nt, Human
aggcuccagucugaaccuuggg

SEQ ID NO: 765342 - RNA, 22 nt, Human
ugcuguggcaguuuauguauag

SEQ ID NO: 765343 - RNA, 22 nt, Human
aggagccauccccaugagaggu

SEQ ID NO: 765344 - RNA, 22 nt, Human
gugcaggagcucccgcaguggu

SEQ ID NO: 765345 - RNA, 22 nt, Human
auuccuuguuucacugaaaagg

SEQ ID NO: 765346 - RNA, 22 nt, Human
aacaaaugaccugauuucuucc

SEQ ID NO: 765347 - RNA, 22 nt, Human
cugugaaacuggacagcacuug

SEQ ID NO: 765348 - RNA, 22 nt, Human
uuucacagauguuuuggagucu

SEQ ID NO: 765349 - RNA, 22 nt, Human
ccaggcuggagugcaguagugu

SEQ ID NO: 765350 - RNA, 18 nt, Human
acuggcuuuagcaucaga

SEQ ID NO: 765351 - RNA, 22 nt, Human
cccuggagucagguuggccugg

SEQ ID NO: 765352 - RNA, 22 nt, Human
ggcaccuggauguagcagugaa

SEQ ID NO: 765353 - RNA, 20 nt, Human
cuggccagaacgccuacaca

SEQ ID NO: 765354 - RNA, 22 nt, Human
aauuuccagaucagaugacuca

SEQ ID NO: 765355 - RNA, 22 nt, Human
uauuugauagagauaaaugaua

SEQ ID NO: 765356 - RNA, 22 nt, Human
cacuaagauuuaaaguauuagu

SEQ ID NO: 765357 - RNA, 23 nt, Human
cccagagcacagccuccagaugc

SEQ ID NO: 765358 - RNA, 22 nt, Human
uguuuauaccuugguauaacca

SEQ ID NO: 765359 - RNA, 22 nt, Human
uccauggguagcccugguugag

SEQ ID NO: 765360 - RNA, 22 nt, Human
caaaugauagagccgauuauca

SEQ ID NO: 765361 - RNA, 22 nt, Human
ggccaccaaaguccuguggcuu

SEQ ID NO: 765362 - RNA, 22 nt, Human
ccauccagaccaguccaugggu

SEQ ID NO: 765363 - RNA, 22 nt, Human
cucugugcuuaugcuccauggg

SEQ ID NO: 765364 - RNA, 22 nt, Human
aaacauuagacaccauaugcuc

SEQ ID NO: 765365 - RNA, 22 nt, Human
ucucacagccauuucucccucu

SEQ ID NO: 765366 - RNA, 22 nt, Human
gaguacaucuuaauuugacuaa

SEQ ID NO: 765367 - RNA, 22 nt, Human
gcacagcucaguacucccucug

SEQ ID NO: 765368 - RNA, 22 nt, Human
acacacuggcaggagcuauaaa

SEQ ID NO: 765369 - RNA, 20 nt, Human
gcuccuguccugguggaggg

SEQ ID NO: 765370 - RNA, 22 nt, Human
ggagcugggaauuggaucaucu

SEQ ID NO: 765371 - RNA, 22 nt, Human
cuuugaagagauuacugugcuc

SEQ ID NO: 765372 - RNA, 22 nt, Human
auugaaauugaugaaauucuug

SEQ ID NO: 765373 - RNA, 22 nt, Human
aaacacagcauguccuugggga

SEQ ID NO: 765374 - RNA, 22 nt, Human
ucuggcagaggaaggaggccug

SEQ ID NO: 765375 - RNA, 22 nt, Human
gcccagcacaucuggccuugaa

SEQ ID NO: 765376 - RNA, 22 nt, Human
agguucaguaaauguuaguuga

SEQ ID NO: 765377 - RNA, 22 nt, Human
augcuggcagccgagugcucca

SEQ ID NO: 765378 - RNA, 22 nt, Human
aauuucucucucaugcuucaug

SEQ ID NO: 765379 - RNA, 22 nt, Human
uucauugaaauuaagcccaacu

SEQ ID NO: 765380 - RNA, 22 nt, Human
gcucagcugcaccuggagagcc

SEQ ID NO: 765381 - RNA, 22 nt, Human
uuucuucucgacaccuuauccc

SEQ ID NO: 765382 - RNA, 22 nt, Human
agccaggacaucucuagcugcu

SEQ ID NO: 765383 - RNA, 22 nt, Human
agacugggccauuuccccagcu

SEQ ID NO: 765384 - RNA, 22 nt, Human
auacagaaguuuuccacuuauu

SEQ ID NO: 765385 - RNA, 22 nt, Human
guaggguuggagagcacaacca

SEQ ID NO: 765386 - RNA, 22 nt, Human
ggcccagcuguauauuacaguu

SEQ ID NO: 765387 - RNA, 22 nt, Human
gucauucuuaacaacucaguag

SEQ ID NO: 765388 - RNA, 22 nt, Human
agcaagcagaaaugccauggca

SEQ ID NO: 765389 - RNA, 22 nt, Human
ucuggagauaagcagcaaugaa

SEQ ID NO: 765390 - RNA, 23 nt, Human
ccagugauugccuggaaggaggu

SEQ ID NO: 765391 - RNA, 22 nt, Human
gucccucugcucuagagagcca

SEQ ID NO: 765392 - RNA, 22 nt, Human
gauaaugugccgauaauuucua

SEQ ID NO: 765393 - RNA, 22 nt, Human
auacaaguucucauguguaucu

SEQ ID NO: 765394 - RNA, 20 nt, Human
uagauucugucuguccaaac

SEQ ID NO: 765395 - RNA, 22 nt, Human
gaagucuggcugacgagaguua

SEQ ID NO: 765396 - RNA, 23 nt, Human
aacuuugccaggagacagcacag

SEQ ID NO: 765397 - RNA, 21 nt, Human
augugcagcaagcagcaugcu

SEQ ID NO: 765398 - RNA, 22 nt, Human
ccuggcagguggagguugcagu

SEQ ID NO: 765399 - RNA, 22 nt, Human
ccggcgaccgcugucggaggcg

SEQ ID NO: 765400 - RNA, 22 nt, Human
ucccacagugaaguucaugaua

SEQ ID NO: 765401 - RNA, 22 nt, Human
gcaguaaguuaauagugcuggu

SEQ ID NO: 765402 - RNA, 21 nt, Human
aagaugguuaugugcuaaaga

SEQ ID NO: 765403 - RNA, 22 nt, Human
uucuguacccucgcgauucucc

SEQ ID NO: 765404 - RNA, 22 nt, Human
ggcuguggccagcggggcugag

SEQ ID NO: 765405 - RNA, 22 nt, Human
cagcaggaccauugaggcauca

SEQ ID NO: 765406 - RNA, 22 nt, Human
acuuuccuggcccuguccucug

SEQ ID NO: 765407 - RNA, 15 nt, Human
gcccucaggcgacac

SEQ ID NO: 765408 - RNA, 22 nt, Human
uacaugaaguugucuaaacugg

SEQ ID NO: 765409 - RNA, 22 nt, Human
uaaaagacauauaacuguagga

SEQ ID NO: 765410 - RNA, 22 nt, Human
cagauaggaaaagcuaggcaua

SEQ ID NO: 765411 - RNA, 22 nt, Human
gacucuuucaaacagaaagcca

SEQ ID NO: 765412 - RNA, 22 nt, Human
guagaaauauuuaucucugaga

SEQ ID NO: 765413 - RNA, 22 nt, Human
uucugagcuacauaguacuggg

SEQ ID NO: 765414 - RNA, 22 nt, Human
guccagagaagggaggggacuc

SEQ ID NO: 765415 - RNA, 18 nt, Human
aaggcuucaaagaguaga

SEQ ID NO: 765416 - RNA, 22 nt, Human
ucagauuuuccacagacuggaa

SEQ ID NO: 765417 - RNA, 22 nt, Human
gcauuuguuccgcuuugucauc

SEQ ID NO: 765418 - RNA, 19 nt, Human
gaggcgaggcgugcaggag

SEQ ID NO: 765419 - RNA, 22 nt, Human
acucaggcacucagcccucgcc

SEQ ID NO: 765420 - RNA, 22 nt, Human
gcauuggcauuucuccagcgga

SEQ ID NO: 765421 - RNA, 22 nt, Human
ugggaaguuaggaugccaggga

SEQ ID NO: 765422 - RNA, 22 nt, Human
cuggcccagucucagaguguca

SEQ ID NO: 765423 - RNA, 23 nt, Human
uccucaguauauaaaggcagaug

SEQ ID NO: 765424 - RNA, 22 nt, Human
uucacauuugcccuuaugugug

SEQ ID NO: 765425 - RNA, 17 nt, Human
uuucugcaugauuggac

SEQ ID NO: 765426 - RNA, 22 nt, Human
agccagggucucucgcucuguu

SEQ ID NO: 765427 - RNA, 22 nt, Human
ccugaaaaucaagguaguuugg

SEQ ID NO: 765428 - RNA, 22 nt, Human
uuucacaaucaaauggugaaau

SEQ ID NO: 765429 - RNA, 22 nt, Human
ugacaaaccaguagcaauaaag

SEQ ID NO: 765430 - RNA, 22 nt, Human
caugggcuuuggaggcuggagg

SEQ ID NO: 765431 - RNA, 22 nt, Human
ugggccugacacuuacuaggga

SEQ ID NO: 765432 - RNA, 22 nt, Human
cagggagggacaauugucaccu

SEQ ID NO: 765433 - RNA, 22 nt, Human
caggaaagccgagugccauagg

SEQ ID NO: 765434 - RNA, 22 nt, Human
acagcaucauauaguggaagaa

SEQ ID NO: 765435 - RNA, 20 nt, Human
cugcuugggccccucuggcc

SEQ ID NO: 765436 - RNA, 22 nt, Human
cauccaguggucagggaaguug

SEQ ID NO: 765437 - RNA, 22 nt, Human
caagcuggcugggagaggcacg

SEQ ID NO: 765438 - RNA, 22 nt, Human
ugccagccagggaagcucaccc

SEQ ID NO: 765439 - RNA, 22 nt, Human
augaacucuugcuuuauuucag

SEQ ID NO: 765440 - RNA, 22 nt, Human
uggggagaaaugucuuuguucc

SEQ ID NO: 765441 - RNA, 22 nt, Human
aguccuggacuuggagucaggg

SEQ ID NO: 765442 - RNA, 22 nt, Human
acuacuacaagugaguacaaag

SEQ ID NO: 765443 - RNA, 17 nt, Human
augaggucauuaagaua

SEQ ID NO: 765444 - RNA, 22 nt, Human
ggaggaagcacacggcuuguau

SEQ ID NO: 765445 - RNA, 22 nt, Human
uacaggugguaaaaauauuguu

SEQ ID NO: 765446 - RNA, 22 nt, Human
cagccuucugaaugaacguacu

SEQ ID NO: 765447 - RNA, 21 nt, Human
uacauugacuacaaauaaagc

SEQ ID NO: 765448 - RNA, 22 nt, Human
uuuacugaacugcuaguacagg

SEQ ID NO: 765449 - RNA, 22 nt, Human
aacaugcucuguuucuuggaug

SEQ ID NO: 765450 - RNA, 22 nt, Human
aggcaggccgugucccuccuca

SEQ ID NO: 765451 - RNA, 22 nt, Human
uauauucauuuuaaagccaucu

SEQ ID NO: 765452 - RNA, 17 nt, Human
cuauuuuggagauuaaa

SEQ ID NO: 765453 - RNA, 22 nt, Human
ccugaagaauucaaauccagau

SEQ ID NO: 765454 - RNA, 23 nt, Human
ucagcugcuuccuccugccugcc

SEQ ID NO: 765455 - RNA, 22 nt, Human
guccucugggagccuugagccu

SEQ ID NO: 765456 - RNA, 22 nt, Human
ugcuggggucucuccggugccc

SEQ ID NO: 765457 - RNA, 22 nt, Human
aguggacauucugcacuuggag

SEQ ID NO: 765458 - RNA, 22 nt, Human
ggcagcaaauauugucagcugu

SEQ ID NO: 765459 - RNA, 22 nt, Human
cuguacauaaaggaauaggugu

SEQ ID NO: 765460 - RNA, 22 nt, Human
cugucugugaccucugcauguc

SEQ ID NO: 765461 - RNA, 22 nt, Human
aaggcagcacagcaacugcuca

SEQ ID NO: 765462 - RNA, 22 nt, Human
ucauuucaaguucugacagcua

SEQ ID NO: 765463 - RNA, 22 nt, Human
cagggcaugaggugugcuucuc

SEQ ID NO: 765464 - RNA, 22 nt, Human
gugcagaccuuaguucaagcca

SEQ ID NO: 765465 - RNA, 22 nt, Human
uuuaaaaggcagcuucuuuugu

SEQ ID NO: 765466 - RNA, 19 nt, Human
ggucagcugggcuagaggc

SEQ ID NO: 765467 - RNA, 22 nt, Human
uggcucaggauaauuuucccaa

SEQ ID NO: 765468 - RNA, 22 nt, Human
uguaguguggccuaucuuugcc

SEQ ID NO: 765469 - RNA, 22 nt, Human
uggcagggccuaccccaauauc

SEQ ID NO: 765470 - RNA, 22 nt, Human
ucauaaaguucuaagaauugua

SEQ ID NO: 765471 - RNA, 22 nt, Human
ucacaguauucaugaacaugga

SEQ ID NO: 765472 - RNA, 22 nt, Human
auuguacaaaaaaguagaccuu

SEQ ID NO: 765473 - RNA, 22 nt, Human
uauguacauaacaugaaaugca

SEQ ID NO: 765474 - RNA, 22 nt, Human
augggagugacagggccacugg

SEQ ID NO: 765475 - RNA, 20 nt, Human
cucacagucaaugcagaggu

SEQ ID NO: 765476 - RNA, 22 nt, Human
ucauauuuauauguuggcacag

SEQ ID NO: 765477 - RNA, 22 nt, Human
cccuucaggguuaaguagaggg

SEQ ID NO: 765478 - RNA, 22 nt, Human
ugcuccagccccuggugcacag

SEQ ID NO: 765479 - RNA, 22 nt, Human
ugcaagggguuuaugcagauga

SEQ ID NO: 765480 - RNA, 19 nt, Human
ugauggaauuugacauucc

SEQ ID NO: 765481 - RNA, 22 nt, Human
uuggcagugaugcagcuuguuc

SEQ ID NO: 765482 - RNA, 22 nt, Human
uucaagaugcacaguggcauuc

SEQ ID NO: 765483 - RNA, 22 nt, Human
ugggcagauuaaugcaguggcu

SEQ ID NO: 765484 - RNA, 22 nt, Human
cuucccugagcuuucucaggcu

SEQ ID NO: 765485 - RNA, 22 nt, Human
accugggagucacaccugagaa

SEQ ID NO: 765486 - RNA, 22 nt, Human
uucuuaaaacuuauggacaggu

SEQ ID NO: 765487 - RNA, 22 nt, Human
uuuccuugcacauugguuucca

SEQ ID NO: 765488 - RNA, 19 nt, Human
ucauaaggagagaggaaau

SEQ ID NO: 765489 - RNA, 22 nt, Human
aggcuggugucucuguccuguc

SEQ ID NO: 765490 - RNA, 22 nt, Human
aaguuuagcuugagauggaaag

SEQ ID NO: 765491 - RNA, 22 nt, Human
ugucuggggaacugugcaucca

SEQ ID NO: 765492 - RNA, 23 nt, Human
ugugggaauguuggagaggaaac

SEQ ID NO: 765493 - RNA, 22 nt, Human
aggcacagccucccuucacaug

SEQ ID NO: 765494 - RNA, 22 nt, Human
cuauuuucauucuuacauuguc

SEQ ID NO: 765495 - RNA, 22 nt, Human
acagauaaaaguuguuuaaaau

SEQ ID NO: 765496 - RNA, 22 nt, Human
gcccugcucuguuggucaccug

SEQ ID NO: 765497 - RNA, 22 nt, Human
uuuacccauucagacucacuug

SEQ ID NO: 765498 - RNA, 22 nt, Human
uagacacaagagaaggguauaa

SEQ ID NO: 765499 - RNA, 22 nt, Human
gauccguugcaaccaauuagca

SEQ ID NO: 765500 - RNA, 22 nt, Human
ucucauaauuagguaagucaga

SEQ ID NO: 765501 - RNA, 22 nt, Human
uaaaguauccaguuauucuucu

SEQ ID NO: 765502 - RNA, 22 nt, Human
gugacugugagucgcugugaca

SEQ ID NO: 765503 - RNA, 22 nt, Human
accuucuuccaccaaaaacguc

SEQ ID NO: 765504 - RNA, 22 nt, Human
auuugcuucugugaaaucaagu

SEQ ID NO: 765505 - RNA, 20 nt, Human
uucagggcuuuggggacacc

SEQ ID NO: 765506 - RNA, 22 nt, Human
aagauaaacucuugauuucuga

SEQ ID NO: 765507 - RNA, 19 nt, Human
ugaggggcucacagucuca

SEQ ID NO: 765508 - RNA, 22 nt, Human
auaucaguaucuauguauuugu

SEQ ID NO: 765509 - RNA, 22 nt, Human
agccagcuaagggaagcaugau

SEQ ID NO: 765510 - RNA, 22 nt, Human
uugauuuauagaauguucaagc

SEQ ID NO: 765511 - RNA, 22 nt, Human
aucauuggaggcacugugcagu

SEQ ID NO: 765512 - RNA, 22 nt, Human
ugcaggaguccaaucaggagac

SEQ ID NO: 765513 - RNA, 22 nt, Human
ucauugauggcuucuuucuugc

SEQ ID NO: 765514 - RNA, 22 nt, Human
ggcugccauaacagaguaccac

SEQ ID NO: 765515 - RNA, 22 nt, Human
ccaggaguuggaagcugccaug

SEQ ID NO: 765516 - RNA, 22 nt, Human
ugugaaaucacaggcuauuuag

SEQ ID NO: 765517 - RNA, 19 nt, Human
cccucauucacuuauucuc

SEQ ID NO: 765518 - RNA, 22 nt, Human
ugcagcaggugacaacgagugg

SEQ ID NO: 765519 - RNA, 22 nt, Human
acuggggcagugggcagugguu

SEQ ID NO: 765520 - RNA, 22 nt, Human
uugacuuuauguguauguuuac

SEQ ID NO: 765521 - RNA, 22 nt, Human
aaagugcaucaaaugacuuccc

SEQ ID NO: 765522 - RNA, 22 nt, Human
ugggcagaggcagcagaaaccu

SEQ ID NO: 765523 - RNA, 18 nt, Human
ucuggcuuuguuccuugu

SEQ ID NO: 765524 - RNA, 22 nt, Human
aggaaacaacuuggcaugagcc

SEQ ID NO: 765525 - RNA, 19 nt, Human
acugccugaggcucacagg

SEQ ID NO: 765526 - RNA, 22 nt, Human
gagguggcugcuugcugggaaa

SEQ ID NO: 765527 - RNA, 22 nt, Human
uaggaaaacgugauuuucucac

SEQ ID NO: 765528 - RNA, 22 nt, Human
aggaauagaccacuucacugag

SEQ ID NO: 765529 - RNA, 22 nt, Human
agccagaaccacuggaacggug

SEQ ID NO: 765530 - RNA, 22 nt, Human
ucagugcagugaaagguuuacu

SEQ ID NO: 765531 - RNA, 22 nt, Human
uuauaguuaguaggucauuaaa

SEQ ID NO: 765532 - RNA, 19 nt, Human
aaaucagaaucugcauuuu

SEQ ID NO: 765533 - RNA, 22 nt, Human
cuuuuacaguggaccugccauu

SEQ ID NO: 765534 - RNA, 22 nt, Human
gaggggagaaggcacuaaccag

SEQ ID NO: 765535 - RNA, 18 nt, Human
ccauuucaugauuauuac

SEQ ID NO: 765536 - RNA, 22 nt, Human
gacuucauaauauugagcaugu

SEQ ID NO: 765537 - RNA, 23 nt, Human
acaugggaaaugcaaagagaagu

SEQ ID NO: 765538 - RNA, 22 nt, Human
ggccacagagggcgggaugcug

SEQ ID NO: 765539 - RNA, 22 nt, Human
ggccaaaagcauaauccucaca

SEQ ID NO: 765540 - RNA, 22 nt, Human
cugugucuuccucugcccaggc

SEQ ID NO: 765541 - RNA, 23 nt, Human
uagaaugucauucaaugauaugg

SEQ ID NO: 765542 - RNA, 22 nt, Human
uuuuguuuucuuagaaaccugg

SEQ ID NO: 765543 - RNA, 22 nt, Human
ggcagcaguccauggcccaagg

SEQ ID NO: 765544 - RNA, 22 nt, Human
guauauauuggauaaaccagag

SEQ ID NO: 765545 - RNA, 22 nt, Human
auggcuuuccggacuuuggcca

SEQ ID NO: 765546 - RNA, 20 nt, Human
ucugauaaaaacuacuccau

SEQ ID NO: 765547 - RNA, 23 nt, Human
cagguggcuccacgagggguggg

SEQ ID NO: 765548 - RNA, 22 nt, Human
cucuuuggcguuggcagagcca

SEQ ID NO: 765549 - RNA, 22 nt, Human
ccaggaguuggagguugcagug

SEQ ID NO: 765550 - RNA, 22 nt, Human
uauuguaucuucuguuuagaag

SEQ ID NO: 765551 - RNA, 22 nt, Human
gauuuucaugauaaacuuguga

SEQ ID NO: 765552 - RNA, 22 nt, Human
aggacaauugagaguuuguuga

SEQ ID NO: 765553 - RNA, 22 nt, Human
ggagucagccugucagagugua

SEQ ID NO: 765554 - RNA, 22 nt, Human
gcccagcuccucugcagacccu

SEQ ID NO: 765555 - RNA, 22 nt, Human
cccucccuauguagaugauguu

SEQ ID NO: 765556 - RNA, 22 nt, Human
uugucugcaugauucuaggcag

SEQ ID NO: 765557 - RNA, 22 nt, Human
aguaaugucccuuaaauguggu

SEQ ID NO: 765558 - RNA, 22 nt, Human
agugucugcagugaugucucuu

SEQ ID NO: 765559 - RNA, 22 nt, Human
cuugccaguguugcagaagcuc

SEQ ID NO: 765560 - RNA, 22 nt, Human
uggucuaagagccuaacugcug

SEQ ID NO: 765561 - RNA, 22 nt, Human
aagaagcaugagaagauuuuau

SEQ ID NO: 765562 - RNA, 22 nt, Human
augacuucguuuucucucugca

SEQ ID NO: 765563 - RNA, 22 nt, Human
uucugggcaggacuggggaccc

SEQ ID NO: 765564 - RNA, 17 nt, Human
ggcaggugcggggccgc

SEQ ID NO: 765565 - RNA, 22 nt, Human
gggacaugaagcaucggaggca

SEQ ID NO: 765566 - RNA, 22 nt, Human
uuggaaggugagucccuggguu

SEQ ID NO: 765567 - RNA, 22 nt, Human
uuacaagauugauuugcuuggc

SEQ ID NO: 765568 - RNA, 22 nt, Human
uguggcugcaggcgauggagga

SEQ ID NO: 765569 - RNA, 22 nt, Human
ugaagcugccugcucacagcca

SEQ ID NO: 765570 - RNA, 22 nt, Human
ggcaugcucuuuguccacagua

SEQ ID NO: 765571 - RNA, 22 nt, Human
cagaguacugggagaacagaag

SEQ ID NO: 765572 - RNA, 20 nt, Human
acugugugaucuggaaagcu

SEQ ID NO: 765573 - RNA, 22 nt, Human
cugcucuucccacucacuccca

SEQ ID NO: 765574 - RNA, 22 nt, Human
gcucuugaccuuggagaacucg

SEQ ID NO: 765575 - RNA, 20 nt, Human
uauaacaguguugggugugu

SEQ ID NO: 765576 - RNA, 22 nt, Human
gggcuagaaauucugcagugga

SEQ ID NO: 765577 - RNA, 21 nt, Human
guuaagccuugaggugauugu

SEQ ID NO: 765578 - RNA, 22 nt, Human
uaagcuauuccugaagaagguu

SEQ ID NO: 765579 - RNA, 19 nt, Human
agugcagggagcacccuca

SEQ ID NO: 765580 - RNA, 22 nt, Human
ugcucugggauucagcagccug

SEQ ID NO: 765581 - RNA, 20 nt, Human
cauuucauugugucuucacu

SEQ ID NO: 765582 - RNA, 22 nt, Human
auaucacaaacaagucuguacu

SEQ ID NO: 765583 - RNA, 22 nt, Human
cagaggucugaugcgucccugc

SEQ ID NO: 765584 - RNA, 22 nt, Human
uuucuuauauucugucauuguu

SEQ ID NO: 765585 - RNA, 22 nt, Human
uguuaaauguuuugcuaguguc

SEQ ID NO: 765586 - RNA, 22 nt, Human
cccuaggggcaaugauggugcu

SEQ ID NO: 765587 - RNA, 22 nt, Human
aguccuggcauauagguccuca

SEQ ID NO: 765588 - RNA, 22 nt, Human
gggccaaggggagcuggaaggg

SEQ ID NO: 765589 - RNA, 22 nt, Human
gggcugagaauucagcuuuccu

SEQ ID NO: 765590 - RNA, 22 nt, Human
agcagcaggagccgugggguga

SEQ ID NO: 765591 - RNA, 22 nt, Human
gggcugcuuccuggggaaugcu

SEQ ID NO: 765592 - RNA, 22 nt, Human
gcagcugagagaagaacagggc

SEQ ID NO: 765593 - RNA, 22 nt, Human
cuggcugccacuucagggucuu

SEQ ID NO: 765594 - RNA, 22 nt, Human
ggggcuguuuuuggaauggcug

SEQ ID NO: 765595 - RNA, 22 nt, Human
agaaguuuguuauguaaacaaa

SEQ ID NO: 765596 - RNA, 23 nt, Human
uuugaagaagugaauaucauaua

SEQ ID NO: 765597 - RNA, 23 nt, Human
gcucagguggcucagggacugau

SEQ ID NO: 765598 - RNA, 22 nt, Human
acccagaggugucuagcaagcu

SEQ ID NO: 765599 - RNA, 22 nt, Human
caaugauucugcaacugugugc

SEQ ID NO: 765600 - RNA, 22 nt, Human
aaauuguccuuuuaagaaacag

SEQ ID NO: 765601 - RNA, 22 nt, Human
cuaggcccaugagguuugcugg

SEQ ID NO: 765602 - RNA, 22 nt, Human
uacacacagaggccaugggauu

SEQ ID NO: 765603 - RNA, 22 nt, Human
uuucagagccugcaaucccaau

SEQ ID NO: 765604 - RNA, 22 nt, Human
caaggcuaagcuuuggcuuucu

SEQ ID NO: 765605 - RNA, 22 nt, Human
gcuggcugaguucugucgucug

SEQ ID NO: 765606 - RNA, 23 nt, Human
cuugagcucaggaagagcugagu

SEQ ID NO: 765607 - RNA, 22 nt, Human
uagcugugaaacagcagaagag

SEQ ID NO: 765608 - RNA, 19 nt, Human
cuucuggcccugagccacc

SEQ ID NO: 765609 - RNA, 22 nt, Human
ccagaaagacuuuuuagguacg

SEQ ID NO: 765610 - RNA, 22 nt, Human
agguggcugguccaggcugcag

SEQ ID NO: 765611 - RNA, 22 nt, Human
gaaguauagcagauguuauuua

SEQ ID NO: 765612 - RNA, 22 nt, Human
cugccagggaggcugggaaguu

SEQ ID NO: 765613 - RNA, 22 nt, Human
uggguagagugcugacaaugcc

SEQ ID NO: 765614 - RNA, 22 nt, Human
gccugugcuuaacugacgugag

SEQ ID NO: 765615 - RNA, 22 nt, Human
gccaggaccucagaugcagggc

SEQ ID NO: 765616 - RNA, 22 nt, Human
gcccaggaucugcucagaucau

SEQ ID NO: 765617 - RNA, 22 nt, Human
gccaagaaugcgacagccguca

SEQ ID NO: 765618 - RNA, 22 nt, Human
ugucauuaugaggauuacaaua

SEQ ID NO: 765619 - RNA, 22 nt, Human
ugcagagauuuggcucuuaaag

SEQ ID NO: 765620 - RNA, 21 nt, Human
agggagcauguuagcuuucga

SEQ ID NO: 765621 - RNA, 22 nt, Human
aucccucagcagacagcaaaau

SEQ ID NO: 765622 - RNA, 22 nt, Human
aggcagccaucugcaggaagga

SEQ ID NO: 765623 - RNA, 22 nt, Human
uacuucaaccuucucuauuaga

SEQ ID NO: 765624 - RNA, 22 nt, Human
uccuaauugcuucauguguugu

SEQ ID NO: 765625 - RNA, 22 nt, Human
uggcagauacccaggcaaaugg

SEQ ID NO: 765626 - RNA, 22 nt, Human
uggaggcagucaccugaaguca

SEQ ID NO: 765627 - RNA, 22 nt, Human
cuggguaccucaccgcugcugc

SEQ ID NO: 765628 - RNA, 22 nt, Human
cuggcugcaggaaggagugggc

SEQ ID NO: 765629 - RNA, 22 nt, Human
aguuauaaaaggagcacugauu

SEQ ID NO: 765630 - RNA, 22 nt, Human
uguacaguaggaacuuguuauu

SEQ ID NO: 765631 - RNA, 22 nt, Human
ccugagagguuggccuguccag

SEQ ID NO: 765632 - RNA, 17 nt, Human
uuuguacaacauuuuaa

SEQ ID NO: 765633 - RNA, 19 nt, Human
guguggcagagagugacca

SEQ ID NO: 765634 - RNA, 22 nt, Human
acagagucauucacugaugaag

SEQ ID NO: 765635 - RNA, 17 nt, Human
gcaagggaugggagauu

SEQ ID NO: 765636 - RNA, 22 nt, Human
ugugugcagccucugucuuugg

SEQ ID NO: 765637 - RNA, 22 nt, Human
agcuuucguuccuuagacacau

SEQ ID NO: 765638 - RNA, 19 nt, Human
auauaggcugaaccaugcu

SEQ ID NO: 765639 - RNA, 22 nt, Human
cugagggccgggacccaguuuc

SEQ ID NO: 765640 - RNA, 22 nt, Human
ugcuggagaggaaggugggguc

SEQ ID NO: 765641 - RNA, 22 nt, Human
ucaggccuuguccugaccuccu

SEQ ID NO: 765642 - RNA, 22 nt, Human
aacagauaaguauaucuaugua

SEQ ID NO: 765643 - RNA, 22 nt, Human
augugcuucaggaugucagugu

SEQ ID NO: 765644 - RNA, 22 nt, Human
gagaaacacuguuaguuuauua

SEQ ID NO: 765645 - RNA, 22 nt, Human
aggcugaggcuuuccuuggaga

SEQ ID NO: 765646 - RNA, 22 nt, Human
caaauguguuuuuucuucuaca

SEQ ID NO: 765647 - RNA, 22 nt, Human
gcugagagcaaagcaugucuag

SEQ ID NO: 765648 - RNA, 22 nt, Human
uuucucugcugccugugucgau

SEQ ID NO: 765649 - RNA, 22 nt, Human
aagggagccaagaaagcagggc

SEQ ID NO: 765650 - RNA, 22 nt, Human
gaggacaaggccuugcaauucu

SEQ ID NO: 765651 - RNA, 22 nt, Human
uuuccaauaaggucaccuuccu

SEQ ID NO: 765652 - RNA, 22 nt, Human
uugauuuguaggaauggagacc

SEQ ID NO: 765653 - RNA, 22 nt, Human
uguucuuugcuguugauguaga

SEQ ID NO: 765654 - RNA, 22 nt, Human
cuguuaaagauaguuaagcuuc

SEQ ID NO: 765655 - RNA, 22 nt, Human
cugucccagccccguacucuaa

SEQ ID NO: 765656 - RNA, 22 nt, Human
cagacggguggucugcgaggcc

SEQ ID NO: 765657 - RNA, 22 nt, Human
ggguucagagucaggugugaua

SEQ ID NO: 765658 - RNA, 22 nt, Human
agcugugugugcuugggauuau

SEQ ID NO: 765659 - RNA, 22 nt, Human
guuucuaauuggaacuuugagg

SEQ ID NO: 765660 - RNA, 22 nt, Human
uguacaaauucaguucuagggu

SEQ ID NO: 765661 - RNA, 22 nt, Human
guggaaaugcccccaaauagug

SEQ ID NO: 765662 - RNA, 22 nt, Human
uuucuucacaggguauugggug

SEQ ID NO: 765663 - RNA, 22 nt, Human
cgggcacugccuuuguugauuu

SEQ ID NO: 765664 - RNA, 22 nt, Human
cuggccucucugagcagggagc

SEQ ID NO: 765665 - RNA, 22 nt, Human
uagugugucccuggggaguguu

SEQ ID NO: 765666 - RNA, 22 nt, Human
cuccuggaccaccuuguggcca

SEQ ID NO: 765667 - RNA, 22 nt, Human
aguuuucucacaucaaaaauga

SEQ ID NO: 765668 - RNA, 22 nt, Human
augauauauguguugagcuugc

SEQ ID NO: 765669 - RNA, 22 nt, Human
ccacgagggaaccagguggggu

SEQ ID NO: 765670 - RNA, 22 nt, Human
uguaugccuuuuucuguuguaa

SEQ ID NO: 765671 - RNA, 22 nt, Human
uuuuccuucuagagcagauuuc

SEQ ID NO: 765672 - RNA, 22 nt, Human
ucucacacuauuucaggugacu

SEQ ID NO: 765673 - RNA, 22 nt, Human
cuauggaaacucaacauuuguu

SEQ ID NO: 765674 - RNA, 20 nt, Human
cugagagucugugcuuaguc

SEQ ID NO: 765675 - RNA, 18 nt, Human
ugcaucauuuauggguca

SEQ ID NO: 765676 - RNA, 22 nt, Human
acacaguaaauauugucuccuc

SEQ ID NO: 765677 - RNA, 22 nt, Human
ucuggcagggguucugcacuug

SEQ ID NO: 765678 - RNA, 22 nt, Human
ugcaggagcagagauggcugga

SEQ ID NO: 765679 - RNA, 22 nt, Human
gcaagacaauggagcauaaacg

SEQ ID NO: 765680 - RNA, 22 nt, Human
auguagggaacuaaauucacug

SEQ ID NO: 765681 - RNA, 22 nt, Human
cccaggaggcagagguuggagc

SEQ ID NO: 765682 - RNA, 22 nt, Human
ccucacagagcccagaugucua

SEQ ID NO: 765683 - RNA, 20 nt, Human
ggcagggcaucaacagcucu

SEQ ID NO: 765684 - RNA, 20 nt, Human
cucaucucugagccuccugg

SEQ ID NO: 765685 - RNA, 22 nt, Human
ucccagccaggcucuaccacuu

SEQ ID NO: 765686 - RNA, 22 nt, Human
cuuuucucuguaccguauaucu

SEQ ID NO: 765687 - RNA, 22 nt, Human
ucugcugccugcagggcagaga

SEQ ID NO: 765688 - RNA, 22 nt, Human
cuuuggcagccucugcuauuga

SEQ ID NO: 765689 - RNA, 22 nt, Human
ggagggggaagaagcuaaagac

SEQ ID NO: 765690 - RNA, 22 nt, Human
agugggagcggcagucggggac

SEQ ID NO: 765691 - RNA, 22 nt, Human
cuggcuguguccacagaguaag

SEQ ID NO: 765692 - RNA, 22 nt, Human
acugaacacaccugcagcacgu

SEQ ID NO: 765693 - RNA, 17 nt, Human
ugugacauugggacauu

SEQ ID NO: 765694 - RNA, 22 nt, Human
ccccucucccucacuuaucaau

SEQ ID NO: 765695 - RNA, 22 nt, Human
ugcauugaucauauccuuccug

SEQ ID NO: 765696 - RNA, 22 nt, Human
uggugccuccagcugcuucucc

SEQ ID NO: 765697 - RNA, 22 nt, Human
acauucacgcucucaaagcuga

SEQ ID NO: 765698 - RNA, 22 nt, Human
cuaaagaagcuagcaaucuaua

SEQ ID NO: 765699 - RNA, 22 nt, Human
cuuugauuaucggugugaaugu

SEQ ID NO: 765700 - RNA, 22 nt, Human
ggcucugccauuuccuagcugc

SEQ ID NO: 765701 - RNA, 23 nt, Human
agaaaaacaggauuguguuccua

SEQ ID NO: 765702 - RNA, 22 nt, Human
aagacauugucauuuuauaauu

SEQ ID NO: 765703 - RNA, 22 nt, Human
cccagaugcagguucaagagua

SEQ ID NO: 765704 - RNA, 20 nt, Human
uggaauggguccuugaaaaa

SEQ ID NO: 765705 - RNA, 22 nt, Human
ugcagcugugaaagggaaccaa

SEQ ID NO: 765706 - RNA, 22 nt, Human
ccagggcagcgccccuccacgc

SEQ ID NO: 765707 - RNA, 22 nt, Human
gaucuucuagcagaaguaauuu

SEQ ID NO: 765708 - RNA, 19 nt, Human
cuucacaucugugagggga

SEQ ID NO: 765709 - RNA, 22 nt, Human
agugugaguaauucagggaggg

SEQ ID NO: 765710 - RNA, 22 nt, Human
gugacaggccacugcggcucug

SEQ ID NO: 765711 - RNA, 22 nt, Human
gcagagguguagcccccuccau

SEQ ID NO: 765712 - RNA, 22 nt, Human
acauuaugagcccacuggugaa

SEQ ID NO: 765713 - RNA, 22 nt, Human
aagugggaauagaaaugaaggu

SEQ ID NO: 765714 - RNA, 22 nt, Human
cccagagucacaugggguguuc

SEQ ID NO: 765715 - RNA, 22 nt, Human
aucacacuuuuguaaccaucag

SEQ ID NO: 765716 - RNA, 22 nt, Human
ugcuugugacagaacugugucc

SEQ ID NO: 765717 - RNA, 22 nt, Human
gagcaacaaauuagggggauuu

SEQ ID NO: 765718 - RNA, 22 nt, Human
ggagggcugagacuggggucug

SEQ ID NO: 765719 - RNA, 22 nt, Human
caguguguggauccucccagga

SEQ ID NO: 765720 - RNA, 22 nt, Human
ucaggaugguguggaggaaaua

SEQ ID NO: 765721 - RNA, 22 nt, Human
uaugaagaaaccuauccucuag

SEQ ID NO: 765722 - RNA, 22 nt, Human
auuauuucagucagacacuggc

SEQ ID NO: 765723 - RNA, 22 nt, Human
cugccccaggccucgggaggag

SEQ ID NO: 765724 - RNA, 22 nt, Human
agcuuuaaaaauccaauaucca

SEQ ID NO: 765725 - RNA, 22 nt, Human
cccagggagagcgcggaggcgg

SEQ ID NO: 765726 - RNA, 22 nt, Human
acacagcugugcaguuuuuuca

SEQ ID NO: 765727 - RNA, 22 nt, Human
uucauauaaauggaaucagaau

SEQ ID NO: 765728 - RNA, 22 nt, Human
aagacacugauacucugugauu

SEQ ID NO: 765729 - RNA, 22 nt, Human
agagucaaguagggcaugggcu

SEQ ID NO: 765730 - RNA, 22 nt, Human
cuuuauuccuacaagauuuucu

SEQ ID NO: 765731 - RNA, 22 nt, Human
gguggggauuccugaucacugu

SEQ ID NO: 765732 - RNA, 22 nt, Human
aauagcuuaguccugauucugu

SEQ ID NO: 765733 - RNA, 20 nt, Human
uaugcuuuuuauaagauuga

SEQ ID NO: 765734 - RNA, 22 nt, Human
acaauguaggaguaugacagua

SEQ ID NO: 765735 - RNA, 22 nt, Human
ccuucaugauggaaaggguuca

SEQ ID NO: 765736 - RNA, 22 nt, Human
uuucacagguaagcaauacagg

SEQ ID NO: 765737 - RNA, 22 nt, Human
uucugaaauucgacuauccaau

SEQ ID NO: 765738 - RNA, 22 nt, Human
caggcuggaguacaauugugug

SEQ ID NO: 765739 - RNA, 22 nt, Human
aaaguauucaaaaauauuuggu

SEQ ID NO: 765740 - RNA, 22 nt, Human
ucuggagcuuguuucagauggu

SEQ ID NO: 765741 - RNA, 22 nt, Human
uucugcagcaugaggcuggagc

SEQ ID NO: 765742 - RNA, 21 nt, Human
guggccagugacuacuuauug

SEQ ID NO: 765743 - RNA, 20 nt, Human
cuggggaggaggauguguuc

SEQ ID NO: 765744 - RNA, 22 nt, Human
agaucugaaucucauccgagga

SEQ ID NO: 765745 - RNA, 22 nt, Human
caguuuugguccuuucuaggua

SEQ ID NO: 765746 - RNA, 22 nt, Human
uccucagucucuaaggccucag

SEQ ID NO: 765747 - RNA, 22 nt, Human
gaguucuauuaugguuagaagu

SEQ ID NO: 765748 - RNA, 22 nt, Human
gugaggaugcagaugagggccu

SEQ ID NO: 765749 - RNA, 22 nt, Human
guggcacauugguagggucugu

SEQ ID NO: 765750 - RNA, 22 nt, Human
gagagaccuugcuaagugccuu

SEQ ID NO: 765751 - RNA, 22 nt, Human
augcugagauccucaggccaga

SEQ ID NO: 765752 - RNA, 22 nt, Human
caagucugucugcuccugugug

SEQ ID NO: 765753 - RNA, 20 nt, Human
aaauccaguguguauuuuac

SEQ ID NO: 765754 - RNA, 22 nt, Human
agcagcauguugggaugugaaa

SEQ ID NO: 765755 - RNA, 22 nt, Human
ccagcugcgggcaucgagaguu

SEQ ID NO: 765756 - RNA, 22 nt, Human
auuagcuuaucccauuucugaa

SEQ ID NO: 765757 - RNA, 22 nt, Human
guuucagaacaccccauuuggg

SEQ ID NO: 765758 - RNA, 22 nt, Human
cauaaguugcagagggugcauu

SEQ ID NO: 765759 - RNA, 22 nt, Human
agaaguuugaaauuaggagaaa

SEQ ID NO: 765760 - RNA, 22 nt, Human
gucugaaaaugcccuacgauug

SEQ ID NO: 765761 - RNA, 22 nt, Human
uuucacaugcagcagggaagug

SEQ ID NO: 765762 - RNA, 22 nt, Human
ccacaaggccuguggggcugcu

SEQ ID NO: 765763 - RNA, 22 nt, Human
cuccagauucuggaugacuggg

SEQ ID NO: 765764 - RNA, 20 nt, Human
uggagcuguaaucuugucug

SEQ ID NO: 765765 - RNA, 22 nt, Human
acagagcuucccagccugagca

SEQ ID NO: 765766 - RNA, 23 nt, Human
uccuugggccugcccagaguggu

SEQ ID NO: 765767 - RNA, 22 nt, Human
gauuuccuugcauauugguaau

SEQ ID NO: 765768 - RNA, 22 nt, Human
cuagaaacgccuuuagcacaac

SEQ ID NO: 765769 - RNA, 22 nt, Human
ucaagggaggagacacagcccu

SEQ ID NO: 765770 - RNA, 22 nt, Human
caagaccucaaaaugagagggg

SEQ ID NO: 765771 - RNA, 22 nt, Human
cuccugggggacagcggcaggg

SEQ ID NO: 765772 - RNA, 22 nt, Human
agagugcccaagccuggcaggg

SEQ ID NO: 765773 - RNA, 22 nt, Human
uaaguaaauuuauaaugugauu

SEQ ID NO: 765774 - RNA, 22 nt, Human
ugaggugaagaguggagcucag

SEQ ID NO: 765775 - RNA, 22 nt, Human
auauucacuggguacuaaaaag

SEQ ID NO: 765776 - RNA, 22 nt, Human
caaacuuuuccuggaaaagauu

SEQ ID NO: 765777 - RNA, 22 nt, Human
uugcuuuauuuggcaugccacu

SEQ ID NO: 765778 - RNA, 18 nt, Human
gccugccuagagcuugcc

SEQ ID NO: 765779 - RNA, 22 nt, Human
ucuggcuccacucugugcaugc

SEQ ID NO: 765780 - RNA, 22 nt, Human
uccagacauuuuauagcagucu

SEQ ID NO: 765781 - RNA, 22 nt, Human
ugcaucugauucucaggcagaa

SEQ ID NO: 765782 - RNA, 22 nt, Human
ggcugccccagugcucauggcu

SEQ ID NO: 765783 - RNA, 22 nt, Human
acuuuucuuaucagaaaggcca

SEQ ID NO: 765784 - RNA, 22 nt, Human
cagggcagggagcuuagaauga

SEQ ID NO: 765785 - RNA, 22 nt, Human
uggguuaaaaguugaaugaauu

SEQ ID NO: 765786 - RNA, 22 nt, Human
aaauuaagaguaacucuguaga

SEQ ID NO: 765787 - RNA, 22 nt, Human
cccagccuggugcacugugggg

SEQ ID NO: 765788 - RNA, 22 nt, Human
ucacugugguauauauguauca

SEQ ID NO: 765789 - RNA, 22 nt, Human
cccugugggaacuccugaguug

SEQ ID NO: 765790 - RNA, 22 nt, Human
uggggagagguaucauugagau

SEQ ID NO: 765791 - RNA, 22 nt, Human
uuggcuucaaugucagagacag

SEQ ID NO: 765792 - RNA, 22 nt, Human
aguggcagagucaggguuugga

SEQ ID NO: 765793 - RNA, 22 nt, Human
auucaaaugucaaauccaccag

SEQ ID NO: 765794 - RNA, 22 nt, Human
gggcuuggcacaugggcucagc

SEQ ID NO: 765795 - RNA, 22 nt, Human
cagaguuuugugaacaacuugg

SEQ ID NO: 765796 - RNA, 21 nt, Human
cugcucugacagugaggccag

SEQ ID NO: 765797 - RNA, 22 nt, Human
aaauuagucgguuuaggaauuu

SEQ ID NO: 765798 - RNA, 22 nt, Human
aggcuccacccuacagagcucc

SEQ ID NO: 765799 - RNA, 22 nt, Human
uucaguaugcugaaugauuuuu

SEQ ID NO: 765800 - RNA, 19 nt, Human
uucuggucuggaaucaagg

SEQ ID NO: 765801 - RNA, 22 nt, Human
agugacugacaccuguaauccc

SEQ ID NO: 765802 - RNA, 20 nt, Human
ucccaaaauucuacuuuauc

SEQ ID NO: 765803 - RNA, 22 nt, Human
ugcagaagaccuuccagggcug

SEQ ID NO: 765804 - RNA, 22 nt, Human
acaauucugaugguuucccagu

SEQ ID NO: 765805 - RNA, 22 nt, Human
acaaaggugagcagaagacaca

SEQ ID NO: 765806 - RNA, 22 nt, Human
cuguuuaaugcaaugaaaugag

SEQ ID NO: 765807 - RNA, 22 nt, Human
cagagcugcaaaugccccuccg

SEQ ID NO: 765808 - RNA, 22 nt, Human
uucugcaugguuggggagaagc

SEQ ID NO: 765809 - RNA, 22 nt, Human
ugcuggaaauaggcauuguagc

SEQ ID NO: 765810 - RNA, 22 nt, Human
acagaguuguaaacauuuacca

SEQ ID NO: 765811 - RNA, 22 nt, Human
cucccagacaugugccuccuug

SEQ ID NO: 765812 - RNA, 22 nt, Human
uccugccucuuuucuuauucca

SEQ ID NO: 765813 - RNA, 19 nt, Human
uugaaaauauggaucugag

SEQ ID NO: 765814 - RNA, 18 nt, Human
auggcuccagugucuucc

SEQ ID NO: 765815 - RNA, 22 nt, Human
auuugcaauuacucaugucauu

SEQ ID NO: 765816 - RNA, 18 nt, Human
guccacagcccucacagc

SEQ ID NO: 765817 - RNA, 22 nt, Human
uagugucuguccaucaguaacu

SEQ ID NO: 765818 - RNA, 22 nt, Human
ucccucagacagauguguuccu

SEQ ID NO: 765819 - RNA, 22 nt, Human
uuagaaagaguauaccagaaac

SEQ ID NO: 765820 - RNA, 22 nt, Human
uuugauaguugauuaaauucca

SEQ ID NO: 765821 - RNA, 22 nt, Human
acacagcaaggucugacuuugg

SEQ ID NO: 765822 - RNA, 22 nt, Human
cugcugcuuuugcgggagaaca

SEQ ID NO: 765823 - RNA, 22 nt, Human
cugucuguuuuaccuucuccag

SEQ ID NO: 765824 - RNA, 22 nt, Human
agcagcugcuccacuugcuuaa

SEQ ID NO: 765825 - RNA, 22 nt, Human
aacaaagaugggugggaaagag

SEQ ID NO: 765826 - RNA, 22 nt, Human
gcuagcagaaagcaggcugcuc

SEQ ID NO: 765827 - RNA, 22 nt, Human
ucaaaucucauugccuaaaacu

SEQ ID NO: 765828 - RNA, 22 nt, Human
uaggaaaaagaggcuggcaagg

SEQ ID NO: 765829 - RNA, 22 nt, Human
uacauuaacuuacguccacaug

SEQ ID NO: 765830 - RNA, 22 nt, Human
ggcagcccuuucuggccagcuc

SEQ ID NO: 765831 - RNA, 22 nt, Human
aggaaagguagcgugccagcag

SEQ ID NO: 765832 - RNA, 22 nt, Human
gcccagcugucuggcagggaug

SEQ ID NO: 765833 - RNA, 22 nt, Human
uuuccacucuggccaccaucuu

SEQ ID NO: 765834 - RNA, 19 nt, Human
ucaaaggcuuuuaggagac

SEQ ID NO: 765835 - RNA, 22 nt, Human
agcugggacagacaacuauguu

SEQ ID NO: 765836 - RNA, 22 nt, Human
uaaggcagcugagcuucuaaca

SEQ ID NO: 765837 - RNA, 22 nt, Human
uucucugcauuguaaagagcca

SEQ ID NO: 765838 - RNA, 22 nt, Human
cugcccaucgucauuuaauaaa

SEQ ID NO: 765839 - RNA, 22 nt, Human
agccaguagaucgggaggaugu

SEQ ID NO: 765840 - RNA, 23 nt, Human
agaguggccuacucacacucauu

SEQ ID NO: 765841 - RNA, 22 nt, Human
uaccaaguguauuaugcuuugu

SEQ ID NO: 765842 - RNA, 22 nt, Human
auguauaugcaugcauucaaag

SEQ ID NO: 765843 - RNA, 23 nt, Human
auuuacagcugugugagcaaguu

SEQ ID NO: 765844 - RNA, 22 nt, Human
cugugucugaauaacucugugu

SEQ ID NO: 765845 - RNA, 22 nt, Human
ggaggccucaucuugccccgug

SEQ ID NO: 765846 - RNA, 22 nt, Human
augacaagggaggguccugcua

SEQ ID NO: 765847 - RNA, 19 nt, Human
cucuccaccuaacagguau

SEQ ID NO: 765848 - RNA, 22 nt, Human
ucucuggcacucccuuauggcu

SEQ ID NO: 765849 - RNA, 22 nt, Human
gagcacagaaggagaaauaugg

SEQ ID NO: 765850 - RNA, 22 nt, Human
uagggacacugcucaugaguuc

SEQ ID NO: 765851 - RNA, 22 nt, Human
cacugugguuauuaucacuguu

SEQ ID NO: 765852 - RNA, 22 nt, Human
gauggcuugcuuagugacagca

SEQ ID NO: 765853 - RNA, 22 nt, Human
ccugcagggaaucgaggcagaa

SEQ ID NO: 765854 - RNA, 22 nt, Human
ucugggcugugccaaagcucuu

SEQ ID NO: 765855 - RNA, 20 nt, Human
agagugggugucacaggcug

SEQ ID NO: 765856 - RNA, 22 nt, Human
guuccuauauagccuuaaggau

SEQ ID NO: 765857 - RNA, 22 nt, Human
agcauauacaaacucauauaca

SEQ ID NO: 765858 - RNA, 22 nt, Human
aggcuggcuuggcucuccugug

SEQ ID NO: 765859 - RNA, 22 nt, Human
uucuggcuucaucugacaagcc

SEQ ID NO: 765860 - RNA, 22 nt, Human
ggguucuuauaguaucagagcu

SEQ ID NO: 765861 - RNA, 22 nt, Human
ggagaucugagagcuggaagug

SEQ ID NO: 765862 - RNA, 22 nt, Human
uagcccagcucaaaugaccggu

SEQ ID NO: 765863 - RNA, 22 nt, Human
gcuuccagagacugagcucuuc

SEQ ID NO: 765864 - RNA, 22 nt, Human
augcuuuaaaugucuuuugcuu

SEQ ID NO: 765865 - RNA, 22 nt, Human
guugaggagcaagcaugugucu

SEQ ID NO: 765866 - RNA, 21 nt, Human
acuuugggaggugugaggggc

SEQ ID NO: 765867 - RNA, 22 nt, Human
augaggcccaaacauuacaaau

SEQ ID NO: 765868 - RNA, 22 nt, Human
ucccugcugcacucacaccuac

SEQ ID NO: 765869 - RNA, 22 nt, Human
uguuuaaguagucucagggccu

SEQ ID NO: 765870 - RNA, 22 nt, Human
cucuggaggccguuggcccuua

SEQ ID NO: 765871 - RNA, 22 nt, Human
cugcuguuucucaaaauuaagu

SEQ ID NO: 765872 - RNA, 22 nt, Human
cuggcucuugcgacucagcuug

SEQ ID NO: 765873 - RNA, 17 nt, Human
ugcugccaagucccaac

SEQ ID NO: 765874 - RNA, 20 nt, Human
gauggguauugaagucaccu

SEQ ID NO: 765875 - RNA, 22 nt, Human
aacaugcuugcuuagaaucagc

SEQ ID NO: 765876 - RNA, 22 nt, Human
auagucuucagcacuuugauca

SEQ ID NO: 765877 - RNA, 22 nt, Human
gagacacaguuaucaggcauac

SEQ ID NO: 765878 - RNA, 22 nt, Human
ccugggugguuccggcaaggag

SEQ ID NO: 765879 - RNA, 22 nt, Human
guauaucagacacucauaugua

SEQ ID NO: 765880 - RNA, 22 nt, Human
ccugagugaccugaggucuagu

SEQ ID NO: 765881 - RNA, 22 nt, Human
aggcaauccccugaggauacuu

SEQ ID NO: 765882 - RNA, 18 nt, Human
ucuagaaacccagacucu

SEQ ID NO: 765883 - RNA, 22 nt, Human
caucucugguucagucucugug

SEQ ID NO: 765884 - RNA, 22 nt, Human
augcuguagaucuuagccucua

SEQ ID NO: 765885 - RNA, 22 nt, Human
ucacccagcgggcgcacacucg

SEQ ID NO: 765886 - RNA, 22 nt, Human
gcagugauuggaucagagaugg

SEQ ID NO: 765887 - RNA, 22 nt, Human
gagcacuuagaugcuaugaaug

SEQ ID NO: 765888 - RNA, 22 nt, Human
aggcaaagaaguuggucaggag

SEQ ID NO: 765889 - RNA, 22 nt, Human
ugcagucagcauuagcaaaaua

SEQ ID NO: 765890 - RNA, 22 nt, Human
cagcucugaggaacacuccuuu

SEQ ID NO: 765891 - RNA, 22 nt, Human
augugucuuggaguuuuaaugu

SEQ ID NO: 765892 - RNA, 18 nt, Human
aguaguggguuuagcuuc

SEQ ID NO: 765893 - RNA, 22 nt, Human
aaagugcugugggcuguaagug

SEQ ID NO: 765894 - RNA, 22 nt, Human
ugaggaggcccagguuggggcu

SEQ ID NO: 765895 - RNA, 20 nt, Human
uggagccaaggugugucugg

SEQ ID NO: 765896 - RNA, 23 nt, Human
uggcccugugcaugcugcuuccc

SEQ ID NO: 765897 - RNA, 22 nt, Human
aaguuacuggcaagggcugcag

SEQ ID NO: 765898 - RNA, 22 nt, Human
ucuacauuuuaacaagaugccc

SEQ ID NO: 765899 - RNA, 22 nt, Human
aauguauggauucaugucugug

SEQ ID NO: 765900 - RNA, 22 nt, Human
aauucauugccagaaucuauga

SEQ ID NO: 765901 - RNA, 22 nt, Human
uccuuuccaugcuucuagaggc

SEQ ID NO: 765902 - RNA, 22 nt, Human
uucuucaguguagcaacuguau

SEQ ID NO: 765903 - RNA, 22 nt, Human
uuaaauggagggggaaauacgu

SEQ ID NO: 765904 - RNA, 22 nt, Human
cucccuucugagccuuuuguua

SEQ ID NO: 765905 - RNA, 22 nt, Human
cacccagcauuggcuaagagag

SEQ ID NO: 765906 - RNA, 22 nt, Human
uauguguaggaggaggacaggg

SEQ ID NO: 765907 - RNA, 22 nt, Human
ccugagacaugaaccaggcucc

SEQ ID NO: 765908 - RNA, 23 nt, Human
ugggccuggccucccaguccagc

SEQ ID NO: 765909 - RNA, 22 nt, Human
cugagaaaguuuauguuuauuu

SEQ ID NO: 765910 - RNA, 22 nt, Human
ugaugguuuuauuaauaggacc

SEQ ID NO: 765911 - RNA, 22 nt, Human
guuuauuagaguuuucugucug

SEQ ID NO: 765912 - RNA, 22 nt, Human
ugagacagggucuugcucuguu

SEQ ID NO: 765913 - RNA, 18 nt, Human
gcagggacacagggucac

SEQ ID NO: 765914 - RNA, 22 nt, Human
ugugucuggauagguaauggau

SEQ ID NO: 765915 - RNA, 22 nt, Human
uuauucaucagugcauuaauuu

SEQ ID NO: 765916 - RNA, 22 nt, Human
augcaaaaguaauugcaauuuu

SEQ ID NO: 765917 - RNA, 22 nt, Human
gcuguggccuggcgcagagcug

SEQ ID NO: 765918 - RNA, 22 nt, Human
caacagcugaucuuugaugaag

SEQ ID NO: 765919 - RNA, 22 nt, Human
ggcagagaugugggucagaauc

SEQ ID NO: 765920 - RNA, 18 nt, Human
uggcuucugcuagcugga

SEQ ID NO: 765921 - RNA, 22 nt, Human
cuugugcaauugacauugaauc

SEQ ID NO: 765922 - RNA, 22 nt, Human
aaaagagcuugguugauuuugc

SEQ ID NO: 765923 - RNA, 22 nt, Human
cuuagcuuuaaaagugagaucu

SEQ ID NO: 765924 - RNA, 22 nt, Human
uccgcuggagagggggcugcca

SEQ ID NO: 765925 - RNA, 22 nt, Human
auggaggugccaggugugaggg

SEQ ID NO: 765926 - RNA, 22 nt, Human
cucagagaaaugucacaacaau

SEQ ID NO: 765927 - RNA, 22 nt, Human
ccauaagguuuggggccaugca

SEQ ID NO: 765928 - RNA, 21 nt, Human
ggaaaauuccauacacccacg

SEQ ID NO: 765929 - RNA, 22 nt, Human
aguggggccggugaggccgagg

SEQ ID NO: 765930 - RNA, 22 nt, Human
ugcauguguguguauuuauaaa

SEQ ID NO: 765931 - RNA, 22 nt, Human
uaauuauaacaugcuuucuggc

SEQ ID NO: 765932 - RNA, 22 nt, Human
gggccccaaaaugccaggcucu

SEQ ID NO: 765933 - RNA, 22 nt, Human
ggugccguugaggaaguaacug

SEQ ID NO: 765934 - RNA, 22 nt, Human
aucauugagauuuuuuacaacu

SEQ ID NO: 765935 - RNA, 22 nt, Human
acaggacagucuaguaacagua

SEQ ID NO: 765936 - RNA, 22 nt, Human
caggcuugggagcagagccacu

SEQ ID NO: 765937 - RNA, 22 nt, Human
uuuguaaagucuguucugaguu

SEQ ID NO: 765938 - RNA, 23 nt, Human
cugaaauaccagaaaaucagugu

SEQ ID NO: 765939 - RNA, 22 nt, Human
gagcugaggcucaggcuggcgu

SEQ ID NO: 765940 - RNA, 22 nt, Human
ccaguguguucccugccucacu

SEQ ID NO: 765941 - RNA, 22 nt, Human
gcaggcagucaucuuucauauu

SEQ ID NO: 765942 - RNA, 22 nt, Human
cuggcuguuuucaauguugaug

SEQ ID NO: 765943 - RNA, 22 nt, Human
ugucauaugcugucauagccau

SEQ ID NO: 765944 - RNA, 22 nt, Human
agacauuuggagccaacuuucc

SEQ ID NO: 765945 - RNA, 22 nt, Human
acaguucaagucuuagacaaca

SEQ ID NO: 765946 - RNA, 22 nt, Human
ugcagugugcuagauuuggacu

SEQ ID NO: 765947 - RNA, 22 nt, Human
uucucugacccccuuaaauauu

SEQ ID NO: 765948 - RNA, 22 nt, Human
cugcagcugugagugcuggaug

SEQ ID NO: 765949 - RNA, 22 nt, Human
ggcuguguuucuguuugacauu

SEQ ID NO: 765950 - RNA, 22 nt, Human
cuugaaugguaugagaguaauu

SEQ ID NO: 765951 - RNA, 22 nt, Human
uacaugcacaugaacaugugug

SEQ ID NO: 765952 - RNA, 22 nt, Human
aauguuaauucacagccaaaua

SEQ ID NO: 765953 - RNA, 22 nt, Human
cuucucagaggccagaagcuau

SEQ ID NO: 765954 - RNA, 22 nt, Human
aaagcagguugcaauuacagug

SEQ ID NO: 765955 - RNA, 22 nt, Human
gcccucuaccuuggcuauagaa

SEQ ID NO: 765956 - RNA, 22 nt, Human
agguggguaucaugagagauua

SEQ ID NO: 765957 - RNA, 22 nt, Human
ugucaguagauuauuacaauaa

SEQ ID NO: 765958 - RNA, 22 nt, Human
ugaggcccggguggaggaaugc

SEQ ID NO: 765959 - RNA, 22 nt, Human
aaaauuuucagcuugacuugau

SEQ ID NO: 765960 - RNA, 22 nt, Human
uauuaaguaucuugaugacaaa

SEQ ID NO: 765961 - RNA, 22 nt, Human
acugucacuugcaacugugagg

SEQ ID NO: 765962 - RNA, 22 nt, Human
gcugugcagauguagggagugg

SEQ ID NO: 765963 - RNA, 22 nt, Human
aaggcagucaguuguuuugaaa

SEQ ID NO: 765964 - RNA, 22 nt, Human
uaccauuguaccaagguaauuu

SEQ ID NO: 765965 - RNA, 22 nt, Human
agcgauucuaauuggagauuaa

SEQ ID NO: 765966 - RNA, 22 nt, Human
acucuucaugcuaugcucaacu

SEQ ID NO: 765967 - RNA, 22 nt, Human
cugagccccucugaccucagag

SEQ ID NO: 765968 - RNA, 22 nt, Human
agaaaauuagauuuuacugugu

SEQ ID NO: 765969 - RNA, 22 nt, Human
auaguguuacccuucuuaaagu

SEQ ID NO: 765970 - RNA, 22 nt, Human
gaguguggugaacaggagcacc

SEQ ID NO: 765971 - RNA, 22 nt, Human
cuggcuccaaauucugauguuc

SEQ ID NO: 765972 - RNA, 22 nt, Human
caggaaaucacucugauuuugg

SEQ ID NO: 765973 - RNA, 22 nt, Human
uguguuaaguauuugauacacu

SEQ ID NO: 765974 - RNA, 22 nt, Human
cuguuuauaaauagaggggagu

SEQ ID NO: 765975 - RNA, 20 nt, Human
agggucuggcccuguuccuu

SEQ ID NO: 765976 - RNA, 22 nt, Human
gacagcuucgaggaggugagcu

SEQ ID NO: 765977 - RNA, 22 nt, Human
ugcaaggguguuugagcugccc

SEQ ID NO: 765978 - RNA, 22 nt, Human
aacaggaauugcaggcagaucu

SEQ ID NO: 765979 - RNA, 22 nt, Human
ccuuccucauccauuucucuug

SEQ ID NO: 765980 - RNA, 22 nt, Human
ccuaggcuaauucaguccagua

SEQ ID NO: 765981 - RNA, 22 nt, Human
caaggaggaagaugcaggggac

SEQ ID NO: 765982 - RNA, 22 nt, Human
auuaauaaaauaccacuuuguu

SEQ ID NO: 765983 - RNA, 22 nt, Human
acaaguucugggaauuaggaca

SEQ ID NO: 765984 - RNA, 22 nt, Human
gcaaguuuagcuaacuggccca

SEQ ID NO: 765985 - RNA, 22 nt, Human
cagcagccugccuugggagcuu

SEQ ID NO: 765986 - RNA, 18 nt, Human
uccaaaaucauguauuuu

SEQ ID NO: 765987 - RNA, 22 nt, Human
agcacagauaacauggagugga

SEQ ID NO: 765988 - RNA, 22 nt, Human
gugccagggaguggaggagcuu

SEQ ID NO: 765989 - RNA, 22 nt, Human
ggucagggcuggguaugaagag

SEQ ID NO: 765990 - RNA, 22 nt, Human
uuucacagaacucacuaaggag

SEQ ID NO: 765991 - RNA, 22 nt, Human
gaagagguagcauuggcaggug

SEQ ID NO: 765992 - RNA, 22 nt, Human
uguuaaaccuaguacagguccu

SEQ ID NO: 765993 - RNA, 22 nt, Human
auaaagcaagcauaccauuaag

SEQ ID NO: 765994 - RNA, 22 nt, Human
ucauguuuguuggaaauguggc

SEQ ID NO: 765995 - RNA, 15 nt, Human
aacaggcauuuauau

SEQ ID NO: 765996 - RNA, 22 nt, Human
uuuagaaauucaucuauggccu

SEQ ID NO: 765997 - RNA, 18 nt, Human
uacaaacuccuugaaggc

SEQ ID NO: 765998 - RNA, 22 nt, Human
gcugggcucugucaugccuucc

SEQ ID NO: 765999 - RNA, 22 nt, Human
ucugacauuagauuaauuggaa

SEQ ID NO: 766000 - RNA, 22 nt, Human
ccaaacaaauccccauucuuag

SEQ ID NO: 766001 - RNA, 22 nt, Human
uuaagaggagaucauacuggag

SEQ ID NO: 766002 - RNA, 22 nt, Human
agaaaugugaauuucauuuccu

SEQ ID NO: 766003 - RNA, 22 nt, Human
ucaggcaggaagggaggacuug

SEQ ID NO: 766004 - RNA, 22 nt, Human
acagcaguuuagaggacagcca

SEQ ID NO: 766005 - RNA, 21 nt, Human
ugauucuguuuuaucaucagc

SEQ ID NO: 766006 - RNA, 22 nt, Human
gcugggccuuccgauucucaag

SEQ ID NO: 766007 - RNA, 22 nt, Human
gcuguccucuuggacucagggc

SEQ ID NO: 766008 - RNA, 22 nt, Human
uucugauugcugaugaggccca

SEQ ID NO: 766009 - RNA, 22 nt, Human
agagcagcuggcugcaucuaga

SEQ ID NO: 766010 - RNA, 22 nt, Human
uucuccagacaacagaggguga

SEQ ID NO: 766011 - RNA, 22 nt, Human
gggcuucucuuaugcuaacugg

SEQ ID NO: 766012 - RNA, 22 nt, Human
acuuuagauauuccucuguaca

SEQ ID NO: 766013 - RNA, 22 nt, Human
gccuagugcacuggcagggcuc

SEQ ID NO: 766014 - RNA, 20 nt, Human
uaagcauaguugucaggguc

SEQ ID NO: 766015 - RNA, 22 nt, Human
ugcugccaggucuugcugucca

SEQ ID NO: 766016 - RNA, 22 nt, Human
uggccucucuaccaggcagccu

SEQ ID NO: 766017 - RNA, 22 nt, Human
gaagauugaaggcugggaauua

SEQ ID NO: 766018 - RNA, 22 nt, Human
uuccaagugaaaguagcuuugu

SEQ ID NO: 766019 - RNA, 22 nt, Human
gcccaagccggagcugggagag

SEQ ID NO: 766020 - RNA, 22 nt, Human
ucuucauuuugaagaggcagaa

SEQ ID NO: 766021 - RNA, 22 nt, Human
aggcauccucucugccuugagg

SEQ ID NO: 766022 - RNA, 23 nt, Human
agacuucuccaacaagcuuggcu

SEQ ID NO: 766023 - RNA, 22 nt, Human
ucacacagcuaguaagggccga

SEQ ID NO: 766024 - RNA, 22 nt, Human
aagagcccugguugaaaauaac

SEQ ID NO: 766025 - RNA, 22 nt, Human
aacauacuuguacuaugcauau

SEQ ID NO: 766026 - RNA, 22 nt, Human
aucuuugugcuaauguaguucu

SEQ ID NO: 766027 - RNA, 22 nt, Human
ccuggcagguuacaaccaguua

SEQ ID NO: 766028 - RNA, 22 nt, Human
aagccaguccucuacugggcac

SEQ ID NO: 766029 - RNA, 22 nt, Human
cccuucucuuucacucacuauu

SEQ ID NO: 766030 - RNA, 22 nt, Human
agccagagggaucuuucuaaga

SEQ ID NO: 766031 - RNA, 22 nt, Human
gcuccuggugcaaaguuucuuc

SEQ ID NO: 766032 - RNA, 22 nt, Human
ugccucgugucugagucuguuc

SEQ ID NO: 766033 - RNA, 22 nt, Human
uuccaagagucagcugauccca

SEQ ID NO: 766034 - RNA, 22 nt, Human
caggcccucguggugagcuggg

SEQ ID NO: 766035 - RNA, 22 nt, Human
guucauuuuucccuaaugagua

SEQ ID NO: 766036 - RNA, 22 nt, Human
cauaucauuugcuuauaaaucu

SEQ ID NO: 766037 - RNA, 20 nt, Human
cauuaugguugggcacagug

SEQ ID NO: 766038 - RNA, 22 nt, Human
uuaagacacauuucucagacgg

SEQ ID NO: 766039 - RNA, 23 nt, Human
uguaugaauaugccacaguuuaa

SEQ ID NO: 766040 - RNA, 20 nt, Human
caugccugcugguaucuggc

SEQ ID NO: 766041 - RNA, 22 nt, Human
ggcagguguuuuuauauuaaag

SEQ ID NO: 766042 - RNA, 22 nt, Human
agagugauucuaguuagggaau

SEQ ID NO: 766043 - RNA, 22 nt, Human
guuucagauauauuuguacuua

SEQ ID NO: 766044 - RNA, 22 nt, Human
gcaguguggccccaguaucacg

SEQ ID NO: 766045 - RNA, 22 nt, Human
cuucauuaaugucuauaaguuu

SEQ ID NO: 766046 - RNA, 22 nt, Human
aauuagacuaauuuuacaaggg

SEQ ID NO: 766047 - RNA, 22 nt, Human
aaacugaugcucagagaggggc

SEQ ID NO: 766048 - RNA, 22 nt, Human
ugcuuaaaaagcuccaucaaua

SEQ ID NO: 766049 - RNA, 22 nt, Human
uguauacaagucguguaaacuu

SEQ ID NO: 766050 - RNA, 22 nt, Human
ugucaugcccaggagcaaggua

SEQ ID NO: 766051 - RNA, 19 nt, Human
guuuuguuugcagaacuua

SEQ ID NO: 766052 - RNA, 22 nt, Human
gcuguaugugaggccacaguga

SEQ ID NO: 766053 - RNA, 22 nt, Human
uaggcugggccugccuuccagg

SEQ ID NO: 766054 - RNA, 22 nt, Human
ucgcagaggcacgagugcagaa

SEQ ID NO: 766055 - RNA, 22 nt, Human
acagcagucagugaauauuuaa

SEQ ID NO: 766056 - RNA, 22 nt, Human
cccaugcugaguggccugagau

SEQ ID NO: 766057 - RNA, 21 nt, Human
aucuggaagaacugguaagug

SEQ ID NO: 766058 - RNA, 22 nt, Human
agcagucaggccucagagccgu

SEQ ID NO: 766059 - RNA, 22 nt, Human
ugaugggaggugcugcaggacc

SEQ ID NO: 766060 - RNA, 22 nt, Human
ucucagagauucagggagaagu

SEQ ID NO: 766061 - RNA, 22 nt, Human
acugagguaauugugaggauua

SEQ ID NO: 766062 - RNA, 22 nt, Human
acuugaauuaggccuugagaga

SEQ ID NO: 766063 - RNA, 22 nt, Human
gcugagguuucaggaguggcag

SEQ ID NO: 766064 - RNA, 22 nt, Human
gguaaaaugcagauucuuagcc

SEQ ID NO: 766065 - RNA, 22 nt, Human
gauaaguuauguaacuugcuca

SEQ ID NO: 766066 - RNA, 22 nt, Human
cugaaggacuuggugauaguug

SEQ ID NO: 766067 - RNA, 22 nt, Human
aaguccagugauacuggcagga

SEQ ID NO: 766068 - RNA, 22 nt, Human
uuugcagaugagaaaacugugg

SEQ ID NO: 766069 - RNA, 22 nt, Human
gucuggagagcugagcagaguu

SEQ ID NO: 766070 - RNA, 22 nt, Human
auacuacacauugacuauauuu

SEQ ID NO: 766071 - RNA, 22 nt, Human
gcucccagggacacuggccacu

SEQ ID NO: 766072 - RNA, 22 nt, Human
uuccuaaccucuagcugcauau

SEQ ID NO: 766073 - RNA, 22 nt, Human
gcugaaaugccuuguaaauauu

SEQ ID NO: 766074 - RNA, 22 nt, Human
agcccucauggaacagcuccua

SEQ ID NO: 766075 - RNA, 22 nt, Human
aggcuguggcaucacaucagga

SEQ ID NO: 766076 - RNA, 22 nt, Human
uaguuaaaauaauggagauguu

SEQ ID NO: 766077 - RNA, 22 nt, Human
ccaggcaauguucuaagugauu

SEQ ID NO: 766078 - RNA, 22 nt, Human
agacacugauguucagcucaau

SEQ ID NO: 766079 - RNA, 22 nt, Human
ugcuggugauuaaauccugaag

SEQ ID NO: 766080 - RNA, 21 nt, Human
gcaggguccuuuccauuccua

SEQ ID NO: 766081 - RNA, 22 nt, Human
acagagauggcacagagaaggu

SEQ ID NO: 766082 - RNA, 22 nt, Human
acacacucaauugcauaagcac

SEQ ID NO: 766083 - RNA, 22 nt, Human
caacagucucuauagcuccuug

SEQ ID NO: 766084 - RNA, 22 nt, Human
ccccagcacuaccagaagccag

SEQ ID NO: 766085 - RNA, 22 nt, Human
cccaguuguugccggcucugga

SEQ ID NO: 766086 - RNA, 22 nt, Human
gccuuggaacaauuauugcugc

SEQ ID NO: 766087 - RNA, 22 nt, Human
ucagcccaggucacguaaucaa

SEQ ID NO: 766088 - RNA, 22 nt, Human
gcaggagucccagaagguuuug

SEQ ID NO: 766089 - RNA, 22 nt, Human
cuuccucaugugcaaugcaagc

SEQ ID NO: 766090 - RNA, 22 nt, Human
gggcccugugauuucuugagga

SEQ ID NO: 766091 - RNA, 22 nt, Human
uccaggauugcaggugcacaac

SEQ ID NO: 766092 - RNA, 22 nt, Human
gcaauguuaagaucacaccugg

SEQ ID NO: 766093 - RNA, 22 nt, Human
ggucagaacaaggguaaauaaa

SEQ ID NO: 766094 - RNA, 22 nt, Human
ggccugugagccuuaguuuaua

SEQ ID NO: 766095 - RNA, 22 nt, Human
ccacugcuagagaugcaucccc

SEQ ID NO: 766096 - RNA, 22 nt, Human
gacauucacagguaaacauucc

SEQ ID NO: 766097 - RNA, 17 nt, Human
cgggcccgcggccgcuc

SEQ ID NO: 766098 - RNA, 22 nt, Human
agcugccccucauuuucaccac

SEQ ID NO: 766099 - RNA, 22 nt, Human
uaucuaaauggaauauuccaga

SEQ ID NO: 766100 - RNA, 22 nt, Human
auuuagaacuuuguuugccaau

SEQ ID NO: 766101 - RNA, 22 nt, Human
uucaaguuuugacuuaguccuu

SEQ ID NO: 766102 - RNA, 22 nt, Human
auggcuguccaguuucuagaga

SEQ ID NO: 766103 - RNA, 20 nt, Human
caauagaauguggagauaag

SEQ ID NO: 766104 - RNA, 22 nt, Human
gcaugcaggagagaaagacggc

SEQ ID NO: 766105 - RNA, 22 nt, Human
uuuaacucugucauucucuuua

SEQ ID NO: 766106 - RNA, 22 nt, Human
ccucuucugcuucaggagcacu

SEQ ID NO: 766107 - RNA, 22 nt, Human
gcauuuuauaaagaguuauuug

SEQ ID NO: 766108 - RNA, 22 nt, Human
augcuauacauaugacaucaca

SEQ ID NO: 766109 - RNA, 22 nt, Human
ugggagcaagcuacuuagggaa

SEQ ID NO: 766110 - RNA, 22 nt, Human
ggcaggaggaagaguuagcacc

SEQ ID NO: 766111 - RNA, 22 nt, Human
gccaggcugaggcucuggaaga

SEQ ID NO: 766112 - RNA, 22 nt, Human
cuuccuugcggccccugccuag

SEQ ID NO: 766113 - RNA, 22 nt, Human
gaucauugcugccuuuuucuau

SEQ ID NO: 766114 - RNA, 22 nt, Human
guacaggcagcaaacaccauaa

SEQ ID NO: 766115 - RNA, 19 nt, Human
cagaguccuugaccagucc

SEQ ID NO: 766116 - RNA, 22 nt, Human
augucuuuauaaauguauaaug

SEQ ID NO: 766117 - RNA, 22 nt, Human
augggcugagaaucaagaauau

SEQ ID NO: 766118 - RNA, 22 nt, Human
ugucugaacaaacucugccucc

SEQ ID NO: 766119 - RNA, 22 nt, Human
acaggcucacagucauuucauu

SEQ ID NO: 766120 - RNA, 22 nt, Human
uccguugacacugcauggagau

SEQ ID NO: 766121 - RNA, 22 nt, Human
gaggaagucucucuacaagaaa

SEQ ID NO: 766122 - RNA, 22 nt, Human
cuccagagguccccgcggcacu

SEQ ID NO: 766123 - RNA, 23 nt, Human
gccauggcugccccacaggccuc

SEQ ID NO: 766124 - RNA, 22 nt, Human
aaaacuaaauacgcuuugccuc

SEQ ID NO: 766125 - RNA, 22 nt, Human
ucaguuacucugauguccugug

SEQ ID NO: 766126 - RNA, 22 nt, Human
uaaagaugcccacauugcaggu

SEQ ID NO: 766127 - RNA, 22 nt, Human
cgccgccugcugcagcagcugu

SEQ ID NO: 766128 - RNA, 22 nt, Human
acagcucucccucagagaaaug

SEQ ID NO: 766129 - RNA, 22 nt, Human
aguacuuugcacuuugcucaga

SEQ ID NO: 766130 - RNA, 18 nt, Human
ucacugugugucuugggu

SEQ ID NO: 766131 - RNA, 22 nt, Human
gaggcacaucacuuggugcauu

SEQ ID NO: 766132 - RNA, 22 nt, Human
aaaugauaguauggaacuagga

SEQ ID NO: 766133 - RNA, 22 nt, Human
ggcuugaauggauauaaucugu

SEQ ID NO: 766134 - RNA, 21 nt, Human
cuccucaggaccagccacagg

SEQ ID NO: 766135 - RNA, 22 nt, Human
uccuuagacaaagagugggcuu

SEQ ID NO: 766136 - RNA, 22 nt, Human
gcuggcagcauuagacccuggg

SEQ ID NO: 766137 - RNA, 22 nt, Human
cugccauguuaccugcacaggu

SEQ ID NO: 766138 - RNA, 22 nt, Human
ccuggacuuucaggacuacugu

SEQ ID NO: 766139 - RNA, 22 nt, Human
uggauccagcugcuccuaugag

SEQ ID NO: 766140 - RNA, 22 nt, Human
gaaauugugcauuuagcaacac

SEQ ID NO: 766141 - RNA, 22 nt, Human
auauuuuggggugaugugcauc

SEQ ID NO: 766142 - RNA, 22 nt, Human
cccaagggguguugauggagga

SEQ ID NO: 766143 - RNA, 22 nt, Human
agucagagcuauguuguuauau

SEQ ID NO: 766144 - RNA, 22 nt, Human
agacuacaggagaaacucacuc

SEQ ID NO: 766145 - RNA, 22 nt, Human
caguauuuggaauauagcuaag

SEQ ID NO: 766146 - RNA, 22 nt, Human
aaauaauugaguuggucaauau

SEQ ID NO: 766147 - RNA, 23 nt, Human
uaugucaugagcauauugaaugu

SEQ ID NO: 766148 - RNA, 22 nt, Human
uucuccaaggauacaguccugu

SEQ ID NO: 766149 - RNA, 22 nt, Human
acaguggaggccauaugguccu

SEQ ID NO: 766150 - RNA, 21 nt, Human
gacaaugcagucuuuuuugga

SEQ ID NO: 766151 - RNA, 22 nt, Human
augaagacuaaugugaauggga

SEQ ID NO: 766152 - RNA, 22 nt, Human
agaucagaguggauugugcugc

SEQ ID NO: 766153 - RNA, 22 nt, Human
auuagcuuaguguuuccguaau

SEQ ID NO: 766154 - RNA, 22 nt, Human
guguaugaacgaaagaauggau

SEQ ID NO: 766155 - RNA, 22 nt, Human
aauugucuucuccuuccuggca

SEQ ID NO: 766156 - RNA, 22 nt, Human
gccaggugcauggcugagucuc

SEQ ID NO: 766157 - RNA, 22 nt, Human
uugugaauagugccgcuauaaa

SEQ ID NO: 766158 - RNA, 22 nt, Human
uagcacuuguguuaugccuugu

SEQ ID NO: 766159 - RNA, 23 nt, Human
gaaaucuagucauuuuuagucug

SEQ ID NO: 766160 - RNA, 22 nt, Human
gaaaauuucugccacaugugug

SEQ ID NO: 766161 - RNA, 22 nt, Human
guaguuagaguugugcuggaga

SEQ ID NO: 766162 - RNA, 22 nt, Human
gcugcuguuaugauguuacuuu

SEQ ID NO: 766163 - RNA, 22 nt, Human
ggacugaauggaagauauaugg

SEQ ID NO: 766164 - RNA, 22 nt, Human
uccuggcccgaucccugugaag

SEQ ID NO: 766165 - RNA, 19 nt, Human
uccucagugacaaccucag

SEQ ID NO: 766166 - RNA, 22 nt, Human
ugacucuguaccugucugccuu

SEQ ID NO: 766167 - RNA, 23 nt, Human
uauuccugguaagccugucacug

SEQ ID NO: 766168 - RNA, 22 nt, Human
acauacacacauacuuucuccu

SEQ ID NO: 766169 - RNA, 22 nt, Human
caguauaagagugaggaagggc

SEQ ID NO: 766170 - RNA, 22 nt, Human
auagaaacagaugcacuucucu

SEQ ID NO: 766171 - RNA, 20 nt, Human
uuuacauccccaccagcaau

SEQ ID NO: 766172 - RNA, 17 nt, Human
gacaggcucagugacga

SEQ ID NO: 766173 - RNA, 22 nt, Human
aggccaaguagccgcuguccua

SEQ ID NO: 766174 - RNA, 21 nt, Human
ucugucagaaaagcugaggcu

SEQ ID NO: 766175 - RNA, 22 nt, Human
uuuguagacuaccaguaauugu

SEQ ID NO: 766176 - RNA, 22 nt, Human
ccuuuacaaaguucuucauggg

SEQ ID NO: 766177 - RNA, 22 nt, Human
cugcccacaguucucugccaug

SEQ ID NO: 766178 - RNA, 19 nt, Human
agggcuuugugugcugcuc

SEQ ID NO: 766179 - RNA, 22 nt, Human
ugacaaagcaugauggugacag

SEQ ID NO: 766180 - RNA, 22 nt, Human
guggcacucaccuguaguuuca

SEQ ID NO: 766181 - RNA, 22 nt, Human
gcagggcagugugucugugggg

SEQ ID NO: 766182 - RNA, 22 nt, Human
uuucauagccuucuaaugaguu

SEQ ID NO: 766183 - RNA, 22 nt, Human
acaaauuguugggacucagccc

SEQ ID NO: 766184 - RNA, 22 nt, Human
aacagggcuuuggaagucuccg

SEQ ID NO: 766185 - RNA, 22 nt, Human
guuuccacuugagaggacuccu

SEQ ID NO: 766186 - RNA, 19 nt, Human
gcuucuguuugggcuuaga

SEQ ID NO: 766187 - RNA, 22 nt, Human
aauuauacauugaacaaucuag

SEQ ID NO: 766188 - RNA, 22 nt, Human
ucccccuccaauugccauguua

SEQ ID NO: 766189 - RNA, 22 nt, Human
agauguggccuuugggagauua

SEQ ID NO: 766190 - RNA, 22 nt, Human
auuaaggugucaauguauuugg

SEQ ID NO: 766191 - RNA, 22 nt, Human
uaagcauaagauacaugagaca

SEQ ID NO: 766192 - RNA, 22 nt, Human
uauuaguagcuugaaauuggug

SEQ ID NO: 766193 - RNA, 22 nt, Human
cgugcaaauauaugugugauga

SEQ ID NO: 766194 - RNA, 22 nt, Human
gcugucugcaucucuagagcuu

SEQ ID NO: 766195 - RNA, 22 nt, Human
uguaaacauaucagacuuucuu

SEQ ID NO: 766196 - RNA, 23 nt, Human
ucaauaacucggguuaaaauaga

SEQ ID NO: 766197 - RNA, 20 nt, Human
uuggggcauccaccgaaugg

SEQ ID NO: 766198 - RNA, 22 nt, Human
gggcccugcgacucgcggcgga

SEQ ID NO: 766199 - RNA, 22 nt, Human
gcagcauccccaggcagcaggg

SEQ ID NO: 766200 - RNA, 22 nt, Human
caguagauuugguaaacuagga

SEQ ID NO: 766201 - RNA, 22 nt, Human
gagcgcgccacaaggagcggcg

SEQ ID NO: 766202 - RNA, 22 nt, Human
auguggaaugaacaaaggaggc

SEQ ID NO: 766203 - RNA, 22 nt, Human
uccaggcacagaguuggucagu

SEQ ID NO: 766204 - RNA, 22 nt, Human
cuggccaccaagagcuugcuca

SEQ ID NO: 766205 - RNA, 22 nt, Human
ucugagagguuaagcaauuuga

SEQ ID NO: 766206 - RNA, 19 nt, Human
cugugcuuuaaacuccuau

SEQ ID NO: 766207 - RNA, 22 nt, Human
agagcugcccacacagcagauu

SEQ ID NO: 766208 - RNA, 22 nt, Human
ggcugccuccugcugggcugga

SEQ ID NO: 766209 - RNA, 23 nt, Human
ggaggcacuuaggcagagcagag

SEQ ID NO: 766210 - RNA, 22 nt, Human
uggaaagugagacauauuuaua

SEQ ID NO: 766211 - RNA, 19 nt, Human
cgcaggcuucgggucgcuc

SEQ ID NO: 766212 - RNA, 22 nt, Human
uugcccugucucacuauguuaa

SEQ ID NO: 766213 - RNA, 22 nt, Human
uugcuuuaaaauggcuaagucu

SEQ ID NO: 766214 - RNA, 19 nt, Human
agaggcaaggguggaagua

SEQ ID NO: 766215 - RNA, 22 nt, Human
aguuuuaaaugauggugguggu

SEQ ID NO: 766216 - RNA, 22 nt, Human
aucagcauucccaaaugaugug

SEQ ID NO: 766217 - RNA, 19 nt, Human
uucacauuuuuguggcacu

SEQ ID NO: 766218 - RNA, 19 nt, Human
ucucugccgaucagggccc

SEQ ID NO: 766219 - RNA, 22 nt, Human
uugaagagucuagauugguuau

SEQ ID NO: 766220 - RNA, 22 nt, Human
cacagcugcccuaacuguacuc

SEQ ID NO: 766221 - RNA, 22 nt, Human
acucaagauagggaaaguacaa

SEQ ID NO: 766222 - RNA, 22 nt, Human
auaaagcagguccccagacacu

SEQ ID NO: 766223 - RNA, 22 nt, Human
aaaugcacgcuacccagcuaga

SEQ ID NO: 766224 - RNA, 22 nt, Human
uucauggauguugguagaaaac

SEQ ID NO: 766225 - RNA, 22 nt, Human
gauucaaagacagacucauuuc

SEQ ID NO: 766226 - RNA, 20 nt, Human
gaaauguaucucuugauucu

SEQ ID NO: 766227 - RNA, 22 nt, Human
agcuccugggccaucacaacca

SEQ ID NO: 766228 - RNA, 22 nt, Human
ugggaagauaugagugaccaac

SEQ ID NO: 766229 - RNA, 22 nt, Human
ugcucuggacgcugagugguuu

SEQ ID NO: 766230 - RNA, 22 nt, Human
cugaacaucauagaguguacuu

SEQ ID NO: 766231 - RNA, 22 nt, Human
gagggggcucccugaagccagu

SEQ ID NO: 766232 - RNA, 22 nt, Human
ugcccagccaguuuaugguaau

SEQ ID NO: 766233 - RNA, 22 nt, Human
cucagagagguugaacaacuug

SEQ ID NO: 766234 - RNA, 22 nt, Human
uucuucuccgaggagggcuggu

SEQ ID NO: 766235 - RNA, 22 nt, Human
uagggaaauauagauuuagggc

SEQ ID NO: 766236 - RNA, 22 nt, Human
aagcacaugaaaaugugaagcu

SEQ ID NO: 766237 - RNA, 22 nt, Human
cuucauguucugccuguggaag

SEQ ID NO: 766238 - RNA, 20 nt, Human
uccuggucauguggcugggc

SEQ ID NO: 766239 - RNA, 22 nt, Human
aaaugcuuguaaauuuuccaug

SEQ ID NO: 766240 - RNA, 22 nt, Human
ucccucagcucauauuuaugcc

SEQ ID NO: 766241 - RNA, 22 nt, Human
gcggggggaggaacaucuugca

SEQ ID NO: 766242 - RNA, 22 nt, Human
gaaagugcaugugcccaccauu

SEQ ID NO: 766243 - RNA, 22 nt, Human
cauggccaaagaauuauauuuu

SEQ ID NO: 766244 - RNA, 20 nt, Human
gcaaauggaucccacaagcc

SEQ ID NO: 766245 - RNA, 22 nt, Human
uagcagcaccuacacgucagag

SEQ ID NO: 766246 - RNA, 22 nt, Human
ggguccagaguugaagagguua

SEQ ID NO: 766247 - RNA, 22 nt, Human
ccagggcaugggaagaacugaa

SEQ ID NO: 766248 - RNA, 22 nt, Human
uggcugaggagggucuucuggu

SEQ ID NO: 766249 - RNA, 22 nt, Human
aaggcacucagccuugggacag

SEQ ID NO: 766250 - RNA, 22 nt, Human
aguuuuaucuguaagcuguuca

SEQ ID NO: 766251 - RNA, 22 nt, Human
acccagagaacugugccuugag

SEQ ID NO: 766252 - RNA, 22 nt, Human
acagauaauacauugugcuaca

SEQ ID NO: 766253 - RNA, 22 nt, Human
ugcaggaauuuuuugcagaaag

SEQ ID NO: 766254 - RNA, 22 nt, Human
uuguaugaauguauccuaauuu

SEQ ID NO: 766255 - RNA, 22 nt, Human
uucagaggcuguaugacuagau

SEQ ID NO: 766256 - RNA, 22 nt, Human
ggcugccucugaugugcagacg

SEQ ID NO: 766257 - RNA, 22 nt, Human
guucacagaaggccagauggua

SEQ ID NO: 766258 - RNA, 22 nt, Human
agaaugucaacagccucucaag

SEQ ID NO: 766259 - RNA, 22 nt, Human
acaucacagagcccagauaaag

SEQ ID NO: 766260 - RNA, 22 nt, Human
cagaguguuucuuugggugggu

SEQ ID NO: 766261 - RNA, 22 nt, Human
uuccauauuuguguggcaaaag

SEQ ID NO: 766262 - RNA, 22 nt, Human
gcaaagcugggugugaaugcac

SEQ ID NO: 766263 - RNA, 22 nt, Human
cagcaauauacacagucuaugg

SEQ ID NO: 766264 - RNA, 19 nt, Human
ccugauggagcuggugcaa

SEQ ID NO: 766265 - RNA, 22 nt, Human
gcccacaguguagcagguacuc

SEQ ID NO: 766266 - RNA, 22 nt, Human
guaagaagaugaauccaggcug

SEQ ID NO: 766267 - RNA, 22 nt, Human
uuuguccucuccauguacaaua

SEQ ID NO: 766268 - RNA, 22 nt, Human
augacaaaggcugaaagggaaa

SEQ ID NO: 766269 - RNA, 21 nt, Human
aguugcugcugcugcagguga

SEQ ID NO: 766270 - RNA, 22 nt, Human
aauuucacuguggagcacauuu

SEQ ID NO: 766271 - RNA, 22 nt, Human
cacuaggcgccggguggcugug

SEQ ID NO: 766272 - RNA, 22 nt, Human
ucaagagagugcugcuuggggu

SEQ ID NO: 766273 - RNA, 22 nt, Human
agccagcacggcgccauggagu

SEQ ID NO: 766274 - RNA, 22 nt, Human
uucagcaguuucugagaagcaa

SEQ ID NO: 766275 - RNA, 22 nt, Human
gaaauugucagcuucuuucagu

SEQ ID NO: 766276 - RNA, 22 nt, Human
ucaauuuuaugaaacaaaguga

SEQ ID NO: 766277 - RNA, 22 nt, Human
uguccugggucaaccaggucga

SEQ ID NO: 766278 - RNA, 20 nt, Human
ccagagcugauggcugcccg

SEQ ID NO: 766279 - RNA, 22 nt, Human
uugcaaaugugaguuuagacug

SEQ ID NO: 766280 - RNA, 22 nt, Human
agcaggaaagaaaaaucugugu

SEQ ID NO: 766281 - RNA, 22 nt, Human
ugcagcuguaacagaggccuca

SEQ ID NO: 766282 - RNA, 22 nt, Human
ccaaaguccuuucuccaccugc

SEQ ID NO: 766283 - RNA, 22 nt, Human
ggaagcugaauccagagacagg

SEQ ID NO: 766284 - RNA, 22 nt, Human
ccagcuggucugugcucauguu

SEQ ID NO: 766285 - RNA, 22 nt, Human
acugaaggaagcgggcaggggu

SEQ ID NO: 766286 - RNA, 22 nt, Human
uauggcuuugggccaaaucuac

SEQ ID NO: 766287 - RNA, 22 nt, Human
ccagcuucaugggcaugcacca

SEQ ID NO: 766288 - RNA, 22 nt, Human
ucuggggaugaggaccuagaug

SEQ ID NO: 766289 - RNA, 22 nt, Human
uggcugaauaauauucuguugu

SEQ ID NO: 766290 - RNA, 21 nt, Human
ucccucagaagguagccaagc

SEQ ID NO: 766291 - RNA, 22 nt, Human
auaaggaaugauguaucaguuu

SEQ ID NO: 766292 - RNA, 22 nt, Human
ugggaagagggguauaaagaag

SEQ ID NO: 766293 - RNA, 22 nt, Human
ugguggacauucuggaugugcu

SEQ ID NO: 766294 - RNA, 23 nt, Human
auggaaauagcaugugucauuua

SEQ ID NO: 766295 - RNA, 22 nt, Human
ugaugcuguguaccucauggga

SEQ ID NO: 766296 - RNA, 22 nt, Human
aaagggccaauggagagugugg

SEQ ID NO: 766297 - RNA, 22 nt, Human
gagagggccgggggccagcucc

SEQ ID NO: 766298 - RNA, 22 nt, Human
augugagggaaaucagucagaa

SEQ ID NO: 766299 - RNA, 20 nt, Human
gcagccucaacaggcacagc

SEQ ID NO: 766300 - RNA, 22 nt, Human
aagacagccuuucccuggugcc

SEQ ID NO: 766301 - RNA, 22 nt, Human
aaaaccaggcguuuccuauuau

SEQ ID NO: 766302 - RNA, 17 nt, Human
uccaggagaggcaaugg

SEQ ID NO: 766303 - RNA, 20 nt, Human
uagcagcagaaagaacuuag

SEQ ID NO: 766304 - RNA, 15 nt, Human
ucugggcugugagca

SEQ ID NO: 766305 - RNA, 22 nt, Human
ugcauuuauaaaauguucgugg

SEQ ID NO: 766306 - RNA, 22 nt, Human
cagggagcagcgcuggggccuc

SEQ ID NO: 766307 - RNA, 22 nt, Human
uuuugaauaauucagaaacagc

SEQ ID NO: 766308 - RNA, 22 nt, Human
gggcuuuagauugcagaggauu

SEQ ID NO: 766309 - RNA, 22 nt, Human
acagaguuuauguguguacaaa

SEQ ID NO: 766310 - RNA, 22 nt, Human
ggcugcagauagccagccacca

SEQ ID NO: 766311 - RNA, 22 nt, Human
uguuuuaagcucuagaagggga

SEQ ID NO: 766312 - RNA, 22 nt, Human
caccuggcuggaagugcuccgg

SEQ ID NO: 766313 - RNA, 22 nt, Human
uccugugguaugggagugaugu

SEQ ID NO: 766314 - RNA, 22 nt, Human
cagauguggaaugcagcaggcu

SEQ ID NO: 766315 - RNA, 22 nt, Human
agcaggcuaaauaauaauacau

SEQ ID NO: 766316 - RNA, 22 nt, Human
uucucuagguuuuagaugaaga

SEQ ID NO: 766317 - RNA, 22 nt, Human
ucacugcugcugccaugaugga

SEQ ID NO: 766318 - RNA, 22 nt, Human
cugggacuuguagucucggcgc

SEQ ID NO: 766319 - RNA, 22 nt, Human
gugcaugugucuuuauaguagc

SEQ ID NO: 766320 - RNA, 22 nt, Human
agcccuaaauuaucuuuauuuu

SEQ ID NO: 766321 - RNA, 22 nt, Human
cugggcuuaggaccuggugcgg

SEQ ID NO: 766322 - RNA, 22 nt, Human
cuacaagauuuuuaaaacugua

SEQ ID NO: 766323 - RNA, 22 nt, Human
acaggucugugugcacagugcu

SEQ ID NO: 766324 - RNA, 22 nt, Human
auccugcugcuguggacuucuc

SEQ ID NO: 766325 - RNA, 22 nt, Human
aacagaguuucaaauaacaucu

SEQ ID NO: 766326 - RNA, 22 nt, Human
accuaacuuaccuagguccaca

SEQ ID NO: 766327 - RNA, 22 nt, Human
ugugacaagcauuguauauugg

SEQ ID NO: 766328 - RNA, 18 nt, Human
ucuguguucugucauugc

SEQ ID NO: 766329 - RNA, 19 nt, Human
gcuucccaccagccagccc

SEQ ID NO: 766330 - RNA, 22 nt, Human
gcugaauaauucuuuguugugg

SEQ ID NO: 766331 - RNA, 22 nt, Human
ucucugggcucaggagcccggc

SEQ ID NO: 766332 - RNA, 22 nt, Human
cucuccuggggagcacacacac

SEQ ID NO: 766333 - RNA, 22 nt, Human
auacacaggcaugcuucugauu

SEQ ID NO: 766334 - RNA, 22 nt, Human
gucuccacagcccagcugccac

SEQ ID NO: 766335 - RNA, 23 nt, Human
ugaguucucaucuuggcuucuau

SEQ ID NO: 766336 - RNA, 22 nt, Human
augcauaugccguagaauaagu

SEQ ID NO: 766337 - RNA, 21 nt, Human
agguuucucuuuuauggaggg

SEQ ID NO: 766338 - RNA, 23 nt, Human
uuguccuucugaaauauaucugg

SEQ ID NO: 766339 - RNA, 22 nt, Human
gcagggacugugaucucacaga

SEQ ID NO: 766340 - RNA, 22 nt, Human
uacagaguggugagaucuuuug

SEQ ID NO: 766341 - RNA, 22 nt, Human
augucuggaggucaucugguua

SEQ ID NO: 766342 - RNA, 22 nt, Human
aaauaugugaucagugaauaaa

SEQ ID NO: 766343 - RNA, 22 nt, Human
uggcauguugauaauggagaag

SEQ ID NO: 766344 - RNA, 22 nt, Human
ucuuuacauaguguggacuacu

SEQ ID NO: 766345 - RNA, 22 nt, Human
aucuuugggcaaugaugaggga

SEQ ID NO: 766346 - RNA, 22 nt, Human
aagauuugguaucagaagaccu

SEQ ID NO: 766347 - RNA, 22 nt, Human
aaaaauugcugagaacggaauu

SEQ ID NO: 766348 - RNA, 23 nt, Human
ugcagagugucacuugaaaacca

SEQ ID NO: 766349 - RNA, 22 nt, Human
guccugagcccucagcacagca

SEQ ID NO: 766350 - RNA, 22 nt, Human
uuuauacuccacucugcaagcg

SEQ ID NO: 766351 - RNA, 22 nt, Human
aaagaucaaguaggcauggccu

SEQ ID NO: 766352 - RNA, 22 nt, Human
cuggggugucucgucugccauu

SEQ ID NO: 766353 - RNA, 19 nt, Human
aggaaggaaccugagucug

SEQ ID NO: 766354 - RNA, 22 nt, Human
ggugaugaaaagugccuuuauc

SEQ ID NO: 766355 - RNA, 22 nt, Human
aagauuuucagugccuaaaaca

SEQ ID NO: 766356 - RNA, 22 nt, Human
uguuauugagguuacuuauaag

SEQ ID NO: 766357 - RNA, 22 nt, Human
gagggaagauuccccauauggg

SEQ ID NO: 766358 - RNA, 22 nt, Human
auauuucuggggguguguuucu

SEQ ID NO: 766359 - RNA, 22 nt, Human
agugcauauaugaagaguauga

SEQ ID NO: 766360 - RNA, 22 nt, Human
uggcaggcgggagccauagagg

SEQ ID NO: 766361 - RNA, 17 nt, Human
ugagcuucaaucaggug

SEQ ID NO: 766362 - RNA, 22 nt, Human
cugugacuagaccugcaggaga

SEQ ID NO: 766363 - RNA, 22 nt, Human
ccuggccucagccuagggcuga

SEQ ID NO: 766364 - RNA, 22 nt, Human
aaagcaugguuaaagacagugg

SEQ ID NO: 766365 - RNA, 22 nt, Human
cucccuggggcuccuccuauuu

SEQ ID NO: 766366 - RNA, 22 nt, Human
ggucugugugcuuugggaagug

SEQ ID NO: 766367 - RNA, 22 nt, Human
gcuggccugggcucaagaccag

SEQ ID NO: 766368 - RNA, 22 nt, Human
gaaaaaggauaaauacaguguu

SEQ ID NO: 766369 - RNA, 22 nt, Human
ucauugaaaacucagcaucuac

SEQ ID NO: 766370 - RNA, 20 nt, Human
aauggcuuauagcaugcuac

SEQ ID NO: 766371 - RNA, 22 nt, Human
ugagcuuccucccugcauccau

SEQ ID NO: 766372 - RNA, 22 nt, Human
ugucugccugucucugugcaaa

SEQ ID NO: 766373 - RNA, 22 nt, Human
aagacaugcaguuuguuccauu

SEQ ID NO: 766374 - RNA, 22 nt, Human
ucucugggccucccuuuccaag

SEQ ID NO: 766375 - RNA, 22 nt, Human
aauaauuuccagccaacuggaa

SEQ ID NO: 766376 - RNA, 20 nt, Human
cuguaaacugcgucuguaau

SEQ ID NO: 766377 - RNA, 22 nt, Human
cacugcuuucacaguuuguucc

SEQ ID NO: 766378 - RNA, 22 nt, Human
aguuucacaugcauggaugugu

SEQ ID NO: 766379 - RNA, 22 nt, Human
accuuuggaaauaaacacucug

SEQ ID NO: 766380 - RNA, 22 nt, Human
acucuucacuuccccugccagc

SEQ ID NO: 766381 - RNA, 22 nt, Human
ugaaaauauaguuuuccagacu

SEQ ID NO: 766382 - RNA, 22 nt, Human
gugccugugcggacucagggaa

SEQ ID NO: 766383 - RNA, 22 nt, Human
gggcuccaacggugagcaugga

SEQ ID NO: 766384 - RNA, 22 nt, Human
uauugcuucauaauuguugcca

SEQ ID NO: 766385 - RNA, 22 nt, Human
aaauaaaggaacuguuuuccca

SEQ ID NO: 766386 - RNA, 22 nt, Human
gagagugagauaauuucacaua

SEQ ID NO: 766387 - RNA, 22 nt, Human
gaaggcauuuuaugccuuauag

SEQ ID NO: 766388 - RNA, 21 nt, Human
ucagggcagugggagguuccu

SEQ ID NO: 766389 - RNA, 22 nt, Human
agccacgucccugucaggguca

SEQ ID NO: 766390 - RNA, 22 nt, Human
uggaacaagacagcauagagcu

SEQ ID NO: 766391 - RNA, 22 nt, Human
aaacucaaagucagaucagaga

SEQ ID NO: 766392 - RNA, 22 nt, Human
agcacagauucugaagaguccu

SEQ ID NO: 766393 - RNA, 22 nt, Human
uucuuuggcuuacgucuggccu

SEQ ID NO: 766394 - RNA, 22 nt, Human
ccagggcaggggcuggaguuca

SEQ ID NO: 766395 - RNA, 22 nt, Human
cucucuggaccucaacuauuuu

SEQ ID NO: 766396 - RNA, 22 nt, Human
auccaaacauguaccacacuaa

SEQ ID NO: 766397 - RNA, 22 nt, Human
uacagccucuucccuggagugg

SEQ ID NO: 766398 - RNA, 17 nt, Human
uaaauacacaaggguau

SEQ ID NO: 766399 - RNA, 22 nt, Human
ugcaggugucucugucuagcgu

SEQ ID NO: 766400 - RNA, 22 nt, Human
agcugcccaauccugcagggcg

SEQ ID NO: 766401 - RNA, 22 nt, Human
uauaggaaguauucaaagacug

SEQ ID NO: 766402 - RNA, 22 nt, Human
agccauggcgccacuagaggga

SEQ ID NO: 766403 - RNA, 22 nt, Human
aagaaagauaagguuugcuugg

SEQ ID NO: 766404 - RNA, 22 nt, Human
uacacugugguaaacucaaagu

SEQ ID NO: 766405 - RNA, 22 nt, Human
ucagaaaauaacuguuaguuug

SEQ ID NO: 766406 - RNA, 22 nt, Human
ucaugcacaugugucaccauca

SEQ ID NO: 766407 - RNA, 22 nt, Human
auuugugaucgugcgugaugaa

SEQ ID NO: 766408 - RNA, 22 nt, Human
aaaggucuucucaaacauccca

SEQ ID NO: 766409 - RNA, 22 nt, Human
ugcauugcaguuaacucaguau

SEQ ID NO: 766410 - RNA, 22 nt, Human
acccagucauccuggugugaga

SEQ ID NO: 766411 - RNA, 22 nt, Human
augcggagccccaagcuugaag

SEQ ID NO: 766412 - RNA, 22 nt, Human
uuccagaauugggagccuugag

SEQ ID NO: 766413 - RNA, 22 nt, Human
cuggcagguggagguugcagug

SEQ ID NO: 766414 - RNA, 19 nt, Human
agguggguaagcaguucuc

SEQ ID NO: 766415 - RNA, 22 nt, Human
ucagugcagcggcagcagcucu

SEQ ID NO: 766416 - RNA, 22 nt, Human
ucaguguuaaucagugguaccu

SEQ ID NO: 766417 - RNA, 22 nt, Human
auuguacaaugccuggaacauu

SEQ ID NO: 766418 - RNA, 22 nt, Human
aagccaggguuuguggaucuau

SEQ ID NO: 766419 - RNA, 22 nt, Human
gugugaaaguuccuaagacuau

SEQ ID NO: 766420 - RNA, 22 nt, Human
uuggcucaccuggagccuguug

SEQ ID NO: 766421 - RNA, 22 nt, Human
gagguagcaugcuggaagggac

SEQ ID NO: 766422 - RNA, 22 nt, Human
gagcagcucaggcacuuagcca

SEQ ID NO: 766423 - RNA, 22 nt, Human
cauguaaagcauccuucuaggg

SEQ ID NO: 766424 - RNA, 22 nt, Human
gcagagguggcaucugggcucu

SEQ ID NO: 766425 - RNA, 22 nt, Human
uggccuggugucugcgaggccu

SEQ ID NO: 766426 - RNA, 22 nt, Human
aaggaggaauaaagagguggug

SEQ ID NO: 766427 - RNA, 22 nt, Human
uggggcuccuccuggcaggagg

SEQ ID NO: 766428 - RNA, 22 nt, Human
ucagaguguggugagaugugca

SEQ ID NO: 766429 - RNA, 22 nt, Human
aaauugauuaaaguccgugcuu

SEQ ID NO: 766430 - RNA, 22 nt, Human
cagcuguucacauuuccaaaac

SEQ ID NO: 766431 - RNA, 22 nt, Human
caugucuggguauaugcauaug

SEQ ID NO: 766432 - RNA, 22 nt, Human
cacuuaaagucuuagcuuacag

SEQ ID NO: 766433 - RNA, 22 nt, Human
gugagaaaugacaaaugugucg

SEQ ID NO: 766434 - RNA, 22 nt, Human
uccuuugguucucuaagaugcu

SEQ ID NO: 766435 - RNA, 22 nt, Human
ucacacauuucucaaguguagg

SEQ ID NO: 766436 - RNA, 22 nt, Human
agucccaggcagccgagccggu

SEQ ID NO: 766437 - RNA, 22 nt, Human
uagcaccauacccggcagcucg

SEQ ID NO: 766438 - RNA, 22 nt, Human
cugcagccuaggugcagcuggg

SEQ ID NO: 766439 - RNA, 22 nt, Human
acagugauugguuuggggguga

SEQ ID NO: 766440 - RNA, 22 nt, Human
ggucucaggagacuggagagca

SEQ ID NO: 766441 - RNA, 22 nt, Human
ccugagauuuguaauuuuugua

SEQ ID NO: 766442 - RNA, 22 nt, Human
ugcaccagagcagggugcccaa

SEQ ID NO: 766443 - RNA, 22 nt, Human
gccuuccuuacaccugcucagc

SEQ ID NO: 766444 - RNA, 17 nt, Human
guuugcaugguguuaac

SEQ ID NO: 766445 - RNA, 22 nt, Human
gaaggcacugaacuccuucugg

SEQ ID NO: 766446 - RNA, 22 nt, Human
caggcacccucugaggggaagc

SEQ ID NO: 766447 - RNA, 22 nt, Human
cucaagaagagggagaccuaca

SEQ ID NO: 766448 - RNA, 22 nt, Human
ugaacacagggccaaacuugag

SEQ ID NO: 766449 - RNA, 19 nt, Human
auguucuauccuccaaguu

SEQ ID NO: 766450 - RNA, 23 nt, Human
agccacagccagagcuaucucca

SEQ ID NO: 766451 - RNA, 22 nt, Human
cucccgugauccuggaggagag

SEQ ID NO: 766452 - RNA, 22 nt, Human
guuccacaaaauguacccaguu

SEQ ID NO: 766453 - RNA, 22 nt, Human
caagggcagcagccucaagcgg

SEQ ID NO: 766454 - RNA, 22 nt, Human
aagagcaucaaugacucgcagu

SEQ ID NO: 766455 - RNA, 22 nt, Human
ucugcugcugcagcuacacuau

SEQ ID NO: 766456 - RNA, 22 nt, Human
ccugugcucccuauguaucugg

SEQ ID NO: 766457 - RNA, 23 nt, Human
agugcuggagaagcuucuggcuu

SEQ ID NO: 766458 - RNA, 22 nt, Human
cagcccugcugguuuugggcaa

SEQ ID NO: 766459 - RNA, 22 nt, Human
uggagcucaaaggccuguggga

SEQ ID NO: 766460 - RNA, 22 nt, Human
acuggccaggcagcaguagcuu

SEQ ID NO: 766461 - RNA, 22 nt, Human
gcagcugcagacccucagugcu

SEQ ID NO: 766462 - RNA, 22 nt, Human
cagccugcaggaggccgucagc

SEQ ID NO: 766463 - RNA, 22 nt, Human
cuuggcuguugggcauugagaa

SEQ ID NO: 766464 - RNA, 22 nt, Human
agguacagaugaaagucuaguu

SEQ ID NO: 766465 - RNA, 22 nt, Human
ucccacagaccaugaguggaag

SEQ ID NO: 766466 - RNA, 22 nt, Human
cccaggucuccugcuucccagg

SEQ ID NO: 766467 - RNA, 21 nt, Human
accaucuuccaugcauuauau

SEQ ID NO: 766468 - RNA, 22 nt, Human
ucaucacauaugucaugauuug

SEQ ID NO: 766469 - RNA, 22 nt, Human
aggucauuggggacuaucuccg

SEQ ID NO: 766470 - RNA, 22 nt, Human
ugcagggaaaacccaggaugcu

SEQ ID NO: 766471 - RNA, 22 nt, Human
ucagggagaggugagagccugu

SEQ ID NO: 766472 - RNA, 18 nt, Human
uaagaagguggcuccagc

SEQ ID NO: 766473 - RNA, 22 nt, Human
agauccauccagcacucuugcc

SEQ ID NO: 766474 - RNA, 22 nt, Human
cucaggaugcaggucacaggac

SEQ ID NO: 766475 - RNA, 19 nt, Human
aguguauuuuuuucuguag

SEQ ID NO: 766476 - RNA, 22 nt, Human
gcagaacauuucacaguaucuu

SEQ ID NO: 766477 - RNA, 22 nt, Human
ucugggccggagccgacggcag

SEQ ID NO: 766478 - RNA, 22 nt, Human
agcucagagauaaucaagagac

SEQ ID NO: 766479 - RNA, 20 nt, Human
cguccccuugagcagguccc

SEQ ID NO: 766480 - RNA, 22 nt, Human
aggcccuggccugacucaaugu

SEQ ID NO: 766481 - RNA, 22 nt, Human
aauagcuugccuaauccucaug

SEQ ID NO: 766482 - RNA, 22 nt, Human
aaauguccuuagagaaaaguca

SEQ ID NO: 766483 - RNA, 22 nt, Human
ugugaucugccuuggaucugca

SEQ ID NO: 766484 - RNA, 22 nt, Human
aauccauaauguugugggguuu

SEQ ID NO: 766485 - RNA, 22 nt, Human
agcacacaggccaccuccacuu

SEQ ID NO: 766486 - RNA, 22 nt, Human
aacugcaguuaccuuugcacca

SEQ ID NO: 766487 - RNA, 22 nt, Human
aggcucccaagcacugacccca

SEQ ID NO: 766488 - RNA, 22 nt, Human
ucagugcuugacagcucuggga

SEQ ID NO: 766489 - RNA, 22 nt, Human
ucaggaaaggcagagugucugu

SEQ ID NO: 766490 - RNA, 22 nt, Human
uccuuggagucaugauggaggu

SEQ ID NO: 766491 - RNA, 20 nt, Human
accaauguuagcuuaguacu

SEQ ID NO: 766492 - RNA, 22 nt, Human
uuuacuguucaacuugcaagua

SEQ ID NO: 766493 - RNA, 22 nt, Human
ucaauguucaaguaugacaaug

SEQ ID NO: 766494 - RNA, 22 nt, Human
aguaucugcaugauuuugagaa

SEQ ID NO: 766495 - RNA, 22 nt, Human
guggcuucuucuugggagcugc

SEQ ID NO: 766496 - RNA, 22 nt, Human
gcaguaaaaaaggauaugugca

SEQ ID NO: 766497 - RNA, 22 nt, Human
uuaaguugugaauaauccaguc

SEQ ID NO: 766498 - RNA, 22 nt, Human
cuggaaugagcagggcuuaugg

SEQ ID NO: 766499 - RNA, 22 nt, Human
uauucaguggaaaauguguuga

SEQ ID NO: 766500 - RNA, 22 nt, Human
gccaggacugagaaugggagca

SEQ ID NO: 766501 - RNA, 22 nt, Human
aacugcuucuuacugcugggca

SEQ ID NO: 766502 - RNA, 22 nt, Human
ucaucuguucauacacaugcgu

SEQ ID NO: 766503 - RNA, 22 nt, Human
aagagcaacuuggaaacacuca

SEQ ID NO: 766504 - RNA, 22 nt, Human
auguucuuggauguuguguaua

SEQ ID NO: 766505 - RNA, 22 nt, Human
ggagauaguccaggugaaggga

SEQ ID NO: 766506 - RNA, 20 nt, Human
agagaauucccuuuggagau

SEQ ID NO: 766507 - RNA, 20 nt, Human
uccuggaguauuccaugcuu

SEQ ID NO: 766508 - RNA, 17 nt, Human
ccugaaggcacuuccag

SEQ ID NO: 766509 - RNA, 22 nt, Human
agggcucagccuccuccucagc

SEQ ID NO: 766510 - RNA, 22 nt, Human
ucucacaguaugaauuguucac

SEQ ID NO: 766511 - RNA, 22 nt, Human
aagcugcagaugugccugugga

SEQ ID NO: 766512 - RNA, 20 nt, Human
aggcaucugagucacaucuu

SEQ ID NO: 766513 - RNA, 22 nt, Human
agcccugggcguuacugggaug

SEQ ID NO: 766514 - RNA, 22 nt, Human
gaugcugagagauuggagacua

SEQ ID NO: 766515 - RNA, 22 nt, Human
uagcuguugggagagggcuaga

SEQ ID NO: 766516 - RNA, 22 nt, Human
cagaaguaagauuacugugaga

SEQ ID NO: 766517 - RNA, 19 nt, Human
ucaguauauaauuacacca

SEQ ID NO: 766518 - RNA, 22 nt, Human
ggccaccuaggagccacaguga

SEQ ID NO: 766519 - RNA, 19 nt, Human
cagcuggaaucaucugagg

SEQ ID NO: 766520 - RNA, 22 nt, Human
ggugcuggacacguggcacucc

SEQ ID NO: 766521 - RNA, 22 nt, Human
uuucccuuguuccuuccucuga

SEQ ID NO: 766522 - RNA, 22 nt, Human
auucugcaacuguuguuggugg

SEQ ID NO: 766523 - RNA, 20 nt, Human
gcucccugguagaaauguuu

SEQ ID NO: 766524 - RNA, 22 nt, Human
aucuucaaagcacaucguuugu

SEQ ID NO: 766525 - RNA, 22 nt, Human
cuguuaagcaacaugaguaagu

SEQ ID NO: 766526 - RNA, 18 nt, Human
uugauucauauuaaccau

SEQ ID NO: 766527 - RNA, 22 nt, Human
ugcagggauccuagcugaagag

SEQ ID NO: 766528 - RNA, 21 nt, Human
uucuuuccccagaggacuaaa

SEQ ID NO: 766529 - RNA, 22 nt, Human
uauccuguguacugucuaguac

SEQ ID NO: 766530 - RNA, 22 nt, Human
cuggcugcaguagcaagagacu

SEQ ID NO: 766531 - RNA, 22 nt, Human
augggccaggcuugggaugaca

SEQ ID NO: 766532 - RNA, 22 nt, Human
ggaauaaaaauuguuuacugua

SEQ ID NO: 766533 - RNA, 21 nt, Human
ugaggccucuccugggcuggc

SEQ ID NO: 766534 - RNA, 22 nt, Human
guggcagucaucaaggacagau

SEQ ID NO: 766535 - RNA, 22 nt, Human
ugggcuuuaucaugggucuggu

SEQ ID NO: 766536 - RNA, 22 nt, Human
uccuaacuccacuagccuuggg

SEQ ID NO: 766537 - RNA, 22 nt, Human
uuggcugcuggucuuuggauau

SEQ ID NO: 766538 - RNA, 22 nt, Human
aggcaacaugacucacuugcac

SEQ ID NO: 766539 - RNA, 22 nt, Human
cagcucccagagugaccagcag

SEQ ID NO: 766540 - RNA, 20 nt, Human
acagagaucagcugaugggc

SEQ ID NO: 766541 - RNA, 20 nt, Human
accuggagacagcacucugg

SEQ ID NO: 766542 - RNA, 22 nt, Human
ugacagugaacagguuaccacu

SEQ ID NO: 766543 - RNA, 20 nt, Human
aggcagacaaggagucuguu

SEQ ID NO: 766544 - RNA, 23 nt, Human
agcacaucaaagcagggaggaga

SEQ ID NO: 766545 - RNA, 22 nt, Human
ucucaucuccauuauagcauca

SEQ ID NO: 766546 - RNA, 22 nt, Human
aaaaguaauugcgguuuuugcc

SEQ ID NO: 766547 - RNA, 22 nt, Human
gauauguaccaccucuuaaaag

SEQ ID NO: 766548 - RNA, 22 nt, Human
ugcuucugaaaugcaggucuuc

SEQ ID NO: 766549 - RNA, 22 nt, Human
caggaggugacuuccagggguu

SEQ ID NO: 766550 - RNA, 22 nt, Human
agugugcauuccucuccucagg

SEQ ID NO: 766551 - RNA, 22 nt, Human
ucugacuuuggacaguggcgaa

SEQ ID NO: 766552 - RNA, 22 nt, Human
auugacaagacaauggcucuua

SEQ ID NO: 766553 - RNA, 22 nt, Human
caugaagcucuugcaccucuag

SEQ ID NO: 766554 - RNA, 20 nt, Human
agacaaaaugacuucaugca

SEQ ID NO: 766555 - RNA, 20 nt, Human
gcuuuaagccaaaaugugaa

SEQ ID NO: 766556 - RNA, 22 nt, Human
caggggccaggcugucugcugu

SEQ ID NO: 766557 - RNA, 22 nt, Human
gguggccucugcaggccucgac

SEQ ID NO: 766558 - RNA, 22 nt, Human
ugugugaagugauuuuaagucu

SEQ ID NO: 766559 - RNA, 22 nt, Human
auguuaugucugggaaggggua

SEQ ID NO: 766560 - RNA, 22 nt, Human
ggaugacaaggaaagcaaacca

SEQ ID NO: 766561 - RNA, 18 nt, Human
caggucugucugccuccc

SEQ ID NO: 766562 - RNA, 22 nt, Human
aaggcuggcaauauauuuguua

SEQ ID NO: 766563 - RNA, 22 nt, Human
aacagcuuuagaggauaauagu

SEQ ID NO: 766564 - RNA, 22 nt, Human
uauauguugauacuaauucugg

SEQ ID NO: 766565 - RNA, 22 nt, Human
cucugggucuauaaugcagcug

SEQ ID NO: 766566 - RNA, 22 nt, Human
cugggcucagcaggccaaggcc

SEQ ID NO: 766567 - RNA, 22 nt, Human
ucuagaaucuaaacuauaguuu

SEQ ID NO: 766568 - RNA, 22 nt, Human
ugggaggcagguaggugaugau

SEQ ID NO: 766569 - RNA, 22 nt, Human
cugccagcacugccuccugagg

SEQ ID NO: 766570 - RNA, 22 nt, Human
gccacagcagggcccucucagg

SEQ ID NO: 766571 - RNA, 22 nt, Human
aagagggaaauuguuggcugcu

SEQ ID NO: 766572 - RNA, 22 nt, Human
uccaggccuggcuccauucagu

SEQ ID NO: 766573 - RNA, 20 nt, Human
gcuggaagggcuagagggcu

SEQ ID NO: 766574 - RNA, 22 nt, Human
auucagcacaauuuggccaaua

SEQ ID NO: 766575 - RNA, 22 nt, Human
acaaggaacaagcauguaguuu

SEQ ID NO: 766576 - RNA, 22 nt, Human
gcauucuucgaaguaaguagug

SEQ ID NO: 766577 - RNA, 22 nt, Human
ccuggcucucugcagauccugg

SEQ ID NO: 766578 - RNA, 22 nt, Human
ugauugccuacuaugugccaug

SEQ ID NO: 766579 - RNA, 23 nt, Human
auguggcuagugagaccaagaaa

SEQ ID NO: 766580 - RNA, 22 nt, Human
uccuagagaguaauacaguuuu

SEQ ID NO: 766581 - RNA, 22 nt, Human
ucuccaggggcugcugugccac

SEQ ID NO: 766582 - RNA, 22 nt, Human
gguuuaauugguccaggauggg

SEQ ID NO: 766583 - RNA, 17 nt, Human
uguaacaacuccuauua

SEQ ID NO: 766584 - RNA, 22 nt, Human
gccucagggggagaggccagcu

SEQ ID NO: 766585 - RNA, 22 nt, Human
aaugcucaaaauguuucaucua

SEQ ID NO: 766586 - RNA, 22 nt, Human
aggcagaauguuggaaaggaag

SEQ ID NO: 766587 - RNA, 22 nt, Human
uaaaggcucacuggcuuggggu

SEQ ID NO: 766588 - RNA, 22 nt, Human
guacuucuuaaauuaggaucaa

SEQ ID NO: 766589 - RNA, 22 nt, Human
ccuggcugggccugauuucuca

SEQ ID NO: 766590 - RNA, 22 nt, Human
cugcacagcuggccagggagag

SEQ ID NO: 766591 - RNA, 22 nt, Human
ccaggagaugggaaaguagcag

SEQ ID NO: 766592 - RNA, 22 nt, Human
aucaccauugaaaaacagguuu

SEQ ID NO: 766593 - RNA, 21 nt, Human
ucuuggcucugccacuuauua

SEQ ID NO: 766594 - RNA, 22 nt, Human
ugagcagauuuguucuaggggu

SEQ ID NO: 766595 - RNA, 22 nt, Human
ugcacuuguguuuucagaaucu

SEQ ID NO: 766596 - RNA, 22 nt, Human
gcauggcauuugaagguagaag

SEQ ID NO: 766597 - RNA, 22 nt, Human
ucuccaggcccacugauuuaua

SEQ ID NO: 766598 - RNA, 21 nt, Human
guugugguuggggcugcagcu

SEQ ID NO: 766599 - RNA, 21 nt, Human
acaaugcauggaacucauggc

SEQ ID NO: 766600 - RNA, 21 nt, Human
cagagcagcguucugcugugg

SEQ ID NO: 766601 - RNA, 20 nt, Human
cuguccccgaggucaccagg

SEQ ID NO: 766602 - RNA, 22 nt, Human
auagaaauggcagcuggugcua

SEQ ID NO: 766603 - RNA, 22 nt, Human
gugcuggggagauaggaagaga

SEQ ID NO: 766604 - RNA, 22 nt, Human
ucucaggccccugaguuucucu

SEQ ID NO: 766605 - RNA, 22 nt, Human
acaggcuuagggcuugggcccg

SEQ ID NO: 766606 - RNA, 22 nt, Human
uggcuucucccgacacccuggc

SEQ ID NO: 766607 - RNA, 22 nt, Human
auaaagaggauguauuuacagc

SEQ ID NO: 766608 - RNA, 22 nt, Human
gaauugcuucugguauguuacu

SEQ ID NO: 766609 - RNA, 22 nt, Human
acuugaauuuaguuuuuccuaa

SEQ ID NO: 766610 - RNA, 22 nt, Human
agggccuguccgcucccgcccg

SEQ ID NO: 766611 - RNA, 22 nt, Human
agugcauucucuaauuacaggu

SEQ ID NO: 766612 - RNA, 22 nt, Human
uugaauaauaugcuucguucuc

SEQ ID NO: 766613 - RNA, 22 nt, Human
uggcacaguuaaaguuguagaa

SEQ ID NO: 766614 - RNA, 22 nt, Human
cugcccagaaucacucacucga

SEQ ID NO: 766615 - RNA, 22 nt, Human
agugccagcuccacacagcagc

SEQ ID NO: 766616 - RNA, 22 nt, Human
ucucaaaguagcucccacagau

SEQ ID NO: 766617 - RNA, 22 nt, Human
caggaaaaugucaauggaaagc

SEQ ID NO: 766618 - RNA, 22 nt, Human
auguacauuuguaguaauauca

SEQ ID NO: 766619 - RNA, 22 nt, Human
agagcuguucaacguagcaaug

SEQ ID NO: 766620 - RNA, 22 nt, Human
ggggcagaguagcuggggugug

SEQ ID NO: 766621 - RNA, 22 nt, Human
cauuaauauuguucuucuuuag

SEQ ID NO: 766622 - RNA, 22 nt, Human
aaggcaaaagaggugucaucac

SEQ ID NO: 766623 - RNA, 23 nt, Human
uggaauaauaagguacauuaaca

SEQ ID NO: 766624 - RNA, 22 nt, Human
gcccugagcacugcugcugggg

SEQ ID NO: 766625 - RNA, 22 nt, Human
gucuggaagagcaggaauaaac

SEQ ID NO: 766626 - RNA, 22 nt, Human
cuggcugggguaccaguugaac

SEQ ID NO: 766627 - RNA, 22 nt, Human
aucauuagcaauuuucaauaag

SEQ ID NO: 766628 - RNA, 22 nt, Human
ucaggcccuucucccaggacuc

SEQ ID NO: 766629 - RNA, 22 nt, Human
ucacaauuuggauacagcuaug

SEQ ID NO: 766630 - RNA, 22 nt, Human
cuuagaaauaaugguuucaguu

SEQ ID NO: 766631 - RNA, 22 nt, Human
aagggcucgguagcaguccuga

SEQ ID NO: 766632 - RNA, 22 nt, Human
ugcagagugggagaggugcggg

SEQ ID NO: 766633 - RNA, 22 nt, Human
uagugcuugguggagauggaga

SEQ ID NO: 766634 - RNA, 22 nt, Human
gcaggugggggucggugcaucu

SEQ ID NO: 766635 - RNA, 22 nt, Human
agcagcugggcucagagcuggg

SEQ ID NO: 766636 - RNA, 21 nt, Human
ucauauuucucuugcuauugu

SEQ ID NO: 766637 - RNA, 22 nt, Human
ccagcucucaaggcucccuggg

SEQ ID NO: 766638 - RNA, 22 nt, Human
uggcuaggacucauccuguuuc

SEQ ID NO: 766639 - RNA, 22 nt, Human
aguuagcagcuuauuagaaaca

SEQ ID NO: 766640 - RNA, 22 nt, Human
uuauuccacagcucagaauuuu

SEQ ID NO: 766641 - RNA, 22 nt, Human
aguguucacucuguggagccca

SEQ ID NO: 766642 - RNA, 22 nt, Human
aggaagggugucaugagcccuu

SEQ ID NO: 766643 - RNA, 22 nt, Human
gcucuccugugcagaugcugcu

SEQ ID NO: 766644 - RNA, 22 nt, Human
uccaggcugugcgcaccgugug

SEQ ID NO: 766645 - RNA, 22 nt, Human
ucacagagaaaagcuaucacaa

SEQ ID NO: 766646 - RNA, 22 nt, Human
acaguaaaacauuuuuauuagg

SEQ ID NO: 766647 - RNA, 22 nt, Human
cuggagaauucuaugaaauauu

SEQ ID NO: 766648 - RNA, 22 nt, Human
cacaugcaccagaaaucaacau

SEQ ID NO: 766649 - RNA, 22 nt, Human
cagaauuuagaaaacaacauaa

SEQ ID NO: 766650 - RNA, 22 nt, Human
uuugugacuugcuucucagaau

SEQ ID NO: 766651 - RNA, 22 nt, Human
agaggcuuggccucaguucugu

SEQ ID NO: 766652 - RNA, 22 nt, Human
cuguacaucccaagauauuucu

SEQ ID NO: 766653 - RNA, 22 nt, Human
aaaguuacacgacuauuuaugu

SEQ ID NO: 766654 - RNA, 22 nt, Human
ucuggcuguuaggccugaccuu

SEQ ID NO: 766655 - RNA, 22 nt, Human
uauguacaucuugagcaaugaa

SEQ ID NO: 766656 - RNA, 22 nt, Human
agcagcaaggaacagaauggac

SEQ ID NO: 766657 - RNA, 22 nt, Human
agacuugggaccuaggaaugga

SEQ ID NO: 766658 - RNA, 22 nt, Human
uugguuuucaggggcaggauaa

SEQ ID NO: 766659 - RNA, 22 nt, Human
gcuaggcuguguuucagacccu

SEQ ID NO: 766660 - RNA, 22 nt, Human
ccugagcaaaggaaggaugacu

SEQ ID NO: 766661 - RNA, 22 nt, Human
ggauguugauugaauggccauu

SEQ ID NO: 766662 - RNA, 21 nt, Human
uuucuuucuggcucucacagu

SEQ ID NO: 766663 - RNA, 22 nt, Human
ccuaacuucacuucauugaagu

SEQ ID NO: 766664 - RNA, 22 nt, Human
ugcugcaguguuugcugaaguu

SEQ ID NO: 766665 - RNA, 22 nt, Human
uagcaacguguauaaacucaag

SEQ ID NO: 766666 - RNA, 22 nt, Human
cacagcuggugcacuagcucug

SEQ ID NO: 766667 - RNA, 22 nt, Human
ucacucuguguuucccugggac

SEQ ID NO: 766668 - RNA, 22 nt, Human
uuauuuccacaaugugguaggg

SEQ ID NO: 766669 - RNA, 22 nt, Human
ccucaugguacuuacuguagcu

SEQ ID NO: 766670 - RNA, 22 nt, Human
agauauuguuuguuucaccaau

SEQ ID NO: 766671 - RNA, 22 nt, Human
auucuguauuucuaauaagauc

SEQ ID NO: 766672 - RNA, 18 nt, Human
agcugcuugcaggccuuc

SEQ ID NO: 766673 - RNA, 22 nt, Human
agccaggaucacccggggcugu

SEQ ID NO: 766674 - RNA, 22 nt, Human
ucuauuaaugauucaauagugu

SEQ ID NO: 766675 - RNA, 22 nt, Human
acaaguggguccuacauaaagc

SEQ ID NO: 766676 - RNA, 22 nt, Human
acaugcaggaaaaugcacagau

SEQ ID NO: 766677 - RNA, 22 nt, Human
ucuuuucaucauuuaauaggua

SEQ ID NO: 766678 - RNA, 22 nt, Human
uauuucuaagagauaucuguac

SEQ ID NO: 766679 - RNA, 22 nt, Human
ccaggccagggcugcagcgagc

SEQ ID NO: 766680 - RNA, 22 nt, Human
ggacaagccucagacaaaacuc

SEQ ID NO: 766681 - RNA, 22 nt, Human
uccucagggggccaacccagcc

SEQ ID NO: 766682 - RNA, 22 nt, Human
accugcucaacuggcuucucgc

SEQ ID NO: 766683 - RNA, 19 nt, Human
agcagccauagacaauaug

SEQ ID NO: 766684 - RNA, 22 nt, Human
aggcacugaaagguggccagag

SEQ ID NO: 766685 - RNA, 22 nt, Human
agauacauugcacgaugcagau

SEQ ID NO: 766686 - RNA, 22 nt, Human
cagcuccugcagcugcugccgu

SEQ ID NO: 766687 - RNA, 22 nt, Human
agguccuggucuugagucuuaa

SEQ ID NO: 766688 - RNA, 22 nt, Human
caagauaucaaugacauaguau

SEQ ID NO: 766689 - RNA, 22 nt, Human
uacaagcucacaaauuuuuaag

SEQ ID NO: 766690 - RNA, 22 nt, Human
ccuugguuuccaggaugaggcu

SEQ ID NO: 766691 - RNA, 22 nt, Human
cugggcugucaguuuuguuuua

SEQ ID NO: 766692 - RNA, 17 nt, Human
ugauucaacuagaaacu

SEQ ID NO: 766693 - RNA, 22 nt, Human
caugugugaguauaucuuaucc

SEQ ID NO: 766694 - RNA, 19 nt, Human
ccaugccaucauuuuaaag

SEQ ID NO: 766695 - RNA, 22 nt, Human
uucucacaggauuucuuuuagu

SEQ ID NO: 766696 - RNA, 22 nt, Human
uuuguagaggguaauugacaga

SEQ ID NO: 766697 - RNA, 22 nt, Human
cacauguucuugaagccaacuc

SEQ ID NO: 766698 - RNA, 22 nt, Human
ucuuuaucaagucuguucuuug

SEQ ID NO: 766699 - RNA, 20 nt, Human
ucucuucaggagguccaugu

SEQ ID NO: 766700 - RNA, 17 nt, Human
aagacccuagucuaccc

SEQ ID NO: 766701 - RNA, 20 nt, Human
uacauauuauaucagcugca

SEQ ID NO: 766702 - RNA, 22 nt, Human
caguguuucugaguuccagcuc

SEQ ID NO: 766703 - RNA, 22 nt, Human
uuccugcuuccuggccucacaa

SEQ ID NO: 766704 - RNA, 23 nt, Human
aucaaaggauguagagaagaagc

SEQ ID NO: 766705 - RNA, 23 nt, Human
ccacuagcaccuguucaacuucu

SEQ ID NO: 766706 - RNA, 22 nt, Human
gaggcagugucgguggcaggau

SEQ ID NO: 766707 - RNA, 22 nt, Human
cagauuuaagauauuuguauug

SEQ ID NO: 766708 - RNA, 21 nt, Human
agaagggauugugguaaagau

SEQ ID NO: 766709 - RNA, 22 nt, Human
cuuggcagcuacacagguaaga

SEQ ID NO: 766710 - RNA, 19 nt, Human
agucaucucacugugccca

SEQ ID NO: 766711 - RNA, 22 nt, Human
uuucagaccugcugugcuaucu

SEQ ID NO: 766712 - RNA, 22 nt, Human
agagcagcguuuguggaacacu

SEQ ID NO: 766713 - RNA, 22 nt, Human
uggggacauagccagucuggcu

SEQ ID NO: 766714 - RNA, 22 nt, Human
uuccuggcucacagcagugggg

SEQ ID NO: 766715 - RNA, 22 nt, Human
agacauuuugauaccccuaccg

SEQ ID NO: 766716 - RNA, 22 nt, Human
cccuucagcugagugggacagc

SEQ ID NO: 766717 - RNA, 22 nt, Human
aucucaaacaucuuugaccaua

SEQ ID NO: 766718 - RNA, 21 nt, Human
ugucucaaucagaagucauua

SEQ ID NO: 766719 - RNA, 22 nt, Human
uaguggcugcagggcuguuuga

SEQ ID NO: 766720 - RNA, 22 nt, Human
auaaugcugggagaaauuguua

SEQ ID NO: 766721 - RNA, 22 nt, Human
uggcagcugaggggaggcuuug

SEQ ID NO: 766722 - RNA, 22 nt, Human
cagggccugccugguuccugga

SEQ ID NO: 766723 - RNA, 22 nt, Human
agcugagguugaagagugaacg

SEQ ID NO: 766724 - RNA, 19 nt, Human
gcccugcaggagguggggc

SEQ ID NO: 766725 - RNA, 20 nt, Human
gcauugaguauagacagaug

SEQ ID NO: 766726 - RNA, 22 nt, Human
cauguucagugacaguuauuga

SEQ ID NO: 766727 - RNA, 22 nt, Human
gcagauggaucaccugaggucg

SEQ ID NO: 766728 - RNA, 22 nt, Human
ugaggcucugcuucuguggcuc

SEQ ID NO: 766729 - RNA, 22 nt, Human
gagguggcccuugcucagccuu

SEQ ID NO: 766730 - RNA, 17 nt, Human
gcaaaggugaggagaga

SEQ ID NO: 766731 - RNA, 20 nt, Human
cuuuaguuauuaacagcacu

SEQ ID NO: 766732 - RNA, 22 nt, Human
ugauugaauauucccuugggcc

SEQ ID NO: 766733 - RNA, 19 nt, Human
acagggcagcaauaggaua

SEQ ID NO: 766734 - RNA, 22 nt, Human
ugaacauuaguugaguaaaguc

SEQ ID NO: 766735 - RNA, 22 nt, Human
uggcuucacacaggcacuuccg

SEQ ID NO: 766736 - RNA, 22 nt, Human
cuuugcugccagaacccagcag

SEQ ID NO: 766737 - RNA, 22 nt, Human
uuaugggagcaauuggggaggu

SEQ ID NO: 766738 - RNA, 22 nt, Human
uacaugaauguuucaauauugu

SEQ ID NO: 766739 - RNA, 22 nt, Human
caucauaaaauugagauaacug

SEQ ID NO: 766740 - RNA, 22 nt, Human
cugagauggaguuucgcucuuc

SEQ ID NO: 766741 - RNA, 23 nt, Human
aacaauagguuuuggcagaauag

SEQ ID NO: 766742 - RNA, 22 nt, Human
ugcccugcccaucuacccuguc

SEQ ID NO: 766743 - RNA, 22 nt, Human
agcugcucucacuggacgccug

SEQ ID NO: 766744 - RNA, 22 nt, Human
gagaggagacuuauccagauug

SEQ ID NO: 766745 - RNA, 22 nt, Human
uaugcaaaugacugguauguuu

SEQ ID NO: 766746 - RNA, 19 nt, Human
ugagaacuuuuacuuaugc

SEQ ID NO: 766747 - RNA, 22 nt, Human
aaaggaggaauggagagaugcu

SEQ ID NO: 766748 - RNA, 22 nt, Human
gugaauuaggacaaaagggcuu

SEQ ID NO: 766749 - RNA, 22 nt, Human
cuggaggcacccuuagagaggc

SEQ ID NO: 766750 - RNA, 22 nt, Human
agcugccucagucacucauggc

SEQ ID NO: 766751 - RNA, 22 nt, Human
uggugagaugcagcaacagaca

SEQ ID NO: 766752 - RNA, 20 nt, Human
ggugcgaggccagagcagac

SEQ ID NO: 766753 - RNA, 22 nt, Human
cauggcaauuucauaaacaggu

SEQ ID NO: 766754 - RNA, 22 nt, Human
auacaaagcuuucugucuggua

SEQ ID NO: 766755 - RNA, 21 nt, Human
ggcuggucgcgugcaugucuc

SEQ ID NO: 766756 - RNA, 21 nt, Human
uagcacuucgcuguaauuggg

SEQ ID NO: 766757 - RNA, 22 nt, Human
acuaaauaguuuugacagaaca

SEQ ID NO: 766758 - RNA, 22 nt, Human
aggcagcccacaggacacagga

SEQ ID NO: 766759 - RNA, 22 nt, Human
uuggcuguuuuauaggucaguu

SEQ ID NO: 766760 - RNA, 22 nt, Human
gagagcagacucucaaagcugg

SEQ ID NO: 766761 - RNA, 22 nt, Human
aacuucauggguucaaagcugg

SEQ ID NO: 766762 - RNA, 22 nt, Human
uacucuaacauuuguuagaugu

SEQ ID NO: 766763 - RNA, 22 nt, Human
cuguggccagucccacaccucc

SEQ ID NO: 766764 - RNA, 22 nt, Human
aaugucacucuguuuccucugc

SEQ ID NO: 766765 - RNA, 22 nt, Human
gagaggaguagacacuuugguu

SEQ ID NO: 766766 - RNA, 22 nt, Human
aaagagcuucauuuccauuuau

SEQ ID NO: 766767 - RNA, 18 nt, Human
agcagaauucuaggguuc

SEQ ID NO: 766768 - RNA, 22 nt, Human
ggacagugaauguggggaugca

SEQ ID NO: 766769 - RNA, 22 nt, Human
agaguucagaaagugcagguuu

SEQ ID NO: 766770 - RNA, 22 nt, Human
gauccuguuagaaauguagacu

SEQ ID NO: 766771 - RNA, 19 nt, Human
ucccagagucuagagguug

SEQ ID NO: 766772 - RNA, 21 nt, Human
ucaggaguggagagaauuggu

SEQ ID NO: 766773 - RNA, 22 nt, Human
agagucugaggcagcugcagcc

SEQ ID NO: 766774 - RNA, 22 nt, Human
ugcugggcagugugcccucgag

SEQ ID NO: 766775 - RNA, 23 nt, Human
ggaggaguucccagcccuccugg

SEQ ID NO: 766776 - RNA, 22 nt, Human
uuggaacacagcagcugauuuu

SEQ ID NO: 766777 - RNA, 22 nt, Human
ggccugcucugcagccucuaca

SEQ ID NO: 766778 - RNA, 22 nt, Human
cccagaggcugaguugggagca

SEQ ID NO: 766779 - RNA, 22 nt, Human
caguccugaggaagagcugcug

SEQ ID NO: 766780 - RNA, 22 nt, Human
ugagaccuguagcuucacagag

SEQ ID NO: 766781 - RNA, 22 nt, Human
uguuaaauugauucaccuuucu

SEQ ID NO: 766782 - RNA, 22 nt, Human
ccugucauacuaacguaguggg

SEQ ID NO: 766783 - RNA, 22 nt, Human
aaggaauucaaauuuucucugg

SEQ ID NO: 766784 - RNA, 22 nt, Human
aaugaucauuauaaagugcucu

SEQ ID NO: 766785 - RNA, 22 nt, Human
gugccuggcaugcgccggugcu

SEQ ID NO: 766786 - RNA, 22 nt, Human
gaaaguuuauagguuauauaau

SEQ ID NO: 766787 - RNA, 22 nt, Human
guuaacauucaauuaaacaguc

SEQ ID NO: 766788 - RNA, 22 nt, Human
guugugauuguagcuaaacuag

SEQ ID NO: 766789 - RNA, 22 nt, Human
gagguaacaacugaaaugagaa

SEQ ID NO: 766790 - RNA, 22 nt, Human
ggaauacuaugacacacaggug

SEQ ID NO: 766791 - RNA, 22 nt, Human
agcugguucacuaagcauaaua

SEQ ID NO: 766792 - RNA, 22 nt, Human
caaggccugccucuggcagaaa

SEQ ID NO: 766793 - RNA, 22 nt, Human
uggaagagacacuuacauucag

SEQ ID NO: 766794 - RNA, 22 nt, Human
agucacucugcuacaugacagc

SEQ ID NO: 766795 - RNA, 23 nt, Human
acugggucuaucuccagagaaga

SEQ ID NO: 766796 - RNA, 20 nt, Human
gcauccagacacccagcugc

SEQ ID NO: 766797 - RNA, 21 nt, Human
uucuucuuggacuguuuuggc

SEQ ID NO: 766798 - RNA, 22 nt, Human
cugaggcugggcugaggguaua

SEQ ID NO: 766799 - RNA, 22 nt, Human
cuuuggcaaugaaacacaagaa

SEQ ID NO: 766800 - RNA, 22 nt, Human
gcagccacugggagugcuuaua

SEQ ID NO: 766801 - RNA, 23 nt, Human
ucaucaaacagcugcucaagaaa

SEQ ID NO: 766802 - RNA, 22 nt, Human
ccuggagauuucuucaagcuuu

SEQ ID NO: 766803 - RNA, 22 nt, Human
cagaaauucccauuucagauuc

SEQ ID NO: 766804 - RNA, 22 nt, Human
uggcugagccacuuguucagau

SEQ ID NO: 766805 - RNA, 22 nt, Human
ucagcuauugaggguggugagu

SEQ ID NO: 766806 - RNA, 22 nt, Human
uuccagaguugggggagugguu

SEQ ID NO: 766807 - RNA, 22 nt, Human
cuggcucccucgcugaggugcu

SEQ ID NO: 766808 - RNA, 22 nt, Human
gccaggcuaagaaaggugugau

SEQ ID NO: 766809 - RNA, 22 nt, Human
caugugucuuuauggagccaca

SEQ ID NO: 766810 - RNA, 22 nt, Human
uguacagcugccuuuuuuacuu

SEQ ID NO: 766811 - RNA, 22 nt, Human
cucagugucuuauuguacacau

SEQ ID NO: 766812 - RNA, 22 nt, Human
agcagcucacaggauuccugaa

SEQ ID NO: 766813 - RNA, 22 nt, Human
ucccacagggcuucucuguaca

SEQ ID NO: 766814 - RNA, 22 nt, Human
agggucagagucaggugcagua

SEQ ID NO: 766815 - RNA, 22 nt, Human
uacuucauaccugcuagaaugg

SEQ ID NO: 766816 - RNA, 22 nt, Human
ucauuucccuccuacaaagagg

SEQ ID NO: 766817 - RNA, 22 nt, Human
ucccugggcaucacguugcuuc

SEQ ID NO: 766818 - RNA, 22 nt, Human
gcaaauauuucuaauuccugaa

SEQ ID NO: 766819 - RNA, 22 nt, Human
ucagagaguccuggucauuugc

SEQ ID NO: 766820 - RNA, 22 nt, Human
cagcuggaugggagaccauguu

SEQ ID NO: 766821 - RNA, 22 nt, Human
aucaagcacuucuacaugacau

SEQ ID NO: 766822 - RNA, 22 nt, Human
gcacugggaagaaugagccugu

SEQ ID NO: 766823 - RNA, 22 nt, Human
cuggagcuguuuuuucaggaaa

SEQ ID NO: 766824 - RNA, 22 nt, Human
aagagcagauuccuaguggagc

SEQ ID NO: 766825 - RNA, 22 nt, Human
cuucugagauguuguuuuacag

SEQ ID NO: 766826 - RNA, 22 nt, Human
aacuaacagucauuaaaagaac

SEQ ID NO: 766827 - RNA, 22 nt, Human
acagauguacacucauauauaa

SEQ ID NO: 766828 - RNA, 22 nt, Human
ucuuuccuguaacugcuguuca

SEQ ID NO: 766829 - RNA, 23 nt, Human
ggcugcucuuuucaugcuguuuc

SEQ ID NO: 766830 - RNA, 22 nt, Human
uaaauuaaagauuggagaagga

SEQ ID NO: 766831 - RNA, 22 nt, Human
ccucaggcuuacgggcaaugga

SEQ ID NO: 766832 - RNA, 22 nt, Human
uaugaaacauucauacaaauaa

SEQ ID NO: 766833 - RNA, 19 nt, Human
uccagggcaggaacaugua

SEQ ID NO: 766834 - RNA, 22 nt, Human
aagaauuggucacaugcuacaa

SEQ ID NO: 766835 - RNA, 22 nt, Human
agggcagcggugcuuguguuau

SEQ ID NO: 766836 - RNA, 19 nt, Human
aagagucacaggcagcccu

SEQ ID NO: 766837 - RNA, 22 nt, Human
ggacggggagcuggaaagggga

SEQ ID NO: 766838 - RNA, 17 nt, Human
uccuucagggccucaca

SEQ ID NO: 766839 - RNA, 21 nt, Human
aguuugaugcaauuucugaga

SEQ ID NO: 766840 - RNA, 22 nt, Human
uuauguacccacucauauuccc

SEQ ID NO: 766841 - RNA, 22 nt, Human
aaacccugcucuuauggaacuu

SEQ ID NO: 766842 - RNA, 22 nt, Human
cauguucaucagaucaauugua

SEQ ID NO: 766843 - RNA, 17 nt, Human
ugcccugugccuggugu

SEQ ID NO: 766844 - RNA, 22 nt, Human
ggagggcagaguccccugcuga

SEQ ID NO: 766845 - RNA, 22 nt, Human
aucauuagaccaaacuagagcu

SEQ ID NO: 766846 - RNA, 22 nt, Human
uuacuuuagggauguuuugcuu

SEQ ID NO: 766847 - RNA, 20 nt, Human
ucauacacaugagcaugcag

SEQ ID NO: 766848 - RNA, 21 nt, Human
aucauucuggaaaauucaagc

SEQ ID NO: 766849 - RNA, 22 nt, Human
gaguccaguguuuaccaggggu

SEQ ID NO: 766850 - RNA, 20 nt, Human
ucuuggaaaaaguucagaau

SEQ ID NO: 766851 - RNA, 22 nt, Human
agguucuggcauugcucaguaa

SEQ ID NO: 766852 - RNA, 22 nt, Human
gcucccagcauugcuucccagg

SEQ ID NO: 766853 - RNA, 22 nt, Human
uguaugcaaauuuauuagcaca

SEQ ID NO: 766854 - RNA, 22 nt, Human
accaggagguguuugcucaagu

SEQ ID NO: 766855 - RNA, 22 nt, Human
augcauaucuccuaucuccuca

SEQ ID NO: 766856 - RNA, 22 nt, Human
cacuggugccagagaacagaau

SEQ ID NO: 766857 - RNA, 22 nt, Human
gagagggccagggugagaacua

SEQ ID NO: 766858 - RNA, 22 nt, Human
ugaggccacaggaaagggcccg

SEQ ID NO: 766859 - RNA, 22 nt, Human
caguacuuggucaaggaagcag

SEQ ID NO: 766860 - RNA, 22 nt, Human
gggagggguugcauguuugagu

SEQ ID NO: 766861 - RNA, 19 nt, Human
ccucugugggagucaguga

SEQ ID NO: 766862 - RNA, 22 nt, Human
aagggcucccugccugaggugg

SEQ ID NO: 766863 - RNA, 18 nt, Human
acccugggcaauucacuc

SEQ ID NO: 766864 - RNA, 22 nt, Human
ggaggcucagacuccauccuca

SEQ ID NO: 766865 - RNA, 22 nt, Human
uggcccagcugcagauggugga

SEQ ID NO: 766866 - RNA, 22 nt, Human
ucagcuucgccugagguauggg

SEQ ID NO: 766867 - RNA, 22 nt, Human
gcugcagguugggcaacagagu

SEQ ID NO: 766868 - RNA, 22 nt, Human
gguggguauaguuagggccucu

SEQ ID NO: 766869 - RNA, 22 nt, Human
acacagugucagggcaggggcc

SEQ ID NO: 766870 - RNA, 22 nt, Human
uugaaaaguuuugaaacacucu

SEQ ID NO: 766871 - RNA, 21 nt, Human
agaaucauuuuucccuucucu

SEQ ID NO: 766872 - RNA, 22 nt, Human
ucagugucuucucuuuccuacc

SEQ ID NO: 766873 - RNA, 22 nt, Human
aauauuuuugaggcccuguuau

SEQ ID NO: 766874 - RNA, 22 nt, Human
uaagaggcagcauuccucgccu

SEQ ID NO: 766875 - RNA, 23 nt, Human
caguggagacucaugcuuccuua

SEQ ID NO: 766876 - RNA, 22 nt, Human
gagagugagauccuccugggga

SEQ ID NO: 766877 - RNA, 22 nt, Human
auggggcuagacaaccagugcc

SEQ ID NO: 766878 - RNA, 22 nt, Human
gggugggagaaaugaguaucua

SEQ ID NO: 766879 - RNA, 22 nt, Human
guggguggaucaccugagguca

SEQ ID NO: 766880 - RNA, 22 nt, Human
ucacagaacaagccugguggag

SEQ ID NO: 766881 - RNA, 22 nt, Human
gggccagugaacaaugagggaa

SEQ ID NO: 766882 - RNA, 22 nt, Human
accugucaacccaucaccuagg

SEQ ID NO: 766883 - RNA, 22 nt, Human
ugacagagacagauugaagcuu

SEQ ID NO: 766884 - RNA, 22 nt, Human
guuugcauauuugcacaggaau

SEQ ID NO: 766885 - RNA, 22 nt, Human
uagauuuguuuccuucucucca

SEQ ID NO: 766886 - RNA, 22 nt, Human
gacauucagccaauuacuuucu

SEQ ID NO: 766887 - RNA, 22 nt, Human
aacucuauuuacccuacuaaac

SEQ ID NO: 766888 - RNA, 22 nt, Human
aagaauguuaguuucugauaca

SEQ ID NO: 766889 - RNA, 22 nt, Human
cauguauaguuggaacuacauc

SEQ ID NO: 766890 - RNA, 22 nt, Human
gcugguuaggugagggugcgcc

SEQ ID NO: 766891 - RNA, 22 nt, Human
ccugggcagugcuggaguugaa

SEQ ID NO: 766892 - RNA, 22 nt, Human
guuaacauaggaguuuguugua

SEQ ID NO: 766893 - RNA, 22 nt, Human
ccuuucagaugggcauggaccg

SEQ ID NO: 766894 - RNA, 21 nt, Human
uuuaggaaguuuaaggcaggu

SEQ ID NO: 766895 - RNA, 22 nt, Human
gugcggaucgguguccuccaaa

SEQ ID NO: 766896 - RNA, 22 nt, Human
augcaugagcuuugugauccug

SEQ ID NO: 766897 - RNA, 22 nt, Human
acauuugugcaacguauccaca

SEQ ID NO: 766898 - RNA, 22 nt, Human
gaaaggaaauugagggacgcau

SEQ ID NO: 766899 - RNA, 22 nt, Human
cagcuuugucauuugauuuggg

SEQ ID NO: 766900 - RNA, 22 nt, Human
ugggaagaugaggugccauggg

SEQ ID NO: 766901 - RNA, 22 nt, Human
aaccaggacaauuugaauagaa

SEQ ID NO: 766902 - RNA, 22 nt, Human
gagucaacaagucagaucucac

SEQ ID NO: 766903 - RNA, 22 nt, Human
guguaaacaaugaaaacagagc

SEQ ID NO: 766904 - RNA, 22 nt, Human
auuucagguaccugugggaucc

SEQ ID NO: 766905 - RNA, 18 nt, Human
cucagagaugcccuuauu

SEQ ID NO: 766906 - RNA, 22 nt, Human
uggcaagaaacugaggccugcu

SEQ ID NO: 766907 - RNA, 22 nt, Human
cuuagaaauuguuacucauuca

SEQ ID NO: 766908 - RNA, 21 nt, Human
cagcagaguaaugcauucgua

SEQ ID NO: 766909 - RNA, 22 nt, Human
cagaaagugauuugcuauucca

SEQ ID NO: 766910 - RNA, 22 nt, Human
uaaagucaagguacuguuucac

SEQ ID NO: 766911 - RNA, 22 nt, Human
gcucuaacuauuaagaggucau

SEQ ID NO: 766912 - RNA, 23 nt, Human
ugauuuccagugagucaguggga

SEQ ID NO: 766913 - RNA, 22 nt, Human
aucucaaagcauggagcagaau

SEQ ID NO: 766914 - RNA, 19 nt, Human
aggcuuggaacagccuuau

SEQ ID NO: 766915 - RNA, 22 nt, Human
uugcuuuugggaaaacaugccu

SEQ ID NO: 766916 - RNA, 22 nt, Human
cucugggguggaggaggcugac

SEQ ID NO: 766917 - RNA, 22 nt, Human
uguauguaaaguuuguaauaga

SEQ ID NO: 766918 - RNA, 22 nt, Human
uggaaagaaaaacaggccauga

SEQ ID NO: 766919 - RNA, 22 nt, Human
ugagcaaaaguugauggugcuu

SEQ ID NO: 766920 - RNA, 21 nt, Human
uauugauucaauuucuugagu

SEQ ID NO: 766921 - RNA, 22 nt, Human
acauacuaugaauacauguguc

SEQ ID NO: 766922 - RNA, 22 nt, Human
auuucagaguagaucguuauuu

SEQ ID NO: 766923 - RNA, 22 nt, Human
agcauuuaccucaaugcaucug

SEQ ID NO: 766924 - RNA, 22 nt, Human
cugcagcaagagaagugcugac

SEQ ID NO: 766925 - RNA, 22 nt, Human
gagguucugggggucugccugg

SEQ ID NO: 766926 - RNA, 22 nt, Human
cacugugggccugucgugggug

SEQ ID NO: 766927 - RNA, 18 nt, Human
uggcagcaggaagccauu

SEQ ID NO: 766928 - RNA, 22 nt, Human
aagcagcaugcuaugcuggugg

SEQ ID NO: 766929 - RNA, 22 nt, Human
acuucuaaucagaaggucuggu

SEQ ID NO: 766930 - RNA, 22 nt, Human
ucaccaggauugggcuguaggc

SEQ ID NO: 766931 - RNA, 22 nt, Human
uucagaguaggauacuagcuua

SEQ ID NO: 766932 - RNA, 22 nt, Human
uuaguuuauaauucauuucugu

SEQ ID NO: 766933 - RNA, 22 nt, Human
ggcagcagaccccuaagucuac

SEQ ID NO: 766934 - RNA, 22 nt, Human
gccucccuguuuccugcuccaa

SEQ ID NO: 766935 - RNA, 22 nt, Human
uugcagggcaucgcguacuucu

SEQ ID NO: 766936 - RNA, 22 nt, Human
ugcuugucucagauaaaacuau

SEQ ID NO: 766937 - RNA, 22 nt, Human
cccagccucuguuugcuccucu

SEQ ID NO: 766938 - RNA, 22 nt, Human
aauuucagaacccaaauuagcg

SEQ ID NO: 766939 - RNA, 22 nt, Human
agcuuuguggcuuugcaagacu

SEQ ID NO: 766940 - RNA, 22 nt, Human
agaggaauaaauuucuguagug

SEQ ID NO: 766941 - RNA, 22 nt, Human
uucuggggccccaguguccucg

SEQ ID NO: 766942 - RNA, 22 nt, Human
ucaggaucaggggccuuuccuu

SEQ ID NO: 766943 - RNA, 22 nt, Human
gggcagcccagaacugcugcag

SEQ ID NO: 766944 - RNA, 22 nt, Human
ucugcugucuaugcaaguccuu

SEQ ID NO: 766945 - RNA, 22 nt, Human
gcccagcccugaggucacagcu

SEQ ID NO: 766946 - RNA, 22 nt, Human
aguguuugagacacauuucacu

SEQ ID NO: 766947 - RNA, 22 nt, Human
gcuggcagacugggggcagaac

SEQ ID NO: 766948 - RNA, 22 nt, Human
gugaggugaguagugagaagcc

SEQ ID NO: 766949 - RNA, 22 nt, Human
agcauucaaugauuggacuugc

SEQ ID NO: 766950 - RNA, 22 nt, Human
ccagaauccaaaacguuuugag

SEQ ID NO: 766951 - RNA, 22 nt, Human
uggaagcagugauucuugucug

SEQ ID NO: 766952 - RNA, 22 nt, Human
ucagagcuuuggagaccaggaa

SEQ ID NO: 766953 - RNA, 22 nt, Human
gaugggggccagggccugcuuu

SEQ ID NO: 766954 - RNA, 22 nt, Human
agguguguauaaacauacauau

SEQ ID NO: 766955 - RNA, 22 nt, Human
uggcucagauuuuuguaggcuu

SEQ ID NO: 766956 - RNA, 22 nt, Human
gagcuggcuaauacugacuuau

SEQ ID NO: 766957 - RNA, 22 nt, Human
caugcucugcagcagaccugug

SEQ ID NO: 766958 - RNA, 22 nt, Human
gcaguaugaguguuuuagacau

SEQ ID NO: 766959 - RNA, 22 nt, Human
guuagacaugcagaaucucagg

SEQ ID NO: 766960 - RNA, 22 nt, Human
gcacaggccaugggaggacagc

SEQ ID NO: 766961 - RNA, 22 nt, Human
ugcagccuagacauucugguca

SEQ ID NO: 766962 - RNA, 22 nt, Human
uauguucugucuguacagauuu

SEQ ID NO: 766963 - RNA, 22 nt, Human
cucuucauuaguuccuguccca

SEQ ID NO: 766964 - RNA, 22 nt, Human
cugggcugagcuguggaaacuc

SEQ ID NO: 766965 - RNA, 22 nt, Human
cuucccauauaacuaauuucug

SEQ ID NO: 766966 - RNA, 21 nt, Human
aggugccaaggagaagcaggc

SEQ ID NO: 766967 - RNA, 22 nt, Human
cuucuaugaggagagacaugca

SEQ ID NO: 766968 - RNA, 22 nt, Human
cucagugucacguuuugccuua

SEQ ID NO: 766969 - RNA, 22 nt, Human
ggugcagaagaaagcagucauu

SEQ ID NO: 766970 - RNA, 20 nt, Human
ugagccaggcuaggaagggc

SEQ ID NO: 766971 - RNA, 22 nt, Human
acaagguauccacauuaaaugu

SEQ ID NO: 766972 - RNA, 22 nt, Human
gccugagauucugcauuucuaa

SEQ ID NO: 766973 - RNA, 22 nt, Human
aauuuaacugagaguacuuuua

SEQ ID NO: 766974 - RNA, 22 nt, Human
uccucuucagagggaccucggg

SEQ ID NO: 766975 - RNA, 22 nt, Human
gcuuuacugagaugacacaggg

SEQ ID NO: 766976 - RNA, 22 nt, Human
auuccacagcuacguuuugagc

SEQ ID NO: 766977 - RNA, 22 nt, Human
gcagaaaccacagugucuuuua

SEQ ID NO: 766978 - RNA, 22 nt, Human
cagcugggagcuccauuagaua

SEQ ID NO: 766979 - RNA, 22 nt, Human
auuuauuaccucggaguuucug

SEQ ID NO: 766980 - RNA, 22 nt, Human
gggcaggugccagcucccuguc

SEQ ID NO: 766981 - RNA, 22 nt, Human
ucucagaaaaacuuugagggua

SEQ ID NO: 766982 - RNA, 22 nt, Human
aaggagcuaugcauaacugauc

SEQ ID NO: 766983 - RNA, 22 nt, Human
ugugguggcuauucuggucuca

SEQ ID NO: 766984 - RNA, 22 nt, Human
cgugaaaugaguugaauuauug

SEQ ID NO: 766985 - RNA, 22 nt, Human
cuccucagaagaggguaacaca

SEQ ID NO: 766986 - RNA, 22 nt, Human
uggagagccuggagucccugau

SEQ ID NO: 766987 - RNA, 22 nt, Human
uuuaguuauuguuacaguauga

SEQ ID NO: 766988 - RNA, 22 nt, Human
cuguuggagucauuccuuccag

SEQ ID NO: 766989 - RNA, 19 nt, Human
aaggggugagggaagcaga

SEQ ID NO: 766990 - RNA, 22 nt, Human
aaacaauguuccuauauuagag

SEQ ID NO: 766991 - RNA, 22 nt, Human
aaacauucacauuugcuaguaa

SEQ ID NO: 766992 - RNA, 22 nt, Human
cauuuacagugagaguuuuuac

SEQ ID NO: 766993 - RNA, 23 nt, Human
cuguggcccugcuucaugcagcc

SEQ ID NO: 766994 - RNA, 22 nt, Human
uuaagauuuguagagaaaaagc

SEQ ID NO: 766995 - RNA, 22 nt, Human
cccaagggagugccuggucaac

SEQ ID NO: 766996 - RNA, 22 nt, Human
ggucccugguucccucugagcu

SEQ ID NO: 766997 - RNA, 22 nt, Human
cuccucucuggaguuaugcaga

SEQ ID NO: 766998 - RNA, 22 nt, Human
augcugaauugaugcgagggag

SEQ ID NO: 766999 - RNA, 22 nt, Human
gcucagagaaagauuagucccu

SEQ ID NO: 767000 - RNA, 22 nt, Human
uugaaagaacaauucugugaug

SEQ ID NO: 767001 - RNA, 22 nt, Human
aagucacagcuaaauagcuaag

SEQ ID NO: 767002 - RNA, 22 nt, Human
acaaaugagaauguagacagag

SEQ ID NO: 767003 - RNA, 22 nt, Human
guggcaguguggagggaggagu

SEQ ID NO: 767004 - RNA, 22 nt, Human
agugugagaugauugaggagca

SEQ ID NO: 767005 - RNA, 22 nt, Human
cagcuucuucaguccuggagcu

SEQ ID NO: 767006 - RNA, 22 nt, Human
ggcagcaacgaggcuugauacc

SEQ ID NO: 767007 - RNA, 22 nt, Human
cacaugggcuuagcaggcaggg

SEQ ID NO: 767008 - RNA, 22 nt, Human
aaggcaguuaauuuggcuagaa

SEQ ID NO: 767009 - RNA, 22 nt, Human
ccucugagaccagcucugcacc

SEQ ID NO: 767010 - RNA, 22 nt, Human
ggucuggauuuugaacaaaauu

SEQ ID NO: 767011 - RNA, 22 nt, Human
uagaucauauacuugccaugac

SEQ ID NO: 767012 - RNA, 22 nt, Human
cucccaagggguaagggagcug

SEQ ID NO: 767013 - RNA, 22 nt, Human
ccuucacacagguagaagcaga

SEQ ID NO: 767014 - RNA, 19 nt, Human
ucucuacacuacauuucua

SEQ ID NO: 767015 - RNA, 22 nt, Human
cuaugagaagaaaacaagauua

SEQ ID NO: 767016 - RNA, 22 nt, Human
uucagacacagcgcugggaaau

SEQ ID NO: 767017 - RNA, 22 nt, Human
auuugaagaaaguuuucuagau

SEQ ID NO: 767018 - RNA, 22 nt, Human
uucagagaugacaccugguguu

SEQ ID NO: 767019 - RNA, 22 nt, Human
acagcaaucugagagacauagu

SEQ ID NO: 767020 - RNA, 22 nt, Human
gcucagcugagcgaaggacaug

SEQ ID NO: 767021 - RNA, 22 nt, Human
uuucuaagaugugguuucaagg

SEQ ID NO: 767022 - RNA, 22 nt, Human
ugcagcagaauauggcugcagg

SEQ ID NO: 767023 - RNA, 22 nt, Human
uagggugguuagaaggaguaug

SEQ ID NO: 767024 - RNA, 22 nt, Human
cugcucuaacugcauuaguuuu

SEQ ID NO: 767025 - RNA, 22 nt, Human
uacaacaauuuccacauuagaa

SEQ ID NO: 767026 - RNA, 16 nt, Human
aggcucagaggcugga

SEQ ID NO: 767027 - RNA, 22 nt, Human
cuguagcaguguuccagcauug

SEQ ID NO: 767028 - RNA, 22 nt, Human
ugcagggaugcuagagguaaga

SEQ ID NO: 767029 - RNA, 22 nt, Human
ggaucauuaacacauccaucac

SEQ ID NO: 767030 - RNA, 22 nt, Human
ugccagggugucaggagagcua

SEQ ID NO: 767031 - RNA, 22 nt, Human
ucccagggacucucugccuucc

SEQ ID NO: 767032 - RNA, 22 nt, Human
gugcaaaaguaauugagguuuu

SEQ ID NO: 767033 - RNA, 22 nt, Human
auuacaacuggaauggugcugg

SEQ ID NO: 767034 - RNA, 22 nt, Human
gagugggcuuggggagaguuug

SEQ ID NO: 767035 - RNA, 19 nt, Human
cacuucaauccuuuaucaa

SEQ ID NO: 767036 - RNA, 22 nt, Human
ucugcaagcgucacaugauucu

SEQ ID NO: 767037 - RNA, 21 nt, Human
caaagccaggcaacucucucc

SEQ ID NO: 767038 - RNA, 22 nt, Human
ucuucaugaaauugauugcuua

SEQ ID NO: 767039 - RNA, 18 nt, Human
ccuaggaaagggaggcaa

SEQ ID NO: 767040 - RNA, 19 nt, Human
uuaacagucaccaaggaga

SEQ ID NO: 767041 - RNA, 22 nt, Human
aaaagagaguugccagucugua

SEQ ID NO: 767042 - RNA, 22 nt, Human
gagaaagcuucagaaauggccu

SEQ ID NO: 767043 - RNA, 22 nt, Human
caugaaggaauaauuguuuaga

SEQ ID NO: 767044 - RNA, 22 nt, Human
cacaguguuccagagcaguggu

SEQ ID NO: 767045 - RNA, 22 nt, Human
aacacuuucuuccuugcucagg

SEQ ID NO: 767046 - RNA, 22 nt, Human
cugugcugucuugggagccuua

SEQ ID NO: 767047 - RNA, 22 nt, Human
auuuccaguccuaaugaucugg

SEQ ID NO: 767048 - RNA, 22 nt, Human
aaacagagggccacugaggcuc

SEQ ID NO: 767049 - RNA, 22 nt, Human
uaaggcauaaggccagaggcua

SEQ ID NO: 767050 - RNA, 22 nt, Human
ucugaggccuucagcaugaauc

SEQ ID NO: 767051 - RNA, 22 nt, Human
auagacauggucuuuugucauu

SEQ ID NO: 767052 - RNA, 22 nt, Human
ucugugugugccuguuaauauu

SEQ ID NO: 767053 - RNA, 22 nt, Human
guucauauuacuuugagugcag

SEQ ID NO: 767054 - RNA, 22 nt, Human
cacacaugucucuccaugcucu

SEQ ID NO: 767055 - RNA, 22 nt, Human
gcauacaaagguuuacaacuga

SEQ ID NO: 767056 - RNA, 22 nt, Human
aauguuauuguccuuuccaaaa

SEQ ID NO: 767057 - RNA, 22 nt, Human
gcugccuugaacuuggccuggg

SEQ ID NO: 767058 - RNA, 22 nt, Human
uucacagucacccuucuccaug

SEQ ID NO: 767059 - RNA, 22 nt, Human
aaaugcagauucaugagcccca

SEQ ID NO: 767060 - RNA, 22 nt, Human
ucugauucauucaugugcacca

SEQ ID NO: 767061 - RNA, 22 nt, Human
gggcuccaggcaggcaggaaau

SEQ ID NO: 767062 - RNA, 22 nt, Human
uuuccacacucacugcacucau

SEQ ID NO: 767063 - RNA, 22 nt, Human
aaaugaacaguugcauucucug

SEQ ID NO: 767064 - RNA, 22 nt, Human
aggcuaauauuuaugaaaccaa

SEQ ID NO: 767065 - RNA, 20 nt, Human
ugauucuggucuacgcuuua

SEQ ID NO: 767066 - RNA, 22 nt, Human
aaggcccuagaaucuauauugc

SEQ ID NO: 767067 - RNA, 22 nt, Human
cugggcagugguggcaucuuug

SEQ ID NO: 767068 - RNA, 22 nt, Human
aaagagucuggcguuuuaaugg

SEQ ID NO: 767069 - RNA, 21 nt, Human
agugucugagcgcugcuucug

SEQ ID NO: 767070 - RNA, 22 nt, Human
agcauccuccuucccagagaug

SEQ ID NO: 767071 - RNA, 22 nt, Human
aaugugacugaauauuuacucu

SEQ ID NO: 767072 - RNA, 22 nt, Human
gccagagagagucccugggccu

SEQ ID NO: 767073 - RNA, 22 nt, Human
uuauauaucuugauuuguucca

SEQ ID NO: 767074 - RNA, 22 nt, Human
agcaacagggggauggccacug

SEQ ID NO: 767075 - RNA, 22 nt, Human
guaauugaguuaccuggaccag

SEQ ID NO: 767076 - RNA, 19 nt, Human
agcaacaccguuuauuucc

SEQ ID NO: 767077 - RNA, 22 nt, Human
cccacacaaaucauggggagaa

SEQ ID NO: 767078 - RNA, 19 nt, Human
uuucugucuguguuuugcc

SEQ ID NO: 767079 - RNA, 22 nt, Human
agcucccauuaucuucugaaac

SEQ ID NO: 767080 - RNA, 22 nt, Human
acaggggcaagggcucacggcc

SEQ ID NO: 767081 - RNA, 22 nt, Human
agcugugugugaauuuggccua

SEQ ID NO: 767082 - RNA, 21 nt, Human
uggugccuucagcugucuuuu

SEQ ID NO: 767083 - RNA, 22 nt, Human
uggucucuucuuccaagauggc

SEQ ID NO: 767084 - RNA, 19 nt, Human
aaaugugcacuguuuucca

SEQ ID NO: 767085 - RNA, 22 nt, Human
gaacacagugugaucguauguc

SEQ ID NO: 767086 - RNA, 22 nt, Human
agcuguggaagacugucagggu

SEQ ID NO: 767087 - RNA, 22 nt, Human
ucugaggaguugggccagugcu

SEQ ID NO: 767088 - RNA, 22 nt, Human
ucuucaugucuugccugauaua

SEQ ID NO: 767089 - RNA, 22 nt, Human
acaugaucccaccugccuauaa

SEQ ID NO: 767090 - RNA, 22 nt, Human
uggucuguucaagguggcugau

SEQ ID NO: 767091 - RNA, 21 nt, Human
aagcaggacauaugaugcccu

SEQ ID NO: 767092 - RNA, 22 nt, Human
aagaaucaucugaacuuugagg

SEQ ID NO: 767093 - RNA, 22 nt, Human
cagggcuuugaacaggcaucaa

SEQ ID NO: 767094 - RNA, 22 nt, Human
ccugccugacagagaagguuca

SEQ ID NO: 767095 - RNA, 22 nt, Human
cuuuucauuguuuguacaugca

SEQ ID NO: 767096 - RNA, 22 nt, Human
cagaugaauaaaugaugaggua

SEQ ID NO: 767097 - RNA, 22 nt, Human
aggcccugcaggaguggggaca

SEQ ID NO: 767098 - RNA, 22 nt, Human
cccaggagauaacguucccaag

SEQ ID NO: 767099 - RNA, 18 nt, Human
uccucucuuuccccaggg

SEQ ID NO: 767100 - RNA, 22 nt, Human
auaaaaaggacagauguggucu

SEQ ID NO: 767101 - RNA, 22 nt, Human
ccagaggugcugggagaggucu

SEQ ID NO: 767102 - RNA, 22 nt, Human
aaacaguguguuucagagaggc

SEQ ID NO: 767103 - RNA, 22 nt, Human
uguauuugaguuaugaaagaga

SEQ ID NO: 767104 - RNA, 22 nt, Human
aagcagaauagaggcccuuccc

SEQ ID NO: 767105 - RNA, 22 nt, Human
aggcuugacugcugauuuugcc

SEQ ID NO: 767106 - RNA, 22 nt, Human
gugcgccagcucaaggggaggc

SEQ ID NO: 767107 - RNA, 22 nt, Human
gaaaaugccucuggcauuaaac

SEQ ID NO: 767108 - RNA, 22 nt, Human
gcugcucugcuguguaagcagg

SEQ ID NO: 767109 - RNA, 18 nt, Human
gagagcccagcagguggu

SEQ ID NO: 767110 - RNA, 22 nt, Human
gaaguucucagcuaggugaugu

SEQ ID NO: 767111 - RNA, 19 nt, Human
ccagugccggcgcugggga

SEQ ID NO: 767112 - RNA, 22 nt, Human
cugggacagcugagacaggaga

SEQ ID NO: 767113 - RNA, 22 nt, Human
ccucugcagcagagagccagag

SEQ ID NO: 767114 - RNA, 22 nt, Human
ugaccuuucucugggugcuugg

SEQ ID NO: 767115 - RNA, 22 nt, Human
aagaauguggcauuuauuuaua

SEQ ID NO: 767116 - RNA, 22 nt, Human
cuucacuuuaagccaaucauga

SEQ ID NO: 767117 - RNA, 22 nt, Human
ccaggaucuguacaccucugag

SEQ ID NO: 767118 - RNA, 22 nt, Human
cucuucuuuccaucccuagcca

SEQ ID NO: 767119 - RNA, 22 nt, Human
uucauucagcacauauuuauug

SEQ ID NO: 767120 - RNA, 22 nt, Human
gugucugcaagauagccaaguc

SEQ ID NO: 767121 - RNA, 22 nt, Human
cagcuauauuguuuucuacugu

SEQ ID NO: 767122 - RNA, 20 nt, Human
uucuuuacgaccuuucugca

SEQ ID NO: 767123 - RNA, 22 nt, Human
uagacuuuucaaaaucuagacc

SEQ ID NO: 767124 - RNA, 22 nt, Human
uuuccagguauuaauacuguau

SEQ ID NO: 767125 - RNA, 22 nt, Human
acucccuugguggagaaugcaa

SEQ ID NO: 767126 - RNA, 22 nt, Human
caauuucuuguuaauucucagg

SEQ ID NO: 767127 - RNA, 22 nt, Human
guccucugggcagcugccccac

SEQ ID NO: 767128 - RNA, 22 nt, Human
auaugaagucagacaaacuggg

SEQ ID NO: 767129 - RNA, 21 nt, Human
auuucauggugcuuuuaagaa

SEQ ID NO: 767130 - RNA, 22 nt, Human
aauguuacacagguauaaucag

SEQ ID NO: 767131 - RNA, 22 nt, Human
gccagcugccaaguugugagau

SEQ ID NO: 767132 - RNA, 22 nt, Human
caccagggcucugagcucugaa

SEQ ID NO: 767133 - RNA, 22 nt, Human
aguggcagagccaggguuggga

SEQ ID NO: 767134 - RNA, 22 nt, Human
cuuaaacugggcauucagagaa

SEQ ID NO: 767135 - RNA, 22 nt, Human
aaucacaauuacuuuugcacca

SEQ ID NO: 767136 - RNA, 22 nt, Human
agagguagaaaauaauggagag

SEQ ID NO: 767137 - RNA, 21 nt, Human
uucccuucugguuuugagaga

SEQ ID NO: 767138 - RNA, 22 nt, Human
gucugggcaccuggccugggaa

SEQ ID NO: 767139 - RNA, 19 nt, Human
uggcauguuuggcuaagga

SEQ ID NO: 767140 - RNA, 22 nt, Human
ggucagagccauggagcaacug

SEQ ID NO: 767141 - RNA, 22 nt, Human
ucacagaagcccucgcaaacua

SEQ ID NO: 767142 - RNA, 22 nt, Human
aggggugauuugggacaggaca

SEQ ID NO: 767143 - RNA, 22 nt, Human
aaaaguuugugcaaacacucag

SEQ ID NO: 767144 - RNA, 22 nt, Human
augugaaagagguguucagugg

SEQ ID NO: 767145 - RNA, 22 nt, Human
aaacagcuaauggccaggaaua

SEQ ID NO: 767146 - RNA, 22 nt, Human
cagaguggcagucccaggccca

SEQ ID NO: 767147 - RNA, 22 nt, Human
aggcuucagaggaagugcggcc

SEQ ID NO: 767148 - RNA, 22 nt, Human
uacuuucuguccuucuguuaaa

SEQ ID NO: 767149 - RNA, 22 nt, Human
agacacauaggaccacacugug

SEQ ID NO: 767150 - RNA, 22 nt, Human
ugcucaucaacaugaugaucau

SEQ ID NO: 767151 - RNA, 22 nt, Human
cugggaaauauaauaaaguggu

SEQ ID NO: 767152 - RNA, 23 nt, Human
agaaggguccuuggcagcgacag

SEQ ID NO: 767153 - RNA, 22 nt, Human
agcaguggagcgagauguuuaa

SEQ ID NO: 767154 - RNA, 22 nt, Human
uacacagauuucaguaucauca

SEQ ID NO: 767155 - RNA, 22 nt, Human
acaguggaagcaugaugcuauc

SEQ ID NO: 767156 - RNA, 22 nt, Human
augcuauacucaaagaaauuca

SEQ ID NO: 767157 - RNA, 22 nt, Human
uacagagaugccgaagagugaa

SEQ ID NO: 767158 - RNA, 22 nt, Human
aggauaaaggucauuauuccca

SEQ ID NO: 767159 - RNA, 23 nt, Human
agggugagcaagcuauggagacc

SEQ ID NO: 767160 - RNA, 22 nt, Human
uuuauuccaguguuucucaaau

SEQ ID NO: 767161 - RNA, 22 nt, Human
uuuauuagugcuuguaucacug

SEQ ID NO: 767162 - RNA, 22 nt, Human
acagcagguuuuaacuuugaag

SEQ ID NO: 767163 - RNA, 22 nt, Human
gauucugcgaugaggacgagcu

SEQ ID NO: 767164 - RNA, 22 nt, Human
agcagcugcagagggcuccccc

SEQ ID NO: 767165 - RNA, 22 nt, Human
caauuucucuuuauaucucaca

SEQ ID NO: 767166 - RNA, 22 nt, Human
acgcuucugguucuggcuuuag

SEQ ID NO: 767167 - RNA, 22 nt, Human
ugaccuauuagauuuccuugcc

SEQ ID NO: 767168 - RNA, 22 nt, Human
gaacaucuuauccauuuccucu

SEQ ID NO: 767169 - RNA, 22 nt, Human
uucagcucagucugugcagcag

SEQ ID NO: 767170 - RNA, 22 nt, Human
ugaagaaaggugugggauacuc

SEQ ID NO: 767171 - RNA, 19 nt, Human
ucucugcagcgcgcccggc

SEQ ID NO: 767172 - RNA, 22 nt, Human
ucaguuuccugguugugauauu

SEQ ID NO: 767173 - RNA, 22 nt, Human
aaggcuggaguacagugcagug

SEQ ID NO: 767174 - RNA, 22 nt, Human
aaacagcuuucagaaucucuca

SEQ ID NO: 767175 - RNA, 22 nt, Human
uuaaugacaucauaggugaagu

SEQ ID NO: 767176 - RNA, 22 nt, Human
aagauacacggucaacucucaa

SEQ ID NO: 767177 - RNA, 22 nt, Human
caucacaguuugucagaaauca

SEQ ID NO: 767178 - RNA, 16 nt, Human
ggcagcagcuccgugc

SEQ ID NO: 767179 - RNA, 22 nt, Human
gagcuuuaccuuagguucuguu

SEQ ID NO: 767180 - RNA, 22 nt, Human
augcacuguuggauauauuugu

SEQ ID NO: 767181 - RNA, 22 nt, Human
agcuuuggcuguguugcucugu

SEQ ID NO: 767182 - RNA, 22 nt, Human
gcgagccucuggaguccucugg

SEQ ID NO: 767183 - RNA, 22 nt, Human
ugccaggguccugagggccuug

SEQ ID NO: 767184 - RNA, 22 nt, Human
cguuugaaagccuuuguacacu

SEQ ID NO: 767185 - RNA, 22 nt, Human
uaaggcacuucaauguuuagaa

SEQ ID NO: 767186 - RNA, 22 nt, Human
gggaccaggugggugcauuccg

SEQ ID NO: 767187 - RNA, 22 nt, Human
cagggccuguacaagucccacc

SEQ ID NO: 767188 - RNA, 22 nt, Human
acauuucuuccuaauuaucccu

SEQ ID NO: 767189 - RNA, 22 nt, Human
aggaaaugccgcggcucucuuu

SEQ ID NO: 767190 - RNA, 22 nt, Human
cagacaugauguaagcagaggc

SEQ ID NO: 767191 - RNA, 22 nt, Human
ucuuuagccaguaucauaauga

SEQ ID NO: 767192 - RNA, 22 nt, Human
uuucaacagcucucaaaugauc

SEQ ID NO: 767193 - RNA, 22 nt, Human
gcucugugaaggguguugcuca

SEQ ID NO: 767194 - RNA, 22 nt, Human
gauccugggcccuucuggguca

SEQ ID NO: 767195 - RNA, 21 nt, Human
ugcccaccaagcuccacacug

SEQ ID NO: 767196 - RNA, 22 nt, Human
ccacaggacggaggucuggccg

SEQ ID NO: 767197 - RNA, 22 nt, Human
auaaggcacacauagauagggu

SEQ ID NO: 767198 - RNA, 22 nt, Human
guuccugacuguggaguuuggu

SEQ ID NO: 767199 - RNA, 22 nt, Human
ucaguucuaacaguuuagaaca

SEQ ID NO: 767200 - RNA, 22 nt, Human
ggcugaaacagauuucaagaca

SEQ ID NO: 767201 - RNA, 22 nt, Human
aauuuucacagugcugugagau

SEQ ID NO: 767202 - RNA, 22 nt, Human
gggaaagaagaucuagauacug

SEQ ID NO: 767203 - RNA, 22 nt, Human
gucagaagcauuuguggcugaa

SEQ ID NO: 767204 - RNA, 22 nt, Human
ggcugccuucccugagccccgg

SEQ ID NO: 767205 - RNA, 19 nt, Human
gaaggggaagguggguacc

SEQ ID NO: 767206 - RNA, 22 nt, Human
uuuucccaucuacaaagcaggg

SEQ ID NO: 767207 - RNA, 22 nt, Human
ccaugccuuccuuucccuggaa

SEQ ID NO: 767208 - RNA, 22 nt, Human
auucucuguagauggcuugaga

SEQ ID NO: 767209 - RNA, 22 nt, Human
aauuuuaugccuugcacguugg

SEQ ID NO: 767210 - RNA, 22 nt, Human
ugcugucagacagcagugguaa

SEQ ID NO: 767211 - RNA, 23 nt, Human
gcaggugguucgaacagaaguuu

SEQ ID NO: 767212 - RNA, 22 nt, Human
uaucuaagagagucaauauuua

SEQ ID NO: 767213 - RNA, 22 nt, Human
aauguaaaguugggcacaaaug

SEQ ID NO: 767214 - RNA, 22 nt, Human
aacaggaaugaggagaaaaggu

SEQ ID NO: 767215 - RNA, 22 nt, Human
uagugucuagugaguuugaugc

SEQ ID NO: 767216 - RNA, 22 nt, Human
uuagacauuaaaugccauuuaa

SEQ ID NO: 767217 - RNA, 22 nt, Human
gugcgugaggccccugagcgaa

SEQ ID NO: 767218 - RNA, 22 nt, Human
agguggagugugcagggagagc

SEQ ID NO: 767219 - RNA, 21 nt, Human
uuugcauuuuacaugugggga

SEQ ID NO: 767220 - RNA, 22 nt, Human
uccugcagagccgcccucaggu

SEQ ID NO: 767221 - RNA, 22 nt, Human
aaccagcucugcaaaaugucau

SEQ ID NO: 767222 - RNA, 22 nt, Human
gaggcucagggaguauaugaau

SEQ ID NO: 767223 - RNA, 22 nt, Human
agacccugaaguuuucuaugau

SEQ ID NO: 767224 - RNA, 22 nt, Human
caguuuccuuguuuaccuacug

SEQ ID NO: 767225 - RNA, 22 nt, Human
caugaaaaugucaaguucugcu

SEQ ID NO: 767226 - RNA, 22 nt, Human
cuggagcuggcuuccuuccacu

SEQ ID NO: 767227 - RNA, 22 nt, Human
gugaaguuuuaguauauguaga

SEQ ID NO: 767228 - RNA, 18 nt, Human
auuucucuggggugauuc

SEQ ID NO: 767229 - RNA, 22 nt, Human
caauuucaauacaaaauacauu

SEQ ID NO: 767230 - RNA, 22 nt, Human
uaccuggaaaaguuauaugugu

SEQ ID NO: 767231 - RNA, 22 nt, Human
acaaugaagauaauguugcagu

SEQ ID NO: 767232 - RNA, 22 nt, Human
ugacaaagugaggucuucagua

SEQ ID NO: 767233 - RNA, 22 nt, Human
auauuucuccaaauguuuucaa

SEQ ID NO: 767234 - RNA, 22 nt, Human
augggggaaaguacgagcaugg

SEQ ID NO: 767235 - RNA, 22 nt, Human
guccugugaccugcauccugag

SEQ ID NO: 767236 - RNA, 22 nt, Human
ugcucccacacuacucggaggc

SEQ ID NO: 767237 - RNA, 22 nt, Human
uggcuucagucucaucuuggaa

SEQ ID NO: 767238 - RNA, 22 nt, Human
agggcucuguccccagaggccc

SEQ ID NO: 767239 - RNA, 22 nt, Human
uccugaagaaggcagauauuug

SEQ ID NO: 767240 - RNA, 22 nt, Human
ucaguccuccucucauagagag

SEQ ID NO: 767241 - RNA, 22 nt, Human
acagaguauuggaaaggcagug

SEQ ID NO: 767242 - RNA, 22 nt, Human
aaaguccugacugcaggggaug

SEQ ID NO: 767243 - RNA, 22 nt, Human
gccauccucugagcacuaggca

SEQ ID NO: 767244 - RNA, 22 nt, Human
augagcaagagcuauguacaga

SEQ ID NO: 767245 - RNA, 22 nt, Human
caagcuccuuacauccacaggg

SEQ ID NO: 767246 - RNA, 20 nt, Human
ccccacacuauugagcacuu

SEQ ID NO: 767247 - RNA, 22 nt, Human
uucuagcuuuuugcaccaaggu

SEQ ID NO: 767248 - RNA, 22 nt, Human
caguacuugggaaugcugggga

SEQ ID NO: 767249 - RNA, 18 nt, Human
acaggcuauugcaggaga

SEQ ID NO: 767250 - RNA, 23 nt, Human
ucacacuggauacacaugcaaga

SEQ ID NO: 767251 - RNA, 22 nt, Human
uaaagauaagacaucaacugag

SEQ ID NO: 767252 - RNA, 22 nt, Human
ucuuucaaaugcuugaauugga

SEQ ID NO: 767253 - RNA, 22 nt, Human
ucagggcacguuucugcaaugc

SEQ ID NO: 767254 - RNA, 22 nt, Human
uccauagugaauggguaaugca

SEQ ID NO: 767255 - RNA, 22 nt, Human
cugggucuuuuucuuccauuga

SEQ ID NO: 767256 - RNA, 22 nt, Human
ucaguuuaagaugacuaacaau

SEQ ID NO: 767257 - RNA, 22 nt, Human
uugagagugccaagcauccucc

SEQ ID NO: 767258 - RNA, 22 nt, Human
auugcugguagucagugucccu

SEQ ID NO: 767259 - RNA, 22 nt, Human
cucagcucuuuauacuagcugu

SEQ ID NO: 767260 - RNA, 22 nt, Human
cuuguggcagguggauggugcc

SEQ ID NO: 767261 - RNA, 21 nt, Human
ugggggugaggccuaggaauc

SEQ ID NO: 767262 - RNA, 22 nt, Human
gcaggagcuuugcuuacugcug

SEQ ID NO: 767263 - RNA, 22 nt, Human
aauauuucuccuucguuauagc

SEQ ID NO: 767264 - RNA, 22 nt, Human
caggaguggugugagggacucc

SEQ ID NO: 767265 - RNA, 22 nt, Human
ucugaggcccugcaggcagugu

SEQ ID NO: 767266 - RNA, 22 nt, Human
ucagaauuagagcucuucuuga

SEQ ID NO: 767267 - RNA, 22 nt, Human
ggcucaggcuggagugcagugg

SEQ ID NO: 767268 - RNA, 22 nt, Human
uguauuucgcuagguacucccu

SEQ ID NO: 767269 - RNA, 22 nt, Human
gacagacacagggccaugauug

SEQ ID NO: 767270 - RNA, 22 nt, Human
gaguuuagauggcauuaaggua

SEQ ID NO: 767271 - RNA, 22 nt, Human
acaguacugaguacugaguugg

SEQ ID NO: 767272 - RNA, 22 nt, Human
uucucugggcuuuucggauccg

SEQ ID NO: 767273 - RNA, 22 nt, Human
cugggcucuagaaaggaaagaa

SEQ ID NO: 767274 - RNA, 22 nt, Human
aacauugccaugguuaauuuua

SEQ ID NO: 767275 - RNA, 17 nt, Human
uuaucuugcuguuucua

SEQ ID NO: 767276 - RNA, 22 nt, Human
ccucaggccugccagagcccca

SEQ ID NO: 767277 - RNA, 22 nt, Human
ggcagccauacucagaccuggg

SEQ ID NO: 767278 - RNA, 22 nt, Human
cccucugcaggcuggaccugcc

SEQ ID NO: 767279 - RNA, 22 nt, Human
accccaggcccagggaagaggc

SEQ ID NO: 767280 - RNA, 22 nt, Human
gacagacaggagcucacaggca

SEQ ID NO: 767281 - RNA, 22 nt, Human
ucauuccuuauccguaucuuuu

SEQ ID NO: 767282 - RNA, 22 nt, Human
cucccugcccugugaguuggcc

SEQ ID NO: 767283 - RNA, 22 nt, Human
aagacagagggaagcaaugaug

SEQ ID NO: 767284 - RNA, 22 nt, Human
cuguggcucaaaaucccaugau

SEQ ID NO: 767285 - RNA, 22 nt, Human
augcauugcucaacagaauaca

SEQ ID NO: 767286 - RNA, 22 nt, Human
aaggcugggaaacaugcaggcc

SEQ ID NO: 767287 - RNA, 22 nt, Human
uggcuggaggguuagugagaua

SEQ ID NO: 767288 - RNA, 22 nt, Human
cagcugccugcaacacaagcuu

SEQ ID NO: 767289 - RNA, 22 nt, Human
cagacuuucaaggagugaaggc

SEQ ID NO: 767290 - RNA, 22 nt, Human
ugccugcccuuuccacacagcc

SEQ ID NO: 767291 - RNA, 22 nt, Human
cuucuguggauauguucucucu

SEQ ID NO: 767292 - RNA, 22 nt, Human
auuuucaguugaaaaaguuggu

SEQ ID NO: 767293 - RNA, 18 nt, Human
cagaugagaugcaaucuc

SEQ ID NO: 767294 - RNA, 22 nt, Human
cucugcccagugcccacaggag

SEQ ID NO: 767295 - RNA, 22 nt, Human
uagggcuauucugaguaauaau

SEQ ID NO: 767296 - RNA, 22 nt, Human
caggacacaggguguggcugau

SEQ ID NO: 767297 - RNA, 18 nt, Human
ccugugcuccagcaucug

SEQ ID NO: 767298 - RNA, 22 nt, Human
agagaagauucuuauaugucuu

SEQ ID NO: 767299 - RNA, 22 nt, Human
caacuguuauaaaucaacagag

SEQ ID NO: 767300 - RNA, 22 nt, Human
agggaccugucaaugacaguua

SEQ ID NO: 767301 - RNA, 22 nt, Human
acacaugauuaaugccaagcau

SEQ ID NO: 767302 - RNA, 22 nt, Human
gggggaagaggcaugaaguccu

SEQ ID NO: 767303 - RNA, 22 nt, Human
cuggggaggaugcuacgaccug

SEQ ID NO: 767304 - RNA, 22 nt, Human
ggagccaggcaaucuguacuuu

SEQ ID NO: 767305 - RNA, 18 nt, Human
gugcugaauaacuacuuu

SEQ ID NO: 767306 - RNA, 22 nt, Human
ggaagggaauccaucugguuag

SEQ ID NO: 767307 - RNA, 22 nt, Human
aaauacuguuuuauuccaugau

SEQ ID NO: 767308 - RNA, 22 nt, Human
uuucaaauggaucccucagccu

SEQ ID NO: 767309 - RNA, 17 nt, Human
gcagaaaagucaaggga

SEQ ID NO: 767310 - RNA, 22 nt, Human
ucagaggaagccuuggugggag

SEQ ID NO: 767311 - RNA, 22 nt, Human
ggcugccugccgcccacuuggc

SEQ ID NO: 767312 - RNA, 22 nt, Human
gaauacaaauaauaccaaggug

SEQ ID NO: 767313 - RNA, 22 nt, Human
cuucagugaauguugaguaagg

SEQ ID NO: 767314 - RNA, 22 nt, Human
cccuggggagcaggcgaaggag

SEQ ID NO: 767315 - RNA, 17 nt, Human
acagagguuauacagac

SEQ ID NO: 767316 - RNA, 22 nt, Human
aaagcucagucagugguguaug

SEQ ID NO: 767317 - RNA, 22 nt, Human
gagaggagaagccugcgcuuca

SEQ ID NO: 767318 - RNA, 22 nt, Human
cugccuguggucugugaucuaa

SEQ ID NO: 767319 - RNA, 22 nt, Human
aggcuuagaaauucagcugagu

SEQ ID NO: 767320 - RNA, 22 nt, Human
uaaacagaauucaggcaagaua

SEQ ID NO: 767321 - RNA, 22 nt, Human
ugacauuucagauaugguauuu

SEQ ID NO: 767322 - RNA, 22 nt, Human
cugggacuugggcuaugcucug

SEQ ID NO: 767323 - RNA, 22 nt, Human
caggugccucaggaugagacaa

SEQ ID NO: 767324 - RNA, 22 nt, Human
aguacacagaauucuacuuguu

SEQ ID NO: 767325 - RNA, 22 nt, Human
gaaugcagcugacagucguuuu

SEQ ID NO: 767326 - RNA, 22 nt, Human
aacauugaauuuaaaauacagu

SEQ ID NO: 767327 - RNA, 22 nt, Human
ucccucagaaauucucucugaa

SEQ ID NO: 767328 - RNA, 22 nt, Human
cagucaccuugaggacucagac

SEQ ID NO: 767329 - RNA, 22 nt, Human
cuccagguuuuacaaggucuau

SEQ ID NO: 767330 - RNA, 18 nt, Human
auccuuggggcugcugcu

SEQ ID NO: 767331 - RNA, 22 nt, Human
uuuaucugcauucugaccaucu

SEQ ID NO: 767332 - RNA, 22 nt, Human
aggcagccauccaggaggcuca

SEQ ID NO: 767333 - RNA, 22 nt, Human
guagaggcagaaacugaaggac

SEQ ID NO: 767334 - RNA, 22 nt, Human
gcugggcucagaccuagugaac

SEQ ID NO: 767335 - RNA, 22 nt, Human
acuucccacacccuguuuucuc

SEQ ID NO: 767336 - RNA, 22 nt, Human
uccagggccccccaguugcacg

SEQ ID NO: 767337 - RNA, 22 nt, Human
gccuggagaauuaaaaggaagg

SEQ ID NO: 767338 - RNA, 22 nt, Human
caggcuuccgccagguuuccag

SEQ ID NO: 767339 - RNA, 22 nt, Human
ucugcuuugaccuucuugaugc

SEQ ID NO: 767340 - RNA, 19 nt, Human
uccugcccaccagccaggg

SEQ ID NO: 767341 - RNA, 22 nt, Human
ucugauaagugguguauacugu

SEQ ID NO: 767342 - RNA, 22 nt, Human
uggagcugguucuggggaagcu

SEQ ID NO: 767343 - RNA, 22 nt, Human
ucucugccaccaugagaugggc

SEQ ID NO: 767344 - RNA, 22 nt, Human
acauuaaauuucauagugauua

SEQ ID NO: 767345 - RNA, 22 nt, Human
uggcagugugugagcuguuauu

SEQ ID NO: 767346 - RNA, 22 nt, Human
cuguagccaguuuggccucacc

SEQ ID NO: 767347 - RNA, 22 nt, Human
cugugggcuccugcagcucagg

SEQ ID NO: 767348 - RNA, 21 nt, Human
acugcaaacagcagagacuga

SEQ ID NO: 767349 - RNA, 22 nt, Human
gcagaauguaggccuucagugu

SEQ ID NO: 767350 - RNA, 20 nt, Human
agcuguuuacauggauuucu

SEQ ID NO: 767351 - RNA, 22 nt, Human
aagggcacagggaaagagugca

SEQ ID NO: 767352 - RNA, 17 nt, Human
gcuccuucuaacuucca

SEQ ID NO: 767353 - RNA, 22 nt, Human
cuggagcuaauaauccaucuga

SEQ ID NO: 767354 - RNA, 22 nt, Human
acuggagacugugucuuuugau

SEQ ID NO: 767355 - RNA, 22 nt, Human
agaagagaaauagugccacugu

SEQ ID NO: 767356 - RNA, 21 nt, Human
ccuaguguuaaaacaguuuaa

SEQ ID NO: 767357 - RNA, 19 nt, Human
auagaaaggguuaaagaca

SEQ ID NO: 767358 - RNA, 22 nt, Human
gagaggggcgcgcagcucgcga

SEQ ID NO: 767359 - RNA, 22 nt, Human
uugggccaaagauguccuuguu

SEQ ID NO: 767360 - RNA, 22 nt, Human
agcugccacauggugucacugu

SEQ ID NO: 767361 - RNA, 22 nt, Human
ugcacaucuuucagcaucauac

SEQ ID NO: 767362 - RNA, 22 nt, Human
acuguacauguaaacauuguca

SEQ ID NO: 767363 - RNA, 19 nt, Human
gggguggcuggggcuccag

SEQ ID NO: 767364 - RNA, 22 nt, Human
guucaauuuagaaagcacaguu

SEQ ID NO: 767365 - RNA, 22 nt, Human
gcccugucccuuggcuucuagg

SEQ ID NO: 767366 - RNA, 22 nt, Human
caaauucagaaaauugguagag

SEQ ID NO: 767367 - RNA, 22 nt, Human
gacccagaaggagugcccuaga

SEQ ID NO: 767368 - RNA, 22 nt, Human
gcaguguuacuugguuugcaga

SEQ ID NO: 767369 - RNA, 22 nt, Human
gcugagugagguccagagcuug

SEQ ID NO: 767370 - RNA, 22 nt, Human
uuugugugcgucuggccugggg

SEQ ID NO: 767371 - RNA, 22 nt, Human
uucugggcucccacauauuuca

SEQ ID NO: 767372 - RNA, 22 nt, Human
ugucuacugagaagcuaugcaa

SEQ ID NO: 767373 - RNA, 22 nt, Human
uguaacugcuuagaagguuuua

SEQ ID NO: 767374 - RNA, 22 nt, Human
cucaguuucuucauauuguagg

SEQ ID NO: 767375 - RNA, 22 nt, Human
uucuucaugcuguugcugcuug

SEQ ID NO: 767376 - RNA, 22 nt, Human
cccuugggcuucagcccuaccg

SEQ ID NO: 767377 - RNA, 22 nt, Human
gaaagguucuugggaguucaca

SEQ ID NO: 767378 - RNA, 22 nt, Human
auauuagggucucuaaauucua

SEQ ID NO: 767379 - RNA, 22 nt, Human
uagcugucagcaaucaaguggu

SEQ ID NO: 767380 - RNA, 22 nt, Human
gaaauguauaagcuggucuuuu

SEQ ID NO: 767381 - RNA, 22 nt, Human
aggagccaagaugcugucuggc

SEQ ID NO: 767382 - RNA, 22 nt, Human
aucauguuccagaaacagugau

SEQ ID NO: 767383 - RNA, 22 nt, Human
gaggguuggugcaaaugggaug

SEQ ID NO: 767384 - RNA, 22 nt, Human
ucccacaggcccagggcggaaa

SEQ ID NO: 767385 - RNA, 22 nt, Human
agggccugagcuggcugaccuc

SEQ ID NO: 767386 - RNA, 22 nt, Human
uuucuuucaauucuccuaaugc

SEQ ID NO: 767387 - RNA, 22 nt, Human
agagucuuccaggcagccugag

SEQ ID NO: 767388 - RNA, 22 nt, Human
uacauguauguuuaucuugaga

SEQ ID NO: 767389 - RNA, 22 nt, Human
auguucauuagucaacauuucu

SEQ ID NO: 767390 - RNA, 21 nt, Human
ucacacuugauuggcuuagac

SEQ ID NO: 767391 - RNA, 18 nt, Human
ucagagagaauaguaauu

SEQ ID NO: 767392 - RNA, 19 nt, Human
ucuauguggcagugauggc

SEQ ID NO: 767393 - RNA, 22 nt, Human
ccagagccuggcaucugcauaa

SEQ ID NO: 767394 - RNA, 22 nt, Human
auuuagacaacaagccuucucc

SEQ ID NO: 767395 - RNA, 21 nt, Human
ccagagguucugggccucccu

SEQ ID NO: 767396 - RNA, 22 nt, Human
uauuccuguuccccaucaccac

SEQ ID NO: 767397 - RNA, 22 nt, Human
uccuggauuaauagggagcugu

SEQ ID NO: 767398 - RNA, 22 nt, Human
uuucacauucagauauagacuu

SEQ ID NO: 767399 - RNA, 22 nt, Human
acugagaacuuggggacagagg

SEQ ID NO: 767400 - RNA, 22 nt, Human
caugugcagacggugggcugga

SEQ ID NO: 767401 - RNA, 22 nt, Human
uccagguaugacaggccacucc

SEQ ID NO: 767402 - RNA, 22 nt, Human
auacugaaggcauucagauaac

SEQ ID NO: 767403 - RNA, 20 nt, Human
ccaggcuggcaaaugggggc

SEQ ID NO: 767404 - RNA, 22 nt, Human
uucacagggcagcagcugagcc

SEQ ID NO: 767405 - RNA, 23 nt, Human
uccagcagccaagaaggguagaa

SEQ ID NO: 767406 - RNA, 22 nt, Human
auucuuggagcagucaaagaag

SEQ ID NO: 767407 - RNA, 23 nt, Human
ucucugcauguccugagcacauc

SEQ ID NO: 767408 - RNA, 22 nt, Human
aagggcagccugacucacgguc

SEQ ID NO: 767409 - RNA, 22 nt, Human
agcaaauacuugaauaaaaaga

SEQ ID NO: 767410 - RNA, 21 nt, Human
gcagccagacgggauucaguu

SEQ ID NO: 767411 - RNA, 22 nt, Human
aaagucauuguaauauaugcua

SEQ ID NO: 767412 - RNA, 18 nt, Human
caggcccugucuggccuc

SEQ ID NO: 767413 - RNA, 20 nt, Human
uauuucacucuccagauggc

SEQ ID NO: 767414 - RNA, 22 nt, Human
uccuggccaaguagauguggcg

SEQ ID NO: 767415 - RNA, 22 nt, Human
cacugaggcuuccuuaggcaau

SEQ ID NO: 767416 - RNA, 20 nt, Human
gcuguugccaguacagaugg

SEQ ID NO: 767417 - RNA, 19 nt, Human
gcugccugucuuagccagu

SEQ ID NO: 767418 - RNA, 22 nt, Human
aagcccagaugugagaacugag

SEQ ID NO: 767419 - RNA, 22 nt, Human
ugaaggcauugaugaaggaauc

SEQ ID NO: 767420 - RNA, 21 nt, Human
agcagguaggcauucauacug

SEQ ID NO: 767421 - RNA, 22 nt, Human
ucagucuucccuccagugcaac

SEQ ID NO: 767422 - RNA, 22 nt, Human
cugguaggggugacuguuaucg

SEQ ID NO: 767423 - RNA, 22 nt, Human
gauccuugcaacucugugaggu

SEQ ID NO: 767424 - RNA, 19 nt, Human
ccuagagcaguaccuggua

SEQ ID NO: 767425 - RNA, 22 nt, Human
uggcagucggacuucuaucuca

SEQ ID NO: 767426 - RNA, 22 nt, Human
uuuccauauucugcgucugcca

SEQ ID NO: 767427 - RNA, 22 nt, Human
ugaacucuccaggcaaaugauc

SEQ ID NO: 767428 - RNA, 22 nt, Human
ugcuucgcccccuggugcagcu

SEQ ID NO: 767429 - RNA, 21 nt, Human
aguuuccucaucugcauagga

SEQ ID NO: 767430 - RNA, 20 nt, Human
uuucugugauagagaggugu

SEQ ID NO: 767431 - RNA, 22 nt, Human
uuuacaaccucauauucugaug

SEQ ID NO: 767432 - RNA, 22 nt, Human
uuaaaggcaugguuagacaugg

SEQ ID NO: 767433 - RNA, 22 nt, Human
uccagggccaagucauggaacc

SEQ ID NO: 767434 - RNA, 22 nt, Human
aggcuugaaaugaaaucuguaa

SEQ ID NO: 767435 - RNA, 22 nt, Human
aaugaugaacucagagggaacc

SEQ ID NO: 767436 - RNA, 19 nt, Human
cccagagcauccugaacuu

SEQ ID NO: 767437 - RNA, 22 nt, Human
gccagagcugagugagguucuu

SEQ ID NO: 767438 - RNA, 22 nt, Human
cuucucaacugcacuugccagg

SEQ ID NO: 767439 - RNA, 22 nt, Human
aggguggggugcuacaucuuua

SEQ ID NO: 767440 - RNA, 22 nt, Human
ugugccauuucuauucugcagc

SEQ ID NO: 767441 - RNA, 22 nt, Human
uaacauugucaguucaacugcu

SEQ ID NO: 767442 - RNA, 22 nt, Human
guuacaaacucaggugccaaaa

SEQ ID NO: 767443 - RNA, 22 nt, Human
cuguagcagacagacccuaggu

SEQ ID NO: 767444 - RNA, 22 nt, Human
gcagugaagccagaucugaaau

SEQ ID NO: 767445 - RNA, 21 nt, Human
ggucagggggugccuccaggu

SEQ ID NO: 767446 - RNA, 22 nt, Human
gccaagcuggaugaagagguug

SEQ ID NO: 767447 - RNA, 22 nt, Human
ggcuucuccagguacugagcau

SEQ ID NO: 767448 - RNA, 22 nt, Human
ucugugacuugcgggaggagaa

SEQ ID NO: 767449 - RNA, 22 nt, Human
gaugaagcuauuugguuggcac

SEQ ID NO: 767450 - RNA, 22 nt, Human
uucugggggccaggacaguggu

SEQ ID NO: 767451 - RNA, 22 nt, Human
cuuuuucaagucaaagagggua

SEQ ID NO: 767452 - RNA, 22 nt, Human
auuaaggaauguaggcaagaag

SEQ ID NO: 767453 - RNA, 22 nt, Human
gugcugucguggaacugggcug

SEQ ID NO: 767454 - RNA, 22 nt, Human
ccugggcaacauagugagaccu

SEQ ID NO: 767455 - RNA, 22 nt, Human
acagagacugggaugccugccu

SEQ ID NO: 767456 - RNA, 22 nt, Human
aguauuuguggauuuguauugg

SEQ ID NO: 767457 - RNA, 22 nt, Human
gaaggaagauucuguuggaauc

SEQ ID NO: 767458 - RNA, 22 nt, Human
uggucugauucuugcuccccaa

SEQ ID NO: 767459 - RNA, 22 nt, Human
cugcugugcaacauugcaccua

SEQ ID NO: 767460 - RNA, 22 nt, Human
cucuguccugguuuauacuggc

SEQ ID NO: 767461 - RNA, 22 nt, Human
ucaggugucaagcagggagcug

SEQ ID NO: 767462 - RNA, 22 nt, Human
uuacauguuuacggauacacuu

SEQ ID NO: 767463 - RNA, 22 nt, Human
gagggcucuaccaaguaacucu

SEQ ID NO: 767464 - RNA, 22 nt, Human
ucuugaggucaucaucugaaac

SEQ ID NO: 767465 - RNA, 22 nt, Human
ugcagacaagucgugggaucuu

SEQ ID NO: 767466 - RNA, 22 nt, Human
ugugaaggagcaugcagagggg

SEQ ID NO: 767467 - RNA, 22 nt, Human
gcugcccugacuccagcagccu

SEQ ID NO: 767468 - RNA, 20 nt, Human
acucuggggcucauuagggg

SEQ ID NO: 767469 - RNA, 22 nt, Human
uccacagaccaguaucugcagc

SEQ ID NO: 767470 - RNA, 22 nt, Human
agcugugguguuuucaagcccu

SEQ ID NO: 767471 - RNA, 22 nt, Human
gcucccagauuucagccuugug

SEQ ID NO: 767472 - RNA, 22 nt, Human
ugccaggcucaggaugucccug

SEQ ID NO: 767473 - RNA, 18 nt, Human
gggcuuuacagaguggag

SEQ ID NO: 767474 - RNA, 22 nt, Human
ccugcugggccugagcaaugag

SEQ ID NO: 767475 - RNA, 22 nt, Human
agacacugaaucagagggacau

SEQ ID NO: 767476 - RNA, 22 nt, Human
uguccuggagacacaagguggu

SEQ ID NO: 767477 - RNA, 22 nt, Human
uggcacagacagaucaggaguc

SEQ ID NO: 767478 - RNA, 22 nt, Human
ccagagagaaauggauuugagu

SEQ ID NO: 767479 - RNA, 22 nt, Human
uggcauguggcaauguugggau

SEQ ID NO: 767480 - RNA, 22 nt, Human
auuaaaugauggcaugucuuau

SEQ ID NO: 767481 - RNA, 19 nt, Human
aguguuuauguagugccua

SEQ ID NO: 767482 - RNA, 22 nt, Human
gacaaugcagaaguacuuguuc

SEQ ID NO: 767483 - RNA, 22 nt, Human
uagaaaucagcaggcauaugua

SEQ ID NO: 767484 - RNA, 22 nt, Human
uuaacacuaucugucauaauua

SEQ ID NO: 767485 - RNA, 22 nt, Human
uuucaucauguuggcagauugg

SEQ ID NO: 767486 - RNA, 22 nt, Human
ucgucugugaaauugggauaag

SEQ ID NO: 767487 - RNA, 21 nt, Human
ugagcccuugccucagagccc

SEQ ID NO: 767488 - RNA, 22 nt, Human
augcuauuaauauccagucuga

SEQ ID NO: 767489 - RNA, 22 nt, Human
uuaaacagucccagaggcugac

SEQ ID NO: 767490 - RNA, 22 nt, Human
ccagcuuuauagcuucaaagga

SEQ ID NO: 767491 - RNA, 18 nt, Human
uggacaggguggagaaaa

SEQ ID NO: 767492 - RNA, 22 nt, Human
gaagguuuugauuccacugaau

SEQ ID NO: 767493 - RNA, 22 nt, Human
cucugggcuucaagucagauuu

SEQ ID NO: 767494 - RNA, 22 nt, Human
guuucuaagcacaugugagugu

SEQ ID NO: 767495 - RNA, 22 nt, Human
gaacauuuccagaaaggaacua

SEQ ID NO: 767496 - RNA, 22 nt, Human
ucuuggccacuaccaccuggag

SEQ ID NO: 767497 - RNA, 22 nt, Human
agucugaaggauggaagguacc

SEQ ID NO: 767498 - RNA, 20 nt, Human
acauuuguggaucugagaga

SEQ ID NO: 767499 - RNA, 22 nt, Human
cagagccacuuggagaugagaa

SEQ ID NO: 767500 - RNA, 22 nt, Human
gaggggcuggcuguggucccau

SEQ ID NO: 767501 - RNA, 22 nt, Human
acguagcacugagagaugcagg

SEQ ID NO: 767502 - RNA, 22 nt, Human
ggcagguacuggggagugaaga

SEQ ID NO: 767503 - RNA, 20 nt, Human
gcugucugacaguucccaga

SEQ ID NO: 767504 - RNA, 22 nt, Human
guugaguggguuaggaugcuga

SEQ ID NO: 767505 - RNA, 22 nt, Human
aaugcucuuugaauuugucaga

SEQ ID NO: 767506 - RNA, 22 nt, Human
gaugucaucaggcuaagacacu

SEQ ID NO: 767507 - RNA, 22 nt, Human
cuucuuuucauggcuugggaag

SEQ ID NO: 767508 - RNA, 22 nt, Human
agccaaaucuaaagugaauauu

SEQ ID NO: 767509 - RNA, 22 nt, Human
ccaaggcaggggaucaaaguuu

SEQ ID NO: 767510 - RNA, 22 nt, Human
agcauaaacucagggacacaca

SEQ ID NO: 767511 - RNA, 22 nt, Human
cugggccuggagcccacgagcc

SEQ ID NO: 767512 - RNA, 22 nt, Human
ugucuuacaugagucaccccaa

SEQ ID NO: 767513 - RNA, 22 nt, Human
gcccugagggguggugucugua

SEQ ID NO: 767514 - RNA, 22 nt, Human
guugaaugaaucauucuaugua

SEQ ID NO: 767515 - RNA, 22 nt, Human
uuuccagagggugcucagggcg

SEQ ID NO: 767516 - RNA, 22 nt, Human
ucugggaacagccuggcugugu

SEQ ID NO: 767517 - RNA, 22 nt, Human
uccacagcuuuuaaaugucuag

SEQ ID NO: 767518 - RNA, 22 nt, Human
uaaccuggaugugccaacguga

SEQ ID NO: 767519 - RNA, 22 nt, Human
aaggcugcuuuuaacaugcaua

SEQ ID NO: 767520 - RNA, 22 nt, Human
cucugucacuucuccagcugag

SEQ ID NO: 767521 - RNA, 23 nt, Human
agcagcccugggaccuggccugc

SEQ ID NO: 767522 - RNA, 22 nt, Human
gguaacaaggccgauagaaaca

SEQ ID NO: 767523 - RNA, 22 nt, Human
ccucaggcuuaacuugucuuga

SEQ ID NO: 767524 - RNA, 22 nt, Human
aaaugcuagggagaaacucucc

SEQ ID NO: 767525 - RNA, 22 nt, Human
uguguuggcuugccuguuaggc

SEQ ID NO: 767526 - RNA, 22 nt, Human
agguccaggccucaugauggcc

SEQ ID NO: 767527 - RNA, 22 nt, Human
gagauggagucuuuuucuguca

SEQ ID NO: 767528 - RNA, 23 nt, Human
uugaggucggcucucugagccug

SEQ ID NO: 767529 - RNA, 22 nt, Human
aaagcaaucagauucagauguc

SEQ ID NO: 767530 - RNA, 22 nt, Human
aguuuuauguagacaauucauu

SEQ ID NO: 767531 - RNA, 22 nt, Human
guauuaggugguggaauuguag

SEQ ID NO: 767532 - RNA, 22 nt, Human
ccagcaucagcacccaaggagc

SEQ ID NO: 767533 - RNA, 22 nt, Human
auucugcaugguggugucucug

SEQ ID NO: 767534 - RNA, 22 nt, Human
ucucaggacuuugggaagcuca

SEQ ID NO: 767535 - RNA, 16 nt, Human
uggagguguuucuagu

SEQ ID NO: 767536 - RNA, 22 nt, Human
uggcauccagauacccugaggg

SEQ ID NO: 767537 - RNA, 22 nt, Human
caucuugaugcuuugacagguu

SEQ ID NO: 767538 - RNA, 22 nt, Human
ccaccugugcuugguacuccau

SEQ ID NO: 767539 - RNA, 22 nt, Human
uucugggcccacuguagcaucc

SEQ ID NO: 767540 - RNA, 22 nt, Human
aauguggacucuuguauuuuuc

SEQ ID NO: 767541 - RNA, 22 nt, Human
cuguggcauugccgaggcuggc

SEQ ID NO: 767542 - RNA, 22 nt, Human
uccaggcaguuuuccagguugu

SEQ ID NO: 767543 - RNA, 22 nt, Human
uuuuugaaggcugaugugauua

SEQ ID NO: 767544 - RNA, 22 nt, Human
gugcccaguccugccuugacag

SEQ ID NO: 767545 - RNA, 22 nt, Human
aggcagccaguucagguuucuu

SEQ ID NO: 767546 - RNA, 22 nt, Human
gucuggaaaggggcuuuuaucu

SEQ ID NO: 767547 - RNA, 22 nt, Human
ggccagggaggagaggccccug

SEQ ID NO: 767548 - RNA, 22 nt, Human
uaagauguacaaccacuucucu

SEQ ID NO: 767549 - RNA, 22 nt, Human
uucuguggcugggagccuggcu

SEQ ID NO: 767550 - RNA, 23 nt, Human
aaaugugagggaaaaucuuucug

SEQ ID NO: 767551 - RNA, 22 nt, Human
gugcuuugucuucaggaucaua

SEQ ID NO: 767552 - RNA, 22 nt, Human
ucaggaaugaggauaaacauug

SEQ ID NO: 767553 - RNA, 22 nt, Human
agccaguuuccagauauuaacu

SEQ ID NO: 767554 - RNA, 22 nt, Human
aucauguuuuaauuagcaaacu

SEQ ID NO: 767555 - RNA, 22 nt, Human
augggcuggggaagcucacucc

SEQ ID NO: 767556 - RNA, 22 nt, Human
ggucagugcgauuucccacucc

SEQ ID NO: 767557 - RNA, 22 nt, Human
cagggcuguaaauuagugcuga

SEQ ID NO: 767558 - RNA, 22 nt, Human
ucagcugcugugguauguacau

SEQ ID NO: 767559 - RNA, 22 nt, Human
aggcugcagugcagguaggauu

SEQ ID NO: 767560 - RNA, 22 nt, Human
aggcuggcucggcuuuucuguc

SEQ ID NO: 767561 - RNA, 22 nt, Human
gcuuugcugggugcuucaugua

SEQ ID NO: 767562 - RNA, 22 nt, Human
ucugccuggcucauggcaguga

SEQ ID NO: 767563 - RNA, 22 nt, Human
cagcacugugauaacugagcca

SEQ ID NO: 767564 - RNA, 22 nt, Human
cugucagcacucuacuacagau

SEQ ID NO: 767565 - RNA, 22 nt, Human
auacuaaaguauagaacuuagu

SEQ ID NO: 767566 - RNA, 22 nt, Human
ucgugucagaucagagguuccu

SEQ ID NO: 767567 - RNA, 22 nt, Human
gcugggagacagacuuggaacc

SEQ ID NO: 767568 - RNA, 22 nt, Human
accugaaacucaacuuuaucuc

SEQ ID NO: 767569 - RNA, 19 nt, Human
ugccugcuccuggcuucca

SEQ ID NO: 767570 - RNA, 22 nt, Human
cacucaggcugugucaggagga

SEQ ID NO: 767571 - RNA, 22 nt, Human
agcucccagagcucgagaguaa

SEQ ID NO: 767572 - RNA, 22 nt, Human
gcagccagaagacucagaacaa

SEQ ID NO: 767573 - RNA, 22 nt, Human
uuguuucuucaggcuuuuagga

SEQ ID NO: 767574 - RNA, 22 nt, Human
acagcaucccugaagauaacca

SEQ ID NO: 767575 - RNA, 22 nt, Human
agaaagacaaaaugcaguggcu

SEQ ID NO: 767576 - RNA, 18 nt, Human
ggugggaagccagggccu

SEQ ID NO: 767577 - RNA, 22 nt, Human
aaaggaaugagcuucuguuagg

SEQ ID NO: 767578 - RNA, 22 nt, Human
uggucccuaaagaugucuacau

SEQ ID NO: 767579 - RNA, 22 nt, Human
cagcagaggaaagcaaaucuaa

SEQ ID NO: 767580 - RNA, 22 nt, Human
ggcuucaguggccagagaugau

SEQ ID NO: 767581 - RNA, 21 nt, Human
aauuagggugccucuuauaau

SEQ ID NO: 767582 - RNA, 22 nt, Human
ggccccuguaaaauguacaugu

SEQ ID NO: 767583 - RNA, 22 nt, Human
cuggggacuugcagacacaauu

SEQ ID NO: 767584 - RNA, 17 nt, Human
ugaaggaaggaugaugu

SEQ ID NO: 767585 - RNA, 22 nt, Human
uucaacaauuaaguaucagccu

SEQ ID NO: 767586 - RNA, 22 nt, Human
gaaaaaugcuccaaaucugugg

SEQ ID NO: 767587 - RNA, 22 nt, Human
caaggcuauaauguugcuggaa

SEQ ID NO: 767588 - RNA, 22 nt, Human
ggugugguuugaagggagaugg

SEQ ID NO: 767589 - RNA, 22 nt, Human
cuccaggacaugacuuucuugc

SEQ ID NO: 767590 - RNA, 20 nt, Human
aaacauucauguacaaguga

SEQ ID NO: 767591 - RNA, 22 nt, Human
aucccugcccucauggagcuua

SEQ ID NO: 767592 - RNA, 22 nt, Human
agguagaggccuccaggcagca

SEQ ID NO: 767593 - RNA, 22 nt, Human
aaaacacugcaaagcugauugg

SEQ ID NO: 767594 - RNA, 22 nt, Human
gcucagaguuaauuggaugggu

SEQ ID NO: 767595 - RNA, 22 nt, Human
agacagacauucuagagccacc

SEQ ID NO: 767596 - RNA, 22 nt, Human
cuccagaggcccuaucccacua

SEQ ID NO: 767597 - RNA, 22 nt, Human
acuccccagacugccaugcugg

SEQ ID NO: 767598 - RNA, 22 nt, Human
cuugcagccuuaccaaggcauu

SEQ ID NO: 767599 - RNA, 22 nt, Human
ucuguguaagaccagugcuggg

SEQ ID NO: 767600 - RNA, 22 nt, Human
gcugcccauuccacuggauggu

SEQ ID NO: 767601 - RNA, 22 nt, Human
aucugguuuggggauccuugug

SEQ ID NO: 767602 - RNA, 22 nt, Human
aaugcuguauaucuuagcuaau

SEQ ID NO: 767603 - RNA, 22 nt, Human
ucucuuggugacuuaaaauguu

SEQ ID NO: 767604 - RNA, 19 nt, Human
gcaggaaaugagugauugc

SEQ ID NO: 767605 - RNA, 22 nt, Human
cagaaggcaaacaaaaggauuu

SEQ ID NO: 767606 - RNA, 19 nt, Human
cugugucacauuuaugaaa

SEQ ID NO: 767607 - RNA, 22 nt, Human
ugucuccugggucccuuccacc

SEQ ID NO: 767608 - RNA, 22 nt, Human
ggcuguccaccuaccaugccgg

SEQ ID NO: 767609 - RNA, 20 nt, Human
ccagaagguuugccacuuuc

SEQ ID NO: 767610 - RNA, 22 nt, Human
ugucauguggcaauuaaagcag

SEQ ID NO: 767611 - RNA, 22 nt, Human
guggcccacacagacagcaucu

SEQ ID NO: 767612 - RNA, 22 nt, Human
uugagggucuggaucugcugcu

SEQ ID NO: 767613 - RNA, 22 nt, Human
uguaaaucacugaacuaaauga

SEQ ID NO: 767614 - RNA, 22 nt, Human
uuauuuuuaaaaguucacacag

SEQ ID NO: 767615 - RNA, 22 nt, Human
ucugcugugauuugcuaccugu

SEQ ID NO: 767616 - RNA, 22 nt, Human
uggacaggggcugcuguuguca

SEQ ID NO: 767617 - RNA, 22 nt, Human
guguggguguacuguucuagau

SEQ ID NO: 767618 - RNA, 22 nt, Human
cugcugccccugagcucagccu

SEQ ID NO: 767619 - RNA, 22 nt, Human
caaagugcuaggauuacaggcc

SEQ ID NO: 767620 - RNA, 22 nt, Human
acuuugauaguuuaaucuagga

SEQ ID NO: 767621 - RNA, 22 nt, Human
aacuucaguugagaaaggcaug

SEQ ID NO: 767622 - RNA, 23 nt, Human
gucuuuauaguggggcacuuugu

SEQ ID NO: 767623 - RNA, 22 nt, Human
uauuccugguguuggcuggguc

SEQ ID NO: 767624 - RNA, 22 nt, Human
auuauuagugauguuguuacug

SEQ ID NO: 767625 - RNA, 22 nt, Human
gugagguccauguuaauggguu

SEQ ID NO: 767626 - RNA, 22 nt, Human
acacuauacuuccauugcuggu

SEQ ID NO: 767627 - RNA, 22 nt, Human
uacagcaaugcuacaagaugac

SEQ ID NO: 767628 - RNA, 22 nt, Human
uuaaaugucaauagauugcuug

SEQ ID NO: 767629 - RNA, 22 nt, Human
auucccaccaacaauguacagg

SEQ ID NO: 767630 - RNA, 22 nt, Human
ggcugcuucucacucauuugca

SEQ ID NO: 767631 - RNA, 22 nt, Human
uauugaccagacugacacacau

SEQ ID NO: 767632 - RNA, 22 nt, Human
aggcacugaccugcuuccuuga

SEQ ID NO: 767633 - RNA, 22 nt, Human
cuuccugggcaauguucugcuu

SEQ ID NO: 767634 - RNA, 22 nt, Human
auaacagagagcuacugaacug

SEQ ID NO: 767635 - RNA, 22 nt, Human
ugacaagagaccccuccgcagg

SEQ ID NO: 767636 - RNA, 22 nt, Human
augauggugagguugagcacag

SEQ ID NO: 767637 - RNA, 22 nt, Human
ugcuggaagagaauacuggugg

SEQ ID NO: 767638 - RNA, 22 nt, Human
uugccaggggacaucuggagcc

SEQ ID NO: 767639 - RNA, 22 nt, Human
aagugaauguagcaaacuugaa

SEQ ID NO: 767640 - RNA, 17 nt, Human
ugucugucaucaguucc

SEQ ID NO: 767641 - RNA, 22 nt, Human
aggucauuguuaagucaccaua

SEQ ID NO: 767642 - RNA, 22 nt, Human
uugaaagaagaagcugcgaugu

SEQ ID NO: 767643 - RNA, 22 nt, Human
gccugcuucucagucagcuugg

SEQ ID NO: 767644 - RNA, 16 nt, Human
accuccagucaagggu

SEQ ID NO: 767645 - RNA, 22 nt, Human
auguuacacauaggcauaaaug

SEQ ID NO: 767646 - RNA, 22 nt, Human
cugccuucuuucaaggguaagc

SEQ ID NO: 767647 - RNA, 22 nt, Human
ugcaggcagcugaaaggugccu

SEQ ID NO: 767648 - RNA, 22 nt, Human
cuacagaaggagaaauggguaa

SEQ ID NO: 767649 - RNA, 21 nt, Human
ugcucaugcaaugcaugucca

SEQ ID NO: 767650 - RNA, 22 nt, Human
cugggaggcaccgcgucgugcu

SEQ ID NO: 767651 - RNA, 22 nt, Human
gaacccaguccaggugcagccu

SEQ ID NO: 767652 - RNA, 22 nt, Human
ugccaggcauguaguagacuug

SEQ ID NO: 767653 - RNA, 18 nt, Human
ggagcccagaggacagga

SEQ ID NO: 767654 - RNA, 22 nt, Human
ucuaacucugccaggacacaga

SEQ ID NO: 767655 - RNA, 22 nt, Human
ccuuuaugucacucuggagagc

SEQ ID NO: 767656 - RNA, 22 nt, Human
uuagggaaacaaacauuuucuu

SEQ ID NO: 767657 - RNA, 22 nt, Human
ugaaguauccaucuuguucuag

SEQ ID NO: 767658 - RNA, 22 nt, Human
ucacauuucaagugcucaaaag

SEQ ID NO: 767659 - RNA, 22 nt, Human
uguauaugagucugaguguaca

SEQ ID NO: 767660 - RNA, 22 nt, Human
uagaaagacuguccagauuuca

SEQ ID NO: 767661 - RNA, 22 nt, Human
gaggagucuaguuuauggcuuc

SEQ ID NO: 767662 - RNA, 22 nt, Human
aggagccauugcaggauggcag

SEQ ID NO: 767663 - RNA, 22 nt, Human
aucaaguucugucacauuuguc

SEQ ID NO: 767664 - RNA, 22 nt, Human
aaacuucauuuucaacugcaaa

SEQ ID NO: 767665 - RNA, 18 nt, Human
cugccccuucucugagau

SEQ ID NO: 767666 - RNA, 22 nt, Human
acauucagaaucuuguagcagu

SEQ ID NO: 767667 - RNA, 22 nt, Human
aggagccaguggaguuccugcc

SEQ ID NO: 767668 - RNA, 22 nt, Human
cuucccuuccuggggcaauuua

SEQ ID NO: 767669 - RNA, 22 nt, Human
cacugaacaacaaauagugaau

SEQ ID NO: 767670 - RNA, 22 nt, Human
cuuaacaugggggguaagucug

SEQ ID NO: 767671 - RNA, 22 nt, Human
uuaucugaaacuuuugggacca

SEQ ID NO: 767672 - RNA, 22 nt, Human
aguccucugcugugcgucuuug

SEQ ID NO: 767673 - RNA, 21 nt, Human
ggcaugagggcagugagcaga

SEQ ID NO: 767674 - RNA, 22 nt, Human
gaacaaaucccuuccugucucc

SEQ ID NO: 767675 - RNA, 22 nt, Human
gugagucuguggaccgggcacu

SEQ ID NO: 767676 - RNA, 19 nt, Human
uagucucugaugaggcuuu

SEQ ID NO: 767677 - RNA, 22 nt, Human
acacaggcauagccauacaugu

SEQ ID NO: 767678 - RNA, 22 nt, Human
agaacugguggugaucaguuau

SEQ ID NO: 767679 - RNA, 22 nt, Human
gagcuuuacuucugacuggugc

SEQ ID NO: 767680 - RNA, 22 nt, Human
cugccucucaggucccugagau

SEQ ID NO: 767681 - RNA, 22 nt, Human
agcagugggugguuuuugagca

SEQ ID NO: 767682 - RNA, 22 nt, Human
uuguuaaaaauagauuuccagg

SEQ ID NO: 767683 - RNA, 22 nt, Human
cugucugcuagaacaucuauac

SEQ ID NO: 767684 - RNA, 22 nt, Human
aaggcugaggcuggagaauuac

SEQ ID NO: 767685 - RNA, 23 nt, Human
uggcucuguggaucccucaggag

SEQ ID NO: 767686 - RNA, 22 nt, Human
aacuuucuauagguugggauuu

SEQ ID NO: 767687 - RNA, 22 nt, Human
uucuggagauugagaaggcauu

SEQ ID NO: 767688 - RNA, 22 nt, Human
aauaagcaagccugugugcaag

SEQ ID NO: 767689 - RNA, 22 nt, Human
uaugaugggaggaauggaauuu

SEQ ID NO: 767690 - RNA, 22 nt, Human
gcuuccuguccaggccccacau

SEQ ID NO: 767691 - RNA, 22 nt, Human
guaccugggggauccacuucuu

SEQ ID NO: 767692 - RNA, 22 nt, Human
auagagugauguaagguaugug

SEQ ID NO: 767693 - RNA, 22 nt, Human
aggaugggucagcuagagucca

SEQ ID NO: 767694 - RNA, 22 nt, Human
aaauuccugucauuugcacuuu

SEQ ID NO: 767695 - RNA, 22 nt, Human
ucucccaguccucugugcuuac

SEQ ID NO: 767696 - RNA, 22 nt, Human
cuaggaaucaccaagauucuag

SEQ ID NO: 767697 - RNA, 19 nt, Human
acuuguuuuggaggugaug

SEQ ID NO: 767698 - RNA, 20 nt, Human
aagagcccgcagggcagugc

SEQ ID NO: 767699 - RNA, 22 nt, Human
ugacaugaaacuguguugcuac

SEQ ID NO: 767700 - RNA, 22 nt, Human
uucaaauacauucuuugccacu

SEQ ID NO: 767701 - RNA, 22 nt, Human
ccucagaugucuuaaggcacug

SEQ ID NO: 767702 - RNA, 22 nt, Human
auuaagcugguccagacaaguu

SEQ ID NO: 767703 - RNA, 22 nt, Human
guuguauucuucaauaucagag

SEQ ID NO: 767704 - RNA, 19 nt, Human
gggaccugacuaauuggca

SEQ ID NO: 767705 - RNA, 22 nt, Human
gagggcuuguaaguggguggag

SEQ ID NO: 767706 - RNA, 22 nt, Human
caucuuuggagaaacuuccguu

SEQ ID NO: 767707 - RNA, 22 nt, Human
aacacugugcuccccaggcugu

SEQ ID NO: 767708 - RNA, 18 nt, Human
uuucacaaccuccagagg

SEQ ID NO: 767709 - RNA, 22 nt, Human
uggcuggaauggagcugagccu

SEQ ID NO: 767710 - RNA, 22 nt, Human
cuguauguuucuaugaauguga

SEQ ID NO: 767711 - RNA, 22 nt, Human
ugagaaagugggugccuagcaa

SEQ ID NO: 767712 - RNA, 21 nt, Human
aaauguguuccauaaugcuuu

SEQ ID NO: 767713 - RNA, 22 nt, Human
caagggaauugugugugagagg

SEQ ID NO: 767714 - RNA, 22 nt, Human
agcaccaucacagcuguauguc

SEQ ID NO: 767715 - RNA, 22 nt, Human
ccacuguauaagcaaaaugaaa

SEQ ID NO: 767716 - RNA, 22 nt, Human
aagguccuuuugcagugugauc

SEQ ID NO: 767717 - RNA, 22 nt, Human
ugcauuucuuuugaguauaugc

SEQ ID NO: 767718 - RNA, 22 nt, Human
gcugucacaagcaucuggggca

SEQ ID NO: 767719 - RNA, 22 nt, Human
agggcucaccacugugcacucc

SEQ ID NO: 767720 - RNA, 22 nt, Human
caagcagacaguaggccuagaa

SEQ ID NO: 767721 - RNA, 22 nt, Human
uuaaauuccagccucauaauag

SEQ ID NO: 767722 - RNA, 22 nt, Human
uaccuggacaucagagagacac

SEQ ID NO: 767723 - RNA, 22 nt, Human
cccagccaaggugcugguguug

SEQ ID NO: 767724 - RNA, 22 nt, Human
aguguguagcacaugguaagca

SEQ ID NO: 767725 - RNA, 22 nt, Human
agagacugcaaugagugguagg

SEQ ID NO: 767726 - RNA, 22 nt, Human
uggcauguugagaggcaagauu

SEQ ID NO: 767727 - RNA, 22 nt, Human
guggccaguggugggcgcccug

SEQ ID NO: 767728 - RNA, 21 nt, Human
cucuuugggaucuuuggaaag

SEQ ID NO: 767729 - RNA, 22 nt, Human
gcaugcaguaaaauucagcaac

SEQ ID NO: 767730 - RNA, 22 nt, Human
uauuucugauugcucaugaggc

SEQ ID NO: 767731 - RNA, 17 nt, Human
gcagccagugcagcagg

SEQ ID NO: 767732 - RNA, 22 nt, Human
cucccucucaccggagcccugg

SEQ ID NO: 767733 - RNA, 22 nt, Human
gcauucuuuccacgaggaggua

SEQ ID NO: 767734 - RNA, 22 nt, Human
gcuggccucaucacugacuucu

SEQ ID NO: 767735 - RNA, 22 nt, Human
augcauauaaggcacauguauu

SEQ ID NO: 767736 - RNA, 22 nt, Human
aggcaaagaggauauuuugggg

SEQ ID NO: 767737 - RNA, 22 nt, Human
uggcagagaaccugggcuuugu

SEQ ID NO: 767738 - RNA, 17 nt, Human
uuuucucucuuggauuc

SEQ ID NO: 767739 - RNA, 22 nt, Human
aguccccucucgcuuggcugag

SEQ ID NO: 767740 - RNA, 22 nt, Human
acagaagaccaagaaagcuucc

SEQ ID NO: 767741 - RNA, 22 nt, Human
acauuugacucuguucauauua

SEQ ID NO: 767742 - RNA, 22 nt, Human
ugacugccccuuccauuccugc

SEQ ID NO: 767743 - RNA, 22 nt, Human
aacacuuugggcauggccuucc

SEQ ID NO: 767744 - RNA, 22 nt, Human
cugagccuguguuucucuggca

SEQ ID NO: 767745 - RNA, 22 nt, Human
uguggccuuucaaggauggaau

SEQ ID NO: 767746 - RNA, 22 nt, Human
ccugugcaugccaggguacacc

SEQ ID NO: 767747 - RNA, 22 nt, Human
uucauauuuucugcuugcucac

SEQ ID NO: 767748 - RNA, 22 nt, Human
uugcacuccagcccgagcaaca

SEQ ID NO: 767749 - RNA, 22 nt, Human
acagacuguuggccuacugagc

SEQ ID NO: 767750 - RNA, 22 nt, Human
cagaggcccagugagagggcug

SEQ ID NO: 767751 - RNA, 22 nt, Human
cugccuggacagcucuuaccuu

SEQ ID NO: 767752 - RNA, 22 nt, Human
ugaggcccucugggcugguccu

SEQ ID NO: 767753 - RNA, 22 nt, Human
uggaaaacauugagauaccaag

SEQ ID NO: 767754 - RNA, 17 nt, Human
gcaguggagggguaguu

SEQ ID NO: 767755 - RNA, 22 nt, Human
cuccagagacacuucucaugau

SEQ ID NO: 767756 - RNA, 22 nt, Human
accagcucuuucuuuucacuau

SEQ ID NO: 767757 - RNA, 22 nt, Human
guccagagagaucuucugauag

SEQ ID NO: 767758 - RNA, 22 nt, Human
agcaaagacagggacgaccaag

SEQ ID NO: 767759 - RNA, 22 nt, Human
uaggccacgaaggagaugauag

SEQ ID NO: 767760 - RNA, 22 nt, Human
cccagcucucugcucuuagccu

SEQ ID NO: 767761 - RNA, 22 nt, Human
uauagacuagcagcagaauuua

SEQ ID NO: 767762 - RNA, 22 nt, Human
guagggacccacagucuauauu

SEQ ID NO: 767763 - RNA, 22 nt, Human
ugcuggagcuccgggcuguagg

SEQ ID NO: 767764 - RNA, 20 nt, Human
gacagcuuggggugucaccu

SEQ ID NO: 767765 - RNA, 22 nt, Human
gguccucucccaagagcgcauc

SEQ ID NO: 767766 - RNA, 22 nt, Human
caggcagacauuuuugacauag

SEQ ID NO: 767767 - RNA, 22 nt, Human
cuggauuuaauuaacuguugcu

SEQ ID NO: 767768 - RNA, 22 nt, Human
ucugugugauuucagggaaguc

SEQ ID NO: 767769 - RNA, 22 nt, Human
ccaguuuuuccagugcuuucug

SEQ ID NO: 767770 - RNA, 22 nt, Human
ccaggagcagauauggacauaa

SEQ ID NO: 767771 - RNA, 22 nt, Human
aggcagguguuaacccucugag

SEQ ID NO: 767772 - RNA, 22 nt, Human
ccuggcucaguguugaaggggu

SEQ ID NO: 767773 - RNA, 22 nt, Human
gccaggaaugcauaaaugaccu

SEQ ID NO: 767774 - RNA, 19 nt, Human
aaagaacuuugggcuaggc

SEQ ID NO: 767775 - RNA, 22 nt, Human
ugggcacagaauagauggccca

SEQ ID NO: 767776 - RNA, 22 nt, Human
guguggcuaggauggcuuugcu

SEQ ID NO: 767777 - RNA, 22 nt, Human
ggggcagagcauagcuccaauu

SEQ ID NO: 767778 - RNA, 22 nt, Human
guuucuaaauguucugaguuuu

SEQ ID NO: 767779 - RNA, 22 nt, Human
accugaggcuguuagucuaggu

SEQ ID NO: 767780 - RNA, 22 nt, Human
caagugucuauaucagugcuug

SEQ ID NO: 767781 - RNA, 22 nt, Human
cagguccacggcgcccaggggu

SEQ ID NO: 767782 - RNA, 22 nt, Human
gcagugaaacaauaggaucaaa

SEQ ID NO: 767783 - RNA, 22 nt, Human
caugcuuuaccaaagcagugau

SEQ ID NO: 767784 - RNA, 19 nt, Human
caggugguaaucugagccu

SEQ ID NO: 767785 - RNA, 20 nt, Human
gaagauggguagaggcacag

SEQ ID NO: 767786 - RNA, 21 nt, Human
uauugucaaucugcuuucaga

SEQ ID NO: 767787 - RNA, 22 nt, Human
cugcuucacuucgguugcauag

SEQ ID NO: 767788 - RNA, 22 nt, Human
accucaggauguggacacagaa

SEQ ID NO: 767789 - RNA, 22 nt, Human
uggcuggaauauguggagacca

SEQ ID NO: 767790 - RNA, 22 nt, Human
auugaucaugcagaugcuucac

SEQ ID NO: 767791 - RNA, 21 nt, Human
gaaagcacagaaaggacucuu

SEQ ID NO: 767792 - RNA, 22 nt, Human
uuccuguucaggaaaguugugu

SEQ ID NO: 767793 - RNA, 22 nt, Human
accagcugccuggucuaucugc

SEQ ID NO: 767794 - RNA, 22 nt, Human
ugucacaauuuauuucucuuga

SEQ ID NO: 767795 - RNA, 22 nt, Human
gggcuggaugggagccuuggcc

SEQ ID NO: 767796 - RNA, 19 nt, Human
uggaaaauggauugaauca

SEQ ID NO: 767797 - RNA, 22 nt, Human
caggcuggagugcaauggugcu

SEQ ID NO: 767798 - RNA, 22 nt, Human
cauggcuuagaaguuccagccc

SEQ ID NO: 767799 - RNA, 22 nt, Human
aaauagauuuccuagcauugga

SEQ ID NO: 767800 - RNA, 22 nt, Human
aagcagccaccucaucuccacu

SEQ ID NO: 767801 - RNA, 22 nt, Human
ugcccugcuguggcucugccca

SEQ ID NO: 767802 - RNA, 22 nt, Human
ccagcuggugacauccccaacc

SEQ ID NO: 767803 - RNA, 22 nt, Human
cccaguggugcuggcaucugug

SEQ ID NO: 767804 - RNA, 22 nt, Human
ugguggaccuggcauugaaccu

SEQ ID NO: 767805 - RNA, 22 nt, Human
acgaugagauggggcuggaagg

SEQ ID NO: 767806 - RNA, 22 nt, Human
gggucugggcaggcgcuuccuc

SEQ ID NO: 767807 - RNA, 22 nt, Human
aaauguacugauacuuauuuua

SEQ ID NO: 767808 - RNA, 22 nt, Human
gagcugggcuggcuuccucccu

SEQ ID NO: 767809 - RNA, 22 nt, Human
ggguacagaaacugaggcuuag

SEQ ID NO: 767810 - RNA, 22 nt, Human
uuccuggggcuuagcaauggag

SEQ ID NO: 767811 - RNA, 22 nt, Human
cugcugagguccuugcucagac

SEQ ID NO: 767812 - RNA, 22 nt, Human
uccuuagguauuuagcaugaau

SEQ ID NO: 767813 - RNA, 22 nt, Human
ucaguggauauuucuguggcug

SEQ ID NO: 767814 - RNA, 22 nt, Human
uacauguguucuguuucaaguu

SEQ ID NO: 767815 - RNA, 22 nt, Human
gcagagccccucaagccagccu

SEQ ID NO: 767816 - RNA, 22 nt, Human
acaucugacaugaucuucagua

SEQ ID NO: 767817 - RNA, 22 nt, Human
ugcacagagcaggcaccagcgg

SEQ ID NO: 767818 - RNA, 22 nt, Human
cccagggcuugagucauccaug

SEQ ID NO: 767819 - RNA, 22 nt, Human
gaaguuaccgaaccucuccaug

SEQ ID NO: 767820 - RNA, 22 nt, Human
ugcauacugaacagcaugcuaa

SEQ ID NO: 767821 - RNA, 22 nt, Human
augcauauuuucuguuggugac

SEQ ID NO: 767822 - RNA, 22 nt, Human
cuggacaucagugugccuggcu

SEQ ID NO: 767823 - RNA, 22 nt, Human
uacaaagucacauugaaaugaa

SEQ ID NO: 767824 - RNA, 22 nt, Human
uugggcugaaguagagggcaga

SEQ ID NO: 767825 - RNA, 22 nt, Human
auguaacauugaauuauauagu

SEQ ID NO: 767826 - RNA, 22 nt, Human
uacuuacagagcuuauaaguua

SEQ ID NO: 767827 - RNA, 22 nt, Human
augcacagauccccaggacccu

SEQ ID NO: 767828 - RNA, 22 nt, Human
gucccaggcuccauggcagcca

SEQ ID NO: 767829 - RNA, 22 nt, Human
gggcagcagaauuggacagaaa

SEQ ID NO: 767830 - RNA, 22 nt, Human
cuucaagaagacagcagagcau

SEQ ID NO: 767831 - RNA, 22 nt, Human
cuuugaauuaacgacacaagug

SEQ ID NO: 767832 - RNA, 22 nt, Human
ugcaaccugacccagccagccc

SEQ ID NO: 767833 - RNA, 22 nt, Human
auguggcugccaccugccugaa

SEQ ID NO: 767834 - RNA, 22 nt, Human
guucacaguuucuaaucccagc

SEQ ID NO: 767835 - RNA, 22 nt, Human
augaagauaagaccaggcugga

SEQ ID NO: 767836 - RNA, 22 nt, Human
gaggagguuccggguggagaag

SEQ ID NO: 767837 - RNA, 22 nt, Human
caggugacuucugaggccuuca

SEQ ID NO: 767838 - RNA, 22 nt, Human
ucccagcacgucugcuguuucu

SEQ ID NO: 767839 - RNA, 22 nt, Human
ucugagguaccagcugguuuau

SEQ ID NO: 767840 - RNA, 22 nt, Human
caggaacaauguaagucucauu

SEQ ID NO: 767841 - RNA, 22 nt, Human
uggagcagaggaagaaggcuuu

SEQ ID NO: 767842 - RNA, 22 nt, Human
cccaggaggcagaaguugcagu

SEQ ID NO: 767843 - RNA, 22 nt, Human
aagagguuucaugauuuucuua

SEQ ID NO: 767844 - RNA, 22 nt, Human
guagacagaaagcggaaucaua

SEQ ID NO: 767845 - RNA, 22 nt, Human
auaugcuauugcuguaauuuaa

SEQ ID NO: 767846 - RNA, 22 nt, Human
augugggccgugcggguguccu

SEQ ID NO: 767847 - RNA, 22 nt, Human
cugaaaagcuuugaaccguuaa

SEQ ID NO: 767848 - RNA, 18 nt, Human
acacagguuauucucucc

SEQ ID NO: 767849 - RNA, 22 nt, Human
aacacagaguauuugaagcauu

SEQ ID NO: 767850 - RNA, 22 nt, Human
auuguuaacuauagcaucuggu

SEQ ID NO: 767851 - RNA, 22 nt, Human
uucucagauccaucagaagucc

SEQ ID NO: 767852 - RNA, 22 nt, Human
gcaguguuaggaauaaaaauga

SEQ ID NO: 767853 - RNA, 22 nt, Human
aggucacaggcuuugaaaucaa

SEQ ID NO: 767854 - RNA, 22 nt, Human
guacaaaugagaguucuguuuu

SEQ ID NO: 767855 - RNA, 22 nt, Human
aggggaugccuaguggagucuc

SEQ ID NO: 767856 - RNA, 22 nt, Human
ugccgugcccauauugugggug

SEQ ID NO: 767857 - RNA, 22 nt, Human
agcagagguuuguuggaaaccu

SEQ ID NO: 767858 - RNA, 21 nt, Human
ggcaagaaacacaaucaagua

SEQ ID NO: 767859 - RNA, 22 nt, Human
gagcuguggaaggcagggacca

SEQ ID NO: 767860 - RNA, 22 nt, Human
aaggcucccucuucucgagugu

SEQ ID NO: 767861 - RNA, 22 nt, Human
cugggugaguugaugaaggaga

SEQ ID NO: 767862 - RNA, 22 nt, Human
acauacuuaacauuaaagucau

SEQ ID NO: 767863 - RNA, 22 nt, Human
uccugggauucugcauuucuaa

SEQ ID NO: 767864 - RNA, 22 nt, Human
ucuauccugcuuagaaguaugu

SEQ ID NO: 767865 - RNA, 22 nt, Human
gaaggaagcugucuggaugugu

SEQ ID NO: 767866 - RNA, 18 nt, Human
uauaaacacacuuagguu

SEQ ID NO: 767867 - RNA, 22 nt, Human
gaaagaguaugggagcuuuacu

SEQ ID NO: 767868 - RNA, 22 nt, Human
uauuucacauaccacagagugu

SEQ ID NO: 767869 - RNA, 22 nt, Human
uugaucuuuauaauaguuuuga

SEQ ID NO: 767870 - RNA, 22 nt, Human
gaaucaauugugaagacuauga

SEQ ID NO: 767871 - RNA, 22 nt, Human
augcagcuauuugagcauguca

SEQ ID NO: 767872 - RNA, 22 nt, Human
ugcuuuaaccaucuuguuugga

SEQ ID NO: 767873 - RNA, 22 nt, Human
cuuuacagugaacuugcuuguc

SEQ ID NO: 767874 - RNA, 22 nt, Human
gucauuguguggacauggagaa

SEQ ID NO: 767875 - RNA, 22 nt, Human
ggggcugagaauucagucucgg

SEQ ID NO: 767876 - RNA, 22 nt, Human
gccuggcacauugcaguggauu

SEQ ID NO: 767877 - RNA, 22 nt, Human
caaauguguagagcuuuugggg

SEQ ID NO: 767878 - RNA, 22 nt, Human
ucuccaucugucauucuugucc

SEQ ID NO: 767879 - RNA, 22 nt, Human
aaugaagcaagcugcuguguuu

SEQ ID NO: 767880 - RNA, 22 nt, Human
agcugcccugggcuggagaugg

SEQ ID NO: 767881 - RNA, 22 nt, Human
ugggagagucuaaaaccgaggu

SEQ ID NO: 767882 - RNA, 23 nt, Human
gguccaggaaaggcagcagcacc

SEQ ID NO: 767883 - RNA, 22 nt, Human
caaauuuagguaacagucugua

SEQ ID NO: 767884 - RNA, 22 nt, Human
gcacagcagacuugguggggcu

SEQ ID NO: 767885 - RNA, 23 nt, Human
gcugucaguuguuuuugucucua

SEQ ID NO: 767886 - RNA, 22 nt, Human
cucuggagcauuucaccuacau

SEQ ID NO: 767887 - RNA, 22 nt, Human
cuuuguggcuccugcaggccau

SEQ ID NO: 767888 - RNA, 22 nt, Human
agggcugcccagugugagagcu

SEQ ID NO: 767889 - RNA, 22 nt, Human
ccaggagcuggagggugcagug

SEQ ID NO: 767890 - RNA, 22 nt, Human
ccaaggcuguggggcugugcag

SEQ ID NO: 767891 - RNA, 22 nt, Human
ucaguguuugaacccaggguua

SEQ ID NO: 767892 - RNA, 23 nt, Human
cccagcuuucccacugccgagag

SEQ ID NO: 767893 - RNA, 22 nt, Human
cuacagaaguuucccuugcuua

SEQ ID NO: 767894 - RNA, 22 nt, Human
cccagagcucagugugcaaggu

SEQ ID NO: 767895 - RNA, 22 nt, Human
ugggcugcugcggugcucuugg

SEQ ID NO: 767896 - RNA, 22 nt, Human
uggaacaaggguucauuuaaau

SEQ ID NO: 767897 - RNA, 22 nt, Human
auuuaguguguauugcuauuau

SEQ ID NO: 767898 - RNA, 22 nt, Human
ccuugcguuuuacagcuucuag

SEQ ID NO: 767899 - RNA, 22 nt, Human
cacuauuuucucuucagauggc

SEQ ID NO: 767900 - RNA, 22 nt, Human
cagaggcuaagaguguccaaag

SEQ ID NO: 767901 - RNA, 22 nt, Human
cuguccccugugcuuucacuug

SEQ ID NO: 767902 - RNA, 22 nt, Human
auauaucugcaguacugaagaa

SEQ ID NO: 767903 - RNA, 22 nt, Human
auccacuccuggaggugcccca

SEQ ID NO: 767904 - RNA, 22 nt, Human
ugagggugggcccugggcaucu

SEQ ID NO: 767905 - RNA, 22 nt, Human
caagaaauguuuacugagcauc

SEQ ID NO: 767906 - RNA, 20 nt, Human
aacagucaaauguugauugc

SEQ ID NO: 767907 - RNA, 23 nt, Human
agcaacagugggugaguguugcu

SEQ ID NO: 767908 - RNA, 22 nt, Human
agacaaagaaaccguagaagca

SEQ ID NO: 767909 - RNA, 22 nt, Human
ugagagcugccacgugaccaug

SEQ ID NO: 767910 - RNA, 22 nt, Human
gauuuugucaaauuccaaaugu

SEQ ID NO: 767911 - RNA, 22 nt, Human
auauugaucuuggaacugauuu

SEQ ID NO: 767912 - RNA, 22 nt, Human
agcugcugguuuaagggauggg

SEQ ID NO: 767913 - RNA, 22 nt, Human
acuugauuuugaaccuuucuac

SEQ ID NO: 767914 - RNA, 22 nt, Human
caguacacaagcuuucauguau

SEQ ID NO: 767915 - RNA, 22 nt, Human
aacauuuaugauugagguaaau

SEQ ID NO: 767916 - RNA, 22 nt, Human
gggucugaggaguaccauuguc

SEQ ID NO: 767917 - RNA, 22 nt, Human
uccaggcccacucgguggggcu

SEQ ID NO: 767918 - RNA, 22 nt, Human
ucaaaucucacucugcauuucu

SEQ ID NO: 767919 - RNA, 22 nt, Human
aauaagaauugccagauuugaa

SEQ ID NO: 767920 - RNA, 17 nt, Human
ggaccagggguugccau

SEQ ID NO: 767921 - RNA, 18 nt, Human
uccuuucaccccuucucu

SEQ ID NO: 767922 - RNA, 22 nt, Human
cuggcagugcccagucacuguu

SEQ ID NO: 767923 - RNA, 22 nt, Human
cuggcucaguucuugguuuuca

SEQ ID NO: 767924 - RNA, 22 nt, Human
acaagugugugcaguuuguaaa

SEQ ID NO: 767925 - RNA, 22 nt, Human
augaaugagaaagcugaaaucu

SEQ ID NO: 767926 - RNA, 22 nt, Human
gguccaggggguagauauguga

SEQ ID NO: 767927 - RNA, 22 nt, Human
caugaaaucugaguauguuucc

SEQ ID NO: 767928 - RNA, 22 nt, Human
uuccagcaggguacuuguaauu

SEQ ID NO: 767929 - RNA, 21 nt, Human
ugaggaugugcagcagcagga

SEQ ID NO: 767930 - RNA, 19 nt, Human
ucuagacaccaaaguuguc

SEQ ID NO: 767931 - RNA, 22 nt, Human
ggcuuccuggagaaggucugag

SEQ ID NO: 767932 - RNA, 22 nt, Human
auugagaaugaagggacauuuu

SEQ ID NO: 767933 - RNA, 22 nt, Human
uuccuguguguugguggcagaa

SEQ ID NO: 767934 - RNA, 22 nt, Human
uucacagaugccugaugugugg

SEQ ID NO: 767935 - RNA, 22 nt, Human
cuuucucuguguuucacaugcu

SEQ ID NO: 767936 - RNA, 22 nt, Human
agucuguguauauucacugccc

SEQ ID NO: 767937 - RNA, 22 nt, Human
aauggaaccuaguuauccacau

SEQ ID NO: 767938 - RNA, 22 nt, Human
ggaucgcggucccggcccgcgc

SEQ ID NO: 767939 - RNA, 22 nt, Human
agcugcuguuuggugagucuug

SEQ ID NO: 767940 - RNA, 22 nt, Human
uaacaguauauuuaccaaaccu

SEQ ID NO: 767941 - RNA, 22 nt, Human
uaaagugcuggauuugaguaaa
